United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 32

SEQ ID NO: 1414793 - RNA, 12 nt, Human
aauguaauuauu

SEQ ID NO: 1414794 - RNA, 19 nt, Human
aauguaaucaauguuucuu

SEQ ID NO: 1414795 - RNA, 14 nt, Human
uacacccaaagagg

SEQ ID NO: 1414796 - RNA, 11 nt, Human
uacacccagca

SEQ ID NO: 1414797 - RNA, 12 nt, Human
uacacccagcaa

SEQ ID NO: 1414798 - RNA, 16 nt, Human
uacacccuuuuccagc

SEQ ID NO: 1414799 - RNA, 15 nt, Human
uacacccuuuuccag

SEQ ID NO: 1414800 - RNA, 14 nt, Human
uacacccagcaaua

SEQ ID NO: 1414801 - RNA, 23 nt, Human
aaugauucaguguuaaaugugau

SEQ ID NO: 1414802 - RNA, 22 nt, Human
aaugauucaguguuaaauguga

SEQ ID NO: 1414803 - RNA, 21 nt, Human
aaugauucaguguuaaaugug

SEQ ID NO: 1414804 - RNA, 15 nt, Human
aaugauuguaguaau

SEQ ID NO: 1414805 - RNA, 22 nt, Human
aaugauuucaugcuaucucugu

SEQ ID NO: 1414806 - RNA, 13 nt, Human
aaugauuucaugc

SEQ ID NO: 1414807 - RNA, 17 nt, Human
aaugaguaacauuugcu

SEQ ID NO: 1414808 - RNA, 19 nt, Human
aaugaguaacauuugcugu

SEQ ID NO: 1414809 - RNA, 12 nt, Human
aaugaguaacau

SEQ ID NO: 1414810 - RNA, 14 nt, Human
aaugauucaguguu

SEQ ID NO: 1414811 - RNA, 13 nt, Human
aaugauucagugu

SEQ ID NO: 1414812 - RNA, 19 nt, Human
aaugaggucagcaugucua

SEQ ID NO: 1414813 - RNA, 15 nt, Human
aaugaggucagcaug

SEQ ID NO: 1414814 - RNA, 24 nt, Human
aaugaggcuuggggcuggagagga

SEQ ID NO: 1414815 - RNA, 22 nt, Human
aaugaggccauggacucugucc

SEQ ID NO: 1414816 - RNA, 16 nt, Human
aaugaggccauggacu

SEQ ID NO: 1414817 - RNA, 23 nt, Human
aaucuguaaacuguguauuccaa

SEQ ID NO: 1414818 - RNA, 21 nt, Human
aaucuguaaacuguguauucc

SEQ ID NO: 1414819 - RNA, 16 nt, Human
aaucuguaaacugugu

SEQ ID NO: 1414820 - RNA, 15 nt, Human
aaucuguaaacugug

SEQ ID NO: 1414821 - RNA, 14 nt, Human
aaucuguaaacugu

SEQ ID NO: 1414822 - RNA, 16 nt, Human
aaugagauugaauuuc

SEQ ID NO: 1414823 - RNA, 15 nt, Human
aaugagauugaauuu

SEQ ID NO: 1414824 - RNA, 17 nt, Human
aaugagagguuccuaag

SEQ ID NO: 1414825 - RNA, 16 nt, Human
aaugagcauguuuaga

SEQ ID NO: 1414826 - RNA, 22 nt, Human
aaugagcauguuuagacuuuaa

SEQ ID NO: 1414827 - RNA, 14 nt, Human
aaugagcauguuua

SEQ ID NO: 1414828 - RNA, 12 nt, Human
aaugagcauguu

SEQ ID NO: 1414829 - RNA, 14 nt, Human
aaugagaaccaaca

SEQ ID NO: 1414830 - RNA, 22 nt, Human
aaugagagacacacugaagaag

SEQ ID NO: 1414831 - RNA, 12 nt, Human
aaugagaaaucu

SEQ ID NO: 1414832 - RNA, 22 nt, Human
aaugagaaaucuaaaaaacgaa

SEQ ID NO: 1414833 - RNA, 16 nt, Human
aaugcaccuaaagaaa

SEQ ID NO: 1414834 - RNA, 15 nt, Human
aaugcaccuaaagaa

SEQ ID NO: 1414835 - RNA, 17 nt, Human
aaugcacaagaauggau

SEQ ID NO: 1414836 - RNA, 17 nt, Human
aaugcaaaaacucuuug

SEQ ID NO: 1414837 - RNA, 11 nt, Human
aaugauuucag

SEQ ID NO: 1414838 - RNA, 18 nt, Human
aaugauuuuucuuuacaa

SEQ ID NO: 1414839 - RNA, 17 nt, Human
aaugauuuuucuuuaca

SEQ ID NO: 1414840 - RNA, 15 nt, Human
aaugauuuuucuuua

SEQ ID NO: 1414841 - RNA, 15 nt, Human
aaugcacuuucuauc

SEQ ID NO: 1414842 - RNA, 13 nt, Human
aaugcacuuucua

SEQ ID NO: 1414843 - RNA, 11 nt, Human
aaugcacuuuc

SEQ ID NO: 1414844 - RNA, 13 nt, Human
aaugcaccuggaa

SEQ ID NO: 1414845 - RNA, 13 nt, Human
uaauuauuauuua

SEQ ID NO: 1414846 - RNA, 12 nt, Human
uaauuauuauuu

SEQ ID NO: 1414847 - RNA, 14 nt, Human
uaauuauuauucuu

SEQ ID NO: 1414848 - RNA, 12 nt, Human
uaauuauuauuc

SEQ ID NO: 1414849 - RNA, 15 nt, Human
uaauuauguagcucu

SEQ ID NO: 1414850 - RNA, 14 nt, Human
uaauuauguagcuc

SEQ ID NO: 1414851 - RNA, 16 nt, Human
uaauuauguagcucuu

SEQ ID NO: 1414852 - RNA, 22 nt, Human
aaugcacuuucuauccucugua

SEQ ID NO: 1414853 - RNA, 19 nt, Human
uaauuuaaacaccuccuca

SEQ ID NO: 1414854 - RNA, 17 nt, Human
uaauuuaaacaccuccu

SEQ ID NO: 1414855 - RNA, 11 nt, Human
uaauuuaaaca

SEQ ID NO: 1414856 - RNA, 19 nt, Human
uaauuccucaacguauugu

SEQ ID NO: 1414857 - RNA, 17 nt, Human
uaauuauuauuuguguu

SEQ ID NO: 1414858 - RNA, 14 nt, Human
uaauuauuauuugu

SEQ ID NO: 1414859 - RNA, 22 nt, Human
uaauuauuauuuauauauguau

SEQ ID NO: 1414860 - RNA, 17 nt, Human
uaauuauuauuuauaua

SEQ ID NO: 1414861 - RNA, 14 nt, Human
uaauuauuauuuau

SEQ ID NO: 1414862 - RNA, 22 nt, Human
uaauuccguagguuauuuucag

SEQ ID NO: 1414863 - RNA, 13 nt, Human
uaauuuauaaaaa

SEQ ID NO: 1414864 - RNA, 17 nt, Human
uaauuuaguuucauaua

SEQ ID NO: 1414865 - RNA, 16 nt, Human
uaauuuaguuucauau

SEQ ID NO: 1414866 - RNA, 16 nt, Human
uaauuuaguaaaccaa

SEQ ID NO: 1414867 - RNA, 21 nt, Human
uaauuuagacuuggauucuuu

SEQ ID NO: 1414868 - RNA, 17 nt, Human
uaauuuagacuuggauu

SEQ ID NO: 1414869 - RNA, 21 nt, Human
uaauuuagacuucaagcaugg

SEQ ID NO: 1414870 - RNA, 15 nt, Human
uaauuuagaaaucau

SEQ ID NO: 1414871 - RNA, 14 nt, Human
uaauuuagaaauca

SEQ ID NO: 1414872 - RNA, 21 nt, Human
uaauuuagaaaacuuuaaagc

SEQ ID NO: 1414873 - RNA, 17 nt, Human
uaauuuagaaaacuuua

SEQ ID NO: 1414874 - RNA, 16 nt, Human
uaauuuagaaaacuuu

SEQ ID NO: 1414875 - RNA, 15 nt, Human
uaauuuagaaaacuu

SEQ ID NO: 1414876 - RNA, 14 nt, Human
uaauuuagaaaacu

SEQ ID NO: 1414877 - RNA, 11 nt, Human
uaauuuaacuu

SEQ ID NO: 1414878 - RNA, 19 nt, Human
uaauuuaacuuucuggguu

SEQ ID NO: 1414879 - RNA, 21 nt, Human
uaauuuuuauauuugaaauau

SEQ ID NO: 1414880 - RNA, 19 nt, Human
uaauuuuuauauuugaaau

SEQ ID NO: 1414881 - RNA, 16 nt, Human
uaauuuauaaaaaggu

SEQ ID NO: 1414882 - RNA, 18 nt, Human
uaauuuuuauauuugaaa

SEQ ID NO: 1414883 - RNA, 22 nt, Human
uaugucugguucucaauuccaa

SEQ ID NO: 1414884 - RNA, 21 nt, Human
uaugucugguucucaauucca

SEQ ID NO: 1414885 - RNA, 18 nt, Human
uaugucugguucucaauu

SEQ ID NO: 1414886 - RNA, 17 nt, Human
uaugucugguucucaau

SEQ ID NO: 1414887 - RNA, 13 nt, Human
uaugucugguucu

SEQ ID NO: 1414888 - RNA, 19 nt, Human
uaugucucuucugagcuau

SEQ ID NO: 1414889 - RNA, 14 nt, Human
uaugucucuucuga

SEQ ID NO: 1414890 - RNA, 13 nt, Human
uauguccaggugu

SEQ ID NO: 1414891 - RNA, 23 nt, Human
acaggccuguguagcugugaccu

SEQ ID NO: 1414892 - RNA, 20 nt, Human
acaggccuguguagcuguga

SEQ ID NO: 1414893 - RNA, 19 nt, Human
acaggccuguguagcugug

SEQ ID NO: 1414894 - RNA, 15 nt, Human
acaggccucagggcu

SEQ ID NO: 1414895 - RNA, 18 nt, Human
acaggccucagggcuccu

SEQ ID NO: 1414896 - RNA, 14 nt, Human
acaggccucagggc

SEQ ID NO: 1414897 - RNA, 13 nt, Human
acaggccucaggg

SEQ ID NO: 1414898 - RNA, 16 nt, Human
acaggccgcccugcgg

SEQ ID NO: 1414899 - RNA, 19 nt, Human
acaggccucacacacaaug

SEQ ID NO: 1414900 - RNA, 23 nt, Human
acaggcccucccuguuccccaga

SEQ ID NO: 1414901 - RNA, 22 nt, Human
acaggcccucccuguuccccag

SEQ ID NO: 1414902 - RNA, 21 nt, Human
acaggcccucccuguucccca

SEQ ID NO: 1414903 - RNA, 21 nt, Human
acaggcccccuugaguggggu

SEQ ID NO: 1414904 - RNA, 12 nt, Human
acaggcccccuu

SEQ ID NO: 1414905 - RNA, 22 nt, Human
acaggcagccagugcccugagc

SEQ ID NO: 1414906 - RNA, 19 nt, Human
acaggcagccagugcccug

SEQ ID NO: 1414907 - RNA, 15 nt, Human
acaggcagccagugc

SEQ ID NO: 1414908 - RNA, 14 nt, Human
acaggagcuaccug

SEQ ID NO: 1414909 - RNA, 21 nt, Human
acaggcagccagugcccugag

SEQ ID NO: 1414910 - RNA, 23 nt, Human
acaggagcuaccuguguggacag

SEQ ID NO: 1414911 - RNA, 13 nt, Human
acaggagcuaccu

SEQ ID NO: 1414912 - RNA, 23 nt, Human
acagcuugaccugaggcuguggu

SEQ ID NO: 1414913 - RNA, 20 nt, Human
acaggaaacuccugugacca

SEQ ID NO: 1414914 - RNA, 22 nt, Human
acaggaaacuccugugaccaca

SEQ ID NO: 1414915 - RNA, 19 nt, Human
acaggaaacuccugugacc

SEQ ID NO: 1414916 - RNA, 22 nt, Human
acaggaaccacaagacugcaca

SEQ ID NO: 1414917 - RNA, 17 nt, Human
acagcuuguaggggagg

SEQ ID NO: 1414918 - RNA, 22 nt, Human
acagcuugaccugaggcugugg

SEQ ID NO: 1414919 - RNA, 21 nt, Human
acagcuugaccugaggcugug

SEQ ID NO: 1414920 - RNA, 19 nt, Human
acagcuugaccugaggcug

SEQ ID NO: 1414921 - RNA, 17 nt, Human
acagcuugaccugaggc

SEQ ID NO: 1414922 - RNA, 15 nt, Human
acagcuugaccugag

SEQ ID NO: 1414923 - RNA, 21 nt, Human
acagcuucucauccugcaggc

SEQ ID NO: 1414924 - RNA, 20 nt, Human
acagcuucucauccugcagg

SEQ ID NO: 1414925 - RNA, 17 nt, Human
acagcuuagauuucaua

SEQ ID NO: 1414926 - RNA, 21 nt, Human
acagcuucagccaggagcugg

SEQ ID NO: 1414927 - RNA, 22 nt, Human
acagcuucagccaggagcuggg

SEQ ID NO: 1414928 - RNA, 22 nt, Human
acagcuguauagcugcuuccag

SEQ ID NO: 1414929 - RNA, 23 nt, Human
acagcugguguagcuacagagaa

SEQ ID NO: 1414930 - RNA, 22 nt, Human
acagcugguguagcuacagaga

SEQ ID NO: 1414931 - RNA, 21 nt, Human
acagcugguguagcuacagag

SEQ ID NO: 1414932 - RNA, 20 nt, Human
acagcugguguagcuacaga

SEQ ID NO: 1414933 - RNA, 19 nt, Human
acagcugguguagcuacag

SEQ ID NO: 1414934 - RNA, 16 nt, Human
acagcugguguagcua

SEQ ID NO: 1414935 - RNA, 15 nt, Human
acagcugguguagcu

SEQ ID NO: 1414936 - RNA, 12 nt, Human
acagcuggugua

SEQ ID NO: 1414937 - RNA, 11 nt, Human
acagcuggugu

SEQ ID NO: 1414938 - RNA, 18 nt, Human
acagcucagaaguuucuu

SEQ ID NO: 1414939 - RNA, 23 nt, Human
acagcuacucuccccacgagggc

SEQ ID NO: 1414940 - RNA, 22 nt, Human
acagcuacucuccccacgaggg

SEQ ID NO: 1414941 - RNA, 14 nt, Human
acagcuacucuccc

SEQ ID NO: 1414942 - RNA, 21 nt, Human
acagcuaauucuacucacagu

SEQ ID NO: 1414943 - RNA, 13 nt, Human
acagcuacacaga

SEQ ID NO: 1414944 - RNA, 18 nt, Human
acagcuuagauuucauag

SEQ ID NO: 1414945 - RNA, 15 nt, Human
acagcuucagccagg

SEQ ID NO: 1414946 - RNA, 16 nt, Human
acagcuuagauuucau

SEQ ID NO: 1414947 - RNA, 14 nt, Human
acagcuuagauuuc

SEQ ID NO: 1414948 - RNA, 17 nt, Human
acagcuucagccaggag

SEQ ID NO: 1414949 - RNA, 18 nt, Human
acagcuucagccaggagc

SEQ ID NO: 1414950 - RNA, 16 nt, Human
acagcugugccucgcu

SEQ ID NO: 1414951 - RNA, 17 nt, Human
acagcugugccucgcuc

SEQ ID NO: 1414952 - RNA, 15 nt, Human
acagcugugccucgc

SEQ ID NO: 1414953 - RNA, 13 nt, Human
acagcugugccuc

SEQ ID NO: 1414954 - RNA, 12 nt, Human
acagcugugccu

SEQ ID NO: 1414955 - RNA, 20 nt, Human
acagcuguauugucugaacu

SEQ ID NO: 1414956 - RNA, 19 nt, Human
acagcuguauugucugaac

SEQ ID NO: 1414957 - RNA, 17 nt, Human
acagcuguauugucuga

SEQ ID NO: 1414958 - RNA, 23 nt, Human
acagcuguaugauucccagccag

SEQ ID NO: 1414959 - RNA, 20 nt, Human
acagcuguaugauucccagc

SEQ ID NO: 1414960 - RNA, 19 nt, Human
acagcuguaugauucccag

SEQ ID NO: 1414961 - RNA, 14 nt, Human
acagcuguaugauu

SEQ ID NO: 1414962 - RNA, 20 nt, Human
uaugaagcuuuuaugugaaa

SEQ ID NO: 1414963 - RNA, 22 nt, Human
uaugaagcuuuuaugugaaaca

SEQ ID NO: 1414964 - RNA, 21 nt, Human
uaugaaggcuguacacugcac

SEQ ID NO: 1414965 - RNA, 23 nt, Human
uaugaagcuuuuaugugaaacau

SEQ ID NO: 1414966 - RNA, 14 nt, Human
uaugaggcauuugu

SEQ ID NO: 1414967 - RNA, 15 nt, Human
uaugaggcauuuguu

SEQ ID NO: 1414968 - RNA, 21 nt, Human
uaugaggcauuuguuugaacu

SEQ ID NO: 1414969 - RNA, 23 nt, Human
uaugaggcauuuguuugaacuga

SEQ ID NO: 1414970 - RNA, 16 nt, Human
uaugauaauagauucu

SEQ ID NO: 1414971 - RNA, 19 nt, Human
acagcccugucagcaugaa

SEQ ID NO: 1414972 - RNA, 18 nt, Human
acagcccugucagcauga

SEQ ID NO: 1414973 - RNA, 17 nt, Human
acagcccugucagcaug

SEQ ID NO: 1414974 - RNA, 14 nt, Human
acagcccugucagc

SEQ ID NO: 1414975 - RNA, 13 nt, Human
acagcccugucag

SEQ ID NO: 1414976 - RNA, 12 nt, Human
acagcccuguca

SEQ ID NO: 1414977 - RNA, 23 nt, Human
acagcccuuaugcgguuaauuuu

SEQ ID NO: 1414978 - RNA, 22 nt, Human
acagcccuuaugcgguuaauuu

SEQ ID NO: 1414979 - RNA, 21 nt, Human
acagcccugucagcaugaauu

SEQ ID NO: 1414980 - RNA, 22 nt, Human
acagcccugucagcaugaauuu

SEQ ID NO: 1414981 - RNA, 19 nt, Human
acagcccuucuuuccacag

SEQ ID NO: 1414982 - RNA, 19 nt, Human
uaugaaaagcuagaauuga

SEQ ID NO: 1414983 - RNA, 14 nt, Human
uaugaaaagcuaga

SEQ ID NO: 1414984 - RNA, 15 nt, Human
uaugaaaaagaagaa

SEQ ID NO: 1414985 - RNA, 14 nt, Human
uaugaaaaagaaga

SEQ ID NO: 1414986 - RNA, 23 nt, Human
acagcagacucagcucugacauu

SEQ ID NO: 1414987 - RNA, 19 nt, Human
acagcagacucagcucuga

SEQ ID NO: 1414988 - RNA, 18 nt, Human
acagcagacucagcucug

SEQ ID NO: 1414989 - RNA, 13 nt, Human
acagcagacucag

SEQ ID NO: 1414990 - RNA, 13 nt, Human
acagcagcaucuc

SEQ ID NO: 1414991 - RNA, 14 nt, Human
acagcagcaucucu

SEQ ID NO: 1414992 - RNA, 13 nt, Human
acagcaccaaauc

SEQ ID NO: 1414993 - RNA, 12 nt, Human
acagcacagcca

SEQ ID NO: 1414994 - RNA, 14 nt, Human
acagcaauuucuaa

SEQ ID NO: 1414995 - RNA, 19 nt, Human
acagcaauuccucaggcua

SEQ ID NO: 1414996 - RNA, 17 nt, Human
acagcaauuccucaggc

SEQ ID NO: 1414997 - RNA, 15 nt, Human
acagcaauuccucag

SEQ ID NO: 1414998 - RNA, 12 nt, Human
acagcaagucag

SEQ ID NO: 1414999 - RNA, 16 nt, Human
acagcaagucaggguu

SEQ ID NO: 1415000 - RNA, 21 nt, Human
acagauuuggaaagacuggac

SEQ ID NO: 1415001 - RNA, 15 nt, Human
acagauuuggaaaga

SEQ ID NO: 1415002 - RNA, 14 nt, Human
acagauuuggaaag

SEQ ID NO: 1415003 - RNA, 15 nt, Human
uaucuauauuuuaca

SEQ ID NO: 1415004 - RNA, 17 nt, Human
acagauuuugauagcaa

SEQ ID NO: 1415005 - RNA, 19 nt, Human
acagauuuugauagcaaag

SEQ ID NO: 1415006 - RNA, 20 nt, Human
acagauuuugauagcaaagc

SEQ ID NO: 1415007 - RNA, 21 nt, Human
uaugguauuuauuuuuucuuu

SEQ ID NO: 1415008 - RNA, 20 nt, Human
uauggugcaauguguguaua

SEQ ID NO: 1415009 - RNA, 22 nt, Human
uauggugcaauguguguauaug

SEQ ID NO: 1415010 - RNA, 15 nt, Human
acagcggaggugugg

SEQ ID NO: 1415011 - RNA, 21 nt, Human
acagcgcccaaaggacgcacu

SEQ ID NO: 1415012 - RNA, 16 nt, Human
acagcggaggugugga

SEQ ID NO: 1415013 - RNA, 20 nt, Human
uauggcccuggccuagcaua

SEQ ID NO: 1415014 - RNA, 21 nt, Human
uauggcccuggccuagcauac

SEQ ID NO: 1415015 - RNA, 22 nt, Human
uauggcccuggccuagcauacg

SEQ ID NO: 1415016 - RNA, 16 nt, Human
uaugcauuauaucaaa

SEQ ID NO: 1415017 - RNA, 22 nt, Human
uaugcauguugucuaagaaauu

SEQ ID NO: 1415018 - RNA, 20 nt, Human
uaugcaugguuucagcacua

SEQ ID NO: 1415019 - RNA, 19 nt, Human
uaugcaugguuucagcacu

SEQ ID NO: 1415020 - RNA, 18 nt, Human
uaugcaugguuucagcac

SEQ ID NO: 1415021 - RNA, 17 nt, Human
uaugcaugguuucagca

SEQ ID NO: 1415022 - RNA, 16 nt, Human
uaugcaugguuucagc

SEQ ID NO: 1415023 - RNA, 23 nt, Human
uaugcauggugccccaggaccag

SEQ ID NO: 1415024 - RNA, 22 nt, Human
uaugcauggugccccaggacca

SEQ ID NO: 1415025 - RNA, 21 nt, Human
uaugcauggugccccaggacc

SEQ ID NO: 1415026 - RNA, 20 nt, Human
uaugcauggugccccaggac

SEQ ID NO: 1415027 - RNA, 18 nt, Human
uaugcauggugccccagg

SEQ ID NO: 1415028 - RNA, 22 nt, Human
uaugcaugaaguaauaugcaca

SEQ ID NO: 1415029 - RNA, 15 nt, Human
uaugauauuuucugu

SEQ ID NO: 1415030 - RNA, 23 nt, Human
uaugauacuucgacacuguucuu

SEQ ID NO: 1415031 - RNA, 22 nt, Human
uaugauauuuucugugccugaa

SEQ ID NO: 1415032 - RNA, 24 nt, Human
uaugauagguuauuuugauguaaa

SEQ ID NO: 1415033 - RNA, 20 nt, Human
uaugauacuucgacacuguu

SEQ ID NO: 1415034 - RNA, 17 nt, Human
uaugauaauagauucuc

SEQ ID NO: 1415035 - RNA, 17 nt, Human
uaugauacuugaaaauu

SEQ ID NO: 1415036 - RNA, 14 nt, Human
uaugcauuauauca

SEQ ID NO: 1415037 - RNA, 20 nt, Human
uaugccaccugaauaaagaa

SEQ ID NO: 1415038 - RNA, 17 nt, Human
uaugccauauaauucac

SEQ ID NO: 1415039 - RNA, 19 nt, Human
uaugccauugggguaguug

SEQ ID NO: 1415040 - RNA, 15 nt, Human
uaugccccauucaac

SEQ ID NO: 1415041 - RNA, 16 nt, Human
uaugcucaggggcccu

SEQ ID NO: 1415042 - RNA, 13 nt, Human
uauagaucagcca

SEQ ID NO: 1415043 - RNA, 20 nt, Human
uauacagcuguauugucuga

SEQ ID NO: 1415044 - RNA, 20 nt, Human
uauaauuuaccuaagauuac

SEQ ID NO: 1415045 - RNA, 18 nt, Human
uauaauuuaccuaagauu

SEQ ID NO: 1415046 - RNA, 17 nt, Human
uauaauuuaccuaagau

SEQ ID NO: 1415047 - RNA, 18 nt, Human
uauaauuguuuuaucuga

SEQ ID NO: 1415048 - RNA, 22 nt, Human
uauaauuguuuuaucugaauuu

SEQ ID NO: 1415049 - RNA, 14 nt, Human
uauaaguguacaua

SEQ ID NO: 1415050 - RNA, 13 nt, Human
uauaaguguacau

SEQ ID NO: 1415051 - RNA, 13 nt, Human
uauaagugcugua

SEQ ID NO: 1415052 - RNA, 14 nt, Human
uauaagugcuguau

SEQ ID NO: 1415053 - RNA, 15 nt, Human
uauaagugcuguaua

SEQ ID NO: 1415054 - RNA, 16 nt, Human
uauaagugcuguauaa

SEQ ID NO: 1415055 - RNA, 17 nt, Human
uauaagugcuguauaaa

SEQ ID NO: 1415056 - RNA, 19 nt, Human
uauaagugcuguauaaaau

SEQ ID NO: 1415057 - RNA, 20 nt, Human
uauaagugcuguauaaaauc

SEQ ID NO: 1415058 - RNA, 21 nt, Human
uauaagugcuguauaaaauca

SEQ ID NO: 1415059 - RNA, 16 nt, Human
uauaauuuaccuaaga

SEQ ID NO: 1415060 - RNA, 14 nt, Human
uauaauuuaccuaa

SEQ ID NO: 1415061 - RNA, 20 nt, Human
acacuaauauauuuaaaaau

SEQ ID NO: 1415062 - RNA, 19 nt, Human
acacuaauauauuuaaaaa

SEQ ID NO: 1415063 - RNA, 17 nt, Human
acacuaauauauuuaaa

SEQ ID NO: 1415064 - RNA, 14 nt, Human
acacuaauauauuu

SEQ ID NO: 1415065 - RNA, 13 nt, Human
acacuaauauauu

SEQ ID NO: 1415066 - RNA, 15 nt, Human
uagucaccagagacu

SEQ ID NO: 1415067 - RNA, 18 nt, Human
uagucaccagagacuuua

SEQ ID NO: 1415068 - RNA, 12 nt, Human
acacuaauucau

SEQ ID NO: 1415069 - RNA, 13 nt, Human
acacuaauucaua

SEQ ID NO: 1415070 - RNA, 22 nt, Human
acacuaauauauuuaaaaauaa

SEQ ID NO: 1415071 - RNA, 21 nt, Human
acacuaauauauuuaaaaaua

SEQ ID NO: 1415072 - RNA, 23 nt, Human
uauaacuguauuugaaauaagaa

SEQ ID NO: 1415073 - RNA, 13 nt, Human
uauaacuguauuu

SEQ ID NO: 1415074 - RNA, 16 nt, Human
uauaacuggaaagaag

SEQ ID NO: 1415075 - RNA, 19 nt, Human
uauaagugauugcugguuu

SEQ ID NO: 1415076 - RNA, 21 nt, Human
uauaggauuuauuuaaaauag

SEQ ID NO: 1415077 - RNA, 19 nt, Human
uauaggcauaccuccuaug

SEQ ID NO: 1415078 - RNA, 19 nt, Human
uauaggauuuauuuaaaau

SEQ ID NO: 1415079 - RNA, 15 nt, Human
uauaggaucauuugu

SEQ ID NO: 1415080 - RNA, 23 nt, Human
uauaggaacuuaaauaaugugaa

SEQ ID NO: 1415081 - RNA, 22 nt, Human
uauagcugcuuccaguguagac

SEQ ID NO: 1415082 - RNA, 17 nt, Human
uauagcugcuuccagug

SEQ ID NO: 1415083 - RNA, 17 nt, Human
uauagccaauauaacua

SEQ ID NO: 1415084 - RNA, 14 nt, Human
uauagccaauauaa

SEQ ID NO: 1415085 - RNA, 22 nt, Human
uauagccaaaaauagcuaaaua

SEQ ID NO: 1415086 - RNA, 19 nt, Human
uauagccaaaaauagcuaa

SEQ ID NO: 1415087 - RNA, 18 nt, Human
uauagccaaaaauagcua

SEQ ID NO: 1415088 - RNA, 15 nt, Human
uauagaugucuuuuc

SEQ ID NO: 1415089 - RNA, 18 nt, Human
uauagaugucuuuuccca

SEQ ID NO: 1415090 - RNA, 14 nt, Human
uauagaugucuuuu

SEQ ID NO: 1415091 - RNA, 22 nt, Human
uauagaugggggaaagcaaagc

SEQ ID NO: 1415092 - RNA, 23 nt, Human
uauagaugggggaaagcaaagca

SEQ ID NO: 1415093 - RNA, 23 nt, Human
acacucaguggcccauggcauuu

SEQ ID NO: 1415094 - RNA, 21 nt, Human
uauaucuaccccagacuagau

SEQ ID NO: 1415095 - RNA, 21 nt, Human
uauaucuauauuuuacauaaa

SEQ ID NO: 1415096 - RNA, 20 nt, Human
uauauauuuuuuucugaaau

SEQ ID NO: 1415097 - RNA, 19 nt, Human
uauauauuuuuuucugaaa

SEQ ID NO: 1415098 - RNA, 14 nt, Human
uauauauguacagu

SEQ ID NO: 1415099 - RNA, 22 nt, Human
uauauauggggaugguaguuuu

SEQ ID NO: 1415100 - RNA, 21 nt, Human
uauauagccaauauaacuauc

SEQ ID NO: 1415101 - RNA, 19 nt, Human
uauauauuuaaaaguguca

SEQ ID NO: 1415102 - RNA, 15 nt, Human
uauauauuuaaaagu

SEQ ID NO: 1415103 - RNA, 14 nt, Human
uauauauucuauua

SEQ ID NO: 1415104 - RNA, 18 nt, Human
uauauauuaucuuuucau

SEQ ID NO: 1415105 - RNA, 14 nt, Human
uauauauuaucuuu

SEQ ID NO: 1415106 - RNA, 17 nt, Human
uauauauuauauggaaa

SEQ ID NO: 1415107 - RNA, 16 nt, Human
uauauauuauauggaa

SEQ ID NO: 1415108 - RNA, 15 nt, Human
uauauauuauaugga

SEQ ID NO: 1415109 - RNA, 18 nt, Human
uauauauuauacuuguaa

SEQ ID NO: 1415110 - RNA, 16 nt, Human
uauauauuauacuugu

SEQ ID NO: 1415111 - RNA, 14 nt, Human
uauauauuauacuu

SEQ ID NO: 1415112 - RNA, 13 nt, Human
uauauauuauacu

SEQ ID NO: 1415113 - RNA, 17 nt, Human
uauauauguacaguuau

SEQ ID NO: 1415114 - RNA, 19 nt, Human
uauauauguacaguuaucu

SEQ ID NO: 1415115 - RNA, 21 nt, Human
uauauauguguaugcacagua

SEQ ID NO: 1415116 - RNA, 23 nt, Human
uauauauguguaugcacaguaaa

SEQ ID NO: 1415117 - RNA, 19 nt, Human
acagaaaaauauguaccaa

SEQ ID NO: 1415118 - RNA, 21 nt, Human
acagaaaaaccuuggguuaga

SEQ ID NO: 1415119 - RNA, 14 nt, Human
acagaaaaaccuug

SEQ ID NO: 1415120 - RNA, 11 nt, Human
acagaaaaacc

SEQ ID NO: 1415121 - RNA, 21 nt, Human
acacuuuuucucuuuccauga

SEQ ID NO: 1415122 - RNA, 21 nt, Human
acacuuguaauuuuguaucuu

SEQ ID NO: 1415123 - RNA, 14 nt, Human
acacuugguaauug

SEQ ID NO: 1415124 - RNA, 13 nt, Human
acacuugcaaccu

SEQ ID NO: 1415125 - RNA, 23 nt, Human
acacuucucaggacacaggccug

SEQ ID NO: 1415126 - RNA, 24 nt, Human
acacuucucaggacacaggccugu

SEQ ID NO: 1415127 - RNA, 22 nt, Human
acacuucucaggacacaggccu

SEQ ID NO: 1415128 - RNA, 20 nt, Human
acacuucucaggacacaggc

SEQ ID NO: 1415129 - RNA, 16 nt, Human
acacuucucaggacac

SEQ ID NO: 1415130 - RNA, 14 nt, Human
acacuucucaggac

SEQ ID NO: 1415131 - RNA, 13 nt, Human
acagaaagcugcc

SEQ ID NO: 1415132 - RNA, 24 nt, Human
acagaaaugauuacuaaggaagau

SEQ ID NO: 1415133 - RNA, 13 nt, Human
acagaaauguaca

SEQ ID NO: 1415134 - RNA, 18 nt, Human
acagacauacuaaccagc

SEQ ID NO: 1415135 - RNA, 19 nt, Human
acagacauacuaaccagca

SEQ ID NO: 1415136 - RNA, 14 nt, Human
acacuuaauacuac

SEQ ID NO: 1415137 - RNA, 20 nt, Human
acacuguuucaaacuuuacu

SEQ ID NO: 1415138 - RNA, 23 nt, Human
acacuguuucaaacuuuacuaug

SEQ ID NO: 1415139 - RNA, 17 nt, Human
acacuguuucaaacuuu

SEQ ID NO: 1415140 - RNA, 18 nt, Human
acacuguuucaaacuuua

SEQ ID NO: 1415141 - RNA, 16 nt, Human
acacuucaaacuacuu

SEQ ID NO: 1415142 - RNA, 20 nt, Human
acacuuauuggaacucugcu

SEQ ID NO: 1415143 - RNA, 17 nt, Human
acacuuacuuuuucugg

SEQ ID NO: 1415144 - RNA, 19 nt, Human
uaucaauuaccacaccauc

SEQ ID NO: 1415145 - RNA, 16 nt, Human
uaucaccuagcugaau

SEQ ID NO: 1415146 - RNA, 18 nt, Human
uaucaccuagcugaaugu

SEQ ID NO: 1415147 - RNA, 23 nt, Human
uaucaccgugggcucccugacug

SEQ ID NO: 1415148 - RNA, 19 nt, Human
uaucaccgugggcucccug

SEQ ID NO: 1415149 - RNA, 23 nt, Human
uaucacccagacauaaaggaaaa

SEQ ID NO: 1415150 - RNA, 22 nt, Human
uaucacccagacauaaaggaaa

SEQ ID NO: 1415151 - RNA, 20 nt, Human
uaucacccagacauaaagga

SEQ ID NO: 1415152 - RNA, 14 nt, Human
uaucacacaaagca

SEQ ID NO: 1415153 - RNA, 19 nt, Human
uaucacccagaagaaaaua

SEQ ID NO: 1415154 - RNA, 22 nt, Human
uaucacccagaagaaaauagug

SEQ ID NO: 1415155 - RNA, 15 nt, Human
uaucaaaucuaccac

SEQ ID NO: 1415156 - RNA, 23 nt, Human
uaucaaauacauuuaaaacauua

SEQ ID NO: 1415157 - RNA, 23 nt, Human
acagacggaaggguaaacaauau

SEQ ID NO: 1415158 - RNA, 15 nt, Human
acagacaggcucuua

SEQ ID NO: 1415159 - RNA, 13 nt, Human
acagacaggcucu

SEQ ID NO: 1415160 - RNA, 21 nt, Human
acagacggaaggguaaacaau

SEQ ID NO: 1415161 - RNA, 17 nt, Human
acagacggaaggguaaa

SEQ ID NO: 1415162 - RNA, 18 nt, Human
acagacgcugcugucaca

SEQ ID NO: 1415163 - RNA, 14 nt, Human
acagaccuuugaac

SEQ ID NO: 1415164 - RNA, 17 nt, Human
uaucagacuaagccagc

SEQ ID NO: 1415165 - RNA, 15 nt, Human
uauccaaucaaucuu

SEQ ID NO: 1415166 - RNA, 23 nt, Human
uauccaccaaaagggcucccuga

SEQ ID NO: 1415167 - RNA, 16 nt, Human
uauccccauuucuuuu

SEQ ID NO: 1415168 - RNA, 16 nt, Human
uaucccagcugccuag

SEQ ID NO: 1415169 - RNA, 20 nt, Human
uaucccaccuccaucccaga

SEQ ID NO: 1415170 - RNA, 22 nt, Human
uaucccaccugacauguccuuc

SEQ ID NO: 1415171 - RNA, 20 nt, Human
uauccccccaucuugcuucc

SEQ ID NO: 1415172 - RNA, 19 nt, Human
uauccccccaucuugcuuc

SEQ ID NO: 1415173 - RNA, 17 nt, Human
uauccccccaucuugcu

SEQ ID NO: 1415174 - RNA, 15 nt, Human
uauccccccaucuug

SEQ ID NO: 1415175 - RNA, 14 nt, Human
uaucccagcugccu

SEQ ID NO: 1415176 - RNA, 19 nt, Human
uaucuauaauuuaccuaag

SEQ ID NO: 1415177 - RNA, 16 nt, Human
uaucuauaauuuaccu

SEQ ID NO: 1415178 - RNA, 14 nt, Human
uaucuauaauuuac

SEQ ID NO: 1415179 - RNA, 13 nt, Human
uaucuauaauuua

SEQ ID NO: 1415180 - RNA, 13 nt, Human
uaucuauagcuaa

SEQ ID NO: 1415181 - RNA, 16 nt, Human
uaggguggagagccac

SEQ ID NO: 1415182 - RNA, 12 nt, Human
uaggguuuaauc

SEQ ID NO: 1415183 - RNA, 19 nt, Human
uaggguuuaauccccagua

SEQ ID NO: 1415184 - RNA, 21 nt, Human
uaggguuuaauccccaguaaa

SEQ ID NO: 1415185 - RNA, 22 nt, Human
uagggucuggaacaccaggcug

SEQ ID NO: 1415186 - RNA, 15 nt, Human
uaggguauauuuucc

SEQ ID NO: 1415187 - RNA, 19 nt, Human
uaggguacauggugcuggg

SEQ ID NO: 1415188 - RNA, 15 nt, Human
uaggguacauggugc

SEQ ID NO: 1415189 - RNA, 22 nt, Human
uaggguaaaucaguaagaggug

SEQ ID NO: 1415190 - RNA, 16 nt, Human
uaggguaaaucaguaa

SEQ ID NO: 1415191 - RNA, 13 nt, Human
uaggguaaaucag

SEQ ID NO: 1415192 - RNA, 12 nt, Human
uaggguaaauca

SEQ ID NO: 1415193 - RNA, 19 nt, Human
uaggguuugugacagggcg

SEQ ID NO: 1415194 - RNA, 19 nt, Human
uaggguuucccuacugaag

SEQ ID NO: 1415195 - RNA, 16 nt, Human
uagguaaauuacaguu

SEQ ID NO: 1415196 - RNA, 20 nt, Human
acaaugacuuacuguacaug

SEQ ID NO: 1415197 - RNA, 20 nt, Human
acaaugauccuguauucaga

SEQ ID NO: 1415198 - RNA, 21 nt, Human
acaaugaucaccgacugaaaa

SEQ ID NO: 1415199 - RNA, 22 nt, Human
acaaugacuuacuguacaugaa

SEQ ID NO: 1415200 - RNA, 22 nt, Human
acaaugauccuguauucagaca

SEQ ID NO: 1415201 - RNA, 18 nt, Human
acacaaauuaucuuaaaa

SEQ ID NO: 1415202 - RNA, 23 nt, Human
acacaagauugguguuuuuuucu

SEQ ID NO: 1415203 - RNA, 14 nt, Human
acacaacuauauug

SEQ ID NO: 1415204 - RNA, 13 nt, Human
acacaacuauauu

SEQ ID NO: 1415205 - RNA, 23 nt, Human
acacaaggauagaugcuggccca

SEQ ID NO: 1415206 - RNA, 19 nt, Human
acacaaggauagaugcugg

SEQ ID NO: 1415207 - RNA, 21 nt, Human
acacaagauugguguuuuuuu

SEQ ID NO: 1415208 - RNA, 14 nt, Human
acacaauaagcaaa

SEQ ID NO: 1415209 - RNA, 13 nt, Human
acacaauaagcaa

SEQ ID NO: 1415210 - RNA, 22 nt, Human
acacaggccuguguagcuguga

SEQ ID NO: 1415211 - RNA, 16 nt, Human
acacaggccuguguag

SEQ ID NO: 1415212 - RNA, 13 nt, Human
acacaggccugug

SEQ ID NO: 1415213 - RNA, 12 nt, Human
acacaggccugu

SEQ ID NO: 1415214 - RNA, 16 nt, Human
acacaggcccucccug

SEQ ID NO: 1415215 - RNA, 13 nt, Human
acacaggcccucc

SEQ ID NO: 1415216 - RNA, 23 nt, Human
acacaggcauuuccuggguggcu

SEQ ID NO: 1415217 - RNA, 20 nt, Human
acacaggcauuuccugggug

SEQ ID NO: 1415218 - RNA, 18 nt, Human
acacaggcauuuccuggg

SEQ ID NO: 1415219 - RNA, 16 nt, Human
acacaggcauuuccug

SEQ ID NO: 1415220 - RNA, 15 nt, Human
uagguuuuuguuugu

SEQ ID NO: 1415221 - RNA, 16 nt, Human
acacaggggcuugacu

SEQ ID NO: 1415222 - RNA, 22 nt, Human
acacaggggcuugacuuuuuca

SEQ ID NO: 1415223 - RNA, 11 nt, Human
acacagggcag

SEQ ID NO: 1415224 - RNA, 23 nt, Human
uagguuuuaauaauuuuuuaauu

SEQ ID NO: 1415225 - RNA, 19 nt, Human
acacaguaccauuuaaugg

SEQ ID NO: 1415226 - RNA, 14 nt, Human
uaguaauugacaug

SEQ ID NO: 1415227 - RNA, 14 nt, Human
uaguaaucugcauu

SEQ ID NO: 1415228 - RNA, 17 nt, Human
uaguaaucugcauuauu

SEQ ID NO: 1415229 - RNA, 12 nt, Human
uaguaaucauau

SEQ ID NO: 1415230 - RNA, 12 nt, Human
uaggcaacauag

SEQ ID NO: 1415231 - RNA, 22 nt, Human
uaggauuuuuuuuaauguuuaa

SEQ ID NO: 1415232 - RNA, 21 nt, Human
uaggauuuuuuuuaauguuua

SEQ ID NO: 1415233 - RNA, 21 nt, Human
uaggauuuauuuaaaauagca

SEQ ID NO: 1415234 - RNA, 22 nt, Human
uaggauuuauuuaaaauagcaa

SEQ ID NO: 1415235 - RNA, 17 nt, Human
uaggauuuauuuaaaau

SEQ ID NO: 1415236 - RNA, 16 nt, Human
uaggauuuauuuaaaa

SEQ ID NO: 1415237 - RNA, 14 nt, Human
uaggauucuaaaau

SEQ ID NO: 1415238 - RNA, 12 nt, Human
uaggauucuaaa

SEQ ID NO: 1415239 - RNA, 21 nt, Human
uaggauccagugauccuuaca

SEQ ID NO: 1415240 - RNA, 20 nt, Human
uaggaucauuuguuggaaug

SEQ ID NO: 1415241 - RNA, 23 nt, Human
uaggaguuuagggaacaauuugg

SEQ ID NO: 1415242 - RNA, 13 nt, Human
uaggaaaauaaaa

SEQ ID NO: 1415243 - RNA, 15 nt, Human
uagggaacaauuugg

SEQ ID NO: 1415244 - RNA, 14 nt, Human
uagggaacaauuug

SEQ ID NO: 1415245 - RNA, 13 nt, Human
uagggaacaauuu

SEQ ID NO: 1415246 - RNA, 21 nt, Human
uagggaaggauacaaaagcau

SEQ ID NO: 1415247 - RNA, 13 nt, Human
uagggaaaacauu

SEQ ID NO: 1415248 - RNA, 20 nt, Human
uaggcauucuggaccucugg

SEQ ID NO: 1415249 - RNA, 16 nt, Human
uagggaaaacauucca

SEQ ID NO: 1415250 - RNA, 18 nt, Human
uagggaaaacauuccauc

SEQ ID NO: 1415251 - RNA, 17 nt, Human
uagggaucccucaucug

SEQ ID NO: 1415252 - RNA, 15 nt, Human
uagggaugccuccuu

SEQ ID NO: 1415253 - RNA, 14 nt, Human
uagggaugccuccu

SEQ ID NO: 1415254 - RNA, 16 nt, Human
uagggaugccuccuuu

SEQ ID NO: 1415255 - RNA, 18 nt, Human
uagggcaauuaauuccuu

SEQ ID NO: 1415256 - RNA, 20 nt, Human
uagggcaccagggguuucuc

SEQ ID NO: 1415257 - RNA, 15 nt, Human
uagggcaccaggggu

SEQ ID NO: 1415258 - RNA, 21 nt, Human
uagggcaauuaauuccuucag

SEQ ID NO: 1415259 - RNA, 23 nt, Human
uagggcaauuaauuccuucagca

SEQ ID NO: 1415260 - RNA, 23 nt, Human
uagggccaagcccagcacugcuu

SEQ ID NO: 1415261 - RNA, 16 nt, Human
uagggccaagcccagc

SEQ ID NO: 1415262 - RNA, 20 nt, Human
uagggggcuggaggagccca

SEQ ID NO: 1415263 - RNA, 18 nt, Human
uagggggcuggaggagcc

SEQ ID NO: 1415264 - RNA, 16 nt, Human
uagggggcuggaggag

SEQ ID NO: 1415265 - RNA, 15 nt, Human
uagggggcuggagga

SEQ ID NO: 1415266 - RNA, 23 nt, Human
uaggggccccucucagcccucac

SEQ ID NO: 1415267 - RNA, 19 nt, Human
uaggggccccucucagccc

SEQ ID NO: 1415268 - RNA, 21 nt, Human
uaggggaggggcuccuuucca

SEQ ID NO: 1415269 - RNA, 18 nt, Human
uaggggaggggcuccuuu

SEQ ID NO: 1415270 - RNA, 14 nt, Human
uaggggcugggaac

SEQ ID NO: 1415271 - RNA, 11 nt, Human
uaggggcuggg

SEQ ID NO: 1415272 - RNA, 21 nt, Human
uaggggcuuauaauaaaggac

SEQ ID NO: 1415273 - RNA, 22 nt, Human
uaggggcuuauaauaaaggacu

SEQ ID NO: 1415274 - RNA, 23 nt, Human
uaggggcuuauaauaaaggacug

SEQ ID NO: 1415275 - RNA, 11 nt, Human
acaaaugaaaa

SEQ ID NO: 1415276 - RNA, 20 nt, Human
acaaaucagaagucaucuug

SEQ ID NO: 1415277 - RNA, 22 nt, Human
acaaucagcuccuuccuggaga

SEQ ID NO: 1415278 - RNA, 18 nt, Human
acaaucagcuccuuccug

SEQ ID NO: 1415279 - RNA, 16 nt, Human
uagcgugcucacugac

SEQ ID NO: 1415280 - RNA, 18 nt, Human
uagcgggauggggcuccc

SEQ ID NO: 1415281 - RNA, 21 nt, Human
uagcgcuaucucccugccucc

SEQ ID NO: 1415282 - RNA, 17 nt, Human
uagcguucuuguaauuu

SEQ ID NO: 1415283 - RNA, 16 nt, Human
uagcguucuuguaauu

SEQ ID NO: 1415284 - RNA, 15 nt, Human
uagcguucuuguaau

SEQ ID NO: 1415285 - RNA, 14 nt, Human
uagcguucuuguaa

SEQ ID NO: 1415286 - RNA, 13 nt, Human
uagcguucuugua

SEQ ID NO: 1415287 - RNA, 17 nt, Human
uagcgugcucacugacc

SEQ ID NO: 1415288 - RNA, 21 nt, Human
uagcguucuuguaauuuuaca

SEQ ID NO: 1415289 - RNA, 16 nt, Human
uagcguuuuuuaaaug

SEQ ID NO: 1415290 - RNA, 17 nt, Human
uagcguuuuuuaaaugu

SEQ ID NO: 1415291 - RNA, 18 nt, Human
uagcguuuuuuaaaugua

SEQ ID NO: 1415292 - RNA, 11 nt, Human
uagcuuugcuc

SEQ ID NO: 1415293 - RNA, 17 nt, Human
uagcuuuggaaguuuag

SEQ ID NO: 1415294 - RNA, 15 nt, Human
uagcuuugcucuuug

SEQ ID NO: 1415295 - RNA, 22 nt, Human
uagcuuuggaaguuuagcucug

SEQ ID NO: 1415296 - RNA, 19 nt, Human
uagcuuuugugggggacug

SEQ ID NO: 1415297 - RNA, 12 nt, Human
uagcuuuugugg

SEQ ID NO: 1415298 - RNA, 20 nt, Human
uagcuuuugugggggacugu

SEQ ID NO: 1415299 - RNA, 23 nt, Human
uagcuuuuuucucugauacagaa

SEQ ID NO: 1415300 - RNA, 13 nt, Human
uagcuuuuuucuc

SEQ ID NO: 1415301 - RNA, 23 nt, Human
uagcuuuaaugauaugcuuguaa

SEQ ID NO: 1415302 - RNA, 22 nt, Human
uagcuuuaacuuaaauaguauu

SEQ ID NO: 1415303 - RNA, 16 nt, Human
uagcuuuaacuuaaau

SEQ ID NO: 1415304 - RNA, 19 nt, Human
uagcuugauaaagggccaa

SEQ ID NO: 1415305 - RNA, 20 nt, Human
uagcuaaacggauuccaaag

SEQ ID NO: 1415306 - RNA, 19 nt, Human
uagcuaaacggauuccaaa

SEQ ID NO: 1415307 - RNA, 18 nt, Human
uagcuaaacggauuccaa

SEQ ID NO: 1415308 - RNA, 22 nt, Human
uagcguuuuuuaaauguauacu

SEQ ID NO: 1415309 - RNA, 18 nt, Human
uagcguucuuguaauuuu

SEQ ID NO: 1415310 - RNA, 14 nt, Human
uagcuaaguacaca

SEQ ID NO: 1415311 - RNA, 23 nt, Human
acaaaucagaagucaucuugcua

SEQ ID NO: 1415312 - RNA, 16 nt, Human
acaaaucagaagucau

SEQ ID NO: 1415313 - RNA, 15 nt, Human
acaaaucagaaguca

SEQ ID NO: 1415314 - RNA, 14 nt, Human
acaaaucagaaguc

SEQ ID NO: 1415315 - RNA, 21 nt, Human
uagccacuaaccuugccuggu

SEQ ID NO: 1415316 - RNA, 20 nt, Human
uagccacuaaccuugccugg

SEQ ID NO: 1415317 - RNA, 21 nt, Human
uagccacauuuggaauacuuu

SEQ ID NO: 1415318 - RNA, 20 nt, Human
uagccacauuuggaauacuu

SEQ ID NO: 1415319 - RNA, 17 nt, Human
uagccaaaccucaccaa

SEQ ID NO: 1415320 - RNA, 22 nt, Human
uagccaaaccucaccaacuccu

SEQ ID NO: 1415321 - RNA, 14 nt, Human
uagccaaaccucac

SEQ ID NO: 1415322 - RNA, 19 nt, Human
uagcacaaguuauuuaaau

SEQ ID NO: 1415323 - RNA, 13 nt, Human
uagcacaaguuau

SEQ ID NO: 1415324 - RNA, 16 nt, Human
uagcaaagauaucuca

SEQ ID NO: 1415325 - RNA, 14 nt, Human
uagcaaagaauuga

SEQ ID NO: 1415326 - RNA, 12 nt, Human
uagcaaagaauu

SEQ ID NO: 1415327 - RNA, 16 nt, Human
uagcaaaagaagaagu

SEQ ID NO: 1415328 - RNA, 14 nt, Human
uagcaaaagaagaa

SEQ ID NO: 1415329 - RNA, 23 nt, Human
uagagggaggagaaugagccucg

SEQ ID NO: 1415330 - RNA, 14 nt, Human
uagaggguguguaa

SEQ ID NO: 1415331 - RNA, 19 nt, Human
uagaggcuuccuucauuuc

SEQ ID NO: 1415332 - RNA, 18 nt, Human
uagaggcuuccuucauuu

SEQ ID NO: 1415333 - RNA, 17 nt, Human
uagaggcuuccuucauu

SEQ ID NO: 1415334 - RNA, 16 nt, Human
uagaggcuuccuucau

SEQ ID NO: 1415335 - RNA, 13 nt, Human
uagagcuccuccc

SEQ ID NO: 1415336 - RNA, 10 nt, Human
uagagcuccu

SEQ ID NO: 1415337 - RNA, 17 nt, Human
uagagccuguaaacuuu

SEQ ID NO: 1415338 - RNA, 21 nt, Human
uagagccggguguccccaaca

SEQ ID NO: 1415339 - RNA, 16 nt, Human
acaaauagaaaauggu

SEQ ID NO: 1415340 - RNA, 15 nt, Human
acaaauagaaaaugg

SEQ ID NO: 1415341 - RNA, 13 nt, Human
acaaauagaaaau

SEQ ID NO: 1415342 - RNA, 14 nt, Human
uagagccugaggga

SEQ ID NO: 1415343 - RNA, 18 nt, Human
uagagccgggugucccca

SEQ ID NO: 1415344 - RNA, 19 nt, Human
acaaauaggaugcuuggga

SEQ ID NO: 1415345 - RNA, 22 nt, Human
acaaagguuuaaaugaacaaga

SEQ ID NO: 1415346 - RNA, 20 nt, Human
acaaagguuuaaaugaacaa

SEQ ID NO: 1415347 - RNA, 19 nt, Human
acaaagguuuaaaugaaca

SEQ ID NO: 1415348 - RNA, 18 nt, Human
acaaagguuuaaaugaac

SEQ ID NO: 1415349 - RNA, 17 nt, Human
acaaagguuuaaaugaa

SEQ ID NO: 1415350 - RNA, 16 nt, Human
acaaagguuuaaauga

SEQ ID NO: 1415351 - RNA, 15 nt, Human
acaaagguuuaaaug

SEQ ID NO: 1415352 - RNA, 14 nt, Human
acaaagguuuaaau

SEQ ID NO: 1415353 - RNA, 24 nt, Human
acaaagguugagauguaaaaggua

SEQ ID NO: 1415354 - RNA, 20 nt, Human
acaaaaucagguaacuaacu

SEQ ID NO: 1415355 - RNA, 22 nt, Human
acaaaauaaccaauccuggaca

SEQ ID NO: 1415356 - RNA, 21 nt, Human
acaaagguuuuccucuucuau

SEQ ID NO: 1415357 - RNA, 16 nt, Human
acaaauaacaaugugc

SEQ ID NO: 1415358 - RNA, 16 nt, Human
acaaauacuaaaaaga

SEQ ID NO: 1415359 - RNA, 23 nt, Human
acaaagguuuaaaugaacaagag

SEQ ID NO: 1415360 - RNA, 13 nt, Human
acaaauaauuuag

SEQ ID NO: 1415361 - RNA, 14 nt, Human
acaaauaauuuaga

SEQ ID NO: 1415362 - RNA, 14 nt, Human
acaaaauaaacaaa

SEQ ID NO: 1415363 - RNA, 12 nt, Human
acaaaauaaaca

SEQ ID NO: 1415364 - RNA, 15 nt, Human
acaaaacuacaugag

SEQ ID NO: 1415365 - RNA, 20 nt, Human
acaaaaccccccagauauca

SEQ ID NO: 1415366 - RNA, 19 nt, Human
acaaaaccccccagauauc

SEQ ID NO: 1415367 - RNA, 13 nt, Human
acaaaacaaacuc

SEQ ID NO: 1415368 - RNA, 13 nt, Human
acaaaaauauaaa

SEQ ID NO: 1415369 - RNA, 16 nt, Human
acaaaaauacucagau

SEQ ID NO: 1415370 - RNA, 12 nt, Human
acaaaaauaaaa

SEQ ID NO: 1415371 - RNA, 20 nt, Human
acaaaaagguucucaggugu

SEQ ID NO: 1415372 - RNA, 14 nt, Human
acaaaaauuaaaau

SEQ ID NO: 1415373 - RNA, 19 nt, Human
acaaaaagcuaauaccagu

SEQ ID NO: 1415374 - RNA, 20 nt, Human
acaaaaagccacaaugaaca

SEQ ID NO: 1415375 - RNA, 16 nt, Human
acaaaaagcuacuuau

SEQ ID NO: 1415376 - RNA, 20 nt, Human
aauuuuacacgcuuuuguga

SEQ ID NO: 1415377 - RNA, 19 nt, Human
aauuuuacacgcuuuugug

SEQ ID NO: 1415378 - RNA, 20 nt, Human
aauuuuacauggcuggagcu

SEQ ID NO: 1415379 - RNA, 12 nt, Human
aauuuuacauuu

SEQ ID NO: 1415380 - RNA, 14 nt, Human
uagaccaaaauaaa

SEQ ID NO: 1415381 - RNA, 14 nt, Human
uagaccaagcuugu

SEQ ID NO: 1415382 - RNA, 13 nt, Human
uagaccaaaauaa

SEQ ID NO: 1415383 - RNA, 18 nt, Human
uagaccaagcuuguccaa

SEQ ID NO: 1415384 - RNA, 23 nt, Human
uagacauggagguucuaaggccu

SEQ ID NO: 1415385 - RNA, 22 nt, Human
uagacauggagguucuaaggcc

SEQ ID NO: 1415386 - RNA, 21 nt, Human
uagacauggagguucuaaggc

SEQ ID NO: 1415387 - RNA, 20 nt, Human
uagacauggagguucuaagg

SEQ ID NO: 1415388 - RNA, 19 nt, Human
uagacauggagguucuaag

SEQ ID NO: 1415389 - RNA, 18 nt, Human
uagacauggagguucuaa

SEQ ID NO: 1415390 - RNA, 17 nt, Human
uagacauggagguucua

SEQ ID NO: 1415391 - RNA, 19 nt, Human
uagacagaggcccucaagu

SEQ ID NO: 1415392 - RNA, 15 nt, Human
uagacagaggcccuc

SEQ ID NO: 1415393 - RNA, 15 nt, Human
uagacagaagaaaca

SEQ ID NO: 1415394 - RNA, 18 nt, Human
uagacagucucacuuugu

SEQ ID NO: 1415395 - RNA, 16 nt, Human
aauuuuaaugaagaaa

SEQ ID NO: 1415396 - RNA, 20 nt, Human
aauuugugauacaaugcugu

SEQ ID NO: 1415397 - RNA, 17 nt, Human
aauuugugauacaaugc

SEQ ID NO: 1415398 - RNA, 18 nt, Human
aauuugugauacaaugcu

SEQ ID NO: 1415399 - RNA, 15 nt, Human
aauuuggcaauuuug

SEQ ID NO: 1415400 - RNA, 18 nt, Human
aauuuggcaauuuugugg

SEQ ID NO: 1415401 - RNA, 13 nt, Human
aauuuggcaauuu

SEQ ID NO: 1415402 - RNA, 23 nt, Human
aauuuggauuuaaaagccugcuc

SEQ ID NO: 1415403 - RNA, 12 nt, Human
aauuuggauuua

SEQ ID NO: 1415404 - RNA, 14 nt, Human
aauuugugauacaa

SEQ ID NO: 1415405 - RNA, 14 nt, Human
uagacagaagaaac

SEQ ID NO: 1415406 - RNA, 12 nt, Human
uagacagaagaa

SEQ ID NO: 1415407 - RNA, 15 nt, Human
uagacagaacaccua

SEQ ID NO: 1415408 - RNA, 14 nt, Human
uagacagaacaccu

SEQ ID NO: 1415409 - RNA, 15 nt, Human
uagacacuuuggaag

SEQ ID NO: 1415410 - RNA, 21 nt, Human
uagacacuccccgaagucuuu

SEQ ID NO: 1415411 - RNA, 16 nt, Human
uagacacgcacggcag

SEQ ID NO: 1415412 - RNA, 21 nt, Human
uagacaccaaaguucuaauaa

SEQ ID NO: 1415413 - RNA, 20 nt, Human
uagacaccaaaguucuaaua

SEQ ID NO: 1415414 - RNA, 18 nt, Human
uagacaccaaaguucuaa

SEQ ID NO: 1415415 - RNA, 17 nt, Human
uagacaccaaaguucua

SEQ ID NO: 1415416 - RNA, 14 nt, Human
uagacaccaaaguu

SEQ ID NO: 1415417 - RNA, 21 nt, Human
uagacacaugaagguaaauaa

SEQ ID NO: 1415418 - RNA, 22 nt, Human
uagacacaugaagguaaauaaa

SEQ ID NO: 1415419 - RNA, 20 nt, Human
uagacacaugaagguaaaua

SEQ ID NO: 1415420 - RNA, 19 nt, Human
uagacacaugaagguaaau

SEQ ID NO: 1415421 - RNA, 13 nt, Human
uagacacaugaag

SEQ ID NO: 1415422 - RNA, 13 nt, Human
uagacacacauga

SEQ ID NO: 1415423 - RNA, 18 nt, Human
uagacaauuuauuauggc

SEQ ID NO: 1415424 - RNA, 17 nt, Human
uagaagggaaagcccau

SEQ ID NO: 1415425 - RNA, 23 nt, Human
uagaaggcuguggugagggaaga

SEQ ID NO: 1415426 - RNA, 18 nt, Human
uagaaggcuguggugagg

SEQ ID NO: 1415427 - RNA, 20 nt, Human
uagaagacaauugacaacag

SEQ ID NO: 1415428 - RNA, 19 nt, Human
uagaaguauaaagaauugu

SEQ ID NO: 1415429 - RNA, 20 nt, Human
uagaauuugauaugugaaca

SEQ ID NO: 1415430 - RNA, 13 nt, Human
uagaauuugauua

SEQ ID NO: 1415431 - RNA, 17 nt, Human
uagaaguauaaagaauu

SEQ ID NO: 1415432 - RNA, 16 nt, Human
uagaaguauaaagaau

SEQ ID NO: 1415433 - RNA, 22 nt, Human
uagaauuugauaugugaacagu

SEQ ID NO: 1415434 - RNA, 17 nt, Human
uacuuuggaauucuuag

SEQ ID NO: 1415435 - RNA, 22 nt, Human
uacuuugguggccacauaagcc

SEQ ID NO: 1415436 - RNA, 20 nt, Human
uacuuuggggcuaauuuaac

SEQ ID NO: 1415437 - RNA, 13 nt, Human
aauuccacucaaa

SEQ ID NO: 1415438 - RNA, 20 nt, Human
aauuccacaccuuuuauuga

SEQ ID NO: 1415439 - RNA, 16 nt, Human
aauuccacaccuuuua

SEQ ID NO: 1415440 - RNA, 21 nt, Human
aauucauuaaucugccucccu

SEQ ID NO: 1415441 - RNA, 14 nt, Human
uacuuuuuaaaugu

SEQ ID NO: 1415442 - RNA, 15 nt, Human
uacuuuugcccuuug

SEQ ID NO: 1415443 - RNA, 20 nt, Human
uacuuuuacaaguaacaaaa

SEQ ID NO: 1415444 - RNA, 23 nt, Human
uacuuuuacaaguaacaaaaaua

SEQ ID NO: 1415445 - RNA, 21 nt, Human
uacuuuuaaacuguguacaua

SEQ ID NO: 1415446 - RNA, 16 nt, Human
uagaaaacauaaucuu

SEQ ID NO: 1415447 - RNA, 16 nt, Human
uagaaaaacaggcacu

SEQ ID NO: 1415448 - RNA, 15 nt, Human
uagaaaaacaggcac

SEQ ID NO: 1415449 - RNA, 14 nt, Human
uagaaaaacaggca

SEQ ID NO: 1415450 - RNA, 14 nt, Human
uacuuuuuauauau

SEQ ID NO: 1415451 - RNA, 16 nt, Human
uacuuuuuauauauau

SEQ ID NO: 1415452 - RNA, 13 nt, Human
uacuuuuuauaua

SEQ ID NO: 1415453 - RNA, 15 nt, Human
uagaaaaaaaauuau

SEQ ID NO: 1415454 - RNA, 18 nt, Human
uagaagacaaaauguuca

SEQ ID NO: 1415455 - RNA, 17 nt, Human
uagaaaauuuaaaacau

SEQ ID NO: 1415456 - RNA, 12 nt, Human
uagaaaaugguc

SEQ ID NO: 1415457 - RNA, 18 nt, Human
uagaaaaguauguucuaa

SEQ ID NO: 1415458 - RNA, 16 nt, Human
uagaaaaguauguucu

SEQ ID NO: 1415459 - RNA, 21 nt, Human
uagaaaaggcuagguacacag

SEQ ID NO: 1415460 - RNA, 17 nt, Human
uagaaaaggacuauaag

SEQ ID NO: 1415461 - RNA, 15 nt, Human
uagaaaacuuuaaag

SEQ ID NO: 1415462 - RNA, 16 nt, Human
uagaaaacuuuaaagc

SEQ ID NO: 1415463 - RNA, 11 nt, Human
uagaaaacuuu

SEQ ID NO: 1415464 - RNA, 20 nt, Human
uagaaacaacacuguaguaa

SEQ ID NO: 1415465 - RNA, 19 nt, Human
uagaaacaacacuguagua

SEQ ID NO: 1415466 - RNA, 18 nt, Human
uagaaacaacacuguagu

SEQ ID NO: 1415467 - RNA, 17 nt, Human
uagaaacaacacuguag

SEQ ID NO: 1415468 - RNA, 16 nt, Human
uagaaacaacacugua

SEQ ID NO: 1415469 - RNA, 13 nt, Human
uagaaacaacacu

SEQ ID NO: 1415470 - RNA, 17 nt, Human
uagaaacaaaauacaau

SEQ ID NO: 1415471 - RNA, 16 nt, Human
uagaaacaaaauacaa

SEQ ID NO: 1415472 - RNA, 13 nt, Human
uagaaacaaaaua

SEQ ID NO: 1415473 - RNA, 16 nt, Human
uagaaaauuagacugu

SEQ ID NO: 1415474 - RNA, 23 nt, Human
uagaaaauuuguuauuuugcaac

SEQ ID NO: 1415475 - RNA, 22 nt, Human
uagaaaauuuguuauuuugcaa

SEQ ID NO: 1415476 - RNA, 22 nt, Human
uagaaaauuuaaaacauuacuc

SEQ ID NO: 1415477 - RNA, 16 nt, Human
uagaaacagugcaaca

SEQ ID NO: 1415478 - RNA, 15 nt, Human
uagaaacacaacuau

SEQ ID NO: 1415479 - RNA, 15 nt, Human
ucauuuucucucagg

SEQ ID NO: 1415480 - RNA, 14 nt, Human
ucauuuucucucag

SEQ ID NO: 1415481 - RNA, 16 nt, Human
ucauuuucucuaauau

SEQ ID NO: 1415482 - RNA, 15 nt, Human
ucauuuucucuaaua

SEQ ID NO: 1415483 - RNA, 13 nt, Human
ucauuuucucuaa

SEQ ID NO: 1415484 - RNA, 12 nt, Human
ucauuuucucua

SEQ ID NO: 1415485 - RNA, 20 nt, Human
ucauuugguucauuaauucu

SEQ ID NO: 1415486 - RNA, 15 nt, Human
ucauuugcuuuggaa

SEQ ID NO: 1415487 - RNA, 18 nt, Human
ucauuugguucauuaauu

SEQ ID NO: 1415488 - RNA, 16 nt, Human
ucauuugcuuuggaag

SEQ ID NO: 1415489 - RNA, 14 nt, Human
ucauuuugguacuu

SEQ ID NO: 1415490 - RNA, 22 nt, Human
ucauuuugguaaaauacuucuu

SEQ ID NO: 1415491 - RNA, 19 nt, Human
ucauuuuucaauagcacau

SEQ ID NO: 1415492 - RNA, 21 nt, Human
ucauuuuuacaauguaauuau

SEQ ID NO: 1415493 - RNA, 20 nt, Human
ucauuuuuacaauguaauua

SEQ ID NO: 1415494 - RNA, 12 nt, Human
ucauuuuuacaa

SEQ ID NO: 1415495 - RNA, 23 nt, Human
ucauuuuuuuucuuugaauaaau

SEQ ID NO: 1415496 - RNA, 22 nt, Human
ucauuuuuuuucuuugaauaaa

SEQ ID NO: 1415497 - RNA, 20 nt, Human
ucauuuuuuuucuuugaaua

SEQ ID NO: 1415498 - RNA, 15 nt, Human
ucauuuuuccguaaa

SEQ ID NO: 1415499 - RNA, 18 nt, Human
ucauuuuuuuuaagaaaa

SEQ ID NO: 1415500 - RNA, 17 nt, Human
accugcucagcccugca

SEQ ID NO: 1415501 - RNA, 16 nt, Human
accugcucagcccugc

SEQ ID NO: 1415502 - RNA, 20 nt, Human
accugcucacgucaaaugca

SEQ ID NO: 1415503 - RNA, 16 nt, Human
accugcucacgucaaa

SEQ ID NO: 1415504 - RNA, 22 nt, Human
accugcuaggccagagcccacu

SEQ ID NO: 1415505 - RNA, 21 nt, Human
accugcuaggccagagcccac

SEQ ID NO: 1415506 - RNA, 18 nt, Human
accugcuaggccagagcc

SEQ ID NO: 1415507 - RNA, 16 nt, Human
accugcggcccaaucc

SEQ ID NO: 1415508 - RNA, 21 nt, Human
accugccugacauuuggagug

SEQ ID NO: 1415509 - RNA, 23 nt, Human
accugccucggccucccaaagug

SEQ ID NO: 1415510 - RNA, 21 nt, Human
accugccucggccucccaaag

SEQ ID NO: 1415511 - RNA, 21 nt, Human
accugcugagcucugagaggc

SEQ ID NO: 1415512 - RNA, 23 nt, Human
accugcugagcucugagaggccc

SEQ ID NO: 1415513 - RNA, 20 nt, Human
accugcugagcucugagagg

SEQ ID NO: 1415514 - RNA, 19 nt, Human
accugcugagcucugagag

SEQ ID NO: 1415515 - RNA, 23 nt, Human
accugcucuccucuucuacucac

SEQ ID NO: 1415516 - RNA, 17 nt, Human
accugcucuccucuucu

SEQ ID NO: 1415517 - RNA, 18 nt, Human
accugcugagcucugaga

SEQ ID NO: 1415518 - RNA, 16 nt, Human
accugcucuccucuuc

SEQ ID NO: 1415519 - RNA, 15 nt, Human
accugcucuccucuu

SEQ ID NO: 1415520 - RNA, 14 nt, Human
accugcucuccucu

SEQ ID NO: 1415521 - RNA, 13 nt, Human
accugcucuccuc

SEQ ID NO: 1415522 - RNA, 12 nt, Human
accugcucuccu

SEQ ID NO: 1415523 - RNA, 22 nt, Human
accuggacuuaagcaucuggcu

SEQ ID NO: 1415524 - RNA, 21 nt, Human
accuggaccccugcauuggaa

SEQ ID NO: 1415525 - RNA, 20 nt, Human
accuggaccccugcauugga

SEQ ID NO: 1415526 - RNA, 16 nt, Human
accuggaccccugcau

SEQ ID NO: 1415527 - RNA, 15 nt, Human
accuggaccccugca

SEQ ID NO: 1415528 - RNA, 21 nt, Human
accugcugugauacgaugcuu

SEQ ID NO: 1415529 - RNA, 20 nt, Human
accugcugugauacgaugcu

SEQ ID NO: 1415530 - RNA, 21 nt, Human
accugcugucuggguggcuca

SEQ ID NO: 1415531 - RNA, 20 nt, Human
accuggaauauauaaccagu

SEQ ID NO: 1415532 - RNA, 14 nt, Human
accugagccugccg

SEQ ID NO: 1415533 - RNA, 13 nt, Human
accugagccugcc

SEQ ID NO: 1415534 - RNA, 12 nt, Human
accugagccugc

SEQ ID NO: 1415535 - RNA, 10 nt, Human
accugagccu

SEQ ID NO: 1415536 - RNA, 15 nt, Human
accugaccccugcuc

SEQ ID NO: 1415537 - RNA, 20 nt, Human
accugagauuuauuaaagaa

SEQ ID NO: 1415538 - RNA, 19 nt, Human
accugacacucccuugggc

SEQ ID NO: 1415539 - RNA, 17 nt, Human
accugacacucccuugg

SEQ ID NO: 1415540 - RNA, 16 nt, Human
accugacacucccuug

SEQ ID NO: 1415541 - RNA, 21 nt, Human
accugacacaccaggcgcuaa

SEQ ID NO: 1415542 - RNA, 19 nt, Human
accugacacaccaggcgcu

SEQ ID NO: 1415543 - RNA, 22 nt, Human
accugaagcuaucguaaaauua

SEQ ID NO: 1415544 - RNA, 16 nt, Human
accugaagaaucacaa

SEQ ID NO: 1415545 - RNA, 14 nt, Human
accugaagaaucac

SEQ ID NO: 1415546 - RNA, 11 nt, Human
accugaagaau

SEQ ID NO: 1415547 - RNA, 16 nt, Human
accugaacugaacacc

SEQ ID NO: 1415548 - RNA, 22 nt, Human
accugaaauuccaaagucucua

SEQ ID NO: 1415549 - RNA, 20 nt, Human
accugaaauuccaaagucuc

SEQ ID NO: 1415550 - RNA, 19 nt, Human
accugaaauuccaaagucu

SEQ ID NO: 1415551 - RNA, 20 nt, Human
ucauaaggcuucaaaauguu

SEQ ID NO: 1415552 - RNA, 16 nt, Human
ucauaauaaguugcau

SEQ ID NO: 1415553 - RNA, 22 nt, Human
accugaugaaaauaaagaaugg

SEQ ID NO: 1415554 - RNA, 21 nt, Human
accugaugaaaauaaagaaug

SEQ ID NO: 1415555 - RNA, 19 nt, Human
accugaugaaaauaaagaa

SEQ ID NO: 1415556 - RNA, 18 nt, Human
accugaugaaaauaaaga

SEQ ID NO: 1415557 - RNA, 15 nt, Human
accugaugaaaauaa

SEQ ID NO: 1415558 - RNA, 20 nt, Human
accugauuuuuuuuccuuuu

SEQ ID NO: 1415559 - RNA, 17 nt, Human
accugauuuuuuuuccu

SEQ ID NO: 1415560 - RNA, 16 nt, Human
accugauuuuuuuucc

SEQ ID NO: 1415561 - RNA, 11 nt, Human
accugauuuuu

SEQ ID NO: 1415562 - RNA, 14 nt, Human
accugaugaaaaua

SEQ ID NO: 1415563 - RNA, 13 nt, Human
accugaugaaaau

SEQ ID NO: 1415564 - RNA, 22 nt, Human
accugauccuggaggcccaguu

SEQ ID NO: 1415565 - RNA, 20 nt, Human
accugauccuggaggcccag

SEQ ID NO: 1415566 - RNA, 13 nt, Human
accugauccugga

SEQ ID NO: 1415567 - RNA, 14 nt, Human
accugaggcugugg

SEQ ID NO: 1415568 - RNA, 12 nt, Human
accugaggcugu

SEQ ID NO: 1415569 - RNA, 14 nt, Human
accugaggcugguu

SEQ ID NO: 1415570 - RNA, 16 nt, Human
accugagccugccgag

SEQ ID NO: 1415571 - RNA, 22 nt, Human
accugcaaagaucuguccucag

SEQ ID NO: 1415572 - RNA, 16 nt, Human
accugcaaagaucugu

SEQ ID NO: 1415573 - RNA, 15 nt, Human
accugcaaagaucug

SEQ ID NO: 1415574 - RNA, 22 nt, Human
accugccucccuucaugcaugg

SEQ ID NO: 1415575 - RNA, 21 nt, Human
accugccucccuucaugcaug

SEQ ID NO: 1415576 - RNA, 23 nt, Human
accugccucccuucaugcaugga

SEQ ID NO: 1415577 - RNA, 18 nt, Human
accuucgggcugugcccg

SEQ ID NO: 1415578 - RNA, 17 nt, Human
accuucgggcugugccc

SEQ ID NO: 1415579 - RNA, 16 nt, Human
accuucgggcugugcc

SEQ ID NO: 1415580 - RNA, 15 nt, Human
accuucgggcugugc

SEQ ID NO: 1415581 - RNA, 14 nt, Human
accuucgggcugug

SEQ ID NO: 1415582 - RNA, 19 nt, Human
accuucaguuaugauuuuu

SEQ ID NO: 1415583 - RNA, 23 nt, Human
accugggcccuggggccuguacu

SEQ ID NO: 1415584 - RNA, 21 nt, Human
accugggcccuggggccugua

SEQ ID NO: 1415585 - RNA, 20 nt, Human
accugggcccuggggccugu

SEQ ID NO: 1415586 - RNA, 15 nt, Human
accuugccugguaca

SEQ ID NO: 1415587 - RNA, 18 nt, Human
accuuuuuuauacauaaa

SEQ ID NO: 1415588 - RNA, 16 nt, Human
accuuuuuuauacaua

SEQ ID NO: 1415589 - RNA, 17 nt, Human
accuuuuuuauacauaa

SEQ ID NO: 1415590 - RNA, 15 nt, Human
accuucugaguacag

SEQ ID NO: 1415591 - RNA, 23 nt, Human
accuucucuauggggcauccucu

SEQ ID NO: 1415592 - RNA, 22 nt, Human
accuucucuauggggcauccuc

SEQ ID NO: 1415593 - RNA, 21 nt, Human
uccaaggggaaucagaacuca

SEQ ID NO: 1415594 - RNA, 20 nt, Human
uccaaggaggggcuguaaaa

SEQ ID NO: 1415595 - RNA, 23 nt, Human
uccaacaagaagggacugagaga

SEQ ID NO: 1415596 - RNA, 19 nt, Human
uccaaauucaguuucauaa

SEQ ID NO: 1415597 - RNA, 18 nt, Human
uccaaauucaguuucaua

SEQ ID NO: 1415598 - RNA, 16 nt, Human
uccaaauucaguuuca

SEQ ID NO: 1415599 - RNA, 14 nt, Human
uccaaauucaguuu

SEQ ID NO: 1415600 - RNA, 12 nt, Human
uccaaauucagu

SEQ ID NO: 1415601 - RNA, 20 nt, Human
uccaaauggcgucuggaagu

SEQ ID NO: 1415602 - RNA, 18 nt, Human
uccaaauggcgucuggaa

SEQ ID NO: 1415603 - RNA, 15 nt, Human
uccacaugggagccg

SEQ ID NO: 1415604 - RNA, 16 nt, Human
uccacauagguuuaga

SEQ ID NO: 1415605 - RNA, 19 nt, Human
uccacauccuccacguucu

SEQ ID NO: 1415606 - RNA, 13 nt, Human
uccacauccucca

SEQ ID NO: 1415607 - RNA, 12 nt, Human
uccacauccucc

SEQ ID NO: 1415608 - RNA, 19 nt, Human
uccacauacccugaccugg

SEQ ID NO: 1415609 - RNA, 22 nt, Human
uccaauuauaagaggauaugaa

SEQ ID NO: 1415610 - RNA, 23 nt, Human
uccaauuaguuuccuuuuuaaua

SEQ ID NO: 1415611 - RNA, 20 nt, Human
uccaauuaguuuccuuuuua

SEQ ID NO: 1415612 - RNA, 19 nt, Human
uccaauuaguuuccuuuuu

SEQ ID NO: 1415613 - RNA, 16 nt, Human
uccaauuaguuuccuu

SEQ ID NO: 1415614 - RNA, 18 nt, Human
uccaauguggcaaggaaa

SEQ ID NO: 1415615 - RNA, 23 nt, Human
uccaaugucuggagaccaccagg

SEQ ID NO: 1415616 - RNA, 15 nt, Human
uccaauuaguuuccu

SEQ ID NO: 1415617 - RNA, 18 nt, Human
uccaaugucuggagacca

SEQ ID NO: 1415618 - RNA, 17 nt, Human
uccaaugucuggagacc

SEQ ID NO: 1415619 - RNA, 16 nt, Human
uccaaugucuggagac

SEQ ID NO: 1415620 - RNA, 15 nt, Human
uccaaugucuggaga

SEQ ID NO: 1415621 - RNA, 20 nt, Human
uccaaugagcuuucugaaca

SEQ ID NO: 1415622 - RNA, 21 nt, Human
uccaaugagcuuucugaacag

SEQ ID NO: 1415623 - RNA, 19 nt, Human
accugggcccuggggccug

SEQ ID NO: 1415624 - RNA, 18 nt, Human
accugggcccuggggccu

SEQ ID NO: 1415625 - RNA, 16 nt, Human
accugggcccuggggc

SEQ ID NO: 1415626 - RNA, 15 nt, Human
accugggcccugggg

SEQ ID NO: 1415627 - RNA, 14 nt, Human
accugggcccuggg

SEQ ID NO: 1415628 - RNA, 13 nt, Human
accugggcccugg

SEQ ID NO: 1415629 - RNA, 17 nt, Human
accugggcaagcuggcg

SEQ ID NO: 1415630 - RNA, 22 nt, Human
accugggaggcggauguugaag

SEQ ID NO: 1415631 - RNA, 22 nt, Human
accugggagaaaucuggcuucu

SEQ ID NO: 1415632 - RNA, 16 nt, Human
accuggcugccauacu

SEQ ID NO: 1415633 - RNA, 19 nt, Human
accuggcccugcuuccugc

SEQ ID NO: 1415634 - RNA, 18 nt, Human
accuggcccugcuuccug

SEQ ID NO: 1415635 - RNA, 17 nt, Human
accuggcccugcuuccu

SEQ ID NO: 1415636 - RNA, 15 nt, Human
accuggcccugcuuc

SEQ ID NO: 1415637 - RNA, 18 nt, Human
accuggcccaucagggua

SEQ ID NO: 1415638 - RNA, 17 nt, Human
accuggcccaucagggu

SEQ ID NO: 1415639 - RNA, 22 nt, Human
uccaccccaucccuccccaguu

SEQ ID NO: 1415640 - RNA, 20 nt, Human
uccaccccaucccuccccag

SEQ ID NO: 1415641 - RNA, 12 nt, Human
uccaccccaucc

SEQ ID NO: 1415642 - RNA, 22 nt, Human
uccaccccaauccucccagaaa

SEQ ID NO: 1415643 - RNA, 22 nt, Human
uccacccaggggcagccccagg

SEQ ID NO: 1415644 - RNA, 12 nt, Human
uccacccagggg

SEQ ID NO: 1415645 - RNA, 18 nt, Human
uccacauuucccccuagc

SEQ ID NO: 1415646 - RNA, 19 nt, Human
acgaaccuacaguuuuaac

SEQ ID NO: 1415647 - RNA, 18 nt, Human
uccagggaggcugguccu

SEQ ID NO: 1415648 - RNA, 22 nt, Human
uccagggaggcugguccuaugg

SEQ ID NO: 1415649 - RNA, 17 nt, Human
uccagggaggcuggucc

SEQ ID NO: 1415650 - RNA, 14 nt, Human
uccagggaggcugg

SEQ ID NO: 1415651 - RNA, 13 nt, Human
uccagggacagca

SEQ ID NO: 1415652 - RNA, 14 nt, Human
uccagggacagcaa

SEQ ID NO: 1415653 - RNA, 12 nt, Human
uccagggacagc

SEQ ID NO: 1415654 - RNA, 23 nt, Human
uccagggacagaggccccagccu

SEQ ID NO: 1415655 - RNA, 21 nt, Human
uccagggacagaggccccagc

SEQ ID NO: 1415656 - RNA, 19 nt, Human
uccagggacagaggcccca

SEQ ID NO: 1415657 - RNA, 15 nt, Human
uccagggacagaggc

SEQ ID NO: 1415658 - RNA, 14 nt, Human
uccagggacagagg

SEQ ID NO: 1415659 - RNA, 14 nt, Human
acgaaggagcccau

SEQ ID NO: 1415660 - RNA, 13 nt, Human
acgaaggagccca

SEQ ID NO: 1415661 - RNA, 22 nt, Human
acgaauacuuuugcccuuugau

SEQ ID NO: 1415662 - RNA, 14 nt, Human
acgaauacuuuugc

SEQ ID NO: 1415663 - RNA, 22 nt, Human
uccacggagccacuccucugac

SEQ ID NO: 1415664 - RNA, 21 nt, Human
uccacggagccacuccucuga

SEQ ID NO: 1415665 - RNA, 20 nt, Human
uccacggagccacuccucug

SEQ ID NO: 1415666 - RNA, 15 nt, Human
uccacggagccacuc

SEQ ID NO: 1415667 - RNA, 14 nt, Human
uccacggagccacu

SEQ ID NO: 1415668 - RNA, 22 nt, Human
uccacgagcuguuuacuaggga

SEQ ID NO: 1415669 - RNA, 16 nt, Human
uccaggcugccguggg

SEQ ID NO: 1415670 - RNA, 21 nt, Human
acgaggggugucuugggcaga

SEQ ID NO: 1415671 - RNA, 20 nt, Human
acgaggggugucuugggcag

SEQ ID NO: 1415672 - RNA, 18 nt, Human
acgaggggugucuugggc

SEQ ID NO: 1415673 - RNA, 16 nt, Human
acgagggcuggcuggc

SEQ ID NO: 1415674 - RNA, 14 nt, Human
acgagggcuggcug

SEQ ID NO: 1415675 - RNA, 12 nt, Human
acgagggcuggc

SEQ ID NO: 1415676 - RNA, 11 nt, Human
acgagggcugg

SEQ ID NO: 1415677 - RNA, 20 nt, Human
acgagggcuggcuggccuca

SEQ ID NO: 1415678 - RNA, 12 nt, Human
acgacugucucc

SEQ ID NO: 1415679 - RNA, 13 nt, Human
acgacacugcagc

SEQ ID NO: 1415680 - RNA, 14 nt, Human
acgacacugcagcc

SEQ ID NO: 1415681 - RNA, 21 nt, Human
acgacacggucggggcaucug

SEQ ID NO: 1415682 - RNA, 18 nt, Human
acgcccuuuccuccucag

SEQ ID NO: 1415683 - RNA, 17 nt, Human
acgcccuuuccuccuca

SEQ ID NO: 1415684 - RNA, 21 nt, Human
acgcccuuuccuccucaggca

SEQ ID NO: 1415685 - RNA, 20 nt, Human
acgcccguccugccuguggc

SEQ ID NO: 1415686 - RNA, 19 nt, Human
acgcccguccugccugugg

SEQ ID NO: 1415687 - RNA, 18 nt, Human
acgcccguccugccugug

SEQ ID NO: 1415688 - RNA, 16 nt, Human
acgcccguccugccug

SEQ ID NO: 1415689 - RNA, 15 nt, Human
acgcccaggacccca

SEQ ID NO: 1415690 - RNA, 21 nt, Human
acggagccacuccucugacuc

SEQ ID NO: 1415691 - RNA, 12 nt, Human
acgcugcuguca

SEQ ID NO: 1415692 - RNA, 19 nt, Human
acggcaccugggcccuggg

SEQ ID NO: 1415693 - RNA, 14 nt, Human
acggauuuucaguu

SEQ ID NO: 1415694 - RNA, 15 nt, Human
acggauuuucaguua

SEQ ID NO: 1415695 - RNA, 12 nt, Human
acggauuccaaa

SEQ ID NO: 1415696 - RNA, 18 nt, Human
acggccagggagaagcuc

SEQ ID NO: 1415697 - RNA, 23 nt, Human
acggccagggagaagcuccucuc

SEQ ID NO: 1415698 - RNA, 17 nt, Human
acggccagggagaagcu

SEQ ID NO: 1415699 - RNA, 23 nt, Human
acggcaccugggcccuggggccu

SEQ ID NO: 1415700 - RNA, 21 nt, Human
acggcaccugggcccuggggc

SEQ ID NO: 1415701 - RNA, 20 nt, Human
acggcaccugggcccugggg

SEQ ID NO: 1415702 - RNA, 15 nt, Human
acggcagccacagcu

SEQ ID NO: 1415703 - RNA, 15 nt, Human
acgggugccagaagc

SEQ ID NO: 1415704 - RNA, 15 nt, Human
acgggguuucaccau

SEQ ID NO: 1415705 - RNA, 16 nt, Human
ucccaccuagcagcac

SEQ ID NO: 1415706 - RNA, 23 nt, Human
ucccaccgcccagcggcuugccu

SEQ ID NO: 1415707 - RNA, 24 nt, Human
ucccaccgcccagcggcuugccug

SEQ ID NO: 1415708 - RNA, 21 nt, Human
ucccacccucuuccuacuggu

SEQ ID NO: 1415709 - RNA, 15 nt, Human
ucccacccucuuccu

SEQ ID NO: 1415710 - RNA, 12 nt, Human
ucccacccucuu

SEQ ID NO: 1415711 - RNA, 23 nt, Human
ucccacccccacccccagcucaa

SEQ ID NO: 1415712 - RNA, 22 nt, Human
ucccacccccacccccagcuca

SEQ ID NO: 1415713 - RNA, 23 nt, Human
ucccaccccaaccugcucuccuc

SEQ ID NO: 1415714 - RNA, 21 nt, Human
ucccaccccaaccugcucucc

SEQ ID NO: 1415715 - RNA, 20 nt, Human
ucccaccccaaccugcucuc

SEQ ID NO: 1415716 - RNA, 19 nt, Human
ucccacaugggcccaggcc

SEQ ID NO: 1415717 - RNA, 16 nt, Human
ucccacaugggcccag

SEQ ID NO: 1415718 - RNA, 13 nt, Human
ucccacaugggcc

SEQ ID NO: 1415719 - RNA, 23 nt, Human
ucccacaucccugggccugcugc

SEQ ID NO: 1415720 - RNA, 22 nt, Human
ucccacaucccugggccugcug

SEQ ID NO: 1415721 - RNA, 21 nt, Human
ucccacaucccugggccugcu

SEQ ID NO: 1415722 - RNA, 20 nt, Human
ucccacaucccugggccugc

SEQ ID NO: 1415723 - RNA, 18 nt, Human
ucccacaucccugggccu

SEQ ID NO: 1415724 - RNA, 17 nt, Human
ucccacaucccugggcc

SEQ ID NO: 1415725 - RNA, 16 nt, Human
ucccacaucccugggc

SEQ ID NO: 1415726 - RNA, 15 nt, Human
ucccacaucccuggg

SEQ ID NO: 1415727 - RNA, 14 nt, Human
ucccacaucccugg

SEQ ID NO: 1415728 - RNA, 13 nt, Human
ucccacaucccug

SEQ ID NO: 1415729 - RNA, 22 nt, Human
ucccacauuaaagaagaccuga

SEQ ID NO: 1415730 - RNA, 19 nt, Human
ucccacauuaaagaagacc

SEQ ID NO: 1415731 - RNA, 15 nt, Human
ucccacauuaaagaa

SEQ ID NO: 1415732 - RNA, 22 nt, Human
ucccacaugggcccaggccuca

SEQ ID NO: 1415733 - RNA, 17 nt, Human
ucccaccaggcugcuca

SEQ ID NO: 1415734 - RNA, 19 nt, Human
ucccaccccaaccugcucu

SEQ ID NO: 1415735 - RNA, 19 nt, Human
ucccacccaauucaaaaca

SEQ ID NO: 1415736 - RNA, 22 nt, Human
ucccaccaggcugcucagggcu

SEQ ID NO: 1415737 - RNA, 15 nt, Human
uccauuugcauuugu

SEQ ID NO: 1415738 - RNA, 12 nt, Human
uccauuugcauu

SEQ ID NO: 1415739 - RNA, 15 nt, Human
uccauuugcaaggga

SEQ ID NO: 1415740 - RNA, 16 nt, Human
uccauuugcauuuguu

SEQ ID NO: 1415741 - RNA, 21 nt, Human
ucccacagucccaucugcuuc

SEQ ID NO: 1415742 - RNA, 18 nt, Human
ucccacagguucaggcga

SEQ ID NO: 1415743 - RNA, 21 nt, Human
ucccacaggacauuucucuaa

SEQ ID NO: 1415744 - RNA, 18 nt, Human
ucccacaggacauuucuc

SEQ ID NO: 1415745 - RNA, 17 nt, Human
ucccacaggacauuucu

SEQ ID NO: 1415746 - RNA, 20 nt, Human
ucccaauucauccucacuca

SEQ ID NO: 1415747 - RNA, 15 nt, Human
ucccaauucacaucu

SEQ ID NO: 1415748 - RNA, 21 nt, Human
ucccaaagugcugggauuaca

SEQ ID NO: 1415749 - RNA, 23 nt, Human
ucccaauuucagacucccauucc

SEQ ID NO: 1415750 - RNA, 18 nt, Human
ucccaauuucagacuccc

SEQ ID NO: 1415751 - RNA, 17 nt, Human
ucccaauuucagacucc

SEQ ID NO: 1415752 - RNA, 16 nt, Human
ucccaauugagaaaaa

SEQ ID NO: 1415753 - RNA, 24 nt, Human
uccaucccuggcccccucccugga

SEQ ID NO: 1415754 - RNA, 23 nt, Human
uccaucccuggcccccucccugg

SEQ ID NO: 1415755 - RNA, 22 nt, Human
uccaucccuggcccccucccug

SEQ ID NO: 1415756 - RNA, 20 nt, Human
uccauccuacccccugugcc

SEQ ID NO: 1415757 - RNA, 20 nt, Human
uccaucccuggcccccuccc

SEQ ID NO: 1415758 - RNA, 15 nt, Human
uccaucccuggcccc

SEQ ID NO: 1415759 - RNA, 14 nt, Human
uccaucccuggccc

SEQ ID NO: 1415760 - RNA, 13 nt, Human
uccaucccuggcc

SEQ ID NO: 1415761 - RNA, 16 nt, Human
uccauccuacccccug

SEQ ID NO: 1415762 - RNA, 23 nt, Human
uccagucuuccugacacuuuaau

SEQ ID NO: 1415763 - RNA, 22 nt, Human
uccagucuuccugacacuuuaa

SEQ ID NO: 1415764 - RNA, 21 nt, Human
uccagucuuccugacacuuua

SEQ ID NO: 1415765 - RNA, 19 nt, Human
uccagucuuccugacacuu

SEQ ID NO: 1415766 - RNA, 15 nt, Human
uccagucuuccugac

SEQ ID NO: 1415767 - RNA, 21 nt, Human
acggccuuucuagccuggcua

SEQ ID NO: 1415768 - RNA, 14 nt, Human
acggccuuucuagc

SEQ ID NO: 1415769 - RNA, 14 nt, Human
uccaugacaucaag

SEQ ID NO: 1415770 - RNA, 13 nt, Human
uccaucuuuacaa

SEQ ID NO: 1415771 - RNA, 22 nt, Human
uccaucugguagaagggaaagc

SEQ ID NO: 1415772 - RNA, 21 nt, Human
uccaucugguagaagggaaag

SEQ ID NO: 1415773 - RNA, 20 nt, Human
uccaugacugcuugcccuaa

SEQ ID NO: 1415774 - RNA, 19 nt, Human
uccaugacugcuugcccua

SEQ ID NO: 1415775 - RNA, 15 nt, Human
uccaugacugcuugc

SEQ ID NO: 1415776 - RNA, 13 nt, Human
uccaugacugcuu

SEQ ID NO: 1415777 - RNA, 15 nt, Human
uccaugacaucaaga

SEQ ID NO: 1415778 - RNA, 20 nt, Human
uccaugaccuaguuuuccau

SEQ ID NO: 1415779 - RNA, 19 nt, Human
uccauugguccaagauucc

SEQ ID NO: 1415780 - RNA, 18 nt, Human
uccauugguccaagauuc

SEQ ID NO: 1415781 - RNA, 16 nt, Human
uccauugguccaagau

SEQ ID NO: 1415782 - RNA, 15 nt, Human
uccauugguccaaga

SEQ ID NO: 1415783 - RNA, 16 nt, Human
uccauuggaucucauu

SEQ ID NO: 1415784 - RNA, 22 nt, Human
uccaugacugcuugcccuaagc

SEQ ID NO: 1415785 - RNA, 23 nt, Human
uccaugacugcuugcccuaagca

SEQ ID NO: 1415786 - RNA, 22 nt, Human
uccauugguccaagauuccgga

SEQ ID NO: 1415787 - RNA, 20 nt, Human
uccccucugcugcugucccu

SEQ ID NO: 1415788 - RNA, 17 nt, Human
uccccucugcugcuguc

SEQ ID NO: 1415789 - RNA, 15 nt, Human
uccccucugcugcug

SEQ ID NO: 1415790 - RNA, 14 nt, Human
uccccucugcugcu

SEQ ID NO: 1415791 - RNA, 13 nt, Human
uccccucugcugc

SEQ ID NO: 1415792 - RNA, 15 nt, Human
uccccuccuucccaa

SEQ ID NO: 1415793 - RNA, 22 nt, Human
uccccuaaagccucaaaacaaa

SEQ ID NO: 1415794 - RNA, 15 nt, Human
uccccuaaagccuca

SEQ ID NO: 1415795 - RNA, 16 nt, Human
uccccggacucaagcc

SEQ ID NO: 1415796 - RNA, 18 nt, Human
acucaaguugauuagaaa

SEQ ID NO: 1415797 - RNA, 13 nt, Human
acuagaugaugga

SEQ ID NO: 1415798 - RNA, 21 nt, Human
acuagagucugaacagcugua

SEQ ID NO: 1415799 - RNA, 20 nt, Human
acuagagucugaacagcugu

SEQ ID NO: 1415800 - RNA, 24 nt, Human
acuaugcauggugccccaggacca

SEQ ID NO: 1415801 - RNA, 23 nt, Human
acuaugcauggugccccaggacc

SEQ ID NO: 1415802 - RNA, 22 nt, Human
acuaugcauggugccccaggac

SEQ ID NO: 1415803 - RNA, 21 nt, Human
acuaugcauggugccccagga

SEQ ID NO: 1415804 - RNA, 20 nt, Human
acuaugcauggugccccagg

SEQ ID NO: 1415805 - RNA, 19 nt, Human
acuaugauuuaauuugaaa

SEQ ID NO: 1415806 - RNA, 15 nt, Human
acuaugauuauuaac

SEQ ID NO: 1415807 - RNA, 14 nt, Human
acuauguggaugug

SEQ ID NO: 1415808 - RNA, 11 nt, Human
acuauguaaac

SEQ ID NO: 1415809 - RNA, 12 nt, Human
acuauguaaacu

SEQ ID NO: 1415810 - RNA, 14 nt, Human
acuauguaacaugu

SEQ ID NO: 1415811 - RNA, 14 nt, Human
acuauguaaacuac

SEQ ID NO: 1415812 - RNA, 16 nt, Human
acuauguaaacuacuu

SEQ ID NO: 1415813 - RNA, 22 nt, Human
ucccccagcaaagcccccagag

SEQ ID NO: 1415814 - RNA, 21 nt, Human
ucccccagcaaagcccccaga

SEQ ID NO: 1415815 - RNA, 12 nt, Human
ucccccacuuuc

SEQ ID NO: 1415816 - RNA, 10 nt, Human
ucccccaaga

SEQ ID NO: 1415817 - RNA, 14 nt, Human
uccccaucuucuaa

SEQ ID NO: 1415818 - RNA, 14 nt, Human
uccccaucucaggc

SEQ ID NO: 1415819 - RNA, 13 nt, Human
uccccaucucagg

SEQ ID NO: 1415820 - RNA, 22 nt, Human
uccccaucguugcccccauuuc

SEQ ID NO: 1415821 - RNA, 18 nt, Human
uccccaucguugccccca

SEQ ID NO: 1415822 - RNA, 23 nt, Human
uccccauacuccuaugaucugag

SEQ ID NO: 1415823 - RNA, 15 nt, Human
uccccaguaaaauug

SEQ ID NO: 1415824 - RNA, 19 nt, Human
uccccacuguaucuaggca

SEQ ID NO: 1415825 - RNA, 15 nt, Human
uccccacuguaucua

SEQ ID NO: 1415826 - RNA, 14 nt, Human
uccccaguaaaauu

SEQ ID NO: 1415827 - RNA, 15 nt, Human
uccccacuggagcag

SEQ ID NO: 1415828 - RNA, 14 nt, Human
uccccacuggagca

SEQ ID NO: 1415829 - RNA, 13 nt, Human
uccccacuggagc

SEQ ID NO: 1415830 - RNA, 12 nt, Human
uccccacuggag

SEQ ID NO: 1415831 - RNA, 18 nt, Human
uccccacucugcucugau

SEQ ID NO: 1415832 - RNA, 20 nt, Human
uccccacucugcucugaugc

SEQ ID NO: 1415833 - RNA, 17 nt, Human
uccccacucugcucuga

SEQ ID NO: 1415834 - RNA, 16 nt, Human
uccccacucugcucug

SEQ ID NO: 1415835 - RNA, 12 nt, Human
acguacacauuu

SEQ ID NO: 1415836 - RNA, 13 nt, Human
acguacacauuuu

SEQ ID NO: 1415837 - RNA, 14 nt, Human
acguacacauuuua

SEQ ID NO: 1415838 - RNA, 23 nt, Human
ucccccagcaaagcccccagagc

SEQ ID NO: 1415839 - RNA, 22 nt, Human
acuaccuguaaugacaggccug

SEQ ID NO: 1415840 - RNA, 18 nt, Human
acuaccuugguuccccca

SEQ ID NO: 1415841 - RNA, 17 nt, Human
acuaccuugaaaauaag

SEQ ID NO: 1415842 - RNA, 19 nt, Human
acuacuaauagaauaaagg

SEQ ID NO: 1415843 - RNA, 13 nt, Human
acuacgccuggcu

SEQ ID NO: 1415844 - RNA, 16 nt, Human
acuacuuugcugcuaa

SEQ ID NO: 1415845 - RNA, 14 nt, Human
acuacuagggaaau

SEQ ID NO: 1415846 - RNA, 12 nt, Human
acuacuuuauaa

SEQ ID NO: 1415847 - RNA, 17 nt, Human
acuacuugggagcaccg

SEQ ID NO: 1415848 - RNA, 23 nt, Human
acuacuucuuuuuucaaaagaaa

SEQ ID NO: 1415849 - RNA, 20 nt, Human
acuagacaccaaaguucuaa

SEQ ID NO: 1415850 - RNA, 18 nt, Human
acuagacaccaaaguucu

SEQ ID NO: 1415851 - RNA, 17 nt, Human
acuagacaccaaaguuc

SEQ ID NO: 1415852 - RNA, 21 nt, Human
acuagacaagccagaacuuga

SEQ ID NO: 1415853 - RNA, 17 nt, Human
acuagacaagccagaac

SEQ ID NO: 1415854 - RNA, 15 nt, Human
acuagacaagccaga

SEQ ID NO: 1415855 - RNA, 12 nt, Human
acuagacaagcc

SEQ ID NO: 1415856 - RNA, 15 nt, Human
acuagagucugaaca

SEQ ID NO: 1415857 - RNA, 21 nt, Human
acuagaggugagaaauuuaaa

SEQ ID NO: 1415858 - RNA, 18 nt, Human
acuagaggugagaaauuu

SEQ ID NO: 1415859 - RNA, 14 nt, Human
acuagaggugagaa

SEQ ID NO: 1415860 - RNA, 20 nt, Human
acuagaguuuagcuggaaaa

SEQ ID NO: 1415861 - RNA, 23 nt, Human
ucccucuuuggcuccccuguacc

SEQ ID NO: 1415862 - RNA, 18 nt, Human
ucccucuuuggcuccccu

SEQ ID NO: 1415863 - RNA, 19 nt, Human
ucccugacucauucugaag

SEQ ID NO: 1415864 - RNA, 16 nt, Human
ucccugacucauucug

SEQ ID NO: 1415865 - RNA, 14 nt, Human
ucccugacucauuc

SEQ ID NO: 1415866 - RNA, 22 nt, Human
ucccugacucauucugaaggag

SEQ ID NO: 1415867 - RNA, 16 nt, Human
ucccucagacuggggc

SEQ ID NO: 1415868 - RNA, 14 nt, Human
ucccucagacuggg

SEQ ID NO: 1415869 - RNA, 12 nt, Human
ucccucagacug

SEQ ID NO: 1415870 - RNA, 18 nt, Human
ucccucacucgucucccc

SEQ ID NO: 1415871 - RNA, 22 nt, Human
ucccucaccuuggcaccagaca

SEQ ID NO: 1415872 - RNA, 21 nt, Human
ucccucacucgucucccccaa

SEQ ID NO: 1415873 - RNA, 22 nt, Human
ucccucacucgucucccccaac

SEQ ID NO: 1415874 - RNA, 20 nt, Human
ucccucacucgucuccccca

SEQ ID NO: 1415875 - RNA, 19 nt, Human
ucccucacucgucuccccc

SEQ ID NO: 1415876 - RNA, 14 nt, Human
ucccucccccuugu

SEQ ID NO: 1415877 - RNA, 12 nt, Human
ucccucccccuu

SEQ ID NO: 1415878 - RNA, 21 nt, Human
ucccucccccccaugcacugu

SEQ ID NO: 1415879 - RNA, 16 nt, Human
ucccucccccccaugc

SEQ ID NO: 1415880 - RNA, 14 nt, Human
ucccucccccccau

SEQ ID NO: 1415881 - RNA, 12 nt, Human
ucccuccccccc

SEQ ID NO: 1415882 - RNA, 23 nt, Human
ucccucccagaggagccaccagu

SEQ ID NO: 1415883 - RNA, 22 nt, Human
ucccucuuccuucccugcugug

SEQ ID NO: 1415884 - RNA, 21 nt, Human
ucccucuuccuucccugcugu

SEQ ID NO: 1415885 - RNA, 23 nt, Human
ucccucuuccuucccugcuguga

SEQ ID NO: 1415886 - RNA, 23 nt, Human
acucagaagccugggggccuggc

SEQ ID NO: 1415887 - RNA, 22 nt, Human
acucagaagccugggggccugg

SEQ ID NO: 1415888 - RNA, 21 nt, Human
acucagaagccugggggccug

SEQ ID NO: 1415889 - RNA, 14 nt, Human
acucagaauucucu

SEQ ID NO: 1415890 - RNA, 21 nt, Human
acucagaauucucuaguuuga

SEQ ID NO: 1415891 - RNA, 22 nt, Human
acucagaauucucuaguuugau

SEQ ID NO: 1415892 - RNA, 17 nt, Human
acucagaagccuggggg

SEQ ID NO: 1415893 - RNA, 16 nt, Human
acucagaagccugggg

SEQ ID NO: 1415894 - RNA, 15 nt, Human
acucagaagccuggg

SEQ ID NO: 1415895 - RNA, 14 nt, Human
acucagaagccugg

SEQ ID NO: 1415896 - RNA, 13 nt, Human
acucagaagccug

SEQ ID NO: 1415897 - RNA, 22 nt, Human
acucaccugcacuaacagagug

SEQ ID NO: 1415898 - RNA, 13 nt, Human
acucagaaauuca

SEQ ID NO: 1415899 - RNA, 20 nt, Human
acucagagacaugcagagau

SEQ ID NO: 1415900 - RNA, 17 nt, Human
acucagagacaugcaga

SEQ ID NO: 1415901 - RNA, 14 nt, Human
acucagagacaugc

SEQ ID NO: 1415902 - RNA, 12 nt, Human
acucagaccuga

SEQ ID NO: 1415903 - RNA, 18 nt, Human
acucagacauuggcaccu

SEQ ID NO: 1415904 - RNA, 22 nt, Human
acucagauaagguaaaaugcca

SEQ ID NO: 1415905 - RNA, 23 nt, Human
acucaucuagguaaauuacaguu

SEQ ID NO: 1415906 - RNA, 19 nt, Human
acucauuuuucaugauaau

SEQ ID NO: 1415907 - RNA, 19 nt, Human
acuccaaacagaccccugu

SEQ ID NO: 1415908 - RNA, 22 nt, Human
acuccaaacagaccccuguuca

SEQ ID NO: 1415909 - RNA, 22 nt, Human
acuccaaaauguuggucauuuu

SEQ ID NO: 1415910 - RNA, 13 nt, Human
acuccaaaauguu

SEQ ID NO: 1415911 - RNA, 20 nt, Human
acucauuuuucaugauaaug

SEQ ID NO: 1415912 - RNA, 23 nt, Human
acucauuuuucaugauaaugaac

SEQ ID NO: 1415913 - RNA, 21 nt, Human
acuccaaacugacucuuaaga

SEQ ID NO: 1415914 - RNA, 13 nt, Human
uccuaccgucuuu

SEQ ID NO: 1415915 - RNA, 13 nt, Human
acuccuuccugcc

SEQ ID NO: 1415916 - RNA, 23 nt, Human
acuccuugauuuuagccuucucu

SEQ ID NO: 1415917 - RNA, 11 nt, Human
acuccuuccug

SEQ ID NO: 1415918 - RNA, 13 nt, Human
acuccuuccagcu

SEQ ID NO: 1415919 - RNA, 12 nt, Human
acuccuuccagc

SEQ ID NO: 1415920 - RNA, 22 nt, Human
acuccuucaacaauucuaaaau

SEQ ID NO: 1415921 - RNA, 20 nt, Human
acuccuucaacaauucuaaa

SEQ ID NO: 1415922 - RNA, 19 nt, Human
acuccugugggagccucgc

SEQ ID NO: 1415923 - RNA, 20 nt, Human
acuccugugggagccucgca

SEQ ID NO: 1415924 - RNA, 18 nt, Human
acuccugugggagccucg

SEQ ID NO: 1415925 - RNA, 17 nt, Human
acuccugugggagccuc

SEQ ID NO: 1415926 - RNA, 16 nt, Human
acuccugugggagccu

SEQ ID NO: 1415927 - RNA, 15 nt, Human
acuccugugggagcc

SEQ ID NO: 1415928 - RNA, 15 nt, Human
acucgaaucugugug

SEQ ID NO: 1415929 - RNA, 23 nt, Human
acuccuuuuaaagaaaaaaauug

SEQ ID NO: 1415930 - RNA, 14 nt, Human
acuccuuuuaaaga

SEQ ID NO: 1415931 - RNA, 14 nt, Human
acuccuuucucauc

SEQ ID NO: 1415932 - RNA, 12 nt, Human
acuccuuccugc

SEQ ID NO: 1415933 - RNA, 15 nt, Human
uccuaccucaaaauu

SEQ ID NO: 1415934 - RNA, 15 nt, Human
uccguguccaccccc

SEQ ID NO: 1415935 - RNA, 19 nt, Human
uccguuagcuccuguggcc

SEQ ID NO: 1415936 - RNA, 17 nt, Human
uccguuagcuccugugg

SEQ ID NO: 1415937 - RNA, 16 nt, Human
uccguuagcuccugug

SEQ ID NO: 1415938 - RNA, 15 nt, Human
uccguuagcuccugu

SEQ ID NO: 1415939 - RNA, 16 nt, Human
uccgugugggagaccg

SEQ ID NO: 1415940 - RNA, 16 nt, Human
uccguguccaccccca

SEQ ID NO: 1415941 - RNA, 17 nt, Human
uccgugggacggugccc

SEQ ID NO: 1415942 - RNA, 15 nt, Human
uccguuaaaauacca

SEQ ID NO: 1415943 - RNA, 23 nt, Human
uccgugggacggugcccaagcca

SEQ ID NO: 1415944 - RNA, 16 nt, Human
uccgugggacggugcc

SEQ ID NO: 1415945 - RNA, 13 nt, Human
uccguuaaaauac

SEQ ID NO: 1415946 - RNA, 14 nt, Human
uccgugcuuaacca

SEQ ID NO: 1415947 - RNA, 21 nt, Human
uccgugcuuaaccaaagaagc

SEQ ID NO: 1415948 - RNA, 13 nt, Human
uccggcauggaca

SEQ ID NO: 1415949 - RNA, 19 nt, Human
uccggcauggacaauggac

SEQ ID NO: 1415950 - RNA, 19 nt, Human
uccggcagcuucugccccc

SEQ ID NO: 1415951 - RNA, 13 nt, Human
acuccaccuuccc

SEQ ID NO: 1415952 - RNA, 18 nt, Human
acuccagaaagugacaag

SEQ ID NO: 1415953 - RNA, 14 nt, Human
acuccagaaaguga

SEQ ID NO: 1415954 - RNA, 15 nt, Human
acucuucaaaugccu

SEQ ID NO: 1415955 - RNA, 16 nt, Human
acucugcuucucugac

SEQ ID NO: 1415956 - RNA, 14 nt, Human
acucugcuguuuga

SEQ ID NO: 1415957 - RNA, 15 nt, Human
acucugcuucucuga

SEQ ID NO: 1415958 - RNA, 14 nt, Human
acucugcuucucug

SEQ ID NO: 1415959 - RNA, 12 nt, Human
acucugcuucuc

SEQ ID NO: 1415960 - RNA, 16 nt, Human
acucugcucugaugca

SEQ ID NO: 1415961 - RNA, 15 nt, Human
acucugcucugaugc

SEQ ID NO: 1415962 - RNA, 14 nt, Human
acucugcucugaug

SEQ ID NO: 1415963 - RNA, 13 nt, Human
acucugcucugau

SEQ ID NO: 1415964 - RNA, 12 nt, Human
acucugcucuga

SEQ ID NO: 1415965 - RNA, 14 nt, Human
acucuucccucucu

SEQ ID NO: 1415966 - RNA, 15 nt, Human
acucuucacucuuca

SEQ ID NO: 1415967 - RNA, 20 nt, Human
acucuucaaggucugcuuuu

SEQ ID NO: 1415968 - RNA, 16 nt, Human
acucuucacucuucaa

SEQ ID NO: 1415969 - RNA, 19 nt, Human
acucuucaaggucugcuuu

SEQ ID NO: 1415970 - RNA, 23 nt, Human
acucuucugagcaccuacuuaca

SEQ ID NO: 1415971 - RNA, 16 nt, Human
acucuucuugaaauuu

SEQ ID NO: 1415972 - RNA, 15 nt, Human
acucuucuugaaauu

SEQ ID NO: 1415973 - RNA, 13 nt, Human
acucuugaaaaau

SEQ ID NO: 1415974 - RNA, 16 nt, Human
acucucagucucugag

SEQ ID NO: 1415975 - RNA, 14 nt, Human
acucucagucucug

SEQ ID NO: 1415976 - RNA, 13 nt, Human
acucucagucucu

SEQ ID NO: 1415977 - RNA, 22 nt, Human
acucucaggaccaaagcuuuca

SEQ ID NO: 1415978 - RNA, 18 nt, Human
acucucagucucugagca

SEQ ID NO: 1415979 - RNA, 17 nt, Human
acucucagucucugagc

SEQ ID NO: 1415980 - RNA, 11 nt, Human
acucugcucug

SEQ ID NO: 1415981 - RNA, 16 nt, Human
acucgguuucuccaaa

SEQ ID NO: 1415982 - RNA, 14 nt, Human
acucgguuucucca

SEQ ID NO: 1415983 - RNA, 12 nt, Human
acucgguuucuc

SEQ ID NO: 1415984 - RNA, 15 nt, Human
acucgucucccccaa

SEQ ID NO: 1415985 - RNA, 23 nt, Human
acucgugucuggcacagccuggc

SEQ ID NO: 1415986 - RNA, 22 nt, Human
acucgugucuggcacagccugg

SEQ ID NO: 1415987 - RNA, 14 nt, Human
acucuauucuuuaa

SEQ ID NO: 1415988 - RNA, 15 nt, Human
acucuauucuuuaac

SEQ ID NO: 1415989 - RNA, 19 nt, Human
acucguauagcaugcaucu

SEQ ID NO: 1415990 - RNA, 15 nt, Human
acucguguguuucua

SEQ ID NO: 1415991 - RNA, 13 nt, Human
acucuauucuuua

SEQ ID NO: 1415992 - RNA, 23 nt, Human
acucguguguuucuauuuuuuga

SEQ ID NO: 1415993 - RNA, 21 nt, Human
acucuugaaaaaugcauguug

SEQ ID NO: 1415994 - RNA, 14 nt, Human
acucuugaaaaaug

SEQ ID NO: 1415995 - RNA, 19 nt, Human
acucuugaaaaaugcaugu

SEQ ID NO: 1415996 - RNA, 14 nt, Human
uccucccuuccucc

SEQ ID NO: 1415997 - RNA, 15 nt, Human
uccucccuguaacuu

SEQ ID NO: 1415998 - RNA, 14 nt, Human
uccucccuguaacu

SEQ ID NO: 1415999 - RNA, 12 nt, Human
uccucccuguaa

SEQ ID NO: 1416000 - RNA, 11 nt, Human
uccucccugua

SEQ ID NO: 1416001 - RNA, 21 nt, Human
uccuccccacuuguccgcugg

SEQ ID NO: 1416002 - RNA, 19 nt, Human
acucuucuugaaauuuuaa

SEQ ID NO: 1416003 - RNA, 15 nt, Human
uccucugacucaggg

SEQ ID NO: 1416004 - RNA, 17 nt, Human
uccucucuuccucuucc

SEQ ID NO: 1416005 - RNA, 14 nt, Human
uccucucuuccucu

SEQ ID NO: 1416006 - RNA, 17 nt, Human
uccucugacucagggcu

SEQ ID NO: 1416007 - RNA, 16 nt, Human
uccucugacucagggc

SEQ ID NO: 1416008 - RNA, 16 nt, Human
uccucucucuguguua

SEQ ID NO: 1416009 - RNA, 17 nt, Human
uccucucgcggcccuca

SEQ ID NO: 1416010 - RNA, 19 nt, Human
uccucucgcggcccucagu

SEQ ID NO: 1416011 - RNA, 15 nt, Human
uccucucgcggcccu

SEQ ID NO: 1416012 - RNA, 17 nt, Human
uccucuccuagccccug

SEQ ID NO: 1416013 - RNA, 13 nt, Human
uccucuccugucu

SEQ ID NO: 1416014 - RNA, 23 nt, Human
uccucuccccagcccagagacau

SEQ ID NO: 1416015 - RNA, 21 nt, Human
uccucuccccagcccagagac

SEQ ID NO: 1416016 - RNA, 17 nt, Human
uccucuccccaugaugu

SEQ ID NO: 1416017 - RNA, 21 nt, Human
uccugaccaguugcagucacu

SEQ ID NO: 1416018 - RNA, 22 nt, Human
uccugaccaguugcagucacuc

SEQ ID NO: 1416019 - RNA, 14 nt, Human
uccugaccaguugc

SEQ ID NO: 1416020 - RNA, 11 nt, Human
uccugaccagc

SEQ ID NO: 1416021 - RNA, 17 nt, Human
uccugaaggccugaggu

SEQ ID NO: 1416022 - RNA, 22 nt, Human
uccugaauccaaacuaauccau

SEQ ID NO: 1416023 - RNA, 14 nt, Human
acucuuucuguaua

SEQ ID NO: 1416024 - RNA, 20 nt, Human
uccugaccugucucaccaug

SEQ ID NO: 1416025 - RNA, 15 nt, Human
uccugaccugucuca

SEQ ID NO: 1416026 - RNA, 20 nt, Human
uccugaccuccgccauccac

SEQ ID NO: 1416027 - RNA, 16 nt, Human
uccugaccuccgccau

SEQ ID NO: 1416028 - RNA, 15 nt, Human
uccugaccuccgcca

SEQ ID NO: 1416029 - RNA, 16 nt, Human
uccugaccucagguga

SEQ ID NO: 1416030 - RNA, 15 nt, Human
uccugaccucaggca

SEQ ID NO: 1416031 - RNA, 21 nt, Human
uccugaccccaaguuauccac

SEQ ID NO: 1416032 - RNA, 14 nt, Human
acucuuuggucguu

SEQ ID NO: 1416033 - RNA, 15 nt, Human
acucuuugcugcugc

SEQ ID NO: 1416034 - RNA, 12 nt, Human
acucuuugagag

SEQ ID NO: 1416035 - RNA, 18 nt, Human
acucuuugagaaacaaca

SEQ ID NO: 1416036 - RNA, 16 nt, Human
acucuuugagaaacaa

SEQ ID NO: 1416037 - RNA, 22 nt, Human
acucuuucuguauauacuuuuu

SEQ ID NO: 1416038 - RNA, 21 nt, Human
acucuuucuguauauacuuuu

SEQ ID NO: 1416039 - RNA, 13 nt, Human
acucuuugagaaa

SEQ ID NO: 1416040 - RNA, 19 nt, Human
acucuuucuuucaauaaaa

SEQ ID NO: 1416041 - RNA, 19 nt, Human
acugaaaaugugcuauacu

SEQ ID NO: 1416042 - RNA, 17 nt, Human
acugaaaauuauuuaaa

SEQ ID NO: 1416043 - RNA, 15 nt, Human
acugaaaaugugcua

SEQ ID NO: 1416044 - RNA, 20 nt, Human
acugaaaaggaggggucugg

SEQ ID NO: 1416045 - RNA, 18 nt, Human
acugaaaauauuguuuua

SEQ ID NO: 1416046 - RNA, 16 nt, Human
uccucugcacucccac

SEQ ID NO: 1416047 - RNA, 12 nt, Human
uccucugcacuc

SEQ ID NO: 1416048 - RNA, 18 nt, Human
uccucugacucagggcuc

SEQ ID NO: 1416049 - RNA, 22 nt, Human
uccucugcccgggagcucagga

SEQ ID NO: 1416050 - RNA, 16 nt, Human
uccucugcccgggagc

SEQ ID NO: 1416051 - RNA, 21 nt, Human
uccucugcugaccugcugacc

SEQ ID NO: 1416052 - RNA, 16 nt, Human
uccucuuucagcuccu

SEQ ID NO: 1416053 - RNA, 15 nt, Human
uccucuuucagcucc

SEQ ID NO: 1416054 - RNA, 14 nt, Human
uccucuuucagcuc

SEQ ID NO: 1416055 - RNA, 13 nt, Human
uccucuuucagcu

SEQ ID NO: 1416056 - RNA, 12 nt, Human
uccucuuucagc

SEQ ID NO: 1416057 - RNA, 15 nt, Human
uccucuuuagaguua

SEQ ID NO: 1416058 - RNA, 20 nt, Human
uccucuuuagaguuagacug

SEQ ID NO: 1416059 - RNA, 21 nt, Human
uccucuuuagaguuagacugu

SEQ ID NO: 1416060 - RNA, 23 nt, Human
uccugaagaaccaguccccccac

SEQ ID NO: 1416061 - RNA, 18 nt, Human
uccugaagaaccaguccc

SEQ ID NO: 1416062 - RNA, 16 nt, Human
uccugaagaaccaguc

SEQ ID NO: 1416063 - RNA, 14 nt, Human
uccugaagaaccag

SEQ ID NO: 1416064 - RNA, 13 nt, Human
uccugaagaacca

SEQ ID NO: 1416065 - RNA, 18 nt, Human
uccucuuuuccuucccaa

SEQ ID NO: 1416066 - RNA, 22 nt, Human
uccugaaaacccuugccaugug

SEQ ID NO: 1416067 - RNA, 21 nt, Human
uccugaaaacccuugccaugu

SEQ ID NO: 1416068 - RNA, 16 nt, Human
ucaguauuauauguac

SEQ ID NO: 1416069 - RNA, 15 nt, Human
ucaguauuauaugua

SEQ ID NO: 1416070 - RNA, 14 nt, Human
ucaguauuauaugu

SEQ ID NO: 1416071 - RNA, 15 nt, Human
ucaguagucccugca

SEQ ID NO: 1416072 - RNA, 13 nt, Human
ucaguagucagac

SEQ ID NO: 1416073 - RNA, 13 nt, Human
ucagugcugugcu

SEQ ID NO: 1416074 - RNA, 19 nt, Human
ucagugcucccucacaugu

SEQ ID NO: 1416075 - RNA, 13 nt, Human
ucagugcucccuc

SEQ ID NO: 1416076 - RNA, 12 nt, Human
ucagugcucccu

SEQ ID NO: 1416077 - RNA, 22 nt, Human
ucagugcugugcugugcuaugg

SEQ ID NO: 1416078 - RNA, 16 nt, Human
ucagugcugugcugug

SEQ ID NO: 1416079 - RNA, 14 nt, Human
ucagugcugugcug

SEQ ID NO: 1416080 - RNA, 17 nt, Human
ucaguuugugugucuua

SEQ ID NO: 1416081 - RNA, 16 nt, Human
ucaguuugugugucuu

SEQ ID NO: 1416082 - RNA, 15 nt, Human
ucaguuugugugucu

SEQ ID NO: 1416083 - RNA, 19 nt, Human
ucaguuucauaaaaggaga

SEQ ID NO: 1416084 - RNA, 14 nt, Human
ucaguuucauaaaa

SEQ ID NO: 1416085 - RNA, 19 nt, Human
ucaguuucacagaaaauaa

SEQ ID NO: 1416086 - RNA, 18 nt, Human
ucaguuucacagaaaaua

SEQ ID NO: 1416087 - RNA, 17 nt, Human
ucaguuucacagaaaau

SEQ ID NO: 1416088 - RNA, 19 nt, Human
ucaguuuaaaagcacgaca

SEQ ID NO: 1416089 - RNA, 15 nt, Human
ucaguuguucuuuuu

SEQ ID NO: 1416090 - RNA, 20 nt, Human
ucauaaguauuucaaauugg

SEQ ID NO: 1416091 - RNA, 15 nt, Human
ucauaaguauuucaa

SEQ ID NO: 1416092 - RNA, 20 nt, Human
ucauaaguauuaugucucuu

SEQ ID NO: 1416093 - RNA, 15 nt, Human
ucauaaggcuucaaa

SEQ ID NO: 1416094 - RNA, 14 nt, Human
ucauaaggcuucaa

SEQ ID NO: 1416095 - RNA, 24 nt, Human
ucauaaagcaggcagaacucaucu

SEQ ID NO: 1416096 - RNA, 18 nt, Human
ucauaaauaaaguuuguu

SEQ ID NO: 1416097 - RNA, 23 nt, Human
ucaguaggugcccagaauaaguu

SEQ ID NO: 1416098 - RNA, 17 nt, Human
ucaguagauugcagaaa

SEQ ID NO: 1416099 - RNA, 19 nt, Human
ucaguacccucucagcucc

SEQ ID NO: 1416100 - RNA, 17 nt, Human
ucaguacccucucagcu

SEQ ID NO: 1416101 - RNA, 16 nt, Human
ucaguacccucucagc

SEQ ID NO: 1416102 - RNA, 18 nt, Human
ucaguaauuuguuuaaaa

SEQ ID NO: 1416103 - RNA, 18 nt, Human
ucaguaauuugaggacaa

SEQ ID NO: 1416104 - RNA, 17 nt, Human
ucaguaauuugaggaca

SEQ ID NO: 1416105 - RNA, 15 nt, Human
ucaguaauuugagga

SEQ ID NO: 1416106 - RNA, 14 nt, Human
ucaguaauuugagg

SEQ ID NO: 1416107 - RNA, 20 nt, Human
ucaguaauuuagaaaucauu

SEQ ID NO: 1416108 - RNA, 19 nt, Human
ucaguaauuuagaaaucau

SEQ ID NO: 1416109 - RNA, 18 nt, Human
ucaguaauuuagaaauca

SEQ ID NO: 1416110 - RNA, 12 nt, Human
ucaguaagaggu

SEQ ID NO: 1416111 - RNA, 18 nt, Human
ucaguaaauaacuggaaa

SEQ ID NO: 1416112 - RNA, 17 nt, Human
ucaguaaauaacuggaa

SEQ ID NO: 1416113 - RNA, 22 nt, Human
ucagguuuuuccuuuuuuugua

SEQ ID NO: 1416114 - RNA, 14 nt, Human
ucagguguugccaa

SEQ ID NO: 1416115 - RNA, 17 nt, Human
acccuugguuccuaacu

SEQ ID NO: 1416116 - RNA, 20 nt, Human
acccuugggccagaaguacc

SEQ ID NO: 1416117 - RNA, 18 nt, Human
acccuugggccagaagua

SEQ ID NO: 1416118 - RNA, 17 nt, Human
acccuugggccagaagu

SEQ ID NO: 1416119 - RNA, 16 nt, Human
acccuugggccagaag

SEQ ID NO: 1416120 - RNA, 18 nt, Human
acccugcucauccacucu

SEQ ID NO: 1416121 - RNA, 23 nt, Human
acccugccucucccaggcagggg

SEQ ID NO: 1416122 - RNA, 17 nt, Human
acccuggaaaaugaauc

SEQ ID NO: 1416123 - RNA, 16 nt, Human
acccuugcugugaauu

SEQ ID NO: 1416124 - RNA, 21 nt, Human
accgaacugauguaaguaaac

SEQ ID NO: 1416125 - RNA, 20 nt, Human
ucaggggucugagcuccagc

SEQ ID NO: 1416126 - RNA, 17 nt, Human
ucagggggcgccugugg

SEQ ID NO: 1416127 - RNA, 15 nt, Human
ucagguauaccucac

SEQ ID NO: 1416128 - RNA, 17 nt, Human
ucagguauaccucacuu

SEQ ID NO: 1416129 - RNA, 14 nt, Human
ucagguacuuguaa

SEQ ID NO: 1416130 - RNA, 23 nt, Human
acccgauuccaccaaaugugcuu

SEQ ID NO: 1416131 - RNA, 15 nt, Human
acccgccccacuccc

SEQ ID NO: 1416132 - RNA, 21 nt, Human
ucaggcaggggccuccauggg

SEQ ID NO: 1416133 - RNA, 17 nt, Human
ucaggcaggggccucca

SEQ ID NO: 1416134 - RNA, 16 nt, Human
ucaggcaggggccucc

SEQ ID NO: 1416135 - RNA, 13 nt, Human
ucaggcagcucaa

SEQ ID NO: 1416136 - RNA, 19 nt, Human
ucaggcacugggcaugagg

SEQ ID NO: 1416137 - RNA, 12 nt, Human
acccccagcacu

SEQ ID NO: 1416138 - RNA, 12 nt, Human
acccccagccug

SEQ ID NO: 1416139 - RNA, 17 nt, Human
ucaggccagagccaagg

SEQ ID NO: 1416140 - RNA, 14 nt, Human
ucaggccagagcca

SEQ ID NO: 1416141 - RNA, 18 nt, Human
acccugccuuaucuugca

SEQ ID NO: 1416142 - RNA, 14 nt, Human
acccugccuuaucu

SEQ ID NO: 1416143 - RNA, 20 nt, Human
acccugccucucccaggcag

SEQ ID NO: 1416144 - RNA, 16 nt, Human
acccugccucucccag

SEQ ID NO: 1416145 - RNA, 13 nt, Human
acccugccucucc

SEQ ID NO: 1416146 - RNA, 17 nt, Human
acccugccccagcuggg

SEQ ID NO: 1416147 - RNA, 23 nt, Human
acccugauuuaggagaagccagg

SEQ ID NO: 1416148 - RNA, 22 nt, Human
acccugauuuaggagaagccag

SEQ ID NO: 1416149 - RNA, 20 nt, Human
acccugauuuaggagaagcc

SEQ ID NO: 1416150 - RNA, 19 nt, Human
acccugaguugcuuuucag

SEQ ID NO: 1416151 - RNA, 22 nt, Human
acccugcauggcugagcugccc

SEQ ID NO: 1416152 - RNA, 19 nt, Human
acccugauaggaagagggg

SEQ ID NO: 1416153 - RNA, 16 nt, Human
acccugaguugcuuuu

SEQ ID NO: 1416154 - RNA, 23 nt, Human
acccugaggagucugagguccug

SEQ ID NO: 1416155 - RNA, 22 nt, Human
acccugaggagucugagguccu

SEQ ID NO: 1416156 - RNA, 19 nt, Human
acccugaggagucugaggu

SEQ ID NO: 1416157 - RNA, 17 nt, Human
acccugaggagucugag

SEQ ID NO: 1416158 - RNA, 14 nt, Human
acccugaggagucu

SEQ ID NO: 1416159 - RNA, 13 nt, Human
acccugaggaguc

SEQ ID NO: 1416160 - RNA, 23 nt, Human
acccugagcugaggcagcagugu

SEQ ID NO: 1416161 - RNA, 22 nt, Human
acccugagcugaggcagcagug

SEQ ID NO: 1416162 - RNA, 17 nt, Human
acccugagcugaggcag

SEQ ID NO: 1416163 - RNA, 22 nt, Human
acccugagcugaccagccguga

SEQ ID NO: 1416164 - RNA, 12 nt, Human
acccugagccgg

SEQ ID NO: 1416165 - RNA, 20 nt, Human
acccugaccuggcccccuca

SEQ ID NO: 1416166 - RNA, 16 nt, Human
acccugaccuggcccc

SEQ ID NO: 1416167 - RNA, 13 nt, Human
acccugaccuggc

SEQ ID NO: 1416168 - RNA, 17 nt, Human
acccugaccagcucccc

SEQ ID NO: 1416169 - RNA, 14 nt, Human
acccucauguucuu

SEQ ID NO: 1416170 - RNA, 15 nt, Human
acccucauguucuua

SEQ ID NO: 1416171 - RNA, 17 nt, Human
acccucauguucuuaau

SEQ ID NO: 1416172 - RNA, 11 nt, Human
acccucccucc

SEQ ID NO: 1416173 - RNA, 17 nt, Human
acccucccucccuaccc

SEQ ID NO: 1416174 - RNA, 23 nt, Human
acccuccccgcaccccccaagcu

SEQ ID NO: 1416175 - RNA, 17 nt, Human
acccucauucuacugaa

SEQ ID NO: 1416176 - RNA, 20 nt, Human
acccucaugcugugugacuc

SEQ ID NO: 1416177 - RNA, 18 nt, Human
accccagggcacaggagc

SEQ ID NO: 1416178 - RNA, 16 nt, Human
ucagagccgugguccu

SEQ ID NO: 1416179 - RNA, 22 nt, Human
ucagagccaugucuucucccug

SEQ ID NO: 1416180 - RNA, 19 nt, Human
ucagagcaggugcuggcuc

SEQ ID NO: 1416181 - RNA, 22 nt, Human
ucagagaugcaccaccaagcca

SEQ ID NO: 1416182 - RNA, 21 nt, Human
ucagagaugcaccaccaagcc

SEQ ID NO: 1416183 - RNA, 16 nt, Human
ucagagaugcaccacc

SEQ ID NO: 1416184 - RNA, 16 nt, Human
ucagagaggccuuuug

SEQ ID NO: 1416185 - RNA, 18 nt, Human
ucagagagcagugcuuuu

SEQ ID NO: 1416186 - RNA, 20 nt, Human
ucagagagcagugcuuuugg

SEQ ID NO: 1416187 - RNA, 15 nt, Human
ucagagagcagugcu

SEQ ID NO: 1416188 - RNA, 12 nt, Human
ucagagagcagu

SEQ ID NO: 1416189 - RNA, 19 nt, Human
ucagagagaauggcuuugg

SEQ ID NO: 1416190 - RNA, 20 nt, Human
ucagagccgugguccuuugg

SEQ ID NO: 1416191 - RNA, 16 nt, Human
ucagaucucuaacuuc

SEQ ID NO: 1416192 - RNA, 22 nt, Human
ucagaugcuccaagauucuaga

SEQ ID NO: 1416193 - RNA, 20 nt, Human
ucagaugcuccaagauucua

SEQ ID NO: 1416194 - RNA, 19 nt, Human
ucagaugcuccaagauucu

SEQ ID NO: 1416195 - RNA, 18 nt, Human
ucagaugcuccaagauuc

SEQ ID NO: 1416196 - RNA, 16 nt, Human
ucagaugcuccaagau

SEQ ID NO: 1416197 - RNA, 15 nt, Human
ucagaugcuccaaga

SEQ ID NO: 1416198 - RNA, 14 nt, Human
ucagaugcuccaag

SEQ ID NO: 1416199 - RNA, 20 nt, Human
ucagagaccagggcuccagc

SEQ ID NO: 1416200 - RNA, 16 nt, Human
ucagagaccagggcuc

SEQ ID NO: 1416201 - RNA, 15 nt, Human
ucagagaccagggcu

SEQ ID NO: 1416202 - RNA, 14 nt, Human
ucagagaccagggc

SEQ ID NO: 1416203 - RNA, 15 nt, Human
ucagagacaugcaga

SEQ ID NO: 1416204 - RNA, 12 nt, Human
ucagagaccagg

SEQ ID NO: 1416205 - RNA, 19 nt, Human
ucagagacaucagcccuug

SEQ ID NO: 1416206 - RNA, 22 nt, Human
ucagaauuagagcaugggaggu

SEQ ID NO: 1416207 - RNA, 23 nt, Human
ucagagaauuucuaccauuucag

SEQ ID NO: 1416208 - RNA, 16 nt, Human
ucagaauucucuaguu

SEQ ID NO: 1416209 - RNA, 13 nt, Human
ucagagaauuucu

SEQ ID NO: 1416210 - RNA, 17 nt, Human
acccagccaggcccagc

SEQ ID NO: 1416211 - RNA, 18 nt, Human
acccagccaggcccagcc

SEQ ID NO: 1416212 - RNA, 14 nt, Human
acccagccaggccc

SEQ ID NO: 1416213 - RNA, 13 nt, Human
acccagccaggcc

SEQ ID NO: 1416214 - RNA, 14 nt, Human
acccagcaauagag

SEQ ID NO: 1416215 - RNA, 18 nt, Human
ucagaaucccuuaacagu

SEQ ID NO: 1416216 - RNA, 16 nt, Human
acccagcccacccccg

SEQ ID NO: 1416217 - RNA, 15 nt, Human
ucagaauaugucagu

SEQ ID NO: 1416218 - RNA, 23 nt, Human
ucagaauagccacauuuggaaua

SEQ ID NO: 1416219 - RNA, 22 nt, Human
ucagaauagccacauuuggaau

SEQ ID NO: 1416220 - RNA, 21 nt, Human
ucagaauagccacauuuggaa

SEQ ID NO: 1416221 - RNA, 15 nt, Human
acccagcccaccccc

SEQ ID NO: 1416222 - RNA, 14 nt, Human
acccagcccacccc

SEQ ID NO: 1416223 - RNA, 16 nt, Human
ucagaauagaaauuag

SEQ ID NO: 1416224 - RNA, 23 nt, Human
ucagcccuaggguggagagccac

SEQ ID NO: 1416225 - RNA, 13 nt, Human
ucagcccucagaa

SEQ ID NO: 1416226 - RNA, 23 nt, Human
acccaggacuuauuuaaacucug

SEQ ID NO: 1416227 - RNA, 17 nt, Human
acccaggacaggaucca

SEQ ID NO: 1416228 - RNA, 20 nt, Human
acccaggacaggauccaggc

SEQ ID NO: 1416229 - RNA, 14 nt, Human
acccaggacaggau

SEQ ID NO: 1416230 - RNA, 22 nt, Human
ucagauucccagagcaaaauaa

SEQ ID NO: 1416231 - RNA, 21 nt, Human
ucagauucccagagcaaaaua

SEQ ID NO: 1416232 - RNA, 19 nt, Human
ucagauucccagagcaaaa

SEQ ID NO: 1416233 - RNA, 20 nt, Human
ucagauggaaaauucauuuu

SEQ ID NO: 1416234 - RNA, 19 nt, Human
ucagauggaaaauucauuu

SEQ ID NO: 1416235 - RNA, 12 nt, Human
ucagauggaaaa

SEQ ID NO: 1416236 - RNA, 16 nt, Human
ucagauuccuucccau

SEQ ID NO: 1416237 - RNA, 14 nt, Human
ucagauuccuuccc

SEQ ID NO: 1416238 - RNA, 15 nt, Human
ucagauuccuuccca

SEQ ID NO: 1416239 - RNA, 18 nt, Human
ucagcccucacacacccu

SEQ ID NO: 1416240 - RNA, 12 nt, Human
ucagcccucaga

SEQ ID NO: 1416241 - RNA, 19 nt, Human
ucagcccuaggguggagag

SEQ ID NO: 1416242 - RNA, 15 nt, Human
ucagauuucugagga

SEQ ID NO: 1416243 - RNA, 19 nt, Human
acccccacccccagcucaa

SEQ ID NO: 1416244 - RNA, 18 nt, Human
acccccacccccagcuca

SEQ ID NO: 1416245 - RNA, 15 nt, Human
acccccacccccagc

SEQ ID NO: 1416246 - RNA, 14 nt, Human
acccccacccccag

SEQ ID NO: 1416247 - RNA, 21 nt, Human
accccagggcagccagggaga

SEQ ID NO: 1416248 - RNA, 16 nt, Human
accccagggcagccag

SEQ ID NO: 1416249 - RNA, 15 nt, Human
accccagggcagcca

SEQ ID NO: 1416250 - RNA, 19 nt, Human
accccagggcacaggagcu

SEQ ID NO: 1416251 - RNA, 23 nt, Human
accccagggcuguaacugccagg

SEQ ID NO: 1416252 - RNA, 22 nt, Human
accccagggcuguaacugccag

SEQ ID NO: 1416253 - RNA, 17 nt, Human
accccagggcagccagg

SEQ ID NO: 1416254 - RNA, 14 nt, Human
acccaggucucccu

SEQ ID NO: 1416255 - RNA, 15 nt, Human
acccaggggcagccc

SEQ ID NO: 1416256 - RNA, 21 nt, Human
acccaggggcagccccaggcc

SEQ ID NO: 1416257 - RNA, 15 nt, Human
acccagggcucugua

SEQ ID NO: 1416258 - RNA, 12 nt, Human
acccagggcucu

SEQ ID NO: 1416259 - RNA, 13 nt, Human
acccagggcucug

SEQ ID NO: 1416260 - RNA, 19 nt, Human
accccagcuggggccaggc

SEQ ID NO: 1416261 - RNA, 22 nt, Human
accccagcuggggccaggcugg

SEQ ID NO: 1416262 - RNA, 18 nt, Human
acccaaagagguauuuau

SEQ ID NO: 1416263 - RNA, 14 nt, Human
acccacuucugcac

SEQ ID NO: 1416264 - RNA, 13 nt, Human
acccacuucugca

SEQ ID NO: 1416265 - RNA, 21 nt, Human
accauucugacucgguuucuc

SEQ ID NO: 1416266 - RNA, 13 nt, Human
accauucugacuc

SEQ ID NO: 1416267 - RNA, 17 nt, Human
accauguguuauguuuu

SEQ ID NO: 1416268 - RNA, 23 nt, Human
accauguuggccaggcuugucuc

SEQ ID NO: 1416269 - RNA, 17 nt, Human
accaugcugcuggggaa

SEQ ID NO: 1416270 - RNA, 16 nt, Human
accaugcugcugggga

SEQ ID NO: 1416271 - RNA, 14 nt, Human
accaugcugcuggg

SEQ ID NO: 1416272 - RNA, 20 nt, Human
accaugccaggcuaauuuuu

SEQ ID NO: 1416273 - RNA, 20 nt, Human
accaugcucaucugcugguc

SEQ ID NO: 1416274 - RNA, 19 nt, Human
accaugcucaucugcuggu

SEQ ID NO: 1416275 - RNA, 22 nt, Human
accaugcccggcuaauuuuugu

SEQ ID NO: 1416276 - RNA, 20 nt, Human
accaugcccggcuaauuuuu

SEQ ID NO: 1416277 - RNA, 19 nt, Human
accaugccaggcuaauuuu

SEQ ID NO: 1416278 - RNA, 16 nt, Human
accaugcaaaugcuau

SEQ ID NO: 1416279 - RNA, 18 nt, Human
accaugauuccuuuaaca

SEQ ID NO: 1416280 - RNA, 15 nt, Human
accaugauuccuuua

SEQ ID NO: 1416281 - RNA, 21 nt, Human
accagguccaaugagcuuucu

SEQ ID NO: 1416282 - RNA, 19 nt, Human
accagguccaaugagcuuu

SEQ ID NO: 1416283 - RNA, 18 nt, Human
accagguccaaugagcuu

SEQ ID NO: 1416284 - RNA, 21 nt, Human
accaggguugaccccagagga

SEQ ID NO: 1416285 - RNA, 20 nt, Human
accaggguugaccccagagg

SEQ ID NO: 1416286 - RNA, 21 nt, Human
accaggguccuuuugacacug

SEQ ID NO: 1416287 - RNA, 17 nt, Human
accagggguuucucgca

SEQ ID NO: 1416288 - RNA, 16 nt, Human
accagggguuucucgc

SEQ ID NO: 1416289 - RNA, 14 nt, Human
accagggguuucuc

SEQ ID NO: 1416290 - RNA, 23 nt, Human
accaugcugcuggggaagacagu

SEQ ID NO: 1416291 - RNA, 22 nt, Human
accaugcugcuggggaagacag

SEQ ID NO: 1416292 - RNA, 21 nt, Human
accaugcugcuggggaagaca

SEQ ID NO: 1416293 - RNA, 19 nt, Human
accaugcugcuggggaaga

SEQ ID NO: 1416294 - RNA, 18 nt, Human
accaugcugcuggggaag

SEQ ID NO: 1416295 - RNA, 21 nt, Human
accauggacacuacacccagc

SEQ ID NO: 1416296 - RNA, 22 nt, Human
accauggacacuacacccagca

SEQ ID NO: 1416297 - RNA, 23 nt, Human
accauggacacuacacccagcaa

SEQ ID NO: 1416298 - RNA, 16 nt, Human
accauggaguggcagc

SEQ ID NO: 1416299 - RNA, 24 nt, Human
accauggacacuacacccagcaau

SEQ ID NO: 1416300 - RNA, 23 nt, Human
accauggaguggcagcccagcca

SEQ ID NO: 1416301 - RNA, 22 nt, Human
accauggaguggcagcccagcc

SEQ ID NO: 1416302 - RNA, 21 nt, Human
accauggaguggcagcccagc

SEQ ID NO: 1416303 - RNA, 20 nt, Human
accauggccagcuaauuuuu

SEQ ID NO: 1416304 - RNA, 14 nt, Human
accaugucuuucuc

SEQ ID NO: 1416305 - RNA, 16 nt, Human
accaugucuuucucuc

SEQ ID NO: 1416306 - RNA, 18 nt, Human
accaugucauuucagaag

SEQ ID NO: 1416307 - RNA, 15 nt, Human
accaugucauuucag

SEQ ID NO: 1416308 - RNA, 12 nt, Human
accaugucauuu

SEQ ID NO: 1416309 - RNA, 22 nt, Human
accaugucaaggguucaagauu

SEQ ID NO: 1416310 - RNA, 16 nt, Human
ucacuucauaauccag

SEQ ID NO: 1416311 - RNA, 21 nt, Human
ucacuucagguauaccucacu

SEQ ID NO: 1416312 - RNA, 21 nt, Human
ucacuuaggaaauggcuuugu

SEQ ID NO: 1416313 - RNA, 22 nt, Human
ucacuuaaguuaguuccacuga

SEQ ID NO: 1416314 - RNA, 22 nt, Human
ucacuuaaacuugcaucacuua

SEQ ID NO: 1416315 - RNA, 18 nt, Human
ucacugcaagcuccgccu

SEQ ID NO: 1416316 - RNA, 16 nt, Human
ucacugcaaccuucac

SEQ ID NO: 1416317 - RNA, 18 nt, Human
ucacugcaaccucugccu

SEQ ID NO: 1416318 - RNA, 23 nt, Human
ucacugaguuuuccauggcagga

SEQ ID NO: 1416319 - RNA, 17 nt, Human
ucacugaguuuuccaug

SEQ ID NO: 1416320 - RNA, 17 nt, Human
ucacugcaacaugauga

SEQ ID NO: 1416321 - RNA, 21 nt, Human
ucacugaguuuuccauggcag

SEQ ID NO: 1416322 - RNA, 14 nt, Human
ucacugcaaccucc

SEQ ID NO: 1416323 - RNA, 20 nt, Human
ucacugcaacaugaugaggu

SEQ ID NO: 1416324 - RNA, 18 nt, Human
ucacugcaaccuccaccu

SEQ ID NO: 1416325 - RNA, 21 nt, Human
ucacucaucaauggggccagu

SEQ ID NO: 1416326 - RNA, 20 nt, Human
ucacucagccacccugaguu

SEQ ID NO: 1416327 - RNA, 19 nt, Human
ucacucagccacccugagu

SEQ ID NO: 1416328 - RNA, 12 nt, Human
ucacucaaggcg

SEQ ID NO: 1416329 - RNA, 20 nt, Human
ucacucaaggcggugcuuga

SEQ ID NO: 1416330 - RNA, 19 nt, Human
ucacauuccugaacaggau

SEQ ID NO: 1416331 - RNA, 16 nt, Human
ucaccagcccuggcaa

SEQ ID NO: 1416332 - RNA, 16 nt, Human
ucacugaagcuuuuua

SEQ ID NO: 1416333 - RNA, 18 nt, Human
ucacugagaccaaggcuu

SEQ ID NO: 1416334 - RNA, 21 nt, Human
ucacugaacuuugcugagccu

SEQ ID NO: 1416335 - RNA, 17 nt, Human
accacaaugcagugccu

SEQ ID NO: 1416336 - RNA, 20 nt, Human
accacaacuauuuucagaug

SEQ ID NO: 1416337 - RNA, 17 nt, Human
accaaugaaaaaaugua

SEQ ID NO: 1416338 - RNA, 14 nt, Human
accaaugaaaaaau

SEQ ID NO: 1416339 - RNA, 13 nt, Human
accaauccuggac

SEQ ID NO: 1416340 - RNA, 17 nt, Human
accaauccuaugcaugg

SEQ ID NO: 1416341 - RNA, 14 nt, Human
accaacccucaggg

SEQ ID NO: 1416342 - RNA, 15 nt, Human
accaacccucagggc

SEQ ID NO: 1416343 - RNA, 13 nt, Human
accaacccucagg

SEQ ID NO: 1416344 - RNA, 21 nt, Human
accaauguacccaccgggcca

SEQ ID NO: 1416345 - RNA, 13 nt, Human
accaaugucuuga

SEQ ID NO: 1416346 - RNA, 12 nt, Human
accaaugucuug

SEQ ID NO: 1416347 - RNA, 14 nt, Human
accaauguacccac

SEQ ID NO: 1416348 - RNA, 21 nt, Human
accacaacaugaggccacugg

SEQ ID NO: 1416349 - RNA, 17 nt, Human
accacaacaugaggcca

SEQ ID NO: 1416350 - RNA, 13 nt, Human
accacaacaugag

SEQ ID NO: 1416351 - RNA, 22 nt, Human
accacaaacuguaauacaauga

SEQ ID NO: 1416352 - RNA, 16 nt, Human
accacaagacugcaca

SEQ ID NO: 1416353 - RNA, 20 nt, Human
accaacaaucuuccuguuua

SEQ ID NO: 1416354 - RNA, 20 nt, Human
accaaaugugcuuugagaag

SEQ ID NO: 1416355 - RNA, 23 nt, Human
accaacauaaaaaugaucuaaac

SEQ ID NO: 1416356 - RNA, 15 nt, Human
accaacauaaaaaug

SEQ ID NO: 1416357 - RNA, 14 nt, Human
accaacauaaaaau

SEQ ID NO: 1416358 - RNA, 23 nt, Human
accaaaucaaaaucucuccacuu

SEQ ID NO: 1416359 - RNA, 15 nt, Human
accaaaucuggaagc

SEQ ID NO: 1416360 - RNA, 13 nt, Human
accaaaucuggaa

SEQ ID NO: 1416361 - RNA, 22 nt, Human
accaaaucaaaaucucuccacu

SEQ ID NO: 1416362 - RNA, 20 nt, Human
accaaaucaaaaucucucca

SEQ ID NO: 1416363 - RNA, 15 nt, Human
accaaaucaaaaucu

SEQ ID NO: 1416364 - RNA, 14 nt, Human
accaaaucaaaauc

SEQ ID NO: 1416365 - RNA, 23 nt, Human
accaaaguucuaauaauuucuaa

SEQ ID NO: 1416366 - RNA, 21 nt, Human
accaaaguucuaauaauuucu

SEQ ID NO: 1416367 - RNA, 20 nt, Human
accaaaguucuaauaauuuc

SEQ ID NO: 1416368 - RNA, 15 nt, Human
accaaaguucuaaua

SEQ ID NO: 1416369 - RNA, 14 nt, Human
accaaaguucuaau

SEQ ID NO: 1416370 - RNA, 23 nt, Human
accaaaaaucucaauauuucaga

SEQ ID NO: 1416371 - RNA, 21 nt, Human
ucacaugaugcacuucaaauu

SEQ ID NO: 1416372 - RNA, 20 nt, Human
ucacaucagagugacaucca

SEQ ID NO: 1416373 - RNA, 22 nt, Human
ucacauauuuuaaaauuuguuc

SEQ ID NO: 1416374 - RNA, 14 nt, Human
ucacauauuuuaaa

SEQ ID NO: 1416375 - RNA, 18 nt, Human
ucacauauugauuuccgu

SEQ ID NO: 1416376 - RNA, 20 nt, Human
ucacauauugauuuccguua

SEQ ID NO: 1416377 - RNA, 16 nt, Human
ucacagcuccucccac

SEQ ID NO: 1416378 - RNA, 14 nt, Human
ucacagcuccuccc

SEQ ID NO: 1416379 - RNA, 11 nt, Human
ucacagcuccu

SEQ ID NO: 1416380 - RNA, 22 nt, Human
ucacagcuuauuuccucauuuu

SEQ ID NO: 1416381 - RNA, 15 nt, Human
ucacagcuucagcca

SEQ ID NO: 1416382 - RNA, 16 nt, Human
ucacagcuucagccag

SEQ ID NO: 1416383 - RNA, 17 nt, Human
ucacagcuucagccagg

SEQ ID NO: 1416384 - RNA, 19 nt, Human
ucacagcuucagccaggag

SEQ ID NO: 1416385 - RNA, 16 nt, Human
ucacauauugauuucc

SEQ ID NO: 1416386 - RNA, 15 nt, Human
ucacauuagaagaca

SEQ ID NO: 1416387 - RNA, 14 nt, Human
ucacauuagaagac

SEQ ID NO: 1416388 - RNA, 12 nt, Human
ucacauuagaag

SEQ ID NO: 1416389 - RNA, 21 nt, Human
ucacaugucaguaccuucaaa

SEQ ID NO: 1416390 - RNA, 20 nt, Human
ucacauuccugaacaggaua

SEQ ID NO: 1416391 - RNA, 22 nt, Human
ucacauuagaagacaauugaca

SEQ ID NO: 1416392 - RNA, 17 nt, Human
ucacauuccugaacagg

SEQ ID NO: 1416393 - RNA, 13 nt, Human
ucacauuccugaa

SEQ ID NO: 1416394 - RNA, 16 nt, Human
ucacagccaccccuga

SEQ ID NO: 1416395 - RNA, 13 nt, Human
ucacagcccagcc

SEQ ID NO: 1416396 - RNA, 15 nt, Human
ucacagcccagcccg

SEQ ID NO: 1416397 - RNA, 19 nt, Human
ucacagcuccaagaauuuc

SEQ ID NO: 1416398 - RNA, 16 nt, Human
ucacagccacuuggga

SEQ ID NO: 1416399 - RNA, 17 nt, Human
accacacccacacucag

SEQ ID NO: 1416400 - RNA, 23 nt, Human
ucacagaaguguuaacuuuucua

SEQ ID NO: 1416401 - RNA, 16 nt, Human
ucacagaccuuugaac

SEQ ID NO: 1416402 - RNA, 15 nt, Human
ucaauccagcuaugu

SEQ ID NO: 1416403 - RNA, 16 nt, Human
ucaaucauuucuauua

SEQ ID NO: 1416404 - RNA, 13 nt, Human
ucaaucauuucua

SEQ ID NO: 1416405 - RNA, 21 nt, Human
ucaaucagucucagaauguca

SEQ ID NO: 1416406 - RNA, 22 nt, Human
ucaaucagucucagaaugucau

SEQ ID NO: 1416407 - RNA, 19 nt, Human
ucaaucagucucagaaugu

SEQ ID NO: 1416408 - RNA, 17 nt, Human
ucaauauuuucuuuucc

SEQ ID NO: 1416409 - RNA, 16 nt, Human
ucaauauuuuuagaua

SEQ ID NO: 1416410 - RNA, 23 nt, Human
ucaauauuucagauaaucacaau

SEQ ID NO: 1416411 - RNA, 15 nt, Human
ucaaguaauacaaac

SEQ ID NO: 1416412 - RNA, 23 nt, Human
ucaagguuuuagguucuaaaguu

SEQ ID NO: 1416413 - RNA, 22 nt, Human
ucaagguuuuagguucuaaagu

SEQ ID NO: 1416414 - RNA, 21 nt, Human
ucaagguuuuagguucuaaag

SEQ ID NO: 1416415 - RNA, 20 nt, Human
ucaagaggagcccccacccu

SEQ ID NO: 1416416 - RNA, 18 nt, Human
acauucaacagagacuga

SEQ ID NO: 1416417 - RNA, 24 nt, Human
acauucaaaauaggguauauuuuc

SEQ ID NO: 1416418 - RNA, 18 nt, Human
acauuauuaucaacaaua

SEQ ID NO: 1416419 - RNA, 22 nt, Human
acauuaugugguuuuagauuuu

SEQ ID NO: 1416420 - RNA, 21 nt, Human
acauuaugugguuuuagauuu

SEQ ID NO: 1416421 - RNA, 19 nt, Human
acauuaugugguuuuagau

SEQ ID NO: 1416422 - RNA, 20 nt, Human
acauuauauuucuauuuuau

SEQ ID NO: 1416423 - RNA, 16 nt, Human
ucaagauuguuccugc

SEQ ID NO: 1416424 - RNA, 21 nt, Human
ucaagagugaauucccucacu

SEQ ID NO: 1416425 - RNA, 13 nt, Human
ucaagaggagccc

SEQ ID NO: 1416426 - RNA, 20 nt, Human
ucaagagugaauucccucac

SEQ ID NO: 1416427 - RNA, 19 nt, Human
ucaagagugaauucccuca

SEQ ID NO: 1416428 - RNA, 16 nt, Human
ucaaggcacucuagau

SEQ ID NO: 1416429 - RNA, 15 nt, Human
ucaaggcacucuaga

SEQ ID NO: 1416430 - RNA, 14 nt, Human
ucaaggcacucuag

SEQ ID NO: 1416431 - RNA, 13 nt, Human
ucaaggcacucua

SEQ ID NO: 1416432 - RNA, 22 nt, Human
ucaagcagcgaccgcccccucc

SEQ ID NO: 1416433 - RNA, 21 nt, Human
ucaagcagcgaccgcccccuc

SEQ ID NO: 1416434 - RNA, 18 nt, Human
ucaagcagcgaccgcccc

SEQ ID NO: 1416435 - RNA, 19 nt, Human
ucaagauuguuccugcuuu

SEQ ID NO: 1416436 - RNA, 17 nt, Human
ucaagcaagauuucaga

SEQ ID NO: 1416437 - RNA, 21 nt, Human
ucaaggcacucuagauuccau

SEQ ID NO: 1416438 - RNA, 20 nt, Human
ucaaggcacucuagauucca

SEQ ID NO: 1416439 - RNA, 18 nt, Human
ucaaggcacucuagauuc

SEQ ID NO: 1416440 - RNA, 17 nt, Human
ucaaggcacucuagauu

SEQ ID NO: 1416441 - RNA, 11 nt, Human
ucaaggcucag

SEQ ID NO: 1416442 - RNA, 16 nt, Human
ucaaggcggugcuuga

SEQ ID NO: 1416443 - RNA, 15 nt, Human
ucaaggucugcuuuu

SEQ ID NO: 1416444 - RNA, 20 nt, Human
ucaagguuuuagguucuaaa

SEQ ID NO: 1416445 - RNA, 18 nt, Human
ucaagguuuuagguucua

SEQ ID NO: 1416446 - RNA, 13 nt, Human
ucaagguuuuagg

SEQ ID NO: 1416447 - RNA, 14 nt, Human
ucaagguucuaacc

SEQ ID NO: 1416448 - RNA, 11 nt, Human
ucaagguucua

SEQ ID NO: 1416449 - RNA, 21 nt, Human
ucaaggucguuuuuuucauuc

SEQ ID NO: 1416450 - RNA, 14 nt, Human
ucaaggucugcuuu

SEQ ID NO: 1416451 - RNA, 20 nt, Human
acauuuuuuaggaaauguuu

SEQ ID NO: 1416452 - RNA, 16 nt, Human
acauuuuuuaggaaau

SEQ ID NO: 1416453 - RNA, 13 nt, Human
acauuuuucuuag

SEQ ID NO: 1416454 - RNA, 23 nt, Human
acauuuuucuuagggaaggauac

SEQ ID NO: 1416455 - RNA, 15 nt, Human
acauuuuuaagugcu

SEQ ID NO: 1416456 - RNA, 18 nt, Human
acauuuuuaagugcugca

SEQ ID NO: 1416457 - RNA, 19 nt, Human
acauuuuuaagugcugcau

SEQ ID NO: 1416458 - RNA, 15 nt, Human
acauuuuacauuaaa

SEQ ID NO: 1416459 - RNA, 18 nt, Human
acauuuuacauuaaauuu

SEQ ID NO: 1416460 - RNA, 15 nt, Human
acauuuacaaacuga

SEQ ID NO: 1416461 - RNA, 22 nt, Human
acauuuaaaacauuaaaauaua

SEQ ID NO: 1416462 - RNA, 21 nt, Human
acauuuacaaacugaagagua

SEQ ID NO: 1416463 - RNA, 17 nt, Human
acauuuacaaacugaag

SEQ ID NO: 1416464 - RNA, 16 nt, Human
acauuuacaaacugaa

SEQ ID NO: 1416465 - RNA, 14 nt, Human
acauuuuacauuaa

SEQ ID NO: 1416466 - RNA, 23 nt, Human
acauugcguuugaccuuuuaugu

SEQ ID NO: 1416467 - RNA, 15 nt, Human
acauugcguuugacc

SEQ ID NO: 1416468 - RNA, 22 nt, Human
acauuggcaccuaauccaggca

SEQ ID NO: 1416469 - RNA, 21 nt, Human
acauuggcaccuaauccaggc

SEQ ID NO: 1416470 - RNA, 17 nt, Human
acauuggaauguucuca

SEQ ID NO: 1416471 - RNA, 15 nt, Human
acauuggaauguucu

SEQ ID NO: 1416472 - RNA, 12 nt, Human
acauugcuuuuc

SEQ ID NO: 1416473 - RNA, 16 nt, Human
acauuggaaacaaguc

SEQ ID NO: 1416474 - RNA, 18 nt, Human
acauuuaaaacauuaaaa

SEQ ID NO: 1416475 - RNA, 14 nt, Human
acauuuaaaacauu

SEQ ID NO: 1416476 - RNA, 22 nt, Human
acauugguucuuucauuugcuu

SEQ ID NO: 1416477 - RNA, 21 nt, Human
acauguauugcacauuguaaa

SEQ ID NO: 1416478 - RNA, 15 nt, Human
acaugucuuaaugaa

SEQ ID NO: 1416479 - RNA, 19 nt, Human
acauguauugcacauugua

SEQ ID NO: 1416480 - RNA, 18 nt, Human
acauguauugcacauugu

SEQ ID NO: 1416481 - RNA, 21 nt, Human
acauguaucuaugcauuuucu

SEQ ID NO: 1416482 - RNA, 18 nt, Human
acauguaucuaugcauuu

SEQ ID NO: 1416483 - RNA, 18 nt, Human
acaugguuaccaugucuu

SEQ ID NO: 1416484 - RNA, 19 nt, Human
acaugguuaccaugucuuu

SEQ ID NO: 1416485 - RNA, 19 nt, Human
acaugguggguccaugggc

SEQ ID NO: 1416486 - RNA, 18 nt, Human
acaugguggguccauggg

SEQ ID NO: 1416487 - RNA, 23 nt, Human
acauggugcugggagaggcagcc

SEQ ID NO: 1416488 - RNA, 16 nt, Human
acauggugcugggaga

SEQ ID NO: 1416489 - RNA, 21 nt, Human
acauuagaagacaauugacaa

SEQ ID NO: 1416490 - RNA, 20 nt, Human
acauuagaagacaauugaca

SEQ ID NO: 1416491 - RNA, 15 nt, Human
acauuagaagacaau

SEQ ID NO: 1416492 - RNA, 14 nt, Human
acauuagaagacaa

SEQ ID NO: 1416493 - RNA, 19 nt, Human
acauuaauagcagccuuuc

SEQ ID NO: 1416494 - RNA, 18 nt, Human
acauuaauauacuugaau

SEQ ID NO: 1416495 - RNA, 18 nt, Human
acauuaauagcagccuuu

SEQ ID NO: 1416496 - RNA, 16 nt, Human
acaugucuuaaugaag

SEQ ID NO: 1416497 - RNA, 18 nt, Human
acaugucuuaaugaaguu

SEQ ID NO: 1416498 - RNA, 20 nt, Human
acaugucuuaaugaaguuug

SEQ ID NO: 1416499 - RNA, 21 nt, Human
acaugucuuaaugaaguuuga

SEQ ID NO: 1416500 - RNA, 22 nt, Human
acaugucuuaaugaaguuugaa

SEQ ID NO: 1416501 - RNA, 23 nt, Human
acaugucuuaaugaaguuugaau

SEQ ID NO: 1416502 - RNA, 13 nt, Human
acaugaggccacu

SEQ ID NO: 1416503 - RNA, 15 nt, Human
acaugaggccacugg

SEQ ID NO: 1416504 - RNA, 22 nt, Human
acaugaggacucuauucuuuaa

SEQ ID NO: 1416505 - RNA, 21 nt, Human
acaugaggacucuauucuuua

SEQ ID NO: 1416506 - RNA, 20 nt, Human
acaugaggacucuauucuuu

SEQ ID NO: 1416507 - RNA, 18 nt, Human
acaugaggacucuauucu

SEQ ID NO: 1416508 - RNA, 13 nt, Human
acaugaggacucu

SEQ ID NO: 1416509 - RNA, 19 nt, Human
acauggagguucuaaggcc

SEQ ID NO: 1416510 - RNA, 18 nt, Human
acauggagguucuaaggc

SEQ ID NO: 1416511 - RNA, 17 nt, Human
acauggagguucuaagg

SEQ ID NO: 1416512 - RNA, 16 nt, Human
acauggagguucuaag

SEQ ID NO: 1416513 - RNA, 15 nt, Human
acauggagguucuaa

SEQ ID NO: 1416514 - RNA, 14 nt, Human
acauggagguucua

SEQ ID NO: 1416515 - RNA, 22 nt, Human
acauggccccucccccugccag

SEQ ID NO: 1416516 - RNA, 21 nt, Human
acauggccccucccccugcca

SEQ ID NO: 1416517 - RNA, 13 nt, Human
acauggcacagag

SEQ ID NO: 1416518 - RNA, 22 nt, Human
acauggcuggagcuagaauuug

SEQ ID NO: 1416519 - RNA, 21 nt, Human
ucaaaaguuccaagagucuaa

SEQ ID NO: 1416520 - RNA, 17 nt, Human
ucaaaaguuccaagagu

SEQ ID NO: 1416521 - RNA, 15 nt, Human
ucaaaaguuccaaga

SEQ ID NO: 1416522 - RNA, 14 nt, Human
ucaaaaguuccaag

SEQ ID NO: 1416523 - RNA, 13 nt, Human
ucaaaaguuccaa

SEQ ID NO: 1416524 - RNA, 20 nt, Human
ucaaaagggccaaagaacca

SEQ ID NO: 1416525 - RNA, 21 nt, Human
ucaaaagggccaaagaaccaa

SEQ ID NO: 1416526 - RNA, 14 nt, Human
ucaaaagggccaaa

SEQ ID NO: 1416527 - RNA, 20 nt, Human
ucaaagcaaggaaacuaugu

SEQ ID NO: 1416528 - RNA, 16 nt, Human
ucaaagcaaggaaacu

SEQ ID NO: 1416529 - RNA, 15 nt, Human
ucaaagcaaggaaac

SEQ ID NO: 1416530 - RNA, 22 nt, Human
ucaaagcaagcauucagaagaa

SEQ ID NO: 1416531 - RNA, 21 nt, Human
ucaaagcaagcauucagaaga

SEQ ID NO: 1416532 - RNA, 19 nt, Human
ucaaagcaagcauucagaa

SEQ ID NO: 1416533 - RNA, 15 nt, Human
ucaaagcaagcauuc

SEQ ID NO: 1416534 - RNA, 13 nt, Human
ucaaagcaagcau

SEQ ID NO: 1416535 - RNA, 19 nt, Human
ucaaagaugcugugagucu

SEQ ID NO: 1416536 - RNA, 12 nt, Human
ucaaagaugcug

SEQ ID NO: 1416537 - RNA, 22 nt, Human
ucaaagauauuuugcuuuguga

SEQ ID NO: 1416538 - RNA, 13 nt, Human
ucaaagauauuuu

SEQ ID NO: 1416539 - RNA, 20 nt, Human
ucaaagauauuuugcuuugu

SEQ ID NO: 1416540 - RNA, 21 nt, Human
acaugacccuaaaucuugacu

SEQ ID NO: 1416541 - RNA, 19 nt, Human
acaugacccuaaaucuuga

SEQ ID NO: 1416542 - RNA, 22 nt, Human
acaugaauuuuagcuuuugugg

SEQ ID NO: 1416543 - RNA, 19 nt, Human
acaugaauuuuagcuuuug

SEQ ID NO: 1416544 - RNA, 13 nt, Human
acaugaagaagcu

SEQ ID NO: 1416545 - RNA, 22 nt, Human
acaugaacuuagauuuuacaug

SEQ ID NO: 1416546 - RNA, 20 nt, Human
acaugaacuuagauuuuaca

SEQ ID NO: 1416547 - RNA, 15 nt, Human
acaugagaacaaaca

SEQ ID NO: 1416548 - RNA, 19 nt, Human
acaugaacuuagauuuuac

SEQ ID NO: 1416549 - RNA, 14 nt, Human
acaugaacuuagau

SEQ ID NO: 1416550 - RNA, 17 nt, Human
acaugaaaggacccugu

SEQ ID NO: 1416551 - RNA, 15 nt, Human
acaugaaacagaaac

SEQ ID NO: 1416552 - RNA, 13 nt, Human
acaugaaacagaa

SEQ ID NO: 1416553 - RNA, 21 nt, Human
ucaaauauauucagccuggcu

SEQ ID NO: 1416554 - RNA, 23 nt, Human
acaugaaaacacauuuuucuuag

SEQ ID NO: 1416555 - RNA, 19 nt, Human
ucaaaguguuuucucugaa

SEQ ID NO: 1416556 - RNA, 18 nt, Human
ucaaagguuuggaaggag

SEQ ID NO: 1416557 - RNA, 23 nt, Human
ucaaagguucuagguuucaaaga

SEQ ID NO: 1416558 - RNA, 21 nt, Human
ucaaagguucuagguuucaaa

SEQ ID NO: 1416559 - RNA, 20 nt, Human
ucaaagguucuagguuucaa

SEQ ID NO: 1416560 - RNA, 16 nt, Human
ucaaagguucuagguu

SEQ ID NO: 1416561 - RNA, 12 nt, Human
ucaaagguucua

SEQ ID NO: 1416562 - RNA, 18 nt, Human
ucaaaguguuuucucuga

SEQ ID NO: 1416563 - RNA, 23 nt, Human
ucaaauacgugggcauucaaaug

SEQ ID NO: 1416564 - RNA, 13 nt, Human
ucaaauauauuca

SEQ ID NO: 1416565 - RNA, 22 nt, Human
ucaaauacgugggcauucaaau

SEQ ID NO: 1416566 - RNA, 21 nt, Human
ucaaauacgugggcauucaaa

SEQ ID NO: 1416567 - RNA, 21 nt, Human
uauuuuguuuugugcagagau

SEQ ID NO: 1416568 - RNA, 20 nt, Human
uauuuuuggcagucugaauu

SEQ ID NO: 1416569 - RNA, 19 nt, Human
uauuuuuggcagucugaau

SEQ ID NO: 1416570 - RNA, 12 nt, Human
uauuuuuggagg

SEQ ID NO: 1416571 - RNA, 16 nt, Human
uauuuuuggagguuua

SEQ ID NO: 1416572 - RNA, 21 nt, Human
uauuuuguaaacucaaaauau

SEQ ID NO: 1416573 - RNA, 20 nt, Human
uauuuuguaaacucaaaaua

SEQ ID NO: 1416574 - RNA, 13 nt, Human
uauuuuguaaacu

SEQ ID NO: 1416575 - RNA, 17 nt, Human
uauuuuguguuuaggaa

SEQ ID NO: 1416576 - RNA, 20 nt, Human
uauuuuguguuuaggaacua

SEQ ID NO: 1416577 - RNA, 14 nt, Human
uauuuugcuggaau

SEQ ID NO: 1416578 - RNA, 23 nt, Human
uauuuugccaagggcauaaauua

SEQ ID NO: 1416579 - RNA, 22 nt, Human
uauuuugccaagggcauaaauu

SEQ ID NO: 1416580 - RNA, 21 nt, Human
uauuuugcaguucccacauua

SEQ ID NO: 1416581 - RNA, 17 nt, Human
uauuuugauguaaagau

SEQ ID NO: 1416582 - RNA, 23 nt, Human
uauuuuggauuguauauuguguu

SEQ ID NO: 1416583 - RNA, 20 nt, Human
uauuuuggauuguauauugu

SEQ ID NO: 1416584 - RNA, 20 nt, Human
uauuuugcuuugugauuuuu

SEQ ID NO: 1416585 - RNA, 13 nt, Human
uauuuugcuuugu

SEQ ID NO: 1416586 - RNA, 15 nt, Human
uauuuugcuuuguga

SEQ ID NO: 1416587 - RNA, 23 nt, Human
uauuuuacaauuuuuuaucaugc

SEQ ID NO: 1416588 - RNA, 14 nt, Human
uauuuuacaauuuu

SEQ ID NO: 1416589 - RNA, 13 nt, Human
uauuuuacauaaa

SEQ ID NO: 1416590 - RNA, 22 nt, Human
uauuuuaauaauguuucaaaca

SEQ ID NO: 1416591 - RNA, 19 nt, Human
uauuuuaauaauguuucaa

SEQ ID NO: 1416592 - RNA, 17 nt, Human
uauuuuaauaaacacuc

SEQ ID NO: 1416593 - RNA, 14 nt, Human
uauuuuaaagaauu

SEQ ID NO: 1416594 - RNA, 16 nt, Human
uauuuuaaagaauugu

SEQ ID NO: 1416595 - RNA, 13 nt, Human
uauuuuaaagaau

SEQ ID NO: 1416596 - RNA, 12 nt, Human
uauuuuaaagaa

SEQ ID NO: 1416597 - RNA, 14 nt, Human
uauuuuaauaaaca

SEQ ID NO: 1416598 - RNA, 19 nt, Human
uauuuguuaauaguuccug

SEQ ID NO: 1416599 - RNA, 21 nt, Human
uauuuguguuuuaauuuaaac

SEQ ID NO: 1416600 - RNA, 19 nt, Human
uauuuguguuuuaauuuaa

SEQ ID NO: 1416601 - RNA, 12 nt, Human
uauuuguguuuu

SEQ ID NO: 1416602 - RNA, 20 nt, Human
uauuugucaugcugggauuu

SEQ ID NO: 1416603 - RNA, 22 nt, Human
uauuuguauaaaagugugaaau

SEQ ID NO: 1416604 - RNA, 18 nt, Human
uauuuguauaaaagugug

SEQ ID NO: 1416605 - RNA, 12 nt, Human
uauuuguacaua

SEQ ID NO: 1416606 - RNA, 15 nt, Human
uauuuguaauuaaaa

SEQ ID NO: 1416607 - RNA, 14 nt, Human
uauuuguaauuaaa

SEQ ID NO: 1416608 - RNA, 13 nt, Human
uauuuguaauuaa

SEQ ID NO: 1416609 - RNA, 12 nt, Human
uauuuguaauua

SEQ ID NO: 1416610 - RNA, 20 nt, Human
uauuuguaauagauguuuga

SEQ ID NO: 1416611 - RNA, 15 nt, Human
uauuuguaauagaug

SEQ ID NO: 1416612 - RNA, 14 nt, Human
uauuuguaauagau

SEQ ID NO: 1416613 - RNA, 16 nt, Human
acaugaaaacacauuu

SEQ ID NO: 1416614 - RNA, 15 nt, Human
acaugaaaacacauu

SEQ ID NO: 1416615 - RNA, 18 nt, Human
uauuuuaaaagaaugauu

SEQ ID NO: 1416616 - RNA, 21 nt, Human
uauuuguuuaugguaaaaaau

SEQ ID NO: 1416617 - RNA, 17 nt, Human
uauuuguucccaagagc

SEQ ID NO: 1416618 - RNA, 14 nt, Human
uauuuuaaaagaau

SEQ ID NO: 1416619 - RNA, 17 nt, Human
uauuuuaaaauuuguuc

SEQ ID NO: 1416620 - RNA, 14 nt, Human
uauuuuaaaauuug

SEQ ID NO: 1416621 - RNA, 13 nt, Human
uauuuuaaaauuu

SEQ ID NO: 1416622 - RNA, 18 nt, Human
uauuuuaaaaucugucac

SEQ ID NO: 1416623 - RNA, 23 nt, Human
uauuuuaaaauagcguucuugua

SEQ ID NO: 1416624 - RNA, 22 nt, Human
uauuuuaaaauagcguucuugu

SEQ ID NO: 1416625 - RNA, 14 nt, Human
uauuuuaagacgaa

SEQ ID NO: 1416626 - RNA, 22 nt, Human
uauuuuaagacgaaacauuugu

SEQ ID NO: 1416627 - RNA, 23 nt, Human
acaucuugucauuuuuuuucuuu

SEQ ID NO: 1416628 - RNA, 23 nt, Human
acaucuuugaaauuauguaaauu

SEQ ID NO: 1416629 - RNA, 22 nt, Human
acaucuuugaaauuauguaaau

SEQ ID NO: 1416630 - RNA, 17 nt, Human
acaucuuugaaauuaug

SEQ ID NO: 1416631 - RNA, 14 nt, Human
acaucuuugaaauu

SEQ ID NO: 1416632 - RNA, 13 nt, Human
acaucuuuauccg

SEQ ID NO: 1416633 - RNA, 11 nt, Human
acaucuuuaag

SEQ ID NO: 1416634 - RNA, 20 nt, Human
acaucuuuaaggggaggaac

SEQ ID NO: 1416635 - RNA, 19 nt, Human
uaugugguuuuagauuuuc

SEQ ID NO: 1416636 - RNA, 18 nt, Human
uaugugguuuuagauuuu

SEQ ID NO: 1416637 - RNA, 16 nt, Human
uaugugguuuuagauu

SEQ ID NO: 1416638 - RNA, 23 nt, Human
uaugugccagauuuaugcauauu

SEQ ID NO: 1416639 - RNA, 14 nt, Human
uaugugccagauuu

SEQ ID NO: 1416640 - RNA, 19 nt, Human
uaugugccagauuuaugca

SEQ ID NO: 1416641 - RNA, 24 nt, Human
ucuaagaugugauauucuaagacu

SEQ ID NO: 1416642 - RNA, 22 nt, Human
ucuaagaugugauauucuaaga

SEQ ID NO: 1416643 - RNA, 21 nt, Human
ucuaagaugugauauucuaag

SEQ ID NO: 1416644 - RNA, 20 nt, Human
ucuaagaugugauauucuaa

SEQ ID NO: 1416645 - RNA, 19 nt, Human
ucuaagaugugauauucua

SEQ ID NO: 1416646 - RNA, 18 nt, Human
ucuaagaugugauauucu

SEQ ID NO: 1416647 - RNA, 13 nt, Human
ucuaagaugugau

SEQ ID NO: 1416648 - RNA, 12 nt, Human
ucuaagauguga

SEQ ID NO: 1416649 - RNA, 21 nt, Human
ucuaagaucuuagauucucug

SEQ ID NO: 1416650 - RNA, 19 nt, Human
ucuaagaucuuagauucuc

SEQ ID NO: 1416651 - RNA, 17 nt, Human
ucuaagaucuuagauuc

SEQ ID NO: 1416652 - RNA, 15 nt, Human
ucuaagaucuuagau

SEQ ID NO: 1416653 - RNA, 12 nt, Human
ucuaagaucuua

SEQ ID NO: 1416654 - RNA, 23 nt, Human
ucuaagacuuacucuaagaucuu

SEQ ID NO: 1416655 - RNA, 20 nt, Human
ucuaagagaacaaugugcua

SEQ ID NO: 1416656 - RNA, 20 nt, Human
ucuaagacuuacucuaagau

SEQ ID NO: 1416657 - RNA, 19 nt, Human
ucuaagacuuacucuaaga

SEQ ID NO: 1416658 - RNA, 22 nt, Human
ucuaagacucaaauguucuaag

SEQ ID NO: 1416659 - RNA, 21 nt, Human
ucuaagacucaaauguucuaa

SEQ ID NO: 1416660 - RNA, 19 nt, Human
ucuaagacucaaauguucu

SEQ ID NO: 1416661 - RNA, 18 nt, Human
ucuaagacucaaauguuc

SEQ ID NO: 1416662 - RNA, 16 nt, Human
ucuaagacucaaaugu

SEQ ID NO: 1416663 - RNA, 19 nt, Human
ucuaagaaauugaauacuu

SEQ ID NO: 1416664 - RNA, 24 nt, Human
ucuaagaaauugaauacuuugaau

SEQ ID NO: 1416665 - RNA, 16 nt, Human
ucuaagaaauugaaua

SEQ ID NO: 1416666 - RNA, 12 nt, Human
ucuaagaaauug

SEQ ID NO: 1416667 - RNA, 12 nt, Human
ucuaagaaagaa

SEQ ID NO: 1416668 - RNA, 18 nt, Human
ucuaagaaacauuuauau

SEQ ID NO: 1416669 - RNA, 13 nt, Human
ucuaagaaagaac

SEQ ID NO: 1416670 - RNA, 22 nt, Human
ucuaagaaacauuuauauugau

SEQ ID NO: 1416671 - RNA, 17 nt, Human
ucuaagaaacauuuaua

SEQ ID NO: 1416672 - RNA, 15 nt, Human
ucuaagaaacauuua

SEQ ID NO: 1416673 - RNA, 19 nt, Human
ucuaacuuggcucacacuc

SEQ ID NO: 1416674 - RNA, 13 nt, Human
ucuaagaaacauu

SEQ ID NO: 1416675 - RNA, 18 nt, Human
ucuaaaggaguuuauguu

SEQ ID NO: 1416676 - RNA, 17 nt, Human
ucuaaaggaguuuaugu

SEQ ID NO: 1416677 - RNA, 19 nt, Human
ucuaaacuggagacugugu

SEQ ID NO: 1416678 - RNA, 17 nt, Human
ucuaaacuuccccaucu

SEQ ID NO: 1416679 - RNA, 15 nt, Human
ucuaaacuggagacu

SEQ ID NO: 1416680 - RNA, 14 nt, Human
ucuaaacuggagac

SEQ ID NO: 1416681 - RNA, 13 nt, Human
ucuaaacuggaga

SEQ ID NO: 1416682 - RNA, 13 nt, Human
ucuaaaggaguuu

SEQ ID NO: 1416683 - RNA, 21 nt, Human
ucuaaagcugguuuaauguuu

SEQ ID NO: 1416684 - RNA, 19 nt, Human
ucuaaagcugguuuaaugu

SEQ ID NO: 1416685 - RNA, 13 nt, Human
ucuaaaggcuacc

SEQ ID NO: 1416686 - RNA, 16 nt, Human
ucuaaaggcuaccuuu

SEQ ID NO: 1416687 - RNA, 12 nt, Human
ucuaaguuucua

SEQ ID NO: 1416688 - RNA, 22 nt, Human
ucuaaguuauaagacucucaca

SEQ ID NO: 1416689 - RNA, 20 nt, Human
ucuaaguuauaagacucuca

SEQ ID NO: 1416690 - RNA, 17 nt, Human
ucuaaguuauaagacuc

SEQ ID NO: 1416691 - RNA, 16 nt, Human
ucuaaguuauaagacu

SEQ ID NO: 1416692 - RNA, 14 nt, Human
ucuaaguuauaaga

SEQ ID NO: 1416693 - RNA, 21 nt, Human
ucuaaguuaauuuaaaguugu

SEQ ID NO: 1416694 - RNA, 20 nt, Human
ucuaaguuaauuuaaaguug

SEQ ID NO: 1416695 - RNA, 18 nt, Human
ucuaaguuaauuuaaagu

SEQ ID NO: 1416696 - RNA, 16 nt, Human
ucuaaguuaauuuaaa

SEQ ID NO: 1416697 - RNA, 14 nt, Human
ucuaaguuaauuua

SEQ ID NO: 1416698 - RNA, 18 nt, Human
ucuaaguguuucauaaau

SEQ ID NO: 1416699 - RNA, 13 nt, Human
ucuaagugauaua

SEQ ID NO: 1416700 - RNA, 14 nt, Human
ucuaagucuuucca

SEQ ID NO: 1416701 - RNA, 13 nt, Human
ucuaagucuuucc

SEQ ID NO: 1416702 - RNA, 19 nt, Human
ucuaaguaaauacaauuuu

SEQ ID NO: 1416703 - RNA, 20 nt, Human
ucuaaguaaauacaauuuuu

SEQ ID NO: 1416704 - RNA, 17 nt, Human
ucuaagcauaaaagaug

SEQ ID NO: 1416705 - RNA, 13 nt, Human
ucuaagauucuga

SEQ ID NO: 1416706 - RNA, 16 nt, Human
ucuaaguaaauacaau

SEQ ID NO: 1416707 - RNA, 19 nt, Human
ucuaagauucugauuuuag

SEQ ID NO: 1416708 - RNA, 12 nt, Human
ucuaagauucug

SEQ ID NO: 1416709 - RNA, 19 nt, Human
ucuaagauucuagaucaga

SEQ ID NO: 1416710 - RNA, 16 nt, Human
ucuaagauucuagauc

SEQ ID NO: 1416711 - RNA, 15 nt, Human
ucuaagauucuagau

SEQ ID NO: 1416712 - RNA, 14 nt, Human
ucuaagauucuaga

SEQ ID NO: 1416713 - RNA, 13 nt, Human
ucuaagauucuag

SEQ ID NO: 1416714 - RNA, 20 nt, Human
ucuaagauucuaaugaugau

SEQ ID NO: 1416715 - RNA, 19 nt, Human
ucuaagauucuaaugauga

SEQ ID NO: 1416716 - RNA, 17 nt, Human
ucuaagauucuaaugau

SEQ ID NO: 1416717 - RNA, 16 nt, Human
ucuaagauucuaauga

SEQ ID NO: 1416718 - RNA, 15 nt, Human
ucuaagauucuaaug

SEQ ID NO: 1416719 - RNA, 14 nt, Human
ucuaagauucuaau

SEQ ID NO: 1416720 - RNA, 19 nt, Human
ucuaagauucuaaaggucc

SEQ ID NO: 1416721 - RNA, 18 nt, Human
ucuaagauucuaaagguc

SEQ ID NO: 1416722 - RNA, 17 nt, Human
ucuaagauucuaaaggu

SEQ ID NO: 1416723 - RNA, 16 nt, Human
ucuaagauucuaaagg

SEQ ID NO: 1416724 - RNA, 15 nt, Human
ucuaagauucuaaag

SEQ ID NO: 1416725 - RNA, 14 nt, Human
ucuaagauucuaaa

SEQ ID NO: 1416726 - RNA, 13 nt, Human
ucuaagauucuaa

SEQ ID NO: 1416727 - RNA, 12 nt, Human
ucuaagauucua

SEQ ID NO: 1416728 - RNA, 23 nt, Human
ucuaccccagacuagauguagua

SEQ ID NO: 1416729 - RNA, 21 nt, Human
ucuaccccagacuagauguag

SEQ ID NO: 1416730 - RNA, 18 nt, Human
ucuaccccagacuagaug

SEQ ID NO: 1416731 - RNA, 16 nt, Human
ucuaccccagacuaga

SEQ ID NO: 1416732 - RNA, 16 nt, Human
ucuacauaugaucugu

SEQ ID NO: 1416733 - RNA, 17 nt, Human
ucuacaucuucugccuu

SEQ ID NO: 1416734 - RNA, 16 nt, Human
ucuacaucuucugccu

SEQ ID NO: 1416735 - RNA, 15 nt, Human
ucuacaucuucugcc

SEQ ID NO: 1416736 - RNA, 21 nt, Human
ucuacauaugaucugucugug

SEQ ID NO: 1416737 - RNA, 15 nt, Human
ucuacccauauuaca

SEQ ID NO: 1416738 - RNA, 17 nt, Human
ucuaccaaaaaucucaa

SEQ ID NO: 1416739 - RNA, 21 nt, Human
ucgggagacagcaucaggguu

SEQ ID NO: 1416740 - RNA, 16 nt, Human
ucgggagacagcauca

SEQ ID NO: 1416741 - RNA, 12 nt, Human
acuguguuccuu

SEQ ID NO: 1416742 - RNA, 14 nt, Human
acuguguuccuucc

SEQ ID NO: 1416743 - RNA, 16 nt, Human
acuguguuaugcaaaa

SEQ ID NO: 1416744 - RNA, 21 nt, Human
acuguguuaugcaaaagcaag

SEQ ID NO: 1416745 - RNA, 15 nt, Human
acuguggauauuguu

SEQ ID NO: 1416746 - RNA, 16 nt, Human
acuguccugggccugc

SEQ ID NO: 1416747 - RNA, 14 nt, Human
acuguccugggccu

SEQ ID NO: 1416748 - RNA, 22 nt, Human
acugugugugugaaugaacacu

SEQ ID NO: 1416749 - RNA, 18 nt, Human
acugugugugugaaugaa

SEQ ID NO: 1416750 - RNA, 16 nt, Human
acugugugugugaaug

SEQ ID NO: 1416751 - RNA, 15 nt, Human
acugugugugugaau

SEQ ID NO: 1416752 - RNA, 23 nt, Human
acugugugugcccucugggcucu

SEQ ID NO: 1416753 - RNA, 22 nt, Human
acugugugugcccucugggcuc

SEQ ID NO: 1416754 - RNA, 21 nt, Human
acugugugugcccucugggcu

SEQ ID NO: 1416755 - RNA, 20 nt, Human
acugugugugcccucugggc

SEQ ID NO: 1416756 - RNA, 19 nt, Human
acugugugugcccucuggg

SEQ ID NO: 1416757 - RNA, 18 nt, Human
acugugugugcccucugg

SEQ ID NO: 1416758 - RNA, 17 nt, Human
acugugugugcccucug

SEQ ID NO: 1416759 - RNA, 14 nt, Human
acugugugugcccu

SEQ ID NO: 1416760 - RNA, 13 nt, Human
acuguggguagac

SEQ ID NO: 1416761 - RNA, 18 nt, Human
ucguaugauacuucgaca

SEQ ID NO: 1416762 - RNA, 16 nt, Human
ucguacagaaagcugc

SEQ ID NO: 1416763 - RNA, 15 nt, Human
ucguacagaaagcug

SEQ ID NO: 1416764 - RNA, 20 nt, Human
ucguaagauuuccuucuuuu

SEQ ID NO: 1416765 - RNA, 16 nt, Human
ucggggcugggaaguc

SEQ ID NO: 1416766 - RNA, 15 nt, Human
ucggggcaucuggcc

SEQ ID NO: 1416767 - RNA, 17 nt, Human
ucggggauguguccuga

SEQ ID NO: 1416768 - RNA, 13 nt, Human
ucgggcugugccc

SEQ ID NO: 1416769 - RNA, 20 nt, Human
ucggggagccgggagccuga

SEQ ID NO: 1416770 - RNA, 12 nt, Human
ucgggcugugcc

SEQ ID NO: 1416771 - RNA, 19 nt, Human
ucuaaacccaauccaaaug

SEQ ID NO: 1416772 - RNA, 16 nt, Human
ucuaaacccaauccaa

SEQ ID NO: 1416773 - RNA, 18 nt, Human
ucuaaaauuauaaaugac

SEQ ID NO: 1416774 - RNA, 22 nt, Human
ucuaaaaugugauguucuaagg

SEQ ID NO: 1416775 - RNA, 21 nt, Human
ucuaaaaugugauguucuaag

SEQ ID NO: 1416776 - RNA, 20 nt, Human
ucuaaaaugugauguucuaa

SEQ ID NO: 1416777 - RNA, 19 nt, Human
ucuaaaaugugauguucua

SEQ ID NO: 1416778 - RNA, 18 nt, Human
ucuaaaaugugauguucu

SEQ ID NO: 1416779 - RNA, 19 nt, Human
ucguuuauuuucaagaaua

SEQ ID NO: 1416780 - RNA, 11 nt, Human
ucguucugugg

SEQ ID NO: 1416781 - RNA, 21 nt, Human
ucguaugauacuucgacacug

SEQ ID NO: 1416782 - RNA, 22 nt, Human
ucguaugauacuucgacacugu

SEQ ID NO: 1416783 - RNA, 23 nt, Human
ucgucacugcuuaacuucacaua

SEQ ID NO: 1416784 - RNA, 15 nt, Human
ucguucaaagcauga

SEQ ID NO: 1416785 - RNA, 14 nt, Human
ucguuaucuaauag

SEQ ID NO: 1416786 - RNA, 22 nt, Human
acugucauccucaaagaaagug

SEQ ID NO: 1416787 - RNA, 21 nt, Human
acugucauccucaaagaaagu

SEQ ID NO: 1416788 - RNA, 13 nt, Human
acugucauagaaa

SEQ ID NO: 1416789 - RNA, 15 nt, Human
acuguccccuugaag

SEQ ID NO: 1416790 - RNA, 18 nt, Human
acuguccccuugaaggag

SEQ ID NO: 1416791 - RNA, 21 nt, Human
acuguauuuuguauuguuuca

SEQ ID NO: 1416792 - RNA, 23 nt, Human
acuguauuugaaauaagaauuca

SEQ ID NO: 1416793 - RNA, 12 nt, Human
acuguauuugaa

SEQ ID NO: 1416794 - RNA, 23 nt, Human
acuguaucuaggcaacauaguau

SEQ ID NO: 1416795 - RNA, 22 nt, Human
acuguaucuaggcaacauagua

SEQ ID NO: 1416796 - RNA, 15 nt, Human
acuguaucuaggcaa

SEQ ID NO: 1416797 - RNA, 16 nt, Human
acuguauauuacagau

SEQ ID NO: 1416798 - RNA, 16 nt, Human
acuguaucaugacaaa

SEQ ID NO: 1416799 - RNA, 20 nt, Human
acuguaucaugacaaagacu

SEQ ID NO: 1416800 - RNA, 15 nt, Human
acuguacuugcucuu

SEQ ID NO: 1416801 - RNA, 20 nt, Human
acuguacaugaaaacacauu

SEQ ID NO: 1416802 - RNA, 21 nt, Human
acuguacaugaaaacacauuu

SEQ ID NO: 1416803 - RNA, 14 nt, Human
acuguauauucagg

SEQ ID NO: 1416804 - RNA, 14 nt, Human
acuguaucaugaca

SEQ ID NO: 1416805 - RNA, 23 nt, Human
acuguacuugcucuugaugccug

SEQ ID NO: 1416806 - RNA, 19 nt, Human
acuguacaugaaaacacau

SEQ ID NO: 1416807 - RNA, 20 nt, Human
acuggguaaugaaacaaaga

SEQ ID NO: 1416808 - RNA, 14 nt, Human
acuggguaaugaaa

SEQ ID NO: 1416809 - RNA, 18 nt, Human
acuguacagacagaaaaa

SEQ ID NO: 1416810 - RNA, 16 nt, Human
acuggggcaggggccg

SEQ ID NO: 1416811 - RNA, 17 nt, Human
acugggcugagggagcc

SEQ ID NO: 1416812 - RNA, 14 nt, Human
acugggcugaggga

SEQ ID NO: 1416813 - RNA, 13 nt, Human
acugggcugaggg

SEQ ID NO: 1416814 - RNA, 15 nt, Human
acugggggaaaagau

SEQ ID NO: 1416815 - RNA, 16 nt, Human
acuggggcucagagcc

SEQ ID NO: 1416816 - RNA, 18 nt, Human
acuggggcucagagccgg

SEQ ID NO: 1416817 - RNA, 15 nt, Human
acuggggcucagagc

SEQ ID NO: 1416818 - RNA, 13 nt, Human
acuggggcucaga

SEQ ID NO: 1416819 - RNA, 22 nt, Human
ucgcuggacucucagucucuga

SEQ ID NO: 1416820 - RNA, 20 nt, Human
ucgcuggacucucagucucu

SEQ ID NO: 1416821 - RNA, 16 nt, Human
ucgcugcuucguggga

SEQ ID NO: 1416822 - RNA, 20 nt, Human
ucgcugccagcucuguauca

SEQ ID NO: 1416823 - RNA, 19 nt, Human
ucgcugccagcucuguauc

SEQ ID NO: 1416824 - RNA, 15 nt, Human
ucgcucuuugagaaa

SEQ ID NO: 1416825 - RNA, 13 nt, Human
ucgcucuuugaga

SEQ ID NO: 1416826 - RNA, 11 nt, Human
ucgcuguccuu

SEQ ID NO: 1416827 - RNA, 17 nt, Human
ucgcuguccuuucuaga

SEQ ID NO: 1416828 - RNA, 16 nt, Human
ucgcugucacaggcgg

SEQ ID NO: 1416829 - RNA, 23 nt, Human
ucgcuggacucucagucucugag

SEQ ID NO: 1416830 - RNA, 14 nt, Human
ucgccccuggcaga

SEQ ID NO: 1416831 - RNA, 20 nt, Human
ucgccccagcaggugcugac

SEQ ID NO: 1416832 - RNA, 14 nt, Human
ucgccccagcaggu

SEQ ID NO: 1416833 - RNA, 19 nt, Human
ucgcccaugcuggagugca

SEQ ID NO: 1416834 - RNA, 21 nt, Human
acugaagcagccucuccccag

SEQ ID NO: 1416835 - RNA, 14 nt, Human
acugaagcagccuc

SEQ ID NO: 1416836 - RNA, 13 nt, Human
acugaagcagccu

SEQ ID NO: 1416837 - RNA, 19 nt, Human
acugaacaccauugaaggc

SEQ ID NO: 1416838 - RNA, 12 nt, Human
acugaagaguaa

SEQ ID NO: 1416839 - RNA, 22 nt, Human
acugaagaagcaccaaucauga

SEQ ID NO: 1416840 - RNA, 18 nt, Human
ucgcccuggacugugugc

SEQ ID NO: 1416841 - RNA, 16 nt, Human
ucgcccuuugcugcau

SEQ ID NO: 1416842 - RNA, 16 nt, Human
ucgccggaucugaggg

SEQ ID NO: 1416843 - RNA, 17 nt, Human
ucgccggaucugaggga

SEQ ID NO: 1416844 - RNA, 14 nt, Human
ucgcucucaguucu

SEQ ID NO: 1416845 - RNA, 12 nt, Human
ucgccuguaauc

SEQ ID NO: 1416846 - RNA, 22 nt, Human
ucgccugacaaccacuggucug

SEQ ID NO: 1416847 - RNA, 21 nt, Human
ucgccugacaaccacuggucu

SEQ ID NO: 1416848 - RNA, 20 nt, Human
ucgccugacaaccacugguc

SEQ ID NO: 1416849 - RNA, 11 nt, Human
ucgccugacaa

SEQ ID NO: 1416850 - RNA, 12 nt, Human
ucgccucagccu

SEQ ID NO: 1416851 - RNA, 22 nt, Human
acuuccucucgcggcccucagu

SEQ ID NO: 1416852 - RNA, 18 nt, Human
acuuccuccuccccacuu

SEQ ID NO: 1416853 - RNA, 17 nt, Human
acuuccuccuccccacu

SEQ ID NO: 1416854 - RNA, 15 nt, Human
acuuccuccucccca

SEQ ID NO: 1416855 - RNA, 20 nt, Human
acuuccuaaauauuaugaga

SEQ ID NO: 1416856 - RNA, 18 nt, Human
acuuccucucgcggcccu

SEQ ID NO: 1416857 - RNA, 14 nt, Human
ucuauaguucuaga

SEQ ID NO: 1416858 - RNA, 12 nt, Human
ucuauaguucua

SEQ ID NO: 1416859 - RNA, 19 nt, Human
ucuauagccaaaaauagcu

SEQ ID NO: 1416860 - RNA, 15 nt, Human
ucuauaguucuagac

SEQ ID NO: 1416861 - RNA, 19 nt, Human
ucuauuuuuggagguuuau

SEQ ID NO: 1416862 - RNA, 18 nt, Human
ucuauuuuuggagguuua

SEQ ID NO: 1416863 - RNA, 15 nt, Human
ucuauuuuuggaggu

SEQ ID NO: 1416864 - RNA, 15 nt, Human
ucuauuuuuaucuga

SEQ ID NO: 1416865 - RNA, 17 nt, Human
ucucaccaggcagccuc

SEQ ID NO: 1416866 - RNA, 16 nt, Human
ucucaccaggcagccu

SEQ ID NO: 1416867 - RNA, 14 nt, Human
ucucaccaggcagc

SEQ ID NO: 1416868 - RNA, 13 nt, Human
ucucaccaggcag

SEQ ID NO: 1416869 - RNA, 21 nt, Human
ucucaccaggcagccucuggg

SEQ ID NO: 1416870 - RNA, 22 nt, Human
ucucaccaggcagccucugggg

SEQ ID NO: 1416871 - RNA, 19 nt, Human
ucucaccaggcagccucug

SEQ ID NO: 1416872 - RNA, 18 nt, Human
ucucaccaggcagccucu

SEQ ID NO: 1416873 - RNA, 22 nt, Human
ucucacagugggagccagggcu

SEQ ID NO: 1416874 - RNA, 23 nt, Human
ucucacagugggagccagggcug

SEQ ID NO: 1416875 - RNA, 12 nt, Human
ucucacaguggg

SEQ ID NO: 1416876 - RNA, 19 nt, Human
ucucacagugggagccagg

SEQ ID NO: 1416877 - RNA, 21 nt, Human
ucucacagugggagccagggc

SEQ ID NO: 1416878 - RNA, 21 nt, Human
ucuauuuuuggagguuuauua

SEQ ID NO: 1416879 - RNA, 22 nt, Human
ucuauuuuuggagguuuauuac

SEQ ID NO: 1416880 - RNA, 20 nt, Human
ucuauuuuuugaaaagcaga

SEQ ID NO: 1416881 - RNA, 19 nt, Human
acuugccaaauuuagauuu

SEQ ID NO: 1416882 - RNA, 14 nt, Human
acuugccaaauuua

SEQ ID NO: 1416883 - RNA, 23 nt, Human
acuuggaacugaagggggcggcc

SEQ ID NO: 1416884 - RNA, 12 nt, Human
acuugccucuuc

SEQ ID NO: 1416885 - RNA, 16 nt, Human
acuugucuauuaccug

SEQ ID NO: 1416886 - RNA, 20 nt, Human
acuuguccuuagccuggacc

SEQ ID NO: 1416887 - RNA, 21 nt, Human
acuuguccuuagccuggaccu

SEQ ID NO: 1416888 - RNA, 18 nt, Human
acuuguccuagcacagau

SEQ ID NO: 1416889 - RNA, 17 nt, Human
acuuguccuagcacaga

SEQ ID NO: 1416890 - RNA, 15 nt, Human
acuuguauuaugugu

SEQ ID NO: 1416891 - RNA, 14 nt, Human
acuuguauauuuua

SEQ ID NO: 1416892 - RNA, 20 nt, Human
acuuguauauuuuaagaaau

SEQ ID NO: 1416893 - RNA, 13 nt, Human
acuuguauuaugu

SEQ ID NO: 1416894 - RNA, 14 nt, Human
acuuguauuaugug

SEQ ID NO: 1416895 - RNA, 18 nt, Human
acuugacccugagcugac

SEQ ID NO: 1416896 - RNA, 15 nt, Human
acuugacccugagcu

SEQ ID NO: 1416897 - RNA, 14 nt, Human
acuugacccugagc

SEQ ID NO: 1416898 - RNA, 13 nt, Human
acuugacagugga

SEQ ID NO: 1416899 - RNA, 14 nt, Human
acuugacaguggaa

SEQ ID NO: 1416900 - RNA, 12 nt, Human
acuugacagugg

SEQ ID NO: 1416901 - RNA, 14 nt, Human
acuugaagggccag

SEQ ID NO: 1416902 - RNA, 13 nt, Human
acuugaacugauu

SEQ ID NO: 1416903 - RNA, 21 nt, Human
acuugaacugauucacaucuc

SEQ ID NO: 1416904 - RNA, 17 nt, Human
acuugaggacacauguc

SEQ ID NO: 1416905 - RNA, 18 nt, Human
acuugaggacacaugucc

SEQ ID NO: 1416906 - RNA, 19 nt, Human
acuugaggacacaugucca

SEQ ID NO: 1416907 - RNA, 22 nt, Human
acuugaacguuuucuaauugcu

SEQ ID NO: 1416908 - RNA, 21 nt, Human
acuugaacguuuucuaauugc

SEQ ID NO: 1416909 - RNA, 20 nt, Human
acuugaacguuuucuaauug

SEQ ID NO: 1416910 - RNA, 19 nt, Human
acuugaacguuuucuaauu

SEQ ID NO: 1416911 - RNA, 18 nt, Human
acuugaacguuuucuaau

SEQ ID NO: 1416912 - RNA, 17 nt, Human
acuugaacguuuucuaa

SEQ ID NO: 1416913 - RNA, 20 nt, Human
acuugaaauauccugcuuga

SEQ ID NO: 1416914 - RNA, 14 nt, Human
acuucugacagccu

SEQ ID NO: 1416915 - RNA, 21 nt, Human
acuucucuuugccucaaauaa

SEQ ID NO: 1416916 - RNA, 17 nt, Human
acuucucuuugccucaa

SEQ ID NO: 1416917 - RNA, 16 nt, Human
acuucucuuugccuca

SEQ ID NO: 1416918 - RNA, 15 nt, Human
acuucucuuugccuc

SEQ ID NO: 1416919 - RNA, 14 nt, Human
acuucucuuugccu

SEQ ID NO: 1416920 - RNA, 21 nt, Human
acuucucuuguuagguaauuu

SEQ ID NO: 1416921 - RNA, 17 nt, Human
acuugaaaauuaacaug

SEQ ID NO: 1416922 - RNA, 12 nt, Human
acuugaaagaaa

SEQ ID NO: 1416923 - RNA, 16 nt, Human
acuucugacagccuca

SEQ ID NO: 1416924 - RNA, 15 nt, Human
acuucugacagccuc

SEQ ID NO: 1416925 - RNA, 18 nt, Human
acuugaaaauuaacauga

SEQ ID NO: 1416926 - RNA, 23 nt, Human
ucuagcgcaguuuuuuuuuucuu

SEQ ID NO: 1416927 - RNA, 13 nt, Human
ucuagccuggcua

SEQ ID NO: 1416928 - RNA, 12 nt, Human
ucuagcaugaag

SEQ ID NO: 1416929 - RNA, 21 nt, Human
ucuagauucucuggcuguaag

SEQ ID NO: 1416930 - RNA, 15 nt, Human
ucuagauugagagaa

SEQ ID NO: 1416931 - RNA, 14 nt, Human
ucuagauucucugg

SEQ ID NO: 1416932 - RNA, 11 nt, Human
ucuagauucuc

SEQ ID NO: 1416933 - RNA, 23 nt, Human
ucuagauuccauugguccaagau

SEQ ID NO: 1416934 - RNA, 22 nt, Human
ucuagauuccauugguccaaga

SEQ ID NO: 1416935 - RNA, 21 nt, Human
ucuagauuccauugguccaag

SEQ ID NO: 1416936 - RNA, 19 nt, Human
ucuagauuccauuggucca

SEQ ID NO: 1416937 - RNA, 23 nt, Human
ucuagauucaaagguucuagguu

SEQ ID NO: 1416938 - RNA, 22 nt, Human
ucuagauucaaagguucuaggu

SEQ ID NO: 1416939 - RNA, 20 nt, Human
ucuagauucaaagguucuag

SEQ ID NO: 1416940 - RNA, 19 nt, Human
ucuagauucaaagguucua

SEQ ID NO: 1416941 - RNA, 18 nt, Human
ucuagauucaaagguucu

SEQ ID NO: 1416942 - RNA, 17 nt, Human
ucuagauucaaagguuc

SEQ ID NO: 1416943 - RNA, 13 nt, Human
ucuagauucaaag

SEQ ID NO: 1416944 - RNA, 22 nt, Human
ucuagauguuuauucuucuaga

SEQ ID NO: 1416945 - RNA, 23 nt, Human
ucuagauguuuauucuucuagag

SEQ ID NO: 1416946 - RNA, 21 nt, Human
ucuagauguuuauucuucuag

SEQ ID NO: 1416947 - RNA, 22 nt, Human
ucuagaugauuaaauaagauuc

SEQ ID NO: 1416948 - RNA, 23 nt, Human
ucuagaugaaguuuuacauuguu

SEQ ID NO: 1416949 - RNA, 22 nt, Human
ucuagaugaaguuuuacauugu

SEQ ID NO: 1416950 - RNA, 21 nt, Human
ucuagaugaaguuuuacauug

SEQ ID NO: 1416951 - RNA, 20 nt, Human
ucuagaugaaguuuuacauu

SEQ ID NO: 1416952 - RNA, 19 nt, Human
ucuagaugaaguuuuacau

SEQ ID NO: 1416953 - RNA, 14 nt, Human
ucuagaucauaagg

SEQ ID NO: 1416954 - RNA, 22 nt, Human
ucuagaucagaugcuccaagau

SEQ ID NO: 1416955 - RNA, 21 nt, Human
ucuagaucagaugcuccaaga

SEQ ID NO: 1416956 - RNA, 20 nt, Human
ucuagaucagaugcuccaag

SEQ ID NO: 1416957 - RNA, 18 nt, Human
ucuagaucagaugcucca

SEQ ID NO: 1416958 - RNA, 16 nt, Human
ucuagaucagaugcuc

SEQ ID NO: 1416959 - RNA, 15 nt, Human
ucuagauaucgacuu

SEQ ID NO: 1416960 - RNA, 23 nt, Human
acuucccagcuaggaagagcagg

SEQ ID NO: 1416961 - RNA, 20 nt, Human
acuuccccauggcccugagc

SEQ ID NO: 1416962 - RNA, 24 nt, Human
ucuagauacuguaucaugacaaag

SEQ ID NO: 1416963 - RNA, 23 nt, Human
ucuaguuugauuaaauucuugca

SEQ ID NO: 1416964 - RNA, 14 nt, Human
ucuaguucauugaa

SEQ ID NO: 1416965 - RNA, 14 nt, Human
ucuaguucugccag

SEQ ID NO: 1416966 - RNA, 15 nt, Human
ucuaggaaauauacu

SEQ ID NO: 1416967 - RNA, 14 nt, Human
ucuagcuuaucuac

SEQ ID NO: 1416968 - RNA, 22 nt, Human
ucuaggaaauauacuuuuacaa

SEQ ID NO: 1416969 - RNA, 20 nt, Human
ucuauagccaaaaauagcua

SEQ ID NO: 1416970 - RNA, 17 nt, Human
ucuauagccaaaaauag

SEQ ID NO: 1416971 - RNA, 16 nt, Human
ucuauaauuuaccuaa

SEQ ID NO: 1416972 - RNA, 12 nt, Human
ucuauaauuuac

SEQ ID NO: 1416973 - RNA, 13 nt, Human
ucuauaaaccgaa

SEQ ID NO: 1416974 - RNA, 22 nt, Human
ucuaguuuuuuacuuuuguuua

SEQ ID NO: 1416975 - RNA, 13 nt, Human
ucuauaauuuaaa

SEQ ID NO: 1416976 - RNA, 14 nt, Human
acuuacucuaagau

SEQ ID NO: 1416977 - RNA, 13 nt, Human
acuuacucuaaga

SEQ ID NO: 1416978 - RNA, 21 nt, Human
ucuaccuggucucuccuuguu

SEQ ID NO: 1416979 - RNA, 19 nt, Human
ucuaccucaggcagcucaa

SEQ ID NO: 1416980 - RNA, 21 nt, Human
ucuacccugcauggcugagcu

SEQ ID NO: 1416981 - RNA, 13 nt, Human
acuuacuguacau

SEQ ID NO: 1416982 - RNA, 14 nt, Human
acuuacuguacaug

SEQ ID NO: 1416983 - RNA, 15 nt, Human
acuuacuguacauga

SEQ ID NO: 1416984 - RNA, 21 nt, Human
acuuagauuuuacaugaagua

SEQ ID NO: 1416985 - RNA, 24 nt, Human
acuuagauuuuacaugaaguauuu

SEQ ID NO: 1416986 - RNA, 16 nt, Human
acuuagcuaguuuuau

SEQ ID NO: 1416987 - RNA, 20 nt, Human
acuuagauuuuacaugaagu

SEQ ID NO: 1416988 - RNA, 19 nt, Human
acuuagauuuuacaugaag

SEQ ID NO: 1416989 - RNA, 18 nt, Human
acuuagauuuuacaugaa

SEQ ID NO: 1416990 - RNA, 17 nt, Human
acuuagauuuuacauga

SEQ ID NO: 1416991 - RNA, 16 nt, Human
acuuagauuuuacaug

SEQ ID NO: 1416992 - RNA, 15 nt, Human
acuuagauuuuacau

SEQ ID NO: 1416993 - RNA, 16 nt, Human
acuuacucuaagaucu

SEQ ID NO: 1416994 - RNA, 16 nt, Human
acuuacuguacaugaa

SEQ ID NO: 1416995 - RNA, 18 nt, Human
acuuccaaacuaauuuuu

SEQ ID NO: 1416996 - RNA, 17 nt, Human
acuuccaaacuaauuuu

SEQ ID NO: 1416997 - RNA, 16 nt, Human
acuuccaaacuaauuu

SEQ ID NO: 1416998 - RNA, 14 nt, Human
acuuccaaacuaau

SEQ ID NO: 1416999 - RNA, 13 nt, Human
acuucauuucaga

SEQ ID NO: 1417000 - RNA, 16 nt, Human
acuuaucugaucagaa

SEQ ID NO: 1417001 - RNA, 21 nt, Human
acuuccacagggucccacagc

SEQ ID NO: 1417002 - RNA, 20 nt, Human
acuuccacagggucccacag

SEQ ID NO: 1417003 - RNA, 16 nt, Human
acuuccacaggguccc

SEQ ID NO: 1417004 - RNA, 21 nt, Human
acuuccaaauccccuaagcag

SEQ ID NO: 1417005 - RNA, 19 nt, Human
acuuccaaauccccuaagc

SEQ ID NO: 1417006 - RNA, 19 nt, Human
acuuccaaacuaauuuuua

SEQ ID NO: 1417007 - RNA, 21 nt, Human
acuuccagguguuacuguaau

SEQ ID NO: 1417008 - RNA, 20 nt, Human
acuuccagguguuacuguaa

SEQ ID NO: 1417009 - RNA, 20 nt, Human
acuuccagauccuggaaauc

SEQ ID NO: 1417010 - RNA, 13 nt, Human
agaaaacaaaacu

SEQ ID NO: 1417011 - RNA, 21 nt, Human
agaaaacaaaacugcauuuca

SEQ ID NO: 1417012 - RNA, 14 nt, Human
agaaaaacaggcac

SEQ ID NO: 1417013 - RNA, 13 nt, Human
agaaaaacaggca

SEQ ID NO: 1417014 - RNA, 22 nt, Human
ucucuuguauaagauccuagau

SEQ ID NO: 1417015 - RNA, 23 nt, Human
agaaaaacaaacucguuuuuuac

SEQ ID NO: 1417016 - RNA, 22 nt, Human
ucucugcaggucccuaauaaag

SEQ ID NO: 1417017 - RNA, 19 nt, Human
ucucugcaggucccuaaua

SEQ ID NO: 1417018 - RNA, 20 nt, Human
ucucugcaggucccuaauaa

SEQ ID NO: 1417019 - RNA, 21 nt, Human
ucucugcaggucccuaauaaa

SEQ ID NO: 1417020 - RNA, 15 nt, Human
agaaacauuugguaa

SEQ ID NO: 1417021 - RNA, 17 nt, Human
agaaacuuaaauguuau

SEQ ID NO: 1417022 - RNA, 20 nt, Human
agaaacuuaaauguuauuau

SEQ ID NO: 1417023 - RNA, 18 nt, Human
agaaacuuaaauguuauu

SEQ ID NO: 1417024 - RNA, 21 nt, Human
agaaacuuaaauuuuaguucu

SEQ ID NO: 1417025 - RNA, 19 nt, Human
agaaacauuuauauugaua

SEQ ID NO: 1417026 - RNA, 15 nt, Human
agaaacauuuauauu

SEQ ID NO: 1417027 - RNA, 12 nt, Human
agaaacauuuau

SEQ ID NO: 1417028 - RNA, 22 nt, Human
agaaacaguugguaacuuuugu

SEQ ID NO: 1417029 - RNA, 21 nt, Human
agaaacaguugguaacuuuug

SEQ ID NO: 1417030 - RNA, 17 nt, Human
agaaacacccucacacu

SEQ ID NO: 1417031 - RNA, 18 nt, Human
agaaacaagguuuucagu

SEQ ID NO: 1417032 - RNA, 20 nt, Human
agaaacaacucuuugagaaa

SEQ ID NO: 1417033 - RNA, 14 nt, Human
agaaaagcuuugaa

SEQ ID NO: 1417034 - RNA, 21 nt, Human
agaaaagcuauaaaaugaaua

SEQ ID NO: 1417035 - RNA, 13 nt, Human
agaaaagcuauaa

SEQ ID NO: 1417036 - RNA, 16 nt, Human
agaaacacaacuauau

SEQ ID NO: 1417037 - RNA, 16 nt, Human
agaaaagaugcacuuu

SEQ ID NO: 1417038 - RNA, 19 nt, Human
agaaaagaugcacuuugcu

SEQ ID NO: 1417039 - RNA, 15 nt, Human
agaaaagaugcacuu

SEQ ID NO: 1417040 - RNA, 13 nt, Human
agaaaagaugcac

SEQ ID NO: 1417041 - RNA, 12 nt, Human
agaaaagaugca

SEQ ID NO: 1417042 - RNA, 16 nt, Human
agaaaacaaggaugaa

SEQ ID NO: 1417043 - RNA, 17 nt, Human
agaaagagaaacaguug

SEQ ID NO: 1417044 - RNA, 22 nt, Human
agaaagacuugguugguagggu

SEQ ID NO: 1417045 - RNA, 12 nt, Human
agaaagacuugg

SEQ ID NO: 1417046 - RNA, 19 nt, Human
agaaagaggugaccccagg

SEQ ID NO: 1417047 - RNA, 22 nt, Human
agaaagaggcaccaggaagccg

SEQ ID NO: 1417048 - RNA, 23 nt, Human
agaaacuuaaauguuauuaucug

SEQ ID NO: 1417049 - RNA, 22 nt, Human
agaaagaggugaccccagggca

SEQ ID NO: 1417050 - RNA, 23 nt, Human
agaaagaggugaccccagggcac

SEQ ID NO: 1417051 - RNA, 21 nt, Human
agaaagaggugaccccagggc

SEQ ID NO: 1417052 - RNA, 20 nt, Human
agaaagaggugaccccaggg

SEQ ID NO: 1417053 - RNA, 14 nt, Human
agaaauacaaaaau

SEQ ID NO: 1417054 - RNA, 14 nt, Human
agaaagcauuugaa

SEQ ID NO: 1417055 - RNA, 23 nt, Human
agaaauacaaaaauacucagaua

SEQ ID NO: 1417056 - RNA, 17 nt, Human
agaaagcaucccucacc

SEQ ID NO: 1417057 - RNA, 19 nt, Human
agaaagcaucccucaccca

SEQ ID NO: 1417058 - RNA, 22 nt, Human
agaaagcaucccucacccaucc

SEQ ID NO: 1417059 - RNA, 13 nt, Human
agaaagcauuuga

SEQ ID NO: 1417060 - RNA, 15 nt, Human
agaaaugcuuagaaa

SEQ ID NO: 1417061 - RNA, 17 nt, Human
agaaaucuggcuucugg

SEQ ID NO: 1417062 - RNA, 15 nt, Human
agaaaugccuuaccc

SEQ ID NO: 1417063 - RNA, 21 nt, Human
ucugaaggagccccauuccug

SEQ ID NO: 1417064 - RNA, 20 nt, Human
ucugaaggagccccauuccu

SEQ ID NO: 1417065 - RNA, 15 nt, Human
agaaaugguuguauu

SEQ ID NO: 1417066 - RNA, 16 nt, Human
agaaaugguuguauua

SEQ ID NO: 1417067 - RNA, 17 nt, Human
agaaaugguuguauuag

SEQ ID NO: 1417068 - RNA, 20 nt, Human
ucugaaggguaauuauauag

SEQ ID NO: 1417069 - RNA, 20 nt, Human
agaaauagcuuaugaaaaga

SEQ ID NO: 1417070 - RNA, 15 nt, Human
agaaauagucgguga

SEQ ID NO: 1417071 - RNA, 19 nt, Human
agaaauagcuuaugaaaag

SEQ ID NO: 1417072 - RNA, 13 nt, Human
agaaauagaacaa

SEQ ID NO: 1417073 - RNA, 16 nt, Human
agaaauagaauuauaa

SEQ ID NO: 1417074 - RNA, 23 nt, Human
agaaauacuacuguguaagggcc

SEQ ID NO: 1417075 - RNA, 16 nt, Human
agaaauacagauuuug

SEQ ID NO: 1417076 - RNA, 21 nt, Human
agaaauacagauuuugauagc

SEQ ID NO: 1417077 - RNA, 16 nt, Human
agaaaugaaaaaauau

SEQ ID NO: 1417078 - RNA, 13 nt, Human
agaaaugaaaaaa

SEQ ID NO: 1417079 - RNA, 22 nt, Human
agaaaucuauagaacugaauga

SEQ ID NO: 1417080 - RNA, 12 nt, Human
agaaaugaaaaa

SEQ ID NO: 1417081 - RNA, 15 nt, Human
acuuugcuugcuuug

SEQ ID NO: 1417082 - RNA, 14 nt, Human
acuuugcuugcuuu

SEQ ID NO: 1417083 - RNA, 13 nt, Human
acuuugcuugcuu

SEQ ID NO: 1417084 - RNA, 11 nt, Human
acuuugcuugc

SEQ ID NO: 1417085 - RNA, 21 nt, Human
acuuugcuaaagacaugaagc

SEQ ID NO: 1417086 - RNA, 20 nt, Human
acuuugcuaaagacaugaag

SEQ ID NO: 1417087 - RNA, 17 nt, Human
acuuugcuaaagacaug

SEQ ID NO: 1417088 - RNA, 16 nt, Human
acuuugcaucucagua

SEQ ID NO: 1417089 - RNA, 23 nt, Human
acuuugcagccggcacagggucu

SEQ ID NO: 1417090 - RNA, 22 nt, Human
acuuugcagcacagcugagagg

SEQ ID NO: 1417091 - RNA, 21 nt, Human
acuuugcacugauauaucaug

SEQ ID NO: 1417092 - RNA, 19 nt, Human
acuuugcacugauauauca

SEQ ID NO: 1417093 - RNA, 18 nt, Human
acuuugcacugauauauc

SEQ ID NO: 1417094 - RNA, 17 nt, Human
acuuugcacugauauau

SEQ ID NO: 1417095 - RNA, 14 nt, Human
acuuugaaguuagc

SEQ ID NO: 1417096 - RNA, 20 nt, Human
acuuugaaaggagaugucuu

SEQ ID NO: 1417097 - RNA, 19 nt, Human
acuuuguauaaaagggacu

SEQ ID NO: 1417098 - RNA, 22 nt, Human
acuuugcuuuaauauaaaugca

SEQ ID NO: 1417099 - RNA, 21 nt, Human
acuuugcuuuaauauaaaugc

SEQ ID NO: 1417100 - RNA, 19 nt, Human
acuuugcuuuaauauaaau

SEQ ID NO: 1417101 - RNA, 18 nt, Human
acuuugcuuuaauauaaa

SEQ ID NO: 1417102 - RNA, 17 nt, Human
acuuugcuuuaauauaa

SEQ ID NO: 1417103 - RNA, 16 nt, Human
acuuugcuuuaauaua

SEQ ID NO: 1417104 - RNA, 15 nt, Human
acuuugcuuuaauau

SEQ ID NO: 1417105 - RNA, 20 nt, Human
acuuugcuugcuuugaagua

SEQ ID NO: 1417106 - RNA, 13 nt, Human
acuuguuuuggau

SEQ ID NO: 1417107 - RNA, 16 nt, Human
acuuguuuuggaugcc

SEQ ID NO: 1417108 - RNA, 20 nt, Human
acuugugcccucccuguccu

SEQ ID NO: 1417109 - RNA, 21 nt, Human
acuugugcccucccuguccuu

SEQ ID NO: 1417110 - RNA, 22 nt, Human
acuuguuuuauuuaaccucuaa

SEQ ID NO: 1417111 - RNA, 16 nt, Human
acuuuagaagccugca

SEQ ID NO: 1417112 - RNA, 15 nt, Human
acuuuagaagccugc

SEQ ID NO: 1417113 - RNA, 17 nt, Human
acuuuagaauaugccuu

SEQ ID NO: 1417114 - RNA, 18 nt, Human
acuuugaaaggagauguc

SEQ ID NO: 1417115 - RNA, 23 nt, Human
acuuucuuuuuuuucuauuucac

SEQ ID NO: 1417116 - RNA, 22 nt, Human
acuuucuuuuuuuucuauuuca

SEQ ID NO: 1417117 - RNA, 23 nt, Human
acuuucuuuuuugauauagaagu

SEQ ID NO: 1417118 - RNA, 17 nt, Human
acuuucuuuuuugauau

SEQ ID NO: 1417119 - RNA, 23 nt, Human
acuuucuuuuuguagcuggggcu

SEQ ID NO: 1417120 - RNA, 18 nt, Human
acuuucuuuuuguagcug

SEQ ID NO: 1417121 - RNA, 16 nt, Human
acuuucuuucucacua

SEQ ID NO: 1417122 - RNA, 19 nt, Human
acuuucuuuucuggaaugu

SEQ ID NO: 1417123 - RNA, 15 nt, Human
acuuucuuuucugga

SEQ ID NO: 1417124 - RNA, 22 nt, Human
acuuucuuucucacuaaaucuu

SEQ ID NO: 1417125 - RNA, 13 nt, Human
acuuucuuucuca

SEQ ID NO: 1417126 - RNA, 13 nt, Human
acuuuagggaagu

SEQ ID NO: 1417127 - RNA, 17 nt, Human
agaaaaaaauugaaaug

SEQ ID NO: 1417128 - RNA, 16 nt, Human
agaaaaaaauugaaau

SEQ ID NO: 1417129 - RNA, 14 nt, Human
agaaaaaaauugaa

SEQ ID NO: 1417130 - RNA, 18 nt, Human
agaaaaaaauugaaaugu

SEQ ID NO: 1417131 - RNA, 22 nt, Human
agaaaaaaauguauuuuauguu

SEQ ID NO: 1417132 - RNA, 23 nt, Human
agaaaaaaauguauuuuauguua

SEQ ID NO: 1417133 - RNA, 18 nt, Human
agaaaaaaauguauuuua

SEQ ID NO: 1417134 - RNA, 16 nt, Human
agaaaaaaauguauuu

SEQ ID NO: 1417135 - RNA, 13 nt, Human
ucuccuucuuagc

SEQ ID NO: 1417136 - RNA, 14 nt, Human
agaaaaaaauguau

SEQ ID NO: 1417137 - RNA, 19 nt, Human
agaaaaaaaaauucacaug

SEQ ID NO: 1417138 - RNA, 14 nt, Human
acuuugugaauaga

SEQ ID NO: 1417139 - RNA, 20 nt, Human
acuuugucgcccaggcugga

SEQ ID NO: 1417140 - RNA, 18 nt, Human
acuuugugcauucuggau

SEQ ID NO: 1417141 - RNA, 14 nt, Human
ucucgcacaccucu

SEQ ID NO: 1417142 - RNA, 23 nt, Human
ucucgcauaggaccuuuccacca

SEQ ID NO: 1417143 - RNA, 16 nt, Human
ucucgcauaggaccuu

SEQ ID NO: 1417144 - RNA, 13 nt, Human
ucucgaucuccug

SEQ ID NO: 1417145 - RNA, 17 nt, Human
ucucgaugcaaugaaca

SEQ ID NO: 1417146 - RNA, 14 nt, Human
ucucgaugcaauga

SEQ ID NO: 1417147 - RNA, 22 nt, Human
ucucgagcgcccugcagacccu

SEQ ID NO: 1417148 - RNA, 19 nt, Human
ucucgagcgcccugcagac

SEQ ID NO: 1417149 - RNA, 18 nt, Human
ucucgagcgcccugcaga

SEQ ID NO: 1417150 - RNA, 17 nt, Human
ucucgagcgcccugcag

SEQ ID NO: 1417151 - RNA, 16 nt, Human
ucucgagcgcccugca

SEQ ID NO: 1417152 - RNA, 14 nt, Human
ucucgagcgcccug

SEQ ID NO: 1417153 - RNA, 14 nt, Human
ucuccuucuuagcu

SEQ ID NO: 1417154 - RNA, 19 nt, Human
ucuccuuuuccucucuccc

SEQ ID NO: 1417155 - RNA, 13 nt, Human
ucucuccagugca

SEQ ID NO: 1417156 - RNA, 19 nt, Human
ucucuccagcugacuaaac

SEQ ID NO: 1417157 - RNA, 18 nt, Human
ucucuccagcugacuaaa

SEQ ID NO: 1417158 - RNA, 18 nt, Human
ucucggccuucacaaucu

SEQ ID NO: 1417159 - RNA, 22 nt, Human
ucucucacuuguuuuauuuaac

SEQ ID NO: 1417160 - RNA, 22 nt, Human
agaagccaucaccucagauggc

SEQ ID NO: 1417161 - RNA, 20 nt, Human
agaagccaucaccucagaug

SEQ ID NO: 1417162 - RNA, 18 nt, Human
agaagccaucaccucaga

SEQ ID NO: 1417163 - RNA, 16 nt, Human
agaagccaucaccuca

SEQ ID NO: 1417164 - RNA, 22 nt, Human
agaagccaggaauuucccagga

SEQ ID NO: 1417165 - RNA, 13 nt, Human
agaagccaggaau

SEQ ID NO: 1417166 - RNA, 12 nt, Human
agaagccaggaa

SEQ ID NO: 1417167 - RNA, 21 nt, Human
agaagccagcuuguuuacaug

SEQ ID NO: 1417168 - RNA, 20 nt, Human
agaagccagcuuguuuacau

SEQ ID NO: 1417169 - RNA, 19 nt, Human
agaagccagcuuguuuaca

SEQ ID NO: 1417170 - RNA, 15 nt, Human
agaagccagcuuguu

SEQ ID NO: 1417171 - RNA, 14 nt, Human
agaagccagcuugu

SEQ ID NO: 1417172 - RNA, 13 nt, Human
agaagccagcuug

SEQ ID NO: 1417173 - RNA, 15 nt, Human
agaagcaguggccuu

SEQ ID NO: 1417174 - RNA, 20 nt, Human
agaacuuugagcuacugccg

SEQ ID NO: 1417175 - RNA, 15 nt, Human
agaacuuugagcuac

SEQ ID NO: 1417176 - RNA, 23 nt, Human
agaacuuggauguaccugccccc

SEQ ID NO: 1417177 - RNA, 18 nt, Human
agaacuuggauguaccug

SEQ ID NO: 1417178 - RNA, 15 nt, Human
agaacuugacccuga

SEQ ID NO: 1417179 - RNA, 19 nt, Human
agaagcaccaaucaugaau

SEQ ID NO: 1417180 - RNA, 21 nt, Human
agaagcaaccucaguaauuua

SEQ ID NO: 1417181 - RNA, 23 nt, Human
agaagcaaccucaguaauuuaga

SEQ ID NO: 1417182 - RNA, 13 nt, Human
agaagcaaguaaa

SEQ ID NO: 1417183 - RNA, 15 nt, Human
ucugcccccugcaga

SEQ ID NO: 1417184 - RNA, 16 nt, Human
ucugcccccugcagaa

SEQ ID NO: 1417185 - RNA, 14 nt, Human
ucugcccccugcag

SEQ ID NO: 1417186 - RNA, 20 nt, Human
agaagcccggcuccugguca

SEQ ID NO: 1417187 - RNA, 20 nt, Human
agaagcccgugugagaagug

SEQ ID NO: 1417188 - RNA, 13 nt, Human
ucugcccaggcac

SEQ ID NO: 1417189 - RNA, 22 nt, Human
ucugcccaggcacugcuaggcu

SEQ ID NO: 1417190 - RNA, 18 nt, Human
agaagcccggcuccuggu

SEQ ID NO: 1417191 - RNA, 17 nt, Human
agaagcccggcuccugg

SEQ ID NO: 1417192 - RNA, 16 nt, Human
agaagcccggcuccug

SEQ ID NO: 1417193 - RNA, 15 nt, Human
agaagcccggcuccu

SEQ ID NO: 1417194 - RNA, 14 nt, Human
agaagcccggcucc

SEQ ID NO: 1417195 - RNA, 13 nt, Human
agaagcccggcuc

SEQ ID NO: 1417196 - RNA, 24 nt, Human
agaagcccccagcuaagaaccugg

SEQ ID NO: 1417197 - RNA, 23 nt, Human
agaagcccccagcuaagaaccug

SEQ ID NO: 1417198 - RNA, 17 nt, Human
agaagcccccagcuaag

SEQ ID NO: 1417199 - RNA, 14 nt, Human
agaagcccccagcu

SEQ ID NO: 1417200 - RNA, 12 nt, Human
agaagcccccag

SEQ ID NO: 1417201 - RNA, 20 nt, Human
agaacugcaggcccuggccu

SEQ ID NO: 1417202 - RNA, 18 nt, Human
agaacugcaggcccuggc

SEQ ID NO: 1417203 - RNA, 16 nt, Human
agaacugcaggcccug

SEQ ID NO: 1417204 - RNA, 15 nt, Human
agaacugcaggcccu

SEQ ID NO: 1417205 - RNA, 12 nt, Human
agaacugcaggc

SEQ ID NO: 1417206 - RNA, 20 nt, Human
agaacucaaauggggccaga

SEQ ID NO: 1417207 - RNA, 18 nt, Human
agaaccuucucuaugggg

SEQ ID NO: 1417208 - RNA, 14 nt, Human
agaaccuucucuau

SEQ ID NO: 1417209 - RNA, 12 nt, Human
agaaccuucucu

SEQ ID NO: 1417210 - RNA, 19 nt, Human
agaacucaaauggggccag

SEQ ID NO: 1417211 - RNA, 17 nt, Human
agaacuagaauuugauu

SEQ ID NO: 1417212 - RNA, 16 nt, Human
agaacgcugauuuaaa

SEQ ID NO: 1417213 - RNA, 12 nt, Human
agaacggaagaa

SEQ ID NO: 1417214 - RNA, 13 nt, Human
agaacggaagaag

SEQ ID NO: 1417215 - RNA, 14 nt, Human
ucugaauaaagcaa

SEQ ID NO: 1417216 - RNA, 18 nt, Human
ucugaauaaaguguaaca

SEQ ID NO: 1417217 - RNA, 17 nt, Human
ucugaauaaaguguaac

SEQ ID NO: 1417218 - RNA, 17 nt, Human
ucugaauaaagcaauua

SEQ ID NO: 1417219 - RNA, 21 nt, Human
ucugcaggucccuaauaaagc

SEQ ID NO: 1417220 - RNA, 19 nt, Human
ucugcaggucccuaauaaa

SEQ ID NO: 1417221 - RNA, 22 nt, Human
ucugcaggucccuaauaaagcu

SEQ ID NO: 1417222 - RNA, 23 nt, Human
ucugcaggucccuaauaaagcug

SEQ ID NO: 1417223 - RNA, 20 nt, Human
agaaauuaccuguggauauu

SEQ ID NO: 1417224 - RNA, 19 nt, Human
agaaauuaccuguggauau

SEQ ID NO: 1417225 - RNA, 18 nt, Human
agaaauuaccuguggaua

SEQ ID NO: 1417226 - RNA, 18 nt, Human
agaaauuacacccaaaga

SEQ ID NO: 1417227 - RNA, 15 nt, Human
ucugcaguaaaucuu

SEQ ID NO: 1417228 - RNA, 21 nt, Human
agaaccuggguugcagacagg

SEQ ID NO: 1417229 - RNA, 22 nt, Human
agaaccuggccuucaguguacc

SEQ ID NO: 1417230 - RNA, 14 nt, Human
agaaccuggccuuc

SEQ ID NO: 1417231 - RNA, 13 nt, Human
agaaccuggccuu

SEQ ID NO: 1417232 - RNA, 12 nt, Human
agaaccuggccu

SEQ ID NO: 1417233 - RNA, 21 nt, Human
agaaccuggaacuuggggagu

SEQ ID NO: 1417234 - RNA, 20 nt, Human
agaaccuggaacuuggggag

SEQ ID NO: 1417235 - RNA, 13 nt, Human
agaaccuggaacu

SEQ ID NO: 1417236 - RNA, 12 nt, Human
agaaauuaugug

SEQ ID NO: 1417237 - RNA, 23 nt, Human
agaaucaacauuucucaauaauu

SEQ ID NO: 1417238 - RNA, 21 nt, Human
agaaucaacauuucucaauaa

SEQ ID NO: 1417239 - RNA, 14 nt, Human
agaaucaaacauuu

SEQ ID NO: 1417240 - RNA, 21 nt, Human
agaauagccacauuuggaaua

SEQ ID NO: 1417241 - RNA, 20 nt, Human
agaauagccacauuuggaau

SEQ ID NO: 1417242 - RNA, 15 nt, Human
agaauaaauugauuu

SEQ ID NO: 1417243 - RNA, 21 nt, Human
agaauaaucacgcuuuccuga

SEQ ID NO: 1417244 - RNA, 20 nt, Human
agaauaaucacgcuuuccug

SEQ ID NO: 1417245 - RNA, 17 nt, Human
agaauaaucacgcuuuc

SEQ ID NO: 1417246 - RNA, 21 nt, Human
agaauaaaggcaguuuucuaa

SEQ ID NO: 1417247 - RNA, 20 nt, Human
agaauaaaggcaguuuucua

SEQ ID NO: 1417248 - RNA, 18 nt, Human
agaauaaaggcaguuuuc

SEQ ID NO: 1417249 - RNA, 15 nt, Human
agaauaaaggcaguu

SEQ ID NO: 1417250 - RNA, 14 nt, Human
agaauaaaggcagu

SEQ ID NO: 1417251 - RNA, 13 nt, Human
agaauaaaggcag

SEQ ID NO: 1417252 - RNA, 23 nt, Human
agaaguuugcacuaucuuucagc

SEQ ID NO: 1417253 - RNA, 21 nt, Human
agaaguuugcacuaucuuuca

SEQ ID NO: 1417254 - RNA, 16 nt, Human
agaaguuugcacuauc

SEQ ID NO: 1417255 - RNA, 13 nt, Human
agaaguuugcacu

SEQ ID NO: 1417256 - RNA, 16 nt, Human
agaagugacauugcau

SEQ ID NO: 1417257 - RNA, 17 nt, Human
agaagugacauugcauc

SEQ ID NO: 1417258 - RNA, 16 nt, Human
agaaggcaaaaauagu

SEQ ID NO: 1417259 - RNA, 11 nt, Human
agaaggcaaaa

SEQ ID NO: 1417260 - RNA, 23 nt, Human
agaagcuccucuccccagcccag

SEQ ID NO: 1417261 - RNA, 22 nt, Human
agaagcuccucuccccagccca

SEQ ID NO: 1417262 - RNA, 20 nt, Human
agaagcuccucuccccagcc

SEQ ID NO: 1417263 - RNA, 18 nt, Human
agaagcuccucuccccag

SEQ ID NO: 1417264 - RNA, 17 nt, Human
agaagcuccucucccca

SEQ ID NO: 1417265 - RNA, 14 nt, Human
agaagcuccucucc

SEQ ID NO: 1417266 - RNA, 16 nt, Human
agaagcucccccagca

SEQ ID NO: 1417267 - RNA, 15 nt, Human
agaagcucccccagc

SEQ ID NO: 1417268 - RNA, 13 nt, Human
agaagcuccccca

SEQ ID NO: 1417269 - RNA, 22 nt, Human
agaaguuggggacacauguauu

SEQ ID NO: 1417270 - RNA, 21 nt, Human
agaaguuguaaaguauguauu

SEQ ID NO: 1417271 - RNA, 13 nt, Human
agaaguuucuguc

SEQ ID NO: 1417272 - RNA, 15 nt, Human
agaaguuuagauuuu

SEQ ID NO: 1417273 - RNA, 16 nt, Human
agaaguuuagauuuua

SEQ ID NO: 1417274 - RNA, 23 nt, Human
agaagugcaucuggagagaacag

SEQ ID NO: 1417275 - RNA, 13 nt, Human
agaaguugauaug

SEQ ID NO: 1417276 - RNA, 21 nt, Human
agaagccugaugcugacauuc

SEQ ID NO: 1417277 - RNA, 17 nt, Human
agaagccugaugcugac

SEQ ID NO: 1417278 - RNA, 17 nt, Human
ucuggccuggccagugc

SEQ ID NO: 1417279 - RNA, 14 nt, Human
ucuggccuggccag

SEQ ID NO: 1417280 - RNA, 19 nt, Human
ucuggccuggccagugccc

SEQ ID NO: 1417281 - RNA, 13 nt, Human
ucuggccuggcca

SEQ ID NO: 1417282 - RNA, 15 nt, Human
ucuggccucugcuuu

SEQ ID NO: 1417283 - RNA, 22 nt, Human
ucuggcacagccuggcuguggc

SEQ ID NO: 1417284 - RNA, 23 nt, Human
ucuggcccuugcuuaccucucag

SEQ ID NO: 1417285 - RNA, 19 nt, Human
ucugccuuagucucaguuu

SEQ ID NO: 1417286 - RNA, 15 nt, Human
ucugccuuagucuca

SEQ ID NO: 1417287 - RNA, 17 nt, Human
ucuggaaccucagccug

SEQ ID NO: 1417288 - RNA, 20 nt, Human
ucugcuuugcucuucaagaa

SEQ ID NO: 1417289 - RNA, 23 nt, Human
ucuggaagauggggaccagcagc

SEQ ID NO: 1417290 - RNA, 15 nt, Human
ucuggaagaugggga

SEQ ID NO: 1417291 - RNA, 23 nt, Human
ucuggaaccucagccuggccaga

SEQ ID NO: 1417292 - RNA, 21 nt, Human
ucuggaaccucagccuggcca

SEQ ID NO: 1417293 - RNA, 20 nt, Human
ucuggaaccucagccuggcc

SEQ ID NO: 1417294 - RNA, 19 nt, Human
ucuggaaccucagccuggc

SEQ ID NO: 1417295 - RNA, 18 nt, Human
ucuggaaccucagccugg

SEQ ID NO: 1417296 - RNA, 14 nt, Human
ucuggauuccagag

SEQ ID NO: 1417297 - RNA, 13 nt, Human
ucuggaaguccaa

SEQ ID NO: 1417298 - RNA, 18 nt, Human
ucuggaagugacuuuggc

SEQ ID NO: 1417299 - RNA, 19 nt, Human
ucuggaagugacuuuggcu

SEQ ID NO: 1417300 - RNA, 22 nt, Human
ucuggaagugacuuuggcugca

SEQ ID NO: 1417301 - RNA, 22 nt, Human
ucuggcaaugccacagcccugu

SEQ ID NO: 1417302 - RNA, 23 nt, Human
ucuggcaaugccacagcccuguc

SEQ ID NO: 1417303 - RNA, 21 nt, Human
ucuggcaaugccacagcccug

SEQ ID NO: 1417304 - RNA, 20 nt, Human
ucuggcaaugccacagcccu

SEQ ID NO: 1417305 - RNA, 17 nt, Human
ucuggcaaugccacagc

SEQ ID NO: 1417306 - RNA, 16 nt, Human
ucuggcaaugccacag

SEQ ID NO: 1417307 - RNA, 15 nt, Human
ucuggcaaugccaca

SEQ ID NO: 1417308 - RNA, 14 nt, Human
ucuggcaaugccac

SEQ ID NO: 1417309 - RNA, 23 nt, Human
ucuggcaaggacuuuguacauuu

SEQ ID NO: 1417310 - RNA, 18 nt, Human
ucuggcaaggacuuugua

SEQ ID NO: 1417311 - RNA, 12 nt, Human
ucuggcaaggac

SEQ ID NO: 1417312 - RNA, 16 nt, Human
ucuggcaacaucuuua

SEQ ID NO: 1417313 - RNA, 15 nt, Human
ucuggcaacaucuuu

SEQ ID NO: 1417314 - RNA, 20 nt, Human
ucuggauuccccaucucagg

SEQ ID NO: 1417315 - RNA, 22 nt, Human
ucuggauuccagagcacugcuc

SEQ ID NO: 1417316 - RNA, 21 nt, Human
ucuucccccucucccaguugu

SEQ ID NO: 1417317 - RNA, 18 nt, Human
ucuucccccucucccagu

SEQ ID NO: 1417318 - RNA, 17 nt, Human
ucuucccccucucccag

SEQ ID NO: 1417319 - RNA, 16 nt, Human
ucuucccccucuccca

SEQ ID NO: 1417320 - RNA, 14 nt, Human
ucuucccccucucc

SEQ ID NO: 1417321 - RNA, 14 nt, Human
ucuucccccaccac

SEQ ID NO: 1417322 - RNA, 21 nt, Human
ucuuccccagacgccuggcug

SEQ ID NO: 1417323 - RNA, 19 nt, Human
ucuuccccagacgccuggc

SEQ ID NO: 1417324 - RNA, 13 nt, Human
ucuuccccagacg

SEQ ID NO: 1417325 - RNA, 18 nt, Human
ucuuccucagccagccuc

SEQ ID NO: 1417326 - RNA, 17 nt, Human
ucuuccucagccagccu

SEQ ID NO: 1417327 - RNA, 16 nt, Human
ucuuccucagccagcc

SEQ ID NO: 1417328 - RNA, 13 nt, Human
ucuucucuguugu

SEQ ID NO: 1417329 - RNA, 20 nt, Human
ucuucucucucaauuuuauc

SEQ ID NO: 1417330 - RNA, 18 nt, Human
ucuucucuccagcugacu

SEQ ID NO: 1417331 - RNA, 14 nt, Human
ucuucucuccagcu

SEQ ID NO: 1417332 - RNA, 18 nt, Human
ucuuccugaguggugcca

SEQ ID NO: 1417333 - RNA, 14 nt, Human
ucuuccugaguggu

SEQ ID NO: 1417334 - RNA, 16 nt, Human
ucuuccugacacuuua

SEQ ID NO: 1417335 - RNA, 15 nt, Human
ucuuccugacacuuu

SEQ ID NO: 1417336 - RNA, 13 nt, Human
ucuuccugacacu

SEQ ID NO: 1417337 - RNA, 16 nt, Human
ucuuccucuuccccca

SEQ ID NO: 1417338 - RNA, 14 nt, Human
ucuuccauuugcaa

SEQ ID NO: 1417339 - RNA, 13 nt, Human
ucuuccauuugca

SEQ ID NO: 1417340 - RNA, 17 nt, Human
ucuuccaugcugugcgc

SEQ ID NO: 1417341 - RNA, 15 nt, Human
ucuuccaugcugugc

SEQ ID NO: 1417342 - RNA, 14 nt, Human
ucuuccaugcugug

SEQ ID NO: 1417343 - RNA, 14 nt, Human
ucuucaagaaaucu

SEQ ID NO: 1417344 - RNA, 23 nt, Human
agaaucagagaaggaacauaccc

SEQ ID NO: 1417345 - RNA, 13 nt, Human
agaaucagagaag

SEQ ID NO: 1417346 - RNA, 15 nt, Human
agacauuggcaccua

SEQ ID NO: 1417347 - RNA, 20 nt, Human
agacauuaacucauuagacu

SEQ ID NO: 1417348 - RNA, 22 nt, Human
agacauuaacucauuagacugg

SEQ ID NO: 1417349 - RNA, 19 nt, Human
agacaucugagguuuuauu

SEQ ID NO: 1417350 - RNA, 14 nt, Human
agacccccagcacu

SEQ ID NO: 1417351 - RNA, 24 nt, Human
agaccccuaacccuuugugugcuc

SEQ ID NO: 1417352 - RNA, 20 nt, Human
agacauccaaacuaaaagga

SEQ ID NO: 1417353 - RNA, 16 nt, Human
agacaucagcccuugg

SEQ ID NO: 1417354 - RNA, 14 nt, Human
agacaucagcccuu

SEQ ID NO: 1417355 - RNA, 23 nt, Human
agacauacuaaccagcagaaaug

SEQ ID NO: 1417356 - RNA, 18 nt, Human
agacauaaccacugcuuc

SEQ ID NO: 1417357 - RNA, 23 nt, Human
agacauaaaggaaaagacacauu

SEQ ID NO: 1417358 - RNA, 21 nt, Human
agacauaaaggaaaagacaca

SEQ ID NO: 1417359 - RNA, 16 nt, Human
agacauaaaggaaaag

SEQ ID NO: 1417360 - RNA, 15 nt, Human
agacauaaaggaaaa

SEQ ID NO: 1417361 - RNA, 19 nt, Human
agacauacuaaccagcaga

SEQ ID NO: 1417362 - RNA, 21 nt, Human
ucuucuggggcaggcugggcc

SEQ ID NO: 1417363 - RNA, 20 nt, Human
ucuucuggggcaggcugggc

SEQ ID NO: 1417364 - RNA, 18 nt, Human
ucuucuggggcaggcugg

SEQ ID NO: 1417365 - RNA, 23 nt, Human
ucuucugggagggcagcagggcu

SEQ ID NO: 1417366 - RNA, 22 nt, Human
ucuucugggagggcagcagggc

SEQ ID NO: 1417367 - RNA, 24 nt, Human
ucuucugaacucaaacugaggaau

SEQ ID NO: 1417368 - RNA, 19 nt, Human
ucuucugaacucaaacuga

SEQ ID NO: 1417369 - RNA, 21 nt, Human
ucuucucuuccuuuuaucagu

SEQ ID NO: 1417370 - RNA, 19 nt, Human
ucuucucuuccuuuuauca

SEQ ID NO: 1417371 - RNA, 22 nt, Human
ucuucuggggcaggcugggcca

SEQ ID NO: 1417372 - RNA, 14 nt, Human
agacauaaaggaaa

SEQ ID NO: 1417373 - RNA, 22 nt, Human
ucuucuuaauauguucuuuuaa

SEQ ID NO: 1417374 - RNA, 21 nt, Human
ucuugggcagagcuggcucug

SEQ ID NO: 1417375 - RNA, 20 nt, Human
ucuugggcagagcuggcucu

SEQ ID NO: 1417376 - RNA, 19 nt, Human
ucuugggcagagcuggcuc

SEQ ID NO: 1417377 - RNA, 14 nt, Human
ucuugggaacugaa

SEQ ID NO: 1417378 - RNA, 13 nt, Human
ucuugggaacuga

SEQ ID NO: 1417379 - RNA, 13 nt, Human
ucuuggggaagau

SEQ ID NO: 1417380 - RNA, 23 nt, Human
ucuuggggaguuuaggguggggg

SEQ ID NO: 1417381 - RNA, 23 nt, Human
ucuugggcagagcuggcucugag

SEQ ID NO: 1417382 - RNA, 22 nt, Human
ucuuggggaguuuagggugggg

SEQ ID NO: 1417383 - RNA, 20 nt, Human
ucuuggggggguggccgcug

SEQ ID NO: 1417384 - RNA, 19 nt, Human
ucuuggggggguggccgcu

SEQ ID NO: 1417385 - RNA, 20 nt, Human
ucuuggcuggacccagccag

SEQ ID NO: 1417386 - RNA, 19 nt, Human
ucuuggcuggacccagcca

SEQ ID NO: 1417387 - RNA, 18 nt, Human
ucuuggcuggacccagcc

SEQ ID NO: 1417388 - RNA, 17 nt, Human
ucuuggcuggacccagc

SEQ ID NO: 1417389 - RNA, 14 nt, Human
ucuuggcuggaccc

SEQ ID NO: 1417390 - RNA, 15 nt, Human
ucuuuauaugaagaa

SEQ ID NO: 1417391 - RNA, 11 nt, Human
ucuuuauauga

SEQ ID NO: 1417392 - RNA, 22 nt, Human
ucuuuaacugccguaauuuaac

SEQ ID NO: 1417393 - RNA, 21 nt, Human
ucuuuaacugccguaauuuaa

SEQ ID NO: 1417394 - RNA, 20 nt, Human
ucuuuaacugccguaauuua

SEQ ID NO: 1417395 - RNA, 11 nt, Human
ucuuuaacugc

SEQ ID NO: 1417396 - RNA, 23 nt, Human
ucuuuaacucccauuaccaugua

SEQ ID NO: 1417397 - RNA, 14 nt, Human
ucuuuaaaguucuu

SEQ ID NO: 1417398 - RNA, 12 nt, Human
ucuuuauuuuga

SEQ ID NO: 1417399 - RNA, 23 nt, Human
ucuuuauuuuaaccuuugauaga

SEQ ID NO: 1417400 - RNA, 14 nt, Human
ucuuuaugcuugca

SEQ ID NO: 1417401 - RNA, 15 nt, Human
ucuuuaugcuugcaa

SEQ ID NO: 1417402 - RNA, 15 nt, Human
ucuuucucugaggac

SEQ ID NO: 1417403 - RNA, 13 nt, Human
ucuuucucugagg

SEQ ID NO: 1417404 - RNA, 15 nt, Human
agacuaugaaaaugc

SEQ ID NO: 1417405 - RNA, 20 nt, Human
agacuaucuuacuauuucac

SEQ ID NO: 1417406 - RNA, 22 nt, Human
agaccuuguuacuucugaggua

SEQ ID NO: 1417407 - RNA, 21 nt, Human
agaccuuguuacuucugaggu

SEQ ID NO: 1417408 - RNA, 19 nt, Human
agaccuuguuacuucugag

SEQ ID NO: 1417409 - RNA, 18 nt, Human
agaccuuguuacuucuga

SEQ ID NO: 1417410 - RNA, 18 nt, Human
agaccuguuagcagacag

SEQ ID NO: 1417411 - RNA, 13 nt, Human
agaccuguaauca

SEQ ID NO: 1417412 - RNA, 23 nt, Human
agaccuggcagcucuggacagcc

SEQ ID NO: 1417413 - RNA, 18 nt, Human
agaccuggcagcucugga

SEQ ID NO: 1417414 - RNA, 17 nt, Human
agaccuggcagcucugg

SEQ ID NO: 1417415 - RNA, 16 nt, Human
agaccuggcagcucug

SEQ ID NO: 1417416 - RNA, 15 nt, Human
agaccuggcagcucu

SEQ ID NO: 1417417 - RNA, 14 nt, Human
agaccuggcagcuc

SEQ ID NO: 1417418 - RNA, 11 nt, Human
agaccuggcag

SEQ ID NO: 1417419 - RNA, 19 nt, Human
agaccuguuagcagacagg

SEQ ID NO: 1417420 - RNA, 23 nt, Human
agacucaggccaagaaacgucuu

SEQ ID NO: 1417421 - RNA, 20 nt, Human
agacucaggccaagaaacgu

SEQ ID NO: 1417422 - RNA, 19 nt, Human
agacucaggccaagaaacg

SEQ ID NO: 1417423 - RNA, 20 nt, Human
agacucagcucugacauucu

SEQ ID NO: 1417424 - RNA, 18 nt, Human
agacucagcucugacauu

SEQ ID NO: 1417425 - RNA, 13 nt, Human
agacucagcucug

SEQ ID NO: 1417426 - RNA, 14 nt, Human
ucuugagcaguggc

SEQ ID NO: 1417427 - RNA, 16 nt, Human
ucuugagccuugaacu

SEQ ID NO: 1417428 - RNA, 20 nt, Human
ucuugaguuugucgcucaug

SEQ ID NO: 1417429 - RNA, 14 nt, Human
ucuugaguuugucg

SEQ ID NO: 1417430 - RNA, 13 nt, Human
ucuugaguuuguc

SEQ ID NO: 1417431 - RNA, 19 nt, Human
ucuugaggggaccaggagu

SEQ ID NO: 1417432 - RNA, 18 nt, Human
ucuugaggggaccaggag

SEQ ID NO: 1417433 - RNA, 17 nt, Human
ucuugaggggaccagga

SEQ ID NO: 1417434 - RNA, 15 nt, Human
ucuugaggggaccag

SEQ ID NO: 1417435 - RNA, 22 nt, Human
ucuugaggggaagcuagucuuu

SEQ ID NO: 1417436 - RNA, 16 nt, Human
ucuugagcucuauuau

SEQ ID NO: 1417437 - RNA, 14 nt, Human
ucuugagcucuauu

SEQ ID NO: 1417438 - RNA, 13 nt, Human
ucuugagcucuau

SEQ ID NO: 1417439 - RNA, 22 nt, Human
ucuugagcaguggcugguccag

SEQ ID NO: 1417440 - RNA, 23 nt, Human
ucuugauuauccauauugaguca

SEQ ID NO: 1417441 - RNA, 14 nt, Human
ucuugauuauccau

SEQ ID NO: 1417442 - RNA, 22 nt, Human
ucuugauguaaaaucuugucau

SEQ ID NO: 1417443 - RNA, 21 nt, Human
ucuugauguaaggaugggcau

SEQ ID NO: 1417444 - RNA, 19 nt, Human
ucuugauguaaaaucuugu

SEQ ID NO: 1417445 - RNA, 16 nt, Human
ucuugauguaaaaucu

SEQ ID NO: 1417446 - RNA, 15 nt, Human
ucuugauguaaaauc

SEQ ID NO: 1417447 - RNA, 14 nt, Human
ucuugauguaaaau

SEQ ID NO: 1417448 - RNA, 21 nt, Human
ucuugaugccuggcggggugg

SEQ ID NO: 1417449 - RNA, 18 nt, Human
ucuuuguguagcuuugcu

SEQ ID NO: 1417450 - RNA, 15 nt, Human
ucuuuguguagcuuu

SEQ ID NO: 1417451 - RNA, 13 nt, Human
ucuuuguguagcu

SEQ ID NO: 1417452 - RNA, 21 nt, Human
ucuuugguucuaaggaccuga

SEQ ID NO: 1417453 - RNA, 16 nt, Human
ucuuugguucuaagga

SEQ ID NO: 1417454 - RNA, 15 nt, Human
ucuuugguucuaagg

SEQ ID NO: 1417455 - RNA, 14 nt, Human
ucuuugguucuaag

SEQ ID NO: 1417456 - RNA, 12 nt, Human
ucuuugguucua

SEQ ID NO: 1417457 - RNA, 23 nt, Human
agagacauuaacucauuagacug

SEQ ID NO: 1417458 - RNA, 13 nt, Human
agagacaucagcc

SEQ ID NO: 1417459 - RNA, 23 nt, Human
agagacauacuugaagggccaga

SEQ ID NO: 1417460 - RNA, 22 nt, Human
agagacauacuugaagggccag

SEQ ID NO: 1417461 - RNA, 17 nt, Human
agagacauacuugaagg

SEQ ID NO: 1417462 - RNA, 22 nt, Human
agagacauuaacucauuagacu

SEQ ID NO: 1417463 - RNA, 18 nt, Human
agagacauuaacucauua

SEQ ID NO: 1417464 - RNA, 15 nt, Human
agagacaugcagaga

SEQ ID NO: 1417465 - RNA, 15 nt, Human
agagacaucagcccu

SEQ ID NO: 1417466 - RNA, 10 nt, Human
ucuuucugua

SEQ ID NO: 1417467 - RNA, 21 nt, Human
ucuuucuggcuaugcauuuga

SEQ ID NO: 1417468 - RNA, 13 nt, Human
ucuuucuuagaaa

SEQ ID NO: 1417469 - RNA, 14 nt, Human
ucuuucuuagaaau

SEQ ID NO: 1417470 - RNA, 17 nt, Human
ucuuucucuuucccugg

SEQ ID NO: 1417471 - RNA, 16 nt, Human
ucuuucucuuucccug

SEQ ID NO: 1417472 - RNA, 17 nt, Human
ucuuucucugccaguga

SEQ ID NO: 1417473 - RNA, 16 nt, Human
ucuuucucugccagug

SEQ ID NO: 1417474 - RNA, 15 nt, Human
ucuuucucugccagu

SEQ ID NO: 1417475 - RNA, 13 nt, Human
ucuuucucugcca

SEQ ID NO: 1417476 - RNA, 12 nt, Human
ucuuucucugcc

SEQ ID NO: 1417477 - RNA, 11 nt, Human
ucuuucucugc

SEQ ID NO: 1417478 - RNA, 20 nt, Human
ucuuucuggcuaugcauuug

SEQ ID NO: 1417479 - RNA, 21 nt, Human
ugaaaaaaaaccugagauuua

SEQ ID NO: 1417480 - RNA, 22 nt, Human
ugaaaaaaaaccugagauuuau

SEQ ID NO: 1417481 - RNA, 16 nt, Human
ugaaaaaaaacagugg

SEQ ID NO: 1417482 - RNA, 18 nt, Human
ucuuuuacccuggccccu

SEQ ID NO: 1417483 - RNA, 17 nt, Human
ucuuuuacccuggcccc

SEQ ID NO: 1417484 - RNA, 13 nt, Human
ucuuuuacccugg

SEQ ID NO: 1417485 - RNA, 22 nt, Human
ucuuuuacccuggccccucucc

SEQ ID NO: 1417486 - RNA, 12 nt, Human
ucuuuuacaacu

SEQ ID NO: 1417487 - RNA, 20 nt, Human
ucuuuguuuugugucucuua

SEQ ID NO: 1417488 - RNA, 19 nt, Human
ucuuuguuuugugucucuu

SEQ ID NO: 1417489 - RNA, 18 nt, Human
ucuuuguuuugugucucu

SEQ ID NO: 1417490 - RNA, 17 nt, Human
ucuuuguuuugugucuc

SEQ ID NO: 1417491 - RNA, 16 nt, Human
ucuuuguuuugugucu

SEQ ID NO: 1417492 - RNA, 15 nt, Human
ucuuuguuucuuucu

SEQ ID NO: 1417493 - RNA, 23 nt, Human
ucuuuguucauagcccaguagac

SEQ ID NO: 1417494 - RNA, 16 nt, Human
ucuuuguucauagccc

SEQ ID NO: 1417495 - RNA, 18 nt, Human
ucuuuguuaagacugcug

SEQ ID NO: 1417496 - RNA, 13 nt, Human
ugaaaaagaagaa

SEQ ID NO: 1417497 - RNA, 13 nt, Human
ugaaaaagcgaaa

SEQ ID NO: 1417498 - RNA, 12 nt, Human
ugaaaaaauaua

SEQ ID NO: 1417499 - RNA, 22 nt, Human
ugaaaaaauagagccugaggga

SEQ ID NO: 1417500 - RNA, 16 nt, Human
ugaaaaaaaauaaauu

SEQ ID NO: 1417501 - RNA, 13 nt, Human
ugaaaaaauauau

SEQ ID NO: 1417502 - RNA, 18 nt, Human
ugaaaaaauguauaugca

SEQ ID NO: 1417503 - RNA, 23 nt, Human
ugaaaaaauauauaucaaauaua

SEQ ID NO: 1417504 - RNA, 22 nt, Human
ugaaaaauugcugacuguagcu

SEQ ID NO: 1417505 - RNA, 23 nt, Human
ugaaaaauugcugacuguagcuu

SEQ ID NO: 1417506 - RNA, 16 nt, Human
ugaaaaauugcugacu

SEQ ID NO: 1417507 - RNA, 14 nt, Human
ugaaaaauugcuga

SEQ ID NO: 1417508 - RNA, 21 nt, Human
ugaaaaauuccacucaaaaua

SEQ ID NO: 1417509 - RNA, 19 nt, Human
ugaaaaaugggcacuuaaa

SEQ ID NO: 1417510 - RNA, 15 nt, Human
ugaaaaaguuuguuu

SEQ ID NO: 1417511 - RNA, 16 nt, Human
ugaaaauauaaccagc

SEQ ID NO: 1417512 - RNA, 14 nt, Human
ugaaaauauaacca

SEQ ID NO: 1417513 - RNA, 17 nt, Human
ugaaaagugaagacaga

SEQ ID NO: 1417514 - RNA, 21 nt, Human
ugaaaaguauauugauaaccu

SEQ ID NO: 1417515 - RNA, 22 nt, Human
ugaaaagguuuaugaaaaagaa

SEQ ID NO: 1417516 - RNA, 21 nt, Human
ugaaaagguuuaugaaaaaga

SEQ ID NO: 1417517 - RNA, 19 nt, Human
ugaaaagguuuaugaaaaa

SEQ ID NO: 1417518 - RNA, 20 nt, Human
ugaaaaggguguugggaggg

SEQ ID NO: 1417519 - RNA, 16 nt, Human
ugaaaauauuguuuua

SEQ ID NO: 1417520 - RNA, 20 nt, Human
ugaaaauauuguuuuacaau

SEQ ID NO: 1417521 - RNA, 23 nt, Human
ugaaaauauuguuuuacaauagu

SEQ ID NO: 1417522 - RNA, 20 nt, Human
ugaaaaucuuauaauuuaaa

SEQ ID NO: 1417523 - RNA, 13 nt, Human
ugaaaaugucuug

SEQ ID NO: 1417524 - RNA, 23 nt, Human
ugaaaauguccuugugaugugca

SEQ ID NO: 1417525 - RNA, 19 nt, Human
ugaaaauguccuugugaug

SEQ ID NO: 1417526 - RNA, 18 nt, Human
ugaaaauguccuugugau

SEQ ID NO: 1417527 - RNA, 17 nt, Human
ugaaaauguccuuguga

SEQ ID NO: 1417528 - RNA, 16 nt, Human
ugaaaauguccuugug

SEQ ID NO: 1417529 - RNA, 14 nt, Human
ugaaaauguccuug

SEQ ID NO: 1417530 - RNA, 13 nt, Human
ugaaaauguccuu

SEQ ID NO: 1417531 - RNA, 20 nt, Human
ugaaaauguccaggaaagug

SEQ ID NO: 1417532 - RNA, 16 nt, Human
ugaaaauguccaggaa

SEQ ID NO: 1417533 - RNA, 15 nt, Human
ugaaaaugucuugug

SEQ ID NO: 1417534 - RNA, 14 nt, Human
ugaaaaugucuugu

SEQ ID NO: 1417535 - RNA, 19 nt, Human
ugaaacuccagaugccaca

SEQ ID NO: 1417536 - RNA, 18 nt, Human
ugaaacuccagaugccac

SEQ ID NO: 1417537 - RNA, 19 nt, Human
ugaaacucguuaauuugua

SEQ ID NO: 1417538 - RNA, 17 nt, Human
ugaaacuccagaugcca

SEQ ID NO: 1417539 - RNA, 22 nt, Human
agagccaggggggugaggagcu

SEQ ID NO: 1417540 - RNA, 19 nt, Human
agagccaggagaagcucag

SEQ ID NO: 1417541 - RNA, 22 nt, Human
agagccaggagaagcucagcug

SEQ ID NO: 1417542 - RNA, 18 nt, Human
agagccaggagaagcuca

SEQ ID NO: 1417543 - RNA, 16 nt, Human
agagccaggagaagcu

SEQ ID NO: 1417544 - RNA, 15 nt, Human
agagccaggagaagc

SEQ ID NO: 1417545 - RNA, 13 nt, Human
agagccaggagaa

SEQ ID NO: 1417546 - RNA, 12 nt, Human
agagccaggaga

SEQ ID NO: 1417547 - RNA, 21 nt, Human
agagccagcuaaggggugggg

SEQ ID NO: 1417548 - RNA, 23 nt, Human
agagcaucaugccucugaggcca

SEQ ID NO: 1417549 - RNA, 22 nt, Human
agagcaucaugccucugaggcc

SEQ ID NO: 1417550 - RNA, 21 nt, Human
agagcaucaugccucugaggc

SEQ ID NO: 1417551 - RNA, 20 nt, Human
agagcaucaugccucugagg

SEQ ID NO: 1417552 - RNA, 19 nt, Human
agagcaucaugccucugag

SEQ ID NO: 1417553 - RNA, 18 nt, Human
agagcaucaugccucuga

SEQ ID NO: 1417554 - RNA, 17 nt, Human
agagcaucaugccucug

SEQ ID NO: 1417555 - RNA, 16 nt, Human
agagcaucaugccucu

SEQ ID NO: 1417556 - RNA, 15 nt, Human
agagcaucaugccuc

SEQ ID NO: 1417557 - RNA, 14 nt, Human
agagcaucaugccu

SEQ ID NO: 1417558 - RNA, 13 nt, Human
agagcauaggguc

SEQ ID NO: 1417559 - RNA, 19 nt, Human
agagcaggacugaugucuc

SEQ ID NO: 1417560 - RNA, 17 nt, Human
agagcaggacugauguc

SEQ ID NO: 1417561 - RNA, 22 nt, Human
agagcaggacuccaggcccaag

SEQ ID NO: 1417562 - RNA, 21 nt, Human
agagcaggacuccaggcccaa

SEQ ID NO: 1417563 - RNA, 20 nt, Human
agagcaggacuccaggccca

SEQ ID NO: 1417564 - RNA, 17 nt, Human
agagcaggacuccaggc

SEQ ID NO: 1417565 - RNA, 21 nt, Human
agagcaguuugguuucuagca

SEQ ID NO: 1417566 - RNA, 23 nt, Human
agagcaguuugguuucuagcaug

SEQ ID NO: 1417567 - RNA, 15 nt, Human
agagcaggacuccag

SEQ ID NO: 1417568 - RNA, 13 nt, Human
agagcaggacucc

SEQ ID NO: 1417569 - RNA, 14 nt, Human
agagcaggaauggg

SEQ ID NO: 1417570 - RNA, 22 nt, Human
agagcagcaccuccucagccug

SEQ ID NO: 1417571 - RNA, 23 nt, Human
agagcagcaccuccucagccuga

SEQ ID NO: 1417572 - RNA, 16 nt, Human
agagcagcaccuccuc

SEQ ID NO: 1417573 - RNA, 12 nt, Human
agagcagcaccu

SEQ ID NO: 1417574 - RNA, 13 nt, Human
agagcacugccac

SEQ ID NO: 1417575 - RNA, 12 nt, Human
agagcacugcca

SEQ ID NO: 1417576 - RNA, 20 nt, Human
agagcacgccuguacuagag

SEQ ID NO: 1417577 - RNA, 21 nt, Human
agagcacgccuguacuagagc

SEQ ID NO: 1417578 - RNA, 18 nt, Human
agagcaagaccccaucuc

SEQ ID NO: 1417579 - RNA, 17 nt, Human
agagcuacguauuuaau

SEQ ID NO: 1417580 - RNA, 16 nt, Human
agagcuacguauuuaa

SEQ ID NO: 1417581 - RNA, 14 nt, Human
agagcuacguauuu

SEQ ID NO: 1417582 - RNA, 18 nt, Human
agagcuacauaauuuagu

SEQ ID NO: 1417583 - RNA, 16 nt, Human
agagcuacauaauuua

SEQ ID NO: 1417584 - RNA, 14 nt, Human
agagcuacauaauu

SEQ ID NO: 1417585 - RNA, 11 nt, Human
agagcuacaua

SEQ ID NO: 1417586 - RNA, 23 nt, Human
agagccaggggggugaggagcug

SEQ ID NO: 1417587 - RNA, 13 nt, Human
agagcuccucccu

SEQ ID NO: 1417588 - RNA, 17 nt, Human
agagcuccucccucuca

SEQ ID NO: 1417589 - RNA, 12 nt, Human
agagcuccuccc

SEQ ID NO: 1417590 - RNA, 13 nt, Human
agagcucaggaug

SEQ ID NO: 1417591 - RNA, 12 nt, Human
agagcucaggau

SEQ ID NO: 1417592 - RNA, 10 nt, Human
agagcucagg

SEQ ID NO: 1417593 - RNA, 21 nt, Human
agagcuaggagcaaagccugu

SEQ ID NO: 1417594 - RNA, 20 nt, Human
agagcuaggagcaaagccug

SEQ ID NO: 1417595 - RNA, 19 nt, Human
agagcuaggagcaaagccu

SEQ ID NO: 1417596 - RNA, 18 nt, Human
agagcuaggagcaaagcc

SEQ ID NO: 1417597 - RNA, 13 nt, Human
agagcuaggagca

SEQ ID NO: 1417598 - RNA, 23 nt, Human
agagcugaagguuguggccuuug

SEQ ID NO: 1417599 - RNA, 20 nt, Human
agagcugaagguuguggccu

SEQ ID NO: 1417600 - RNA, 19 nt, Human
agagcugaagguuguggcc

SEQ ID NO: 1417601 - RNA, 16 nt, Human
agagcugauggagaag

SEQ ID NO: 1417602 - RNA, 17 nt, Human
agagcugauggagaagg

SEQ ID NO: 1417603 - RNA, 18 nt, Human
agagcugauggagaagga

SEQ ID NO: 1417604 - RNA, 15 nt, Human
agagagaaaggacuc

SEQ ID NO: 1417605 - RNA, 15 nt, Human
agagaucaaagauga

SEQ ID NO: 1417606 - RNA, 14 nt, Human
agagaucaaagaug

SEQ ID NO: 1417607 - RNA, 14 nt, Human
agagaucaggaaga

SEQ ID NO: 1417608 - RNA, 15 nt, Human
agagaucaggaagag

SEQ ID NO: 1417609 - RNA, 18 nt, Human
agagauguguguugauac

SEQ ID NO: 1417610 - RNA, 17 nt, Human
agagauguguguugaua

SEQ ID NO: 1417611 - RNA, 15 nt, Human
agagauguguguuga

SEQ ID NO: 1417612 - RNA, 20 nt, Human
agagauguguguugauacug

SEQ ID NO: 1417613 - RNA, 14 nt, Human
agagauguguguug

SEQ ID NO: 1417614 - RNA, 13 nt, Human
agagauguguguu

SEQ ID NO: 1417615 - RNA, 12 nt, Human
agagaugugugu

SEQ ID NO: 1417616 - RNA, 18 nt, Human
agagauccaaaagaagcc

SEQ ID NO: 1417617 - RNA, 19 nt, Human
agagaucaggaagagaagg

SEQ ID NO: 1417618 - RNA, 20 nt, Human
agagaucaggaagagaagga

SEQ ID NO: 1417619 - RNA, 16 nt, Human
agagaccuuccagaaa

SEQ ID NO: 1417620 - RNA, 17 nt, Human
agagacgggcccuggug

SEQ ID NO: 1417621 - RNA, 20 nt, Human
ugaaagaauagaacacaguu

SEQ ID NO: 1417622 - RNA, 13 nt, Human
ugaaagaagaaaa

SEQ ID NO: 1417623 - RNA, 14 nt, Human
ugaaacuuucauuc

SEQ ID NO: 1417624 - RNA, 23 nt, Human
ugaaacuuucauuccuucagauu

SEQ ID NO: 1417625 - RNA, 12 nt, Human
ugaaacuuuugg

SEQ ID NO: 1417626 - RNA, 13 nt, Human
agaucaaagauga

SEQ ID NO: 1417627 - RNA, 12 nt, Human
agaucaaagaug

SEQ ID NO: 1417628 - RNA, 23 nt, Human
ugaauuucuuuugccguuauuaa

SEQ ID NO: 1417629 - RNA, 13 nt, Human
ugaauuugugaag

SEQ ID NO: 1417630 - RNA, 21 nt, Human
ugaauuugugaagguggaaau

SEQ ID NO: 1417631 - RNA, 21 nt, Human
ugaauuuuuaaacaaguauuu

SEQ ID NO: 1417632 - RNA, 23 nt, Human
ugaauuuuuaaacaaguauuugu

SEQ ID NO: 1417633 - RNA, 19 nt, Human
ugaauuuuuaaacaaguau

SEQ ID NO: 1417634 - RNA, 17 nt, Human
ugaauuuuuaaacaagu

SEQ ID NO: 1417635 - RNA, 22 nt, Human
ugaauuuuuaaaacccauuuaa

SEQ ID NO: 1417636 - RNA, 16 nt, Human
ugaauuuuguugcugu

SEQ ID NO: 1417637 - RNA, 21 nt, Human
ugaauuuguaaugucuugagc

SEQ ID NO: 1417638 - RNA, 17 nt, Human
ugaauuuguaaugucuu

SEQ ID NO: 1417639 - RNA, 13 nt, Human
ugaauuuguaaug

SEQ ID NO: 1417640 - RNA, 23 nt, Human
ugaauuugugaagguggaaauaa

SEQ ID NO: 1417641 - RNA, 14 nt, Human
ugaauuuuguugcu

SEQ ID NO: 1417642 - RNA, 22 nt, Human
ugacacucccuugggcucccug

SEQ ID NO: 1417643 - RNA, 22 nt, Human
ugacacucauauaauuauaugu

SEQ ID NO: 1417644 - RNA, 16 nt, Human
ugacacucauauaauu

SEQ ID NO: 1417645 - RNA, 23 nt, Human
ugacacuagcccaaugaaaugaa

SEQ ID NO: 1417646 - RNA, 22 nt, Human
ugacacuagcccaaugaaauga

SEQ ID NO: 1417647 - RNA, 21 nt, Human
ugacacuagcccaaugaaaug

SEQ ID NO: 1417648 - RNA, 19 nt, Human
ugacacuagcccaaugaaa

SEQ ID NO: 1417649 - RNA, 18 nt, Human
ugacacuagcccaaugaa

SEQ ID NO: 1417650 - RNA, 22 nt, Human
ugacacauggccccucccccug

SEQ ID NO: 1417651 - RNA, 16 nt, Human
ugacacauggccccuc

SEQ ID NO: 1417652 - RNA, 12 nt, Human
ugacacaugcaa

SEQ ID NO: 1417653 - RNA, 20 nt, Human
ugacacaugcaaggucauuu

SEQ ID NO: 1417654 - RNA, 17 nt, Human
ugacaaaggcaagcacu

SEQ ID NO: 1417655 - RNA, 22 nt, Human
ugacaaagcagauucagaaaug

SEQ ID NO: 1417656 - RNA, 19 nt, Human
ugacaaagacugaguacgu

SEQ ID NO: 1417657 - RNA, 20 nt, Human
ugacaaagguaaaucagacu

SEQ ID NO: 1417658 - RNA, 13 nt, Human
agauaacuaggaa

SEQ ID NO: 1417659 - RNA, 20 nt, Human
agaguuuuggaugcagugcu

SEQ ID NO: 1417660 - RNA, 21 nt, Human
agaguuuuggaugcagugcuc

SEQ ID NO: 1417661 - RNA, 13 nt, Human
agaguuuuggaug

SEQ ID NO: 1417662 - RNA, 17 nt, Human
agaguuuuggaugcagu

SEQ ID NO: 1417663 - RNA, 18 nt, Human
agaguuuuggaugcagug

SEQ ID NO: 1417664 - RNA, 19 nt, Human
agaguuuuggaugcagugc

SEQ ID NO: 1417665 - RNA, 22 nt, Human
agaguuugaugaggcccuccac

SEQ ID NO: 1417666 - RNA, 23 nt, Human
agaguuugaugaggcccuccaca

SEQ ID NO: 1417667 - RNA, 20 nt, Human
agaguuugaugaggcccucc

SEQ ID NO: 1417668 - RNA, 18 nt, Human
agaguuugaugaggcccu

SEQ ID NO: 1417669 - RNA, 11 nt, Human
agauaacuuuu

SEQ ID NO: 1417670 - RNA, 22 nt, Human
agauaacugaaaauuauuuaaa

SEQ ID NO: 1417671 - RNA, 18 nt, Human
agauaacugaaaauuauu

SEQ ID NO: 1417672 - RNA, 15 nt, Human
agauaacugaaaauu

SEQ ID NO: 1417673 - RNA, 13 nt, Human
agaguuuccugaa

SEQ ID NO: 1417674 - RNA, 21 nt, Human
agaguuguuacauuuuuaagu

SEQ ID NO: 1417675 - RNA, 19 nt, Human
agaguuguuacauuuuuaa

SEQ ID NO: 1417676 - RNA, 20 nt, Human
agaguuguuacauuuuuaag

SEQ ID NO: 1417677 - RNA, 17 nt, Human
agaguuguuacauuuuu

SEQ ID NO: 1417678 - RNA, 16 nt, Human
agauacauacagaauu

SEQ ID NO: 1417679 - RNA, 15 nt, Human
agauacuguaucaug

SEQ ID NO: 1417680 - RNA, 16 nt, Human
agauacuguaucauga

SEQ ID NO: 1417681 - RNA, 20 nt, Human
agauauuuugcuuugugauu

SEQ ID NO: 1417682 - RNA, 21 nt, Human
agauauuuugcuuugugauuu

SEQ ID NO: 1417683 - RNA, 22 nt, Human
agauauuuugcuuugugauuuu

SEQ ID NO: 1417684 - RNA, 15 nt, Human
agauacauacagaau

SEQ ID NO: 1417685 - RNA, 14 nt, Human
agauacauacagaa

SEQ ID NO: 1417686 - RNA, 22 nt, Human
agauacaguuacucagaauucu

SEQ ID NO: 1417687 - RNA, 11 nt, Human
agauacuguau

SEQ ID NO: 1417688 - RNA, 13 nt, Human
agauacaguuacu

SEQ ID NO: 1417689 - RNA, 18 nt, Human
ugaagguaaauaaaaaga

SEQ ID NO: 1417690 - RNA, 20 nt, Human
ugaagguaaauaaaaagaaa

SEQ ID NO: 1417691 - RNA, 14 nt, Human
ugaagguaaauaaa

SEQ ID NO: 1417692 - RNA, 22 nt, Human
ugaaggguaauuauauaguuac

SEQ ID NO: 1417693 - RNA, 17 nt, Human
ugaauaaaguguaacaa

SEQ ID NO: 1417694 - RNA, 14 nt, Human
ugaauaaagcaauu

SEQ ID NO: 1417695 - RNA, 14 nt, Human
ugaauaaaugucuu

SEQ ID NO: 1417696 - RNA, 13 nt, Human
ugaauaaaugucu

SEQ ID NO: 1417697 - RNA, 20 nt, Human
ugaauaaaugucacuuuuug

SEQ ID NO: 1417698 - RNA, 19 nt, Human
ugaauaaaugucacuuuuu

SEQ ID NO: 1417699 - RNA, 16 nt, Human
ugaauaaaugucacuu

SEQ ID NO: 1417700 - RNA, 15 nt, Human
ugaauaaaugucacu

SEQ ID NO: 1417701 - RNA, 13 nt, Human
ugaauaaauguca

SEQ ID NO: 1417702 - RNA, 12 nt, Human
ugaauaaauguc

SEQ ID NO: 1417703 - RNA, 23 nt, Human
ugaauaccacucuguaauugcaa

SEQ ID NO: 1417704 - RNA, 19 nt, Human
ugaauaccacucuguaauu

SEQ ID NO: 1417705 - RNA, 18 nt, Human
ugaauaccacucuguaau

SEQ ID NO: 1417706 - RNA, 17 nt, Human
ugaauaccacucuguaa

SEQ ID NO: 1417707 - RNA, 16 nt, Human
ugaauaccacucugua

SEQ ID NO: 1417708 - RNA, 14 nt, Human
ugaauaccugcuca

SEQ ID NO: 1417709 - RNA, 16 nt, Human
ugaauacccuuuucug

SEQ ID NO: 1417710 - RNA, 20 nt, Human
ugaauaccacucuguaauug

SEQ ID NO: 1417711 - RNA, 16 nt, Human
ugaauacuuugaaugu

SEQ ID NO: 1417712 - RNA, 15 nt, Human
ugaauacuuugaaug

SEQ ID NO: 1417713 - RNA, 14 nt, Human
ugaauacuuugaau

SEQ ID NO: 1417714 - RNA, 13 nt, Human
ugaauacuuugaa

SEQ ID NO: 1417715 - RNA, 16 nt, Human
ugaauacuguauuuug

SEQ ID NO: 1417716 - RNA, 14 nt, Human
ugaauacugcuaca

SEQ ID NO: 1417717 - RNA, 15 nt, Human
ugaauacuuuauaaa

SEQ ID NO: 1417718 - RNA, 21 nt, Human
ugaauguaaauuuguacuauu

SEQ ID NO: 1417719 - RNA, 20 nt, Human
ugaauguaaauuuguacuau

SEQ ID NO: 1417720 - RNA, 22 nt, Human
ugaauguaaauuuguacuauuu

SEQ ID NO: 1417721 - RNA, 18 nt, Human
ugaaugggacagaguuga

SEQ ID NO: 1417722 - RNA, 22 nt, Human
ugaauagccauauuuguaaaau

SEQ ID NO: 1417723 - RNA, 18 nt, Human
ugaauaggcgaucacaac

SEQ ID NO: 1417724 - RNA, 19 nt, Human
ugaauaggcgaucacaacg

SEQ ID NO: 1417725 - RNA, 20 nt, Human
ugaauagccauauuuguaaa

SEQ ID NO: 1417726 - RNA, 18 nt, Human
ugaauagccauauuugua

SEQ ID NO: 1417727 - RNA, 17 nt, Human
ugaauaggcgaucacaa

SEQ ID NO: 1417728 - RNA, 16 nt, Human
ugaauagccauauuug

SEQ ID NO: 1417729 - RNA, 18 nt, Human
ugaauagauaugaaagcu

SEQ ID NO: 1417730 - RNA, 21 nt, Human
ugaauagauaugaaagcugau

SEQ ID NO: 1417731 - RNA, 16 nt, Human
ugaauacuuuuuacaa

SEQ ID NO: 1417732 - RNA, 20 nt, Human
ugaauacuuugaauguguuu

SEQ ID NO: 1417733 - RNA, 19 nt, Human
ugaauacuuugaauguguu

SEQ ID NO: 1417734 - RNA, 18 nt, Human
ugaauacuuugaaugugu

SEQ ID NO: 1417735 - RNA, 17 nt, Human
ugaauacuuugaaugug

SEQ ID NO: 1417736 - RNA, 18 nt, Human
ugaauauugccauuaugc

SEQ ID NO: 1417737 - RNA, 16 nt, Human
ugaauauugccauuau

SEQ ID NO: 1417738 - RNA, 15 nt, Human
ugaauauuauuccuc

SEQ ID NO: 1417739 - RNA, 13 nt, Human
ugaauauuauucc

SEQ ID NO: 1417740 - RNA, 18 nt, Human
ugaauauuuaguguucau

SEQ ID NO: 1417741 - RNA, 20 nt, Human
agaggcuuccuucauuuccu

SEQ ID NO: 1417742 - RNA, 22 nt, Human
agaggcuguucccaccaggcug

SEQ ID NO: 1417743 - RNA, 14 nt, Human
agaggcugucuguu

SEQ ID NO: 1417744 - RNA, 14 nt, Human
agaggcuggguuca

SEQ ID NO: 1417745 - RNA, 19 nt, Human
agaggcccucgcugccagc

SEQ ID NO: 1417746 - RNA, 14 nt, Human
agaggcccucgcug

SEQ ID NO: 1417747 - RNA, 24 nt, Human
agagggaggagaaugagccucggc

SEQ ID NO: 1417748 - RNA, 14 nt, Human
agaggcccucaagu

SEQ ID NO: 1417749 - RNA, 17 nt, Human
ugaaagucuguccuuga

SEQ ID NO: 1417750 - RNA, 22 nt, Human
agaggcccccagcccagggcuc

SEQ ID NO: 1417751 - RNA, 21 nt, Human
agaggcccccagcccagggcu

SEQ ID NO: 1417752 - RNA, 20 nt, Human
agaggcccccagcccagggc

SEQ ID NO: 1417753 - RNA, 17 nt, Human
agaggcccccagcccag

SEQ ID NO: 1417754 - RNA, 16 nt, Human
agaggcccccagccca

SEQ ID NO: 1417755 - RNA, 14 nt, Human
agaggcccccagcc

SEQ ID NO: 1417756 - RNA, 23 nt, Human
agaggccccagccucccugaagc

SEQ ID NO: 1417757 - RNA, 16 nt, Human
agaggccccagccucc

SEQ ID NO: 1417758 - RNA, 15 nt, Human
agaggccccagccuc

SEQ ID NO: 1417759 - RNA, 14 nt, Human
agaggccccagccu

SEQ ID NO: 1417760 - RNA, 13 nt, Human
agaggccccagcc

SEQ ID NO: 1417761 - RNA, 12 nt, Human
agaggccccagc

SEQ ID NO: 1417762 - RNA, 16 nt, Human
ugaaagucuguccuug

SEQ ID NO: 1417763 - RNA, 15 nt, Human
ugaaagucuguccuu

SEQ ID NO: 1417764 - RNA, 12 nt, Human
ugaaagucuguc

SEQ ID NO: 1417765 - RNA, 19 nt, Human
ugaaagucacggcugcgca

SEQ ID NO: 1417766 - RNA, 17 nt, Human
ugaaagguuuuuuuuca

SEQ ID NO: 1417767 - RNA, 18 nt, Human
ugaaagguuuuuuuucag

SEQ ID NO: 1417768 - RNA, 19 nt, Human
agagcugauggagaaggaa

SEQ ID NO: 1417769 - RNA, 20 nt, Human
agagcugauggagaaggaag

SEQ ID NO: 1417770 - RNA, 21 nt, Human
agagcugauggagaaggaagg

SEQ ID NO: 1417771 - RNA, 16 nt, Human
agagguguuauuugga

SEQ ID NO: 1417772 - RNA, 24 nt, Human
agaggugggccagucuguggauca

SEQ ID NO: 1417773 - RNA, 19 nt, Human
ugaagccaauucagacagg

SEQ ID NO: 1417774 - RNA, 18 nt, Human
ugaagggggcggccuaug

SEQ ID NO: 1417775 - RNA, 15 nt, Human
ugaagggggcggccu

SEQ ID NO: 1417776 - RNA, 14 nt, Human
ugaagggcccgaga

SEQ ID NO: 1417777 - RNA, 19 nt, Human
ugaagggccagagccaggg

SEQ ID NO: 1417778 - RNA, 18 nt, Human
ugaagggccagagccagg

SEQ ID NO: 1417779 - RNA, 16 nt, Human
ugaagcucacuucugg

SEQ ID NO: 1417780 - RNA, 22 nt, Human
ugaagcuacugugugugugaau

SEQ ID NO: 1417781 - RNA, 14 nt, Human
ugaagcuacugugu

SEQ ID NO: 1417782 - RNA, 20 nt, Human
ugaagcuaucguaaaauuaa

SEQ ID NO: 1417783 - RNA, 17 nt, Human
agauuccuucccaugga

SEQ ID NO: 1417784 - RNA, 15 nt, Human
agauuccuucccaug

SEQ ID NO: 1417785 - RNA, 13 nt, Human
agauuccuuccca

SEQ ID NO: 1417786 - RNA, 24 nt, Human
agauuccggauccuaagcaucuaa

SEQ ID NO: 1417787 - RNA, 23 nt, Human
agauuccggauccuaagcaucua

SEQ ID NO: 1417788 - RNA, 20 nt, Human
agauuccggauccuaagcau

SEQ ID NO: 1417789 - RNA, 18 nt, Human
agauuccggauccuaagc

SEQ ID NO: 1417790 - RNA, 16 nt, Human
agauuccggauccuaa

SEQ ID NO: 1417791 - RNA, 13 nt, Human
agauucuaaagau

SEQ ID NO: 1417792 - RNA, 22 nt, Human
agauugcugaaauuuuauaugc

SEQ ID NO: 1417793 - RNA, 12 nt, Human
agauucuaaaga

SEQ ID NO: 1417794 - RNA, 11 nt, Human
agauucuaaag

SEQ ID NO: 1417795 - RNA, 18 nt, Human
ugacucggggguggggaa

SEQ ID NO: 1417796 - RNA, 19 nt, Human
ugacuuacuguacaugaaa

SEQ ID NO: 1417797 - RNA, 16 nt, Human
agauuuccuucuuuuu

SEQ ID NO: 1417798 - RNA, 21 nt, Human
agauuuccuucuuuuuuucuu

SEQ ID NO: 1417799 - RNA, 14 nt, Human
agauuucugaggaa

SEQ ID NO: 1417800 - RNA, 15 nt, Human
agauuucugaggaaa

SEQ ID NO: 1417801 - RNA, 15 nt, Human
agauuuugauagcaa

SEQ ID NO: 1417802 - RNA, 18 nt, Human
agauuuugauagcaaagc

SEQ ID NO: 1417803 - RNA, 19 nt, Human
agauuuugauagcaaagcg

SEQ ID NO: 1417804 - RNA, 22 nt, Human
agauuuucuuuugccuuuugca

SEQ ID NO: 1417805 - RNA, 19 nt, Human
agauuuucugguucuaaca

SEQ ID NO: 1417806 - RNA, 18 nt, Human
agauuuucugguucuaac

SEQ ID NO: 1417807 - RNA, 17 nt, Human
agauuuucugguucuaa

SEQ ID NO: 1417808 - RNA, 16 nt, Human
agauuuucugguucua

SEQ ID NO: 1417809 - RNA, 12 nt, Human
agauuuucuggu

SEQ ID NO: 1417810 - RNA, 19 nt, Human
agauuuucugcuacuuugc

SEQ ID NO: 1417811 - RNA, 21 nt, Human
agcaacuuguccuagcacaga

SEQ ID NO: 1417812 - RNA, 20 nt, Human
agcaacucuugauuauccau

SEQ ID NO: 1417813 - RNA, 16 nt, Human
agcaacucuugauuau

SEQ ID NO: 1417814 - RNA, 19 nt, Human
agcaagaaggcaaaaauag

SEQ ID NO: 1417815 - RNA, 14 nt, Human
agcaacuuguccua

SEQ ID NO: 1417816 - RNA, 14 nt, Human
agcaacucuugauu

SEQ ID NO: 1417817 - RNA, 16 nt, Human
agcaacuaucagacua

SEQ ID NO: 1417818 - RNA, 16 nt, Human
agcaacuaggccuuca

SEQ ID NO: 1417819 - RNA, 21 nt, Human
agcaacuacagucuaaagcug

SEQ ID NO: 1417820 - RNA, 13 nt, Human
agcaacggcacag

SEQ ID NO: 1417821 - RNA, 23 nt, Human
agcaacgcuauuccagcuguccc

SEQ ID NO: 1417822 - RNA, 20 nt, Human
agcaacgcuauuccagcugu

SEQ ID NO: 1417823 - RNA, 19 nt, Human
agcaacgcuauuccagcug

SEQ ID NO: 1417824 - RNA, 18 nt, Human
agcaacgcuauuccagcu

SEQ ID NO: 1417825 - RNA, 14 nt, Human
agcaaaaaagaaaa

SEQ ID NO: 1417826 - RNA, 12 nt, Human
agcaaaaaagaa

SEQ ID NO: 1417827 - RNA, 18 nt, Human
agauuuuuuuuuuuucuc

SEQ ID NO: 1417828 - RNA, 16 nt, Human
agauuuuuuaauaauu

SEQ ID NO: 1417829 - RNA, 14 nt, Human
agauuuuuuaauaa

SEQ ID NO: 1417830 - RNA, 13 nt, Human
agauuuuuuaaua

SEQ ID NO: 1417831 - RNA, 22 nt, Human
ugagaagugaaugcugggacuc

SEQ ID NO: 1417832 - RNA, 21 nt, Human
ugagaagugaaugcugggacu

SEQ ID NO: 1417833 - RNA, 19 nt, Human
ugagaagugaaugcuggga

SEQ ID NO: 1417834 - RNA, 18 nt, Human
ugagaagugaaugcuggg

SEQ ID NO: 1417835 - RNA, 14 nt, Human
agcaagauuucaga

SEQ ID NO: 1417836 - RNA, 21 nt, Human
agcaagaggccguggcugcug

SEQ ID NO: 1417837 - RNA, 19 nt, Human
agcaagaggccguggcugc

SEQ ID NO: 1417838 - RNA, 22 nt, Human
agcaagacuucucuuugccuca

SEQ ID NO: 1417839 - RNA, 23 nt, Human
agcaagacuucucuuugccucaa

SEQ ID NO: 1417840 - RNA, 21 nt, Human
agcaagacuucucuuugccuc

SEQ ID NO: 1417841 - RNA, 21 nt, Human
agcaagacccuaaacauccau

SEQ ID NO: 1417842 - RNA, 17 nt, Human
agcaagaccccaucuca

SEQ ID NO: 1417843 - RNA, 20 nt, Human
ugaccugugagcccagcugg

SEQ ID NO: 1417844 - RNA, 17 nt, Human
ugaccugaggcuguggu

SEQ ID NO: 1417845 - RNA, 15 nt, Human
ugaccugaggcugug

SEQ ID NO: 1417846 - RNA, 12 nt, Human
ugaccugaggcu

SEQ ID NO: 1417847 - RNA, 21 nt, Human
ugacccggcacccccugcagc

SEQ ID NO: 1417848 - RNA, 16 nt, Human
ugaccuuaaaugcaac

SEQ ID NO: 1417849 - RNA, 14 nt, Human
ugaccuuaaaugca

SEQ ID NO: 1417850 - RNA, 13 nt, Human
ugaccccugcuca

SEQ ID NO: 1417851 - RNA, 20 nt, Human
ugaccccagggcacaggagc

SEQ ID NO: 1417852 - RNA, 19 nt, Human
ugaccccagggcacaggag

SEQ ID NO: 1417853 - RNA, 18 nt, Human
ugaccccagggcacagga

SEQ ID NO: 1417854 - RNA, 17 nt, Human
ugaccccagggcacagg

SEQ ID NO: 1417855 - RNA, 13 nt, Human
ugaccccagggca

SEQ ID NO: 1417856 - RNA, 12 nt, Human
ugaccccagggc

SEQ ID NO: 1417857 - RNA, 11 nt, Human
ugaccccaggg

SEQ ID NO: 1417858 - RNA, 13 nt, Human
ugaccccagagga

SEQ ID NO: 1417859 - RNA, 22 nt, Human
ugaccccaaacaccuuccagcu

SEQ ID NO: 1417860 - RNA, 18 nt, Human
ugacccggcacccccugc

SEQ ID NO: 1417861 - RNA, 22 nt, Human
ugacccggcacccccugcagcu

SEQ ID NO: 1417862 - RNA, 20 nt, Human
ugacccggcacccccugcag

SEQ ID NO: 1417863 - RNA, 19 nt, Human
ugacccggcacccccugca

SEQ ID NO: 1417864 - RNA, 21 nt, Human
ugacccucaucuuucuuccaa

SEQ ID NO: 1417865 - RNA, 22 nt, Human
ugacucaagaagugaagaaugc

SEQ ID NO: 1417866 - RNA, 15 nt, Human
ugacucaagaaguga

SEQ ID NO: 1417867 - RNA, 14 nt, Human
ugacucaagaagug

SEQ ID NO: 1417868 - RNA, 12 nt, Human
ugacucaagaag

SEQ ID NO: 1417869 - RNA, 21 nt, Human
ugacuagggagccauguuuca

SEQ ID NO: 1417870 - RNA, 20 nt, Human
ugacuagggagccauguuuc

SEQ ID NO: 1417871 - RNA, 18 nt, Human
ugacuagggagccauguu

SEQ ID NO: 1417872 - RNA, 17 nt, Human
ugacuagggagccaugu

SEQ ID NO: 1417873 - RNA, 13 nt, Human
ugacuagggagcc

SEQ ID NO: 1417874 - RNA, 23 nt, Human
ugacuagaugauggaugccaaua

SEQ ID NO: 1417875 - RNA, 19 nt, Human
ugacucacaccugaacuga

SEQ ID NO: 1417876 - RNA, 14 nt, Human
ugacucacaccuga

SEQ ID NO: 1417877 - RNA, 17 nt, Human
ugacucgggggugggga

SEQ ID NO: 1417878 - RNA, 16 nt, Human
ugacucgggggugggg

SEQ ID NO: 1417879 - RNA, 13 nt, Human
ugacuuacuguac

SEQ ID NO: 1417880 - RNA, 15 nt, Human
ugacuuacuguacau

SEQ ID NO: 1417881 - RNA, 16 nt, Human
ugacuuacuguacaug

SEQ ID NO: 1417882 - RNA, 19 nt, Human
agauguuugauagauuuuc

SEQ ID NO: 1417883 - RNA, 17 nt, Human
agauguuugauagauuu

SEQ ID NO: 1417884 - RNA, 16 nt, Human
agauguuuauuucagg

SEQ ID NO: 1417885 - RNA, 15 nt, Human
agauguuuauuucag

SEQ ID NO: 1417886 - RNA, 22 nt, Human
agauguuuauucuucuagaguu

SEQ ID NO: 1417887 - RNA, 21 nt, Human
agauguuuauucuucuagagu

SEQ ID NO: 1417888 - RNA, 20 nt, Human
agauguuuauucuucuagag

SEQ ID NO: 1417889 - RNA, 19 nt, Human
agauguuuauucuucuaga

SEQ ID NO: 1417890 - RNA, 18 nt, Human
agauguuuauucuucuag

SEQ ID NO: 1417891 - RNA, 21 nt, Human
agauguucucuaucauuuaau

SEQ ID NO: 1417892 - RNA, 21 nt, Human
ugaccccaaacaccuuccagc

SEQ ID NO: 1417893 - RNA, 13 nt, Human
agauuaagaaaua

SEQ ID NO: 1417894 - RNA, 20 nt, Human
agaugcuccuugggcccuuu

SEQ ID NO: 1417895 - RNA, 15 nt, Human
agaugcuccuugggc

SEQ ID NO: 1417896 - RNA, 16 nt, Human
agaugcugaaaauguc

SEQ ID NO: 1417897 - RNA, 15 nt, Human
agaugcccaaauccu

SEQ ID NO: 1417898 - RNA, 16 nt, Human
agaugcagggcaguca

SEQ ID NO: 1417899 - RNA, 14 nt, Human
ugacacucccuugg

SEQ ID NO: 1417900 - RNA, 13 nt, Human
agaugcagggcag

SEQ ID NO: 1417901 - RNA, 17 nt, Human
agaugcaguucugaaga

SEQ ID NO: 1417902 - RNA, 16 nt, Human
agaugcaguucugaag

SEQ ID NO: 1417903 - RNA, 14 nt, Human
ugauuccuuuaaca

SEQ ID NO: 1417904 - RNA, 15 nt, Human
ugauuccuuuaacaa

SEQ ID NO: 1417905 - RNA, 22 nt, Human
ugauuccuugauggagauauuu

SEQ ID NO: 1417906 - RNA, 18 nt, Human
ugauuccauccaccuuuc

SEQ ID NO: 1417907 - RNA, 16 nt, Human
ugauuccauccaccuu

SEQ ID NO: 1417908 - RNA, 22 nt, Human
ugauucauuuuaacaucugaga

SEQ ID NO: 1417909 - RNA, 21 nt, Human
ugauucaguguuaaaugugau

SEQ ID NO: 1417910 - RNA, 12 nt, Human
ugauucaguguu

SEQ ID NO: 1417911 - RNA, 20 nt, Human
ugauucauuuuaacaucuga

SEQ ID NO: 1417912 - RNA, 24 nt, Human
ugauucaguguuaaaugugaugaa

SEQ ID NO: 1417913 - RNA, 21 nt, Human
agcccaggaagucucaucugg

SEQ ID NO: 1417914 - RNA, 12 nt, Human
agcccagcucca

SEQ ID NO: 1417915 - RNA, 19 nt, Human
agcccagccccacuccucu

SEQ ID NO: 1417916 - RNA, 16 nt, Human
agcccagccccacucc

SEQ ID NO: 1417917 - RNA, 11 nt, Human
agcccagccca

SEQ ID NO: 1417918 - RNA, 16 nt, Human
agcccagcugggucag

SEQ ID NO: 1417919 - RNA, 15 nt, Human
agcccagcuggguca

SEQ ID NO: 1417920 - RNA, 13 nt, Human
agcccagcugggu

SEQ ID NO: 1417921 - RNA, 14 nt, Human
agcccagcucugaa

SEQ ID NO: 1417922 - RNA, 21 nt, Human
agccauauuuguaaaaugaca

SEQ ID NO: 1417923 - RNA, 16 nt, Human
agccaucaaaaugcuu

SEQ ID NO: 1417924 - RNA, 15 nt, Human
agccaucaaaaugcu

SEQ ID NO: 1417925 - RNA, 14 nt, Human
agccaucaaaaugc

SEQ ID NO: 1417926 - RNA, 13 nt, Human
agccaucaaaaug

SEQ ID NO: 1417927 - RNA, 17 nt, Human
agccaugucuucucccu

SEQ ID NO: 1417928 - RNA, 16 nt, Human
agccaugucuucuccc

SEQ ID NO: 1417929 - RNA, 15 nt, Human
agccaugucuucucc

SEQ ID NO: 1417930 - RNA, 22 nt, Human
agcccagagacauacuugaagg

SEQ ID NO: 1417931 - RNA, 21 nt, Human
agcccagagacauacuugaag

SEQ ID NO: 1417932 - RNA, 12 nt, Human
agcccagagaca

SEQ ID NO: 1417933 - RNA, 11 nt, Human
agcccagagac

SEQ ID NO: 1417934 - RNA, 10 nt, Human
agcccagaga

SEQ ID NO: 1417935 - RNA, 21 nt, Human
agccaugucuucucccuggaa

SEQ ID NO: 1417936 - RNA, 13 nt, Human
agccaggcccagc

SEQ ID NO: 1417937 - RNA, 14 nt, Human
agccaggcccagcc

SEQ ID NO: 1417938 - RNA, 23 nt, Human
agccaggggagcagaggggcaga

SEQ ID NO: 1417939 - RNA, 18 nt, Human
agccaggggagcagaggg

SEQ ID NO: 1417940 - RNA, 17 nt, Human
agccaggggagcagagg

SEQ ID NO: 1417941 - RNA, 16 nt, Human
agccagggucuccaga

SEQ ID NO: 1417942 - RNA, 14 nt, Human
agccagggucucca

SEQ ID NO: 1417943 - RNA, 21 nt, Human
agccagggggagcugggccug

SEQ ID NO: 1417944 - RNA, 19 nt, Human
agccagggggagcugggcc

SEQ ID NO: 1417945 - RNA, 16 nt, Human
agccauauuuguaaaa

SEQ ID NO: 1417946 - RNA, 14 nt, Human
agccauauuuguaa

SEQ ID NO: 1417947 - RNA, 10 nt, Human
agccauagug

SEQ ID NO: 1417948 - RNA, 23 nt, Human
agccaguuuggguaaaauacuuu

SEQ ID NO: 1417949 - RNA, 22 nt, Human
agccaguuuggguaaaauacuu

SEQ ID NO: 1417950 - RNA, 23 nt, Human
agccagugcccugagccaggguc

SEQ ID NO: 1417951 - RNA, 18 nt, Human
agccagugcccugagcca

SEQ ID NO: 1417952 - RNA, 17 nt, Human
agccagugcccugagcc

SEQ ID NO: 1417953 - RNA, 16 nt, Human
agccagugcccugagc

SEQ ID NO: 1417954 - RNA, 15 nt, Human
agccagugcccugag

SEQ ID NO: 1417955 - RNA, 15 nt, Human
agccagggucuccag

SEQ ID NO: 1417956 - RNA, 23 nt, Human
agccaguaaaugggggugcauuu

SEQ ID NO: 1417957 - RNA, 14 nt, Human
agccagcuuucccu

SEQ ID NO: 1417958 - RNA, 13 nt, Human
agccagcuuuccc

SEQ ID NO: 1417959 - RNA, 21 nt, Human
agccagcuuguuuacaugcuu

SEQ ID NO: 1417960 - RNA, 20 nt, Human
agccagcuuguuuacaugcu

SEQ ID NO: 1417961 - RNA, 19 nt, Human
agccagcuuguuuacaugc

SEQ ID NO: 1417962 - RNA, 12 nt, Human
agccagcuuguu

SEQ ID NO: 1417963 - RNA, 16 nt, Human
agccagcucugcauua

SEQ ID NO: 1417964 - RNA, 22 nt, Human
agccagaacuugacccugagcu

SEQ ID NO: 1417965 - RNA, 14 nt, Human
agccaggagcuggg

SEQ ID NO: 1417966 - RNA, 18 nt, Human
agccaggagcugggcaga

SEQ ID NO: 1417967 - RNA, 20 nt, Human
agccaggagaagcucagcug

SEQ ID NO: 1417968 - RNA, 15 nt, Human
agccaggagaagcuc

SEQ ID NO: 1417969 - RNA, 14 nt, Human
agccaggagaagcu

SEQ ID NO: 1417970 - RNA, 13 nt, Human
agccaggagaagc

SEQ ID NO: 1417971 - RNA, 23 nt, Human
agccaggaauuucccaggacccu

SEQ ID NO: 1417972 - RNA, 22 nt, Human
agccaggaauuucccaggaccc

SEQ ID NO: 1417973 - RNA, 21 nt, Human
agccaggaauuucccaggacc

SEQ ID NO: 1417974 - RNA, 20 nt, Human
agccaggaauuucccaggac

SEQ ID NO: 1417975 - RNA, 18 nt, Human
agccagcuuucccugccu

SEQ ID NO: 1417976 - RNA, 16 nt, Human
agccagcuuucccugc

SEQ ID NO: 1417977 - RNA, 22 nt, Human
agccagcuuucccugccucuca

SEQ ID NO: 1417978 - RNA, 20 nt, Human
agccaggaagaucccccaga

SEQ ID NO: 1417979 - RNA, 19 nt, Human
agccaggaauuucccagga

SEQ ID NO: 1417980 - RNA, 17 nt, Human
agccaggaauuucccag

SEQ ID NO: 1417981 - RNA, 21 nt, Human
agccaggaagaucccccagaa

SEQ ID NO: 1417982 - RNA, 22 nt, Human
agccaggaagaucccccagaaa

SEQ ID NO: 1417983 - RNA, 14 nt, Human
ugauuacagugcag

SEQ ID NO: 1417984 - RNA, 22 nt, Human
ugauuaaagaugagcuuugucu

SEQ ID NO: 1417985 - RNA, 15 nt, Human
ugauuaaagaugagc

SEQ ID NO: 1417986 - RNA, 16 nt, Human
ugauuacagugcagug

SEQ ID NO: 1417987 - RNA, 22 nt, Human
agccacuccucugacucagggc

SEQ ID NO: 1417988 - RNA, 21 nt, Human
agccacuccucugacucaggg

SEQ ID NO: 1417989 - RNA, 15 nt, Human
agccacuccucugac

SEQ ID NO: 1417990 - RNA, 14 nt, Human
agccacuccucuga

SEQ ID NO: 1417991 - RNA, 17 nt, Human
agccacuuaaaauguuc

SEQ ID NO: 1417992 - RNA, 12 nt, Human
agccacugccau

SEQ ID NO: 1417993 - RNA, 15 nt, Human
agccacuugccugug

SEQ ID NO: 1417994 - RNA, 22 nt, Human
agccacuugccugugcuacaau

SEQ ID NO: 1417995 - RNA, 19 nt, Human
agccacuugccugugcuac

SEQ ID NO: 1417996 - RNA, 13 nt, Human
ugaugaguuguga

SEQ ID NO: 1417997 - RNA, 24 nt, Human
ugaugagggcagcagccagcccug

SEQ ID NO: 1417998 - RNA, 23 nt, Human
ugauuaaaaugcuuccucccagc

SEQ ID NO: 1417999 - RNA, 17 nt, Human
ugauguuuuaaggaugc

SEQ ID NO: 1418000 - RNA, 18 nt, Human
ugauguuuuaaggaugcu

SEQ ID NO: 1418001 - RNA, 15 nt, Human
ugauggugguauguu

SEQ ID NO: 1418002 - RNA, 20 nt, Human
agccacauuuggaauacuuu

SEQ ID NO: 1418003 - RNA, 15 nt, Human
agccacauuuggaau

SEQ ID NO: 1418004 - RNA, 16 nt, Human
agcauuugaaugcauu

SEQ ID NO: 1418005 - RNA, 18 nt, Human
agcauuucucaucaguag

SEQ ID NO: 1418006 - RNA, 11 nt, Human
agcauuugaau

SEQ ID NO: 1418007 - RNA, 12 nt, Human
agcauuugaaug

SEQ ID NO: 1418008 - RNA, 13 nt, Human
agcauuugaaugc

SEQ ID NO: 1418009 - RNA, 14 nt, Human
agcauuugaaugca

SEQ ID NO: 1418010 - RNA, 15 nt, Human
agcauuugaaugcau

SEQ ID NO: 1418011 - RNA, 21 nt, Human
agccaccgaagccgccugugg

SEQ ID NO: 1418012 - RNA, 20 nt, Human
agccaccgaagccgccugug

SEQ ID NO: 1418013 - RNA, 15 nt, Human
agccaccgaagccgc

SEQ ID NO: 1418014 - RNA, 22 nt, Human
agccacccugaggagucugagg

SEQ ID NO: 1418015 - RNA, 21 nt, Human
agccacccugaggagucugag

SEQ ID NO: 1418016 - RNA, 20 nt, Human
agccacccugaggagucuga

SEQ ID NO: 1418017 - RNA, 19 nt, Human
agccacccugaggagucug

SEQ ID NO: 1418018 - RNA, 18 nt, Human
agccacccugaggagucu

SEQ ID NO: 1418019 - RNA, 14 nt, Human
agccacccugagga

SEQ ID NO: 1418020 - RNA, 13 nt, Human
agccacccugagg

SEQ ID NO: 1418021 - RNA, 12 nt, Human
agccacccugag

SEQ ID NO: 1418022 - RNA, 23 nt, Human
agccacauuuggaauacuuuuug

SEQ ID NO: 1418023 - RNA, 22 nt, Human
agccacauuuggaauacuuuuu

SEQ ID NO: 1418024 - RNA, 21 nt, Human
agccacauuuggaauacuuuu

SEQ ID NO: 1418025 - RNA, 14 nt, Human
agccacccugaguu

SEQ ID NO: 1418026 - RNA, 22 nt, Human
agccaccgaagccgccugugga

SEQ ID NO: 1418027 - RNA, 14 nt, Human
ugaucgccuucccc

SEQ ID NO: 1418028 - RNA, 13 nt, Human
ugaucgccuuccc

SEQ ID NO: 1418029 - RNA, 15 nt, Human
ugauccuuacaaguu

SEQ ID NO: 1418030 - RNA, 20 nt, Human
ugauccuguauucagacaga

SEQ ID NO: 1418031 - RNA, 21 nt, Human
ugauccuguauucagacagau

SEQ ID NO: 1418032 - RNA, 20 nt, Human
ugauccuggaggcccaguuc

SEQ ID NO: 1418033 - RNA, 14 nt, Human
ugauccauguaacu

SEQ ID NO: 1418034 - RNA, 13 nt, Human
ugauccauguaac

SEQ ID NO: 1418035 - RNA, 12 nt, Human
ugauccauguaa

SEQ ID NO: 1418036 - RNA, 23 nt, Human
ugaugagggcagcagccagcccu

SEQ ID NO: 1418037 - RNA, 22 nt, Human
ugaugagggcagcagccagccc

SEQ ID NO: 1418038 - RNA, 21 nt, Human
ugaugagggcagcagccagcc

SEQ ID NO: 1418039 - RNA, 19 nt, Human
ugaugagggcagcagccag

SEQ ID NO: 1418040 - RNA, 17 nt, Human
ugaugagggcagcagcc

SEQ ID NO: 1418041 - RNA, 16 nt, Human
ugaugagggcagcagc

SEQ ID NO: 1418042 - RNA, 15 nt, Human
ugaugagggcagcag

SEQ ID NO: 1418043 - RNA, 13 nt, Human
ugaugagggcagc

SEQ ID NO: 1418044 - RNA, 23 nt, Human
ugaugaggcccuccacaccugcg

SEQ ID NO: 1418045 - RNA, 21 nt, Human
ugaugaggcccuccacaccug

SEQ ID NO: 1418046 - RNA, 17 nt, Human
ugaugaggcccuccaca

SEQ ID NO: 1418047 - RNA, 16 nt, Human
ugaugaggcccuccac

SEQ ID NO: 1418048 - RNA, 15 nt, Human
ugaugaggcccucca

SEQ ID NO: 1418049 - RNA, 14 nt, Human
ugaugaggcccucc

SEQ ID NO: 1418050 - RNA, 14 nt, Human
ugaugaauacugua

SEQ ID NO: 1418051 - RNA, 14 nt, Human
ugaugaagagagag

SEQ ID NO: 1418052 - RNA, 15 nt, Human
ugaucgccuucccca

SEQ ID NO: 1418053 - RNA, 18 nt, Human
ugaucggagccuccucuc

SEQ ID NO: 1418054 - RNA, 17 nt, Human
ugaucgccuuucccagg

SEQ ID NO: 1418055 - RNA, 15 nt, Human
ugaucgccuuuccca

SEQ ID NO: 1418056 - RNA, 17 nt, Human
ugaugaagaaguugaua

SEQ ID NO: 1418057 - RNA, 15 nt, Human
agcauugaauggcua

SEQ ID NO: 1418058 - RNA, 23 nt, Human
agcauguuuagacuuuaacauaa

SEQ ID NO: 1418059 - RNA, 24 nt, Human
agcauguuuagacuuuaacauaag

SEQ ID NO: 1418060 - RNA, 22 nt, Human
agcauguuuagacuuuaacaua

SEQ ID NO: 1418061 - RNA, 21 nt, Human
agcauguuuagacuuuaacau

SEQ ID NO: 1418062 - RNA, 18 nt, Human
agcauguuuagacuuuaa

SEQ ID NO: 1418063 - RNA, 13 nt, Human
agcauguuuagac

SEQ ID NO: 1418064 - RNA, 12 nt, Human
agcauguuuaga

SEQ ID NO: 1418065 - RNA, 12 nt, Human
agcauguuacug

SEQ ID NO: 1418066 - RNA, 19 nt, Human
agcaugucuauucagcuuc

SEQ ID NO: 1418067 - RNA, 17 nt, Human
agcaugucuauucagcu

SEQ ID NO: 1418068 - RNA, 20 nt, Human
agcauuguaaaauaauucug

SEQ ID NO: 1418069 - RNA, 16 nt, Human
agcauuguaaaauaau

SEQ ID NO: 1418070 - RNA, 15 nt, Human
agcauuguaaaauaa

SEQ ID NO: 1418071 - RNA, 14 nt, Human
agcauuguaaaaua

SEQ ID NO: 1418072 - RNA, 17 nt, Human
agcauuguaaaagcauu

SEQ ID NO: 1418073 - RNA, 20 nt, Human
agcauuguagugcuuugaga

SEQ ID NO: 1418074 - RNA, 22 nt, Human
agcauuguagugcuuugagaga

SEQ ID NO: 1418075 - RNA, 18 nt, Human
agcauuguagugcuuuga

SEQ ID NO: 1418076 - RNA, 15 nt, Human
agcauuguagugcuu

SEQ ID NO: 1418077 - RNA, 22 nt, Human
agcauuguaaaauuauuucaug

SEQ ID NO: 1418078 - RNA, 14 nt, Human
agcauuucucauca

SEQ ID NO: 1418079 - RNA, 17 nt, Human
agcauuucccuuccuuc

SEQ ID NO: 1418080 - RNA, 16 nt, Human
agcaugucacuaaagc

SEQ ID NO: 1418081 - RNA, 21 nt, Human
agcauguacugagccuuguaa

SEQ ID NO: 1418082 - RNA, 21 nt, Human
agcauguacggauuuucaguu

SEQ ID NO: 1418083 - RNA, 20 nt, Human
agcauguacggauuuucagu

SEQ ID NO: 1418084 - RNA, 17 nt, Human
agcauggcuauuuuaua

SEQ ID NO: 1418085 - RNA, 18 nt, Human
agcauggcuauuuuauau

SEQ ID NO: 1418086 - RNA, 15 nt, Human
agcauggcuauuuua

SEQ ID NO: 1418087 - RNA, 17 nt, Human
agcaugucgucaaagcu

SEQ ID NO: 1418088 - RNA, 20 nt, Human
agcaugucgucaaagcugaa

SEQ ID NO: 1418089 - RNA, 13 nt, Human
agcaucacagaau

SEQ ID NO: 1418090 - RNA, 14 nt, Human
agcaucacagaaug

SEQ ID NO: 1418091 - RNA, 20 nt, Human
agcaucacaugaacuuguaa

SEQ ID NO: 1418092 - RNA, 12 nt, Human
ugaucaaggccu

SEQ ID NO: 1418093 - RNA, 13 nt, Human
ugaucaaggccuu

SEQ ID NO: 1418094 - RNA, 11 nt, Human
ugaucaaggcc

SEQ ID NO: 1418095 - RNA, 20 nt, Human
ugauauuuucugugccugaa

SEQ ID NO: 1418096 - RNA, 17 nt, Human
ugauauuuucugugccu

SEQ ID NO: 1418097 - RNA, 14 nt, Human
ugauauuuucucua

SEQ ID NO: 1418098 - RNA, 15 nt, Human
ugauauuuucucuag

SEQ ID NO: 1418099 - RNA, 19 nt, Human
ugaucaaaaucaauuaaaa

SEQ ID NO: 1418100 - RNA, 17 nt, Human
ugauauucuaagacuua

SEQ ID NO: 1418101 - RNA, 15 nt, Human
ugauauucuaagacu

SEQ ID NO: 1418102 - RNA, 12 nt, Human
ugauauucuaag

SEQ ID NO: 1418103 - RNA, 17 nt, Human
ugauauuucuagcuuau

SEQ ID NO: 1418104 - RNA, 20 nt, Human
ugauacuguugcacgugugu

SEQ ID NO: 1418105 - RNA, 19 nt, Human
ugauacuguugcacgugug

SEQ ID NO: 1418106 - RNA, 18 nt, Human
ugauacuguugcacgugu

SEQ ID NO: 1418107 - RNA, 16 nt, Human
ugauacuguugcacgu

SEQ ID NO: 1418108 - RNA, 14 nt, Human
ugauacuguugcac

SEQ ID NO: 1418109 - RNA, 13 nt, Human
ugauacuguugca

SEQ ID NO: 1418110 - RNA, 11 nt, Human
ugauacuguug

SEQ ID NO: 1418111 - RNA, 22 nt, Human
ugauacuaauaaacuaauaauu

SEQ ID NO: 1418112 - RNA, 16 nt, Human
ugauacuaauaaacua

SEQ ID NO: 1418113 - RNA, 20 nt, Human
ugauacuucgacacuguucu

SEQ ID NO: 1418114 - RNA, 21 nt, Human
ugauacuucgacacuguucuu

SEQ ID NO: 1418115 - RNA, 18 nt, Human
ugauacuucgacacuguu

SEQ ID NO: 1418116 - RNA, 17 nt, Human
ugauacuucgacacugu

SEQ ID NO: 1418117 - RNA, 16 nt, Human
ugauaugugaacaguu

SEQ ID NO: 1418118 - RNA, 19 nt, Human
ugauauguugguagauucu

SEQ ID NO: 1418119 - RNA, 15 nt, Human
ugauaugugaacagu

SEQ ID NO: 1418120 - RNA, 12 nt, Human
ugauaugggucu

SEQ ID NO: 1418121 - RNA, 19 nt, Human
ugauagaaaugccaagcac

SEQ ID NO: 1418122 - RNA, 17 nt, Human
ugauagacaauugaggu

SEQ ID NO: 1418123 - RNA, 18 nt, Human
ugauagacaauugaggua

SEQ ID NO: 1418124 - RNA, 17 nt, Human
ugaguagaguugaucaa

SEQ ID NO: 1418125 - RNA, 21 nt, Human
ugaguacuccacacugcacaa

SEQ ID NO: 1418126 - RNA, 17 nt, Human
ugaguagaaaggccuuu

SEQ ID NO: 1418127 - RNA, 20 nt, Human
ugaguacuccacacugcaca

SEQ ID NO: 1418128 - RNA, 20 nt, Human
ugaguagagagcaagggaag

SEQ ID NO: 1418129 - RNA, 14 nt, Human
ugaguagaguugau

SEQ ID NO: 1418130 - RNA, 18 nt, Human
ugaguagaaaggccuuua

SEQ ID NO: 1418131 - RNA, 23 nt, Human
ugaguagaaaggccuuuaaaauu

SEQ ID NO: 1418132 - RNA, 19 nt, Human
ugaguaacauuugcuguuu

SEQ ID NO: 1418133 - RNA, 18 nt, Human
ugaguaacauuugcuguu

SEQ ID NO: 1418134 - RNA, 17 nt, Human
ugaguaacauuugcugu

SEQ ID NO: 1418135 - RNA, 16 nt, Human
ugaguaacauuugcug

SEQ ID NO: 1418136 - RNA, 15 nt, Human
ugaguaacauuugcu

SEQ ID NO: 1418137 - RNA, 10 nt, Human
ugaguaacau

SEQ ID NO: 1418138 - RNA, 22 nt, Human
ugaguaacugauuuguaacaag

SEQ ID NO: 1418139 - RNA, 22 nt, Human
ugagguuuuauuucauuuuuca

SEQ ID NO: 1418140 - RNA, 15 nt, Human
ugagacaaugccuug

SEQ ID NO: 1418141 - RNA, 16 nt, Human
ugagacaaugccuugu

SEQ ID NO: 1418142 - RNA, 23 nt, Human
ugagacaagaaaauaagagcuca

SEQ ID NO: 1418143 - RNA, 21 nt, Human
ugagacaagaaaauaagagcu

SEQ ID NO: 1418144 - RNA, 18 nt, Human
ugagacaaauggaggccu

SEQ ID NO: 1418145 - RNA, 20 nt, Human
ugagaauuugagugcucuga

SEQ ID NO: 1418146 - RNA, 21 nt, Human
agcauaauacuugcuuuggaa

SEQ ID NO: 1418147 - RNA, 15 nt, Human
agcauacguacacau

SEQ ID NO: 1418148 - RNA, 23 nt, Human
agcauaaguuucugggaccucag

SEQ ID NO: 1418149 - RNA, 17 nt, Human
agcauaaguuucuggga

SEQ ID NO: 1418150 - RNA, 23 nt, Human
agcauaaauguugacaugggaca

SEQ ID NO: 1418151 - RNA, 16 nt, Human
agcauacguacacauu

SEQ ID NO: 1418152 - RNA, 17 nt, Human
agcauacguacacauuu

SEQ ID NO: 1418153 - RNA, 18 nt, Human
agcauacguacacauuuu

SEQ ID NO: 1418154 - RNA, 19 nt, Human
agcauacguacacauuuua

SEQ ID NO: 1418155 - RNA, 20 nt, Human
agcauacguacacauuuuau

SEQ ID NO: 1418156 - RNA, 21 nt, Human
agcauacguacacauuuuauu

SEQ ID NO: 1418157 - RNA, 17 nt, Human
agcauaucugccuuuau

SEQ ID NO: 1418158 - RNA, 20 nt, Human
agcauaucugccuuuauugu

SEQ ID NO: 1418159 - RNA, 22 nt, Human
agcauaucugccuuuauugugu

SEQ ID NO: 1418160 - RNA, 23 nt, Human
agcauaucugccuuuauuguguu

SEQ ID NO: 1418161 - RNA, 18 nt, Human
ugauaaugaacagaacau

SEQ ID NO: 1418162 - RNA, 20 nt, Human
ugauaaugaacagaacauag

SEQ ID NO: 1418163 - RNA, 16 nt, Human
ugauaaugaacagaac

SEQ ID NO: 1418164 - RNA, 15 nt, Human
ugauaaugaacagaa

SEQ ID NO: 1418165 - RNA, 22 nt, Human
ugauaagaucuuuuauuuugcc

SEQ ID NO: 1418166 - RNA, 15 nt, Human
ugauaagaucuuuua

SEQ ID NO: 1418167 - RNA, 12 nt, Human
ugauaagaucuu

SEQ ID NO: 1418168 - RNA, 18 nt, Human
ugauaagagaaucaacau

SEQ ID NO: 1418169 - RNA, 17 nt, Human
ugauaagagaaucaaca

SEQ ID NO: 1418170 - RNA, 15 nt, Human
ugauacuaauaaacu

SEQ ID NO: 1418171 - RNA, 14 nt, Human
ugauacuaauaaac

SEQ ID NO: 1418172 - RNA, 13 nt, Human
ugauacuaauaaa

SEQ ID NO: 1418173 - RNA, 16 nt, Human
ugauacuaagcauuga

SEQ ID NO: 1418174 - RNA, 14 nt, Human
ugauacuaagcauu

SEQ ID NO: 1418175 - RNA, 16 nt, Human
ugauacgaugcuucaa

SEQ ID NO: 1418176 - RNA, 14 nt, Human
ugauacuacaguuu

SEQ ID NO: 1418177 - RNA, 17 nt, Human
ugauacuacaguuuguu

SEQ ID NO: 1418178 - RNA, 21 nt, Human
ugauacagaaaaguugaauuu

SEQ ID NO: 1418179 - RNA, 12 nt, Human
ugauacagaaaa

SEQ ID NO: 1418180 - RNA, 21 nt, Human
ugauacaaugcugugcccuaa

SEQ ID NO: 1418181 - RNA, 20 nt, Human
ugauacaaugcugugcccua

SEQ ID NO: 1418182 - RNA, 22 nt, Human
ugagugggguuaucucuguguu

SEQ ID NO: 1418183 - RNA, 21 nt, Human
ugagugggguuaucucugugu

SEQ ID NO: 1418184 - RNA, 19 nt, Human
ugagugcuugcuuuucaug

SEQ ID NO: 1418185 - RNA, 19 nt, Human
ugagugcucugaucccucu

SEQ ID NO: 1418186 - RNA, 13 nt, Human
ugagugcucugau

SEQ ID NO: 1418187 - RNA, 12 nt, Human
ugagugcucuga

SEQ ID NO: 1418188 - RNA, 18 nt, Human
ugaguauuaaaauguaug

SEQ ID NO: 1418189 - RNA, 14 nt, Human
ugaguauuaaaaug

SEQ ID NO: 1418190 - RNA, 17 nt, Human
ugaguauuaaaauguau

SEQ ID NO: 1418191 - RNA, 18 nt, Human
ugagucaaguuguuccuu

SEQ ID NO: 1418192 - RNA, 15 nt, Human
ugagucaaaaaaucu

SEQ ID NO: 1418193 - RNA, 15 nt, Human
agcccaguagaccuu

SEQ ID NO: 1418194 - RNA, 18 nt, Human
agcccagugcacugaaag

SEQ ID NO: 1418195 - RNA, 18 nt, Human
agcccaguagaccuuguu

SEQ ID NO: 1418196 - RNA, 22 nt, Human
ugauucuauuuauauguacaug

SEQ ID NO: 1418197 - RNA, 21 nt, Human
ugauucuauuuauauguacau

SEQ ID NO: 1418198 - RNA, 18 nt, Human
ugauucgaaugacacugu

SEQ ID NO: 1418199 - RNA, 17 nt, Human
agcccauggagauugac

SEQ ID NO: 1418200 - RNA, 17 nt, Human
agcccauccugaccagc

SEQ ID NO: 1418201 - RNA, 23 nt, Human
agcccauccugaccagcugcucc

SEQ ID NO: 1418202 - RNA, 16 nt, Human
agcccauccugaccag

SEQ ID NO: 1418203 - RNA, 15 nt, Human
agcccauccugacca

SEQ ID NO: 1418204 - RNA, 14 nt, Human
agcccauccugacc

SEQ ID NO: 1418205 - RNA, 14 nt, Human
agcccauaugcuac

SEQ ID NO: 1418206 - RNA, 21 nt, Human
agcccauaugcuaccaccagc

SEQ ID NO: 1418207 - RNA, 17 nt, Human
agcccccagcucccacc

SEQ ID NO: 1418208 - RNA, 16 nt, Human
agcccccagccuguca

SEQ ID NO: 1418209 - RNA, 22 nt, Human
agcccccagcuaagaaccugga

SEQ ID NO: 1418210 - RNA, 20 nt, Human
agcccccagcuaagaaccug

SEQ ID NO: 1418211 - RNA, 19 nt, Human
agcccccagcuaagaaccu

SEQ ID NO: 1418212 - RNA, 12 nt, Human
agcccccagcua

SEQ ID NO: 1418213 - RNA, 15 nt, Human
agcccccagccuguc

SEQ ID NO: 1418214 - RNA, 14 nt, Human
agcccccagccugu

SEQ ID NO: 1418215 - RNA, 13 nt, Human
agcccccagccug

SEQ ID NO: 1418216 - RNA, 14 nt, Human
agcccccagagccc

SEQ ID NO: 1418217 - RNA, 18 nt, Human
agcccccagagcccaggc

SEQ ID NO: 1418218 - RNA, 13 nt, Human
agcccccagagcc

SEQ ID NO: 1418219 - RNA, 12 nt, Human
agcccccagagc

SEQ ID NO: 1418220 - RNA, 19 nt, Human
agcccccaccgugggcagg

SEQ ID NO: 1418221 - RNA, 23 nt, Human
agcccccacccuguuccugcugc

SEQ ID NO: 1418222 - RNA, 22 nt, Human
agcccccacccuguuccugcug

SEQ ID NO: 1418223 - RNA, 19 nt, Human
agcccccacccuguuccug

SEQ ID NO: 1418224 - RNA, 18 nt, Human
agcccccacccuguuccu

SEQ ID NO: 1418225 - RNA, 17 nt, Human
agcccccacccuguucc

SEQ ID NO: 1418226 - RNA, 13 nt, Human
agcccccacccug

SEQ ID NO: 1418227 - RNA, 22 nt, Human
agcccauggagauugaccugga

SEQ ID NO: 1418228 - RNA, 21 nt, Human
agcccauggagauugaccugg

SEQ ID NO: 1418229 - RNA, 19 nt, Human
agcccauggagauugaccu

SEQ ID NO: 1418230 - RNA, 22 nt, Human
agcccccagcucccaccucccc

SEQ ID NO: 1418231 - RNA, 16 nt, Human
agccccugccccuccu

SEQ ID NO: 1418232 - RNA, 20 nt, Human
agcccugucagcaugaauuu

SEQ ID NO: 1418233 - RNA, 22 nt, Human
agccccuucugcucagcucugg

SEQ ID NO: 1418234 - RNA, 19 nt, Human
agccccuucugcucagcuc

SEQ ID NO: 1418235 - RNA, 16 nt, Human
agccccuucugcucag

SEQ ID NO: 1418236 - RNA, 15 nt, Human
agccccuucugcuca

SEQ ID NO: 1418237 - RNA, 22 nt, Human
ugcacguggccucuugagcagu

SEQ ID NO: 1418238 - RNA, 19 nt, Human
ugcacguggccucuugagc

SEQ ID NO: 1418239 - RNA, 18 nt, Human
ugcacaccccacucccac

SEQ ID NO: 1418240 - RNA, 16 nt, Human
ugcacaccccacuccc

SEQ ID NO: 1418241 - RNA, 10 nt, Human
ugcacacauu

SEQ ID NO: 1418242 - RNA, 11 nt, Human
ugcacacauuu

SEQ ID NO: 1418243 - RNA, 22 nt, Human
ugcaccaugcugcuggggaaga

SEQ ID NO: 1418244 - RNA, 23 nt, Human
ugcaccaugcugcuggggaagac

SEQ ID NO: 1418245 - RNA, 19 nt, Human
ugcaccaugcugcugggga

SEQ ID NO: 1418246 - RNA, 19 nt, Human
ugcacaccccacucccaca

SEQ ID NO: 1418247 - RNA, 20 nt, Human
ugcacaccuacuagucacca

SEQ ID NO: 1418248 - RNA, 22 nt, Human
ugcacaccuacuagucaccaga

SEQ ID NO: 1418249 - RNA, 14 nt, Human
agccucccaaagug

SEQ ID NO: 1418250 - RNA, 13 nt, Human
agccucccaaagu

SEQ ID NO: 1418251 - RNA, 16 nt, Human
agccgugguccuuugg

SEQ ID NO: 1418252 - RNA, 13 nt, Human
agccgacccccuc

SEQ ID NO: 1418253 - RNA, 17 nt, Human
agcccuucuuuccacag

SEQ ID NO: 1418254 - RNA, 23 nt, Human
agcccuucuauacccacccagaa

SEQ ID NO: 1418255 - RNA, 21 nt, Human
agcccuucuccauggcccugc

SEQ ID NO: 1418256 - RNA, 20 nt, Human
agccgacccccucucccugc

SEQ ID NO: 1418257 - RNA, 21 nt, Human
agccgacaccuuuuuucaaca

SEQ ID NO: 1418258 - RNA, 23 nt, Human
agcccuucuccauggcccugcca

SEQ ID NO: 1418259 - RNA, 19 nt, Human
ugcacguguguuuuucuau

SEQ ID NO: 1418260 - RNA, 16 nt, Human
ugcacuaucuuucagc

SEQ ID NO: 1418261 - RNA, 22 nt, Human
ugcacguguguuuuucuauuaa

SEQ ID NO: 1418262 - RNA, 18 nt, Human
ugcacguguguuuuucua

SEQ ID NO: 1418263 - RNA, 15 nt, Human
ugcacguguguuuuu

SEQ ID NO: 1418264 - RNA, 13 nt, Human
ugcacguguguuu

SEQ ID NO: 1418265 - RNA, 12 nt, Human
ugcacguguguu

SEQ ID NO: 1418266 - RNA, 11 nt, Human
ugcacgugugu

SEQ ID NO: 1418267 - RNA, 14 nt, Human
ugcacucaaccuua

SEQ ID NO: 1418268 - RNA, 15 nt, Human
ugcacuaucuuucag

SEQ ID NO: 1418269 - RNA, 19 nt, Human
agcccuucuauacccaccc

SEQ ID NO: 1418270 - RNA, 20 nt, Human
agcccuucuauacccaccca

SEQ ID NO: 1418271 - RNA, 22 nt, Human
agcccuucuauacccacccaga

SEQ ID NO: 1418272 - RNA, 23 nt, Human
ugcauaacguauaaaagccuguu

SEQ ID NO: 1418273 - RNA, 23 nt, Human
ugcagucccaagcggugucucuc

SEQ ID NO: 1418274 - RNA, 22 nt, Human
ugcagucccaagcggugucucu

SEQ ID NO: 1418275 - RNA, 21 nt, Human
ugcagucccaagcggugucuc

SEQ ID NO: 1418276 - RNA, 20 nt, Human
ugcagucccaagcggugucu

SEQ ID NO: 1418277 - RNA, 14 nt, Human
ugcagucccaagcg

SEQ ID NO: 1418278 - RNA, 13 nt, Human
ugcagucccaagc

SEQ ID NO: 1418279 - RNA, 11 nt, Human
ugcagucccaa

SEQ ID NO: 1418280 - RNA, 22 nt, Human
ugcaguccugaucagagccgug

SEQ ID NO: 1418281 - RNA, 19 nt, Human
ugcaguccugaucagagcc

SEQ ID NO: 1418282 - RNA, 16 nt, Human
ugcagucucuauacca

SEQ ID NO: 1418283 - RNA, 18 nt, Human
ugcagucucuauaccaau

SEQ ID NO: 1418284 - RNA, 19 nt, Human
ugcagucucuauaccaaua

SEQ ID NO: 1418285 - RNA, 20 nt, Human
ugcagucucuauaccaauaa

SEQ ID NO: 1418286 - RNA, 21 nt, Human
ugcagucucuauaccaauaaa

SEQ ID NO: 1418287 - RNA, 23 nt, Human
ugcagucucuauaccaauaaagu

SEQ ID NO: 1418288 - RNA, 22 nt, Human
ugcagucucuauaccaauaaag

SEQ ID NO: 1418289 - RNA, 18 nt, Human
ugcaguacuuugugcauu

SEQ ID NO: 1418290 - RNA, 17 nt, Human
ugcaguacuuugugcau

SEQ ID NO: 1418291 - RNA, 21 nt, Human
ugcaguaacuguuuuuuaagu

SEQ ID NO: 1418292 - RNA, 18 nt, Human
ugcaguaacuguuuuuua

SEQ ID NO: 1418293 - RNA, 16 nt, Human
ugcaguaacuguuuuu

SEQ ID NO: 1418294 - RNA, 11 nt, Human
ugcaguaacug

SEQ ID NO: 1418295 - RNA, 21 nt, Human
ugcaguaaaucuuuuacaacu

SEQ ID NO: 1418296 - RNA, 18 nt, Human
ugcaguaaaucuuuuaca

SEQ ID NO: 1418297 - RNA, 15 nt, Human
ugcaguaaaucuuuu

SEQ ID NO: 1418298 - RNA, 14 nt, Human
ugcaguaaaucuuu

SEQ ID NO: 1418299 - RNA, 17 nt, Human
ugcaggucccuaauaaa

SEQ ID NO: 1418300 - RNA, 12 nt, Human
ugcaggucccua

SEQ ID NO: 1418301 - RNA, 14 nt, Human
ugcaggucccuaau

SEQ ID NO: 1418302 - RNA, 15 nt, Human
ugcaggucccuaaua

SEQ ID NO: 1418303 - RNA, 16 nt, Human
ugcaggucccuaauaa

SEQ ID NO: 1418304 - RNA, 20 nt, Human
ugcagcucaagagaucccaa

SEQ ID NO: 1418305 - RNA, 17 nt, Human
ugcagcgacuggcauac

SEQ ID NO: 1418306 - RNA, 14 nt, Human
ugcagccugcgcca

SEQ ID NO: 1418307 - RNA, 14 nt, Human
ugcagcccugcugc

SEQ ID NO: 1418308 - RNA, 18 nt, Human
agccugaaccccagggcu

SEQ ID NO: 1418309 - RNA, 17 nt, Human
agccugacaacauuucu

SEQ ID NO: 1418310 - RNA, 21 nt, Human
agccugaauuuuguugcuguu

SEQ ID NO: 1418311 - RNA, 20 nt, Human
agccugaauuuuguugcugu

SEQ ID NO: 1418312 - RNA, 22 nt, Human
agccugacaucaaaaaaggcag

SEQ ID NO: 1418313 - RNA, 18 nt, Human
agccugacccucaucuuu

SEQ ID NO: 1418314 - RNA, 19 nt, Human
agccugaaccccagggcug

SEQ ID NO: 1418315 - RNA, 17 nt, Human
ugcagcccccacugccu

SEQ ID NO: 1418316 - RNA, 23 nt, Human
ugcagcccccacugccuuugacc

SEQ ID NO: 1418317 - RNA, 16 nt, Human
ugccacaaggacuucc

SEQ ID NO: 1418318 - RNA, 15 nt, Human
ugccacaaggacuuc

SEQ ID NO: 1418319 - RNA, 15 nt, Human
ugccaauuagcaauu

SEQ ID NO: 1418320 - RNA, 13 nt, Human
ugccaauuucaag

SEQ ID NO: 1418321 - RNA, 21 nt, Human
ugccaaguccagguccuggug

SEQ ID NO: 1418322 - RNA, 20 nt, Human
ugccaaguccagguccuggu

SEQ ID NO: 1418323 - RNA, 17 nt, Human
ugccaaguccagguccu

SEQ ID NO: 1418324 - RNA, 15 nt, Human
ugccaaguccagguc

SEQ ID NO: 1418325 - RNA, 13 nt, Human
ugccaaguccagg

SEQ ID NO: 1418326 - RNA, 21 nt, Human
ugccaagggcuuuguuuugca

SEQ ID NO: 1418327 - RNA, 21 nt, Human
ugccaagggcauaaauuauug

SEQ ID NO: 1418328 - RNA, 17 nt, Human
ugccaagggcauaaauu

SEQ ID NO: 1418329 - RNA, 22 nt, Human
ugcauuggaacuggaggcaggg

SEQ ID NO: 1418330 - RNA, 21 nt, Human
ugcauuggaacuggaggcagg

SEQ ID NO: 1418331 - RNA, 18 nt, Human
ugcauuggaacuggaggc

SEQ ID NO: 1418332 - RNA, 17 nt, Human
ugcauuggaacuggagg

SEQ ID NO: 1418333 - RNA, 19 nt, Human
ugcauugcuuuuuuuuccu

SEQ ID NO: 1418334 - RNA, 18 nt, Human
ugcauugacuuuccccac

SEQ ID NO: 1418335 - RNA, 22 nt, Human
ugcauugacuuuccccaccaga

SEQ ID NO: 1418336 - RNA, 17 nt, Human
ugcauugacuuucccca

SEQ ID NO: 1418337 - RNA, 20 nt, Human
ugcauugaccgcgacuaauu

SEQ ID NO: 1418338 - RNA, 22 nt, Human
ugcauugaccgcgacuaauuuc

SEQ ID NO: 1418339 - RNA, 23 nt, Human
ugcauugaacacaaacuguaaau

SEQ ID NO: 1418340 - RNA, 18 nt, Human
ugcauuaugcaauuuuua

SEQ ID NO: 1418341 - RNA, 13 nt, Human
ugcauuaugcaau

SEQ ID NO: 1418342 - RNA, 21 nt, Human
ugcauuaucuagauacuguau

SEQ ID NO: 1418343 - RNA, 22 nt, Human
ugcauuaucuagauacuguauc

SEQ ID NO: 1418344 - RNA, 23 nt, Human
agccuugugaugucauacagaga

SEQ ID NO: 1418345 - RNA, 22 nt, Human
agccuugugaugucauacagag

SEQ ID NO: 1418346 - RNA, 21 nt, Human
agccuugugaugucauacaga

SEQ ID NO: 1418347 - RNA, 18 nt, Human
agccuuguaauucuaaau

SEQ ID NO: 1418348 - RNA, 16 nt, Human
agccuuguaauucuaa

SEQ ID NO: 1418349 - RNA, 15 nt, Human
agccuuccacccagg

SEQ ID NO: 1418350 - RNA, 14 nt, Human
agccuuccacccag

SEQ ID NO: 1418351 - RNA, 13 nt, Human
agccuuccaccca

SEQ ID NO: 1418352 - RNA, 20 nt, Human
agccuuggggcugaugcagu

SEQ ID NO: 1418353 - RNA, 14 nt, Human
agcggaggugugga

SEQ ID NO: 1418354 - RNA, 20 nt, Human
ugcauuaucuagauacugua

SEQ ID NO: 1418355 - RNA, 22 nt, Human
agcgccuccauccaaggccagg

SEQ ID NO: 1418356 - RNA, 23 nt, Human
agcgccuccauccaaggccaggu

SEQ ID NO: 1418357 - RNA, 20 nt, Human
agcgccuccauccaaggcca

SEQ ID NO: 1418358 - RNA, 18 nt, Human
agcgccuccauccaaggc

SEQ ID NO: 1418359 - RNA, 18 nt, Human
agcgccuccaacccuagc

SEQ ID NO: 1418360 - RNA, 19 nt, Human
agcgccuccaacccuagca

SEQ ID NO: 1418361 - RNA, 22 nt, Human
agcgccuccaacccuagcaaaa

SEQ ID NO: 1418362 - RNA, 23 nt, Human
agcgccuccaacccuagcaaaag

SEQ ID NO: 1418363 - RNA, 23 nt, Human
agccugggggccuggcuggcuga

SEQ ID NO: 1418364 - RNA, 15 nt, Human
agccuggggucugga

SEQ ID NO: 1418365 - RNA, 22 nt, Human
agccugggggccuggcuggcug

SEQ ID NO: 1418366 - RNA, 21 nt, Human
agccugggggccuggcuggcu

SEQ ID NO: 1418367 - RNA, 20 nt, Human
agccugggggccuggcuggc

SEQ ID NO: 1418368 - RNA, 19 nt, Human
agccugggggccuggcugg

SEQ ID NO: 1418369 - RNA, 18 nt, Human
agccugggggccuggcug

SEQ ID NO: 1418370 - RNA, 17 nt, Human
agccugggggccuggcu

SEQ ID NO: 1418371 - RNA, 16 nt, Human
agccugggggccuggc

SEQ ID NO: 1418372 - RNA, 15 nt, Human
agccugggggccugg

SEQ ID NO: 1418373 - RNA, 14 nt, Human
agccugggggccug

SEQ ID NO: 1418374 - RNA, 22 nt, Human
ugcauacacuuuuucucuuucc

SEQ ID NO: 1418375 - RNA, 12 nt, Human
ugcauaccacuu

SEQ ID NO: 1418376 - RNA, 14 nt, Human
ugcauaccacuuuu

SEQ ID NO: 1418377 - RNA, 23 nt, Human
agccuucaagcucugagggaaag

SEQ ID NO: 1418378 - RNA, 20 nt, Human
agccuucaagcucugaggga

SEQ ID NO: 1418379 - RNA, 19 nt, Human
agccuucaagcucugaggg

SEQ ID NO: 1418380 - RNA, 18 nt, Human
agccuucaagcucugagg

SEQ ID NO: 1418381 - RNA, 17 nt, Human
agccuucaagcucugag

SEQ ID NO: 1418382 - RNA, 16 nt, Human
agccuucaagcucuga

SEQ ID NO: 1418383 - RNA, 15 nt, Human
agccuucaagcucug

SEQ ID NO: 1418384 - RNA, 14 nt, Human
agccuucaagcucu

SEQ ID NO: 1418385 - RNA, 13 nt, Human
agccuucaagcuc

SEQ ID NO: 1418386 - RNA, 20 nt, Human
agccuuagcucucccaacuc

SEQ ID NO: 1418387 - RNA, 19 nt, Human
agccuguucauggcagaug

SEQ ID NO: 1418388 - RNA, 18 nt, Human
agccuguucauggcagau

SEQ ID NO: 1418389 - RNA, 17 nt, Human
agccuguucauggcaga

SEQ ID NO: 1418390 - RNA, 16 nt, Human
agccuguucauggcag

SEQ ID NO: 1418391 - RNA, 14 nt, Human
agccuguucauggc

SEQ ID NO: 1418392 - RNA, 13 nt, Human
agccuguuuaaga

SEQ ID NO: 1418393 - RNA, 15 nt, Human
agccuguuuaagaga

SEQ ID NO: 1418394 - RNA, 17 nt, Human
agcuagacacaugaagg

SEQ ID NO: 1418395 - RNA, 16 nt, Human
agcuagacacaugaag

SEQ ID NO: 1418396 - RNA, 15 nt, Human
agcuagacacaugaa

SEQ ID NO: 1418397 - RNA, 20 nt, Human
agcuagaauugaguguuuaa

SEQ ID NO: 1418398 - RNA, 14 nt, Human
agcuagaauugagu

SEQ ID NO: 1418399 - RNA, 16 nt, Human
agcuacuaaaaucagu

SEQ ID NO: 1418400 - RNA, 17 nt, Human
agcuagaacccucuguu

SEQ ID NO: 1418401 - RNA, 16 nt, Human
agcuagaacccucugu

SEQ ID NO: 1418402 - RNA, 15 nt, Human
agcuagaacccucug

SEQ ID NO: 1418403 - RNA, 16 nt, Human
agcuagaauuugauau

SEQ ID NO: 1418404 - RNA, 13 nt, Human
agcuagaauuuga

SEQ ID NO: 1418405 - RNA, 20 nt, Human
agcggugucucuccugcccc

SEQ ID NO: 1418406 - RNA, 14 nt, Human
agcggugucucucc

SEQ ID NO: 1418407 - RNA, 13 nt, Human
agcgggucugcuc

SEQ ID NO: 1418408 - RNA, 16 nt, Human
agcgggucugcuccca

SEQ ID NO: 1418409 - RNA, 18 nt, Human
agcgggggccuaaaaaaa

SEQ ID NO: 1418410 - RNA, 21 nt, Human
agcgggggaggguaggcagga

SEQ ID NO: 1418411 - RNA, 12 nt, Human
agcgggggaggg

SEQ ID NO: 1418412 - RNA, 13 nt, Human
ugccagagaaccc

SEQ ID NO: 1418413 - RNA, 21 nt, Human
ugccagagaacccagcccacc

SEQ ID NO: 1418414 - RNA, 22 nt, Human
agcuaccugcucagcccugcac

SEQ ID NO: 1418415 - RNA, 21 nt, Human
agcuacccuuuuucuccagcu

SEQ ID NO: 1418416 - RNA, 20 nt, Human
agcgugagcuuaaaauacaa

SEQ ID NO: 1418417 - RNA, 12 nt, Human
agcgugagcuua

SEQ ID NO: 1418418 - RNA, 16 nt, Human
agcgugagcugagcag

SEQ ID NO: 1418419 - RNA, 15 nt, Human
agcgugagcugagca

SEQ ID NO: 1418420 - RNA, 14 nt, Human
agcuacuaaaauca

SEQ ID NO: 1418421 - RNA, 16 nt, Human
agcuacguauuuaaua

SEQ ID NO: 1418422 - RNA, 22 nt, Human
agcuaccuguguggacaggacu

SEQ ID NO: 1418423 - RNA, 20 nt, Human
agcuaccuguguggacagga

SEQ ID NO: 1418424 - RNA, 19 nt, Human
agcuaccuguguggacagg

SEQ ID NO: 1418425 - RNA, 18 nt, Human
agcuaccuguguggacag

SEQ ID NO: 1418426 - RNA, 19 nt, Human
agcuacuaauuuuaaaaug

SEQ ID NO: 1418427 - RNA, 19 nt, Human
ugcccagcccuaaacauca

SEQ ID NO: 1418428 - RNA, 21 nt, Human
ugcccacaggccgcccugcgg

SEQ ID NO: 1418429 - RNA, 14 nt, Human
ugcccacaggccgc

SEQ ID NO: 1418430 - RNA, 12 nt, Human
ugcccacaggcc

SEQ ID NO: 1418431 - RNA, 20 nt, Human
ugcccaagccagaggcuggg

SEQ ID NO: 1418432 - RNA, 18 nt, Human
ugcccaagccagaggcug

SEQ ID NO: 1418433 - RNA, 16 nt, Human
ugcccaagccagaggc

SEQ ID NO: 1418434 - RNA, 15 nt, Human
ugcccaagccagagg

SEQ ID NO: 1418435 - RNA, 14 nt, Human
ugcccaagccagag

SEQ ID NO: 1418436 - RNA, 13 nt, Human
ugcccaagccaga

SEQ ID NO: 1418437 - RNA, 11 nt, Human
ugcccaagcca

SEQ ID NO: 1418438 - RNA, 15 nt, Human
agcuccaaccugcaa

SEQ ID NO: 1418439 - RNA, 14 nt, Human
agcuccaaccugca

SEQ ID NO: 1418440 - RNA, 13 nt, Human
agcuccaaccugc

SEQ ID NO: 1418441 - RNA, 18 nt, Human
agcuccaaccugcaaaga

SEQ ID NO: 1418442 - RNA, 16 nt, Human
agcuccaaccugcaaa

SEQ ID NO: 1418443 - RNA, 21 nt, Human
agcucauccaugccucagaag

SEQ ID NO: 1418444 - RNA, 20 nt, Human
agcucauucuccuuguguua

SEQ ID NO: 1418445 - RNA, 21 nt, Human
agcucauucuccuuguguuac

SEQ ID NO: 1418446 - RNA, 22 nt, Human
agcucaggaaccgaggcaggga

SEQ ID NO: 1418447 - RNA, 21 nt, Human
agcucaggaaccgaggcaggg

SEQ ID NO: 1418448 - RNA, 23 nt, Human
agcucagcugcauuccgcagccc

SEQ ID NO: 1418449 - RNA, 20 nt, Human
agcucaggaaccgaggcagg

SEQ ID NO: 1418450 - RNA, 18 nt, Human
agcucaggacagaugcca

SEQ ID NO: 1418451 - RNA, 17 nt, Human
agcucaggacagaugcc

SEQ ID NO: 1418452 - RNA, 13 nt, Human
agcucaggacaga

SEQ ID NO: 1418453 - RNA, 19 nt, Human
agcucagcugcauuccgca

SEQ ID NO: 1418454 - RNA, 13 nt, Human
agcucagcugcau

SEQ ID NO: 1418455 - RNA, 21 nt, Human
agcuaggagcaaagccuguuc

SEQ ID NO: 1418456 - RNA, 20 nt, Human
agcuaggagcaaagccuguu

SEQ ID NO: 1418457 - RNA, 19 nt, Human
agcuaggagcaaagccugu

SEQ ID NO: 1418458 - RNA, 18 nt, Human
agcuaggagcaaagccug

SEQ ID NO: 1418459 - RNA, 17 nt, Human
agcuaggagcaaagccu

SEQ ID NO: 1418460 - RNA, 16 nt, Human
agcuaggagcaaagcc

SEQ ID NO: 1418461 - RNA, 15 nt, Human
agcuaggagcaaagc

SEQ ID NO: 1418462 - RNA, 13 nt, Human
agcuaggaaugaa

SEQ ID NO: 1418463 - RNA, 12 nt, Human
agcuaggaauga

SEQ ID NO: 1418464 - RNA, 21 nt, Human
agcuaggaagagcaggacucc

SEQ ID NO: 1418465 - RNA, 18 nt, Human
agcuaggaagagcaggac

SEQ ID NO: 1418466 - RNA, 18 nt, Human
agcuaggaauuguguuua

SEQ ID NO: 1418467 - RNA, 14 nt, Human
ugcggcugugugug

SEQ ID NO: 1418468 - RNA, 13 nt, Human
ugcggcugugugu

SEQ ID NO: 1418469 - RNA, 12 nt, Human
ugcggcugugug

SEQ ID NO: 1418470 - RNA, 22 nt, Human
ugcggcuggccauggagaaagc

SEQ ID NO: 1418471 - RNA, 23 nt, Human
ugcggcuggccauggagaaagcu

SEQ ID NO: 1418472 - RNA, 15 nt, Human
ugcggcuggccaugg

SEQ ID NO: 1418473 - RNA, 14 nt, Human
ugcggcuggccaug

SEQ ID NO: 1418474 - RNA, 15 nt, Human
ugcggcuccucaggg

SEQ ID NO: 1418475 - RNA, 13 nt, Human
ugcggcuccucag

SEQ ID NO: 1418476 - RNA, 21 nt, Human
ugcgggugaacaaagcagcca

SEQ ID NO: 1418477 - RNA, 18 nt, Human
ugcgggugaacaaagcag

SEQ ID NO: 1418478 - RNA, 15 nt, Human
ugcggggugggggca

SEQ ID NO: 1418479 - RNA, 22 nt, Human
ugcggggguuccguguccaccc

SEQ ID NO: 1418480 - RNA, 16 nt, Human
ugcgggugagaguaau

SEQ ID NO: 1418481 - RNA, 23 nt, Human
ugcggguggggcuuggggcucac

SEQ ID NO: 1418482 - RNA, 23 nt, Human
ugcgggugaacaaagcagccacg

SEQ ID NO: 1418483 - RNA, 22 nt, Human
ugcgggugaacaaagcagccac

SEQ ID NO: 1418484 - RNA, 22 nt, Human
ugcggaccacccucacuggcuc

SEQ ID NO: 1418485 - RNA, 18 nt, Human
ugcggaccacccucacug

SEQ ID NO: 1418486 - RNA, 14 nt, Human
ugccuuuuauccca

SEQ ID NO: 1418487 - RNA, 17 nt, Human
ugccuuuucccaacucc

SEQ ID NO: 1418488 - RNA, 13 nt, Human
ugcggauggccgg

SEQ ID NO: 1418489 - RNA, 21 nt, Human
ugcggaggaaggaggacccag

SEQ ID NO: 1418490 - RNA, 22 nt, Human
ugcggaggaaggaggacccagg

SEQ ID NO: 1418491 - RNA, 23 nt, Human
ugcggaggaaggaggacccagga

SEQ ID NO: 1418492 - RNA, 17 nt, Human
ugccuuugccaggugac

SEQ ID NO: 1418493 - RNA, 16 nt, Human
ugccuuugccagguga

SEQ ID NO: 1418494 - RNA, 17 nt, Human
ugccuuuggcagaguuc

SEQ ID NO: 1418495 - RNA, 21 nt, Human
ugccuuuccauccauggccag

SEQ ID NO: 1418496 - RNA, 20 nt, Human
ugccuuuccauccauggcca

SEQ ID NO: 1418497 - RNA, 22 nt, Human
ugccuuuccauccauggccagc

SEQ ID NO: 1418498 - RNA, 19 nt, Human
ugccuuucaggaucuauuu

SEQ ID NO: 1418499 - RNA, 17 nt, Human
ugccuuucaggaucuau

SEQ ID NO: 1418500 - RNA, 14 nt, Human
ugccuuaucuugca

SEQ ID NO: 1418501 - RNA, 20 nt, Human
ugccuuagucucaguuugug

SEQ ID NO: 1418502 - RNA, 16 nt, Human
ugccuuagucucaguu

SEQ ID NO: 1418503 - RNA, 13 nt, Human
ugccuuugaccug

SEQ ID NO: 1418504 - RNA, 16 nt, Human
ugccuuucaggaucua

SEQ ID NO: 1418505 - RNA, 17 nt, Human
ugccuuugaccugccuc

SEQ ID NO: 1418506 - RNA, 23 nt, Human
ugccuuugaccugccucccuuca

SEQ ID NO: 1418507 - RNA, 14 nt, Human
agcuuggggaagac

SEQ ID NO: 1418508 - RNA, 20 nt, Human
agcuugaccugaggcugugg

SEQ ID NO: 1418509 - RNA, 15 nt, Human
agcuuagacuaaggc

SEQ ID NO: 1418510 - RNA, 12 nt, Human
ugcuacaauguc

SEQ ID NO: 1418511 - RNA, 11 nt, Human
ugcuacacacu

SEQ ID NO: 1418512 - RNA, 18 nt, Human
agcuguucugucuuccca

SEQ ID NO: 1418513 - RNA, 18 nt, Human
ugcuaagguucuaaggcc

SEQ ID NO: 1418514 - RNA, 17 nt, Human
ugcuaagguucuaaggc

SEQ ID NO: 1418515 - RNA, 16 nt, Human
ugcuaagguucuaagg

SEQ ID NO: 1418516 - RNA, 15 nt, Human
ugcuaagguucuaag

SEQ ID NO: 1418517 - RNA, 14 nt, Human
ugcuaagguucuaa

SEQ ID NO: 1418518 - RNA, 13 nt, Human
ugcuaagguucua

SEQ ID NO: 1418519 - RNA, 12 nt, Human
ugcuaagguucu

SEQ ID NO: 1418520 - RNA, 23 nt, Human
ugcuaaggucuuggaacuugccu

SEQ ID NO: 1418521 - RNA, 15 nt, Human
ugcuaaggucuugga

SEQ ID NO: 1418522 - RNA, 20 nt, Human
ugcuaagccccagcaagcaa

SEQ ID NO: 1418523 - RNA, 21 nt, Human
agcuggcauuacagcuggaga

SEQ ID NO: 1418524 - RNA, 15 nt, Human
agcuggcauuacagc

SEQ ID NO: 1418525 - RNA, 14 nt, Human
agcuggaugagaau

SEQ ID NO: 1418526 - RNA, 16 nt, Human
agcugccggucgcccu

SEQ ID NO: 1418527 - RNA, 21 nt, Human
agcugccuagauucagggaaa

SEQ ID NO: 1418528 - RNA, 19 nt, Human
agcugccggucgcccuuug

SEQ ID NO: 1418529 - RNA, 21 nt, Human
ugccuggaggaccugagccug

SEQ ID NO: 1418530 - RNA, 23 nt, Human
ugccuggaguguaugacugcaca

SEQ ID NO: 1418531 - RNA, 22 nt, Human
ugccuggaggaccugagccugc

SEQ ID NO: 1418532 - RNA, 20 nt, Human
ugccuggaggaccugagccu

SEQ ID NO: 1418533 - RNA, 19 nt, Human
ugccuggaggaccugagcc

SEQ ID NO: 1418534 - RNA, 18 nt, Human
ugccuggaggaccugagc

SEQ ID NO: 1418535 - RNA, 16 nt, Human
ugccuggaggaccuga

SEQ ID NO: 1418536 - RNA, 15 nt, Human
ugccuggaggaccug

SEQ ID NO: 1418537 - RNA, 11 nt, Human
ugccuggagga

SEQ ID NO: 1418538 - RNA, 20 nt, Human
ugccuggagacuuagggcac

SEQ ID NO: 1418539 - RNA, 15 nt, Human
ugcccaggcacugca

SEQ ID NO: 1418540 - RNA, 12 nt, Human
ugcccaggcacu

SEQ ID NO: 1418541 - RNA, 12 nt, Human
ugccuggacccg

SEQ ID NO: 1418542 - RNA, 11 nt, Human
ugccuggaccc

SEQ ID NO: 1418543 - RNA, 13 nt, Human
ugccugccugcuc

SEQ ID NO: 1418544 - RNA, 15 nt, Human
ugccugcccugguga

SEQ ID NO: 1418545 - RNA, 13 nt, Human
ugccugcccuggu

SEQ ID NO: 1418546 - RNA, 15 nt, Human
ugccugcccuauucu

SEQ ID NO: 1418547 - RNA, 14 nt, Human
agcugucuuuugga

SEQ ID NO: 1418548 - RNA, 22 nt, Human
agcuguguguuuggaagacuau

SEQ ID NO: 1418549 - RNA, 15 nt, Human
ugccuuagucucagu

SEQ ID NO: 1418550 - RNA, 19 nt, Human
ugccuguuucccaggccca

SEQ ID NO: 1418551 - RNA, 16 nt, Human
ugccuguuucccaggc

SEQ ID NO: 1418552 - RNA, 14 nt, Human
ugccuguuucccag

SEQ ID NO: 1418553 - RNA, 11 nt, Human
agcuggcucua

SEQ ID NO: 1418554 - RNA, 23 nt, Human
agcuggcucugagcgccuccauc

SEQ ID NO: 1418555 - RNA, 20 nt, Human
agcuggcucugagcgccucc

SEQ ID NO: 1418556 - RNA, 19 nt, Human
agcuggcucugagcgccuc

SEQ ID NO: 1418557 - RNA, 14 nt, Human
agcuggcucugagc

SEQ ID NO: 1418558 - RNA, 13 nt, Human
agcuggcucugag

SEQ ID NO: 1418559 - RNA, 22 nt, Human
agcuguccccccacucccucac

SEQ ID NO: 1418560 - RNA, 23 nt, Human
agcuguccccccacucccucaca

SEQ ID NO: 1418561 - RNA, 14 nt, Human
agcuguccccccac

SEQ ID NO: 1418562 - RNA, 19 nt, Human
agcugucaucaauuaaagg

SEQ ID NO: 1418563 - RNA, 21 nt, Human
agcugggacaccccgacuuuu

SEQ ID NO: 1418564 - RNA, 21 nt, Human
agcuguccuuuuuccucucca

SEQ ID NO: 1418565 - RNA, 17 nt, Human
agcugucugcucagaca

SEQ ID NO: 1418566 - RNA, 11 nt, Human
agcugucugcu

SEQ ID NO: 1418567 - RNA, 23 nt, Human
agcuguccuuuuuccucuccaca

SEQ ID NO: 1418568 - RNA, 20 nt, Human
agcuguccuuuuuccucucc

SEQ ID NO: 1418569 - RNA, 18 nt, Human
agcuguccuuuuuccucu

SEQ ID NO: 1418570 - RNA, 17 nt, Human
agcuguccuuuuuccuc

SEQ ID NO: 1418571 - RNA, 16 nt, Human
agcuguccuuuuuccu

SEQ ID NO: 1418572 - RNA, 14 nt, Human
agcuguccuuuuuc

SEQ ID NO: 1418573 - RNA, 14 nt, Human
agcuguguggcagu

SEQ ID NO: 1418574 - RNA, 16 nt, Human
agcuguguggcagucu

SEQ ID NO: 1418575 - RNA, 23 nt, Human
ugcuuauuugacaacguuucagc

SEQ ID NO: 1418576 - RNA, 21 nt, Human
ugcuuauuuauuguauucugg

SEQ ID NO: 1418577 - RNA, 19 nt, Human
ugcuuauuuauuguauucu

SEQ ID NO: 1418578 - RNA, 18 nt, Human
ugcuuauuuauuguauuc

SEQ ID NO: 1418579 - RNA, 22 nt, Human
ugcuuacugauauauuuuacaa

SEQ ID NO: 1418580 - RNA, 14 nt, Human
ugcuuacugauaua

SEQ ID NO: 1418581 - RNA, 17 nt, Human
ugcuguggccaggaggu

SEQ ID NO: 1418582 - RNA, 16 nt, Human
ugcuguggccaggagg

SEQ ID NO: 1418583 - RNA, 15 nt, Human
ugcuguggccaggag

SEQ ID NO: 1418584 - RNA, 14 nt, Human
ugcuguggccagga

SEQ ID NO: 1418585 - RNA, 13 nt, Human
ugcuguggccagg

SEQ ID NO: 1418586 - RNA, 18 nt, Human
ugcugugcugugcuaugg

SEQ ID NO: 1418587 - RNA, 22 nt, Human
ugcuguggaacuacauuacugu

SEQ ID NO: 1418588 - RNA, 15 nt, Human
ugcugugcugugcua

SEQ ID NO: 1418589 - RNA, 18 nt, Human
ugcugugcgcccagggcu

SEQ ID NO: 1418590 - RNA, 17 nt, Human
ugcugugcgcccagggc

SEQ ID NO: 1418591 - RNA, 16 nt, Human
ugcugugcgcccaggg

SEQ ID NO: 1418592 - RNA, 22 nt, Human
ugcugugauacgaugcuucaag

SEQ ID NO: 1418593 - RNA, 20 nt, Human
ugcugugauacgaugcuuca

SEQ ID NO: 1418594 - RNA, 23 nt, Human
ugcuguauuuuaaaagaaugauu

SEQ ID NO: 1418595 - RNA, 15 nt, Human
ugcuuccaauuuucu

SEQ ID NO: 1418596 - RNA, 21 nt, Human
ugcuucaugugucccagaaga

SEQ ID NO: 1418597 - RNA, 19 nt, Human
ugcuucaugugucccagaa

SEQ ID NO: 1418598 - RNA, 17 nt, Human
ugcuucaugugucccag

SEQ ID NO: 1418599 - RNA, 15 nt, Human
ugcuucauguguccc

SEQ ID NO: 1418600 - RNA, 23 nt, Human
ugcuucaagagaaaaugcgguua

SEQ ID NO: 1418601 - RNA, 16 nt, Human
ugcuucaagagaaaau

SEQ ID NO: 1418602 - RNA, 14 nt, Human
ugcuucaacugucu

SEQ ID NO: 1418603 - RNA, 16 nt, Human
aggacagaugccuccu

SEQ ID NO: 1418604 - RNA, 14 nt, Human
aggacagagagaaa

SEQ ID NO: 1418605 - RNA, 15 nt, Human
aggacagagagaaau

SEQ ID NO: 1418606 - RNA, 23 nt, Human
aggacacgggccuguccacaggc

SEQ ID NO: 1418607 - RNA, 18 nt, Human
aggacacgggccugucca

SEQ ID NO: 1418608 - RNA, 11 nt, Human
aggacacaugu

SEQ ID NO: 1418609 - RNA, 12 nt, Human
aggacacauguc

SEQ ID NO: 1418610 - RNA, 13 nt, Human
aggacacaugucc

SEQ ID NO: 1418611 - RNA, 20 nt, Human
ugcuggaguuucauguacaa

SEQ ID NO: 1418612 - RNA, 16 nt, Human
aggaaggacuaugaaa

SEQ ID NO: 1418613 - RNA, 14 nt, Human
aggaauggaagucc

SEQ ID NO: 1418614 - RNA, 16 nt, Human
ugcuggccucugcgag

SEQ ID NO: 1418615 - RNA, 13 nt, Human
ugcuggccucugc

SEQ ID NO: 1418616 - RNA, 23 nt, Human
ugcuggccgcccccagcccccuc

SEQ ID NO: 1418617 - RNA, 23 nt, Human
ugcugggacucagccuucagaca

SEQ ID NO: 1418618 - RNA, 22 nt, Human
ugcugggacucagccuucagac

SEQ ID NO: 1418619 - RNA, 18 nt, Human
ugcugggacucagccuuc

SEQ ID NO: 1418620 - RNA, 16 nt, Human
ugcugggacucagccu

SEQ ID NO: 1418621 - RNA, 13 nt, Human
ugcuguauuuuaa

SEQ ID NO: 1418622 - RNA, 17 nt, Human
ugcuguauaaaaucagc

SEQ ID NO: 1418623 - RNA, 18 nt, Human
ugcuguauaaaaucagcc

SEQ ID NO: 1418624 - RNA, 22 nt, Human
ugcuguauuuuaaaagaaugau

SEQ ID NO: 1418625 - RNA, 21 nt, Human
ugcuguauuuuaaaagaauga

SEQ ID NO: 1418626 - RNA, 13 nt, Human
ugcuguauaaaau

SEQ ID NO: 1418627 - RNA, 14 nt, Human
ugcuguauaaaauc

SEQ ID NO: 1418628 - RNA, 15 nt, Human
ugcuguauaaaauca

SEQ ID NO: 1418629 - RNA, 16 nt, Human
ugcuguauaaaaucag

SEQ ID NO: 1418630 - RNA, 22 nt, Human
ugcugacuguagcuuuggaagu

SEQ ID NO: 1418631 - RNA, 17 nt, Human
ugcugacuguagcuuug

SEQ ID NO: 1418632 - RNA, 14 nt, Human
ugcugacuguagcu

SEQ ID NO: 1418633 - RNA, 12 nt, Human
aggaaauauuua

SEQ ID NO: 1418634 - RNA, 15 nt, Human
aggaaauauacuuuu

SEQ ID NO: 1418635 - RNA, 13 nt, Human
aggaaauauuuau

SEQ ID NO: 1418636 - RNA, 19 nt, Human
aggaagcccaauugcugga

SEQ ID NO: 1418637 - RNA, 17 nt, Human
aggaagcaagcuuaaug

SEQ ID NO: 1418638 - RNA, 15 nt, Human
aggaagcaagcuuaa

SEQ ID NO: 1418639 - RNA, 21 nt, Human
aggaaaucaacuugcuuauca

SEQ ID NO: 1418640 - RNA, 13 nt, Human
aggaaaucaaaug

SEQ ID NO: 1418641 - RNA, 12 nt, Human
aggaagccuucc

SEQ ID NO: 1418642 - RNA, 20 nt, Human
aggaagccugcaguccugga

SEQ ID NO: 1418643 - RNA, 19 nt, Human
aggaagccugcaguccugg

SEQ ID NO: 1418644 - RNA, 22 nt, Human
aggaagccucagauuccuuccc

SEQ ID NO: 1418645 - RNA, 20 nt, Human
aggaagccucagauuccuuc

SEQ ID NO: 1418646 - RNA, 14 nt, Human
aggaagccucagau

SEQ ID NO: 1418647 - RNA, 13 nt, Human
aggaagccucaga

SEQ ID NO: 1418648 - RNA, 14 nt, Human
aggaagccguccug

SEQ ID NO: 1418649 - RNA, 22 nt, Human
aggaagcccccaccgugggcag

SEQ ID NO: 1418650 - RNA, 15 nt, Human
ugcuauucugucccu

SEQ ID NO: 1418651 - RNA, 14 nt, Human
ugcuauucuguccc

SEQ ID NO: 1418652 - RNA, 13 nt, Human
ugcuauucugucc

SEQ ID NO: 1418653 - RNA, 12 nt, Human
ugcuauucuguc

SEQ ID NO: 1418654 - RNA, 11 nt, Human
ugcuauucugu

SEQ ID NO: 1418655 - RNA, 20 nt, Human
ugcuauucugucccuaggug

SEQ ID NO: 1418656 - RNA, 17 nt, Human
ugcuauucugucccuag

SEQ ID NO: 1418657 - RNA, 16 nt, Human
ugcuauucugucccua

SEQ ID NO: 1418658 - RNA, 14 nt, Human
ugcuaugguuuucu

SEQ ID NO: 1418659 - RNA, 17 nt, Human
ugcuaugguuuucucca

SEQ ID NO: 1418660 - RNA, 15 nt, Human
ugcuauggugcucug

SEQ ID NO: 1418661 - RNA, 20 nt, Human
ugcuaucucugugugcacaa

SEQ ID NO: 1418662 - RNA, 21 nt, Human
ugcuaucucugugugcacaaa

SEQ ID NO: 1418663 - RNA, 16 nt, Human
ugcuaucucugugugc

SEQ ID NO: 1418664 - RNA, 18 nt, Human
agcuuuagaaucccagcc

SEQ ID NO: 1418665 - RNA, 18 nt, Human
agcuuuagaaacagugca

SEQ ID NO: 1418666 - RNA, 18 nt, Human
agcuuuaacuuaaauagu

SEQ ID NO: 1418667 - RNA, 21 nt, Human
agcuuuaaugauaugcuugua

SEQ ID NO: 1418668 - RNA, 14 nt, Human
ugcucccucagacu

SEQ ID NO: 1418669 - RNA, 19 nt, Human
ugcucccucagacuggggc

SEQ ID NO: 1418670 - RNA, 13 nt, Human
ugcucccucagac

SEQ ID NO: 1418671 - RNA, 12 nt, Human
ugcucccucaga

SEQ ID NO: 1418672 - RNA, 15 nt, Human
ugcucccucacaugu

SEQ ID NO: 1418673 - RNA, 14 nt, Human
ugcucauggaauug

SEQ ID NO: 1418674 - RNA, 19 nt, Human
ugcuccaagauucuagaug

SEQ ID NO: 1418675 - RNA, 18 nt, Human
ugcuccaagauucuagau

SEQ ID NO: 1418676 - RNA, 17 nt, Human
ugcuccaagauucuaga

SEQ ID NO: 1418677 - RNA, 16 nt, Human
ugcuccaagauucuag

SEQ ID NO: 1418678 - RNA, 15 nt, Human
ugcuccaagauucua

SEQ ID NO: 1418679 - RNA, 14 nt, Human
ugcuccaagauucu

SEQ ID NO: 1418680 - RNA, 14 nt, Human
ugcucauuucagga

SEQ ID NO: 1418681 - RNA, 22 nt, Human
aggccagccgcgcaucagacug

SEQ ID NO: 1418682 - RNA, 12 nt, Human
aggccagccugg

SEQ ID NO: 1418683 - RNA, 22 nt, Human
aggccagcacucgcuagcagug

SEQ ID NO: 1418684 - RNA, 22 nt, Human
aggccagaggcccccagcccag

SEQ ID NO: 1418685 - RNA, 15 nt, Human
uggcagccuugugau

SEQ ID NO: 1418686 - RNA, 12 nt, Human
uggcagccuugu

SEQ ID NO: 1418687 - RNA, 17 nt, Human
aggcccaguucacccug

SEQ ID NO: 1418688 - RNA, 17 nt, Human
aggcccaggcugggaac

SEQ ID NO: 1418689 - RNA, 16 nt, Human
aggcccaggcugggaa

SEQ ID NO: 1418690 - RNA, 15 nt, Human
aggcccaggcuggga

SEQ ID NO: 1418691 - RNA, 13 nt, Human
aggcccaggcugg

SEQ ID NO: 1418692 - RNA, 18 nt, Human
aggcccaggcugccgucc

SEQ ID NO: 1418693 - RNA, 17 nt, Human
aggcccaggcugccguc

SEQ ID NO: 1418694 - RNA, 15 nt, Human
aggcccaggcugccg

SEQ ID NO: 1418695 - RNA, 13 nt, Human
aggcccaggcugc

SEQ ID NO: 1418696 - RNA, 18 nt, Human
aggcccagccgacccccu

SEQ ID NO: 1418697 - RNA, 20 nt, Human
aggcccagccgacccccucu

SEQ ID NO: 1418698 - RNA, 15 nt, Human
aggccccaacccugu

SEQ ID NO: 1418699 - RNA, 14 nt, Human
aggccccagccucc

SEQ ID NO: 1418700 - RNA, 13 nt, Human
aggccccagccuc

SEQ ID NO: 1418701 - RNA, 12 nt, Human
aggccccagccu

SEQ ID NO: 1418702 - RNA, 23 nt, Human
uggcaaugccacagcccugucag

SEQ ID NO: 1418703 - RNA, 19 nt, Human
uggcaaugccaucaucucc

SEQ ID NO: 1418704 - RNA, 21 nt, Human
uggcaaugccacagcccuguc

SEQ ID NO: 1418705 - RNA, 20 nt, Human
uggcaaugccacagcccugu

SEQ ID NO: 1418706 - RNA, 19 nt, Human
uggcaaugccacagcccug

SEQ ID NO: 1418707 - RNA, 15 nt, Human
uggcaaugccacagc

SEQ ID NO: 1418708 - RNA, 15 nt, Human
uggcaauuuuguaac

SEQ ID NO: 1418709 - RNA, 14 nt, Human
uggcaauuuuguaa

SEQ ID NO: 1418710 - RNA, 13 nt, Human
uggcaauuuugua

SEQ ID NO: 1418711 - RNA, 14 nt, Human
uggcaauuuugugg

SEQ ID NO: 1418712 - RNA, 23 nt, Human
uggagggguguggcuccuuccca

SEQ ID NO: 1418713 - RNA, 14 nt, Human
uggagggguguggc

SEQ ID NO: 1418714 - RNA, 13 nt, Human
uggaggggugugg

SEQ ID NO: 1418715 - RNA, 21 nt, Human
uggagggguaggggcugggaa

SEQ ID NO: 1418716 - RNA, 22 nt, Human
uggagggguaggggcugggaac

SEQ ID NO: 1418717 - RNA, 20 nt, Human
uggagggguaggggcuggga

SEQ ID NO: 1418718 - RNA, 17 nt, Human
uggagggguaggggcug

SEQ ID NO: 1418719 - RNA, 14 nt, Human
aggccaagaggcug

SEQ ID NO: 1418720 - RNA, 21 nt, Human
aggcagcccaggaagucucau

SEQ ID NO: 1418721 - RNA, 17 nt, Human
aggcagcccaggaaguc

SEQ ID NO: 1418722 - RNA, 15 nt, Human
aggcagcccaggaag

SEQ ID NO: 1418723 - RNA, 12 nt, Human
aggcagcccagg

SEQ ID NO: 1418724 - RNA, 22 nt, Human
aggcagccagugcccugagcca

SEQ ID NO: 1418725 - RNA, 20 nt, Human
aggcagccagugcccugagc

SEQ ID NO: 1418726 - RNA, 19 nt, Human
aggcagccagugcccugag

SEQ ID NO: 1418727 - RNA, 18 nt, Human
aggcagccagugcccuga

SEQ ID NO: 1418728 - RNA, 17 nt, Human
aggcagccagugcccug

SEQ ID NO: 1418729 - RNA, 22 nt, Human
uggaugggggaacucagaucca

SEQ ID NO: 1418730 - RNA, 21 nt, Human
uggaugggggaacucagaucc

SEQ ID NO: 1418731 - RNA, 18 nt, Human
uggaugggggaacucaga

SEQ ID NO: 1418732 - RNA, 20 nt, Human
uggauggggcaggccaccug

SEQ ID NO: 1418733 - RNA, 21 nt, Human
uggauggccccagcacagcuu

SEQ ID NO: 1418734 - RNA, 18 nt, Human
uggauggccccagcacag

SEQ ID NO: 1418735 - RNA, 17 nt, Human
uggauggccccagcaca

SEQ ID NO: 1418736 - RNA, 16 nt, Human
uggauggccccagcac

SEQ ID NO: 1418737 - RNA, 15 nt, Human
uggauggccccagca

SEQ ID NO: 1418738 - RNA, 14 nt, Human
uggauggccccagc

SEQ ID NO: 1418739 - RNA, 16 nt, Human
uggagguucuaaggcc

SEQ ID NO: 1418740 - RNA, 15 nt, Human
uggagguucuaaggc

SEQ ID NO: 1418741 - RNA, 13 nt, Human
uggagguucuaag

SEQ ID NO: 1418742 - RNA, 15 nt, Human
uggaguacuuagcua

SEQ ID NO: 1418743 - RNA, 14 nt, Human
uggcaaugccacag

SEQ ID NO: 1418744 - RNA, 13 nt, Human
uggcaaugccaca

SEQ ID NO: 1418745 - RNA, 20 nt, Human
uggcaaucaaacauuuucug

SEQ ID NO: 1418746 - RNA, 20 nt, Human
uggauuacugccauucacuu

SEQ ID NO: 1418747 - RNA, 13 nt, Human
uggauggggcagg

SEQ ID NO: 1418748 - RNA, 17 nt, Human
uggauuauauuaugaag

SEQ ID NO: 1418749 - RNA, 20 nt, Human
uggccucuuuccucagccuu

SEQ ID NO: 1418750 - RNA, 22 nt, Human
uggccucuugagcaguggcugg

SEQ ID NO: 1418751 - RNA, 20 nt, Human
uggccucuugagcaguggcu

SEQ ID NO: 1418752 - RNA, 19 nt, Human
uggccucuugagcaguggc

SEQ ID NO: 1418753 - RNA, 17 nt, Human
uggccucuugagcagug

SEQ ID NO: 1418754 - RNA, 21 nt, Human
aggccugggccgcugccacgu

SEQ ID NO: 1418755 - RNA, 20 nt, Human
aggccugggccgcugccacg

SEQ ID NO: 1418756 - RNA, 23 nt, Human
aggccuguguagcugugaccugc

SEQ ID NO: 1418757 - RNA, 24 nt, Human
aggccuguguagcugugaccugcu

SEQ ID NO: 1418758 - RNA, 22 nt, Human
aggccuguguagcugugaccug

SEQ ID NO: 1418759 - RNA, 21 nt, Human
aggccuguguagcugugaccu

SEQ ID NO: 1418760 - RNA, 16 nt, Human
aggccugggcugggaa

SEQ ID NO: 1418761 - RNA, 21 nt, Human
uggcccugggucccaggaccc

SEQ ID NO: 1418762 - RNA, 22 nt, Human
uggcccugggagaaucgcuccu

SEQ ID NO: 1418763 - RNA, 23 nt, Human
uggcccugggagaaucgcuccug

SEQ ID NO: 1418764 - RNA, 17 nt, Human
uggcccugcuuccugcu

SEQ ID NO: 1418765 - RNA, 14 nt, Human
uggcccugcuuccu

SEQ ID NO: 1418766 - RNA, 23 nt, Human
uggcccaccccacccacuucugc

SEQ ID NO: 1418767 - RNA, 21 nt, Human
uggccgugaaugggugcccac

SEQ ID NO: 1418768 - RNA, 17 nt, Human
uggccgugaaugggugc

SEQ ID NO: 1418769 - RNA, 16 nt, Human
uggccuaaccugccga

SEQ ID NO: 1418770 - RNA, 13 nt, Human
uggccucuucaga

SEQ ID NO: 1418771 - RNA, 14 nt, Human
uggccauggccugc

SEQ ID NO: 1418772 - RNA, 13 nt, Human
uggccauggccug

SEQ ID NO: 1418773 - RNA, 23 nt, Human
uggccauggagaaagcugacuug

SEQ ID NO: 1418774 - RNA, 22 nt, Human
uggccauggagaaagcugacuu

SEQ ID NO: 1418775 - RNA, 18 nt, Human
uggccauggagaaagcug

SEQ ID NO: 1418776 - RNA, 17 nt, Human
uggccauggagaaagcu

SEQ ID NO: 1418777 - RNA, 16 nt, Human
uggccauggagaaagc

SEQ ID NO: 1418778 - RNA, 22 nt, Human
uggccaugcuccucuuccccag

SEQ ID NO: 1418779 - RNA, 21 nt, Human
uggccaugcuccucuucccca

SEQ ID NO: 1418780 - RNA, 17 nt, Human
uggccaugcuccucuuc

SEQ ID NO: 1418781 - RNA, 16 nt, Human
uggccaugcuccucuu

SEQ ID NO: 1418782 - RNA, 21 nt, Human
uggccaugacccugccucucc

SEQ ID NO: 1418783 - RNA, 15 nt, Human
uggccauuugcuuuu

SEQ ID NO: 1418784 - RNA, 14 nt, Human
uggccauuugcuuu

SEQ ID NO: 1418785 - RNA, 22 nt, Human
uggcccaccccacccacuucug

SEQ ID NO: 1418786 - RNA, 19 nt, Human
uggcccaccccacccacuu

SEQ ID NO: 1418787 - RNA, 20 nt, Human
uggccaugacccugccucuc

SEQ ID NO: 1418788 - RNA, 17 nt, Human
uggccaugacccugccu

SEQ ID NO: 1418789 - RNA, 16 nt, Human
uggccaugacccugcc

SEQ ID NO: 1418790 - RNA, 15 nt, Human
uggccaugacccugc

SEQ ID NO: 1418791 - RNA, 14 nt, Human
uggccaugacccug

SEQ ID NO: 1418792 - RNA, 15 nt, Human
uggccaucugcuccu

SEQ ID NO: 1418793 - RNA, 18 nt, Human
uggccaucugcuccugga

SEQ ID NO: 1418794 - RNA, 14 nt, Human
uggccaucugcucc

SEQ ID NO: 1418795 - RNA, 23 nt, Human
uggccauauuuaccucagccugg

SEQ ID NO: 1418796 - RNA, 24 nt, Human
uggccauauuuaccucagccuggg

SEQ ID NO: 1418797 - RNA, 22 nt, Human
uggccauauuuaccucagccug

SEQ ID NO: 1418798 - RNA, 21 nt, Human
uggccauauuuaccucagccu

SEQ ID NO: 1418799 - RNA, 20 nt, Human
uggccauauuuaccucagcc

SEQ ID NO: 1418800 - RNA, 19 nt, Human
uggccauauuuaccucagc

SEQ ID NO: 1418801 - RNA, 18 nt, Human
uggccauauuuaccucag

SEQ ID NO: 1418802 - RNA, 15 nt, Human
uggccauauuuaccu

SEQ ID NO: 1418803 - RNA, 16 nt, Human
uggccauacugugucc

SEQ ID NO: 1418804 - RNA, 18 nt, Human
uggccaguguuuaaaacu

SEQ ID NO: 1418805 - RNA, 19 nt, Human
uggccaguguuuaaaacuu

SEQ ID NO: 1418806 - RNA, 15 nt, Human
uggccaguccaggcu

SEQ ID NO: 1418807 - RNA, 14 nt, Human
uggccaguccaggc

SEQ ID NO: 1418808 - RNA, 16 nt, Human
uggccaguccaggcug

SEQ ID NO: 1418809 - RNA, 17 nt, Human
uggccacaguagucuug

SEQ ID NO: 1418810 - RNA, 11 nt, Human
uggccaccagu

SEQ ID NO: 1418811 - RNA, 16 nt, Human
uggccacagccagggg

SEQ ID NO: 1418812 - RNA, 18 nt, Human
uggccacagccaggggag

SEQ ID NO: 1418813 - RNA, 14 nt, Human
uggccacagccagg

SEQ ID NO: 1418814 - RNA, 13 nt, Human
uggccacagccag

SEQ ID NO: 1418815 - RNA, 12 nt, Human
uggccacagcca

SEQ ID NO: 1418816 - RNA, 18 nt, Human
uggcaugagaaauacaaa

SEQ ID NO: 1418817 - RNA, 21 nt, Human
uggcaugagaaauacaaaaau

SEQ ID NO: 1418818 - RNA, 13 nt, Human
uggcaugagaaau

SEQ ID NO: 1418819 - RNA, 23 nt, Human
uggcaucgcaccauucugacucg

SEQ ID NO: 1418820 - RNA, 22 nt, Human
uggcaucgcaccauucugacuc

SEQ ID NO: 1418821 - RNA, 21 nt, Human
uggcaucgcaccauucugacu

SEQ ID NO: 1418822 - RNA, 20 nt, Human
uggcaucccugggccuuggg

SEQ ID NO: 1418823 - RNA, 16 nt, Human
uggcaucccugggccu

SEQ ID NO: 1418824 - RNA, 15 nt, Human
uggcaucccugggcc

SEQ ID NO: 1418825 - RNA, 14 nt, Human
uggcaucccugggc

SEQ ID NO: 1418826 - RNA, 13 nt, Human
uggcaucccuggg

SEQ ID NO: 1418827 - RNA, 16 nt, Human
uggcauagcucugggg

SEQ ID NO: 1418828 - RNA, 15 nt, Human
uggcauagcucuggg

SEQ ID NO: 1418829 - RNA, 14 nt, Human
uggcauagcucugg

SEQ ID NO: 1418830 - RNA, 18 nt, Human
uggacuuuccugcaacuc

SEQ ID NO: 1418831 - RNA, 14 nt, Human
uggacuuuccugca

SEQ ID NO: 1418832 - RNA, 19 nt, Human
uggacuuuccugcaacuca

SEQ ID NO: 1418833 - RNA, 13 nt, Human
uggagaagaacug

SEQ ID NO: 1418834 - RNA, 13 nt, Human
uggacuuuccugc

SEQ ID NO: 1418835 - RNA, 15 nt, Human
uggacugugugcuca

SEQ ID NO: 1418836 - RNA, 14 nt, Human
uggagaagaacuga

SEQ ID NO: 1418837 - RNA, 14 nt, Human
uggagccccaucag

SEQ ID NO: 1418838 - RNA, 14 nt, Human
aggcacccaucugu

SEQ ID NO: 1418839 - RNA, 20 nt, Human
aggcaccucacaggccccag

SEQ ID NO: 1418840 - RNA, 23 nt, Human
aggcaccuacacucaccugcacu

SEQ ID NO: 1418841 - RNA, 21 nt, Human
aggcaccuacacucaccugca

SEQ ID NO: 1418842 - RNA, 17 nt, Human
uggagcuccagccugac

SEQ ID NO: 1418843 - RNA, 15 nt, Human
uggagcuccagccug

SEQ ID NO: 1418844 - RNA, 14 nt, Human
uggagcuccagccu

SEQ ID NO: 1418845 - RNA, 13 nt, Human
uggagcccuggag

SEQ ID NO: 1418846 - RNA, 14 nt, Human
uggagcccuggaga

SEQ ID NO: 1418847 - RNA, 16 nt, Human
uggagcccuggagacc

SEQ ID NO: 1418848 - RNA, 16 nt, Human
uggagcuccagccuga

SEQ ID NO: 1418849 - RNA, 22 nt, Human
aggcaaggcuguggaccaugga

SEQ ID NO: 1418850 - RNA, 14 nt, Human
uggagcucguggaa

SEQ ID NO: 1418851 - RNA, 13 nt, Human
aggcaaucauggu

SEQ ID NO: 1418852 - RNA, 22 nt, Human
aggcaaacccaucaacaaaaau

SEQ ID NO: 1418853 - RNA, 20 nt, Human
aggcaaaauugcaaaucuug

SEQ ID NO: 1418854 - RNA, 19 nt, Human
aggcaaaauugcaaaucuu

SEQ ID NO: 1418855 - RNA, 19 nt, Human
uggacaagcuucugagacg

SEQ ID NO: 1418856 - RNA, 17 nt, Human
uggacaagcuucugaga

SEQ ID NO: 1418857 - RNA, 16 nt, Human
uggacaagcuucugag

SEQ ID NO: 1418858 - RNA, 22 nt, Human
uggaauugauuugcauugaaca

SEQ ID NO: 1418859 - RNA, 20 nt, Human
uggaauugauuugcauugaa

SEQ ID NO: 1418860 - RNA, 19 nt, Human
uggaauugauuugcauuga

SEQ ID NO: 1418861 - RNA, 18 nt, Human
uggaauugauuugcauug

SEQ ID NO: 1418862 - RNA, 17 nt, Human
uggaauugauuugcauu

SEQ ID NO: 1418863 - RNA, 16 nt, Human
uggaauugauuugcau

SEQ ID NO: 1418864 - RNA, 15 nt, Human
uggaauugauuugca

SEQ ID NO: 1418865 - RNA, 12 nt, Human
uggaauugauuu

SEQ ID NO: 1418866 - RNA, 22 nt, Human
uggaauucuuagucacaaaaua

SEQ ID NO: 1418867 - RNA, 13 nt, Human
uggaauucuaaca

SEQ ID NO: 1418868 - RNA, 16 nt, Human
uggacacacacagacu

SEQ ID NO: 1418869 - RNA, 20 nt, Human
uggacacacacagacuauuu

SEQ ID NO: 1418870 - RNA, 15 nt, Human
uggaccugccugcau

SEQ ID NO: 1418871 - RNA, 14 nt, Human
uggaccugccugca

SEQ ID NO: 1418872 - RNA, 13 nt, Human
uggacccuguugc

SEQ ID NO: 1418873 - RNA, 14 nt, Human
uggacccuguugcu

SEQ ID NO: 1418874 - RNA, 15 nt, Human
uggacccuguugcua

SEQ ID NO: 1418875 - RNA, 16 nt, Human
uggacccuguugcuaa

SEQ ID NO: 1418876 - RNA, 19 nt, Human
aggagcuuugacucaggag

SEQ ID NO: 1418877 - RNA, 18 nt, Human
aggagcuuugacucagga

SEQ ID NO: 1418878 - RNA, 17 nt, Human
aggagcuuugacucagg

SEQ ID NO: 1418879 - RNA, 21 nt, Human
aggagcuggggaucccucccc

SEQ ID NO: 1418880 - RNA, 20 nt, Human
aggagcuggggaucccuccc

SEQ ID NO: 1418881 - RNA, 12 nt, Human
aggagcugggga

SEQ ID NO: 1418882 - RNA, 20 nt, Human
aggagcugggcagaaggcca

SEQ ID NO: 1418883 - RNA, 21 nt, Human
aggagcuccccuccccaacug

SEQ ID NO: 1418884 - RNA, 15 nt, Human
aggagcugauacuuu

SEQ ID NO: 1418885 - RNA, 22 nt, Human
aggagcugacucacaccugaac

SEQ ID NO: 1418886 - RNA, 23 nt, Human
aggagcucuuaacuacaguggcu

SEQ ID NO: 1418887 - RNA, 20 nt, Human
aggagcuccccuccccaacu

SEQ ID NO: 1418888 - RNA, 17 nt, Human
aggagcuccccucccca

SEQ ID NO: 1418889 - RNA, 15 nt, Human
aggagcuccccuccc

SEQ ID NO: 1418890 - RNA, 12 nt, Human
aggagcuccccu

SEQ ID NO: 1418891 - RNA, 22 nt, Human
aggagcuccaguguccugagcu

SEQ ID NO: 1418892 - RNA, 14 nt, Human
aggagcuccagugu

SEQ ID NO: 1418893 - RNA, 22 nt, Human
aggagcuaccuguguggacagg

SEQ ID NO: 1418894 - RNA, 23 nt, Human
aggagcuaccuguguggacagga

SEQ ID NO: 1418895 - RNA, 18 nt, Human
aggagcuaccugugugga

SEQ ID NO: 1418896 - RNA, 17 nt, Human
aggagcuaccugugugg

SEQ ID NO: 1418897 - RNA, 16 nt, Human
aggagcuaccugugug

SEQ ID NO: 1418898 - RNA, 15 nt, Human
aggagcuaccugugu

SEQ ID NO: 1418899 - RNA, 14 nt, Human
aggagcuaccugug

SEQ ID NO: 1418900 - RNA, 12 nt, Human
aggagcuaccug

SEQ ID NO: 1418901 - RNA, 21 nt, Human
aggagcuaaggcucuaugagu

SEQ ID NO: 1418902 - RNA, 14 nt, Human
aggauagagacugg

SEQ ID NO: 1418903 - RNA, 23 nt, Human
aggauagaaguauaccugauuuu

SEQ ID NO: 1418904 - RNA, 20 nt, Human
aggauacgacaguacacugu

SEQ ID NO: 1418905 - RNA, 18 nt, Human
aggauacgacaguacacu

SEQ ID NO: 1418906 - RNA, 22 nt, Human
aggauaccauauacagcucaga

SEQ ID NO: 1418907 - RNA, 15 nt, Human
aggauaccauauaca

SEQ ID NO: 1418908 - RNA, 23 nt, Human
aggagcuuugacucaggagccug

SEQ ID NO: 1418909 - RNA, 16 nt, Human
aggauccggaaagaag

SEQ ID NO: 1418910 - RNA, 14 nt, Human
aggauccggaaaga

SEQ ID NO: 1418911 - RNA, 14 nt, Human
aggauagaugcugg

SEQ ID NO: 1418912 - RNA, 19 nt, Human
aggaucccaugagcuccuu

SEQ ID NO: 1418913 - RNA, 23 nt, Human
uggaagauggggaccagcagccc

SEQ ID NO: 1418914 - RNA, 13 nt, Human
uggaagauccugc

SEQ ID NO: 1418915 - RNA, 21 nt, Human
uggaagauccugcgggugggg

SEQ ID NO: 1418916 - RNA, 18 nt, Human
uggaagauagcugugacu

SEQ ID NO: 1418917 - RNA, 16 nt, Human
uggaagauagcuguga

SEQ ID NO: 1418918 - RNA, 14 nt, Human
uggaagauagcugu

SEQ ID NO: 1418919 - RNA, 21 nt, Human
uggaagauggggaccagcagc

SEQ ID NO: 1418920 - RNA, 20 nt, Human
uggaaaguacacucugcugu

SEQ ID NO: 1418921 - RNA, 19 nt, Human
uggaaaguacacucugcug

SEQ ID NO: 1418922 - RNA, 16 nt, Human
uggaagggaggugggc

SEQ ID NO: 1418923 - RNA, 14 nt, Human
uggaaggcauggcg

SEQ ID NO: 1418924 - RNA, 11 nt, Human
uggaaggcaug

SEQ ID NO: 1418925 - RNA, 13 nt, Human
uggaaggagcaga

SEQ ID NO: 1418926 - RNA, 14 nt, Human
uggaaggagcagaa

SEQ ID NO: 1418927 - RNA, 12 nt, Human
uggaaggagcag

SEQ ID NO: 1418928 - RNA, 16 nt, Human
uggaagcuuggggaag

SEQ ID NO: 1418929 - RNA, 20 nt, Human
aggagcuaaggcucuaugag

SEQ ID NO: 1418930 - RNA, 19 nt, Human
aggagcuaaggcucuauga

SEQ ID NO: 1418931 - RNA, 17 nt, Human
aggagcuaaggcucuau

SEQ ID NO: 1418932 - RNA, 16 nt, Human
aggagcuaaggcucua

SEQ ID NO: 1418933 - RNA, 17 nt, Human
uggaagguauuuaauag

SEQ ID NO: 1418934 - RNA, 13 nt, Human
uggaagguauuua

SEQ ID NO: 1418935 - RNA, 22 nt, Human
uggaaaggugugagacugggaa

SEQ ID NO: 1418936 - RNA, 19 nt, Human
uggaaaggugugagacugg

SEQ ID NO: 1418937 - RNA, 18 nt, Human
ugcuuuugcccauuuuga

SEQ ID NO: 1418938 - RNA, 17 nt, Human
ugcuuuuggcggggagg

SEQ ID NO: 1418939 - RNA, 21 nt, Human
ugcuuuuggcaaaacucuacu

SEQ ID NO: 1418940 - RNA, 19 nt, Human
ugcuuuuggcaaaacucua

SEQ ID NO: 1418941 - RNA, 14 nt, Human
ugcuuuugcccauu

SEQ ID NO: 1418942 - RNA, 12 nt, Human
ugcuuuugccca

SEQ ID NO: 1418943 - RNA, 17 nt, Human
ugcuuugugauuuuugu

SEQ ID NO: 1418944 - RNA, 14 nt, Human
ugcuuguacauaau

SEQ ID NO: 1418945 - RNA, 16 nt, Human
ugcuuguacauaaugc

SEQ ID NO: 1418946 - RNA, 22 nt, Human
ugcuuguacauaaugcgugcau

SEQ ID NO: 1418947 - RNA, 12 nt, Human
ugcuuugugauu

SEQ ID NO: 1418948 - RNA, 14 nt, Human
ugcuuugugauuuu

SEQ ID NO: 1418949 - RNA, 16 nt, Human
ugcuuugugauuuuug

SEQ ID NO: 1418950 - RNA, 15 nt, Human
ugcuuguaacuaaaa

SEQ ID NO: 1418951 - RNA, 17 nt, Human
ugcuuggagcugagcaa

SEQ ID NO: 1418952 - RNA, 15 nt, Human
ugcuuggagcugagc

SEQ ID NO: 1418953 - RNA, 23 nt, Human
ugcuugcuuuucaugcaaacucu

SEQ ID NO: 1418954 - RNA, 12 nt, Human
ugcuuguacaua

SEQ ID NO: 1418955 - RNA, 13 nt, Human
ugcuuguacauaa

SEQ ID NO: 1418956 - RNA, 15 nt, Human
ugcuugcuuugaagu

SEQ ID NO: 1418957 - RNA, 12 nt, Human
ugcuugauuuuu

SEQ ID NO: 1418958 - RNA, 22 nt, Human
ugcuugaugggauucuggacag

SEQ ID NO: 1418959 - RNA, 20 nt, Human
ugcuugaugggauucuggac

SEQ ID NO: 1418960 - RNA, 19 nt, Human
ugcuugaugggauucugga

SEQ ID NO: 1418961 - RNA, 13 nt, Human
ugcuugauagaaa

SEQ ID NO: 1418962 - RNA, 18 nt, Human
ugcuugauagaaaugcca

SEQ ID NO: 1418963 - RNA, 21 nt, Human
aggacagaugccuccuuccuc

SEQ ID NO: 1418964 - RNA, 20 nt, Human
aggacagaugccuccuuccu

SEQ ID NO: 1418965 - RNA, 17 nt, Human
aggacagaugccuccuu

SEQ ID NO: 1418966 - RNA, 23 nt, Human
aggacagcccuucuuuccacaga

SEQ ID NO: 1418967 - RNA, 18 nt, Human
agggccagccucuagagc

SEQ ID NO: 1418968 - RNA, 20 nt, Human
agggcagucgauagagcugu

SEQ ID NO: 1418969 - RNA, 20 nt, Human
agggcagucauuggcugucu

SEQ ID NO: 1418970 - RNA, 22 nt, Human
agggcaguaccugagggucugu

SEQ ID NO: 1418971 - RNA, 18 nt, Human
agggcaguaccugagggu

SEQ ID NO: 1418972 - RNA, 15 nt, Human
agggcaguaccugag

SEQ ID NO: 1418973 - RNA, 16 nt, Human
agggcaggugcuucag

SEQ ID NO: 1418974 - RNA, 17 nt, Human
agggcagggccccaggc

SEQ ID NO: 1418975 - RNA, 12 nt, Human
agggcagggccc

SEQ ID NO: 1418976 - RNA, 22 nt, Human
agggcagggaccacacccugua

SEQ ID NO: 1418977 - RNA, 16 nt, Human
agggcagcgccaggcu

SEQ ID NO: 1418978 - RNA, 14 nt, Human
agggcagcgccagg

SEQ ID NO: 1418979 - RNA, 23 nt, Human
agggcagccagggagagcccagg

SEQ ID NO: 1418980 - RNA, 22 nt, Human
agggcagccagggagagcccag

SEQ ID NO: 1418981 - RNA, 21 nt, Human
agggcagccagggagagccca

SEQ ID NO: 1418982 - RNA, 19 nt, Human
agggcagccagggagagcc

SEQ ID NO: 1418983 - RNA, 15 nt, Human
agggcagccagggag

SEQ ID NO: 1418984 - RNA, 14 nt, Human
agggcagccaggga

SEQ ID NO: 1418985 - RNA, 13 nt, Human
agggcagccaggg

SEQ ID NO: 1418986 - RNA, 15 nt, Human
agggcagcagggcua

SEQ ID NO: 1418987 - RNA, 14 nt, Human
agggcagcagggcu

SEQ ID NO: 1418988 - RNA, 23 nt, Human
agggccggggaacuggccaagcu

SEQ ID NO: 1418989 - RNA, 22 nt, Human
agggccggggaacuggccaagc

SEQ ID NO: 1418990 - RNA, 21 nt, Human
agggccggggaacuggccaag

SEQ ID NO: 1418991 - RNA, 20 nt, Human
agggccggggaacuggccaa

SEQ ID NO: 1418992 - RNA, 19 nt, Human
agggccggggaacuggcca

SEQ ID NO: 1418993 - RNA, 18 nt, Human
agggccggggaacuggcc

SEQ ID NO: 1418994 - RNA, 16 nt, Human
agggcccagagcccag

SEQ ID NO: 1418995 - RNA, 15 nt, Human
agggcccagagccca

SEQ ID NO: 1418996 - RNA, 14 nt, Human
agggcccagagccc

SEQ ID NO: 1418997 - RNA, 13 nt, Human
agggcccagagcc

SEQ ID NO: 1418998 - RNA, 12 nt, Human
agggcccagagc

SEQ ID NO: 1418999 - RNA, 14 nt, Human
ugggccccacccuc

SEQ ID NO: 1419000 - RNA, 16 nt, Human
ugggccccacccucgg

SEQ ID NO: 1419001 - RNA, 15 nt, Human
ugggcccaggccuca

SEQ ID NO: 1419002 - RNA, 16 nt, Human
ugggcccacaccuccu

SEQ ID NO: 1419003 - RNA, 20 nt, Human
ugggcccacaccuccuuccc

SEQ ID NO: 1419004 - RNA, 15 nt, Human
ugggcccacaccucc

SEQ ID NO: 1419005 - RNA, 23 nt, Human
agggcagcagccagcccugccug

SEQ ID NO: 1419006 - RNA, 22 nt, Human
agggcagcagccagcccugccu

SEQ ID NO: 1419007 - RNA, 21 nt, Human
agggcagcagccagcccugcc

SEQ ID NO: 1419008 - RNA, 20 nt, Human
agggcagcagccagcccugc

SEQ ID NO: 1419009 - RNA, 19 nt, Human
agggcagcagccagcccug

SEQ ID NO: 1419010 - RNA, 18 nt, Human
agggcagcagccagcccu

SEQ ID NO: 1419011 - RNA, 17 nt, Human
agggcagcagccagccc

SEQ ID NO: 1419012 - RNA, 16 nt, Human
agggcagcagccagcc

SEQ ID NO: 1419013 - RNA, 15 nt, Human
agggcagcagccagc

SEQ ID NO: 1419014 - RNA, 14 nt, Human
agggcagcagccag

SEQ ID NO: 1419015 - RNA, 13 nt, Human
agggcagcagcca

SEQ ID NO: 1419016 - RNA, 12 nt, Human
agggcagcagcc

SEQ ID NO: 1419017 - RNA, 18 nt, Human
agggagucugccagggcc

SEQ ID NO: 1419018 - RNA, 15 nt, Human
agggagucugccagg

SEQ ID NO: 1419019 - RNA, 19 nt, Human
agggcagagugagacccag

SEQ ID NO: 1419020 - RNA, 13 nt, Human
agggaggggcugu

SEQ ID NO: 1419021 - RNA, 20 nt, Human
ugggccauucuccacagcaa

SEQ ID NO: 1419022 - RNA, 19 nt, Human
ugggccauucuccacagca

SEQ ID NO: 1419023 - RNA, 24 nt, Human
ugggccauguccaaagaggcugcc

SEQ ID NO: 1419024 - RNA, 19 nt, Human
ugggccagacaugccacaa

SEQ ID NO: 1419025 - RNA, 18 nt, Human
ugggccagacaugccaca

SEQ ID NO: 1419026 - RNA, 13 nt, Human
ugggccagacaug

SEQ ID NO: 1419027 - RNA, 18 nt, Human
ugggccagcuuuucaaac

SEQ ID NO: 1419028 - RNA, 21 nt, Human
ugggccagaaguaccagacua

SEQ ID NO: 1419029 - RNA, 18 nt, Human
ugggcacccccagccugg

SEQ ID NO: 1419030 - RNA, 17 nt, Human
ugggcacccccagccug

SEQ ID NO: 1419031 - RNA, 16 nt, Human
ugggcacccccagccu

SEQ ID NO: 1419032 - RNA, 15 nt, Human
ugggcacccccagcc

SEQ ID NO: 1419033 - RNA, 23 nt, Human
ugggcacccccagccugggccua

SEQ ID NO: 1419034 - RNA, 22 nt, Human
ugggcacccccagccugggccu

SEQ ID NO: 1419035 - RNA, 21 nt, Human
ugggcacccccagccugggcc

SEQ ID NO: 1419036 - RNA, 20 nt, Human
ugggcacccccagccugggc

SEQ ID NO: 1419037 - RNA, 19 nt, Human
ugggcacccccagccuggg

SEQ ID NO: 1419038 - RNA, 20 nt, Human
ugggccagaaguaccagacu

SEQ ID NO: 1419039 - RNA, 16 nt, Human
aggccuguuuggccuc

SEQ ID NO: 1419040 - RNA, 18 nt, Human
aggccuguuuggccucuc

SEQ ID NO: 1419041 - RNA, 23 nt, Human
ugggauucaggaaaaggccuggg

SEQ ID NO: 1419042 - RNA, 20 nt, Human
ugggagguguuggcugcacg

SEQ ID NO: 1419043 - RNA, 22 nt, Human
ugggauucaggaaaaggccugg

SEQ ID NO: 1419044 - RNA, 14 nt, Human
ugggaguacaaaag

SEQ ID NO: 1419045 - RNA, 19 nt, Human
ugggaggugagaccaccuc

SEQ ID NO: 1419046 - RNA, 19 nt, Human
ugggauugagucugugcca

SEQ ID NO: 1419047 - RNA, 16 nt, Human
ugggauugagucugug

SEQ ID NO: 1419048 - RNA, 21 nt, Human
ugggauucuggacaggaugug

SEQ ID NO: 1419049 - RNA, 14 nt, Human
ugggauuugcugug

SEQ ID NO: 1419050 - RNA, 16 nt, Human
ugggauuuggucaaca

SEQ ID NO: 1419051 - RNA, 16 nt, Human
uggggcugguucugua

SEQ ID NO: 1419052 - RNA, 18 nt, Human
ugggggaacucagaucca

SEQ ID NO: 1419053 - RNA, 21 nt, Human
ugggggaaagcaaagcacaga

SEQ ID NO: 1419054 - RNA, 22 nt, Human
ugggggaaagcaaagcacagag

SEQ ID NO: 1419055 - RNA, 20 nt, Human
ugggggaaagcaaagcacag

SEQ ID NO: 1419056 - RNA, 17 nt, Human
ugggggaaagcaaagca

SEQ ID NO: 1419057 - RNA, 15 nt, Human
ugggggaaagcaaag

SEQ ID NO: 1419058 - RNA, 16 nt, Human
uggggcuugggggcuc

SEQ ID NO: 1419059 - RNA, 20 nt, Human
ugggggaacucagauccagg

SEQ ID NO: 1419060 - RNA, 12 nt, Human
uggggguuuuuu

SEQ ID NO: 1419061 - RNA, 18 nt, Human
uggggguuguaaauuggc

SEQ ID NO: 1419062 - RNA, 20 nt, Human
uggggaguuaagaccuggca

SEQ ID NO: 1419063 - RNA, 19 nt, Human
uggggaguuaagaccuggc

SEQ ID NO: 1419064 - RNA, 18 nt, Human
uggggaguuaagaccugg

SEQ ID NO: 1419065 - RNA, 17 nt, Human
uggggaguuaagaccug

SEQ ID NO: 1419066 - RNA, 16 nt, Human
uggggaguuaagaccu

SEQ ID NO: 1419067 - RNA, 19 nt, Human
uggggaguuuagggugggg

SEQ ID NO: 1419068 - RNA, 18 nt, Human
uggggaguuuaggguggg

SEQ ID NO: 1419069 - RNA, 19 nt, Human
uggggacuuggccucucuc

SEQ ID NO: 1419070 - RNA, 14 nt, Human
uggggacuuggccu

SEQ ID NO: 1419071 - RNA, 18 nt, Human
uggggaccugguacccuc

SEQ ID NO: 1419072 - RNA, 17 nt, Human
uggggaguggggguggg

SEQ ID NO: 1419073 - RNA, 19 nt, Human
uggggccgccgccucuuuc

SEQ ID NO: 1419074 - RNA, 24 nt, Human
uggggcucuaacgccugagcccag

SEQ ID NO: 1419075 - RNA, 23 nt, Human
uggggcucuaacgccugagccca

SEQ ID NO: 1419076 - RNA, 22 nt, Human
uggggcucuaacgccugagccc

SEQ ID NO: 1419077 - RNA, 20 nt, Human
uggggcuagggggagccccu

SEQ ID NO: 1419078 - RNA, 21 nt, Human
uggggcucuaacgccugagcc

SEQ ID NO: 1419079 - RNA, 20 nt, Human
agggccucaaaggcccgcuc

SEQ ID NO: 1419080 - RNA, 11 nt, Human
ugggcugaggg

SEQ ID NO: 1419081 - RNA, 15 nt, Human
uggggaccagcagcc

SEQ ID NO: 1419082 - RNA, 22 nt, Human
uggggaccagcagccccacacc

SEQ ID NO: 1419083 - RNA, 19 nt, Human
ugggcuggcaguccuggaa

SEQ ID NO: 1419084 - RNA, 18 nt, Human
ugggcuggaugagcuccc

SEQ ID NO: 1419085 - RNA, 16 nt, Human
ugggcuggaugagcuc

SEQ ID NO: 1419086 - RNA, 15 nt, Human
ugggcuggaugagcu

SEQ ID NO: 1419087 - RNA, 18 nt, Human
ugggcuggaaucaggaau

SEQ ID NO: 1419088 - RNA, 15 nt, Human
uggggaagagagccu

SEQ ID NO: 1419089 - RNA, 18 nt, Human
uggggaagacaguggccc

SEQ ID NO: 1419090 - RNA, 24 nt, Human
uggggaagacccauuccuucccag

SEQ ID NO: 1419091 - RNA, 20 nt, Human
uggggaagguuaucagugcu

SEQ ID NO: 1419092 - RNA, 16 nt, Human
uggggaagggccugcc

SEQ ID NO: 1419093 - RNA, 17 nt, Human
uggggaagagagccugc

SEQ ID NO: 1419094 - RNA, 22 nt, Human
uggggaagagagccugcaggau

SEQ ID NO: 1419095 - RNA, 15 nt, Human
uggggaaugaagaua

SEQ ID NO: 1419096 - RNA, 14 nt, Human
uggggaaugaagau

SEQ ID NO: 1419097 - RNA, 19 nt, Human
agguagaauguaaagcuug

SEQ ID NO: 1419098 - RNA, 15 nt, Human
agguaggguuuaauc

SEQ ID NO: 1419099 - RNA, 22 nt, Human
agguagaauuaucuaauuuaua

SEQ ID NO: 1419100 - RNA, 14 nt, Human
agguagaauguaaa

SEQ ID NO: 1419101 - RNA, 21 nt, Human
agguagaauguaaagcuuguc

SEQ ID NO: 1419102 - RNA, 23 nt, Human
agguauaauucacauuguauuca

SEQ ID NO: 1419103 - RNA, 23 nt, Human
agguacuuucauauuuuaaacag

SEQ ID NO: 1419104 - RNA, 23 nt, Human
agguacuucaaauccuugaagau

SEQ ID NO: 1419105 - RNA, 23 nt, Human
agguccagcucuggaggggaggg

SEQ ID NO: 1419106 - RNA, 17 nt, Human
aggucauuuuuuuuaag

SEQ ID NO: 1419107 - RNA, 20 nt, Human
aggucauuuuuuuuaagaaa

SEQ ID NO: 1419108 - RNA, 15 nt, Human
aggucacccuuugcu

SEQ ID NO: 1419109 - RNA, 13 nt, Human
agguauaccucac

SEQ ID NO: 1419110 - RNA, 14 nt, Human
agguauuacacucu

SEQ ID NO: 1419111 - RNA, 18 nt, Human
agguauucguuaucuaau

SEQ ID NO: 1419112 - RNA, 15 nt, Human
aggucacauaaaacu

SEQ ID NO: 1419113 - RNA, 14 nt, Human
agguauuuaucuuu

SEQ ID NO: 1419114 - RNA, 20 nt, Human
agguauucguuaucuaauag

SEQ ID NO: 1419115 - RNA, 14 nt, Human
uggucucacccugg

SEQ ID NO: 1419116 - RNA, 23 nt, Human
uggucucaaacuccugaccucag

SEQ ID NO: 1419117 - RNA, 18 nt, Human
uggucucaaacuccugac

SEQ ID NO: 1419118 - RNA, 23 nt, Human
uggucucacccuggaggcaccug

SEQ ID NO: 1419119 - RNA, 17 nt, Human
uggucucacccuggagg

SEQ ID NO: 1419120 - RNA, 15 nt, Human
uggucucacccugga

SEQ ID NO: 1419121 - RNA, 22 nt, Human
uggucagcccuaggguggagag

SEQ ID NO: 1419122 - RNA, 19 nt, Human
uggucagcccuagggugga

SEQ ID NO: 1419123 - RNA, 15 nt, Human
uggucagcccuaggg

SEQ ID NO: 1419124 - RNA, 18 nt, Human
ugguaggaauagcauguc

SEQ ID NO: 1419125 - RNA, 16 nt, Human
uggucuuguggaauug

SEQ ID NO: 1419126 - RNA, 20 nt, Human
agggugguucaacaaagaaa

SEQ ID NO: 1419127 - RNA, 12 nt, Human
agggugugugcu

SEQ ID NO: 1419128 - RNA, 17 nt, Human
aggguuaugauuaagua

SEQ ID NO: 1419129 - RNA, 22 nt, Human
agggguuccuccccuccagcuc

SEQ ID NO: 1419130 - RNA, 21 nt, Human
agggguuccuccccuccagcu

SEQ ID NO: 1419131 - RNA, 17 nt, Human
agggguuccuccccucc

SEQ ID NO: 1419132 - RNA, 15 nt, Human
agggguuccuccccu

SEQ ID NO: 1419133 - RNA, 14 nt, Human
agggguuccucccc

SEQ ID NO: 1419134 - RNA, 15 nt, Human
agggguuagagcagg

SEQ ID NO: 1419135 - RNA, 15 nt, Human
agggguguggcuccu

SEQ ID NO: 1419136 - RNA, 24 nt, Human
aggggugucuugggcagagcuggc

SEQ ID NO: 1419137 - RNA, 22 nt, Human
aggggugucuugggcagagcug

SEQ ID NO: 1419138 - RNA, 14 nt, Human
aggggugucuuggg

SEQ ID NO: 1419139 - RNA, 14 nt, Human
aggggugggcuggu

SEQ ID NO: 1419140 - RNA, 13 nt, Human
aggggugggcugg

SEQ ID NO: 1419141 - RNA, 23 nt, Human
agggggugauuagagggaggaga

SEQ ID NO: 1419142 - RNA, 17 nt, Human
agggggucuggcuggug

SEQ ID NO: 1419143 - RNA, 16 nt, Human
agggggucuggcuggu

SEQ ID NO: 1419144 - RNA, 15 nt, Human
agggggucuggcugg

SEQ ID NO: 1419145 - RNA, 11 nt, Human
agggggucugg

SEQ ID NO: 1419146 - RNA, 20 nt, Human
agggggauccgacugcuuug

SEQ ID NO: 1419147 - RNA, 19 nt, Human
agggggauccgacugcuuu

SEQ ID NO: 1419148 - RNA, 23 nt, Human
agggggucguggagagcuaggag

SEQ ID NO: 1419149 - RNA, 14 nt, Human
aggggcucccuccg

SEQ ID NO: 1419150 - RNA, 19 nt, Human
agggggucguggagagcua

SEQ ID NO: 1419151 - RNA, 21 nt, Human
aggggagaccucagaaguaaa

SEQ ID NO: 1419152 - RNA, 19 nt, Human
aggggagaccucagaagua

SEQ ID NO: 1419153 - RNA, 20 nt, Human
ugggguauggauucuaaaau

SEQ ID NO: 1419154 - RNA, 19 nt, Human
ugggguauggauucuaaaa

SEQ ID NO: 1419155 - RNA, 22 nt, Human
agggggagcugggccuggucuc

SEQ ID NO: 1419156 - RNA, 22 nt, Human
agggggagccccuucugcucag

SEQ ID NO: 1419157 - RNA, 21 nt, Human
agggggagccccuucugcuca

SEQ ID NO: 1419158 - RNA, 16 nt, Human
agggggagagggcugc

SEQ ID NO: 1419159 - RNA, 15 nt, Human
agggggagagggcug

SEQ ID NO: 1419160 - RNA, 16 nt, Human
agggggaauggcagca

SEQ ID NO: 1419161 - RNA, 22 nt, Human
agggggaaggugggguccugga

SEQ ID NO: 1419162 - RNA, 15 nt, Human
aggggcucccuccgc

SEQ ID NO: 1419163 - RNA, 13 nt, Human
aggggcucccucc

SEQ ID NO: 1419164 - RNA, 17 nt, Human
aggggcuaccaggaaag

SEQ ID NO: 1419165 - RNA, 14 nt, Human
aggggcuaccagga

SEQ ID NO: 1419166 - RNA, 15 nt, Human
aggggcuaccaggaa

SEQ ID NO: 1419167 - RNA, 18 nt, Human
ugggucucaccggcucuc

SEQ ID NO: 1419168 - RNA, 21 nt, Human
ugggucugggagucacacagu

SEQ ID NO: 1419169 - RNA, 23 nt, Human
ugggucucaccggcucucaccug

SEQ ID NO: 1419170 - RNA, 17 nt, Human
ugggugcuacuggggaa

SEQ ID NO: 1419171 - RNA, 12 nt, Human
agggugggaagg

SEQ ID NO: 1419172 - RNA, 11 nt, Human
aggguggcagc

SEQ ID NO: 1419173 - RNA, 13 nt, Human
aggguggcagcaa

SEQ ID NO: 1419174 - RNA, 15 nt, Human
aggguggcagcaaca

SEQ ID NO: 1419175 - RNA, 16 nt, Human
aggguggcagcaacaa

SEQ ID NO: 1419176 - RNA, 22 nt, Human
ugguaggaccaagcaucuuggg

SEQ ID NO: 1419177 - RNA, 16 nt, Human
ugguaggaccaagcau

SEQ ID NO: 1419178 - RNA, 17 nt, Human
ugguaggaauagcaugu

SEQ ID NO: 1419179 - RNA, 21 nt, Human
ugguacuguacagcuggcucu

SEQ ID NO: 1419180 - RNA, 19 nt, Human
ugguacuguacagcuggcu

SEQ ID NO: 1419181 - RNA, 17 nt, Human
ugguacuguacagcugg

SEQ ID NO: 1419182 - RNA, 21 nt, Human
ugguacugacuuugcuugcuu

SEQ ID NO: 1419183 - RNA, 17 nt, Human
ugguacugacuuugcuu

SEQ ID NO: 1419184 - RNA, 22 nt, Human
ugguacucccucucaggaucca

SEQ ID NO: 1419185 - RNA, 17 nt, Human
ugguacucccucucagg

SEQ ID NO: 1419186 - RNA, 14 nt, Human
uggguggcucacuc

SEQ ID NO: 1419187 - RNA, 23 nt, Human
uggguggcuacucugugccagag

SEQ ID NO: 1419188 - RNA, 20 nt, Human
uggguggcuacucugugcca

SEQ ID NO: 1419189 - RNA, 19 nt, Human
uggguggcuacucugugcc

SEQ ID NO: 1419190 - RNA, 14 nt, Human
uggguggcuacucu

SEQ ID NO: 1419191 - RNA, 14 nt, Human
ugguaauauugacu

SEQ ID NO: 1419192 - RNA, 17 nt, Human
ugguaagcuauguccca

SEQ ID NO: 1419193 - RNA, 20 nt, Human
ugguaagcaacauggcuuug

SEQ ID NO: 1419194 - RNA, 19 nt, Human
ugguaagcaacauggcuuu

SEQ ID NO: 1419195 - RNA, 18 nt, Human
ugguaagcaacauggcuu

SEQ ID NO: 1419196 - RNA, 20 nt, Human
ugguaaggggaauugaggac

SEQ ID NO: 1419197 - RNA, 15 nt, Human
uguccgacucuucug

SEQ ID NO: 1419198 - RNA, 23 nt, Human
uguccaaaaccgccagcucuguu

SEQ ID NO: 1419199 - RNA, 22 nt, Human
uguccaaaaccgccagcucugu

SEQ ID NO: 1419200 - RNA, 21 nt, Human
uguccaaaaccgccagcucug

SEQ ID NO: 1419201 - RNA, 20 nt, Human
uguccaaaaccgccagcucu

SEQ ID NO: 1419202 - RNA, 19 nt, Human
uguccaaaaccgccagcuc

SEQ ID NO: 1419203 - RNA, 18 nt, Human
uguccaaaaccgccagcu

SEQ ID NO: 1419204 - RNA, 15 nt, Human
uguccaaaacugccu

SEQ ID NO: 1419205 - RNA, 16 nt, Human
uguccaaaaccgccag

SEQ ID NO: 1419206 - RNA, 15 nt, Human
ugucauuuuuuuucu

SEQ ID NO: 1419207 - RNA, 13 nt, Human
ugucauuuuggua

SEQ ID NO: 1419208 - RNA, 23 nt, Human
uguccgcugggugguacccucug

SEQ ID NO: 1419209 - RNA, 22 nt, Human
uguccgcugggugguacccucu

SEQ ID NO: 1419210 - RNA, 20 nt, Human
uguccgcugggugguacccu

SEQ ID NO: 1419211 - RNA, 15 nt, Human
uguccgcuggguggu

SEQ ID NO: 1419212 - RNA, 21 nt, Human
uguccuuuuuccucuccacac

SEQ ID NO: 1419213 - RNA, 18 nt, Human
uguccuuuuuccucucca

SEQ ID NO: 1419214 - RNA, 17 nt, Human
uguccuuuuuccucucc

SEQ ID NO: 1419215 - RNA, 16 nt, Human
uguccuuuuuccucuc

SEQ ID NO: 1419216 - RNA, 15 nt, Human
uguccuuuuuccucu

SEQ ID NO: 1419217 - RNA, 15 nt, Human
uguccuuuugcaaag

SEQ ID NO: 1419218 - RNA, 22 nt, Human
uguccuuuucauaggucugaaa

SEQ ID NO: 1419219 - RNA, 13 nt, Human
uguccuuuucaua

SEQ ID NO: 1419220 - RNA, 19 nt, Human
uguccuuucuagagcacug

SEQ ID NO: 1419221 - RNA, 18 nt, Human
uguccuuucuagagcacu

SEQ ID NO: 1419222 - RNA, 14 nt, Human
uguccuuucuagag

SEQ ID NO: 1419223 - RNA, 13 nt, Human
uguccuuucuaga

SEQ ID NO: 1419224 - RNA, 23 nt, Human
uguccuuucccuucaguacccuc

SEQ ID NO: 1419225 - RNA, 14 nt, Human
ugucgauuagacug

SEQ ID NO: 1419226 - RNA, 15 nt, Human
uguccuacagaaaaa

SEQ ID NO: 1419227 - RNA, 14 nt, Human
uguccuacagaaaa

SEQ ID NO: 1419228 - RNA, 13 nt, Human
uguccuacagaaa

SEQ ID NO: 1419229 - RNA, 12 nt, Human
uguccuacagaa

SEQ ID NO: 1419230 - RNA, 22 nt, Human
uguccuaauaauaucccacugg

SEQ ID NO: 1419231 - RNA, 14 nt, Human
uguccuuucccuuc

SEQ ID NO: 1419232 - RNA, 13 nt, Human
uguccuuucccuu

SEQ ID NO: 1419233 - RNA, 18 nt, Human
uguccuacagaaaaaccu

SEQ ID NO: 1419234 - RNA, 16 nt, Human
uguccuacagaaaaac

SEQ ID NO: 1419235 - RNA, 17 nt, Human
ugucguuaaaaacagau

SEQ ID NO: 1419236 - RNA, 16 nt, Human
ugucguaaagauuugg

SEQ ID NO: 1419237 - RNA, 23 nt, Human
ugucgauuagacuggacagcuug

SEQ ID NO: 1419238 - RNA, 20 nt, Human
ugucgauuagacuggacagc

SEQ ID NO: 1419239 - RNA, 18 nt, Human
ugucgauuagacuggaca

SEQ ID NO: 1419240 - RNA, 20 nt, Human
ugucguggacacacacagac

SEQ ID NO: 1419241 - RNA, 23 nt, Human
agucagagccaugucuucucccu

SEQ ID NO: 1419242 - RNA, 23 nt, Human
agucagacuggauaguccgucuc

SEQ ID NO: 1419243 - RNA, 16 nt, Human
agucaggaaagagaac

SEQ ID NO: 1419244 - RNA, 22 nt, Human
agucuagauucaaagguucuag

SEQ ID NO: 1419245 - RNA, 21 nt, Human
agucuagauucaaagguucua

SEQ ID NO: 1419246 - RNA, 20 nt, Human
agucuagauucaaagguucu

SEQ ID NO: 1419247 - RNA, 18 nt, Human
agucuagauucaaagguu

SEQ ID NO: 1419248 - RNA, 15 nt, Human
agucuagauucaaag

SEQ ID NO: 1419249 - RNA, 14 nt, Human
agucuagauucaaa

SEQ ID NO: 1419250 - RNA, 23 nt, Human
agucuagauguuuauucuucuag

SEQ ID NO: 1419251 - RNA, 22 nt, Human
agucuaaagauggaguuucuaa

SEQ ID NO: 1419252 - RNA, 21 nt, Human
agucuaaagauggaguuucua

SEQ ID NO: 1419253 - RNA, 20 nt, Human
agucuaaagauggaguuucu

SEQ ID NO: 1419254 - RNA, 21 nt, Human
agucguggggugugcugggag

SEQ ID NO: 1419255 - RNA, 20 nt, Human
agucguggggugugcuggga

SEQ ID NO: 1419256 - RNA, 19 nt, Human
agucguggggugugcuggg

SEQ ID NO: 1419257 - RNA, 18 nt, Human
agucguggggugugcugg

SEQ ID NO: 1419258 - RNA, 16 nt, Human
agucuagauucucugg

SEQ ID NO: 1419259 - RNA, 20 nt, Human
agucuagauucucuggcugu

SEQ ID NO: 1419260 - RNA, 14 nt, Human
agucuagauucucu

SEQ ID NO: 1419261 - RNA, 13 nt, Human
agucuagauucuc

SEQ ID NO: 1419262 - RNA, 17 nt, Human
agucguggggugugcug

SEQ ID NO: 1419263 - RNA, 17 nt, Human
agucgugaccugcuagg

SEQ ID NO: 1419264 - RNA, 15 nt, Human
agucgugccuguguc

SEQ ID NO: 1419265 - RNA, 14 nt, Human
agucgugccugugu

SEQ ID NO: 1419266 - RNA, 13 nt, Human
agucgugccugug

SEQ ID NO: 1419267 - RNA, 12 nt, Human
agucgugccugu

SEQ ID NO: 1419268 - RNA, 21 nt, Human
agucgugagcucuugugagga

SEQ ID NO: 1419269 - RNA, 21 nt, Human
agucgugaccugcuaggccag

SEQ ID NO: 1419270 - RNA, 18 nt, Human
agucgugagcucuuguga

SEQ ID NO: 1419271 - RNA, 13 nt, Human
aguccgugggacg

SEQ ID NO: 1419272 - RNA, 23 nt, Human
aguccgugggacgggaugguucu

SEQ ID NO: 1419273 - RNA, 14 nt, Human
aguccgucaaaaca

SEQ ID NO: 1419274 - RNA, 15 nt, Human
aguccgucaaaacag

SEQ ID NO: 1419275 - RNA, 21 nt, Human
aguccggccccaguacacagg

SEQ ID NO: 1419276 - RNA, 23 nt, Human
agucccugccuggaccagccucu

SEQ ID NO: 1419277 - RNA, 22 nt, Human
agucccugccuggaccagccuc

SEQ ID NO: 1419278 - RNA, 21 nt, Human
agucccugccuggaccagccu

SEQ ID NO: 1419279 - RNA, 15 nt, Human
agucccugccuggac

SEQ ID NO: 1419280 - RNA, 21 nt, Human
agucccugcacagugacuucu

SEQ ID NO: 1419281 - RNA, 19 nt, Human
agucccugcacagugacuu

SEQ ID NO: 1419282 - RNA, 14 nt, Human
agucccugccugga

SEQ ID NO: 1419283 - RNA, 22 nt, Human
aguccaggaugcuaacaucuaa

SEQ ID NO: 1419284 - RNA, 17 nt, Human
agucaggcccaggcacu

SEQ ID NO: 1419285 - RNA, 12 nt, Human
agucaggaaagg

SEQ ID NO: 1419286 - RNA, 18 nt, Human
aguccaggcugccguggg

SEQ ID NO: 1419287 - RNA, 17 nt, Human
aguccaggcugccgugg

SEQ ID NO: 1419288 - RNA, 14 nt, Human
aguccaggcugccg

SEQ ID NO: 1419289 - RNA, 22 nt, Human
aguccaggcuuuuuuaucaugu

SEQ ID NO: 1419290 - RNA, 14 nt, Human
aguaguccugugaa

SEQ ID NO: 1419291 - RNA, 13 nt, Human
aguaguccuguga

SEQ ID NO: 1419292 - RNA, 12 nt, Human
aguaguccugug

SEQ ID NO: 1419293 - RNA, 21 nt, Human
aguagucccugcacagugacu

SEQ ID NO: 1419294 - RNA, 22 nt, Human
aguaggcauuuuuaccaucacu

SEQ ID NO: 1419295 - RNA, 17 nt, Human
aguaggcauuuuuacca

SEQ ID NO: 1419296 - RNA, 13 nt, Human
aguaggagcccag

SEQ ID NO: 1419297 - RNA, 12 nt, Human
aguaguucacau

SEQ ID NO: 1419298 - RNA, 15 nt, Human
ugucaaucuguccgu

SEQ ID NO: 1419299 - RNA, 20 nt, Human
ugucaaucagccuaguugau

SEQ ID NO: 1419300 - RNA, 21 nt, Human
ugucaagaauagcauuguaaa

SEQ ID NO: 1419301 - RNA, 16 nt, Human
uguauuuuuuuacuaa

SEQ ID NO: 1419302 - RNA, 14 nt, Human
uguauuuuuuuacu

SEQ ID NO: 1419303 - RNA, 21 nt, Human
uguauuauuuacauuuaauag

SEQ ID NO: 1419304 - RNA, 18 nt, Human
uguauuauuuacauuuaa

SEQ ID NO: 1419305 - RNA, 18 nt, Human
uguaguaauugacaugug

SEQ ID NO: 1419306 - RNA, 16 nt, Human
uguaguaauugacaug

SEQ ID NO: 1419307 - RNA, 15 nt, Human
uguaguaauugacau

SEQ ID NO: 1419308 - RNA, 14 nt, Human
uguaguaauugaca

SEQ ID NO: 1419309 - RNA, 19 nt, Human
uguaguaaucugcauuauu

SEQ ID NO: 1419310 - RNA, 20 nt, Human
uguaguaacacuaauauauu

SEQ ID NO: 1419311 - RNA, 17 nt, Human
uguaguaacacuaauau

SEQ ID NO: 1419312 - RNA, 15 nt, Human
uguaguaacacuaau

SEQ ID NO: 1419313 - RNA, 14 nt, Human
uguaguaacacuaa

SEQ ID NO: 1419314 - RNA, 21 nt, Human
uguaguaaauaaugcuuugaa

SEQ ID NO: 1419315 - RNA, 18 nt, Human
uguaguaaauaaugcuuu

SEQ ID NO: 1419316 - RNA, 17 nt, Human
uguaguaaauaaugcuu

SEQ ID NO: 1419317 - RNA, 16 nt, Human
uguaguaaauaaugcu

SEQ ID NO: 1419318 - RNA, 20 nt, Human
uguagguugcacacuuuggu

SEQ ID NO: 1419319 - RNA, 18 nt, Human
uguagguugcacacuuug

SEQ ID NO: 1419320 - RNA, 15 nt, Human
uguagguugcacacu

SEQ ID NO: 1419321 - RNA, 18 nt, Human
uguauucagacagaugag

SEQ ID NO: 1419322 - RNA, 14 nt, Human
uguauucagacaga

SEQ ID NO: 1419323 - RNA, 21 nt, Human
uguauuccaagacaugucugu

SEQ ID NO: 1419324 - RNA, 20 nt, Human
uguauuccaagacaugucug

SEQ ID NO: 1419325 - RNA, 15 nt, Human
uguauuccaagacau

SEQ ID NO: 1419326 - RNA, 13 nt, Human
uguauuccaagac

SEQ ID NO: 1419327 - RNA, 17 nt, Human
uguauuuuuaguagaga

SEQ ID NO: 1419328 - RNA, 19 nt, Human
ugucagggaguguucccua

SEQ ID NO: 1419329 - RNA, 20 nt, Human
ugucaguaccuucaaacuag

SEQ ID NO: 1419330 - RNA, 23 nt, Human
ugucaggauugcgagagaugugu

SEQ ID NO: 1419331 - RNA, 14 nt, Human
ugucaggcacuggg

SEQ ID NO: 1419332 - RNA, 22 nt, Human
ugucaggauugcgagagaugug

SEQ ID NO: 1419333 - RNA, 21 nt, Human
ugucaggauugcgagagaugu

SEQ ID NO: 1419334 - RNA, 19 nt, Human
ugucaggauugcgagagau

SEQ ID NO: 1419335 - RNA, 13 nt, Human
ugucaggauugcg

SEQ ID NO: 1419336 - RNA, 16 nt, Human
ugucaggagugugugu

SEQ ID NO: 1419337 - RNA, 23 nt, Human
ugucagggaguguucccuaucca

SEQ ID NO: 1419338 - RNA, 23 nt, Human
ugucagcugcaagguacucuggu

SEQ ID NO: 1419339 - RNA, 22 nt, Human
ugucagcugcaagguacucugg

SEQ ID NO: 1419340 - RNA, 13 nt, Human
agucacugagacc

SEQ ID NO: 1419341 - RNA, 23 nt, Human
agucacugagaccaaggcuuucu

SEQ ID NO: 1419342 - RNA, 21 nt, Human
aguauuugggaagugaagacu

SEQ ID NO: 1419343 - RNA, 20 nt, Human
agucacauuccugaacagga

SEQ ID NO: 1419344 - RNA, 19 nt, Human
agucacauuccugaacagg

SEQ ID NO: 1419345 - RNA, 17 nt, Human
aguauuugggaagugaa

SEQ ID NO: 1419346 - RNA, 16 nt, Human
aguauuucuaugaaau

SEQ ID NO: 1419347 - RNA, 17 nt, Human
aguauaaagaauugugg

SEQ ID NO: 1419348 - RNA, 23 nt, Human
aguaugugggcagauuuucagca

SEQ ID NO: 1419349 - RNA, 13 nt, Human
aguauguauuauu

SEQ ID NO: 1419350 - RNA, 15 nt, Human
aguauuucuaugaaa

SEQ ID NO: 1419351 - RNA, 13 nt, Human
aguauuucuauga

SEQ ID NO: 1419352 - RNA, 20 nt, Human
uguaggagagguugucugug

SEQ ID NO: 1419353 - RNA, 14 nt, Human
uguagguugcacac

SEQ ID NO: 1419354 - RNA, 22 nt, Human
aguagaugcauuuggguccagg

SEQ ID NO: 1419355 - RNA, 23 nt, Human
aguagaugcauuuggguccagga

SEQ ID NO: 1419356 - RNA, 21 nt, Human
aguagaugcauuuggguccag

SEQ ID NO: 1419357 - RNA, 19 nt, Human
aguagauaggccaugggca

SEQ ID NO: 1419358 - RNA, 12 nt, Human
aguagaaaucau

SEQ ID NO: 1419359 - RNA, 18 nt, Human
aguagaaaggccuuuaaa

SEQ ID NO: 1419360 - RNA, 13 nt, Human
aguagagacaggg

SEQ ID NO: 1419361 - RNA, 19 nt, Human
aguagaagucucuuccagu

SEQ ID NO: 1419362 - RNA, 22 nt, Human
aguagagacgagguuucacugu

SEQ ID NO: 1419363 - RNA, 17 nt, Human
aguacacucugcuguuu

SEQ ID NO: 1419364 - RNA, 15 nt, Human
aguacacucugcugu

SEQ ID NO: 1419365 - RNA, 14 nt, Human
aguacacucugcug

SEQ ID NO: 1419366 - RNA, 20 nt, Human
aguacacagcaccagaaugu

SEQ ID NO: 1419367 - RNA, 16 nt, Human
aguacaccccaccucu

SEQ ID NO: 1419368 - RNA, 14 nt, Human
aguacacuguuuca

SEQ ID NO: 1419369 - RNA, 16 nt, Human
aguacacuguuucaaa

SEQ ID NO: 1419370 - RNA, 20 nt, Human
aguacacuguuucaaacuuu

SEQ ID NO: 1419371 - RNA, 16 nt, Human
aguacuuugugcauuc

SEQ ID NO: 1419372 - RNA, 15 nt, Human
aguacuuugugcauu

SEQ ID NO: 1419373 - RNA, 13 nt, Human
aguacuuugugca

SEQ ID NO: 1419374 - RNA, 19 nt, Human
aguacuuuuggcauuuuac

SEQ ID NO: 1419375 - RNA, 14 nt, Human
aguagaaaggccuu

SEQ ID NO: 1419376 - RNA, 15 nt, Human
aguagaaaggccuuu

SEQ ID NO: 1419377 - RNA, 16 nt, Human
aguagaaaggccuuua

SEQ ID NO: 1419378 - RNA, 17 nt, Human
aguagaaaggccuuuaa

SEQ ID NO: 1419379 - RNA, 22 nt, Human
aguaaucaaucuacucaaagca

SEQ ID NO: 1419380 - RNA, 15 nt, Human
aguaauccaagcaaa

SEQ ID NO: 1419381 - RNA, 21 nt, Human
aguaauccaagcaaaugugaa

SEQ ID NO: 1419382 - RNA, 21 nt, Human
aguaauuuguuuaaaaaguaa

SEQ ID NO: 1419383 - RNA, 15 nt, Human
aguaauuugaggaca

SEQ ID NO: 1419384 - RNA, 16 nt, Human
aguacacaauaagcaa

SEQ ID NO: 1419385 - RNA, 17 nt, Human
aguacacaauaagcaaa

SEQ ID NO: 1419386 - RNA, 18 nt, Human
aguacacaauaagcaaaa

SEQ ID NO: 1419387 - RNA, 21 nt, Human
aguacacaauaagcaaaaaca

SEQ ID NO: 1419388 - RNA, 22 nt, Human
aguacacaauaagcaaaaacaa

SEQ ID NO: 1419389 - RNA, 19 nt, Human
aguacaccacaagggucac

SEQ ID NO: 1419390 - RNA, 22 nt, Human
agguuuuccucuucuauuuugu

SEQ ID NO: 1419391 - RNA, 10 nt, Human
agguuuucag

SEQ ID NO: 1419392 - RNA, 22 nt, Human
aguaauaugccugcuauuugaa

SEQ ID NO: 1419393 - RNA, 20 nt, Human
aguaauaugcacacauuuuu

SEQ ID NO: 1419394 - RNA, 18 nt, Human
aguaauaugcacacauuu

SEQ ID NO: 1419395 - RNA, 19 nt, Human
aguaauaugcacacauuuu

SEQ ID NO: 1419396 - RNA, 22 nt, Human
aguaagggcacugacggacuca

SEQ ID NO: 1419397 - RNA, 23 nt, Human
aguaaggaauuuuauuuuuuucu

SEQ ID NO: 1419398 - RNA, 23 nt, Human
uguaccaguuaauuuuuccaacu

SEQ ID NO: 1419399 - RNA, 22 nt, Human
uguaccaguuaauuuuuccaac

SEQ ID NO: 1419400 - RNA, 21 nt, Human
uguaccaguuaauuuuuccaa

SEQ ID NO: 1419401 - RNA, 15 nt, Human
uguaccaguuaauuu

SEQ ID NO: 1419402 - RNA, 14 nt, Human
uguaccaguuaauu

SEQ ID NO: 1419403 - RNA, 12 nt, Human
uguaccaguuaa

SEQ ID NO: 1419404 - RNA, 11 nt, Human
uguaccaguua

SEQ ID NO: 1419405 - RNA, 15 nt, Human
uguaccaagaaucuu

SEQ ID NO: 1419406 - RNA, 19 nt, Human
uguaauuucaggaggaaua

SEQ ID NO: 1419407 - RNA, 23 nt, Human
uguaauuucaggaggaauacuga

SEQ ID NO: 1419408 - RNA, 14 nt, Human
uguaauuugugaua

SEQ ID NO: 1419409 - RNA, 17 nt, Human
uguaccauguacaugaa

SEQ ID NO: 1419410 - RNA, 12 nt, Human
uguaccauguac

SEQ ID NO: 1419411 - RNA, 23 nt, Human
aggugcacugggaggcuccccuu

SEQ ID NO: 1419412 - RNA, 22 nt, Human
aggugcacugggaggcuccccu

SEQ ID NO: 1419413 - RNA, 15 nt, Human
aggugcacugggagg

SEQ ID NO: 1419414 - RNA, 22 nt, Human
aggugcaauuucaagguucuaa

SEQ ID NO: 1419415 - RNA, 21 nt, Human
aggugcaauuucaagguucua

SEQ ID NO: 1419416 - RNA, 20 nt, Human
aggugcaauuucaagguucu

SEQ ID NO: 1419417 - RNA, 19 nt, Human
aggugcaauuucaagguuc

SEQ ID NO: 1419418 - RNA, 18 nt, Human
aggugcaauuucaagguu

SEQ ID NO: 1419419 - RNA, 16 nt, Human
aggugcaauuucaagg

SEQ ID NO: 1419420 - RNA, 17 nt, Human
agguggccaaguuccuc

SEQ ID NO: 1419421 - RNA, 16 nt, Human
agguggccaaguuccu

SEQ ID NO: 1419422 - RNA, 20 nt, Human
aggugcauauuuauaaaaau

SEQ ID NO: 1419423 - RNA, 19 nt, Human
agguggccaaguuccucua

SEQ ID NO: 1419424 - RNA, 14 nt, Human
agguggcccuacug

SEQ ID NO: 1419425 - RNA, 19 nt, Human
aggugggcacuggauuagu

SEQ ID NO: 1419426 - RNA, 21 nt, Human
agguggugguagagaagcaag

SEQ ID NO: 1419427 - RNA, 15 nt, Human
aggugcaauuucaag

SEQ ID NO: 1419428 - RNA, 21 nt, Human
aggugcaacagacuugaaugc

SEQ ID NO: 1419429 - RNA, 15 nt, Human
uguaaaucuacacac

SEQ ID NO: 1419430 - RNA, 10 nt, Human
aggucccuaa

SEQ ID NO: 1419431 - RNA, 18 nt, Human
aggucuuugguucagcua

SEQ ID NO: 1419432 - RNA, 19 nt, Human
aggucuuggaacuugccug

SEQ ID NO: 1419433 - RNA, 21 nt, Human
aggucuuggaacuugccugcc

SEQ ID NO: 1419434 - RNA, 23 nt, Human
uguaagauuuguuuuuaaacugu

SEQ ID NO: 1419435 - RNA, 22 nt, Human
uguaagauuauagauucuaaag

SEQ ID NO: 1419436 - RNA, 21 nt, Human
uguaagauuauagauucuaaa

SEQ ID NO: 1419437 - RNA, 20 nt, Human
uguaagauuauagauucuaa

SEQ ID NO: 1419438 - RNA, 19 nt, Human
uguaagauuauagauucua

SEQ ID NO: 1419439 - RNA, 18 nt, Human
uguaagauuauagauucu

SEQ ID NO: 1419440 - RNA, 16 nt, Human
uguaaguugaagcaaa

SEQ ID NO: 1419441 - RNA, 18 nt, Human
uguaagggccagaaauau

SEQ ID NO: 1419442 - RNA, 21 nt, Human
uguaagauuuguuuuuaaacu

SEQ ID NO: 1419443 - RNA, 13 nt, Human
uguaagauuuguu

SEQ ID NO: 1419444 - RNA, 23 nt, Human
uguaagauuauagauucuaaaga

SEQ ID NO: 1419445 - RNA, 21 nt, Human
uguaagggccagaaauaucuu

SEQ ID NO: 1419446 - RNA, 15 nt, Human
uguaaguaaacgguc

SEQ ID NO: 1419447 - RNA, 20 nt, Human
uguaauuauuuauguauggu

SEQ ID NO: 1419448 - RNA, 19 nt, Human
uguaaguugggcuugcuau

SEQ ID NO: 1419449 - RNA, 21 nt, Human
uguaaguugggcuugcuauuc

SEQ ID NO: 1419450 - RNA, 18 nt, Human
uguaaguugggcuugcua

SEQ ID NO: 1419451 - RNA, 14 nt, Human
uguaaguugggcuu

SEQ ID NO: 1419452 - RNA, 23 nt, Human
uguaauuagugccacuuaaugua

SEQ ID NO: 1419453 - RNA, 21 nt, Human
uguaauuagugccacuuaaug

SEQ ID NO: 1419454 - RNA, 13 nt, Human
agguugcacacuu

SEQ ID NO: 1419455 - RNA, 12 nt, Human
agguugcacacu

SEQ ID NO: 1419456 - RNA, 19 nt, Human
agguugcacacuuugguac

SEQ ID NO: 1419457 - RNA, 17 nt, Human
agguugcacacuuuggu

SEQ ID NO: 1419458 - RNA, 16 nt, Human
agguugcacacuuugg

SEQ ID NO: 1419459 - RNA, 22 nt, Human
agguuggcucugccaguccugu

SEQ ID NO: 1419460 - RNA, 15 nt, Human
agguuggcucugcca

SEQ ID NO: 1419461 - RNA, 21 nt, Human
agguuggcucugccaguccug

SEQ ID NO: 1419462 - RNA, 19 nt, Human
agguuggcucugccagucc

SEQ ID NO: 1419463 - RNA, 18 nt, Human
agguuggcucugccaguc

SEQ ID NO: 1419464 - RNA, 16 nt, Human
agguuggcucugccag

SEQ ID NO: 1419465 - RNA, 24 nt, Human
agguugagcucuucuuaaaguauu

SEQ ID NO: 1419466 - RNA, 17 nt, Human
agguugagcucuucuua

SEQ ID NO: 1419467 - RNA, 13 nt, Human
aggugguguuucu

SEQ ID NO: 1419468 - RNA, 19 nt, Human
agguguagccacaccagga

SEQ ID NO: 1419469 - RNA, 23 nt, Human
uguaacuugauccauuucuaauu

SEQ ID NO: 1419470 - RNA, 22 nt, Human
uguaacuugauccauuucuaau

SEQ ID NO: 1419471 - RNA, 21 nt, Human
uguaagacaaagguuuuccuc

SEQ ID NO: 1419472 - RNA, 20 nt, Human
uguaagacaaagguuuuccu

SEQ ID NO: 1419473 - RNA, 16 nt, Human
uguaacuuuuguaaga

SEQ ID NO: 1419474 - RNA, 15 nt, Human
uguaacuuuuguaag

SEQ ID NO: 1419475 - RNA, 20 nt, Human
uguaacuuuuguaagacaaa

SEQ ID NO: 1419476 - RNA, 17 nt, Human
uguaagaaaauaucacu

SEQ ID NO: 1419477 - RNA, 22 nt, Human
uguggauuuuuuccuucaaagu

SEQ ID NO: 1419478 - RNA, 22 nt, Human
uguggcaaagccuucauugccu

SEQ ID NO: 1419479 - RNA, 20 nt, Human
uguggagccgaggccuaccc

SEQ ID NO: 1419480 - RNA, 19 nt, Human
uguggagccgaggccuacc

SEQ ID NO: 1419481 - RNA, 16 nt, Human
uguggagccgaggccu

SEQ ID NO: 1419482 - RNA, 19 nt, Human
uguggagagggaaugugaa

SEQ ID NO: 1419483 - RNA, 20 nt, Human
uguggagagggaaugugaaa

SEQ ID NO: 1419484 - RNA, 17 nt, Human
uguggagagggaaugug

SEQ ID NO: 1419485 - RNA, 19 nt, Human
uguggccccacccugggcc

SEQ ID NO: 1419486 - RNA, 17 nt, Human
uguggccccacccuggg

SEQ ID NO: 1419487 - RNA, 13 nt, Human
uguggccccaccc

SEQ ID NO: 1419488 - RNA, 12 nt, Human
uguggccccacc

SEQ ID NO: 1419489 - RNA, 20 nt, Human
uguggcagaguuacaguucu

SEQ ID NO: 1419490 - RNA, 19 nt, Human
uguggcagaguuacaguuc

SEQ ID NO: 1419491 - RNA, 15 nt, Human
uguggcagaguuaca

SEQ ID NO: 1419492 - RNA, 14 nt, Human
uguggcagaguuac

SEQ ID NO: 1419493 - RNA, 14 nt, Human
uguggcaagugaau

SEQ ID NO: 1419494 - RNA, 15 nt, Human
uguggcaagugaauu

SEQ ID NO: 1419495 - RNA, 17 nt, Human
uguggcaaggaaaaaca

SEQ ID NO: 1419496 - RNA, 19 nt, Human
uguggcacuggggcagggg

SEQ ID NO: 1419497 - RNA, 22 nt, Human
ugugccuauugcuagagcuccu

SEQ ID NO: 1419498 - RNA, 13 nt, Human
ugugcccuaucac

SEQ ID NO: 1419499 - RNA, 23 nt, Human
ugugccccuugacaacuggcagg

SEQ ID NO: 1419500 - RNA, 16 nt, Human
ugugccccuugacaac

SEQ ID NO: 1419501 - RNA, 21 nt, Human
ugugccccuuccgccacuggg

SEQ ID NO: 1419502 - RNA, 20 nt, Human
ugugccccuuccgccacugg

SEQ ID NO: 1419503 - RNA, 18 nt, Human
ugugccccuuccgccacu

SEQ ID NO: 1419504 - RNA, 21 nt, Human
ugugcccuaaaguguauuuuu

SEQ ID NO: 1419505 - RNA, 20 nt, Human
ugugcccuaaaguguauuuu

SEQ ID NO: 1419506 - RNA, 21 nt, Human
ugugccuccucccucccucuc

SEQ ID NO: 1419507 - RNA, 16 nt, Human
ugugccuccucccucc

SEQ ID NO: 1419508 - RNA, 15 nt, Human
ugugccuccucccuc

SEQ ID NO: 1419509 - RNA, 14 nt, Human
ugugccuccucccu

SEQ ID NO: 1419510 - RNA, 13 nt, Human
ugugccuccuccc

SEQ ID NO: 1419511 - RNA, 16 nt, Human
ugugccuccucacccc

SEQ ID NO: 1419512 - RNA, 15 nt, Human
ugugccuccucaccc

SEQ ID NO: 1419513 - RNA, 14 nt, Human
ugugccuccucacc

SEQ ID NO: 1419514 - RNA, 14 nt, Human
ugugccucagagac

SEQ ID NO: 1419515 - RNA, 16 nt, Human
ugugccucagagacca

SEQ ID NO: 1419516 - RNA, 20 nt, Human
ugugccucgcuccccacucu

SEQ ID NO: 1419517 - RNA, 21 nt, Human
ugugccucgcuccccacucug

SEQ ID NO: 1419518 - RNA, 14 nt, Human
agugaguggcccuu

SEQ ID NO: 1419519 - RNA, 17 nt, Human
agugagucucucugggc

SEQ ID NO: 1419520 - RNA, 24 nt, Human
agugagucucucugggccuuagga

SEQ ID NO: 1419521 - RNA, 15 nt, Human
agugagucucucugg

SEQ ID NO: 1419522 - RNA, 14 nt, Human
agugagucucucug

SEQ ID NO: 1419523 - RNA, 22 nt, Human
uguggccccugaacaagaauug

SEQ ID NO: 1419524 - RNA, 23 nt, Human
uguggccaugacccugccucucc

SEQ ID NO: 1419525 - RNA, 17 nt, Human
uguggccccugaacaag

SEQ ID NO: 1419526 - RNA, 23 nt, Human
uguggccccacccugggcccugg

SEQ ID NO: 1419527 - RNA, 13 nt, Human
agugagucucucu

SEQ ID NO: 1419528 - RNA, 17 nt, Human
agugauugucuuaauau

SEQ ID NO: 1419529 - RNA, 15 nt, Human
agugauugucuuaau

SEQ ID NO: 1419530 - RNA, 21 nt, Human
agugcaaauugucacaggaca

SEQ ID NO: 1419531 - RNA, 18 nt, Human
agugcaaauugucacagg

SEQ ID NO: 1419532 - RNA, 13 nt, Human
agugcaccaaaga

SEQ ID NO: 1419533 - RNA, 22 nt, Human
agugcaaauugucacaggacag

SEQ ID NO: 1419534 - RNA, 15 nt, Human
agugcccucuccccu

SEQ ID NO: 1419535 - RNA, 16 nt, Human
agugcccccacugacc

SEQ ID NO: 1419536 - RNA, 14 nt, Human
agugcccccacuga

SEQ ID NO: 1419537 - RNA, 17 nt, Human
agugccacuguuguuuu

SEQ ID NO: 1419538 - RNA, 17 nt, Human
agugccacuuaauguau

SEQ ID NO: 1419539 - RNA, 16 nt, Human
agugccacuuaaugua

SEQ ID NO: 1419540 - RNA, 14 nt, Human
agugccacuuaaug

SEQ ID NO: 1419541 - RNA, 21 nt, Human
agugcaucuggagagaacagg

SEQ ID NO: 1419542 - RNA, 19 nt, Human
agugcaucuggagagaaca

SEQ ID NO: 1419543 - RNA, 14 nt, Human
agugcaucuggaga

SEQ ID NO: 1419544 - RNA, 22 nt, Human
agugcaguccugaucagagccg

SEQ ID NO: 1419545 - RNA, 16 nt, Human
agugcaguccugauca

SEQ ID NO: 1419546 - RNA, 20 nt, Human
agugcaccaaagagaaugcc

SEQ ID NO: 1419547 - RNA, 18 nt, Human
agugcaccaaagagaaug

SEQ ID NO: 1419548 - RNA, 16 nt, Human
agugcaccaaagagaa

SEQ ID NO: 1419549 - RNA, 14 nt, Human
agugcacuaaugug

SEQ ID NO: 1419550 - RNA, 16 nt, Human
uguguguugauacugu

SEQ ID NO: 1419551 - RNA, 20 nt, Human
uguguguuaagcucugcuau

SEQ ID NO: 1419552 - RNA, 13 nt, Human
uguguugccaagc

SEQ ID NO: 1419553 - RNA, 23 nt, Human
uguguugauacuguugcacgugu

SEQ ID NO: 1419554 - RNA, 16 nt, Human
uguguucccauuucag

SEQ ID NO: 1419555 - RNA, 15 nt, Human
uguguguugauacug

SEQ ID NO: 1419556 - RNA, 19 nt, Human
uguguuaugcaaaagcaag

SEQ ID NO: 1419557 - RNA, 20 nt, Human
ugugucuaagauucuagauc

SEQ ID NO: 1419558 - RNA, 19 nt, Human
ugugucuaagauucuagau

SEQ ID NO: 1419559 - RNA, 18 nt, Human
ugugucuaagauucuaga

SEQ ID NO: 1419560 - RNA, 17 nt, Human
ugugucuaagauucuag

SEQ ID NO: 1419561 - RNA, 16 nt, Human
ugugucuaagauucua

SEQ ID NO: 1419562 - RNA, 22 nt, Human
ugugguuucauguuaguuaccu

SEQ ID NO: 1419563 - RNA, 15 nt, Human
ugugucuaagauucu

SEQ ID NO: 1419564 - RNA, 17 nt, Human
ugugguuucauguuagu

SEQ ID NO: 1419565 - RNA, 15 nt, Human
ugugguuuauauauu

SEQ ID NO: 1419566 - RNA, 23 nt, Human
agugcuuuuaagugaaaaugguc

SEQ ID NO: 1419567 - RNA, 19 nt, Human
agugcuuuuaagugaaaau

SEQ ID NO: 1419568 - RNA, 14 nt, Human
agugcuuugagaga

SEQ ID NO: 1419569 - RNA, 19 nt, Human
uguguugucucuugaguuu

SEQ ID NO: 1419570 - RNA, 13 nt, Human
uguguugucucua

SEQ ID NO: 1419571 - RNA, 22 nt, Human
uguguugggauugagucugugc

SEQ ID NO: 1419572 - RNA, 12 nt, Human
uguguuggcugu

SEQ ID NO: 1419573 - RNA, 17 nt, Human
uguguucccauuucagc

SEQ ID NO: 1419574 - RNA, 16 nt, Human
uguguugccaagcucc

SEQ ID NO: 1419575 - RNA, 21 nt, Human
uguuaacauuccaagacucua

SEQ ID NO: 1419576 - RNA, 20 nt, Human
uguuaacauuccaagacucu

SEQ ID NO: 1419577 - RNA, 16 nt, Human
uguuaacauuccaaga

SEQ ID NO: 1419578 - RNA, 15 nt, Human
uguuaacauuccaag

SEQ ID NO: 1419579 - RNA, 22 nt, Human
uguuaacagaagggagggcaga

SEQ ID NO: 1419580 - RNA, 21 nt, Human
uguuaacagaagggagggcag

SEQ ID NO: 1419581 - RNA, 13 nt, Human
uguuaacagaagg

SEQ ID NO: 1419582 - RNA, 18 nt, Human
agugccugacacacuaac

SEQ ID NO: 1419583 - RNA, 21 nt, Human
agugcccugagccagggucuc

SEQ ID NO: 1419584 - RNA, 23 nt, Human
agugcccugagccagggucucca

SEQ ID NO: 1419585 - RNA, 20 nt, Human
agugcccugagccagggucu

SEQ ID NO: 1419586 - RNA, 16 nt, Human
agugcccugagccagg

SEQ ID NO: 1419587 - RNA, 15 nt, Human
agugcccugagccag

SEQ ID NO: 1419588 - RNA, 13 nt, Human
agugcccugagcc

SEQ ID NO: 1419589 - RNA, 20 nt, Human
agugcugcauuuaaaagaua

SEQ ID NO: 1419590 - RNA, 22 nt, Human
agugcuguuuuguuauauaauu

SEQ ID NO: 1419591 - RNA, 23 nt, Human
agugcuguuuuguuauauaauuu

SEQ ID NO: 1419592 - RNA, 19 nt, Human
agugcugggauuacaggcu

SEQ ID NO: 1419593 - RNA, 20 nt, Human
agugcuguuuuguuauauaa

SEQ ID NO: 1419594 - RNA, 20 nt, Human
agugcugggauuacaggugu

SEQ ID NO: 1419595 - RNA, 20 nt, Human
agugcuggcauuacaggugu

SEQ ID NO: 1419596 - RNA, 22 nt, Human
agugcugcauuuaaaagauaca

SEQ ID NO: 1419597 - RNA, 22 nt, Human
agugcuugcuuuucaugcaaac

SEQ ID NO: 1419598 - RNA, 17 nt, Human
agugcuugcuuuucaug

SEQ ID NO: 1419599 - RNA, 13 nt, Human
agugcuugcuuuu

SEQ ID NO: 1419600 - RNA, 14 nt, Human
ugugguuuauauau

SEQ ID NO: 1419601 - RNA, 21 nt, Human
ugugguucugagauggcuccc

SEQ ID NO: 1419602 - RNA, 16 nt, Human
uguggugagggaagac

SEQ ID NO: 1419603 - RNA, 14 nt, Human
aguuauauuuugca

SEQ ID NO: 1419604 - RNA, 16 nt, Human
aguuauauuuugcagu

SEQ ID NO: 1419605 - RNA, 21 nt, Human
aguucccaguuggagcuccag

SEQ ID NO: 1419606 - RNA, 20 nt, Human
aguucccaguuggagcucca

SEQ ID NO: 1419607 - RNA, 19 nt, Human
aguucccaguuggagcucc

SEQ ID NO: 1419608 - RNA, 18 nt, Human
aguucccaguuggagcuc

SEQ ID NO: 1419609 - RNA, 17 nt, Human
aguucccaguuggagcu

SEQ ID NO: 1419610 - RNA, 22 nt, Human
aguucccacauuaaagaagacc

SEQ ID NO: 1419611 - RNA, 19 nt, Human
aguucccacauuaaagaag

SEQ ID NO: 1419612 - RNA, 18 nt, Human
aguucccacauuaaagaa

SEQ ID NO: 1419613 - RNA, 17 nt, Human
aguucccacauuaaaga

SEQ ID NO: 1419614 - RNA, 15 nt, Human
aguucagaauuuagu

SEQ ID NO: 1419615 - RNA, 22 nt, Human
aguucuaggcacuguaguucua

SEQ ID NO: 1419616 - RNA, 14 nt, Human
aguucuaggcacug

SEQ ID NO: 1419617 - RNA, 10 nt, Human
aguucuaggc

SEQ ID NO: 1419618 - RNA, 15 nt, Human
aguucuaggaaaaua

SEQ ID NO: 1419619 - RNA, 14 nt, Human
aguucuaggaaaau

SEQ ID NO: 1419620 - RNA, 13 nt, Human
aguucuaggaaaa

SEQ ID NO: 1419621 - RNA, 23 nt, Human
aguucuagacauggagguucuaa

SEQ ID NO: 1419622 - RNA, 22 nt, Human
aguucuagacauggagguucua

SEQ ID NO: 1419623 - RNA, 21 nt, Human
aguucuagacauggagguucu

SEQ ID NO: 1419624 - RNA, 10 nt, Human
aguucuagac

SEQ ID NO: 1419625 - RNA, 15 nt, Human
aguucuagaaaaaca

SEQ ID NO: 1419626 - RNA, 14 nt, Human
aguucuagaaaaac

SEQ ID NO: 1419627 - RNA, 12 nt, Human
aguucuagaaaa

SEQ ID NO: 1419628 - RNA, 23 nt, Human
aguucuaccucaggcagcucaag

SEQ ID NO: 1419629 - RNA, 22 nt, Human
aguucuaccucaggcagcucaa

SEQ ID NO: 1419630 - RNA, 22 nt, Human
aguucucccuguacaguguuac

SEQ ID NO: 1419631 - RNA, 13 nt, Human
aguucucccugua

SEQ ID NO: 1419632 - RNA, 17 nt, Human
uguugggguggguauaa

SEQ ID NO: 1419633 - RNA, 18 nt, Human
uguugggguggguauaaa

SEQ ID NO: 1419634 - RNA, 20 nt, Human
uguugggguggguauaaaag

SEQ ID NO: 1419635 - RNA, 19 nt, Human
aguuccucuaacuuggcuc

SEQ ID NO: 1419636 - RNA, 21 nt, Human
aguuccucuaacuuggcucac

SEQ ID NO: 1419637 - RNA, 19 nt, Human
aguucggugagcuacaaau

SEQ ID NO: 1419638 - RNA, 20 nt, Human
aguucuaccucaggcagcuc

SEQ ID NO: 1419639 - RNA, 21 nt, Human
aguucuaauaauuucuaaugu

SEQ ID NO: 1419640 - RNA, 18 nt, Human
aguucgcagccacccuga

SEQ ID NO: 1419641 - RNA, 20 nt, Human
aguucuaauaauuucuaaug

SEQ ID NO: 1419642 - RNA, 21 nt, Human
aguucgcagccacccugagga

SEQ ID NO: 1419643 - RNA, 17 nt, Human
aguucgcagccacccug

SEQ ID NO: 1419644 - RNA, 14 nt, Human
aguucgcagccacc

SEQ ID NO: 1419645 - RNA, 13 nt, Human
aguucgcagccac

SEQ ID NO: 1419646 - RNA, 13 nt, Human
aguuccugcuaaa

SEQ ID NO: 1419647 - RNA, 20 nt, Human
aguucggugagcuacaaaug

SEQ ID NO: 1419648 - RNA, 15 nt, Human
uguuuauguaauuuc

SEQ ID NO: 1419649 - RNA, 14 nt, Human
uguuuauguaauuu

SEQ ID NO: 1419650 - RNA, 13 nt, Human
uguuuaugguaaa

SEQ ID NO: 1419651 - RNA, 16 nt, Human
uguuuaugguaaaaaa

SEQ ID NO: 1419652 - RNA, 17 nt, Human
uguuuauucuucuagag

SEQ ID NO: 1419653 - RNA, 16 nt, Human
uguuuauucuucuaga

SEQ ID NO: 1419654 - RNA, 13 nt, Human
uguuuaguaauca

SEQ ID NO: 1419655 - RNA, 14 nt, Human
uguuuaguaaucau

SEQ ID NO: 1419656 - RNA, 17 nt, Human
uguuuaguaaucauauu

SEQ ID NO: 1419657 - RNA, 18 nt, Human
uguuuauccuuucauaua

SEQ ID NO: 1419658 - RNA, 21 nt, Human
uguuuauccuuucauauaguu

SEQ ID NO: 1419659 - RNA, 17 nt, Human
uguuuauccuuucauau

SEQ ID NO: 1419660 - RNA, 16 nt, Human
uguuuauccuuucaua

SEQ ID NO: 1419661 - RNA, 15 nt, Human
uguuuauccuuucau

SEQ ID NO: 1419662 - RNA, 18 nt, Human
uguuuaguagcagugauu

SEQ ID NO: 1419663 - RNA, 16 nt, Human
uguuuaguagcaguga

SEQ ID NO: 1419664 - RNA, 22 nt, Human
uguuguucuguuaacugaauac

SEQ ID NO: 1419665 - RNA, 13 nt, Human
uguuguuauuuaa

SEQ ID NO: 1419666 - RNA, 11 nt, Human
uguuguuauuu

SEQ ID NO: 1419667 - RNA, 18 nt, Human
uguuguucuguuaacuga

SEQ ID NO: 1419668 - RNA, 13 nt, Human
uguuguucuguua

SEQ ID NO: 1419669 - RNA, 11 nt, Human
uguuguucugu

SEQ ID NO: 1419670 - RNA, 23 nt, Human
uguuguuccaaauacuaaugaaa

SEQ ID NO: 1419671 - RNA, 13 nt, Human
uguugugcuuuua

SEQ ID NO: 1419672 - RNA, 15 nt, Human
uguugucucuugagu

SEQ ID NO: 1419673 - RNA, 20 nt, Human
uguugguugguuuucuucuu

SEQ ID NO: 1419674 - RNA, 15 nt, Human
uguugguugguuuuc

SEQ ID NO: 1419675 - RNA, 14 nt, Human
uguuggucauuuua

SEQ ID NO: 1419676 - RNA, 22 nt, Human
uguugggguggguauaaaagau

SEQ ID NO: 1419677 - RNA, 23 nt, Human
uguugggguggguauaaaagaug

SEQ ID NO: 1419678 - RNA, 18 nt, Human
uguuggugcacagcacaa

SEQ ID NO: 1419679 - RNA, 14 nt, Human
uguuggugcacagc

SEQ ID NO: 1419680 - RNA, 11 nt, Human
uguuggugcac

SEQ ID NO: 1419681 - RNA, 16 nt, Human
uguugucugcaacucu

SEQ ID NO: 1419682 - RNA, 13 nt, Human
uguugucugcaac

SEQ ID NO: 1419683 - RNA, 22 nt, Human
uguuauuauuacuuauuuuuga

SEQ ID NO: 1419684 - RNA, 23 nt, Human
uguuauuaucugggcuuauaucu

SEQ ID NO: 1419685 - RNA, 16 nt, Human
uguuauuaucugggcu

SEQ ID NO: 1419686 - RNA, 23 nt, Human
uguuauuagagauuaccuccuga

SEQ ID NO: 1419687 - RNA, 21 nt, Human
uguuauuagagauuaccuccu

SEQ ID NO: 1419688 - RNA, 16 nt, Human
uguuaucuucucaagu

SEQ ID NO: 1419689 - RNA, 20 nt, Human
uguuaucuucucaaguucua

SEQ ID NO: 1419690 - RNA, 15 nt, Human
uguuaucuucucaag

SEQ ID NO: 1419691 - RNA, 21 nt, Human
uguuaucagucaauauuuuua

SEQ ID NO: 1419692 - RNA, 19 nt, Human
uguuaucaccgugggcucc

SEQ ID NO: 1419693 - RNA, 22 nt, Human
uguuaucaaacaccaacauaaa

SEQ ID NO: 1419694 - RNA, 20 nt, Human
uguuaucaaaacuuucuuuu

SEQ ID NO: 1419695 - RNA, 16 nt, Human
aguggaucacaaagug

SEQ ID NO: 1419696 - RNA, 24 nt, Human
aguggaacgaaaaugaaagcuacu

SEQ ID NO: 1419697 - RNA, 16 nt, Human
aguggaacgaaaauga

SEQ ID NO: 1419698 - RNA, 22 nt, Human
aguggaaagacagcuucucauc

SEQ ID NO: 1419699 - RNA, 14 nt, Human
aguggaaaaggcac

SEQ ID NO: 1419700 - RNA, 18 nt, Human
agugcuuuuggcggggag

SEQ ID NO: 1419701 - RNA, 20 nt, Human
aguggagucugccacccagg

SEQ ID NO: 1419702 - RNA, 19 nt, Human
aguggagucugccacccag

SEQ ID NO: 1419703 - RNA, 17 nt, Human
aguggagucugccaccc

SEQ ID NO: 1419704 - RNA, 14 nt, Human
aguggagucugcca

SEQ ID NO: 1419705 - RNA, 18 nt, Human
aguggaucacucaccauu

SEQ ID NO: 1419706 - RNA, 15 nt, Human
aguggaucacaaagu

SEQ ID NO: 1419707 - RNA, 22 nt, Human
uguuccccuuugcuucauucaa

SEQ ID NO: 1419708 - RNA, 23 nt, Human
uguuccccuuccacugagggcag

SEQ ID NO: 1419709 - RNA, 21 nt, Human
uguuccccuuccacugagggc

SEQ ID NO: 1419710 - RNA, 20 nt, Human
uguuccccuuccacugaggg

SEQ ID NO: 1419711 - RNA, 17 nt, Human
uguuccccuuccacuga

SEQ ID NO: 1419712 - RNA, 14 nt, Human
uguuccccuuccac

SEQ ID NO: 1419713 - RNA, 14 nt, Human
uguuauuuaaagaa

SEQ ID NO: 1419714 - RNA, 15 nt, Human
uguucuuccuggccg

SEQ ID NO: 1419715 - RNA, 13 nt, Human
uguucuuccuggc

SEQ ID NO: 1419716 - RNA, 21 nt, Human
uguucuuccucagccagccuc

SEQ ID NO: 1419717 - RNA, 20 nt, Human
uguucuuccucagccagccu

SEQ ID NO: 1419718 - RNA, 17 nt, Human
uguucuuccucagccag

SEQ ID NO: 1419719 - RNA, 16 nt, Human
uguucuuccucagcca

SEQ ID NO: 1419720 - RNA, 15 nt, Human
uguucuuccucagcc

SEQ ID NO: 1419721 - RNA, 10 nt, Human
uguucuuccu

SEQ ID NO: 1419722 - RNA, 16 nt, Human
uguucuaaguuucuaa

SEQ ID NO: 1419723 - RNA, 14 nt, Human
uguucuaaguuucu

SEQ ID NO: 1419724 - RNA, 12 nt, Human
uguucuaaguuu

SEQ ID NO: 1419725 - RNA, 19 nt, Human
uguucuaaggcucugagag

SEQ ID NO: 1419726 - RNA, 17 nt, Human
uguucuaagucuuucca

SEQ ID NO: 1419727 - RNA, 23 nt, Human
uguucuaaggcucugagagucua

SEQ ID NO: 1419728 - RNA, 18 nt, Human
uguucuaaggcucugaga

SEQ ID NO: 1419729 - RNA, 16 nt, Human
uguucuaaggcucuga

SEQ ID NO: 1419730 - RNA, 15 nt, Human
uguucuaaggcucug

SEQ ID NO: 1419731 - RNA, 16 nt, Human
uguucccuauccaauc

SEQ ID NO: 1419732 - RNA, 23 nt, Human
uguucuaaguuucuaagauucua

SEQ ID NO: 1419733 - RNA, 22 nt, Human
uguucuaaguuucuaagauucu

SEQ ID NO: 1419734 - RNA, 19 nt, Human
uguucuaaguuucuaagau

SEQ ID NO: 1419735 - RNA, 18 nt, Human
uguucuaaguuucuaaga

SEQ ID NO: 1419736 - RNA, 17 nt, Human
uguucuaaguuucuaag

SEQ ID NO: 1419737 - RNA, 13 nt, Human
uguucuuguauuu

SEQ ID NO: 1419738 - RNA, 14 nt, Human
uguucuuguauuua

SEQ ID NO: 1419739 - RNA, 10 nt, Human
uguucuugua

SEQ ID NO: 1419740 - RNA, 22 nt, Human
uguucuugguuuguaaauuaac

SEQ ID NO: 1419741 - RNA, 23 nt, Human
uguucuugaauuuaauaaucugu

SEQ ID NO: 1419742 - RNA, 13 nt, Human
uguucuugaauuu

SEQ ID NO: 1419743 - RNA, 20 nt, Human
uguucuugguuuguaaauua

SEQ ID NO: 1419744 - RNA, 21 nt, Human
aguguuagccuuuuuucccca

SEQ ID NO: 1419745 - RNA, 23 nt, Human
aguguuagccuuuuuuccccaga

SEQ ID NO: 1419746 - RNA, 15 nt, Human
aguguuaaaugugau

SEQ ID NO: 1419747 - RNA, 22 nt, Human
uguucuuagcucaaugagcaug

SEQ ID NO: 1419748 - RNA, 23 nt, Human
aguguuagggaagggccugccac

SEQ ID NO: 1419749 - RNA, 19 nt, Human
aguguuagggaagggccug

SEQ ID NO: 1419750 - RNA, 18 nt, Human
aguguuagggaagggccu

SEQ ID NO: 1419751 - RNA, 15 nt, Human
aguguuagggaaggg

SEQ ID NO: 1419752 - RNA, 23 nt, Human
aguguuaucagucauaacuaaau

SEQ ID NO: 1419753 - RNA, 16 nt, Human
aguguuaucagucaua

SEQ ID NO: 1419754 - RNA, 17 nt, Human
aguguuauuuucauuca

SEQ ID NO: 1419755 - RNA, 21 nt, Human
aguguucauaaauaaaguuug

SEQ ID NO: 1419756 - RNA, 23 nt, Human
aguuauagugaauacugcuacag

SEQ ID NO: 1419757 - RNA, 20 nt, Human
aguuauagugaauacugcua

SEQ ID NO: 1419758 - RNA, 15 nt, Human
aguuauagugaauac

SEQ ID NO: 1419759 - RNA, 14 nt, Human
aguuauagugaaua

SEQ ID NO: 1419760 - RNA, 12 nt, Human
aguuagacuguu

SEQ ID NO: 1419761 - RNA, 19 nt, Human
aguuacuguguaauuagug

SEQ ID NO: 1419762 - RNA, 18 nt, Human
aguuacuguguaauuagu

SEQ ID NO: 1419763 - RNA, 16 nt, Human
aguuacuguguaauua

SEQ ID NO: 1419764 - RNA, 15 nt, Human
aguuacuguguaauu

SEQ ID NO: 1419765 - RNA, 14 nt, Human
aguuacuguguaau

SEQ ID NO: 1419766 - RNA, 11 nt, Human
aguuacugugu

SEQ ID NO: 1419767 - RNA, 16 nt, Human
aguguuggagaagaac

SEQ ID NO: 1419768 - RNA, 14 nt, Human
aguguuggagaaga

SEQ ID NO: 1419769 - RNA, 17 nt, Human
aguguugagccuuuucc

SEQ ID NO: 1419770 - RNA, 20 nt, Human
aguguugagcaucugucccc

SEQ ID NO: 1419771 - RNA, 18 nt, Human
aguguuggagaagaacug

SEQ ID NO: 1419772 - RNA, 17 nt, Human
aguguuggagaagaacu

SEQ ID NO: 1419773 - RNA, 23 nt, Human
aguguuggagaagaacugaaauc

SEQ ID NO: 1419774 - RNA, 19 nt, Human
uuaauugccaccucuaaca

SEQ ID NO: 1419775 - RNA, 15 nt, Human
uuaaugaaaauaaga

SEQ ID NO: 1419776 - RNA, 16 nt, Human
uuaaucuuaguguaug

SEQ ID NO: 1419777 - RNA, 14 nt, Human
uuaaucuuagugua

SEQ ID NO: 1419778 - RNA, 18 nt, Human
uuaaucucuaacagugga

SEQ ID NO: 1419779 - RNA, 17 nt, Human
uuaaucucuaacagugg

SEQ ID NO: 1419780 - RNA, 22 nt, Human
uuaaucauuaggugugacugaa

SEQ ID NO: 1419781 - RNA, 23 nt, Human
uuaaucauuaggugugacugaau

SEQ ID NO: 1419782 - RNA, 13 nt, Human
uuaaucauuaggu

SEQ ID NO: 1419783 - RNA, 13 nt, Human
uuaagucagaaca

SEQ ID NO: 1419784 - RNA, 13 nt, Human
uuaauauugauuu

SEQ ID NO: 1419785 - RNA, 16 nt, Human
uuaauauugauuuauu

SEQ ID NO: 1419786 - RNA, 22 nt, Human
uuaagugcugcauuuaaaagau

SEQ ID NO: 1419787 - RNA, 19 nt, Human
uuaagugcugcauuuaaaa

SEQ ID NO: 1419788 - RNA, 15 nt, Human
uuaagugcugcauuu

SEQ ID NO: 1419789 - RNA, 16 nt, Human
uuaagugcugcauuua

SEQ ID NO: 1419790 - RNA, 22 nt, Human
uuaagaaauagacagcaugaga

SEQ ID NO: 1419791 - RNA, 15 nt, Human
uuaagaaauagaauu

SEQ ID NO: 1419792 - RNA, 20 nt, Human
uuaagaagacugcauuauau

SEQ ID NO: 1419793 - RNA, 17 nt, Human
uuaagguguagccacac

SEQ ID NO: 1419794 - RNA, 14 nt, Human
uuaagguguagcca

SEQ ID NO: 1419795 - RNA, 24 nt, Human
uuaaggggaggaaccagagugcug

SEQ ID NO: 1419796 - RNA, 16 nt, Human
aguuuugcaaagugca

SEQ ID NO: 1419797 - RNA, 18 nt, Human
aguuuugauauuucuagc

SEQ ID NO: 1419798 - RNA, 15 nt, Human
aguuuuggaugcagu

SEQ ID NO: 1419799 - RNA, 17 nt, Human
aguuuuggaugcagugc

SEQ ID NO: 1419800 - RNA, 18 nt, Human
aguuuuggaugcagugcu

SEQ ID NO: 1419801 - RNA, 19 nt, Human
aguuuuggaugcagugcuc

SEQ ID NO: 1419802 - RNA, 23 nt, Human
aguuuuuauggcuuuugugcauu

SEQ ID NO: 1419803 - RNA, 21 nt, Human
auaaaauaugaagacauaaac

SEQ ID NO: 1419804 - RNA, 15 nt, Human
auaaaauaauuuuua

SEQ ID NO: 1419805 - RNA, 22 nt, Human
auaaaauaauuuuaucucuuuc

SEQ ID NO: 1419806 - RNA, 20 nt, Human
uuaagaaaaaggaugcacag

SEQ ID NO: 1419807 - RNA, 11 nt, Human
auaaaaucagc

SEQ ID NO: 1419808 - RNA, 16 nt, Human
auaaaaucagccaauu

SEQ ID NO: 1419809 - RNA, 21 nt, Human
uuaagaaaaaggaugcacaga

SEQ ID NO: 1419810 - RNA, 15 nt, Human
auaaaaucagccaau

SEQ ID NO: 1419811 - RNA, 23 nt, Human
auaaaauaaugggauuuucuuuu

SEQ ID NO: 1419812 - RNA, 12 nt, Human
auaaaauaauuu

SEQ ID NO: 1419813 - RNA, 18 nt, Human
auaaaagccuguuuaaga

SEQ ID NO: 1419814 - RNA, 19 nt, Human
auaaaagccuguuuaagag

SEQ ID NO: 1419815 - RNA, 19 nt, Human
aguuuuuauuaaaccccuu

SEQ ID NO: 1419816 - RNA, 19 nt, Human
auaaaagauggggucugua

SEQ ID NO: 1419817 - RNA, 21 nt, Human
auaaaagauggggucuguaaa

SEQ ID NO: 1419818 - RNA, 18 nt, Human
aguuuuuaugagaaacuu

SEQ ID NO: 1419819 - RNA, 16 nt, Human
aguuuuuaugagaaac

SEQ ID NO: 1419820 - RNA, 17 nt, Human
aguuuuuauauguugua

SEQ ID NO: 1419821 - RNA, 13 nt, Human
auaaaagccuguu

SEQ ID NO: 1419822 - RNA, 22 nt, Human
auaaaagauggggucuguaaaa

SEQ ID NO: 1419823 - RNA, 21 nt, Human
aguuucauguacaagaugaag

SEQ ID NO: 1419824 - RNA, 18 nt, Human
aguuucauguacaagaug

SEQ ID NO: 1419825 - RNA, 15 nt, Human
aguuucauguacaag

SEQ ID NO: 1419826 - RNA, 16 nt, Human
aguuucauauaaagua

SEQ ID NO: 1419827 - RNA, 20 nt, Human
aguuucaguagauugcagaa

SEQ ID NO: 1419828 - RNA, 14 nt, Human
uuaacagagucuga

SEQ ID NO: 1419829 - RNA, 13 nt, Human
uuaacagagucug

SEQ ID NO: 1419830 - RNA, 14 nt, Human
uuaacagaagggag

SEQ ID NO: 1419831 - RNA, 20 nt, Human
uuaacagaagggagggcaga

SEQ ID NO: 1419832 - RNA, 21 nt, Human
uuaacagaaauuguauauugu

SEQ ID NO: 1419833 - RNA, 19 nt, Human
uuaacagaaauuguauauu

SEQ ID NO: 1419834 - RNA, 17 nt, Human
uuaacagaaauuguaua

SEQ ID NO: 1419835 - RNA, 16 nt, Human
uuaacagaaauuguau

SEQ ID NO: 1419836 - RNA, 15 nt, Human
uuaacagaaauugua

SEQ ID NO: 1419837 - RNA, 13 nt, Human
uuaacagaaauug

SEQ ID NO: 1419838 - RNA, 20 nt, Human
uuaacagaaauguacagcaa

SEQ ID NO: 1419839 - RNA, 12 nt, Human
uuaacacacuac

SEQ ID NO: 1419840 - RNA, 17 nt, Human
uuaacaauuaggcagac

SEQ ID NO: 1419841 - RNA, 19 nt, Human
uuaacagaaauguacagca

SEQ ID NO: 1419842 - RNA, 13 nt, Human
uuaaauacagucu

SEQ ID NO: 1419843 - RNA, 20 nt, Human
uuaaauacaggaaacaguug

SEQ ID NO: 1419844 - RNA, 19 nt, Human
uuaaauacaggaaacaguu

SEQ ID NO: 1419845 - RNA, 17 nt, Human
uuaaauacaggaaacag

SEQ ID NO: 1419846 - RNA, 15 nt, Human
uuaaauacaggaaac

SEQ ID NO: 1419847 - RNA, 14 nt, Human
uuaaauacaggaaa

SEQ ID NO: 1419848 - RNA, 10 nt, Human
uuaaauacag

SEQ ID NO: 1419849 - RNA, 20 nt, Human
uuaaaguuaguaucuuuuga

SEQ ID NO: 1419850 - RNA, 19 nt, Human
uuaaauaaugugaaacugg

SEQ ID NO: 1419851 - RNA, 16 nt, Human
uuaaauaaugugaaac

SEQ ID NO: 1419852 - RNA, 18 nt, Human
uuaaauaaugugaaacug

SEQ ID NO: 1419853 - RNA, 16 nt, Human
uuaaacaccuccucau

SEQ ID NO: 1419854 - RNA, 13 nt, Human
uuaaacaccuccu

SEQ ID NO: 1419855 - RNA, 14 nt, Human
uuaaacaaagguug

SEQ ID NO: 1419856 - RNA, 23 nt, Human
uuaaacagugagccugaauuuug

SEQ ID NO: 1419857 - RNA, 18 nt, Human
uuaaacagugagccugaa

SEQ ID NO: 1419858 - RNA, 13 nt, Human
uuaaacagaggau

SEQ ID NO: 1419859 - RNA, 14 nt, Human
uuaaaaaucucaaa

SEQ ID NO: 1419860 - RNA, 15 nt, Human
uuaaaaaucucaaau

SEQ ID NO: 1419861 - RNA, 16 nt, Human
uuaaaaaucucaaauu

SEQ ID NO: 1419862 - RNA, 17 nt, Human
uuaaaaaucucaaauuu

SEQ ID NO: 1419863 - RNA, 18 nt, Human
uuaaaauuuuuuuagaaa

SEQ ID NO: 1419864 - RNA, 19 nt, Human
uuaaacaucaaucuuuaaa

SEQ ID NO: 1419865 - RNA, 23 nt, Human
uuaaacauuaauagcagccuuuc

SEQ ID NO: 1419866 - RNA, 19 nt, Human
uuaaacauuaauagcagcc

SEQ ID NO: 1419867 - RNA, 13 nt, Human
uuaaagugccagu

SEQ ID NO: 1419868 - RNA, 20 nt, Human
uuaaagugacuaauggcaug

SEQ ID NO: 1419869 - RNA, 21 nt, Human
uuaaagugacuaauggcauga

SEQ ID NO: 1419870 - RNA, 13 nt, Human
uuaaaguauucuu

SEQ ID NO: 1419871 - RNA, 22 nt, Human
uuaaagugcuaagguucuaagg

SEQ ID NO: 1419872 - RNA, 21 nt, Human
uuaaagugcuaagguucuaag

SEQ ID NO: 1419873 - RNA, 19 nt, Human
uuaaagugcuaagguucua

SEQ ID NO: 1419874 - RNA, 15 nt, Human
uuaaauaaugugaaa

SEQ ID NO: 1419875 - RNA, 12 nt, Human
uuaaaaaaauaa

SEQ ID NO: 1419876 - RNA, 20 nt, Human
aguugguaacuuuugugaau

SEQ ID NO: 1419877 - RNA, 16 nt, Human
aguugguaacuuuugu

SEQ ID NO: 1419878 - RNA, 15 nt, Human
aguuuaaaaucauca

SEQ ID NO: 1419879 - RNA, 21 nt, Human
aguuuaaaagcacgacagugg

SEQ ID NO: 1419880 - RNA, 18 nt, Human
aguuuaaaacagaagccu

SEQ ID NO: 1419881 - RNA, 21 nt, Human
aguuuaaaaucaucagaaagg

SEQ ID NO: 1419882 - RNA, 14 nt, Human
aguuuaaauuguaa

SEQ ID NO: 1419883 - RNA, 17 nt, Human
aguuggagucacucuua

SEQ ID NO: 1419884 - RNA, 19 nt, Human
aguuggagcuccagccuga

SEQ ID NO: 1419885 - RNA, 13 nt, Human
aguugcuuuucag

SEQ ID NO: 1419886 - RNA, 21 nt, Human
aguuggggucuggcagccucc

SEQ ID NO: 1419887 - RNA, 17 nt, Human
aguuggggucuggcagc

SEQ ID NO: 1419888 - RNA, 20 nt, Human
aguugggcuugcuauucugu

SEQ ID NO: 1419889 - RNA, 16 nt, Human
aguuggggacacaugu

SEQ ID NO: 1419890 - RNA, 15 nt, Human
aguugguaacuuuug

SEQ ID NO: 1419891 - RNA, 19 nt, Human
aguugggcuugcuauucug

SEQ ID NO: 1419892 - RNA, 15 nt, Human
aguugggcuugcuau

SEQ ID NO: 1419893 - RNA, 20 nt, Human
aguuggaguuuuuuguacca

SEQ ID NO: 1419894 - RNA, 19 nt, Human
aguuggaguuuuuuguacc

SEQ ID NO: 1419895 - RNA, 23 nt, Human
uguuuauuuuucuugucuuuauu

SEQ ID NO: 1419896 - RNA, 19 nt, Human
uguuucaaacauauauaac

SEQ ID NO: 1419897 - RNA, 19 nt, Human
uguuuauuuuucuugucuu

SEQ ID NO: 1419898 - RNA, 12 nt, Human
uguuuauuuuuc

SEQ ID NO: 1419899 - RNA, 13 nt, Human
uguuucaaacaua

SEQ ID NO: 1419900 - RNA, 21 nt, Human
aguugcugcuucucccaggca

SEQ ID NO: 1419901 - RNA, 18 nt, Human
aguugcugcuucucccag

SEQ ID NO: 1419902 - RNA, 14 nt, Human
uuacucugccuaca

SEQ ID NO: 1419903 - RNA, 13 nt, Human
uuaccuuucauac

SEQ ID NO: 1419904 - RNA, 16 nt, Human
uuaccuuguauacugu

SEQ ID NO: 1419905 - RNA, 18 nt, Human
uuacucugccuacagaac

SEQ ID NO: 1419906 - RNA, 12 nt, Human
uuagaaagcauu

SEQ ID NO: 1419907 - RNA, 13 nt, Human
uuagaaagcauuu

SEQ ID NO: 1419908 - RNA, 14 nt, Human
uuagaaagcauuug

SEQ ID NO: 1419909 - RNA, 15 nt, Human
uuagaaagcauuuga

SEQ ID NO: 1419910 - RNA, 16 nt, Human
uuagaaagcauuugaa

SEQ ID NO: 1419911 - RNA, 13 nt, Human
uuagaaaucauuu

SEQ ID NO: 1419912 - RNA, 22 nt, Human
uuagaaauauuuuaaaaucagc

SEQ ID NO: 1419913 - RNA, 13 nt, Human
uuagaaauauuuu

SEQ ID NO: 1419914 - RNA, 16 nt, Human
uuagaaagauaauuca

SEQ ID NO: 1419915 - RNA, 23 nt, Human
uuagaaagcauuugaaugcauuu

SEQ ID NO: 1419916 - RNA, 17 nt, Human
uuagaaagcauuugaau

SEQ ID NO: 1419917 - RNA, 18 nt, Human
uuagaaagcauuugaaug

SEQ ID NO: 1419918 - RNA, 19 nt, Human
uuagaaagcauuugaaugc

SEQ ID NO: 1419919 - RNA, 21 nt, Human
uuagaaagcauuugaaugcau

SEQ ID NO: 1419920 - RNA, 23 nt, Human
uuagaaauuaccuguggauauuu

SEQ ID NO: 1419921 - RNA, 19 nt, Human
uuagaaauuaccuguggau

SEQ ID NO: 1419922 - RNA, 16 nt, Human
uuagaaaugcagaauc

SEQ ID NO: 1419923 - RNA, 20 nt, Human
uuagaacacacacacuuacu

SEQ ID NO: 1419924 - RNA, 17 nt, Human
uuagaacacacacacuu

SEQ ID NO: 1419925 - RNA, 17 nt, Human
uuagaaauuuauuuccu

SEQ ID NO: 1419926 - RNA, 20 nt, Human
uuacaggcaugagccacugc

SEQ ID NO: 1419927 - RNA, 23 nt, Human
uuacccauuugggugggaguguu

SEQ ID NO: 1419928 - RNA, 19 nt, Human
uuacccucauguucuuaau

SEQ ID NO: 1419929 - RNA, 19 nt, Human
uuaccuccugagaaaaaag

SEQ ID NO: 1419930 - RNA, 11 nt, Human
uuaccuccuga

SEQ ID NO: 1419931 - RNA, 18 nt, Human
uuaccucagccugggcgc

SEQ ID NO: 1419932 - RNA, 20 nt, Human
uuaccucagccugggcgcug

SEQ ID NO: 1419933 - RNA, 15 nt, Human
uuaccucagccuggg

SEQ ID NO: 1419934 - RNA, 14 nt, Human
uuaccucagccugg

SEQ ID NO: 1419935 - RNA, 13 nt, Human
uuaccucagccug

SEQ ID NO: 1419936 - RNA, 12 nt, Human
uuaccucagccu

SEQ ID NO: 1419937 - RNA, 23 nt, Human
uuaccuacuuugacuuuuugcau

SEQ ID NO: 1419938 - RNA, 13 nt, Human
uuaccuacuuuga

SEQ ID NO: 1419939 - RNA, 18 nt, Human
uuaccuuauaguuacugu

SEQ ID NO: 1419940 - RNA, 13 nt, Human
uuaccuuugacaa

SEQ ID NO: 1419941 - RNA, 20 nt, Human
uuaccuuugacaaagguaaa

SEQ ID NO: 1419942 - RNA, 12 nt, Human
auaacccacuuu

SEQ ID NO: 1419943 - RNA, 19 nt, Human
auaaauuauuguuuuucuu

SEQ ID NO: 1419944 - RNA, 13 nt, Human
auaaauuauuguu

SEQ ID NO: 1419945 - RNA, 18 nt, Human
auaacguuuaagccaaaa

SEQ ID NO: 1419946 - RNA, 17 nt, Human
auaacguuuaagccaaa

SEQ ID NO: 1419947 - RNA, 18 nt, Human
auaacguguucaauauuu

SEQ ID NO: 1419948 - RNA, 20 nt, Human
auaacggaucagaaauacag

SEQ ID NO: 1419949 - RNA, 21 nt, Human
auaacggaucagaaauacaga

SEQ ID NO: 1419950 - RNA, 20 nt, Human
auaacguuuaagccaaaaca

SEQ ID NO: 1419951 - RNA, 22 nt, Human
auaacguuuaagccaaaacaau

SEQ ID NO: 1419952 - RNA, 22 nt, Human
auaacgauaaaagacagugaaa

SEQ ID NO: 1419953 - RNA, 14 nt, Human
auaaccuuaauuua

SEQ ID NO: 1419954 - RNA, 22 nt, Human
auaaccugucucaccuggacuu

SEQ ID NO: 1419955 - RNA, 14 nt, Human
auaacguauaaaag

SEQ ID NO: 1419956 - RNA, 13 nt, Human
auaaauaaaaaua

SEQ ID NO: 1419957 - RNA, 17 nt, Human
auaaagguucaugcaaa

SEQ ID NO: 1419958 - RNA, 15 nt, Human
uuaauuguaaaguaa

SEQ ID NO: 1419959 - RNA, 14 nt, Human
uuaauuguaaucug

SEQ ID NO: 1419960 - RNA, 14 nt, Human
uuaauuguaaagua

SEQ ID NO: 1419961 - RNA, 21 nt, Human
uuaauugggccagcuuuucaa

SEQ ID NO: 1419962 - RNA, 22 nt, Human
uuaauugggccagcuuuucaaa

SEQ ID NO: 1419963 - RNA, 18 nt, Human
uuaauugggccagcuuuu

SEQ ID NO: 1419964 - RNA, 15 nt, Human
auaaagguucaugca

SEQ ID NO: 1419965 - RNA, 14 nt, Human
auaaauaaaaauaa

SEQ ID NO: 1419966 - RNA, 21 nt, Human
auaaaguuuuauauauuauau

SEQ ID NO: 1419967 - RNA, 20 nt, Human
auaaaguuuuauauauuaua

SEQ ID NO: 1419968 - RNA, 18 nt, Human
auaaaguuuuauauauua

SEQ ID NO: 1419969 - RNA, 17 nt, Human
auaaaguuuuauauauu

SEQ ID NO: 1419970 - RNA, 14 nt, Human
auaaaguuuuauau

SEQ ID NO: 1419971 - RNA, 22 nt, Human
auaaaguuuuauauauuauaug

SEQ ID NO: 1419972 - RNA, 19 nt, Human
auaauucuuucaauacaga

SEQ ID NO: 1419973 - RNA, 15 nt, Human
auaauucuuucaaua

SEQ ID NO: 1419974 - RNA, 23 nt, Human
auaauucuuucaauacagauaua

SEQ ID NO: 1419975 - RNA, 15 nt, Human
auaaugcgugcauac

SEQ ID NO: 1419976 - RNA, 20 nt, Human
auaaugcgugcauaccacuu

SEQ ID NO: 1419977 - RNA, 15 nt, Human
auaaucuagaacaca

SEQ ID NO: 1419978 - RNA, 12 nt, Human
auaaucuagaac

SEQ ID NO: 1419979 - RNA, 13 nt, Human
auaauagauucuc

SEQ ID NO: 1419980 - RNA, 18 nt, Human
auaauccuaaacauauga

SEQ ID NO: 1419981 - RNA, 17 nt, Human
auaagaauuauuuugau

SEQ ID NO: 1419982 - RNA, 16 nt, Human
auaagaauucagacau

SEQ ID NO: 1419983 - RNA, 15 nt, Human
auaagagaaucaaca

SEQ ID NO: 1419984 - RNA, 14 nt, Human
auaauaaagaauag

SEQ ID NO: 1419985 - RNA, 13 nt, Human
auaauaaagaaua

SEQ ID NO: 1419986 - RNA, 23 nt, Human
auaauaaagaauagcuuuaauga

SEQ ID NO: 1419987 - RNA, 11 nt, Human
auaauaaagga

SEQ ID NO: 1419988 - RNA, 13 nt, Human
auaauaaaggacu

SEQ ID NO: 1419989 - RNA, 18 nt, Human
auaauaaaggacuguaau

SEQ ID NO: 1419990 - RNA, 15 nt, Human
auaauaaauguacau

SEQ ID NO: 1419991 - RNA, 12 nt, Human
auaauacaccac

SEQ ID NO: 1419992 - RNA, 18 nt, Human
auaauacaccacuacauu

SEQ ID NO: 1419993 - RNA, 20 nt, Human
auaauacaccacuacauucu

SEQ ID NO: 1419994 - RNA, 21 nt, Human
auaauacugcugagauacaua

SEQ ID NO: 1419995 - RNA, 21 nt, Human
auaauacaccacuacauucug

SEQ ID NO: 1419996 - RNA, 12 nt, Human
auaauagauucu

SEQ ID NO: 1419997 - RNA, 22 nt, Human
auaauacugcugagauacauac

SEQ ID NO: 1419998 - RNA, 19 nt, Human
auaauacuugcuuuggaaa

SEQ ID NO: 1419999 - RNA, 14 nt, Human
uuagccuucucugu

SEQ ID NO: 1420000 - RNA, 12 nt, Human
uuagccuucucu

SEQ ID NO: 1420001 - RNA, 14 nt, Human
uuagccuguccugu

SEQ ID NO: 1420002 - RNA, 22 nt, Human
uuagccuggaccucugacagca

SEQ ID NO: 1420003 - RNA, 17 nt, Human
uuagccuucucuguuca

SEQ ID NO: 1420004 - RNA, 15 nt, Human
uuagccuucucuguu

SEQ ID NO: 1420005 - RNA, 23 nt, Human
uuagccuuuuuuccccagacuug

SEQ ID NO: 1420006 - RNA, 20 nt, Human
uuagccuuuuuuccccagac

SEQ ID NO: 1420007 - RNA, 18 nt, Human
uuagccuuuuuuccccag

SEQ ID NO: 1420008 - RNA, 17 nt, Human
uuagccuuuuuucccca

SEQ ID NO: 1420009 - RNA, 12 nt, Human
uuagccuguccu

SEQ ID NO: 1420010 - RNA, 21 nt, Human
uuagccuucucuguucauuuc

SEQ ID NO: 1420011 - RNA, 22 nt, Human
uuagcauuguagugcuuugaga

SEQ ID NO: 1420012 - RNA, 19 nt, Human
uuagcauguuguugaaagg

SEQ ID NO: 1420013 - RNA, 19 nt, Human
auaauuguuguucuguuaa

SEQ ID NO: 1420014 - RNA, 18 nt, Human
auaauuguuguucuguua

SEQ ID NO: 1420015 - RNA, 17 nt, Human
auaauuguuguucuguu

SEQ ID NO: 1420016 - RNA, 15 nt, Human
auaauuguuguucug

SEQ ID NO: 1420017 - RNA, 15 nt, Human
auaauuguucucaga

SEQ ID NO: 1420018 - RNA, 23 nt, Human
auaauuguucucagaaucccuua

SEQ ID NO: 1420019 - RNA, 22 nt, Human
auaauuguuguucuguuaacug

SEQ ID NO: 1420020 - RNA, 21 nt, Human
auaauuguuguucuguuaacu

SEQ ID NO: 1420021 - RNA, 21 nt, Human
auaauuguuuuaucugaauuu

SEQ ID NO: 1420022 - RNA, 16 nt, Human
auaauuuaccuaagau

SEQ ID NO: 1420023 - RNA, 13 nt, Human
auaauuuaccuaa

SEQ ID NO: 1420024 - RNA, 22 nt, Human
uuagcaaagauaucucaucucu

SEQ ID NO: 1420025 - RNA, 23 nt, Human
auaauuguuguucuguuaacuga

SEQ ID NO: 1420026 - RNA, 23 nt, Human
auaauuuaccuaagauuacaaau

SEQ ID NO: 1420027 - RNA, 20 nt, Human
uuaguuuccuuuuuaauaug

SEQ ID NO: 1420028 - RNA, 11 nt, Human
uuaguuuccuu

SEQ ID NO: 1420029 - RNA, 22 nt, Human
uuaguuucaguagauugcagaa

SEQ ID NO: 1420030 - RNA, 23 nt, Human
uuaguaacauguguuaaguauuu

SEQ ID NO: 1420031 - RNA, 12 nt, Human
uuaguaacaugu

SEQ ID NO: 1420032 - RNA, 12 nt, Human
uuaguaaaccaa

SEQ ID NO: 1420033 - RNA, 18 nt, Human
uuaguaaagucaaggaga

SEQ ID NO: 1420034 - RNA, 14 nt, Human
uuaggugucugucc

SEQ ID NO: 1420035 - RNA, 15 nt, Human
uuaguuuguguguug

SEQ ID NO: 1420036 - RNA, 15 nt, Human
uuaguuuguauauau

SEQ ID NO: 1420037 - RNA, 22 nt, Human
uuaggugcaauuucaagguucu

SEQ ID NO: 1420038 - RNA, 18 nt, Human
uuaggugcaauuucaagg

SEQ ID NO: 1420039 - RNA, 21 nt, Human
uuaggugugacugaauuucuu

SEQ ID NO: 1420040 - RNA, 16 nt, Human
uuaggugugacugaau

SEQ ID NO: 1420041 - RNA, 14 nt, Human
uuagggaagggccu

SEQ ID NO: 1420042 - RNA, 21 nt, Human
uuagccuuuuuuccccagacu

SEQ ID NO: 1420043 - RNA, 15 nt, Human
uuagggaaaacauuc

SEQ ID NO: 1420044 - RNA, 16 nt, Human
uuagggaacaauuugg

SEQ ID NO: 1420045 - RNA, 17 nt, Human
uuagggaaaacauucca

SEQ ID NO: 1420046 - RNA, 20 nt, Human
uuagggaaggauacaaaagc

SEQ ID NO: 1420047 - RNA, 13 nt, Human
auauauguacagu

SEQ ID NO: 1420048 - RNA, 12 nt, Human
auauauguauuu

SEQ ID NO: 1420049 - RNA, 15 nt, Human
auauauguauauaca

SEQ ID NO: 1420050 - RNA, 14 nt, Human
auauauguacaguu

SEQ ID NO: 1420051 - RNA, 24 nt, Human
uucaucccaaaggacagccgccug

SEQ ID NO: 1420052 - RNA, 17 nt, Human
uucauccauaacugaac

SEQ ID NO: 1420053 - RNA, 15 nt, Human
uucauccauaacuga

SEQ ID NO: 1420054 - RNA, 23 nt, Human
uucauauuguugcauugcuuuuu

SEQ ID NO: 1420055 - RNA, 21 nt, Human
uucaucccacuccaacucuuc

SEQ ID NO: 1420056 - RNA, 16 nt, Human
auauauuuaaaaauaa

SEQ ID NO: 1420057 - RNA, 14 nt, Human
auauauugaauuaa

SEQ ID NO: 1420058 - RNA, 13 nt, Human
auauauugaauua

SEQ ID NO: 1420059 - RNA, 18 nt, Human
auauauuuaaaaguguca

SEQ ID NO: 1420060 - RNA, 12 nt, Human
auauauuuuaag

SEQ ID NO: 1420061 - RNA, 13 nt, Human
auauauuuuaaga

SEQ ID NO: 1420062 - RNA, 22 nt, Human
uucagaaaugaggccauggacu

SEQ ID NO: 1420063 - RNA, 11 nt, Human
uucagaaaugu

SEQ ID NO: 1420064 - RNA, 13 nt, Human
uucagaaaugugu

SEQ ID NO: 1420065 - RNA, 20 nt, Human
uucauauguaccauguacau

SEQ ID NO: 1420066 - RNA, 19 nt, Human
uucauaauuauuauuuggc

SEQ ID NO: 1420067 - RNA, 19 nt, Human
auauguacccucugaaaua

SEQ ID NO: 1420068 - RNA, 17 nt, Human
auauguacccucugaaa

SEQ ID NO: 1420069 - RNA, 19 nt, Human
auauguaccauguacauga

SEQ ID NO: 1420070 - RNA, 14 nt, Human
auauguaccaugua

SEQ ID NO: 1420071 - RNA, 11 nt, Human
auauguaccaa

SEQ ID NO: 1420072 - RNA, 14 nt, Human
auauguacaugaga

SEQ ID NO: 1420073 - RNA, 16 nt, Human
auauguacaguuaucu

SEQ ID NO: 1420074 - RNA, 14 nt, Human
auauguacaguuau

SEQ ID NO: 1420075 - RNA, 22 nt, Human
auauguaaaugguaugucauuc

SEQ ID NO: 1420076 - RNA, 24 nt, Human
auauguaaaacauuuauuuugaca

SEQ ID NO: 1420077 - RNA, 18 nt, Human
auauguaaaacauuuauu

SEQ ID NO: 1420078 - RNA, 16 nt, Human
auauguaaaacauuua

SEQ ID NO: 1420079 - RNA, 15 nt, Human
auauguaaaacauuu

SEQ ID NO: 1420080 - RNA, 14 nt, Human
auauguaaaacauu

SEQ ID NO: 1420081 - RNA, 13 nt, Human
auauguaaaacau

SEQ ID NO: 1420082 - RNA, 12 nt, Human
auauguaaaaca

SEQ ID NO: 1420083 - RNA, 13 nt, Human
auaugaaagcuga

SEQ ID NO: 1420084 - RNA, 17 nt, Human
auaugaucugucugugg

SEQ ID NO: 1420085 - RNA, 16 nt, Human
auaugaucugucugug

SEQ ID NO: 1420086 - RNA, 15 nt, Human
auaugaucugucugu

SEQ ID NO: 1420087 - RNA, 15 nt, Human
auaugauguuaaaaa

SEQ ID NO: 1420088 - RNA, 21 nt, Human
auaugauguuaaaaaaauaag

SEQ ID NO: 1420089 - RNA, 12 nt, Human
auaugauucaaa

SEQ ID NO: 1420090 - RNA, 14 nt, Human
auaugcacacauuu

SEQ ID NO: 1420091 - RNA, 15 nt, Human
auaugcacacauuuu

SEQ ID NO: 1420092 - RNA, 16 nt, Human
auaugcacacauuuuu

SEQ ID NO: 1420093 - RNA, 22 nt, Human
auaugcacacauuuuuuaaaug

SEQ ID NO: 1420094 - RNA, 23 nt, Human
auaucuccugaaaagguuuauga

SEQ ID NO: 1420095 - RNA, 22 nt, Human
auaucuccugaaaagguuuaug

SEQ ID NO: 1420096 - RNA, 15 nt, Human
auaucuccugaaaag

SEQ ID NO: 1420097 - RNA, 13 nt, Human
auaucuccugaaa

SEQ ID NO: 1420098 - RNA, 12 nt, Human
auaucucaucuc

SEQ ID NO: 1420099 - RNA, 21 nt, Human
auaucuccgucaacucauauu

SEQ ID NO: 1420100 - RNA, 20 nt, Human
auaucuccgucaacucauau

SEQ ID NO: 1420101 - RNA, 19 nt, Human
auaucuccgucaacucaua

SEQ ID NO: 1420102 - RNA, 14 nt, Human
auauauuuuaagac

SEQ ID NO: 1420103 - RNA, 15 nt, Human
auauauuuuaagacg

SEQ ID NO: 1420104 - RNA, 22 nt, Human
uuccagguagcugaaaggggaa

SEQ ID NO: 1420105 - RNA, 20 nt, Human
uuccagggucccucugugua

SEQ ID NO: 1420106 - RNA, 19 nt, Human
uuccagggucccucugugu

SEQ ID NO: 1420107 - RNA, 18 nt, Human
uuccagggucccucugug

SEQ ID NO: 1420108 - RNA, 16 nt, Human
uuccagggucccucug

SEQ ID NO: 1420109 - RNA, 23 nt, Human
uucccaaaggcauuauaaaaaga

SEQ ID NO: 1420110 - RNA, 14 nt, Human
uucccacgaggaau

SEQ ID NO: 1420111 - RNA, 21 nt, Human
uucccaccccaaccugcucuc

SEQ ID NO: 1420112 - RNA, 20 nt, Human
uucccaccccaaccugcucu

SEQ ID NO: 1420113 - RNA, 22 nt, Human
uucccaccccaaccugcucucc

SEQ ID NO: 1420114 - RNA, 21 nt, Human
uucccacccaauucaaaacau

SEQ ID NO: 1420115 - RNA, 18 nt, Human
uucccaccaggcugcuca

SEQ ID NO: 1420116 - RNA, 16 nt, Human
uucccacauuaaagaa

SEQ ID NO: 1420117 - RNA, 18 nt, Human
uucccacaggacauuucu

SEQ ID NO: 1420118 - RNA, 14 nt, Human
uucccaauucacau

SEQ ID NO: 1420119 - RNA, 23 nt, Human
uucccaagugagucucucugggc

SEQ ID NO: 1420120 - RNA, 16 nt, Human
uucccaagggcugccg

SEQ ID NO: 1420121 - RNA, 13 nt, Human
uucccaagggcug

SEQ ID NO: 1420122 - RNA, 11 nt, Human
uucccaagcuc

SEQ ID NO: 1420123 - RNA, 22 nt, Human
uucccaagagcaucaugccucu

SEQ ID NO: 1420124 - RNA, 21 nt, Human
uucccaagagcaucaugccuc

SEQ ID NO: 1420125 - RNA, 20 nt, Human
uucccaagagcaucaugccu

SEQ ID NO: 1420126 - RNA, 15 nt, Human
uucccaacacaaaga

SEQ ID NO: 1420127 - RNA, 13 nt, Human
uucccaacacaaa

SEQ ID NO: 1420128 - RNA, 18 nt, Human
uucccaacuccagaaagu

SEQ ID NO: 1420129 - RNA, 16 nt, Human
uuccaaguugcuaaua

SEQ ID NO: 1420130 - RNA, 15 nt, Human
uuccaagucuccacc

SEQ ID NO: 1420131 - RNA, 17 nt, Human
uuccaagagucuaaaga

SEQ ID NO: 1420132 - RNA, 15 nt, Human
uuccaagagucuaaa

SEQ ID NO: 1420133 - RNA, 22 nt, Human
uuccacaccuuuuauugacaca

SEQ ID NO: 1420134 - RNA, 15 nt, Human
uuccacaccuuuuau

SEQ ID NO: 1420135 - RNA, 17 nt, Human
uuccagcugucccccca

SEQ ID NO: 1420136 - RNA, 18 nt, Human
uuccagcuggaugagaau

SEQ ID NO: 1420137 - RNA, 11 nt, Human
uuccagcuccu

SEQ ID NO: 1420138 - RNA, 14 nt, Human
uuccagcuccugua

SEQ ID NO: 1420139 - RNA, 23 nt, Human
uuccagcuagugacccacaugcc

SEQ ID NO: 1420140 - RNA, 24 nt, Human
uuccagcuagugacccacaugcca

SEQ ID NO: 1420141 - RNA, 12 nt, Human
uuccacccaggg

SEQ ID NO: 1420142 - RNA, 12 nt, Human
uuccacagacgg

SEQ ID NO: 1420143 - RNA, 10 nt, Human
uuccacagac

SEQ ID NO: 1420144 - RNA, 13 nt, Human
uuccacagaggac

SEQ ID NO: 1420145 - RNA, 21 nt, Human
uuccacccaggggcagcccca

SEQ ID NO: 1420146 - RNA, 19 nt, Human
uuccacccaggggcagccc

SEQ ID NO: 1420147 - RNA, 23 nt, Human
uuccacccagugcugaauuuccc

SEQ ID NO: 1420148 - RNA, 21 nt, Human
uucauuuagcuaaacggauuc

SEQ ID NO: 1420149 - RNA, 14 nt, Human
uuccaagagucuaa

SEQ ID NO: 1420150 - RNA, 13 nt, Human
uuccaagagucua

SEQ ID NO: 1420151 - RNA, 12 nt, Human
uuccaagagucu

SEQ ID NO: 1420152 - RNA, 9 nt, Human
uucauucag

SEQ ID NO: 1420153 - RNA, 19 nt, Human
auaugugcuggaauucuaa

SEQ ID NO: 1420154 - RNA, 18 nt, Human
auaugugcuggaauucua

SEQ ID NO: 1420155 - RNA, 16 nt, Human
uucauuccauucugga

SEQ ID NO: 1420156 - RNA, 12 nt, Human
uucauuccucca

SEQ ID NO: 1420157 - RNA, 13 nt, Human
uucauuccuccag

SEQ ID NO: 1420158 - RNA, 13 nt, Human
uucauucugcaag

SEQ ID NO: 1420159 - RNA, 18 nt, Human
uucauucugcaaguauac

SEQ ID NO: 1420160 - RNA, 18 nt, Human
uucauucucccuuucacu

SEQ ID NO: 1420161 - RNA, 21 nt, Human
uucauuccuucagauuuggcu

SEQ ID NO: 1420162 - RNA, 22 nt, Human
uucauuccuucagauuuggcuu

SEQ ID NO: 1420163 - RNA, 14 nt, Human
uucauuccuccagg

SEQ ID NO: 1420164 - RNA, 22 nt, Human
auaguuuucauccauaacugaa

SEQ ID NO: 1420165 - RNA, 23 nt, Human
auaguuuucauccauaacugaac

SEQ ID NO: 1420166 - RNA, 20 nt, Human
auaguuuucauccauaacug

SEQ ID NO: 1420167 - RNA, 13 nt, Human
auaguuuucaucc

SEQ ID NO: 1420168 - RNA, 12 nt, Human
auaguucuaggc

SEQ ID NO: 1420169 - RNA, 23 nt, Human
auaguucuagacauggagguucu

SEQ ID NO: 1420170 - RNA, 14 nt, Human
auaguucuagacau

SEQ ID NO: 1420171 - RNA, 13 nt, Human
auaguucuagaca

SEQ ID NO: 1420172 - RNA, 12 nt, Human
auaguucuagac

SEQ ID NO: 1420173 - RNA, 15 nt, Human
auaguuccugcuaaa

SEQ ID NO: 1420174 - RNA, 18 nt, Human
auaguucagaauuuagug

SEQ ID NO: 1420175 - RNA, 21 nt, Human
auaguucagaauuuaguguau

SEQ ID NO: 1420176 - RNA, 16 nt, Human
auaguuagcuaauaaa

SEQ ID NO: 1420177 - RNA, 15 nt, Human
auaguuagaaccugg

SEQ ID NO: 1420178 - RNA, 20 nt, Human
auaguuacuguguaauuagu

SEQ ID NO: 1420179 - RNA, 18 nt, Human
auaguuacuguguaauua

SEQ ID NO: 1420180 - RNA, 17 nt, Human
auaguuacuguguaauu

SEQ ID NO: 1420181 - RNA, 14 nt, Human
auaguuacugugua

SEQ ID NO: 1420182 - RNA, 13 nt, Human
auaguuacugugu

SEQ ID NO: 1420183 - RNA, 17 nt, Human
auaguuaacacacuacc

SEQ ID NO: 1420184 - RNA, 15 nt, Human
auaguuaacacacua

SEQ ID NO: 1420185 - RNA, 14 nt, Human
auaguuaacacacu

SEQ ID NO: 1420186 - RNA, 19 nt, Human
auaguguagcugaggaggc

SEQ ID NO: 1420187 - RNA, 15 nt, Human
auaguggugugauuu

SEQ ID NO: 1420188 - RNA, 13 nt, Human
auagugaauacug

SEQ ID NO: 1420189 - RNA, 18 nt, Human
auagucuuuuucaguucc

SEQ ID NO: 1420190 - RNA, 16 nt, Human
auagucuuuggagaaa

SEQ ID NO: 1420191 - RNA, 17 nt, Human
auagucuuuugcuuuug

SEQ ID NO: 1420192 - RNA, 16 nt, Human
auagucuuuugcuuuu

SEQ ID NO: 1420193 - RNA, 14 nt, Human
auagucuuuugcuu

SEQ ID NO: 1420194 - RNA, 20 nt, Human
auagugauguaaucuugaau

SEQ ID NO: 1420195 - RNA, 20 nt, Human
auaggcggggcuugccuucu

SEQ ID NO: 1420196 - RNA, 19 nt, Human
auaggcggggcuugccuuc

SEQ ID NO: 1420197 - RNA, 21 nt, Human
auaggcgaucacaacgugcau

SEQ ID NO: 1420198 - RNA, 14 nt, Human
auagucucuuuaaa

SEQ ID NO: 1420199 - RNA, 21 nt, Human
auagucucuuuaaaaggaaag

SEQ ID NO: 1420200 - RNA, 24 nt, Human
auauaaaguaucaucaguguagaa

SEQ ID NO: 1420201 - RNA, 19 nt, Human
auauaaaguaguccuguga

SEQ ID NO: 1420202 - RNA, 19 nt, Human
auauaaaguuuuauauauu

SEQ ID NO: 1420203 - RNA, 22 nt, Human
auauaaaguuuuauauauuaua

SEQ ID NO: 1420204 - RNA, 17 nt, Human
auauaaaguuuuauaua

SEQ ID NO: 1420205 - RNA, 13 nt, Human
auauaaaguuuua

SEQ ID NO: 1420206 - RNA, 20 nt, Human
auauaacuguauuugaaaua

SEQ ID NO: 1420207 - RNA, 17 nt, Human
auauaacuguauuugaa

SEQ ID NO: 1420208 - RNA, 13 nt, Human
auauaacuaacaa

SEQ ID NO: 1420209 - RNA, 20 nt, Human
auauauaaguguacauaugu

SEQ ID NO: 1420210 - RNA, 16 nt, Human
auauauaaguguacau

SEQ ID NO: 1420211 - RNA, 15 nt, Human
auauauaaguguaca

SEQ ID NO: 1420212 - RNA, 13 nt, Human
auauauaaccagu

SEQ ID NO: 1420213 - RNA, 19 nt, Human
auauauaaauauauuauua

SEQ ID NO: 1420214 - RNA, 18 nt, Human
auauauaaauauauuauu

SEQ ID NO: 1420215 - RNA, 14 nt, Human
auauauaaauauau

SEQ ID NO: 1420216 - RNA, 12 nt, Human
auauauaaccag

SEQ ID NO: 1420217 - RNA, 10 nt, Human
auauauaaau

SEQ ID NO: 1420218 - RNA, 13 nt, Human
auauauaaauaua

SEQ ID NO: 1420219 - RNA, 11 nt, Human
auauauaaaua

SEQ ID NO: 1420220 - RNA, 14 nt, Human
auauauaacaaugc

SEQ ID NO: 1420221 - RNA, 24 nt, Human
auauaucuaccccagacuagaugu

SEQ ID NO: 1420222 - RNA, 19 nt, Human
uucacugucuuuaauucug

SEQ ID NO: 1420223 - RNA, 20 nt, Human
uucacugucaccacccugcu

SEQ ID NO: 1420224 - RNA, 23 nt, Human
uucacugucaccacccugcucau

SEQ ID NO: 1420225 - RNA, 13 nt, Human
auauaugaggacu

SEQ ID NO: 1420226 - RNA, 22 nt, Human
uucacuuaaguuaguuccacug

SEQ ID NO: 1420227 - RNA, 16 nt, Human
uucacugucuuuaauu

SEQ ID NO: 1420228 - RNA, 15 nt, Human
auauauauauaaaga

SEQ ID NO: 1420229 - RNA, 14 nt, Human
auauauauaaauau

SEQ ID NO: 1420230 - RNA, 15 nt, Human
auauauauaaauaua

SEQ ID NO: 1420231 - RNA, 15 nt, Human
auauauauauguaca

SEQ ID NO: 1420232 - RNA, 14 nt, Human
auauauauauaugu

SEQ ID NO: 1420233 - RNA, 16 nt, Human
auauauauauauaugu

SEQ ID NO: 1420234 - RNA, 16 nt, Human
auauauauuaucuuuu

SEQ ID NO: 1420235 - RNA, 14 nt, Human
auauauauuauacu

SEQ ID NO: 1420236 - RNA, 12 nt, Human
auauauauuaua

SEQ ID NO: 1420237 - RNA, 20 nt, Human
auauauauguacaguuaucu

SEQ ID NO: 1420238 - RNA, 16 nt, Human
auauauauguacaguu

SEQ ID NO: 1420239 - RNA, 15 nt, Human
auauauauguacagu

SEQ ID NO: 1420240 - RNA, 15 nt, Human
auauaucaugaguga

SEQ ID NO: 1420241 - RNA, 21 nt, Human
auauaucacccagacauaaag

SEQ ID NO: 1420242 - RNA, 17 nt, Human
auauaucacccagacau

SEQ ID NO: 1420243 - RNA, 20 nt, Human
auauauauuaucuuuucaua

SEQ ID NO: 1420244 - RNA, 23 nt, Human
auauauauucuauuacauuuuca

SEQ ID NO: 1420245 - RNA, 21 nt, Human
auauauauuuuuuucugaaau

SEQ ID NO: 1420246 - RNA, 16 nt, Human
uucaagcucugaggga

SEQ ID NO: 1420247 - RNA, 14 nt, Human
uucaagcucugagg

SEQ ID NO: 1420248 - RNA, 12 nt, Human
uucaagcucuga

SEQ ID NO: 1420249 - RNA, 21 nt, Human
uucaagcgauucuccugccuc

SEQ ID NO: 1420250 - RNA, 16 nt, Human
uucaaggaauuucuua

SEQ ID NO: 1420251 - RNA, 14 nt, Human
uucaagguucuaac

SEQ ID NO: 1420252 - RNA, 17 nt, Human
uucaaggucugcuuuuc

SEQ ID NO: 1420253 - RNA, 22 nt, Human
uucaagcagucgugccuguguc

SEQ ID NO: 1420254 - RNA, 18 nt, Human
uucaagcagucgugccug

SEQ ID NO: 1420255 - RNA, 17 nt, Human
uucaagcagucgugccu

SEQ ID NO: 1420256 - RNA, 23 nt, Human
uucaagcagucgugccugugucc

SEQ ID NO: 1420257 - RNA, 20 nt, Human
uucaagccugugcaaugcau

SEQ ID NO: 1420258 - RNA, 18 nt, Human
uucaagcgauucuccugc

SEQ ID NO: 1420259 - RNA, 22 nt, Human
uucaagaggagcccccacccug

SEQ ID NO: 1420260 - RNA, 21 nt, Human
uucaagaggagcccccacccu

SEQ ID NO: 1420261 - RNA, 15 nt, Human
uucaagaggagcccc

SEQ ID NO: 1420262 - RNA, 23 nt, Human
uucaagaggagcccccacccugu

SEQ ID NO: 1420263 - RNA, 14 nt, Human
uucaagcaauccuc

SEQ ID NO: 1420264 - RNA, 16 nt, Human
uucaagcaauccuccc

SEQ ID NO: 1420265 - RNA, 16 nt, Human
uucaaaaguuccaaga

SEQ ID NO: 1420266 - RNA, 20 nt, Human
uucaaaaguuuguuugcuua

SEQ ID NO: 1420267 - RNA, 21 nt, Human
uucaaaauuguuacaaauugu

SEQ ID NO: 1420268 - RNA, 15 nt, Human
uucaaaaguuccaag

SEQ ID NO: 1420269 - RNA, 14 nt, Human
uucaaaaguuccaa

SEQ ID NO: 1420270 - RNA, 12 nt, Human
uucaaaaguucc

SEQ ID NO: 1420271 - RNA, 20 nt, Human
uucaaaaccagguccaauga

SEQ ID NO: 1420272 - RNA, 13 nt, Human
uucaaaagaaagu

SEQ ID NO: 1420273 - RNA, 23 nt, Human
uucaagaauaaucacgcuuuccu

SEQ ID NO: 1420274 - RNA, 14 nt, Human
uucaaacauauaua

SEQ ID NO: 1420275 - RNA, 16 nt, Human
uuaguuuuucauuaaa

SEQ ID NO: 1420276 - RNA, 17 nt, Human
uuaguuuuucauuaaau

SEQ ID NO: 1420277 - RNA, 13 nt, Human
uuaguuuuucauu

SEQ ID NO: 1420278 - RNA, 12 nt, Human
uuaguuuugauu

SEQ ID NO: 1420279 - RNA, 16 nt, Human
uuaguuuugaugaguu

SEQ ID NO: 1420280 - RNA, 16 nt, Human
uuaguuuguguguugu

SEQ ID NO: 1420281 - RNA, 23 nt, Human
uuauuuuuggcguggcugacuua

SEQ ID NO: 1420282 - RNA, 23 nt, Human
uuauuuuugacaguguugaaaau

SEQ ID NO: 1420283 - RNA, 14 nt, Human
uuauuuuucuuguc

SEQ ID NO: 1420284 - RNA, 16 nt, Human
uuauuuuuuaauuauu

SEQ ID NO: 1420285 - RNA, 14 nt, Human
uuauuuuuuaauua

SEQ ID NO: 1420286 - RNA, 13 nt, Human
uuauuuuuuucug

SEQ ID NO: 1420287 - RNA, 17 nt, Human
uuauuuuuuucugaauu

SEQ ID NO: 1420288 - RNA, 18 nt, Human
uucaaaacauugugccau

SEQ ID NO: 1420289 - RNA, 17 nt, Human
uucaaaaccuuuugaaa

SEQ ID NO: 1420290 - RNA, 12 nt, Human
uucaaaagaaag

SEQ ID NO: 1420291 - RNA, 13 nt, Human
uucacaauguuaa

SEQ ID NO: 1420292 - RNA, 15 nt, Human
uucaagguucuaacc

SEQ ID NO: 1420293 - RNA, 13 nt, Human
uucacaucucauu

SEQ ID NO: 1420294 - RNA, 20 nt, Human
uucacaucuaaccucaucuu

SEQ ID NO: 1420295 - RNA, 19 nt, Human
uucacaucuaaccucaucu

SEQ ID NO: 1420296 - RNA, 18 nt, Human
uucacaucuaaccucauc

SEQ ID NO: 1420297 - RNA, 21 nt, Human
uucacaucgcagauucucccu

SEQ ID NO: 1420298 - RNA, 22 nt, Human
uucacaguuugaaauaagcuau

SEQ ID NO: 1420299 - RNA, 23 nt, Human
uucacaguuugaaauaagcuauu

SEQ ID NO: 1420300 - RNA, 17 nt, Human
uucacaguuugaaauaa

SEQ ID NO: 1420301 - RNA, 16 nt, Human
uucacaguuugaaaua

SEQ ID NO: 1420302 - RNA, 14 nt, Human
uucacaguuugaaa

SEQ ID NO: 1420303 - RNA, 21 nt, Human
uucacaguucuuugggccaga

SEQ ID NO: 1420304 - RNA, 20 nt, Human
uucacaguucuuugggccag

SEQ ID NO: 1420305 - RNA, 12 nt, Human
uucacagcuccu

SEQ ID NO: 1420306 - RNA, 19 nt, Human
uucacagccuauaaccaga

SEQ ID NO: 1420307 - RNA, 13 nt, Human
uucacagaaaaua

SEQ ID NO: 1420308 - RNA, 23 nt, Human
auaggaccuuuccaccacagcca

SEQ ID NO: 1420309 - RNA, 20 nt, Human
auaggaccuuuccaccacag

SEQ ID NO: 1420310 - RNA, 14 nt, Human
auaggaccuuucca

SEQ ID NO: 1420311 - RNA, 17 nt, Human
auaggcguaacuaauuu

SEQ ID NO: 1420312 - RNA, 15 nt, Human
uucacauuagaagac

SEQ ID NO: 1420313 - RNA, 16 nt, Human
uucacauuagaagaca

SEQ ID NO: 1420314 - RNA, 15 nt, Human
auagcuuuuuucucu

SEQ ID NO: 1420315 - RNA, 22 nt, Human
auagcuuuucccuuuuuuuaag

SEQ ID NO: 1420316 - RNA, 19 nt, Human
uucuugcuucuuucuagaa

SEQ ID NO: 1420317 - RNA, 17 nt, Human
uucuugcuucuuucuag

SEQ ID NO: 1420318 - RNA, 13 nt, Human
uucuugcaaagua

SEQ ID NO: 1420319 - RNA, 19 nt, Human
uucuugaggggaccaggag

SEQ ID NO: 1420320 - RNA, 20 nt, Human
uucuugaggggaccaggagu

SEQ ID NO: 1420321 - RNA, 23 nt, Human
uucuugaggggaagcuagucuuu

SEQ ID NO: 1420322 - RNA, 21 nt, Human
uucuugaggggaagcuagucu

SEQ ID NO: 1420323 - RNA, 21 nt, Human
uucuugaauuuaauaaucugu

SEQ ID NO: 1420324 - RNA, 19 nt, Human
uucuugauguaaaaucuug

SEQ ID NO: 1420325 - RNA, 20 nt, Human
uucuugauguaaaaucuugu

SEQ ID NO: 1420326 - RNA, 15 nt, Human
uucuugauguaaaau

SEQ ID NO: 1420327 - RNA, 14 nt, Human
uucuugauguaaaa

SEQ ID NO: 1420328 - RNA, 12 nt, Human
uucuugcaaagu

SEQ ID NO: 1420329 - RNA, 17 nt, Human
uucuuuguuucuuucuu

SEQ ID NO: 1420330 - RNA, 19 nt, Human
uucuuuguguagcuuugcu

SEQ ID NO: 1420331 - RNA, 12 nt, Human
uucuuuguguag

SEQ ID NO: 1420332 - RNA, 19 nt, Human
uucuuugaaaaaaaauaaa

SEQ ID NO: 1420333 - RNA, 20 nt, Human
uucuuugaaaaaaaauaaau

SEQ ID NO: 1420334 - RNA, 20 nt, Human
uucuuucuuagaaauuuauu

SEQ ID NO: 1420335 - RNA, 16 nt, Human
uucuuucuuugggaau

SEQ ID NO: 1420336 - RNA, 13 nt, Human
uucuuucuuagaa

SEQ ID NO: 1420337 - RNA, 16 nt, Human
uucuugguugaggaaa

SEQ ID NO: 1420338 - RNA, 14 nt, Human
uucuuucuuagaaa

SEQ ID NO: 1420339 - RNA, 15 nt, Human
uucuuucuuagaaau

SEQ ID NO: 1420340 - RNA, 22 nt, Human
uucuuucuggcuaugcauuuga

SEQ ID NO: 1420341 - RNA, 13 nt, Human
uucuuccuggccg

SEQ ID NO: 1420342 - RNA, 14 nt, Human
uucuuccuggccgc

SEQ ID NO: 1420343 - RNA, 17 nt, Human
uucuuaaacacuugcaa

SEQ ID NO: 1420344 - RNA, 16 nt, Human
uucuuaaacacuugca

SEQ ID NO: 1420345 - RNA, 20 nt, Human
uucuuaaagugccaguauuu

SEQ ID NO: 1420346 - RNA, 15 nt, Human
uucuuaaagugccag

SEQ ID NO: 1420347 - RNA, 13 nt, Human
uucuuaauucuua

SEQ ID NO: 1420348 - RNA, 14 nt, Human
uucuuaaaaaguua

SEQ ID NO: 1420349 - RNA, 17 nt, Human
uucuguuuuguuucgcu

SEQ ID NO: 1420350 - RNA, 18 nt, Human
aucccaccuccaucccag

SEQ ID NO: 1420351 - RNA, 18 nt, Human
uucuguucuuucuggcua

SEQ ID NO: 1420352 - RNA, 13 nt, Human
uucuuuucccccu

SEQ ID NO: 1420353 - RNA, 12 nt, Human
uugaaauaagcu

SEQ ID NO: 1420354 - RNA, 21 nt, Human
uugaaauaagaauucagacau

SEQ ID NO: 1420355 - RNA, 16 nt, Human
uugaaauaagaauuca

SEQ ID NO: 1420356 - RNA, 15 nt, Human
uugaaauaagcuauu

SEQ ID NO: 1420357 - RNA, 20 nt, Human
uugaaagugggcaaaagcuu

SEQ ID NO: 1420358 - RNA, 19 nt, Human
uugaaagugggcaaaagcu

SEQ ID NO: 1420359 - RNA, 16 nt, Human
uucuuuuugaaguauu

SEQ ID NO: 1420360 - RNA, 18 nt, Human
uucuuuuugaaguauuua

SEQ ID NO: 1420361 - RNA, 15 nt, Human
uucuuuuugaaguau

SEQ ID NO: 1420362 - RNA, 18 nt, Human
uugaacacaaacuguaaa

SEQ ID NO: 1420363 - RNA, 15 nt, Human
uugaacacaaacugu

SEQ ID NO: 1420364 - RNA, 14 nt, Human
uugaacacaaacug

SEQ ID NO: 1420365 - RNA, 21 nt, Human
uugaaauauggucuuuugguu

SEQ ID NO: 1420366 - RNA, 18 nt, Human
uugaaauauccugcuuga

SEQ ID NO: 1420367 - RNA, 19 nt, Human
uugaaauauugacuuuuua

SEQ ID NO: 1420368 - RNA, 20 nt, Human
uugaaauauaggaacuuaaa

SEQ ID NO: 1420369 - RNA, 23 nt, Human
auccuaagggucgaaagcucuag

SEQ ID NO: 1420370 - RNA, 22 nt, Human
auccuaagggucgaaagcucua

SEQ ID NO: 1420371 - RNA, 14 nt, Human
auccuaggcugaca

SEQ ID NO: 1420372 - RNA, 20 nt, Human
auccuagguaggguuuaauc

SEQ ID NO: 1420373 - RNA, 16 nt, Human
auccuaggcugacacc

SEQ ID NO: 1420374 - RNA, 21 nt, Human
auccuaagggucgaaagcucu

SEQ ID NO: 1420375 - RNA, 19 nt, Human
auccuaagggucgaaagcu

SEQ ID NO: 1420376 - RNA, 18 nt, Human
auccuaagggucgaaagc

SEQ ID NO: 1420377 - RNA, 21 nt, Human
uugaacacaaacuguaaauaa

SEQ ID NO: 1420378 - RNA, 20 nt, Human
uugaacacaaacuguaaaua

SEQ ID NO: 1420379 - RNA, 12 nt, Human
uugaaccaauaa

SEQ ID NO: 1420380 - RNA, 17 nt, Human
uucugguuccagggucc

SEQ ID NO: 1420381 - RNA, 15 nt, Human
uucugguuccagggu

SEQ ID NO: 1420382 - RNA, 23 nt, Human
uucugguguuggacaagcuucug

SEQ ID NO: 1420383 - RNA, 18 nt, Human
uucuggcuaugcauuuga

SEQ ID NO: 1420384 - RNA, 20 nt, Human
uucuggcuaugcauuugaaa

SEQ ID NO: 1420385 - RNA, 14 nt, Human
aucauuuuuuacuu

SEQ ID NO: 1420386 - RNA, 13 nt, Human
uucuguauaaaug

SEQ ID NO: 1420387 - RNA, 18 nt, Human
uucuguagaaaugguugu

SEQ ID NO: 1420388 - RNA, 20 nt, Human
uucuguagaaaugguuguau

SEQ ID NO: 1420389 - RNA, 21 nt, Human
uucuguagaaaugguuguauu

SEQ ID NO: 1420390 - RNA, 22 nt, Human
uucuguagaaaugguuguauua

SEQ ID NO: 1420391 - RNA, 21 nt, Human
uucugguucuuguguuggcug

SEQ ID NO: 1420392 - RNA, 14 nt, Human
uucugguucuaaca

SEQ ID NO: 1420393 - RNA, 12 nt, Human
uucugguucuaa

SEQ ID NO: 1420394 - RNA, 18 nt, Human
uucugguguuggacaagc

SEQ ID NO: 1420395 - RNA, 13 nt, Human
uucuguagaaaug

SEQ ID NO: 1420396 - RNA, 14 nt, Human
uucuguagaaaugg

SEQ ID NO: 1420397 - RNA, 15 nt, Human
uucuguagaaauggu

SEQ ID NO: 1420398 - RNA, 13 nt, Human
auccauuucuaau

SEQ ID NO: 1420399 - RNA, 12 nt, Human
auccauuucuaa

SEQ ID NO: 1420400 - RNA, 19 nt, Human
auccauuuccccuccuucc

SEQ ID NO: 1420401 - RNA, 18 nt, Human
auccauuuccccuccuuc

SEQ ID NO: 1420402 - RNA, 13 nt, Human
auccauuuccccu

SEQ ID NO: 1420403 - RNA, 15 nt, Human
auccauaacugaaca

SEQ ID NO: 1420404 - RNA, 14 nt, Human
auccauaacugaac

SEQ ID NO: 1420405 - RNA, 11 nt, Human
auccauaaaga

SEQ ID NO: 1420406 - RNA, 14 nt, Human
auccauacauuugu

SEQ ID NO: 1420407 - RNA, 20 nt, Human
aucccaaguagaaucucagu

SEQ ID NO: 1420408 - RNA, 17 nt, Human
aucccaaguagaaucuc

SEQ ID NO: 1420409 - RNA, 23 nt, Human
auccauuucuaauuauguagcuc

SEQ ID NO: 1420410 - RNA, 15 nt, Human
auccauuucuaauua

SEQ ID NO: 1420411 - RNA, 14 nt, Human
auccauuucuaauu

SEQ ID NO: 1420412 - RNA, 15 nt, Human
auccaaguuaaaugu

SEQ ID NO: 1420413 - RNA, 14 nt, Human
auccaaguuaaaug

SEQ ID NO: 1420414 - RNA, 21 nt, Human
auccaaggugggguggaagcu

SEQ ID NO: 1420415 - RNA, 19 nt, Human
auccaaaaucuugaucagu

SEQ ID NO: 1420416 - RNA, 13 nt, Human
auccaaaagcuuu

SEQ ID NO: 1420417 - RNA, 22 nt, Human
auccaaaagaagcccccagcua

SEQ ID NO: 1420418 - RNA, 19 nt, Human
auccaaaagaagcccccag

SEQ ID NO: 1420419 - RNA, 18 nt, Human
auccaaaagaagccccca

SEQ ID NO: 1420420 - RNA, 13 nt, Human
auccaaaagaagc

SEQ ID NO: 1420421 - RNA, 18 nt, Human
auccaaucaaucuugcau

SEQ ID NO: 1420422 - RNA, 13 nt, Human
auccaaucaaucu

SEQ ID NO: 1420423 - RNA, 21 nt, Human
auccaaguuaaauguagaguu

SEQ ID NO: 1420424 - RNA, 16 nt, Human
auccaaguuaaaugua

SEQ ID NO: 1420425 - RNA, 15 nt, Human
aucauuucuauuucu

SEQ ID NO: 1420426 - RNA, 21 nt, Human
aucauuucuauuaaaugagca

SEQ ID NO: 1420427 - RNA, 18 nt, Human
aucauuucuauuaaauga

SEQ ID NO: 1420428 - RNA, 16 nt, Human
aucauuucacuuguca

SEQ ID NO: 1420429 - RNA, 14 nt, Human
aucauuuaauaaua

SEQ ID NO: 1420430 - RNA, 17 nt, Human
aucauuuaauaauauac

SEQ ID NO: 1420431 - RNA, 18 nt, Human
aucauuuaauaauauacu

SEQ ID NO: 1420432 - RNA, 19 nt, Human
aucauuuaauaauauacuu

SEQ ID NO: 1420433 - RNA, 21 nt, Human
aucauuuaauaauauacuugu

SEQ ID NO: 1420434 - RNA, 21 nt, Human
uucuccugaggauguguccca

SEQ ID NO: 1420435 - RNA, 19 nt, Human
uucucuaagagaacaaugu

SEQ ID NO: 1420436 - RNA, 19 nt, Human
aucauugcuuccuccuccc

SEQ ID NO: 1420437 - RNA, 12 nt, Human
aucauuuaauaa

SEQ ID NO: 1420438 - RNA, 13 nt, Human
aucauuuaauaau

SEQ ID NO: 1420439 - RNA, 22 nt, Human
uucugcacuugcgguuccggca

SEQ ID NO: 1420440 - RNA, 13 nt, Human
uucugacagccuc

SEQ ID NO: 1420441 - RNA, 15 nt, Human
uucucuuuuccuuug

SEQ ID NO: 1420442 - RNA, 15 nt, Human
uucucuuugccucaa

SEQ ID NO: 1420443 - RNA, 14 nt, Human
uucucuuugccuca

SEQ ID NO: 1420444 - RNA, 14 nt, Human
uucucuuucccugg

SEQ ID NO: 1420445 - RNA, 24 nt, Human
uucucuaagagaacaaugugcuau

SEQ ID NO: 1420446 - RNA, 12 nt, Human
uucucuaauaug

SEQ ID NO: 1420447 - RNA, 21 nt, Human
uucucuaauauggcaaccauu

SEQ ID NO: 1420448 - RNA, 21 nt, Human
uucucuuucccuggucccuug

SEQ ID NO: 1420449 - RNA, 16 nt, Human
uucucuuuccaugaca

SEQ ID NO: 1420450 - RNA, 23 nt, Human
uucucuuguauaagauccuagau

SEQ ID NO: 1420451 - RNA, 19 nt, Human
aucaaccccagacacuggu

SEQ ID NO: 1420452 - RNA, 18 nt, Human
aucaaccccagacacugg

SEQ ID NO: 1420453 - RNA, 13 nt, Human
aucaagucuguuu

SEQ ID NO: 1420454 - RNA, 20 nt, Human
aucaaguauuugggaaguga

SEQ ID NO: 1420455 - RNA, 21 nt, Human
aucaaguauuugggaagugaa

SEQ ID NO: 1420456 - RNA, 15 nt, Human
aucaagucuguuuac

SEQ ID NO: 1420457 - RNA, 23 nt, Human
aucaagucuguuuacugcaaggu

SEQ ID NO: 1420458 - RNA, 14 nt, Human
aucaaguuauuuuu

SEQ ID NO: 1420459 - RNA, 17 nt, Human
aucaaaugguaucuuuu

SEQ ID NO: 1420460 - RNA, 20 nt, Human
aucaaaucuaccacuguaug

SEQ ID NO: 1420461 - RNA, 18 nt, Human
aucaaaugguaucuuuug

SEQ ID NO: 1420462 - RNA, 13 nt, Human
auauuuuuagaua

SEQ ID NO: 1420463 - RNA, 22 nt, Human
uuccuguccagcuccaaccugc

SEQ ID NO: 1420464 - RNA, 17 nt, Human
uuccuguccagcuccaa

SEQ ID NO: 1420465 - RNA, 16 nt, Human
uuccuguccagcucca

SEQ ID NO: 1420466 - RNA, 15 nt, Human
uuccuguccagcucc

SEQ ID NO: 1420467 - RNA, 21 nt, Human
uuccuguauuuguucccaaga

SEQ ID NO: 1420468 - RNA, 22 nt, Human
uuccuguauuuguucccaagag

SEQ ID NO: 1420469 - RNA, 20 nt, Human
uuccuguauuuguucccaag

SEQ ID NO: 1420470 - RNA, 15 nt, Human
uuccuggugcuggag

SEQ ID NO: 1420471 - RNA, 14 nt, Human
uuccuggugcugga

SEQ ID NO: 1420472 - RNA, 15 nt, Human
uuccuacuggucucu

SEQ ID NO: 1420473 - RNA, 15 nt, Human
uuccucuccacacag

SEQ ID NO: 1420474 - RNA, 22 nt, Human
uuccuuagacucuuuuccuucc

SEQ ID NO: 1420475 - RNA, 11 nt, Human
uuccuggugcu

SEQ ID NO: 1420476 - RNA, 22 nt, Human
uuccuucagagagcagugcuuu

SEQ ID NO: 1420477 - RNA, 12 nt, Human
uuccuucagauu

SEQ ID NO: 1420478 - RNA, 21 nt, Human
uuccuucagagagcagugcuu

SEQ ID NO: 1420479 - RNA, 14 nt, Human
uuccuucagcacuu

SEQ ID NO: 1420480 - RNA, 13 nt, Human
auauuuucuguuu

SEQ ID NO: 1420481 - RNA, 12 nt, Human
auauuuucuguu

SEQ ID NO: 1420482 - RNA, 16 nt, Human
auauuuucucuaggaa

SEQ ID NO: 1420483 - RNA, 13 nt, Human
auauuuucucuag

SEQ ID NO: 1420484 - RNA, 19 nt, Human
auauuuucucuaggaaaua

SEQ ID NO: 1420485 - RNA, 12 nt, Human
auauuuucucua

SEQ ID NO: 1420486 - RNA, 13 nt, Human
auauuuuccuccu

SEQ ID NO: 1420487 - RNA, 19 nt, Human
auauuuuccuauauuacgg

SEQ ID NO: 1420488 - RNA, 13 nt, Human
auauuuuccuaua

SEQ ID NO: 1420489 - RNA, 15 nt, Human
uuccuucagcacuuu

SEQ ID NO: 1420490 - RNA, 19 nt, Human
uuccuaccaagucaaacuu

SEQ ID NO: 1420491 - RNA, 14 nt, Human
uucccuuuucuguu

SEQ ID NO: 1420492 - RNA, 15 nt, Human
uuccccuuccacuga

SEQ ID NO: 1420493 - RNA, 14 nt, Human
uuccccuuccacug

SEQ ID NO: 1420494 - RNA, 20 nt, Human
uuccccuuauccucccugua

SEQ ID NO: 1420495 - RNA, 19 nt, Human
uuccccuuauccucccugu

SEQ ID NO: 1420496 - RNA, 17 nt, Human
uuccccuuauccucccu

SEQ ID NO: 1420497 - RNA, 16 nt, Human
uuccccuuauccuccc

SEQ ID NO: 1420498 - RNA, 21 nt, Human
uuccccuuccacugagggcag

SEQ ID NO: 1420499 - RNA, 22 nt, Human
uucccuagaaacuuccaaaucc

SEQ ID NO: 1420500 - RNA, 15 nt, Human
uucccuauccaauca

SEQ ID NO: 1420501 - RNA, 12 nt, Human
uucccuaucacu

SEQ ID NO: 1420502 - RNA, 16 nt, Human
uucccuaucuuugcca

SEQ ID NO: 1420503 - RNA, 18 nt, Human
uuccccucugcugcuguc

SEQ ID NO: 1420504 - RNA, 15 nt, Human
uuccccucugcugcu

SEQ ID NO: 1420505 - RNA, 14 nt, Human
uuccccucugcugc

SEQ ID NO: 1420506 - RNA, 12 nt, Human
uuccccucugcu

SEQ ID NO: 1420507 - RNA, 22 nt, Human
uucccccuguuucagaggcuca

SEQ ID NO: 1420508 - RNA, 17 nt, Human
uucccccucucccaguu

SEQ ID NO: 1420509 - RNA, 18 nt, Human
uucccccucucccaguug

SEQ ID NO: 1420510 - RNA, 14 nt, Human
uucccccucuccca

SEQ ID NO: 1420511 - RNA, 18 nt, Human
uucccagagcaaaauaau

SEQ ID NO: 1420512 - RNA, 20 nt, Human
uucccacuuucccaccccac

SEQ ID NO: 1420513 - RNA, 18 nt, Human
uucccacuuucccacccc

SEQ ID NO: 1420514 - RNA, 17 nt, Human
uucccacuuucccaccc

SEQ ID NO: 1420515 - RNA, 20 nt, Human
uucccacuuaaaaauuaaau

SEQ ID NO: 1420516 - RNA, 15 nt, Human
uucccacuguuuaag

SEQ ID NO: 1420517 - RNA, 14 nt, Human
uucccacuccaagc

SEQ ID NO: 1420518 - RNA, 21 nt, Human
uucccacuccaagcccagccc

SEQ ID NO: 1420519 - RNA, 20 nt, Human
uucccacggccuuucuagcc

SEQ ID NO: 1420520 - RNA, 11 nt, Human
uucccagaggg

SEQ ID NO: 1420521 - RNA, 23 nt, Human
uucccagagcaaaauaauuuuaa

SEQ ID NO: 1420522 - RNA, 20 nt, Human
auauuuuacauaaauuuagu

SEQ ID NO: 1420523 - RNA, 16 nt, Human
auauuuuacauaaauu

SEQ ID NO: 1420524 - RNA, 15 nt, Human
auauuuuacauaaau

SEQ ID NO: 1420525 - RNA, 23 nt, Human
uucgcauggucacacacugaugc

SEQ ID NO: 1420526 - RNA, 21 nt, Human
uucgcauggucacacacugau

SEQ ID NO: 1420527 - RNA, 20 nt, Human
uucgcauggucacacacuga

SEQ ID NO: 1420528 - RNA, 19 nt, Human
uucgcauggucacacacug

SEQ ID NO: 1420529 - RNA, 18 nt, Human
uucgcauggucacacacu

SEQ ID NO: 1420530 - RNA, 17 nt, Human
uucgcauggucacacac

SEQ ID NO: 1420531 - RNA, 16 nt, Human
uucgcauggucacaca

SEQ ID NO: 1420532 - RNA, 14 nt, Human
uucgcauggucaca

SEQ ID NO: 1420533 - RNA, 22 nt, Human
uucgcaguccacuucugacagc

SEQ ID NO: 1420534 - RNA, 24 nt, Human
uucgcagccacccugaggagucug

SEQ ID NO: 1420535 - RNA, 19 nt, Human
uucgcagccacccugagga

SEQ ID NO: 1420536 - RNA, 23 nt, Human
uucgagauuaucguuuucuuaaa

SEQ ID NO: 1420537 - RNA, 18 nt, Human
uucgcagccacccugagg

SEQ ID NO: 1420538 - RNA, 16 nt, Human
uucgcagccacccuga

SEQ ID NO: 1420539 - RNA, 15 nt, Human
uucgcagccacccug

SEQ ID NO: 1420540 - RNA, 14 nt, Human
uucgcagccacccu

SEQ ID NO: 1420541 - RNA, 13 nt, Human
uucgcagccaccc

SEQ ID NO: 1420542 - RNA, 11 nt, Human
uucgcagccac

SEQ ID NO: 1420543 - RNA, 15 nt, Human
uucgacacuguucuu

SEQ ID NO: 1420544 - RNA, 15 nt, Human
uucgaaugacacugu

SEQ ID NO: 1420545 - RNA, 14 nt, Human
uucgacacuguucu

SEQ ID NO: 1420546 - RNA, 16 nt, Human
uuccuuuuuuuguacc

SEQ ID NO: 1420547 - RNA, 14 nt, Human
uuccuuuuuuugua

SEQ ID NO: 1420548 - RNA, 13 nt, Human
uucgaaaaucaaa

SEQ ID NO: 1420549 - RNA, 19 nt, Human
uucuaaggccuaggauucu

SEQ ID NO: 1420550 - RNA, 22 nt, Human
uucuaaggaccugaaauuccaa

SEQ ID NO: 1420551 - RNA, 21 nt, Human
uucuaaggaccugaaauucca

SEQ ID NO: 1420552 - RNA, 14 nt, Human
uucuaagauucuga

SEQ ID NO: 1420553 - RNA, 17 nt, Human
uucuaagcauaaaagau

SEQ ID NO: 1420554 - RNA, 13 nt, Human
uucuaagauucug

SEQ ID NO: 1420555 - RNA, 19 nt, Human
uucuaagauucuaaugaug

SEQ ID NO: 1420556 - RNA, 17 nt, Human
uucuaagauucuaauga

SEQ ID NO: 1420557 - RNA, 16 nt, Human
uucuaagauucuaaug

SEQ ID NO: 1420558 - RNA, 15 nt, Human
uucuaagauucuaau

SEQ ID NO: 1420559 - RNA, 17 nt, Human
uucuaagauucuaaagg

SEQ ID NO: 1420560 - RNA, 16 nt, Human
uucuaagauucuaaag

SEQ ID NO: 1420561 - RNA, 15 nt, Human
uucuaagauucuaaa

SEQ ID NO: 1420562 - RNA, 14 nt, Human
uucuaagauucuaa

SEQ ID NO: 1420563 - RNA, 13 nt, Human
uucuaagauucua

SEQ ID NO: 1420564 - RNA, 12 nt, Human
uucuaagauucu

SEQ ID NO: 1420565 - RNA, 23 nt, Human
uucuaagaugugauauucuaaga

SEQ ID NO: 1420566 - RNA, 22 nt, Human
uucuaagaugugauauucuaag

SEQ ID NO: 1420567 - RNA, 21 nt, Human
uucuaagaugugauauucuaa

SEQ ID NO: 1420568 - RNA, 20 nt, Human
uucuaagaugugauauucua

SEQ ID NO: 1420569 - RNA, 19 nt, Human
uucuaagaugugauauucu

SEQ ID NO: 1420570 - RNA, 12 nt, Human
uucuaagaugug

SEQ ID NO: 1420571 - RNA, 20 nt, Human
uucuaagaaacauuuauauu

SEQ ID NO: 1420572 - RNA, 22 nt, Human
uucuaacuacaaagguuuaaau

SEQ ID NO: 1420573 - RNA, 23 nt, Human
uucuaacuacaaagguuuaaaug

SEQ ID NO: 1420574 - RNA, 16 nt, Human
uucuaaccuuuacaug

SEQ ID NO: 1420575 - RNA, 15 nt, Human
uucuaaccuuuacau

SEQ ID NO: 1420576 - RNA, 23 nt, Human
uucuaagaaacauuuauauugau

SEQ ID NO: 1420577 - RNA, 16 nt, Human
uucuaagaaacauuua

SEQ ID NO: 1420578 - RNA, 14 nt, Human
uucuaagaaacauu

SEQ ID NO: 1420579 - RNA, 14 nt, Human
uucuaaccuuuaca

SEQ ID NO: 1420580 - RNA, 14 nt, Human
uucuaacaagucau

SEQ ID NO: 1420581 - RNA, 20 nt, Human
uucuaaaguucuaagauucu

SEQ ID NO: 1420582 - RNA, 18 nt, Human
uucuaaaguucuaagauu

SEQ ID NO: 1420583 - RNA, 17 nt, Human
uucuaaaguucuaagau

SEQ ID NO: 1420584 - RNA, 16 nt, Human
uucuaaaguucuaaga

SEQ ID NO: 1420585 - RNA, 14 nt, Human
uucuaaaguucuaa

SEQ ID NO: 1420586 - RNA, 19 nt, Human
uucuaaaucuccaaaauaa

SEQ ID NO: 1420587 - RNA, 13 nt, Human
uucuaaaguucua

SEQ ID NO: 1420588 - RNA, 12 nt, Human
uucuaaaguucu

SEQ ID NO: 1420589 - RNA, 15 nt, Human
uucuaaaguaaaaac

SEQ ID NO: 1420590 - RNA, 15 nt, Human
uucucagauuucuga

SEQ ID NO: 1420591 - RNA, 20 nt, Human
uucucagauuucugaggaaa

SEQ ID NO: 1420592 - RNA, 14 nt, Human
uucucagauuucug

SEQ ID NO: 1420593 - RNA, 16 nt, Human
uucucagauuucugag

SEQ ID NO: 1420594 - RNA, 20 nt, Human
aucacuuucucaguuuucau

SEQ ID NO: 1420595 - RNA, 21 nt, Human
aucacuuucucaguuuucaua

SEQ ID NO: 1420596 - RNA, 18 nt, Human
aucacuuucucaguuuuc

SEQ ID NO: 1420597 - RNA, 22 nt, Human
aucagaaaggaaaaacaaacuc

SEQ ID NO: 1420598 - RNA, 20 nt, Human
aucagaaaggaaaaacaaac

SEQ ID NO: 1420599 - RNA, 14 nt, Human
aucagaaagaggca

SEQ ID NO: 1420600 - RNA, 16 nt, Human
aucagaaacacccuca

SEQ ID NO: 1420601 - RNA, 20 nt, Human
aucagaaacacccucacacu

SEQ ID NO: 1420602 - RNA, 20 nt, Human
aucaggacccagaggaaggg

SEQ ID NO: 1420603 - RNA, 18 nt, Human
aucaggacccagaggaag

SEQ ID NO: 1420604 - RNA, 14 nt, Human
aucaggacccugga

SEQ ID NO: 1420605 - RNA, 16 nt, Human
aucaggacccagagga

SEQ ID NO: 1420606 - RNA, 22 nt, Human
aucaggaauauuuuccaaagag

SEQ ID NO: 1420607 - RNA, 19 nt, Human
aucaggaauauuuuccaaa

SEQ ID NO: 1420608 - RNA, 13 nt, Human
aucagacugacag

SEQ ID NO: 1420609 - RNA, 20 nt, Human
aucagaccauaauguuacau

SEQ ID NO: 1420610 - RNA, 16 nt, Human
aucagaccauaauguu

SEQ ID NO: 1420611 - RNA, 17 nt, Human
aucagaaagggagggcu

SEQ ID NO: 1420612 - RNA, 16 nt, Human
aucagaaagggagggc

SEQ ID NO: 1420613 - RNA, 15 nt, Human
aucagaaagggaggg

SEQ ID NO: 1420614 - RNA, 17 nt, Human
aucagacugacaguuua

SEQ ID NO: 1420615 - RNA, 20 nt, Human
aucagacuaagccagcaccg

SEQ ID NO: 1420616 - RNA, 19 nt, Human
aucagacuaagccagcacc

SEQ ID NO: 1420617 - RNA, 17 nt, Human
aucagacuaagccagca

SEQ ID NO: 1420618 - RNA, 16 nt, Human
aucagacuaagccagc

SEQ ID NO: 1420619 - RNA, 19 nt, Human
aucagacuaugaaguuuuu

SEQ ID NO: 1420620 - RNA, 22 nt, Human
uucuauaaguuuuauguuaaau

SEQ ID NO: 1420621 - RNA, 21 nt, Human
uucuauaaguuuuauguuaaa

SEQ ID NO: 1420622 - RNA, 16 nt, Human
uucuaguucugccagg

SEQ ID NO: 1420623 - RNA, 15 nt, Human
uucuaguucugccag

SEQ ID NO: 1420624 - RNA, 13 nt, Human
uucuauaauuuaa

SEQ ID NO: 1420625 - RNA, 14 nt, Human
uucuauaauuuaaa

SEQ ID NO: 1420626 - RNA, 12 nt, Human
uucuagaccaau

SEQ ID NO: 1420627 - RNA, 23 nt, Human
uucuagacauggagguucuaagg

SEQ ID NO: 1420628 - RNA, 22 nt, Human
uucuagacauggagguucuaag

SEQ ID NO: 1420629 - RNA, 20 nt, Human
uucuagacauggagguucua

SEQ ID NO: 1420630 - RNA, 22 nt, Human
uucuagaaagagaaacaguugg

SEQ ID NO: 1420631 - RNA, 19 nt, Human
uucuagaaagagaaacagu

SEQ ID NO: 1420632 - RNA, 12 nt, Human
uucuagaaaaac

SEQ ID NO: 1420633 - RNA, 17 nt, Human
uucuaaggccuaggauu

SEQ ID NO: 1420634 - RNA, 15 nt, Human
uucuaaggccuagga

SEQ ID NO: 1420635 - RNA, 23 nt, Human
uucuaaggaccugaaauuccaaa

SEQ ID NO: 1420636 - RNA, 21 nt, Human
uucuagguuucaaagaugcug

SEQ ID NO: 1420637 - RNA, 23 nt, Human
uucuagaucagaugcuccaagau

SEQ ID NO: 1420638 - RNA, 22 nt, Human
uucuagaucagaugcuccaaga

SEQ ID NO: 1420639 - RNA, 16 nt, Human
uucuagaucagaugcu

SEQ ID NO: 1420640 - RNA, 19 nt, Human
uucuagaguucagaguccu

SEQ ID NO: 1420641 - RNA, 14 nt, Human
uucuagaguucaga

SEQ ID NO: 1420642 - RNA, 16 nt, Human
uucuagagcacugcca

SEQ ID NO: 1420643 - RNA, 15 nt, Human
uucuaguguagaauu

SEQ ID NO: 1420644 - RNA, 17 nt, Human
augcagugccuuucuuc

SEQ ID NO: 1420645 - RNA, 17 nt, Human
augcaguucugaagaag

SEQ ID NO: 1420646 - RNA, 15 nt, Human
augcaguucugaaga

SEQ ID NO: 1420647 - RNA, 24 nt, Human
augcagugcucgcuguugcugaau

SEQ ID NO: 1420648 - RNA, 21 nt, Human
augcagugcucgcuguugcug

SEQ ID NO: 1420649 - RNA, 23 nt, Human
augcagugcucgcuguugcugaa

SEQ ID NO: 1420650 - RNA, 13 nt, Human
augcagugcucgc

SEQ ID NO: 1420651 - RNA, 17 nt, Human
augcagugcucgcuguu

SEQ ID NO: 1420652 - RNA, 19 nt, Human
augcagugcucgcuguugc

SEQ ID NO: 1420653 - RNA, 20 nt, Human
augcagugcucgcuguugcu

SEQ ID NO: 1420654 - RNA, 15 nt, Human
augcagggcagucau

SEQ ID NO: 1420655 - RNA, 13 nt, Human
augcagggcaguc

SEQ ID NO: 1420656 - RNA, 15 nt, Human
augccacugccuucg

SEQ ID NO: 1420657 - RNA, 14 nt, Human
augccacugccuuc

SEQ ID NO: 1420658 - RNA, 16 nt, Human
augcccagagacccag

SEQ ID NO: 1420659 - RNA, 14 nt, Human
augcccagagaccc

SEQ ID NO: 1420660 - RNA, 11 nt, Human
augcccagaga

SEQ ID NO: 1420661 - RNA, 10 nt, Human
augcccagag

SEQ ID NO: 1420662 - RNA, 18 nt, Human
augcccagagacccagcg

SEQ ID NO: 1420663 - RNA, 17 nt, Human
augcccagagacccagc

SEQ ID NO: 1420664 - RNA, 19 nt, Human
augccaaauuaaaaaagau

SEQ ID NO: 1420665 - RNA, 22 nt, Human
augccaaauuaaaaaagauaaa

SEQ ID NO: 1420666 - RNA, 18 nt, Human
augccaaauuaaaaaaga

SEQ ID NO: 1420667 - RNA, 15 nt, Human
augccaaauuaaaaa

SEQ ID NO: 1420668 - RNA, 14 nt, Human
augccaaauuaaaa

SEQ ID NO: 1420669 - RNA, 13 nt, Human
augccaaauuaaa

SEQ ID NO: 1420670 - RNA, 18 nt, Human
augcaguugucucuguuu

SEQ ID NO: 1420671 - RNA, 16 nt, Human
augcaguugucucugu

SEQ ID NO: 1420672 - RNA, 15 nt, Human
augcaguugucucug

SEQ ID NO: 1420673 - RNA, 14 nt, Human
augcaguugucucu

SEQ ID NO: 1420674 - RNA, 19 nt, Human
augcaguucugaagaagau

SEQ ID NO: 1420675 - RNA, 18 nt, Human
augcaguucugaagaaga

SEQ ID NO: 1420676 - RNA, 13 nt, Human
uuuaagcucugag

SEQ ID NO: 1420677 - RNA, 18 nt, Human
uuuaagccaaaacaaugu

SEQ ID NO: 1420678 - RNA, 20 nt, Human
uuuaagccaaaacaauguuu

SEQ ID NO: 1420679 - RNA, 12 nt, Human
uuuaagccaaaa

SEQ ID NO: 1420680 - RNA, 15 nt, Human
uuuaagugcugcauu

SEQ ID NO: 1420681 - RNA, 16 nt, Human
uuuaagugcugcauuu

SEQ ID NO: 1420682 - RNA, 16 nt, Human
uuuaaugaagaucuaa

SEQ ID NO: 1420683 - RNA, 16 nt, Human
uuuaaugaacaaaugg

SEQ ID NO: 1420684 - RNA, 15 nt, Human
uuuaaugaacaaaug

SEQ ID NO: 1420685 - RNA, 19 nt, Human
uuuaagcucugagcuguca

SEQ ID NO: 1420686 - RNA, 18 nt, Human
uuuaagcucugagcuguc

SEQ ID NO: 1420687 - RNA, 17 nt, Human
uuuaagcucugagcugu

SEQ ID NO: 1420688 - RNA, 14 nt, Human
uuuaagcucugagc

SEQ ID NO: 1420689 - RNA, 19 nt, Human
uuuaaugaagaucuaaaua

SEQ ID NO: 1420690 - RNA, 17 nt, Human
uuuaagugcugcauuua

SEQ ID NO: 1420691 - RNA, 19 nt, Human
uuuaagugcugcauuuaaa

SEQ ID NO: 1420692 - RNA, 18 nt, Human
uuuaauguauaguaaauc

SEQ ID NO: 1420693 - RNA, 19 nt, Human
uuuaauggggugcaccugu

SEQ ID NO: 1420694 - RNA, 23 nt, Human
uuuaaugccgauauacucuagau

SEQ ID NO: 1420695 - RNA, 12 nt, Human
uuuaauuguaaa

SEQ ID NO: 1420696 - RNA, 21 nt, Human
uuuaauuguaaaguaaaagcu

SEQ ID NO: 1420697 - RNA, 15 nt, Human
uuuaauuguaaagua

SEQ ID NO: 1420698 - RNA, 12 nt, Human
uuuaauuuuaca

SEQ ID NO: 1420699 - RNA, 14 nt, Human
uuuaagauaauuau

SEQ ID NO: 1420700 - RNA, 15 nt, Human
uuuaagauaauuaua

SEQ ID NO: 1420701 - RNA, 11 nt, Human
uuuaaauugug

SEQ ID NO: 1420702 - RNA, 12 nt, Human
uuuaaauugugu

SEQ ID NO: 1420703 - RNA, 21 nt, Human
augcacuuugcuuuaauauaa

SEQ ID NO: 1420704 - RNA, 20 nt, Human
augcacuuugcuuuaauaua

SEQ ID NO: 1420705 - RNA, 19 nt, Human
augcacuuugcuuuaauau

SEQ ID NO: 1420706 - RNA, 18 nt, Human
augcacuuugcuuuaaua

SEQ ID NO: 1420707 - RNA, 23 nt, Human
augcacuuugcuuuaauauaaau

SEQ ID NO: 1420708 - RNA, 22 nt, Human
augcacuuugcuuuaauauaaa

SEQ ID NO: 1420709 - RNA, 14 nt, Human
uuuaaauguauacu

SEQ ID NO: 1420710 - RNA, 15 nt, Human
uuuaaauguauacua

SEQ ID NO: 1420711 - RNA, 14 nt, Human
uuuaaauguuuuuu

SEQ ID NO: 1420712 - RNA, 21 nt, Human
uuguuggcguaggcuacagag

SEQ ID NO: 1420713 - RNA, 18 nt, Human
uuguuggcguaggcuaca

SEQ ID NO: 1420714 - RNA, 15 nt, Human
uuguucuguuaacug

SEQ ID NO: 1420715 - RNA, 16 nt, Human
uuguuggcauagcucu

SEQ ID NO: 1420716 - RNA, 14 nt, Human
uuguucuguuaacu

SEQ ID NO: 1420717 - RNA, 14 nt, Human
uuguucugucacca

SEQ ID NO: 1420718 - RNA, 17 nt, Human
uuguguguugucucuug

SEQ ID NO: 1420719 - RNA, 15 nt, Human
uuguguguugucucu

SEQ ID NO: 1420720 - RNA, 13 nt, Human
uuguguguugucu

SEQ ID NO: 1420721 - RNA, 16 nt, Human
uuguguggauucuuua

SEQ ID NO: 1420722 - RNA, 13 nt, Human
uuguguggauucu

SEQ ID NO: 1420723 - RNA, 15 nt, Human
uugugugcucuccau

SEQ ID NO: 1420724 - RNA, 14 nt, Human
uugugugcucucca

SEQ ID NO: 1420725 - RNA, 13 nt, Human
uugugugcucucc

SEQ ID NO: 1420726 - RNA, 18 nt, Human
uuguguaagaaauacaga

SEQ ID NO: 1420727 - RNA, 20 nt, Human
uugugguuuauauauuuaaa

SEQ ID NO: 1420728 - RNA, 23 nt, Human
uugugugaaagguacuucaaauc

SEQ ID NO: 1420729 - RNA, 14 nt, Human
uuguguaagaaaua

SEQ ID NO: 1420730 - RNA, 13 nt, Human
uugugggccuggg

SEQ ID NO: 1420731 - RNA, 18 nt, Human
uuguggccuuugcgcucc

SEQ ID NO: 1420732 - RNA, 23 nt, Human
uugugggccugggcuccuggacc

SEQ ID NO: 1420733 - RNA, 19 nt, Human
uugugggccugggcuccug

SEQ ID NO: 1420734 - RNA, 18 nt, Human
uugugggccugggcuccu

SEQ ID NO: 1420735 - RNA, 15 nt, Human
uugugggccugggcu

SEQ ID NO: 1420736 - RNA, 14 nt, Human
uugugggccugggc

SEQ ID NO: 1420737 - RNA, 16 nt, Human
uugugggggacuguaa

SEQ ID NO: 1420738 - RNA, 17 nt, Human
uuguggggccugggagg

SEQ ID NO: 1420739 - RNA, 14 nt, Human
uuguggggccuggg

SEQ ID NO: 1420740 - RNA, 20 nt, Human
uugugggccugggcuccugg

SEQ ID NO: 1420741 - RNA, 19 nt, Human
uugugggggacuguaaguu

SEQ ID NO: 1420742 - RNA, 18 nt, Human
uugugggggacuguaagu

SEQ ID NO: 1420743 - RNA, 17 nt, Human
uuguggccuaagaggcu

SEQ ID NO: 1420744 - RNA, 19 nt, Human
uugugauacaaugcugugc

SEQ ID NO: 1420745 - RNA, 22 nt, Human
uugugaguuuaccuuguauacu

SEQ ID NO: 1420746 - RNA, 18 nt, Human
uugugauacaaugcugug

SEQ ID NO: 1420747 - RNA, 23 nt, Human
augagagacacacugaagaagca

SEQ ID NO: 1420748 - RNA, 21 nt, Human
augagagacacacugaagaag

SEQ ID NO: 1420749 - RNA, 20 nt, Human
augagagacacacugaagaa

SEQ ID NO: 1420750 - RNA, 16 nt, Human
augcacuuugcuuuaa

SEQ ID NO: 1420751 - RNA, 15 nt, Human
augcacuuugcuuua

SEQ ID NO: 1420752 - RNA, 13 nt, Human
augcacuuugcuu

SEQ ID NO: 1420753 - RNA, 12 nt, Human
augcacuuugcu

SEQ ID NO: 1420754 - RNA, 22 nt, Human
augcacuuucuauccucuguaa

SEQ ID NO: 1420755 - RNA, 20 nt, Human
augcacuucaaauucaaaua

SEQ ID NO: 1420756 - RNA, 19 nt, Human
augcacuuauaauuuuccu

SEQ ID NO: 1420757 - RNA, 21 nt, Human
augcaccaccaagccaaggga

SEQ ID NO: 1420758 - RNA, 18 nt, Human
augcaccaccaagccaag

SEQ ID NO: 1420759 - RNA, 15 nt, Human
augcaccaccaagcc

SEQ ID NO: 1420760 - RNA, 18 nt, Human
augcaaaucaauuacugg

SEQ ID NO: 1420761 - RNA, 14 nt, Human
augcaccaccaagc

SEQ ID NO: 1420762 - RNA, 17 nt, Human
augcacaugaacuuaga

SEQ ID NO: 1420763 - RNA, 14 nt, Human
augcacaucccugg

SEQ ID NO: 1420764 - RNA, 21 nt, Human
augauuuuaaguuucucugca

SEQ ID NO: 1420765 - RNA, 21 nt, Human
augauuucaugcuaucucugu

SEQ ID NO: 1420766 - RNA, 20 nt, Human
augauuucaugcuaucucug

SEQ ID NO: 1420767 - RNA, 21 nt, Human
augauuucaguucuaggaaaa

SEQ ID NO: 1420768 - RNA, 20 nt, Human
augauuucaguucuaggaaa

SEQ ID NO: 1420769 - RNA, 14 nt, Human
augauuucaguagc

SEQ ID NO: 1420770 - RNA, 21 nt, Human
augauuuccuugaauguggcu

SEQ ID NO: 1420771 - RNA, 14 nt, Human
augauuucuucuua

SEQ ID NO: 1420772 - RNA, 13 nt, Human
uuguugugcuuuu

SEQ ID NO: 1420773 - RNA, 16 nt, Human
uuguuguccuuuucau

SEQ ID NO: 1420774 - RNA, 14 nt, Human
uuguuguccuuuuc

SEQ ID NO: 1420775 - RNA, 20 nt, Human
augauuaaauaagauucuaa

SEQ ID NO: 1420776 - RNA, 19 nt, Human
augauuaaauaagauucua

SEQ ID NO: 1420777 - RNA, 23 nt, Human
augauuagaaauuaccuguggau

SEQ ID NO: 1420778 - RNA, 22 nt, Human
augauuaugaauuacauuugua

SEQ ID NO: 1420779 - RNA, 18 nt, Human
uuguuguaaccugcugug

SEQ ID NO: 1420780 - RNA, 15 nt, Human
uuguuguaaccugcu

SEQ ID NO: 1420781 - RNA, 20 nt, Human
uuguugguugguuuucuucu

SEQ ID NO: 1420782 - RNA, 16 nt, Human
uuguugguugguuuuc

SEQ ID NO: 1420783 - RNA, 15 nt, Human
uuguuggugcacagc

SEQ ID NO: 1420784 - RNA, 22 nt, Human
uuguuggcguaggcuacagaga

SEQ ID NO: 1420785 - RNA, 23 nt, Human
uuguuggcguaggcuacagagaa

SEQ ID NO: 1420786 - RNA, 23 nt, Human
uuguuguagauugauuguauugu

SEQ ID NO: 1420787 - RNA, 20 nt, Human
uuguuguagauugauuguau

SEQ ID NO: 1420788 - RNA, 15 nt, Human
uuguugucugcaacu

SEQ ID NO: 1420789 - RNA, 24 nt, Human
augauuaaauaagauucuaacggu

SEQ ID NO: 1420790 - RNA, 13 nt, Human
augauucauuuua

SEQ ID NO: 1420791 - RNA, 16 nt, Human
augauucaguguuaaa

SEQ ID NO: 1420792 - RNA, 21 nt, Human
augauucaaaugucuauaaac

SEQ ID NO: 1420793 - RNA, 12 nt, Human
augauucccagc

SEQ ID NO: 1420794 - RNA, 14 nt, Human
auggccuucauauc

SEQ ID NO: 1420795 - RNA, 17 nt, Human
auggccugcaaacuggg

SEQ ID NO: 1420796 - RNA, 23 nt, Human
auggccuucauaucauccacaca

SEQ ID NO: 1420797 - RNA, 18 nt, Human
auggccugcaaacuggga

SEQ ID NO: 1420798 - RNA, 22 nt, Human
auggccgugaaugggugcccac

SEQ ID NO: 1420799 - RNA, 22 nt, Human
auggccugcaaacugggaaccc

SEQ ID NO: 1420800 - RNA, 21 nt, Human
auggccagccccuuagacaga

SEQ ID NO: 1420801 - RNA, 19 nt, Human
auggccagccccuuagaca

SEQ ID NO: 1420802 - RNA, 17 nt, Human
auggccagccccuuaga

SEQ ID NO: 1420803 - RNA, 13 nt, Human
auggccagccccu

SEQ ID NO: 1420804 - RNA, 13 nt, Human
auggccagcagca

SEQ ID NO: 1420805 - RNA, 18 nt, Human
auggcaugagaaauacaa

SEQ ID NO: 1420806 - RNA, 22 nt, Human
auggccacaguagucuugauga

SEQ ID NO: 1420807 - RNA, 19 nt, Human
auggcaugagaaauacaaa

SEQ ID NO: 1420808 - RNA, 21 nt, Human
auggcagaaggcaaacccauc

SEQ ID NO: 1420809 - RNA, 20 nt, Human
auggcagaaggcaaacccau

SEQ ID NO: 1420810 - RNA, 15 nt, Human
auggcagaaggcaaa

SEQ ID NO: 1420811 - RNA, 20 nt, Human
auggccagcuggaggcaggg

SEQ ID NO: 1420812 - RNA, 14 nt, Human
auggccagcuggag

SEQ ID NO: 1420813 - RNA, 22 nt, Human
auggccagccccuuagacagag

SEQ ID NO: 1420814 - RNA, 18 nt, Human
auggccgugaaugggugc

SEQ ID NO: 1420815 - RNA, 18 nt, Human
auggccggagaggaccgg

SEQ ID NO: 1420816 - RNA, 15 nt, Human
auggcaacagaucug

SEQ ID NO: 1420817 - RNA, 14 nt, Human
auggcaacagaucu

SEQ ID NO: 1420818 - RNA, 18 nt, Human
auggcaaaggaaggugga

SEQ ID NO: 1420819 - RNA, 20 nt, Human
auggauuuuucuuuaacugc

SEQ ID NO: 1420820 - RNA, 19 nt, Human
auggauuuuucuuuaacug

SEQ ID NO: 1420821 - RNA, 16 nt, Human
auggauuuuucuuuaa

SEQ ID NO: 1420822 - RNA, 15 nt, Human
auggauuuuucuuua

SEQ ID NO: 1420823 - RNA, 21 nt, Human
auggauuuugggagugacuca

SEQ ID NO: 1420824 - RNA, 15 nt, Human
auggauuuugggagu

SEQ ID NO: 1420825 - RNA, 17 nt, Human
auggauuucuuugaaaa

SEQ ID NO: 1420826 - RNA, 16 nt, Human
auggcaauuuuguaac

SEQ ID NO: 1420827 - RNA, 15 nt, Human
auggcaauuuuguaa

SEQ ID NO: 1420828 - RNA, 22 nt, Human
auggcaaucaaacauuuucugg

SEQ ID NO: 1420829 - RNA, 16 nt, Human
auggcaaccauuauaa

SEQ ID NO: 1420830 - RNA, 15 nt, Human
auggcaaccauuaua

SEQ ID NO: 1420831 - RNA, 24 nt, Human
auggcaacagaucuggaaccucag

SEQ ID NO: 1420832 - RNA, 17 nt, Human
auggcaacagaucugga

SEQ ID NO: 1420833 - RNA, 16 nt, Human
auggcaacagaucugg

SEQ ID NO: 1420834 - RNA, 18 nt, Human
auggcaaccauuauaacc

SEQ ID NO: 1420835 - RNA, 13 nt, Human
auggcagaaggca

SEQ ID NO: 1420836 - RNA, 13 nt, Human
auggcagaaaagu

SEQ ID NO: 1420837 - RNA, 17 nt, Human
auggcacaucagcacga

SEQ ID NO: 1420838 - RNA, 23 nt, Human
auggcacaucagcacgauuucug

SEQ ID NO: 1420839 - RNA, 23 nt, Human
uuuccccauuuagguuucugagu

SEQ ID NO: 1420840 - RNA, 15 nt, Human
uuuccccagacuugu

SEQ ID NO: 1420841 - RNA, 18 nt, Human
uuuccccaccagaugcug

SEQ ID NO: 1420842 - RNA, 16 nt, Human
uuucccauggggaggg

SEQ ID NO: 1420843 - RNA, 17 nt, Human
auggacaucuugucauu

SEQ ID NO: 1420844 - RNA, 12 nt, Human
auggacaucuug

SEQ ID NO: 1420845 - RNA, 19 nt, Human
auggacaggcuggcuccag

SEQ ID NO: 1420846 - RNA, 18 nt, Human
auggacagggcaugccac

SEQ ID NO: 1420847 - RNA, 14 nt, Human
auggacaggcuggc

SEQ ID NO: 1420848 - RNA, 20 nt, Human
auggacaucuugucauuuuu

SEQ ID NO: 1420849 - RNA, 19 nt, Human
auggacaucuugucauuuu

SEQ ID NO: 1420850 - RNA, 19 nt, Human
uuucauuaaauaaauuuga

SEQ ID NO: 1420851 - RNA, 18 nt, Human
uuucauuaaauaaauuug

SEQ ID NO: 1420852 - RNA, 17 nt, Human
uuucauuaaauaaauuu

SEQ ID NO: 1420853 - RNA, 15 nt, Human
uuucauuaaauaaau

SEQ ID NO: 1420854 - RNA, 14 nt, Human
uuucauuaaauaaa

SEQ ID NO: 1420855 - RNA, 15 nt, Human
uuucauguuuuugau

SEQ ID NO: 1420856 - RNA, 19 nt, Human
uuucauguuaguuaccuua

SEQ ID NO: 1420857 - RNA, 16 nt, Human
uuucaugcuaucucug

SEQ ID NO: 1420858 - RNA, 18 nt, Human
uuucaugcaaacucuuug

SEQ ID NO: 1420859 - RNA, 17 nt, Human
uuucaugcaaacucuuu

SEQ ID NO: 1420860 - RNA, 13 nt, Human
uuucaugcaaacu

SEQ ID NO: 1420861 - RNA, 16 nt, Human
uuucaugauuagaaau

SEQ ID NO: 1420862 - RNA, 19 nt, Human
uuucaugcuaucucugugu

SEQ ID NO: 1420863 - RNA, 21 nt, Human
uuucaugcaaacucuuugguc

SEQ ID NO: 1420864 - RNA, 19 nt, Human
uuucaugcuguucaugaaa

SEQ ID NO: 1420865 - RNA, 22 nt, Human
uuucaucuucaguugucucuga

SEQ ID NO: 1420866 - RNA, 17 nt, Human
uuucaucuucaguuguc

SEQ ID NO: 1420867 - RNA, 16 nt, Human
uuucaucuucaguugu

SEQ ID NO: 1420868 - RNA, 15 nt, Human
uuucaucuucaguug

SEQ ID NO: 1420869 - RNA, 22 nt, Human
uuucaugauaaugaacagaaca

SEQ ID NO: 1420870 - RNA, 19 nt, Human
uuucaugauaaugaacaga

SEQ ID NO: 1420871 - RNA, 17 nt, Human
uuucaugaccaguaaag

SEQ ID NO: 1420872 - RNA, 24 nt, Human
uuucaugaccaguaaaggcugcug

SEQ ID NO: 1420873 - RNA, 11 nt, Human
uuucagacucc

SEQ ID NO: 1420874 - RNA, 21 nt, Human
uuucagacucccauuccugaa

SEQ ID NO: 1420875 - RNA, 15 nt, Human
uuucagaauauguca

SEQ ID NO: 1420876 - RNA, 23 nt, Human
uuucagaaguuaguuuguauaua

SEQ ID NO: 1420877 - RNA, 22 nt, Human
uuucagaaguuaguuuguauau

SEQ ID NO: 1420878 - RNA, 20 nt, Human
uuucagaaguuaguuuguau

SEQ ID NO: 1420879 - RNA, 16 nt, Human
uuucagaaguuaguuu

SEQ ID NO: 1420880 - RNA, 17 nt, Human
uuucauauuuuaaacag

SEQ ID NO: 1420881 - RNA, 16 nt, Human
auggaauacucuuaua

SEQ ID NO: 1420882 - RNA, 17 nt, Human
auggaauacucuuauau

SEQ ID NO: 1420883 - RNA, 21 nt, Human
augcuggcuauagaugucuuu

SEQ ID NO: 1420884 - RNA, 22 nt, Human
augcuggcuauagaugucuuuu

SEQ ID NO: 1420885 - RNA, 23 nt, Human
augcuggcccagggcccagagcc

SEQ ID NO: 1420886 - RNA, 20 nt, Human
augcuggccuugccacacuc

SEQ ID NO: 1420887 - RNA, 22 nt, Human
augcuggcccagggcccagagc

SEQ ID NO: 1420888 - RNA, 21 nt, Human
augcuggcccagggcccagag

SEQ ID NO: 1420889 - RNA, 20 nt, Human
augcuggcccagggcccaga

SEQ ID NO: 1420890 - RNA, 19 nt, Human
augcuggcccagggcccag

SEQ ID NO: 1420891 - RNA, 18 nt, Human
augcuggcccagggccca

SEQ ID NO: 1420892 - RNA, 16 nt, Human
augcuggcccagggcc

SEQ ID NO: 1420893 - RNA, 15 nt, Human
augcuggcccagggc

SEQ ID NO: 1420894 - RNA, 13 nt, Human
augcuggcccagg

SEQ ID NO: 1420895 - RNA, 12 nt, Human
augcuggcccag

SEQ ID NO: 1420896 - RNA, 19 nt, Human
augcucuccaaaccacuuu

SEQ ID NO: 1420897 - RNA, 16 nt, Human
augcuccuugggcccu

SEQ ID NO: 1420898 - RNA, 15 nt, Human
augcuccuugggccc

SEQ ID NO: 1420899 - RNA, 18 nt, Human
uuuauuacguaugucugg

SEQ ID NO: 1420900 - RNA, 16 nt, Human
uuuauuacuguaagaa

SEQ ID NO: 1420901 - RNA, 19 nt, Human
uuuauuacguaugucuggu

SEQ ID NO: 1420902 - RNA, 16 nt, Human
uuuauuacguaugucu

SEQ ID NO: 1420903 - RNA, 14 nt, Human
uuuauuacguaugu

SEQ ID NO: 1420904 - RNA, 22 nt, Human
augcuguacaucuauuuuggau

SEQ ID NO: 1420905 - RNA, 16 nt, Human
augcuguacaucuauu

SEQ ID NO: 1420906 - RNA, 12 nt, Human
augcuguacauc

SEQ ID NO: 1420907 - RNA, 22 nt, Human
augcugucuacacuaagagaga

SEQ ID NO: 1420908 - RNA, 23 nt, Human
augcugucuacacuaagagagaa

SEQ ID NO: 1420909 - RNA, 21 nt, Human
uuuaugguaacugcuuucugu

SEQ ID NO: 1420910 - RNA, 23 nt, Human
uuuaugguaacugcuuucuguuc

SEQ ID NO: 1420911 - RNA, 19 nt, Human
uuuaugguaaaaaauuuau

SEQ ID NO: 1420912 - RNA, 24 nt, Human
uuuauggcuuuugugcauuaucua

SEQ ID NO: 1420913 - RNA, 22 nt, Human
uuuaugggucagaguuccgacu

SEQ ID NO: 1420914 - RNA, 13 nt, Human
uuuauauaagcuu

SEQ ID NO: 1420915 - RNA, 21 nt, Human
uuuauguuauauauaaauaua

SEQ ID NO: 1420916 - RNA, 19 nt, Human
uuuauguuccauuaaacga

SEQ ID NO: 1420917 - RNA, 22 nt, Human
uuuauguuauauauaaauauau

SEQ ID NO: 1420918 - RNA, 20 nt, Human
uuuauguuauauauaaauau

SEQ ID NO: 1420919 - RNA, 17 nt, Human
uuuauguuauauauaaa

SEQ ID NO: 1420920 - RNA, 14 nt, Human
uuuauguuauauau

SEQ ID NO: 1420921 - RNA, 20 nt, Human
uuuauguuacuacaugcacu

SEQ ID NO: 1420922 - RNA, 20 nt, Human
uuuauguuaagggaagaauu

SEQ ID NO: 1420923 - RNA, 18 nt, Human
uuuauuaaaaacugagug

SEQ ID NO: 1420924 - RNA, 13 nt, Human
uuuauuaaaaacu

SEQ ID NO: 1420925 - RNA, 19 nt, Human
uuuagauuuucuuuugccu

SEQ ID NO: 1420926 - RNA, 19 nt, Human
uuuagauuuucugguucua

SEQ ID NO: 1420927 - RNA, 17 nt, Human
uuuagauguaauuuugu

SEQ ID NO: 1420928 - RNA, 21 nt, Human
uuuagaugauaaagagacagu

SEQ ID NO: 1420929 - RNA, 22 nt, Human
augcccccuaauccccuucucc

SEQ ID NO: 1420930 - RNA, 18 nt, Human
augccccaucccaugcug

SEQ ID NO: 1420931 - RNA, 10 nt, Human
uuuaggaaau

SEQ ID NO: 1420932 - RNA, 22 nt, Human
uuuagcuggaaaaguauguuag

SEQ ID NO: 1420933 - RNA, 18 nt, Human
uuuaggaagcaagcuuaa

SEQ ID NO: 1420934 - RNA, 22 nt, Human
uuuaggaaguugacuuauagua

SEQ ID NO: 1420935 - RNA, 22 nt, Human
uuuaguagcagugauugucuua

SEQ ID NO: 1420936 - RNA, 16 nt, Human
uuuaguaucuuuuuau

SEQ ID NO: 1420937 - RNA, 15 nt, Human
uuuagucaugugacc

SEQ ID NO: 1420938 - RNA, 21 nt, Human
uuuaguagcagugauugucuu

SEQ ID NO: 1420939 - RNA, 21 nt, Human
augagaaacuuaaauguuauu

SEQ ID NO: 1420940 - RNA, 20 nt, Human
augagaaacuuaaauguuau

SEQ ID NO: 1420941 - RNA, 11 nt, Human
augagaaacuu

SEQ ID NO: 1420942 - RNA, 21 nt, Human
augacuuucuuuuuguagcug

SEQ ID NO: 1420943 - RNA, 20 nt, Human
augacuuucuuuuuguagcu

SEQ ID NO: 1420944 - RNA, 22 nt, Human
augacuugggcacccccagccu

SEQ ID NO: 1420945 - RNA, 21 nt, Human
augacuugggcacccccagcc

SEQ ID NO: 1420946 - RNA, 20 nt, Human
augacuugggcacccccagc

SEQ ID NO: 1420947 - RNA, 23 nt, Human
augacuugggcacccccagccug

SEQ ID NO: 1420948 - RNA, 18 nt, Human
augacuugggcaccccca

SEQ ID NO: 1420949 - RNA, 16 nt, Human
augacuuacuguacau

SEQ ID NO: 1420950 - RNA, 17 nt, Human
augacuuacuguacaug

SEQ ID NO: 1420951 - RNA, 19 nt, Human
augacaauuuuuuccacuu

SEQ ID NO: 1420952 - RNA, 18 nt, Human
augacaaucauguguguu

SEQ ID NO: 1420953 - RNA, 17 nt, Human
augacaaucaugugugu

SEQ ID NO: 1420954 - RNA, 15 nt, Human
augaccaaaguccuu

SEQ ID NO: 1420955 - RNA, 18 nt, Human
augacauuuauuuuucau

SEQ ID NO: 1420956 - RNA, 22 nt, Human
augacauuuauaucacauguuu

SEQ ID NO: 1420957 - RNA, 14 nt, Human
augacuuacuguac

SEQ ID NO: 1420958 - RNA, 15 nt, Human
augagaaaucuaaaa

SEQ ID NO: 1420959 - RNA, 18 nt, Human
augagaaaucuaaaaaac

SEQ ID NO: 1420960 - RNA, 14 nt, Human
augagaacucugag

SEQ ID NO: 1420961 - RNA, 22 nt, Human
augagaaauacaaaaauacuca

SEQ ID NO: 1420962 - RNA, 13 nt, Human
augagaacaaaca

SEQ ID NO: 1420963 - RNA, 15 nt, Human
augagaaauacaaaa

SEQ ID NO: 1420964 - RNA, 19 nt, Human
augagaaagccuucuuuug

SEQ ID NO: 1420965 - RNA, 15 nt, Human
augagaaagccuucu

SEQ ID NO: 1420966 - RNA, 14 nt, Human
augagaaagccuuc

SEQ ID NO: 1420967 - RNA, 23 nt, Human
augagaaaucuaaaaaacgaaaa

SEQ ID NO: 1420968 - RNA, 18 nt, Human
augagaccacuguuauca

SEQ ID NO: 1420969 - RNA, 21 nt, Human
augagaauuugagugcucuga

SEQ ID NO: 1420970 - RNA, 23 nt, Human
augagaaucuacccccagaucca

SEQ ID NO: 1420971 - RNA, 11 nt, Human
augagaaucua

SEQ ID NO: 1420972 - RNA, 16 nt, Human
augagaaggaacuucc

SEQ ID NO: 1420973 - RNA, 19 nt, Human
augagagacacacugaaga

SEQ ID NO: 1420974 - RNA, 17 nt, Human
augagagacacacugaa

SEQ ID NO: 1420975 - RNA, 14 nt, Human
augagagacacacu

SEQ ID NO: 1420976 - RNA, 13 nt, Human
augagagacacac

SEQ ID NO: 1420977 - RNA, 12 nt, Human
augaauuuagug

SEQ ID NO: 1420978 - RNA, 19 nt, Human
uuguauauuguguuugugu

SEQ ID NO: 1420979 - RNA, 18 nt, Human
augaauuuuagcuuuugu

SEQ ID NO: 1420980 - RNA, 17 nt, Human
augaauuuuagcuuuug

SEQ ID NO: 1420981 - RNA, 16 nt, Human
augaauuuuagcuuuu

SEQ ID NO: 1420982 - RNA, 14 nt, Human
augaauuuuagcuu

SEQ ID NO: 1420983 - RNA, 14 nt, Human
augaauuuguaaug

SEQ ID NO: 1420984 - RNA, 19 nt, Human
augaauuuguaaugucuug

SEQ ID NO: 1420985 - RNA, 14 nt, Human
augacacaugcaag

SEQ ID NO: 1420986 - RNA, 22 nt, Human
augacacaugcaaggucauuuu

SEQ ID NO: 1420987 - RNA, 15 nt, Human
uuguauauuguguuu

SEQ ID NO: 1420988 - RNA, 13 nt, Human
uuguauauugugu

SEQ ID NO: 1420989 - RNA, 14 nt, Human
uuguauauuguaau

SEQ ID NO: 1420990 - RNA, 18 nt, Human
uuguauaguuaacacacu

SEQ ID NO: 1420991 - RNA, 19 nt, Human
uuguauaguuaacacacua

SEQ ID NO: 1420992 - RNA, 16 nt, Human
uuguauaguuaacaca

SEQ ID NO: 1420993 - RNA, 13 nt, Human
uuguauaguuaac

SEQ ID NO: 1420994 - RNA, 20 nt, Human
uuguauaccuuguaauuuga

SEQ ID NO: 1420995 - RNA, 17 nt, Human
uuguagugcuuugagag

SEQ ID NO: 1420996 - RNA, 23 nt, Human
uuguagugcuuugagagagaaag

SEQ ID NO: 1420997 - RNA, 19 nt, Human
uuguauaaaauaauuuuua

SEQ ID NO: 1420998 - RNA, 23 nt, Human
uuguaguguuggagaagaacuga

SEQ ID NO: 1420999 - RNA, 17 nt, Human
uuguauaaaauaauuuu

SEQ ID NO: 1421000 - RNA, 16 nt, Human
uuguauaaaauaauuu

SEQ ID NO: 1421001 - RNA, 14 nt, Human
uuguaggguuucua

SEQ ID NO: 1421002 - RNA, 13 nt, Human
uuguaggguuucu

SEQ ID NO: 1421003 - RNA, 21 nt, Human
uuguaguagcguuuuuuaaau

SEQ ID NO: 1421004 - RNA, 19 nt, Human
uuguagugccacuguuguu

SEQ ID NO: 1421005 - RNA, 22 nt, Human
uuguaguagcguuuuuuaaaug

SEQ ID NO: 1421006 - RNA, 23 nt, Human
uuguaguagcguuuuuuaaaugu

SEQ ID NO: 1421007 - RNA, 21 nt, Human
uuguaggggaggggcuccuuu

SEQ ID NO: 1421008 - RNA, 23 nt, Human
uuguacaaaauaaacaaauaaca

SEQ ID NO: 1421009 - RNA, 22 nt, Human
uugguucuugaggggaccagga

SEQ ID NO: 1421010 - RNA, 20 nt, Human
uugguugaaaauaaaaagau

SEQ ID NO: 1421011 - RNA, 23 nt, Human
uugguucuugaggggaccaggag

SEQ ID NO: 1421012 - RNA, 15 nt, Human
uugguucuugagggg

SEQ ID NO: 1421013 - RNA, 18 nt, Human
uugguucuagcgcaguuu

SEQ ID NO: 1421014 - RNA, 20 nt, Human
uugguucuagcgcaguuuuu

SEQ ID NO: 1421015 - RNA, 22 nt, Human
uugguuuaaagaaaguguauuu

SEQ ID NO: 1421016 - RNA, 18 nt, Human
uugguuuaaagaaagugu

SEQ ID NO: 1421017 - RNA, 17 nt, Human
uugguuuaaagaaagug

SEQ ID NO: 1421018 - RNA, 18 nt, Human
uugguugguaggguggga

SEQ ID NO: 1421019 - RNA, 23 nt, Human
uugguuuaaagaaaguguauuug

SEQ ID NO: 1421020 - RNA, 21 nt, Human
aucuuuacaaaacuacaugag

SEQ ID NO: 1421021 - RNA, 17 nt, Human
aucuuuacaaaacuaca

SEQ ID NO: 1421022 - RNA, 22 nt, Human
aucuuuaauuuuacauuuccua

SEQ ID NO: 1421023 - RNA, 16 nt, Human
aucuuuaauuuuacau

SEQ ID NO: 1421024 - RNA, 21 nt, Human
aucuuuaauuuuacauuuccu

SEQ ID NO: 1421025 - RNA, 16 nt, Human
aucuuugccacccuca

SEQ ID NO: 1421026 - RNA, 15 nt, Human
aucuuugccacccuc

SEQ ID NO: 1421027 - RNA, 15 nt, Human
aucuuuauaaaugua

SEQ ID NO: 1421028 - RNA, 14 nt, Human
aucuuugccacccu

SEQ ID NO: 1421029 - RNA, 19 nt, Human
aucuuuuuaccuuucauac

SEQ ID NO: 1421030 - RNA, 18 nt, Human
aucuuuuuaccuuucaua

SEQ ID NO: 1421031 - RNA, 12 nt, Human
augaaagauuca

SEQ ID NO: 1421032 - RNA, 13 nt, Human
aucuuuuuauuca

SEQ ID NO: 1421033 - RNA, 22 nt, Human
aucuuuuguauuaagaaaggaa

SEQ ID NO: 1421034 - RNA, 23 nt, Human
uuggcugagauaugaacauauug

SEQ ID NO: 1421035 - RNA, 22 nt, Human
uuggcugaaauucuccuggagg

SEQ ID NO: 1421036 - RNA, 21 nt, Human
uuggcugaaauucuccuggag

SEQ ID NO: 1421037 - RNA, 20 nt, Human
uuggcugaaauucuccugga

SEQ ID NO: 1421038 - RNA, 19 nt, Human
uuggcugaaauucuccugg

SEQ ID NO: 1421039 - RNA, 19 nt, Human
uuggcucugccaguccugu

SEQ ID NO: 1421040 - RNA, 23 nt, Human
uuggcucugccaguccuguccuu

SEQ ID NO: 1421041 - RNA, 16 nt, Human
uuggcucugccagucc

SEQ ID NO: 1421042 - RNA, 14 nt, Human
uuggcucugccagu

SEQ ID NO: 1421043 - RNA, 13 nt, Human
uuggcucugccag

SEQ ID NO: 1421044 - RNA, 12 nt, Human
uuggcucugcca

SEQ ID NO: 1421045 - RNA, 22 nt, Human
uuggcucgaaucucugugccuu

SEQ ID NO: 1421046 - RNA, 23 nt, Human
uuggcguaggcuacagagaagcc

SEQ ID NO: 1421047 - RNA, 22 nt, Human
uuggcguaggcuacagagaagc

SEQ ID NO: 1421048 - RNA, 21 nt, Human
uuggcguaggcuacagagaag

SEQ ID NO: 1421049 - RNA, 20 nt, Human
uuggcguaggcuacagagaa

SEQ ID NO: 1421050 - RNA, 19 nt, Human
uuggcguaggcuacagaga

SEQ ID NO: 1421051 - RNA, 18 nt, Human
uuggcguaggcuacagag

SEQ ID NO: 1421052 - RNA, 17 nt, Human
uuggcguaggcuacaga

SEQ ID NO: 1421053 - RNA, 22 nt, Human
uuggcggggaggaggaaauccc

SEQ ID NO: 1421054 - RNA, 18 nt, Human
uuggcuagagguucaaag

SEQ ID NO: 1421055 - RNA, 19 nt, Human
uuggauauuuuuuacuuua

SEQ ID NO: 1421056 - RNA, 19 nt, Human
uuggauauguaaaacauuu

SEQ ID NO: 1421057 - RNA, 19 nt, Human
uuggauacuuggauuuagu

SEQ ID NO: 1421058 - RNA, 18 nt, Human
uuggauccuguguggaga

SEQ ID NO: 1421059 - RNA, 13 nt, Human
uuggauccugugu

SEQ ID NO: 1421060 - RNA, 20 nt, Human
uuggauauguaaaacauuua

SEQ ID NO: 1421061 - RNA, 23 nt, Human
uuggaugcagugcucgcuguugc

SEQ ID NO: 1421062 - RNA, 24 nt, Human
uuggaugcagugcucgcuguugcu

SEQ ID NO: 1421063 - RNA, 22 nt, Human
uuggaguguuccccuuccacug

SEQ ID NO: 1421064 - RNA, 19 nt, Human
uuggaguguuccccuucca

SEQ ID NO: 1421065 - RNA, 23 nt, Human
aucuugcuucccuaaucuauggu

SEQ ID NO: 1421066 - RNA, 23 nt, Human
aucuugcuuucuuuguuuggcug

SEQ ID NO: 1421067 - RNA, 15 nt, Human
uuggagugcaguggc

SEQ ID NO: 1421068 - RNA, 18 nt, Human
uugguucuaaggaccuga

SEQ ID NO: 1421069 - RNA, 14 nt, Human
uugguucuaaggac

SEQ ID NO: 1421070 - RNA, 13 nt, Human
uugguucuaagga

SEQ ID NO: 1421071 - RNA, 15 nt, Human
uugguuccuucccaa

SEQ ID NO: 1421072 - RNA, 17 nt, Human
uuggggguucaggcccg

SEQ ID NO: 1421073 - RNA, 20 nt, Human
uuggggguccuccuccaggg

SEQ ID NO: 1421074 - RNA, 13 nt, Human
uuggggggguggc

SEQ ID NO: 1421075 - RNA, 20 nt, Human
uuggggggguggccgcugag

SEQ ID NO: 1421076 - RNA, 23 nt, Human
uuggggggaguaaagaauuauuu

SEQ ID NO: 1421077 - RNA, 19 nt, Human
uuggggggaaggggacccu

SEQ ID NO: 1421078 - RNA, 22 nt, Human
uuggggcaggaguagcugagcu

SEQ ID NO: 1421079 - RNA, 23 nt, Human
uuggggcaggaguagcugagcuc

SEQ ID NO: 1421080 - RNA, 20 nt, Human
uuggggcaggaguagcugag

SEQ ID NO: 1421081 - RNA, 19 nt, Human
uugggccugcuccagaccu

SEQ ID NO: 1421082 - RNA, 14 nt, Human
augaauuaaauaaa

SEQ ID NO: 1421083 - RNA, 14 nt, Human
augaauuaaagugg

SEQ ID NO: 1421084 - RNA, 22 nt, Human
augaauguuuacacucuuugua

SEQ ID NO: 1421085 - RNA, 11 nt, Human
augaauguuua

SEQ ID NO: 1421086 - RNA, 17 nt, Human
augaaugugaagccuuc

SEQ ID NO: 1421087 - RNA, 18 nt, Human
augaaugugaagccuucc

SEQ ID NO: 1421088 - RNA, 16 nt, Human
augaaugugaagccuu

SEQ ID NO: 1421089 - RNA, 15 nt, Human
augaaugugaagccu

SEQ ID NO: 1421090 - RNA, 19 nt, Human
uugggcccacaccuccuuc

SEQ ID NO: 1421091 - RNA, 18 nt, Human
uugggccagcuuuucaaa

SEQ ID NO: 1421092 - RNA, 17 nt, Human
uugggccagacaugcca

SEQ ID NO: 1421093 - RNA, 16 nt, Human
augaauuaaauaaacc

SEQ ID NO: 1421094 - RNA, 15 nt, Human
augaauuaaguuuuu

SEQ ID NO: 1421095 - RNA, 20 nt, Human
uugggcccacaccuccuucc

SEQ ID NO: 1421096 - RNA, 22 nt, Human
uugggcccacaccuccuucccu

SEQ ID NO: 1421097 - RNA, 20 nt, Human
uugggccugcuccagaccug

SEQ ID NO: 1421098 - RNA, 17 nt, Human
uugggccugcuccagac

SEQ ID NO: 1421099 - RNA, 16 nt, Human
uugggccugcuccaga

SEQ ID NO: 1421100 - RNA, 15 nt, Human
augaagauacugaaa

SEQ ID NO: 1421101 - RNA, 20 nt, Human
augaacuuagauuuuacaug

SEQ ID NO: 1421102 - RNA, 19 nt, Human
augaacuuagauuuuacau

SEQ ID NO: 1421103 - RNA, 12 nt, Human
augaacuuagau

SEQ ID NO: 1421104 - RNA, 16 nt, Human
augaacucuuaaucaa

SEQ ID NO: 1421105 - RNA, 14 nt, Human
augaacucaacuuu

SEQ ID NO: 1421106 - RNA, 20 nt, Human
augaaauauuauguuaaaac

SEQ ID NO: 1421107 - RNA, 18 nt, Human
augaaauauuauguuaaa

SEQ ID NO: 1421108 - RNA, 17 nt, Human
augaaauauuauguuaa

SEQ ID NO: 1421109 - RNA, 16 nt, Human
augaaugagaaucuac

SEQ ID NO: 1421110 - RNA, 14 nt, Human
augaaugugaagcc

SEQ ID NO: 1421111 - RNA, 22 nt, Human
augaagaucuaaauaaaaugcu

SEQ ID NO: 1421112 - RNA, 22 nt, Human
augaacuuagauuuuacaugaa

SEQ ID NO: 1421113 - RNA, 17 nt, Human
augaagauacugaaaua

SEQ ID NO: 1421114 - RNA, 16 nt, Human
augaagauacugaaau

SEQ ID NO: 1421115 - RNA, 20 nt, Human
uugauguaaggaugggcaug

SEQ ID NO: 1421116 - RNA, 23 nt, Human
uugauguaaagauguucuggaua

SEQ ID NO: 1421117 - RNA, 14 nt, Human
uugauguaaagaug

SEQ ID NO: 1421118 - RNA, 21 nt, Human
uugauguaaaaucuugucaug

SEQ ID NO: 1421119 - RNA, 18 nt, Human
uugauguaaaaucuuguc

SEQ ID NO: 1421120 - RNA, 16 nt, Human
uugauguaaaaucuug

SEQ ID NO: 1421121 - RNA, 15 nt, Human
uugauguaaaaucuu

SEQ ID NO: 1421122 - RNA, 13 nt, Human
uugauguaaaauc

SEQ ID NO: 1421123 - RNA, 19 nt, Human
uugauggugguauguuuuc

SEQ ID NO: 1421124 - RNA, 17 nt, Human
uugaugggauucuggac

SEQ ID NO: 1421125 - RNA, 18 nt, Human
uugauggugguauguuuu

SEQ ID NO: 1421126 - RNA, 14 nt, Human
uugaugccaaaaaa

SEQ ID NO: 1421127 - RNA, 14 nt, Human
uugauggagauauu

SEQ ID NO: 1421128 - RNA, 22 nt, Human
uugaugccaaaaaaaaauacau

SEQ ID NO: 1421129 - RNA, 15 nt, Human
uugaugggauuuggu

SEQ ID NO: 1421130 - RNA, 12 nt, Human
uugaugccuggc

SEQ ID NO: 1421131 - RNA, 12 nt, Human
aucucuucaguc

SEQ ID NO: 1421132 - RNA, 13 nt, Human
aucucuucagucu

SEQ ID NO: 1421133 - RNA, 21 nt, Human
aucucuucagucucuauacca

SEQ ID NO: 1421134 - RNA, 14 nt, Human
uugcacacuuuggu

SEQ ID NO: 1421135 - RNA, 20 nt, Human
uugcacacuuugguaccaga

SEQ ID NO: 1421136 - RNA, 19 nt, Human
uugcacagccaaauuuaaa

SEQ ID NO: 1421137 - RNA, 13 nt, Human
uugcacaugucuu

SEQ ID NO: 1421138 - RNA, 15 nt, Human
uugcacaugucuuaa

SEQ ID NO: 1421139 - RNA, 16 nt, Human
uugcacaugucuuaau

SEQ ID NO: 1421140 - RNA, 21 nt, Human
uugcacagucacugcucuuca

SEQ ID NO: 1421141 - RNA, 16 nt, Human
uugcacagcuaugaag

SEQ ID NO: 1421142 - RNA, 18 nt, Human
uugcacagccaaauuuaa

SEQ ID NO: 1421143 - RNA, 19 nt, Human
uugcacaaaccaauuaaac

SEQ ID NO: 1421144 - RNA, 15 nt, Human
uugcauguggaucaa

SEQ ID NO: 1421145 - RNA, 21 nt, Human
uugcauguaguaacacuaaua

SEQ ID NO: 1421146 - RNA, 16 nt, Human
uugcacauguuuccuc

SEQ ID NO: 1421147 - RNA, 17 nt, Human
uugcacaugucuuaaug

SEQ ID NO: 1421148 - RNA, 21 nt, Human
uugcacaugucuuaaugaagu

SEQ ID NO: 1421149 - RNA, 22 nt, Human
uugcacaugucuuaaugaaguu

SEQ ID NO: 1421150 - RNA, 20 nt, Human
uugcaucucccagauaaugu

SEQ ID NO: 1421151 - RNA, 23 nt, Human
uugcaucccaaaccacgccucuu

SEQ ID NO: 1421152 - RNA, 14 nt, Human
uugcaucugaaaau

SEQ ID NO: 1421153 - RNA, 20 nt, Human
aucucagaaagugccugaca

SEQ ID NO: 1421154 - RNA, 19 nt, Human
aucucagaaagugccugac

SEQ ID NO: 1421155 - RNA, 18 nt, Human
aucucagaaagugccuga

SEQ ID NO: 1421156 - RNA, 20 nt, Human
aucucagaucaguguaccau

SEQ ID NO: 1421157 - RNA, 17 nt, Human
aucucagaaagugccug

SEQ ID NO: 1421158 - RNA, 16 nt, Human
aucucagaaagugccu

SEQ ID NO: 1421159 - RNA, 15 nt, Human
aucucagaaagugcc

SEQ ID NO: 1421160 - RNA, 12 nt, Human
aucucagaaagu

SEQ ID NO: 1421161 - RNA, 17 nt, Human
aucucaggccagagcca

SEQ ID NO: 1421162 - RNA, 14 nt, Human
aucucaggccagag

SEQ ID NO: 1421163 - RNA, 18 nt, Human
aucucaggccagagccaa

SEQ ID NO: 1421164 - RNA, 14 nt, Human
aucucagcucacug

SEQ ID NO: 1421165 - RNA, 11 nt, Human
aucucagcuca

SEQ ID NO: 1421166 - RNA, 13 nt, Human
aucucagcucacu

SEQ ID NO: 1421167 - RNA, 15 nt, Human
aucucagcucacuac

SEQ ID NO: 1421168 - RNA, 23 nt, Human
auccuaugcaugguuucagcacu

SEQ ID NO: 1421169 - RNA, 22 nt, Human
auccuaugcaugguuucagcac

SEQ ID NO: 1421170 - RNA, 21 nt, Human
auccuaugcaugguuucagca

SEQ ID NO: 1421171 - RNA, 17 nt, Human
auccuaugcaugguuuc

SEQ ID NO: 1421172 - RNA, 13 nt, Human
auccuaugcaugg

SEQ ID NO: 1421173 - RNA, 21 nt, Human
auccuaucucuccaaccagau

SEQ ID NO: 1421174 - RNA, 16 nt, Human
auccuaucucuccaac

SEQ ID NO: 1421175 - RNA, 13 nt, Human
aucucaauauuuc

SEQ ID NO: 1421176 - RNA, 14 nt, Human
aucucaauucuucc

SEQ ID NO: 1421177 - RNA, 16 nt, Human
aucucaauucuucccu

SEQ ID NO: 1421178 - RNA, 19 nt, Human
aucucccauuuuggaauuu

SEQ ID NO: 1421179 - RNA, 19 nt, Human
aucucccaccuagcagcac

SEQ ID NO: 1421180 - RNA, 18 nt, Human
aucucccaccuagcagca

SEQ ID NO: 1421181 - RNA, 22 nt, Human
aucuccauugugccuaagucca

SEQ ID NO: 1421182 - RNA, 18 nt, Human
aucucccauuuuggaauu

SEQ ID NO: 1421183 - RNA, 17 nt, Human
aucucccauuuuggaau

SEQ ID NO: 1421184 - RNA, 20 nt, Human
aucucccagauaaugugaaa

SEQ ID NO: 1421185 - RNA, 19 nt, Human
aucucccagauaaugugaa

SEQ ID NO: 1421186 - RNA, 20 nt, Human
aucucccaccuagcagcacc

SEQ ID NO: 1421187 - RNA, 16 nt, Human
aucuccccaucauugg

SEQ ID NO: 1421188 - RNA, 23 nt, Human
aucucauuuuuccguaaaaauga

SEQ ID NO: 1421189 - RNA, 16 nt, Human
aucuccagcggcccug

SEQ ID NO: 1421190 - RNA, 13 nt, Human
aucuccaaaauaa

SEQ ID NO: 1421191 - RNA, 21 nt, Human
aucucauuuuuccguaaaaau

SEQ ID NO: 1421192 - RNA, 19 nt, Human
aucucaucucagugaagaa

SEQ ID NO: 1421193 - RNA, 20 nt, Human
aucucaucucagugaagaau

SEQ ID NO: 1421194 - RNA, 23 nt, Human
aucucauuuccaagcaaguauua

SEQ ID NO: 1421195 - RNA, 21 nt, Human
aucucaguugauuuucuggau

SEQ ID NO: 1421196 - RNA, 19 nt, Human
aucucaguugauuuucugg

SEQ ID NO: 1421197 - RNA, 17 nt, Human
aucucagugaagaauac

SEQ ID NO: 1421198 - RNA, 15 nt, Human
aucucagugaagaau

SEQ ID NO: 1421199 - RNA, 14 nt, Human
aucucagugaagaa

SEQ ID NO: 1421200 - RNA, 20 nt, Human
aucucagugaagaauacuuc

SEQ ID NO: 1421201 - RNA, 21 nt, Human
aucucauuuccaagcaaguau

SEQ ID NO: 1421202 - RNA, 13 nt, Human
uugcauuaugcaa

SEQ ID NO: 1421203 - RNA, 14 nt, Human
uugcauuaugcaau

SEQ ID NO: 1421204 - RNA, 22 nt, Human
uugcauuaaauucacaaacuuu

SEQ ID NO: 1421205 - RNA, 21 nt, Human
uugcauuaaauucacaaacuu

SEQ ID NO: 1421206 - RNA, 20 nt, Human
uugcauuaaauucacaaacu

SEQ ID NO: 1421207 - RNA, 13 nt, Human
uugcauuaaauuc

SEQ ID NO: 1421208 - RNA, 15 nt, Human
uugcauuaaauuaca

SEQ ID NO: 1421209 - RNA, 13 nt, Human
uugcauuaaauua

SEQ ID NO: 1421210 - RNA, 14 nt, Human
uugccguuauuaaa

SEQ ID NO: 1421211 - RNA, 20 nt, Human
aucugcagggggugugucug

SEQ ID NO: 1421212 - RNA, 21 nt, Human
aucugcaauucaaaaguucca

SEQ ID NO: 1421213 - RNA, 21 nt, Human
aucugauuuguaacccacuga

SEQ ID NO: 1421214 - RNA, 17 nt, Human
aucugauugugauguga

SEQ ID NO: 1421215 - RNA, 22 nt, Human
aucugauaggguuugugacagg

SEQ ID NO: 1421216 - RNA, 12 nt, Human
aucugauagggu

SEQ ID NO: 1421217 - RNA, 14 nt, Human
aucugaguccugga

SEQ ID NO: 1421218 - RNA, 17 nt, Human
aucugaguccuggauga

SEQ ID NO: 1421219 - RNA, 19 nt, Human
aucugaucagaacaaaugu

SEQ ID NO: 1421220 - RNA, 18 nt, Human
aucugaucagaacaaaug

SEQ ID NO: 1421221 - RNA, 23 nt, Human
uugccucaaauaaaaagugcuuu

SEQ ID NO: 1421222 - RNA, 13 nt, Human
aucugaguccugg

SEQ ID NO: 1421223 - RNA, 16 nt, Human
aucugagucagagcca

SEQ ID NO: 1421224 - RNA, 15 nt, Human
aucugugugaaacuu

SEQ ID NO: 1421225 - RNA, 20 nt, Human
aucugugugaaacuuucauu

SEQ ID NO: 1421226 - RNA, 15 nt, Human
aucugugucuuguuu

SEQ ID NO: 1421227 - RNA, 13 nt, Human
aucuuagauucuc

SEQ ID NO: 1421228 - RNA, 16 nt, Human
aucuuacuauuucaca

SEQ ID NO: 1421229 - RNA, 15 nt, Human
aucuugcuucccuaa

SEQ ID NO: 1421230 - RNA, 14 nt, Human
aucuugcuucccua

SEQ ID NO: 1421231 - RNA, 17 nt, Human
aucuugacuacagucag

SEQ ID NO: 1421232 - RNA, 16 nt, Human
aucuugacucacugca

SEQ ID NO: 1421233 - RNA, 23 nt, Human
aucuuagauucucugugucuaag

SEQ ID NO: 1421234 - RNA, 22 nt, Human
aucuuagauucucugugucuaa

SEQ ID NO: 1421235 - RNA, 20 nt, Human
aucuuagauucucugugucu

SEQ ID NO: 1421236 - RNA, 18 nt, Human
aucuuagauucucugugu

SEQ ID NO: 1421237 - RNA, 15 nt, Human
aucuuagauucucug

SEQ ID NO: 1421238 - RNA, 23 nt, Human
aucugguagaagggaaagcccau

SEQ ID NO: 1421239 - RNA, 14 nt, Human
aucugcauucccag

SEQ ID NO: 1421240 - RNA, 16 nt, Human
aucuguaaaucuacac

SEQ ID NO: 1421241 - RNA, 15 nt, Human
aucuguaaaucuaca

SEQ ID NO: 1421242 - RNA, 22 nt, Human
aucuguaaacuguguauuccaa

SEQ ID NO: 1421243 - RNA, 17 nt, Human
aucuguaaacuguguau

SEQ ID NO: 1421244 - RNA, 14 nt, Human
aucuguaaacugug

SEQ ID NO: 1421245 - RNA, 13 nt, Human
aucuguaaacugu

SEQ ID NO: 1421246 - RNA, 19 nt, Human
aucugguagaagggaaagc

SEQ ID NO: 1421247 - RNA, 18 nt, Human
aucuguaaugguacugac

SEQ ID NO: 1421248 - RNA, 18 nt, Human
auuuuauguugcauagaa

SEQ ID NO: 1421249 - RNA, 21 nt, Human
auuuuauguugcauagaauaa

SEQ ID NO: 1421250 - RNA, 12 nt, Human
auuuuauuauga

SEQ ID NO: 1421251 - RNA, 13 nt, Human
auuuuauuaugca

SEQ ID NO: 1421252 - RNA, 15 nt, Human
auuuuauuaugaaga

SEQ ID NO: 1421253 - RNA, 14 nt, Human
auuuuauuaugaag

SEQ ID NO: 1421254 - RNA, 17 nt, Human
auuuuauuaugcaugaa

SEQ ID NO: 1421255 - RNA, 14 nt, Human
auuuuauuaugcau

SEQ ID NO: 1421256 - RNA, 15 nt, Human
auuuuauuaugcaug

SEQ ID NO: 1421257 - RNA, 22 nt, Human
auuuuauuuaccccuccccuau

SEQ ID NO: 1421258 - RNA, 23 nt, Human
auuuuauuaugaagaaggugaau

SEQ ID NO: 1421259 - RNA, 22 nt, Human
auuuuauuaugaagaaggugaa

SEQ ID NO: 1421260 - RNA, 16 nt, Human
auuuuauuaugaagaa

SEQ ID NO: 1421261 - RNA, 21 nt, Human
auuuuacacgcuuuugugaug

SEQ ID NO: 1421262 - RNA, 12 nt, Human
auuuuacaauuu

SEQ ID NO: 1421263 - RNA, 13 nt, Human
auuuuacauaaau

SEQ ID NO: 1421264 - RNA, 20 nt, Human
auuuuacuguacagacagaa

SEQ ID NO: 1421265 - RNA, 22 nt, Human
auuuuacuguacagacagaaaa

SEQ ID NO: 1421266 - RNA, 16 nt, Human
auuuuaauaauguuuc

SEQ ID NO: 1421267 - RNA, 15 nt, Human
auuuuaauaauguuu

SEQ ID NO: 1421268 - RNA, 14 nt, Human
auuuuaauaauguu

SEQ ID NO: 1421269 - RNA, 16 nt, Human
auuuguauaugguauu

SEQ ID NO: 1421270 - RNA, 16 nt, Human
auuuguaggguuucua

SEQ ID NO: 1421271 - RNA, 19 nt, Human
auuuguaguguuggagaag

SEQ ID NO: 1421272 - RNA, 15 nt, Human
auuuggggcuuccaa

SEQ ID NO: 1421273 - RNA, 15 nt, Human
auuuggaauacuuuu

SEQ ID NO: 1421274 - RNA, 14 nt, Human
auuuggaauacuuu

SEQ ID NO: 1421275 - RNA, 13 nt, Human
auuuggaauacuu

SEQ ID NO: 1421276 - RNA, 17 nt, Human
auuuggaaccuuguuuu

SEQ ID NO: 1421277 - RNA, 17 nt, Human
auuuggguucugccugc

SEQ ID NO: 1421278 - RNA, 17 nt, Human
auuuggugguuucagaa

SEQ ID NO: 1421279 - RNA, 14 nt, Human
auuugggugggagu

SEQ ID NO: 1421280 - RNA, 17 nt, Human
auuuggguccaggagga

SEQ ID NO: 1421281 - RNA, 16 nt, Human
auuuggguccaggagg

SEQ ID NO: 1421282 - RNA, 15 nt, Human
auuuggguccaggag

SEQ ID NO: 1421283 - RNA, 14 nt, Human
auuuggguccagga

SEQ ID NO: 1421284 - RNA, 23 nt, Human
auuugguaaggggaauugaggac

SEQ ID NO: 1421285 - RNA, 17 nt, Human
auuugguuuucacauug

SEQ ID NO: 1421286 - RNA, 15 nt, Human
auuugguuuucacau

SEQ ID NO: 1421287 - RNA, 22 nt, Human
auuugguuuucacauuggaaac

SEQ ID NO: 1421288 - RNA, 21 nt, Human
auuugguuuucacauuggaaa

SEQ ID NO: 1421289 - RNA, 18 nt, Human
auuuggugguuucagaaa

SEQ ID NO: 1421290 - RNA, 20 nt, Human
auuuggugguuucagaaaug

SEQ ID NO: 1421291 - RNA, 23 nt, Human
auuuguacugaaaaaugguaauu

SEQ ID NO: 1421292 - RNA, 19 nt, Human
auuuguaaaaugacaauca

SEQ ID NO: 1421293 - RNA, 22 nt, Human
auuuguaaaaugacaaucaugu

SEQ ID NO: 1421294 - RNA, 16 nt, Human
auuuguaaaaugacaa

SEQ ID NO: 1421295 - RNA, 15 nt, Human
auuuguaaaaugaca

SEQ ID NO: 1421296 - RNA, 22 nt, Human
auuuguacuauuuaacugacua

SEQ ID NO: 1421297 - RNA, 20 nt, Human
auuuguacuauuuaacugac

SEQ ID NO: 1421298 - RNA, 19 nt, Human
auuuguacuauuuaacuga

SEQ ID NO: 1421299 - RNA, 18 nt, Human
auuuguaguguuggagaa

SEQ ID NO: 1421300 - RNA, 15 nt, Human
auuucuaauuaugua

SEQ ID NO: 1421301 - RNA, 19 nt, Human
auuucuaauuauguagcuc

SEQ ID NO: 1421302 - RNA, 14 nt, Human
auuucuaauuaugu

SEQ ID NO: 1421303 - RNA, 18 nt, Human
auuucuaauguuggacac

SEQ ID NO: 1421304 - RNA, 22 nt, Human
auuugaaugauuuuucuuuaca

SEQ ID NO: 1421305 - RNA, 12 nt, Human
auuugaaugcau

SEQ ID NO: 1421306 - RNA, 14 nt, Human
auuugaaugcauuu

SEQ ID NO: 1421307 - RNA, 20 nt, Human
auuugaaugauuuuucuuua

SEQ ID NO: 1421308 - RNA, 17 nt, Human
auuugaaugauuuuucu

SEQ ID NO: 1421309 - RNA, 20 nt, Human
auuucuuuugccguuauuaa

SEQ ID NO: 1421310 - RNA, 15 nt, Human
auuugaaugcauuuu

SEQ ID NO: 1421311 - RNA, 16 nt, Human
auuugaaugcauuuug

SEQ ID NO: 1421312 - RNA, 18 nt, Human
auuugaaugcauuuuguu

SEQ ID NO: 1421313 - RNA, 22 nt, Human
auuugaggacaaccauuccaga

SEQ ID NO: 1421314 - RNA, 15 nt, Human
auuugaggucuguuc

SEQ ID NO: 1421315 - RNA, 23 nt, Human
auuugaggucuguucuuuccaaa

SEQ ID NO: 1421316 - RNA, 16 nt, Human
auuugagugcucugau

SEQ ID NO: 1421317 - RNA, 14 nt, Human
auuugagugcucug

SEQ ID NO: 1421318 - RNA, 16 nt, Human
auuuggaaccuuguuu

SEQ ID NO: 1421319 - RNA, 23 nt, Human
auuuauuaaagaaaaaaauguau

SEQ ID NO: 1421320 - RNA, 20 nt, Human
auuuauuaaagaaaaaaaug

SEQ ID NO: 1421321 - RNA, 18 nt, Human
auuuauuaaagaaaaaaa

SEQ ID NO: 1421322 - RNA, 17 nt, Human
auuuauuaaagaaaaaa

SEQ ID NO: 1421323 - RNA, 16 nt, Human
auuuauuaaagaaaaa

SEQ ID NO: 1421324 - RNA, 15 nt, Human
auuuauuaaagaaaa

SEQ ID NO: 1421325 - RNA, 14 nt, Human
auuuauuaaagaaa

SEQ ID NO: 1421326 - RNA, 13 nt, Human
auuuauuaaagaa

SEQ ID NO: 1421327 - RNA, 12 nt, Human
auuuauuaaaga

SEQ ID NO: 1421328 - RNA, 19 nt, Human
auuuaguaauagccugggu

SEQ ID NO: 1421329 - RNA, 14 nt, Human
auuuaguaaaccaa

SEQ ID NO: 1421330 - RNA, 23 nt, Human
auuuagguuuuuguuuguuuccu

SEQ ID NO: 1421331 - RNA, 23 nt, Human
auuuagguuucugaguuccugca

SEQ ID NO: 1421332 - RNA, 22 nt, Human
auuuauuaaagaaaaaaaugua

SEQ ID NO: 1421333 - RNA, 13 nt, Human
auuuauuauggca

SEQ ID NO: 1421334 - RNA, 22 nt, Human
auuuauuacuguaagaaaauau

SEQ ID NO: 1421335 - RNA, 22 nt, Human
auuuagcuaaacggauuccaaa

SEQ ID NO: 1421336 - RNA, 21 nt, Human
auuuagcuaaacggauuccaa

SEQ ID NO: 1421337 - RNA, 22 nt, Human
auuuagccuguccugucaucau

SEQ ID NO: 1421338 - RNA, 16 nt, Human
auuuagccuguccugu

SEQ ID NO: 1421339 - RNA, 15 nt, Human
auuuagccuguccug

SEQ ID NO: 1421340 - RNA, 14 nt, Human
auuuagccuguccu

SEQ ID NO: 1421341 - RNA, 20 nt, Human
auuuagcauuguagugcuuu

SEQ ID NO: 1421342 - RNA, 22 nt, Human
auuuagcauuguagugcuuuga

SEQ ID NO: 1421343 - RNA, 19 nt, Human
auuuagcauuguagugcuu

SEQ ID NO: 1421344 - RNA, 13 nt, Human
auuuagcauugua

SEQ ID NO: 1421345 - RNA, 17 nt, Human
auuuacgcuuugauuca

SEQ ID NO: 1421346 - RNA, 15 nt, Human
auuuacgcuuugauu

SEQ ID NO: 1421347 - RNA, 15 nt, Human
auuuaccucagccug

SEQ ID NO: 1421348 - RNA, 16 nt, Human
auuuaccucagccugg

SEQ ID NO: 1421349 - RNA, 15 nt, Human
auuuagcauguuguu

SEQ ID NO: 1421350 - RNA, 19 nt, Human
auuuacgcuuugauucaua

SEQ ID NO: 1421351 - RNA, 21 nt, Human
auuuagguuucugaguuccug

SEQ ID NO: 1421352 - RNA, 17 nt, Human
auuuagguuucugaguu

SEQ ID NO: 1421353 - RNA, 14 nt, Human
auuuagguuucuga

SEQ ID NO: 1421354 - RNA, 17 nt, Human
auuuaggagaagccagg

SEQ ID NO: 1421355 - RNA, 14 nt, Human
auuuaggagaagcc

SEQ ID NO: 1421356 - RNA, 23 nt, Human
auuuagcuaaacggauuccaaag

SEQ ID NO: 1421357 - RNA, 16 nt, Human
auuuaggaaguugacu

SEQ ID NO: 1421358 - RNA, 23 nt, Human
auuuaggaaguugacuuauagua

SEQ ID NO: 1421359 - RNA, 14 nt, Human
auuuccuugaaugu

SEQ ID NO: 1421360 - RNA, 21 nt, Human
auuucuaaaucuccaaaauaa

SEQ ID NO: 1421361 - RNA, 12 nt, Human
auuucuaaaucu

SEQ ID NO: 1421362 - RNA, 13 nt, Human
auuucuaaaucuc

SEQ ID NO: 1421363 - RNA, 22 nt, Human
auuuccugggagcuuuuguaga

SEQ ID NO: 1421364 - RNA, 23 nt, Human
auuuccugggagcuuuuguagaa

SEQ ID NO: 1421365 - RNA, 16 nt, Human
auuuauuauggcacau

SEQ ID NO: 1421366 - RNA, 23 nt, Human
auuucuuuugccguuauuaaaaa

SEQ ID NO: 1421367 - RNA, 20 nt, Human
auugcgagagauguguguug

SEQ ID NO: 1421368 - RNA, 21 nt, Human
auugcguuugaccuuuuaugu

SEQ ID NO: 1421369 - RNA, 20 nt, Human
auugcguuugaccuuuuaug

SEQ ID NO: 1421370 - RNA, 21 nt, Human
auugcgagagauguguguuga

SEQ ID NO: 1421371 - RNA, 14 nt, Human
auuggcuuuauccu

SEQ ID NO: 1421372 - RNA, 17 nt, Human
auuggcuuuauccucuu

SEQ ID NO: 1421373 - RNA, 21 nt, Human
auuggcuuuauccucuuuaga

SEQ ID NO: 1421374 - RNA, 15 nt, Human
auuguauguggucau

SEQ ID NO: 1421375 - RNA, 19 nt, Human
auugcgagagauguguguu

SEQ ID NO: 1421376 - RNA, 17 nt, Human
auuguauauuguaauuu

SEQ ID NO: 1421377 - RNA, 15 nt, Human
auuguauauuguaau

SEQ ID NO: 1421378 - RNA, 17 nt, Human
auuguauauuguguuug

SEQ ID NO: 1421379 - RNA, 15 nt, Human
auuguauauuacaau

SEQ ID NO: 1421380 - RNA, 13 nt, Human
auuguauauugua

SEQ ID NO: 1421381 - RNA, 15 nt, Human
auuguauauucacuu

SEQ ID NO: 1421382 - RNA, 13 nt, Human
auuguauauucac

SEQ ID NO: 1421383 - RNA, 14 nt, Human
auuguauauucacu

SEQ ID NO: 1421384 - RNA, 17 nt, Human
auuguauauuacaauga

SEQ ID NO: 1421385 - RNA, 18 nt, Human
auuguauauuacaaugau

SEQ ID NO: 1421386 - RNA, 19 nt, Human
auuguauauuacaaugauc

SEQ ID NO: 1421387 - RNA, 20 nt, Human
auuguauauuacaaugauca

SEQ ID NO: 1421388 - RNA, 16 nt, Human
auugucuuaauauugu

SEQ ID NO: 1421389 - RNA, 15 nt, Human
auugugaaauuauuc

SEQ ID NO: 1421390 - RNA, 14 nt, Human
auuguauuacaaau

SEQ ID NO: 1421391 - RNA, 18 nt, Human
auugucugaacuugcauu

SEQ ID NO: 1421392 - RNA, 16 nt, Human
auugucugaacuugca

SEQ ID NO: 1421393 - RNA, 23 nt, Human
auugucugaaaagugaagacaga

SEQ ID NO: 1421394 - RNA, 15 nt, Human
auuguauuacaaauc

SEQ ID NO: 1421395 - RNA, 23 nt, Human
auuuaaaacagacacuggcaugg

SEQ ID NO: 1421396 - RNA, 18 nt, Human
auuuaaaacagacacugg

SEQ ID NO: 1421397 - RNA, 17 nt, Human
auuuaaaacagacacug

SEQ ID NO: 1421398 - RNA, 16 nt, Human
auuuaaaacagacacu

SEQ ID NO: 1421399 - RNA, 15 nt, Human
auuuaaaacagacac

SEQ ID NO: 1421400 - RNA, 22 nt, Human
auuguuucaauugcaucuccca

SEQ ID NO: 1421401 - RNA, 15 nt, Human
auugugcuucuuucu

SEQ ID NO: 1421402 - RNA, 22 nt, Human
auugugccaugucaaacaaaua

SEQ ID NO: 1421403 - RNA, 21 nt, Human
auugugccaugucaaacaaau

SEQ ID NO: 1421404 - RNA, 18 nt, Human
auugugccaugucaaaca

SEQ ID NO: 1421405 - RNA, 13 nt, Human
auuuaaaagauac

SEQ ID NO: 1421406 - RNA, 15 nt, Human
auuuaaagccuccuc

SEQ ID NO: 1421407 - RNA, 20 nt, Human
auuuaaagcagguucuuguu

SEQ ID NO: 1421408 - RNA, 19 nt, Human
auuuaaagcagguucuugu

SEQ ID NO: 1421409 - RNA, 16 nt, Human
auuuaaagcagguucu

SEQ ID NO: 1421410 - RNA, 15 nt, Human
auuuaaagcagguuc

SEQ ID NO: 1421411 - RNA, 12 nt, Human
auuuaaagcagg

SEQ ID NO: 1421412 - RNA, 11 nt, Human
auuuaaagcag

SEQ ID NO: 1421413 - RNA, 11 nt, Human
auuuaaaacuu

SEQ ID NO: 1421414 - RNA, 13 nt, Human
auuuaaaacuguu

SEQ ID NO: 1421415 - RNA, 21 nt, Human
auuuaaaacauuaaaauauaa

SEQ ID NO: 1421416 - RNA, 20 nt, Human
auuuaaaacauuaaaauaua

SEQ ID NO: 1421417 - RNA, 19 nt, Human
auuuaaaacauuaaaauau

SEQ ID NO: 1421418 - RNA, 13 nt, Human
auuuaaaacauua

SEQ ID NO: 1421419 - RNA, 14 nt, Human
auuuaaaguuguuu

SEQ ID NO: 1421420 - RNA, 22 nt, Human
auuuaaaguuguuugugccuuu

SEQ ID NO: 1421421 - RNA, 16 nt, Human
auuuaacagaaaugua

SEQ ID NO: 1421422 - RNA, 22 nt, Human
auuuaacagaaauuguauauug

SEQ ID NO: 1421423 - RNA, 20 nt, Human
auuuaacagaaauuguauau

SEQ ID NO: 1421424 - RNA, 18 nt, Human
auuuaacagaaauuguau

SEQ ID NO: 1421425 - RNA, 17 nt, Human
auuuaacagaaauugua

SEQ ID NO: 1421426 - RNA, 16 nt, Human
auuuaacagaaauugu

SEQ ID NO: 1421427 - RNA, 14 nt, Human
auuuaacagaaauu

SEQ ID NO: 1421428 - RNA, 20 nt, Human
auuuaacagaaauguacagc

SEQ ID NO: 1421429 - RNA, 17 nt, Human
auuuaacagaaauguac

SEQ ID NO: 1421430 - RNA, 19 nt, Human
auuuaacagaaauguacag

SEQ ID NO: 1421431 - RNA, 14 nt, Human
auuuaccucagccu

SEQ ID NO: 1421432 - RNA, 13 nt, Human
auuuaccucagcc

SEQ ID NO: 1421433 - RNA, 12 nt, Human
auuuaccucagc

SEQ ID NO: 1421434 - RNA, 11 nt, Human
auuuaccucag

SEQ ID NO: 1421435 - RNA, 18 nt, Human
auuuaccuaagauuacaa

SEQ ID NO: 1421436 - RNA, 17 nt, Human
auuuaccuaagauuaca

SEQ ID NO: 1421437 - RNA, 15 nt, Human
auuuaccuaagauua

SEQ ID NO: 1421438 - RNA, 14 nt, Human
auuuaccuaagauu

SEQ ID NO: 1421439 - RNA, 19 nt, Human
auuuacccuucuuuucuga

SEQ ID NO: 1421440 - RNA, 22 nt, Human
auuuacaacugggggaggguga

SEQ ID NO: 1421441 - RNA, 14 nt, Human
auuuacaaacugaa

SEQ ID NO: 1421442 - RNA, 15 nt, Human
auuuacaaacugaag

SEQ ID NO: 1421443 - RNA, 23 nt, Human
auuuacaaaaauauaaaauauga

SEQ ID NO: 1421444 - RNA, 20 nt, Human
auuuacaaaaauauaaaaua

SEQ ID NO: 1421445 - RNA, 19 nt, Human
auuuacaaaaauauaaaau

SEQ ID NO: 1421446 - RNA, 16 nt, Human
auuuacaaaugggaaa

SEQ ID NO: 1421447 - RNA, 13 nt, Human
auuuaacugacua

SEQ ID NO: 1421448 - RNA, 23 nt, Human
auuuaaccccccuguacacaacu

SEQ ID NO: 1421449 - RNA, 13 nt, Human
auuuaacugccuu

SEQ ID NO: 1421450 - RNA, 16 nt, Human
auuuaaccccccugua

SEQ ID NO: 1421451 - RNA, 13 nt, Human
auuuaacucucuu

SEQ ID NO: 1421452 - RNA, 18 nt, Human
auuuaaccucuaaauucu

SEQ ID NO: 1421453 - RNA, 21 nt, Human
auuuaaccccccuguacacaa

SEQ ID NO: 1421454 - RNA, 20 nt, Human
auuuaaccccccuguacaca

SEQ ID NO: 1421455 - RNA, 19 nt, Human
auuuaaccccccuguacac

SEQ ID NO: 1421456 - RNA, 18 nt, Human
auuuaaccccccuguaca

SEQ ID NO: 1421457 - RNA, 16 nt, Human
auuuaaccucuaaauu

SEQ ID NO: 1421458 - RNA, 22 nt, Human
auucucacagcuccaagaauuu

SEQ ID NO: 1421459 - RNA, 21 nt, Human
auucucacagcuccaagaauu

SEQ ID NO: 1421460 - RNA, 23 nt, Human
auucuagaucagaugcuccaaga

SEQ ID NO: 1421461 - RNA, 22 nt, Human
auucuagaucagaugcuccaag

SEQ ID NO: 1421462 - RNA, 19 nt, Human
auucucacagcuccaagaa

SEQ ID NO: 1421463 - RNA, 15 nt, Human
auugccucacuucag

SEQ ID NO: 1421464 - RNA, 18 nt, Human
auugccauauugcacaug

SEQ ID NO: 1421465 - RNA, 19 nt, Human
auugccauauugcacaugu

SEQ ID NO: 1421466 - RNA, 22 nt, Human
auugccauauugcacaugucuu

SEQ ID NO: 1421467 - RNA, 20 nt, Human
auugccaaaaagugaaauaa

SEQ ID NO: 1421468 - RNA, 19 nt, Human
auugcaguuuaucauucaa

SEQ ID NO: 1421469 - RNA, 18 nt, Human
auugcaguuuaucauuca

SEQ ID NO: 1421470 - RNA, 17 nt, Human
auugcaguuuaucauuc

SEQ ID NO: 1421471 - RNA, 14 nt, Human
auugcaguuuauca

SEQ ID NO: 1421472 - RNA, 23 nt, Human
auugcaguuuaucauucaagugu

SEQ ID NO: 1421473 - RNA, 22 nt, Human
auugccaccucuaacagcacca

SEQ ID NO: 1421474 - RNA, 21 nt, Human
auugccaccucuaacagcacc

SEQ ID NO: 1421475 - RNA, 12 nt, Human
auugccaccucu

SEQ ID NO: 1421476 - RNA, 14 nt, Human
auugccaagggcuu

SEQ ID NO: 1421477 - RNA, 12 nt, Human
auugccauauug

SEQ ID NO: 1421478 - RNA, 15 nt, Human
auugccauauugcac

SEQ ID NO: 1421479 - RNA, 16 nt, Human
auugccauauugcaca

SEQ ID NO: 1421480 - RNA, 17 nt, Human
auugccauauugcacau

SEQ ID NO: 1421481 - RNA, 17 nt, Human
auugcagaaaauucugu

SEQ ID NO: 1421482 - RNA, 18 nt, Human
auugcagaaaauucugug

SEQ ID NO: 1421483 - RNA, 21 nt, Human
auugcacaugucuuaaugaag

SEQ ID NO: 1421484 - RNA, 16 nt, Human
auugcacaugucuuaa

SEQ ID NO: 1421485 - RNA, 18 nt, Human
auugcacaugucuuaaug

SEQ ID NO: 1421486 - RNA, 20 nt, Human
auugcacaugucuuaaugaa

SEQ ID NO: 1421487 - RNA, 17 nt, Human
auugcaggauggugucu

SEQ ID NO: 1421488 - RNA, 14 nt, Human
auugcaggauggug

SEQ ID NO: 1421489 - RNA, 17 nt, Human
auugcaauaucugaagc

SEQ ID NO: 1421490 - RNA, 16 nt, Human
auugcaauaucugaag

SEQ ID NO: 1421491 - RNA, 14 nt, Human
auugcaauaucuga

SEQ ID NO: 1421492 - RNA, 20 nt, Human
auugaccgcgacuaauuuca

SEQ ID NO: 1421493 - RNA, 17 nt, Human
auugaccgcgacuaauu

SEQ ID NO: 1421494 - RNA, 23 nt, Human
auugaccgcgacuaauuucaaaa

SEQ ID NO: 1421495 - RNA, 19 nt, Human
auugcaaaucuugaaauua

SEQ ID NO: 1421496 - RNA, 17 nt, Human
auugcaaaucuugaaau

SEQ ID NO: 1421497 - RNA, 16 nt, Human
auugcaaaucuugaaa

SEQ ID NO: 1421498 - RNA, 12 nt, Human
auugcaaaucuu

SEQ ID NO: 1421499 - RNA, 22 nt, Human
auugaccuauuuccagaaauac

SEQ ID NO: 1421500 - RNA, 14 nt, Human
auucaguuucauaa

SEQ ID NO: 1421501 - RNA, 13 nt, Human
auucaguuucaua

SEQ ID NO: 1421502 - RNA, 19 nt, Human
auucaggacugcugguuug

SEQ ID NO: 1421503 - RNA, 18 nt, Human
auucaaaauaggguauau

SEQ ID NO: 1421504 - RNA, 21 nt, Human
auucaaaaguuccaagagucu

SEQ ID NO: 1421505 - RNA, 20 nt, Human
auucaaaauaggguauauuu

SEQ ID NO: 1421506 - RNA, 12 nt, Human
auuauuuucauc

SEQ ID NO: 1421507 - RNA, 23 nt, Human
auuauuuucauccuugucuuauu

SEQ ID NO: 1421508 - RNA, 14 nt, Human
auucagcucaugga

SEQ ID NO: 1421509 - RNA, 12 nt, Human
auuccgucacca

SEQ ID NO: 1421510 - RNA, 19 nt, Human
auuccggauccuaagcauc

SEQ ID NO: 1421511 - RNA, 16 nt, Human
auuccggauccuaagc

SEQ ID NO: 1421512 - RNA, 15 nt, Human
auuccggauccuaag

SEQ ID NO: 1421513 - RNA, 13 nt, Human
auuccggauccua

SEQ ID NO: 1421514 - RNA, 19 nt, Human
auucccuuccugccagccc

SEQ ID NO: 1421515 - RNA, 23 nt, Human
auucccuuccugccagccccugc

SEQ ID NO: 1421516 - RNA, 15 nt, Human
auucccuuccugcca

SEQ ID NO: 1421517 - RNA, 16 nt, Human
auucccuucaucugga

SEQ ID NO: 1421518 - RNA, 19 nt, Human
auucccuucaucuggaacc

SEQ ID NO: 1421519 - RNA, 15 nt, Human
auucaguuuucauuu

SEQ ID NO: 1421520 - RNA, 13 nt, Human
auucaguuuucau

SEQ ID NO: 1421521 - RNA, 17 nt, Human
auucaguuucauaaaag

SEQ ID NO: 1421522 - RNA, 14 nt, Human
auucaguuuucauu

SEQ ID NO: 1421523 - RNA, 16 nt, Human
auuccaccugcaauca

SEQ ID NO: 1421524 - RNA, 16 nt, Human
auuccaugugcccagu

SEQ ID NO: 1421525 - RNA, 14 nt, Human
auuccaugugccca

SEQ ID NO: 1421526 - RNA, 17 nt, Human
auuccaugacugcuugc

SEQ ID NO: 1421527 - RNA, 20 nt, Human
auuccaugacugcuugcccu

SEQ ID NO: 1421528 - RNA, 14 nt, Human
auuccaugacugcu

SEQ ID NO: 1421529 - RNA, 13 nt, Human
auuccaugacugc

SEQ ID NO: 1421530 - RNA, 23 nt, Human
auuccauugguccaagauuccgg

SEQ ID NO: 1421531 - RNA, 17 nt, Human
auuccauugguccaaga

SEQ ID NO: 1421532 - RNA, 16 nt, Human
auuccauugguccaag

SEQ ID NO: 1421533 - RNA, 15 nt, Human
auuccaugugcccag

SEQ ID NO: 1421534 - RNA, 21 nt, Human
auuccauucuggaagugacuu

SEQ ID NO: 1421535 - RNA, 20 nt, Human
auuacugccauucacuucau

SEQ ID NO: 1421536 - RNA, 13 nt, Human
auuacugccauuc

SEQ ID NO: 1421537 - RNA, 17 nt, Human
auuacugcaugcacuuc

SEQ ID NO: 1421538 - RNA, 14 nt, Human
auuacugcaugcac

SEQ ID NO: 1421539 - RNA, 15 nt, Human
auuacucugaaauug

SEQ ID NO: 1421540 - RNA, 19 nt, Human
auuaccuguggauauuugu

SEQ ID NO: 1421541 - RNA, 16 nt, Human
auuaccuguggauauu

SEQ ID NO: 1421542 - RNA, 15 nt, Human
auuaccuguggauau

SEQ ID NO: 1421543 - RNA, 14 nt, Human
auuaccuguggaua

SEQ ID NO: 1421544 - RNA, 14 nt, Human
auuaccaaccuguu

SEQ ID NO: 1421545 - RNA, 17 nt, Human
auuaccuccugagaaaa

SEQ ID NO: 1421546 - RNA, 13 nt, Human
auuaccuccugag

SEQ ID NO: 1421547 - RNA, 12 nt, Human
auuaccuccuga

SEQ ID NO: 1421548 - RNA, 16 nt, Human
auuaccaaccuguuac

SEQ ID NO: 1421549 - RNA, 15 nt, Human
auuacauuuucagug

SEQ ID NO: 1421550 - RNA, 19 nt, Human
auuaccacagacauacuaa

SEQ ID NO: 1421551 - RNA, 16 nt, Human
auuacauuuguauaaa

SEQ ID NO: 1421552 - RNA, 15 nt, Human
auuacauuuguauaa

SEQ ID NO: 1421553 - RNA, 19 nt, Human
auuaaugaaaauaagaauu

SEQ ID NO: 1421554 - RNA, 17 nt, Human
auuaaugaaaauaagaa

SEQ ID NO: 1421555 - RNA, 12 nt, Human
auuaaugcacuu

SEQ ID NO: 1421556 - RNA, 11 nt, Human
auuaaugcacu

SEQ ID NO: 1421557 - RNA, 13 nt, Human
auuacauuuguau

SEQ ID NO: 1421558 - RNA, 20 nt, Human
auuaagagagucuauuuacg

SEQ ID NO: 1421559 - RNA, 13 nt, Human
uuuuuuaaaaaag

SEQ ID NO: 1421560 - RNA, 12 nt, Human
uuuuuguugaca

SEQ ID NO: 1421561 - RNA, 15 nt, Human
uuuuuguuuguuugu

SEQ ID NO: 1421562 - RNA, 13 nt, Human
uuuuuguugacau

SEQ ID NO: 1421563 - RNA, 20 nt, Human
uuuuuguucugguccuuuuu

SEQ ID NO: 1421564 - RNA, 23 nt, Human
uuuuuuaaaaaagaaacauuugg

SEQ ID NO: 1421565 - RNA, 16 nt, Human
auuaaucugccucccu

SEQ ID NO: 1421566 - RNA, 22 nt, Human
auuaaucuuaguguaugauuac

SEQ ID NO: 1421567 - RNA, 21 nt, Human
auuaaucuuaguguaugauua

SEQ ID NO: 1421568 - RNA, 20 nt, Human
auuaaucuuaguguaugauu

SEQ ID NO: 1421569 - RNA, 19 nt, Human
auuaaucuuaguguaugau

SEQ ID NO: 1421570 - RNA, 17 nt, Human
auuaaucuuaguguaug

SEQ ID NO: 1421571 - RNA, 16 nt, Human
auuaaucuuaguguau

SEQ ID NO: 1421572 - RNA, 20 nt, Human
auuaauaucccuacauguau

SEQ ID NO: 1421573 - RNA, 19 nt, Human
auuaauaucccuacaugua

SEQ ID NO: 1421574 - RNA, 18 nt, Human
auuaauaucccuacaugu

SEQ ID NO: 1421575 - RNA, 17 nt, Human
auuaauauauauuaucu

SEQ ID NO: 1421576 - RNA, 21 nt, Human
auuaaguaaugauaacuggaa

SEQ ID NO: 1421577 - RNA, 15 nt, Human
auuaaguaaugauaa

SEQ ID NO: 1421578 - RNA, 13 nt, Human
auuaaguaaugau

SEQ ID NO: 1421579 - RNA, 16 nt, Human
auuauuuauauaugua

SEQ ID NO: 1421580 - RNA, 16 nt, Human
auuauuccucaaaaaa

SEQ ID NO: 1421581 - RNA, 13 nt, Human
auuauuacagugu

SEQ ID NO: 1421582 - RNA, 15 nt, Human
auuauuacaguguuu

SEQ ID NO: 1421583 - RNA, 16 nt, Human
auuauuaauuuaugca

SEQ ID NO: 1421584 - RNA, 22 nt, Human
auuauuaaugaaaauaagaauu

SEQ ID NO: 1421585 - RNA, 12 nt, Human
auuauuuguguu

SEQ ID NO: 1421586 - RNA, 22 nt, Human
auuauuuguguuuuaauuuaaa

SEQ ID NO: 1421587 - RNA, 15 nt, Human
auuauuuguguuuua

SEQ ID NO: 1421588 - RNA, 15 nt, Human
auuauuuauguauug

SEQ ID NO: 1421589 - RNA, 14 nt, Human
auuauuuauguauu

SEQ ID NO: 1421590 - RNA, 19 nt, Human
auuauuuauguauggugca

SEQ ID NO: 1421591 - RNA, 16 nt, Human
auuauuuauguauggu

SEQ ID NO: 1421592 - RNA, 14 nt, Human
auuauuuauguaug

SEQ ID NO: 1421593 - RNA, 13 nt, Human
auuauuuauguau

SEQ ID NO: 1421594 - RNA, 12 nt, Human
auuauuuaugua

SEQ ID NO: 1421595 - RNA, 16 nt, Human
auuauuuuauguugca

SEQ ID NO: 1421596 - RNA, 18 nt, Human
auuauuuuauguugcaua

SEQ ID NO: 1421597 - RNA, 14 nt, Human
auuaucccagcugc

SEQ ID NO: 1421598 - RNA, 17 nt, Human
auuauccauauugaguc

SEQ ID NO: 1421599 - RNA, 14 nt, Human
auuauccauauuga

SEQ ID NO: 1421600 - RNA, 17 nt, Human
auuauccagguaaucca

SEQ ID NO: 1421601 - RNA, 21 nt, Human
auuaucaggcaaauuugcauu

SEQ ID NO: 1421602 - RNA, 20 nt, Human
auuaucaggcaaauuugcau

SEQ ID NO: 1421603 - RNA, 12 nt, Human
auuaucagaugc

SEQ ID NO: 1421604 - RNA, 19 nt, Human
auuaucaauuaccacacca

SEQ ID NO: 1421605 - RNA, 17 nt, Human
auuauauuuacaaaugg

SEQ ID NO: 1421606 - RNA, 19 nt, Human
auuaucguuuucuuaaagu

SEQ ID NO: 1421607 - RNA, 14 nt, Human
auuauuaaugaaaa

SEQ ID NO: 1421608 - RNA, 23 nt, Human
auuauuaacauaccuaagaagua

SEQ ID NO: 1421609 - RNA, 14 nt, Human
auuaucugggcuua

SEQ ID NO: 1421610 - RNA, 12 nt, Human
auuaucuuaaaa

SEQ ID NO: 1421611 - RNA, 19 nt, Human
auuaucuauagcuaaguac

SEQ ID NO: 1421612 - RNA, 22 nt, Human
auuaucuauagcuaaguacaca

SEQ ID NO: 1421613 - RNA, 18 nt, Human
auuauagauucuaaagau

SEQ ID NO: 1421614 - RNA, 17 nt, Human
auuauagauucuaaaga

SEQ ID NO: 1421615 - RNA, 16 nt, Human
auuauagauucuaaag

SEQ ID NO: 1421616 - RNA, 15 nt, Human
auuauagauucuaaa

SEQ ID NO: 1421617 - RNA, 14 nt, Human
auuauagauucuaa

SEQ ID NO: 1421618 - RNA, 13 nt, Human
auuauagauucua

SEQ ID NO: 1421619 - RNA, 21 nt, Human
auuauacuuguaauuauggag

SEQ ID NO: 1421620 - RNA, 20 nt, Human
auuauacuuguaauuaugga

SEQ ID NO: 1421621 - RNA, 18 nt, Human
auuauaaucuuauaauug

SEQ ID NO: 1421622 - RNA, 14 nt, Human
auuauaaugaauuu

SEQ ID NO: 1421623 - RNA, 13 nt, Human
auuauaaugaauu

SEQ ID NO: 1421624 - RNA, 19 nt, Human
auuauagauucuaaagauu

SEQ ID NO: 1421625 - RNA, 17 nt, Human
auuauaggaucauuugu

SEQ ID NO: 1421626 - RNA, 16 nt, Human
auuauauuuacaaaug

SEQ ID NO: 1421627 - RNA, 21 nt, Human
auuagaagacaauugacaaca

SEQ ID NO: 1421628 - RNA, 21 nt, Human
auuagaaauauuuuaaaauca

SEQ ID NO: 1421629 - RNA, 22 nt, Human
auuagaaauuaccuguggauau

SEQ ID NO: 1421630 - RNA, 24 nt, Human
auuagaaauauuuuaaaaucagcu

SEQ ID NO: 1421631 - RNA, 17 nt, Human
auuagaaauauuuuaaa

SEQ ID NO: 1421632 - RNA, 15 nt, Human
auuagaaauauuuua

SEQ ID NO: 1421633 - RNA, 14 nt, Human
auuagaaauauuuu

SEQ ID NO: 1421634 - RNA, 12 nt, Human
auuagaaauauu

SEQ ID NO: 1421635 - RNA, 15 nt, Human
auuagaaauaaagca

SEQ ID NO: 1421636 - RNA, 14 nt, Human
auuacuuuugcugu

SEQ ID NO: 1421637 - RNA, 14 nt, Human
auuacuuugugaau

SEQ ID NO: 1421638 - RNA, 23 nt, Human
auuacuuuggggcuaauuuaaca

SEQ ID NO: 1421639 - RNA, 21 nt, Human
auuacuuuggggcuaauuuaa

SEQ ID NO: 1421640 - RNA, 22 nt, Human
auuacuggccuuuuucauuuau

SEQ ID NO: 1421641 - RNA, 21 nt, Human
auuacuggccuuuuucauuua

SEQ ID NO: 1421642 - RNA, 17 nt, Human
auuacuggccuuuuuca

SEQ ID NO: 1421643 - RNA, 14 nt, Human
auuauaaucuuaua

SEQ ID NO: 1421644 - RNA, 22 nt, Human
auuauaauauacuauauuuaug

SEQ ID NO: 1421645 - RNA, 19 nt, Human
auuagagggaggagaauga

SEQ ID NO: 1421646 - RNA, 16 nt, Human
auuagagccuguaaac

SEQ ID NO: 1421647 - RNA, 13 nt, Human
auuagagccugua

SEQ ID NO: 1421648 - RNA, 20 nt, Human
auuagagauuaccuccugag

SEQ ID NO: 1421649 - RNA, 13 nt, Human
auuagaauuauuu

SEQ ID NO: 1421650 - RNA, 14 nt, Human
auuagaauuauuua

SEQ ID NO: 1421651 - RNA, 21 nt, Human
auuagaaucaaacauuuugaa

SEQ ID NO: 1421652 - RNA, 20 nt, Human
auuagaaucaaacauuuuga

SEQ ID NO: 1421653 - RNA, 19 nt, Human
auuagaaucaaacauuuug

SEQ ID NO: 1421654 - RNA, 14 nt, Human
uuuuaaguugcuga

SEQ ID NO: 1421655 - RNA, 23 nt, Human
auguuaguuaccuuauaguuacu

SEQ ID NO: 1421656 - RNA, 22 nt, Human
auguuaguuaccuuauaguuac

SEQ ID NO: 1421657 - RNA, 21 nt, Human
auguuaguuaccuuauaguua

SEQ ID NO: 1421658 - RNA, 20 nt, Human
auguuaguuaccuuauaguu

SEQ ID NO: 1421659 - RNA, 14 nt, Human
auguuauauauaaa

SEQ ID NO: 1421660 - RNA, 16 nt, Human
uuuuaagugcugcauu

SEQ ID NO: 1421661 - RNA, 17 nt, Human
uuuuaagugcugcauuu

SEQ ID NO: 1421662 - RNA, 21 nt, Human
uuuuaagugcugcauuuaaaa

SEQ ID NO: 1421663 - RNA, 22 nt, Human
auguuauauauaaauauauuau

SEQ ID NO: 1421664 - RNA, 19 nt, Human
auguuauauauaaauauau

SEQ ID NO: 1421665 - RNA, 18 nt, Human
auguuauauauaaauaua

SEQ ID NO: 1421666 - RNA, 17 nt, Human
auguuauauauaaauau

SEQ ID NO: 1421667 - RNA, 15 nt, Human
auguuauauauaaau

SEQ ID NO: 1421668 - RNA, 16 nt, Human
auguuaucuucucaag

SEQ ID NO: 1421669 - RNA, 15 nt, Human
auguuaucuucucaa

SEQ ID NO: 1421670 - RNA, 19 nt, Human
auguugaauacuuuuuaca

SEQ ID NO: 1421671 - RNA, 15 nt, Human
auguugaauacuuuu

SEQ ID NO: 1421672 - RNA, 14 nt, Human
auguugaauacuuu

SEQ ID NO: 1421673 - RNA, 15 nt, Human
auguugacaugggac

SEQ ID NO: 1421674 - RNA, 23 nt, Human
uuuuagccuucucuguucauuuc

SEQ ID NO: 1421675 - RNA, 16 nt, Human
uuuuagccuucucugu

SEQ ID NO: 1421676 - RNA, 23 nt, Human
uuuuagcaaagauaucucaucuc

SEQ ID NO: 1421677 - RNA, 22 nt, Human
uuuuagauuuucugguucuaac

SEQ ID NO: 1421678 - RNA, 22 nt, Human
uuuuaguuuuucauuaaauaaa

SEQ ID NO: 1421679 - RNA, 16 nt, Human
uuuuaguuuuucauua

SEQ ID NO: 1421680 - RNA, 12 nt, Human
uuuuauaaacuu

SEQ ID NO: 1421681 - RNA, 13 nt, Human
uuuuauaaacuuu

SEQ ID NO: 1421682 - RNA, 18 nt, Human
auguugauuacagugcag

SEQ ID NO: 1421683 - RNA, 22 nt, Human
auguugagaaucccaaauuuga

SEQ ID NO: 1421684 - RNA, 16 nt, Human
auguugagaaucccaa

SEQ ID NO: 1421685 - RNA, 15 nt, Human
auguugcauagaaua

SEQ ID NO: 1421686 - RNA, 18 nt, Human
uuuuaguuuuucauuaaa

SEQ ID NO: 1421687 - RNA, 19 nt, Human
uuuuauaaacuuuaccuuu

SEQ ID NO: 1421688 - RNA, 14 nt, Human
uuuuauaaacuuua

SEQ ID NO: 1421689 - RNA, 17 nt, Human
uuuuauaaacuuuaccu

SEQ ID NO: 1421690 - RNA, 22 nt, Human
uuuuauaaauacugcaaaucag

SEQ ID NO: 1421691 - RNA, 13 nt, Human
uuuuauaaauacu

SEQ ID NO: 1421692 - RNA, 14 nt, Human
uuuuauaauuuugu

SEQ ID NO: 1421693 - RNA, 19 nt, Human
uuuuauggcacuaguauuu

SEQ ID NO: 1421694 - RNA, 22 nt, Human
uuuuauggcacuaguauuucua

SEQ ID NO: 1421695 - RNA, 19 nt, Human
uuuuauaauucucauuaaa

SEQ ID NO: 1421696 - RNA, 18 nt, Human
uuuuaugugaaacauguu

SEQ ID NO: 1421697 - RNA, 19 nt, Human
uuuuauguaguaauugaca

SEQ ID NO: 1421698 - RNA, 19 nt, Human
uuuuaugugaaacauguuu

SEQ ID NO: 1421699 - RNA, 22 nt, Human
uuuuauguugcauagaauaaaa

SEQ ID NO: 1421700 - RNA, 14 nt, Human
uuuuauuaugcauu

SEQ ID NO: 1421701 - RNA, 20 nt, Human
uuuuccaggcuucugcuggg

SEQ ID NO: 1421702 - RNA, 19 nt, Human
uuuuccaggcuucugcugg

SEQ ID NO: 1421703 - RNA, 17 nt, Human
uuuuccaggcuucugcu

SEQ ID NO: 1421704 - RNA, 18 nt, Human
uuuucauuaaauaaauuu

SEQ ID NO: 1421705 - RNA, 14 nt, Human
uuuucauuaaauaa

SEQ ID NO: 1421706 - RNA, 20 nt, Human
uuuucauuaaauaaauuuga

SEQ ID NO: 1421707 - RNA, 22 nt, Human
uuuucauuaaauaaauuugacu

SEQ ID NO: 1421708 - RNA, 20 nt, Human
uuuucauuccaugugcccag

SEQ ID NO: 1421709 - RNA, 21 nt, Human
uuuucauuccaugugcccagu

SEQ ID NO: 1421710 - RNA, 19 nt, Human
uuuucagcaaacucuuuuc

SEQ ID NO: 1421711 - RNA, 18 nt, Human
uuuucagcaaacucuuuu

SEQ ID NO: 1421712 - RNA, 17 nt, Human
uuuucagaugugaacca

SEQ ID NO: 1421713 - RNA, 18 nt, Human
uuuucagaugugaaccau

SEQ ID NO: 1421714 - RNA, 11 nt, Human
uuuucagaugu

SEQ ID NO: 1421715 - RNA, 21 nt, Human
uuuuauucagcucauggacuu

SEQ ID NO: 1421716 - RNA, 22 nt, Human
auuaagaaggcaaaaauguaaa

SEQ ID NO: 1421717 - RNA, 19 nt, Human
auuaagaaggcaaaaaugu

SEQ ID NO: 1421718 - RNA, 15 nt, Human
auuaagaaggcaaaa

SEQ ID NO: 1421719 - RNA, 23 nt, Human
auuaagaaaggaagcauuguaaa

SEQ ID NO: 1421720 - RNA, 12 nt, Human
auuaagaaauag

SEQ ID NO: 1421721 - RNA, 11 nt, Human
auuaagaaaua

SEQ ID NO: 1421722 - RNA, 17 nt, Human
auuaagaaaggaagcau

SEQ ID NO: 1421723 - RNA, 13 nt, Human
auuaagaaaggaa

SEQ ID NO: 1421724 - RNA, 12 nt, Human
auuaagaaagga

SEQ ID NO: 1421725 - RNA, 13 nt, Human
auuaacuuuaaug

SEQ ID NO: 1421726 - RNA, 23 nt, Human
auuaacuuuuauaaacuuuaccu

SEQ ID NO: 1421727 - RNA, 18 nt, Human
auuaacuggguaaugaaa

SEQ ID NO: 1421728 - RNA, 17 nt, Human
auuaacucauuagacug

SEQ ID NO: 1421729 - RNA, 12 nt, Human
auuaacucauua

SEQ ID NO: 1421730 - RNA, 15 nt, Human
auuaacgauguccaa

SEQ ID NO: 1421731 - RNA, 14 nt, Human
auuaaccucugcac

SEQ ID NO: 1421732 - RNA, 19 nt, Human
auuaacuggguaaugaaac

SEQ ID NO: 1421733 - RNA, 22 nt, Human
auuaacuggguaaugaaacaaa

SEQ ID NO: 1421734 - RNA, 12 nt, Human
auuaacuuuuau

SEQ ID NO: 1421735 - RNA, 16 nt, Human
auuaacuuuuauaaac

SEQ ID NO: 1421736 - RNA, 17 nt, Human
auuaacuuuuauaaacu

SEQ ID NO: 1421737 - RNA, 19 nt, Human
auuaacuuuuauaaacuuu

SEQ ID NO: 1421738 - RNA, 20 nt, Human
auuaacuuuuauaaacuuua

SEQ ID NO: 1421739 - RNA, 13 nt, Human
auuaaccucugca

SEQ ID NO: 1421740 - RNA, 13 nt, Human
auuaaccucucac

SEQ ID NO: 1421741 - RNA, 13 nt, Human
auuaaccuagaga

SEQ ID NO: 1421742 - RNA, 11 nt, Human
auuaaccuaga

SEQ ID NO: 1421743 - RNA, 21 nt, Human
auuaacccacuagcucuuguu

SEQ ID NO: 1421744 - RNA, 17 nt, Human
auuaaacuuaaucuaaa

SEQ ID NO: 1421745 - RNA, 19 nt, Human
auuaaacuuaaucuaaaug

SEQ ID NO: 1421746 - RNA, 21 nt, Human
auuaaacuuaaucuaaaugga

SEQ ID NO: 1421747 - RNA, 18 nt, Human
auuaaaauauaaucucua

SEQ ID NO: 1421748 - RNA, 13 nt, Human
auuaaaauauaau

SEQ ID NO: 1421749 - RNA, 16 nt, Human
auuaaaagcaaaucau

SEQ ID NO: 1421750 - RNA, 22 nt, Human
auuaaaagcaaaucauuuguuu

SEQ ID NO: 1421751 - RNA, 15 nt, Human
auuaaaagcaaauca

SEQ ID NO: 1421752 - RNA, 15 nt, Human
auuaaaagacucauc

SEQ ID NO: 1421753 - RNA, 14 nt, Human
auuaaaagacucau

SEQ ID NO: 1421754 - RNA, 13 nt, Human
auuaaaagacuca

SEQ ID NO: 1421755 - RNA, 12 nt, Human
auuaaaagacuc

SEQ ID NO: 1421756 - RNA, 11 nt, Human
auuaaaagacu

SEQ ID NO: 1421757 - RNA, 18 nt, Human
auuaaaaagguuuacaga

SEQ ID NO: 1421758 - RNA, 19 nt, Human
auuaaaaagguuuacagaa

SEQ ID NO: 1421759 - RNA, 20 nt, Human
auuaaaaacugagugacucu

SEQ ID NO: 1421760 - RNA, 14 nt, Human
auuaaaaacugagu

SEQ ID NO: 1421761 - RNA, 13 nt, Human
auuaaaaacugag

SEQ ID NO: 1421762 - RNA, 18 nt, Human
auuaaaaaagauaaacac

SEQ ID NO: 1421763 - RNA, 23 nt, Human
auguuuucgaaaaucaaauggua

SEQ ID NO: 1421764 - RNA, 21 nt, Human
auguuuucugaaaauauaacc

SEQ ID NO: 1421765 - RNA, 20 nt, Human
auguuuucugaaaauauaac

SEQ ID NO: 1421766 - RNA, 18 nt, Human
auguuuucugaaaauaua

SEQ ID NO: 1421767 - RNA, 22 nt, Human
auguuuucgaaaaucaaauggu

SEQ ID NO: 1421768 - RNA, 20 nt, Human
auguuuucgaaaaucaaaug

SEQ ID NO: 1421769 - RNA, 18 nt, Human
auguuuucgaaaaucaaa

SEQ ID NO: 1421770 - RNA, 19 nt, Human
auguuuuuguucaaagcca

SEQ ID NO: 1421771 - RNA, 22 nt, Human
auguuuuugaucaaaaacuauu

SEQ ID NO: 1421772 - RNA, 22 nt, Human
auguugucuaagaaauugaaua

SEQ ID NO: 1421773 - RNA, 17 nt, Human
auguugucuaagaaauu

SEQ ID NO: 1421774 - RNA, 16 nt, Human
auguugucuaagaaau

SEQ ID NO: 1421775 - RNA, 14 nt, Human
auguugucuaagaa

SEQ ID NO: 1421776 - RNA, 13 nt, Human
auguugucuaaga

SEQ ID NO: 1421777 - RNA, 19 nt, Human
auguuguaauauuucuuca

SEQ ID NO: 1421778 - RNA, 17 nt, Human
auguuguaauauuucuu

SEQ ID NO: 1421779 - RNA, 14 nt, Human
auguuguaauauuu

SEQ ID NO: 1421780 - RNA, 14 nt, Human
auguuguaagcaac

SEQ ID NO: 1421781 - RNA, 23 nt, Human
uuuucuauuucacuggagcacaa

SEQ ID NO: 1421782 - RNA, 16 nt, Human
uuuucuauuuuaauaa

SEQ ID NO: 1421783 - RNA, 18 nt, Human
uuuucuauuucacuggag

SEQ ID NO: 1421784 - RNA, 21 nt, Human
uuuucuauuaaaagacucauc

SEQ ID NO: 1421785 - RNA, 20 nt, Human
uuuucuauuaaaagacucau

SEQ ID NO: 1421786 - RNA, 19 nt, Human
uuuucuauuaaaagacuca

SEQ ID NO: 1421787 - RNA, 18 nt, Human
uuuucuauuaaaagacuc

SEQ ID NO: 1421788 - RNA, 17 nt, Human
uuuucuauuaaaagacu

SEQ ID NO: 1421789 - RNA, 16 nt, Human
uuuucuauuaaaagac

SEQ ID NO: 1421790 - RNA, 15 nt, Human
uuuucuauuaaaaga

SEQ ID NO: 1421791 - RNA, 14 nt, Human
uuuucuauuaaaag

SEQ ID NO: 1421792 - RNA, 13 nt, Human
uuuucuauuaaaa

SEQ ID NO: 1421793 - RNA, 12 nt, Human
uuuucuauuaaa

SEQ ID NO: 1421794 - RNA, 11 nt, Human
uuuucuauuaa

SEQ ID NO: 1421795 - RNA, 21 nt, Human
auguuucaaacauauauaaca

SEQ ID NO: 1421796 - RNA, 14 nt, Human
auguuuauuucagg

SEQ ID NO: 1421797 - RNA, 19 nt, Human
auguuuauucuucuagagu

SEQ ID NO: 1421798 - RNA, 21 nt, Human
auguuuauucuucuagaguuc

SEQ ID NO: 1421799 - RNA, 18 nt, Human
auguuucaaacauauaua

SEQ ID NO: 1421800 - RNA, 18 nt, Human
auguuuagacuuuaacau

SEQ ID NO: 1421801 - RNA, 17 nt, Human
auguuuagacuuuaaca

SEQ ID NO: 1421802 - RNA, 21 nt, Human
auguuuagacuuuaacauaag

SEQ ID NO: 1421803 - RNA, 19 nt, Human
auguuuagacuuuaacaua

SEQ ID NO: 1421804 - RNA, 18 nt, Human
auguuuauucuucuagag

SEQ ID NO: 1421805 - RNA, 17 nt, Human
auguuuauucuucuaga

SEQ ID NO: 1421806 - RNA, 16 nt, Human
auguuuauucuucuag

SEQ ID NO: 1421807 - RNA, 22 nt, Human
auguuuacacucuuuguaagag

SEQ ID NO: 1421808 - RNA, 13 nt, Human
uuuuaaaaaagaa

SEQ ID NO: 1421809 - RNA, 18 nt, Human
uuuguuugaacugauaaa

SEQ ID NO: 1421810 - RNA, 15 nt, Human
uuuguuugguauugu

SEQ ID NO: 1421811 - RNA, 16 nt, Human
uuuguuugguauugua

SEQ ID NO: 1421812 - RNA, 18 nt, Human
uuuguuugguauuguauu

SEQ ID NO: 1421813 - RNA, 23 nt, Human
uuuuaaaaaagcuuaaaacuuug

SEQ ID NO: 1421814 - RNA, 22 nt, Human
uuuuaaaaaagcuuaaaacuuu

SEQ ID NO: 1421815 - RNA, 21 nt, Human
uuuuaaaaaagcuuaaaacuu

SEQ ID NO: 1421816 - RNA, 20 nt, Human
uuuuaaaaaagcuuaaaacu

SEQ ID NO: 1421817 - RNA, 17 nt, Human
uuuuaaaaaagcuuaaa

SEQ ID NO: 1421818 - RNA, 15 nt, Human
uuuuaaaaaagcuua

SEQ ID NO: 1421819 - RNA, 14 nt, Human
uuuuaaaaaagcuu

SEQ ID NO: 1421820 - RNA, 14 nt, Human
uuuuaaaaagcaaa

SEQ ID NO: 1421821 - RNA, 16 nt, Human
uuuuaaaaaaugguca

SEQ ID NO: 1421822 - RNA, 17 nt, Human
uuuuaaaaaauggucac

SEQ ID NO: 1421823 - RNA, 20 nt, Human
uuuuaaaaauuguuaauuuu

SEQ ID NO: 1421824 - RNA, 17 nt, Human
uuuuaaaaauagacacu

SEQ ID NO: 1421825 - RNA, 13 nt, Human
uuuuaaaacccag

SEQ ID NO: 1421826 - RNA, 13 nt, Human
uuuuaacauuccu

SEQ ID NO: 1421827 - RNA, 14 nt, Human
uuuuaacauuccuc

SEQ ID NO: 1421828 - RNA, 15 nt, Human
uuuuaaaagaaugau

SEQ ID NO: 1421829 - RNA, 14 nt, Human
uuuuaaaagaauga

SEQ ID NO: 1421830 - RNA, 18 nt, Human
uuuuaacuuuguuuuauu

SEQ ID NO: 1421831 - RNA, 14 nt, Human
uuuuaacuuuguuu

SEQ ID NO: 1421832 - RNA, 13 nt, Human
uuuuaacuuuguu

SEQ ID NO: 1421833 - RNA, 12 nt, Human
uuuuaacuuugu

SEQ ID NO: 1421834 - RNA, 11 nt, Human
uuuuaacuuug

SEQ ID NO: 1421835 - RNA, 14 nt, Human
uuuuaacuguggau

SEQ ID NO: 1421836 - RNA, 13 nt, Human
uuuuaagaauauc

SEQ ID NO: 1421837 - RNA, 19 nt, Human
uuuuaagaauugaguaaug

SEQ ID NO: 1421838 - RNA, 15 nt, Human
uuuuaacuuuguuuu

SEQ ID NO: 1421839 - RNA, 16 nt, Human
uuuuaagaauaucugu

SEQ ID NO: 1421840 - RNA, 15 nt, Human
uuuuaagcucugagc

SEQ ID NO: 1421841 - RNA, 15 nt, Human
uuuuaaguauuuagg

SEQ ID NO: 1421842 - RNA, 15 nt, Human
uuuuaagugcugcau

SEQ ID NO: 1421843 - RNA, 16 nt, Human
uuuuaaguaaggaauu

SEQ ID NO: 1421844 - RNA, 12 nt, Human
augucuuaauga

SEQ ID NO: 1421845 - RNA, 16 nt, Human
augucuguucuacaua

SEQ ID NO: 1421846 - RNA, 13 nt, Human
augucuuaaugaa

SEQ ID NO: 1421847 - RNA, 16 nt, Human
augucuuaaugaaguu

SEQ ID NO: 1421848 - RNA, 18 nt, Human
augucuuaaugaaguuug

SEQ ID NO: 1421849 - RNA, 19 nt, Human
augucuuaaugaaguuuga

SEQ ID NO: 1421850 - RNA, 14 nt, Human
augucuguucuaca

SEQ ID NO: 1421851 - RNA, 14 nt, Human
augucuguggauuu

SEQ ID NO: 1421852 - RNA, 21 nt, Human
augucugguucucaauuccaa

SEQ ID NO: 1421853 - RNA, 23 nt, Human
augucugguucucaauuccaaca

SEQ ID NO: 1421854 - RNA, 19 nt, Human
augucugguucucaauucc

SEQ ID NO: 1421855 - RNA, 17 nt, Human
augucugguucucaauu

SEQ ID NO: 1421856 - RNA, 16 nt, Human
augucugguucucaau

SEQ ID NO: 1421857 - RNA, 14 nt, Human
augucugguucuca

SEQ ID NO: 1421858 - RNA, 13 nt, Human
augucugguucuc

SEQ ID NO: 1421859 - RNA, 12 nt, Human
augucuggggca

SEQ ID NO: 1421860 - RNA, 23 nt, Human
augucuggagaccaccagggcau

SEQ ID NO: 1421861 - RNA, 18 nt, Human
augucuggagaccaccag

SEQ ID NO: 1421862 - RNA, 14 nt, Human
augucuggagacca

SEQ ID NO: 1421863 - RNA, 13 nt, Human
augucuggagacc

SEQ ID NO: 1421864 - RNA, 12 nt, Human
augucuggagac

SEQ ID NO: 1421865 - RNA, 19 nt, Human
uuuguaacccacugagagg

SEQ ID NO: 1421866 - RNA, 15 nt, Human
uuuguacugaaaaau

SEQ ID NO: 1421867 - RNA, 14 nt, Human
uuuguacugaaaaa

SEQ ID NO: 1421868 - RNA, 19 nt, Human
uuuguaccauuuuaaaguu

SEQ ID NO: 1421869 - RNA, 18 nt, Human
uuuguacauuugggaguu

SEQ ID NO: 1421870 - RNA, 18 nt, Human
uuugugagucaauacaua

SEQ ID NO: 1421871 - RNA, 15 nt, Human
uuugugauacaaugc

SEQ ID NO: 1421872 - RNA, 17 nt, Human
uuuguuucuuucucuga

SEQ ID NO: 1421873 - RNA, 12 nt, Human
uuuguuugaacu

SEQ ID NO: 1421874 - RNA, 13 nt, Human
uuuguuugaacug

SEQ ID NO: 1421875 - RNA, 14 nt, Human
uuuguuugaacuga

SEQ ID NO: 1421876 - RNA, 19 nt, Human
uuugucgcucaugugugca

SEQ ID NO: 1421877 - RNA, 20 nt, Human
uuuguagcuggggcuuugau

SEQ ID NO: 1421878 - RNA, 17 nt, Human
uuuguagaagucacauu

SEQ ID NO: 1421879 - RNA, 23 nt, Human
uuugggagagacuuguuuuggau

SEQ ID NO: 1421880 - RNA, 14 nt, Human
uuugggagagacuu

SEQ ID NO: 1421881 - RNA, 21 nt, Human
uuugggagacaugugacauuu

SEQ ID NO: 1421882 - RNA, 18 nt, Human
uuugggagacaugugaca

SEQ ID NO: 1421883 - RNA, 16 nt, Human
uuugggagacauguga

SEQ ID NO: 1421884 - RNA, 16 nt, Human
uuugggaauauuugaa

SEQ ID NO: 1421885 - RNA, 17 nt, Human
uuugggaauauuugaau

SEQ ID NO: 1421886 - RNA, 22 nt, Human
uuugggaagugaagacuggaag

SEQ ID NO: 1421887 - RNA, 20 nt, Human
uuugggaagugaagacugga

SEQ ID NO: 1421888 - RNA, 16 nt, Human
uuuggcuaguccuugu

SEQ ID NO: 1421889 - RNA, 18 nt, Human
uuuggggcagaaaggacu

SEQ ID NO: 1421890 - RNA, 20 nt, Human
uuuggggcaggaguagcuga

SEQ ID NO: 1421891 - RNA, 14 nt, Human
uuuggggauauuuu

SEQ ID NO: 1421892 - RNA, 17 nt, Human
uuuggccaucugcuccu

SEQ ID NO: 1421893 - RNA, 23 nt, Human
uuuggccaaugcaccuaaagaaa

SEQ ID NO: 1421894 - RNA, 21 nt, Human
uuugcuguuuuaaacauuaau

SEQ ID NO: 1421895 - RNA, 21 nt, Human
uuugcugugaggcuguccugu

SEQ ID NO: 1421896 - RNA, 19 nt, Human
uuugcugugaggcuguccu

SEQ ID NO: 1421897 - RNA, 17 nt, Human
uuugcugugaggcuguc

SEQ ID NO: 1421898 - RNA, 18 nt, Human
uuugcucagcuucuccaa

SEQ ID NO: 1421899 - RNA, 13 nt, Human
uuugcucauggaa

SEQ ID NO: 1421900 - RNA, 18 nt, Human
uuugcccagaaagaagau

SEQ ID NO: 1421901 - RNA, 19 nt, Human
uuugcacauguuuccucua

SEQ ID NO: 1421902 - RNA, 16 nt, Human
uuugcacagcucuccg

SEQ ID NO: 1421903 - RNA, 12 nt, Human
uuugcacagcuc

SEQ ID NO: 1421904 - RNA, 24 nt, Human
uuugcaaggugcauuuuuacuauu

SEQ ID NO: 1421905 - RNA, 21 nt, Human
uuugcuaauuuuuauuaauuu

SEQ ID NO: 1421906 - RNA, 14 nt, Human
uuugcuaauuuuua

SEQ ID NO: 1421907 - RNA, 12 nt, Human
uuugcccuuuga

SEQ ID NO: 1421908 - RNA, 14 nt, Human
uuugccccuuuaua

SEQ ID NO: 1421909 - RNA, 13 nt, Human
uuugcccauuuug

SEQ ID NO: 1421910 - RNA, 12 nt, Human
uuugcucaugga

SEQ ID NO: 1421911 - RNA, 11 nt, Human
uuugcucaugg

SEQ ID NO: 1421912 - RNA, 12 nt, Human
auguauggugca

SEQ ID NO: 1421913 - RNA, 22 nt, Human
auguauggugcaauguguguau

SEQ ID NO: 1421914 - RNA, 21 nt, Human
auguauggguaggguaaauca

SEQ ID NO: 1421915 - RNA, 19 nt, Human
auguauggguaggguaaau

SEQ ID NO: 1421916 - RNA, 17 nt, Human
auguaucauagaaaugu

SEQ ID NO: 1421917 - RNA, 16 nt, Human
auguaucauagaaaug

SEQ ID NO: 1421918 - RNA, 23 nt, Human
auguauaacuaggagcuuugacu

SEQ ID NO: 1421919 - RNA, 11 nt, Human
auguaucacua

SEQ ID NO: 1421920 - RNA, 20 nt, Human
auguaguuuuuauauguugu

SEQ ID NO: 1421921 - RNA, 21 nt, Human
auguaguuuuuauauguugua

SEQ ID NO: 1421922 - RNA, 18 nt, Human
auguaguucugcuccaga

SEQ ID NO: 1421923 - RNA, 17 nt, Human
auguaguucugcuccag

SEQ ID NO: 1421924 - RNA, 23 nt, Human
auguaguauuuuuuguauaauug

SEQ ID NO: 1421925 - RNA, 22 nt, Human
auguaguauuuuuuguauaauu

SEQ ID NO: 1421926 - RNA, 21 nt, Human
auguaguauuuuuuguauaau

SEQ ID NO: 1421927 - RNA, 12 nt, Human
auguaguauuuu

SEQ ID NO: 1421928 - RNA, 15 nt, Human
uuuggggcuugauga

SEQ ID NO: 1421929 - RNA, 20 nt, Human
augucaggguaccuggggcc

SEQ ID NO: 1421930 - RNA, 17 nt, Human
augucaguaccuucaaa

SEQ ID NO: 1421931 - RNA, 14 nt, Human
auguccauuuacac

SEQ ID NO: 1421932 - RNA, 16 nt, Human
augucuauucagcuuc

SEQ ID NO: 1421933 - RNA, 15 nt, Human
augucuauucagcuu

SEQ ID NO: 1421934 - RNA, 14 nt, Human
augucuauucagcu

SEQ ID NO: 1421935 - RNA, 22 nt, Human
augucuauaaaccgaacugaug

SEQ ID NO: 1421936 - RNA, 22 nt, Human
cacaguggaaagacagcuucuc

SEQ ID NO: 1421937 - RNA, 18 nt, Human
cacagugcucuuuucucc

SEQ ID NO: 1421938 - RNA, 16 nt, Human
cacagugcucuuuucu

SEQ ID NO: 1421939 - RNA, 14 nt, Human
cacagcuuuugcaa

SEQ ID NO: 1421940 - RNA, 16 nt, Human
cacaguguuggagguu

SEQ ID NO: 1421941 - RNA, 13 nt, Human
cacagcuuuugca

SEQ ID NO: 1421942 - RNA, 12 nt, Human
cacagcuuuugc

SEQ ID NO: 1421943 - RNA, 19 nt, Human
cacaggaaccacaagacug

SEQ ID NO: 1421944 - RNA, 13 nt, Human
cacaggaaaccag

SEQ ID NO: 1421945 - RNA, 22 nt, Human
cacagcuugaccugaggcugug

SEQ ID NO: 1421946 - RNA, 21 nt, Human
cacagcuugaccugaggcugu

SEQ ID NO: 1421947 - RNA, 20 nt, Human
cacagcuugaccugaggcug

SEQ ID NO: 1421948 - RNA, 19 nt, Human
cacagcuugaccugaggcu

SEQ ID NO: 1421949 - RNA, 18 nt, Human
cacagcuugaccugaggc

SEQ ID NO: 1421950 - RNA, 15 nt, Human
cacagcugccucuuc

SEQ ID NO: 1421951 - RNA, 22 nt, Human
cacagcugccucuucccucuuc

SEQ ID NO: 1421952 - RNA, 17 nt, Human
caaacugaggaauuuca

SEQ ID NO: 1421953 - RNA, 21 nt, Human
caaacaaaaagguucucaggu

SEQ ID NO: 1421954 - RNA, 20 nt, Human
caaacaaaaagguucucagg

SEQ ID NO: 1421955 - RNA, 14 nt, Human
caaacaccuuccag

SEQ ID NO: 1421956 - RNA, 21 nt, Human
caaacaccuuccagcuccugu

SEQ ID NO: 1421957 - RNA, 12 nt, Human
caaacaccuucc

SEQ ID NO: 1421958 - RNA, 15 nt, Human
caaacaccucccagg

SEQ ID NO: 1421959 - RNA, 14 nt, Human
caaacaccucccag

SEQ ID NO: 1421960 - RNA, 16 nt, Human
caaacaaaaagguucu

SEQ ID NO: 1421961 - RNA, 18 nt, Human
caaaaucuugaucaguua

SEQ ID NO: 1421962 - RNA, 16 nt, Human
caaaaucuugaucagu

SEQ ID NO: 1421963 - RNA, 23 nt, Human
caaaaucucuccacuuucagcug

SEQ ID NO: 1421964 - RNA, 22 nt, Human
caaaaucuugaucaguuaagaa

SEQ ID NO: 1421965 - RNA, 20 nt, Human
caaaccugaccccugcucag

SEQ ID NO: 1421966 - RNA, 19 nt, Human
caaaccugaccccugcuca

SEQ ID NO: 1421967 - RNA, 19 nt, Human
caaacuccugaccucaggc

SEQ ID NO: 1421968 - RNA, 17 nt, Human
caaacugaagcagccuc

SEQ ID NO: 1421969 - RNA, 19 nt, Human
caaacucuuuggucguuuu

SEQ ID NO: 1421970 - RNA, 18 nt, Human
caaacuccugaccucagg

SEQ ID NO: 1421971 - RNA, 23 nt, Human
caaacugaagcagccucucccca

SEQ ID NO: 1421972 - RNA, 16 nt, Human
caaacugacucuuaag

SEQ ID NO: 1421973 - RNA, 14 nt, Human
caaacucuuugguc

SEQ ID NO: 1421974 - RNA, 21 nt, Human
caaacugacucuuaagaagac

SEQ ID NO: 1421975 - RNA, 17 nt, Human
caaacugacucuuaaga

SEQ ID NO: 1421976 - RNA, 23 nt, Human
caaaaguuccaagagucuaaaga

SEQ ID NO: 1421977 - RNA, 18 nt, Human
caaaaguuccaagagucu

SEQ ID NO: 1421978 - RNA, 14 nt, Human
caaaaguuccaaga

SEQ ID NO: 1421979 - RNA, 19 nt, Human
caaaaguuacauguuugca

SEQ ID NO: 1421980 - RNA, 18 nt, Human
caaaaguuacauguuugc

SEQ ID NO: 1421981 - RNA, 15 nt, Human
caaaacugcauuuca

SEQ ID NO: 1421982 - RNA, 18 nt, Human
caaaaguuuguuugcuua

SEQ ID NO: 1421983 - RNA, 19 nt, Human
caaaacucuacuuaaucca

SEQ ID NO: 1421984 - RNA, 11 nt, Human
caaaacucuac

SEQ ID NO: 1421985 - RNA, 18 nt, Human
auuuuauuuuauuaugca

SEQ ID NO: 1421986 - RNA, 16 nt, Human
caaaauaaaacuuuuu

SEQ ID NO: 1421987 - RNA, 20 nt, Human
caaaauaaaacuuuuuaaaa

SEQ ID NO: 1421988 - RNA, 16 nt, Human
caaaauccuugcuuau

SEQ ID NO: 1421989 - RNA, 15 nt, Human
caaaaucagguaacu

SEQ ID NO: 1421990 - RNA, 22 nt, Human
caaaaucucuccacuuucagcu

SEQ ID NO: 1421991 - RNA, 21 nt, Human
caaaaucucuccacuuucagc

SEQ ID NO: 1421992 - RNA, 16 nt, Human
caaaaucucuccacuu

SEQ ID NO: 1421993 - RNA, 19 nt, Human
caaaaucucccauuuugga

SEQ ID NO: 1421994 - RNA, 20 nt, Human
caaaauccuugcuuaugaca

SEQ ID NO: 1421995 - RNA, 22 nt, Human
caaaauauauuuuguuuacaaa

SEQ ID NO: 1421996 - RNA, 20 nt, Human
caaaauauauuuuguuuaca

SEQ ID NO: 1421997 - RNA, 16 nt, Human
caaaauagugccacua

SEQ ID NO: 1421998 - RNA, 21 nt, Human
caaaauaggguauauuuuccu

SEQ ID NO: 1421999 - RNA, 18 nt, Human
caaaauaggguauauuuu

SEQ ID NO: 1422000 - RNA, 17 nt, Human
caaaauaggguauauuu

SEQ ID NO: 1422001 - RNA, 13 nt, Human
caaaauagggacu

SEQ ID NO: 1422002 - RNA, 16 nt, Human
caaaauauuuguacau

SEQ ID NO: 1422003 - RNA, 17 nt, Human
caaaauauuuguacaua

SEQ ID NO: 1422004 - RNA, 16 nt, Human
caaaaucaauuaaaau

SEQ ID NO: 1422005 - RNA, 13 nt, Human
caagagauaacug

SEQ ID NO: 1422006 - RNA, 13 nt, Human
caagagacugagu

SEQ ID NO: 1422007 - RNA, 15 nt, Human
caagagacugaguca

SEQ ID NO: 1422008 - RNA, 12 nt, Human
caagagacugag

SEQ ID NO: 1422009 - RNA, 18 nt, Human
caagagaagcauucucau

SEQ ID NO: 1422010 - RNA, 22 nt, Human
caagagaagcauucucauugga

SEQ ID NO: 1422011 - RNA, 16 nt, Human
caagagaagcauucuc

SEQ ID NO: 1422012 - RNA, 14 nt, Human
caagagaagcauuc

SEQ ID NO: 1422013 - RNA, 13 nt, Human
caagagaagcauu

SEQ ID NO: 1422014 - RNA, 23 nt, Human
caagaagcauuuuguaaguugaa

SEQ ID NO: 1422015 - RNA, 17 nt, Human
caagaagcauuuuguaa

SEQ ID NO: 1422016 - RNA, 13 nt, Human
caagagccacagu

SEQ ID NO: 1422017 - RNA, 23 nt, Human
caagagcaucaugccucugaggc

SEQ ID NO: 1422018 - RNA, 22 nt, Human
caagagcaucaugccucugagg

SEQ ID NO: 1422019 - RNA, 21 nt, Human
caagagcaucaugccucugag

SEQ ID NO: 1422020 - RNA, 20 nt, Human
caagagcaucaugccucuga

SEQ ID NO: 1422021 - RNA, 19 nt, Human
caagagcaucaugccucug

SEQ ID NO: 1422022 - RNA, 18 nt, Human
caagagcaucaugccucu

SEQ ID NO: 1422023 - RNA, 16 nt, Human
caagagcaucaugccu

SEQ ID NO: 1422024 - RNA, 19 nt, Human
caagaggccguggcugcug

SEQ ID NO: 1422025 - RNA, 21 nt, Human
caagaggagcccccacccugu

SEQ ID NO: 1422026 - RNA, 14 nt, Human
caagaggagccccc

SEQ ID NO: 1422027 - RNA, 14 nt, Human
caagaggagaucca

SEQ ID NO: 1422028 - RNA, 19 nt, Human
caagagcuacauaauuuag

SEQ ID NO: 1422029 - RNA, 22 nt, Human
caagagcuacguauuuaauagc

SEQ ID NO: 1422030 - RNA, 23 nt, Human
caacguggcuuuuuuuuuuuccc

SEQ ID NO: 1422031 - RNA, 17 nt, Human
caacguggcccagagaa

SEQ ID NO: 1422032 - RNA, 19 nt, Human
caacguggcccagagaagc

SEQ ID NO: 1422033 - RNA, 20 nt, Human
caacguggcccagagaagcc

SEQ ID NO: 1422034 - RNA, 21 nt, Human
caacguggcccagagaagcca

SEQ ID NO: 1422035 - RNA, 20 nt, Human
caacgugcucuuuguuuugu

SEQ ID NO: 1422036 - RNA, 13 nt, Human
caacguggcccag

SEQ ID NO: 1422037 - RNA, 14 nt, Human
caacguggcccaga

SEQ ID NO: 1422038 - RNA, 18 nt, Human
caacgugcauugugcuuc

SEQ ID NO: 1422039 - RNA, 16 nt, Human
caacuuggcugcagga

SEQ ID NO: 1422040 - RNA, 14 nt, Human
caacuugcuuauca

SEQ ID NO: 1422041 - RNA, 18 nt, Human
caacgugcucuuuguuuu

SEQ ID NO: 1422042 - RNA, 20 nt, Human
caacuuguccuagcacagau

SEQ ID NO: 1422043 - RNA, 19 nt, Human
caacuuguccuagcacaga

SEQ ID NO: 1422044 - RNA, 13 nt, Human
caacuuguccuag

SEQ ID NO: 1422045 - RNA, 18 nt, Human
caagaagcaguggccuua

SEQ ID NO: 1422046 - RNA, 14 nt, Human
caagaagcaguggc

SEQ ID NO: 1422047 - RNA, 13 nt, Human
caagaagcagugg

SEQ ID NO: 1422048 - RNA, 23 nt, Human
caaagagaaugcccuucuccuua

SEQ ID NO: 1422049 - RNA, 18 nt, Human
caaagagaaugcccuucu

SEQ ID NO: 1422050 - RNA, 21 nt, Human
caaagaaggcauuugcagggu

SEQ ID NO: 1422051 - RNA, 22 nt, Human
caaagaaggcauuugcaggguc

SEQ ID NO: 1422052 - RNA, 19 nt, Human
caaagaaccaaagaagaaa

SEQ ID NO: 1422053 - RNA, 18 nt, Human
caaagaaccuucucuaug

SEQ ID NO: 1422054 - RNA, 17 nt, Human
caaagaaccaaagaaga

SEQ ID NO: 1422055 - RNA, 14 nt, Human
caaagaaccaaaga

SEQ ID NO: 1422056 - RNA, 18 nt, Human
caaaguguuuucucugaa

SEQ ID NO: 1422057 - RNA, 15 nt, Human
caaaguguuuucucu

SEQ ID NO: 1422058 - RNA, 20 nt, Human
caaauguuaaaauguguugu

SEQ ID NO: 1422059 - RNA, 21 nt, Human
caaauggcgucuggaagucca

SEQ ID NO: 1422060 - RNA, 19 nt, Human
caaauggcgucuggaaguc

SEQ ID NO: 1422061 - RNA, 22 nt, Human
caaauggcgucuggaaguccaa

SEQ ID NO: 1422062 - RNA, 18 nt, Human
caaauggcgucuggaagu

SEQ ID NO: 1422063 - RNA, 22 nt, Human
caaauggauuuugggagugacu

SEQ ID NO: 1422064 - RNA, 19 nt, Human
caaaucacauauuuuaaaa

SEQ ID NO: 1422065 - RNA, 14 nt, Human
caaaucaccacaaa

SEQ ID NO: 1422066 - RNA, 18 nt, Human
caaaucacauauuuuaaa

SEQ ID NO: 1422067 - RNA, 15 nt, Human
caaaucacauauuuu

SEQ ID NO: 1422068 - RNA, 14 nt, Human
caaaucacauauuu

SEQ ID NO: 1422069 - RNA, 16 nt, Human
caaaucaauuacuggu

SEQ ID NO: 1422070 - RNA, 20 nt, Human
caaaucaaucuguaaaacua

SEQ ID NO: 1422071 - RNA, 23 nt, Human
caaauauauucagccuggcuuca

SEQ ID NO: 1422072 - RNA, 20 nt, Human
caaauauuuauuuucuuucu

SEQ ID NO: 1422073 - RNA, 18 nt, Human
caaaucaaaaucucucca

SEQ ID NO: 1422074 - RNA, 17 nt, Human
caaaucaaucuguaaaa

SEQ ID NO: 1422075 - RNA, 17 nt, Human
caacagcaaacaggugc

SEQ ID NO: 1422076 - RNA, 15 nt, Human
caacagcaaacaggu

SEQ ID NO: 1422077 - RNA, 23 nt, Human
caacagaucuggaaccucagccu

SEQ ID NO: 1422078 - RNA, 17 nt, Human
caacagaucuggaaccu

SEQ ID NO: 1422079 - RNA, 14 nt, Human
caacagaucuggaa

SEQ ID NO: 1422080 - RNA, 13 nt, Human
caacagaucugga

SEQ ID NO: 1422081 - RNA, 14 nt, Human
caacagaucaguaa

SEQ ID NO: 1422082 - RNA, 20 nt, Human
caacagagacugaauagaua

SEQ ID NO: 1422083 - RNA, 15 nt, Human
caaauuaguuauaua

SEQ ID NO: 1422084 - RNA, 14 nt, Human
caaauuaguuauau

SEQ ID NO: 1422085 - RNA, 21 nt, Human
caaauuacuuugugaauagaa

SEQ ID NO: 1422086 - RNA, 18 nt, Human
caaauuacuuugugaaua

SEQ ID NO: 1422087 - RNA, 18 nt, Human
caaauguuaaaauguguu

SEQ ID NO: 1422088 - RNA, 19 nt, Human
caaauguuaaaauguguug

SEQ ID NO: 1422089 - RNA, 19 nt, Human
caaauuuguaggguuucua

SEQ ID NO: 1422090 - RNA, 17 nt, Human
caaauuugauugauuug

SEQ ID NO: 1422091 - RNA, 14 nt, Human
caaauuugauugau

SEQ ID NO: 1422092 - RNA, 15 nt, Human
caaauuucuaaaucu

SEQ ID NO: 1422093 - RNA, 22 nt, Human
caaauuucuaaaucuccaaaau

SEQ ID NO: 1422094 - RNA, 21 nt, Human
caacauaguauucaugacuau

SEQ ID NO: 1422095 - RNA, 20 nt, Human
caacaggccucagggcuccu

SEQ ID NO: 1422096 - RNA, 19 nt, Human
caacaggccucagggcucc

SEQ ID NO: 1422097 - RNA, 16 nt, Human
caacaggccucagggc

SEQ ID NO: 1422098 - RNA, 15 nt, Human
caacaggccucaggg

SEQ ID NO: 1422099 - RNA, 17 nt, Human
caaccugcucuccucuu

SEQ ID NO: 1422100 - RNA, 23 nt, Human
caacauagugggacccugucucu

SEQ ID NO: 1422101 - RNA, 23 nt, Human
caacagcguuccuagagaagaca

SEQ ID NO: 1422102 - RNA, 15 nt, Human
caacagcguuccuag

SEQ ID NO: 1422103 - RNA, 15 nt, Human
caacagcgcccaaag

SEQ ID NO: 1422104 - RNA, 12 nt, Human
caacagcgccca

SEQ ID NO: 1422105 - RNA, 20 nt, Human
caacagcuggacccugacca

SEQ ID NO: 1422106 - RNA, 19 nt, Human
caacagcuggacccugacc

SEQ ID NO: 1422107 - RNA, 16 nt, Human
caacagcuggacccug

SEQ ID NO: 1422108 - RNA, 19 nt, Human
cacagauaacugaaaauua

SEQ ID NO: 1422109 - RNA, 22 nt, Human
cacagauaacugaaaauuauuu

SEQ ID NO: 1422110 - RNA, 14 nt, Human
cacagaucacagcu

SEQ ID NO: 1422111 - RNA, 19 nt, Human
cacagaucacagcuucagc

SEQ ID NO: 1422112 - RNA, 22 nt, Human
cacagaucacagcuucagccag

SEQ ID NO: 1422113 - RNA, 16 nt, Human
cacagagggcgugugc

SEQ ID NO: 1422114 - RNA, 22 nt, Human
cacagaguuguuacauuuuuaa

SEQ ID NO: 1422115 - RNA, 21 nt, Human
cacagaggcagcccgcacacc

SEQ ID NO: 1422116 - RNA, 19 nt, Human
cacagaggacacagagaag

SEQ ID NO: 1422117 - RNA, 15 nt, Human
cacagaggacacaga

SEQ ID NO: 1422118 - RNA, 14 nt, Human
cacacugaagaagc

SEQ ID NO: 1422119 - RNA, 13 nt, Human
cacacugaagaag

SEQ ID NO: 1422120 - RNA, 21 nt, Human
cacagcaguucugcagaggac

SEQ ID NO: 1422121 - RNA, 13 nt, Human
cacagccaccccu

SEQ ID NO: 1422122 - RNA, 13 nt, Human
cacagcccuguca

SEQ ID NO: 1422123 - RNA, 23 nt, Human
cacagcccuuaugcgguuaauuu

SEQ ID NO: 1422124 - RNA, 22 nt, Human
cacagcccugucagcaugaauu

SEQ ID NO: 1422125 - RNA, 23 nt, Human
cacagcccugucagcaugaauuu

SEQ ID NO: 1422126 - RNA, 19 nt, Human
cacagcccugucagcauga

SEQ ID NO: 1422127 - RNA, 18 nt, Human
cacagcccugucagcaug

SEQ ID NO: 1422128 - RNA, 16 nt, Human
cacagcccugucagca

SEQ ID NO: 1422129 - RNA, 14 nt, Human
cacagcccugucag

SEQ ID NO: 1422130 - RNA, 14 nt, Human
cacagcugagaggc

SEQ ID NO: 1422131 - RNA, 21 nt, Human
cacagcugccggucgcccuuu

SEQ ID NO: 1422132 - RNA, 14 nt, Human
cacagcugccucuu

SEQ ID NO: 1422133 - RNA, 17 nt, Human
caauguuucuucuaggu

SEQ ID NO: 1422134 - RNA, 22 nt, Human
caauguuucaagaggagccccc

SEQ ID NO: 1422135 - RNA, 21 nt, Human
caauguuaaacuuauaaccca

SEQ ID NO: 1422136 - RNA, 18 nt, Human
caauguguguauauggac

SEQ ID NO: 1422137 - RNA, 17 nt, Human
caauguguguauaugga

SEQ ID NO: 1422138 - RNA, 16 nt, Human
caauguguguauaugg

SEQ ID NO: 1422139 - RNA, 15 nt, Human
caauguguguauaug

SEQ ID NO: 1422140 - RNA, 14 nt, Human
caauguguguauau

SEQ ID NO: 1422141 - RNA, 12 nt, Human
caauguguguau

SEQ ID NO: 1422142 - RNA, 23 nt, Human
caauguguauaaacaagaaaaau

SEQ ID NO: 1422143 - RNA, 21 nt, Human
caauguguauaaacaagaaaa

SEQ ID NO: 1422144 - RNA, 20 nt, Human
caauguguauaaacaagaaa

SEQ ID NO: 1422145 - RNA, 18 nt, Human
caauguguauaaacaaga

SEQ ID NO: 1422146 - RNA, 17 nt, Human
caauguguauaaacaag

SEQ ID NO: 1422147 - RNA, 16 nt, Human
caauguguauaaacaa

SEQ ID NO: 1422148 - RNA, 15 nt, Human
caauguguauaaaca

SEQ ID NO: 1422149 - RNA, 13 nt, Human
caauaucugaagc

SEQ ID NO: 1422150 - RNA, 23 nt, Human
caauaucugaagcccucccaggu

SEQ ID NO: 1422151 - RNA, 23 nt, Human
caauguggcaaggaaaaacaggu

SEQ ID NO: 1422152 - RNA, 13 nt, Human
caaugugcucucg

SEQ ID NO: 1422153 - RNA, 22 nt, Human
cacaaaauaaccaauccuggac

SEQ ID NO: 1422154 - RNA, 23 nt, Human
caauuuuuuuuauuaguauuguu

SEQ ID NO: 1422155 - RNA, 20 nt, Human
caauuuuuuuuauuaguauu

SEQ ID NO: 1422156 - RNA, 17 nt, Human
caauuuuuuuuauuagu

SEQ ID NO: 1422157 - RNA, 21 nt, Human
caauuuuuuaucaugcauguc

SEQ ID NO: 1422158 - RNA, 21 nt, Human
caauuuuuuaagugaaaauau

SEQ ID NO: 1422159 - RNA, 20 nt, Human
caauuuuuuaagugaaaaua

SEQ ID NO: 1422160 - RNA, 22 nt, Human
cacaaaauauauuuuguuuaca

SEQ ID NO: 1422161 - RNA, 17 nt, Human
caauuccccucugcugc

SEQ ID NO: 1422162 - RNA, 14 nt, Human
caauuccccucugc

SEQ ID NO: 1422163 - RNA, 13 nt, Human
caauuccccucug

SEQ ID NO: 1422164 - RNA, 12 nt, Human
caauuccccucu

SEQ ID NO: 1422165 - RNA, 11 nt, Human
caauuccccuc

SEQ ID NO: 1422166 - RNA, 23 nt, Human
caauuaggcagacucuuuaugcu

SEQ ID NO: 1422167 - RNA, 13 nt, Human
caauuccaccugc

SEQ ID NO: 1422168 - RNA, 21 nt, Human
caauuagcaauugacugucac

SEQ ID NO: 1422169 - RNA, 17 nt, Human
caauuacugguccaaaa

SEQ ID NO: 1422170 - RNA, 23 nt, Human
caauuaaaaaaaaagaucuguuu

SEQ ID NO: 1422171 - RNA, 21 nt, Human
cacacaaauuaucuuaaaacu

SEQ ID NO: 1422172 - RNA, 13 nt, Human
cacacaccuguag

SEQ ID NO: 1422173 - RNA, 11 nt, Human
cacacaccugu

SEQ ID NO: 1422174 - RNA, 12 nt, Human
cacacacguuau

SEQ ID NO: 1422175 - RNA, 18 nt, Human
cacaauaaaaauguuuaa

SEQ ID NO: 1422176 - RNA, 16 nt, Human
cacaaguuauuuaaau

SEQ ID NO: 1422177 - RNA, 23 nt, Human
cacacaaaagggaacccagcucu

SEQ ID NO: 1422178 - RNA, 23 nt, Human
cacaaugagauugaauuucacug

SEQ ID NO: 1422179 - RNA, 22 nt, Human
cacaaugcagugccuuucuucu

SEQ ID NO: 1422180 - RNA, 15 nt, Human
cacaauagaauuaua

SEQ ID NO: 1422181 - RNA, 14 nt, Human
cacaauagaauuau

SEQ ID NO: 1422182 - RNA, 15 nt, Human
cacaauaauuuucua

SEQ ID NO: 1422183 - RNA, 17 nt, Human
cacaauaacuccuccca

SEQ ID NO: 1422184 - RNA, 16 nt, Human
cacaauaacuccuccc

SEQ ID NO: 1422185 - RNA, 16 nt, Human
cacaauaaauggcugu

SEQ ID NO: 1422186 - RNA, 20 nt, Human
cacaauaacuccucccaggg

SEQ ID NO: 1422187 - RNA, 13 nt, Human
cacaauaagcaaa

SEQ ID NO: 1422188 - RNA, 19 nt, Human
caauagcagacaguguuuu

SEQ ID NO: 1422189 - RNA, 16 nt, Human
caauagcacauaugga

SEQ ID NO: 1422190 - RNA, 14 nt, Human
caauagugucaucc

SEQ ID NO: 1422191 - RNA, 17 nt, Human
caauagcacauauggaa

SEQ ID NO: 1422192 - RNA, 19 nt, Human
caauagucaaauuguguga

SEQ ID NO: 1422193 - RNA, 15 nt, Human
caauaacguuuaagc

SEQ ID NO: 1422194 - RNA, 23 nt, Human
caauaacguuuaagccaaaacaa

SEQ ID NO: 1422195 - RNA, 19 nt, Human
caauaacuccucccagggu

SEQ ID NO: 1422196 - RNA, 18 nt, Human
caauaacuccucccaggg

SEQ ID NO: 1422197 - RNA, 17 nt, Human
caauaacuccucccagg

SEQ ID NO: 1422198 - RNA, 16 nt, Human
caauaacuccucccag

SEQ ID NO: 1422199 - RNA, 12 nt, Human
caauaagcaaaa

SEQ ID NO: 1422200 - RNA, 16 nt, Human
caagggucaggccuuu

SEQ ID NO: 1422201 - RNA, 18 nt, Human
caagggucaggccuuuga

SEQ ID NO: 1422202 - RNA, 15 nt, Human
caagggucaggccuu

SEQ ID NO: 1422203 - RNA, 16 nt, Human
caagggaaccuguguc

SEQ ID NO: 1422204 - RNA, 15 nt, Human
caagggaaccugugu

SEQ ID NO: 1422205 - RNA, 16 nt, Human
caagggaaaagucucu

SEQ ID NO: 1422206 - RNA, 15 nt, Human
caagggaaaagucuc

SEQ ID NO: 1422207 - RNA, 15 nt, Human
caaggcuuucucuac

SEQ ID NO: 1422208 - RNA, 21 nt, Human
caauaaagugacccugcucuc

SEQ ID NO: 1422209 - RNA, 20 nt, Human
caauaaaguauuuaauuagu

SEQ ID NO: 1422210 - RNA, 22 nt, Human
caauaaaguauuuaauuagugc

SEQ ID NO: 1422211 - RNA, 14 nt, Human
caauaaagugaccc

SEQ ID NO: 1422212 - RNA, 13 nt, Human
caauaaauagaca

SEQ ID NO: 1422213 - RNA, 17 nt, Human
caauaaaguauuuaauu

SEQ ID NO: 1422214 - RNA, 15 nt, Human
caauaaauggcugua

SEQ ID NO: 1422215 - RNA, 20 nt, Human
caauaaaucugacccagugc

SEQ ID NO: 1422216 - RNA, 18 nt, Human
caauaaaucugacccagu

SEQ ID NO: 1422217 - RNA, 17 nt, Human
caauaaaucugacccag

SEQ ID NO: 1422218 - RNA, 16 nt, Human
caauaaauagaccauu

SEQ ID NO: 1422219 - RNA, 17 nt, Human
caauaaauagacacgca

SEQ ID NO: 1422220 - RNA, 20 nt, Human
caagagugaauucccucacu

SEQ ID NO: 1422221 - RNA, 19 nt, Human
caagagugaauucccucac

SEQ ID NO: 1422222 - RNA, 15 nt, Human
caagagucuaaagau

SEQ ID NO: 1422223 - RNA, 14 nt, Human
caagagucuaaaga

SEQ ID NO: 1422224 - RNA, 16 nt, Human
caagaggagcccccac

SEQ ID NO: 1422225 - RNA, 14 nt, Human
caagcugcaucuag

SEQ ID NO: 1422226 - RNA, 15 nt, Human
caagcgauucucuug

SEQ ID NO: 1422227 - RNA, 21 nt, Human
caagcgauucucuugccucaa

SEQ ID NO: 1422228 - RNA, 14 nt, Human
caagcugcuguggc

SEQ ID NO: 1422229 - RNA, 16 nt, Human
caaggagauuuacaac

SEQ ID NO: 1422230 - RNA, 18 nt, Human
caaggaaaaaauaacaau

SEQ ID NO: 1422231 - RNA, 20 nt, Human
caaggaaaaaauaacaauga

SEQ ID NO: 1422232 - RNA, 16 nt, Human
caaggacuuuguacau

SEQ ID NO: 1422233 - RNA, 19 nt, Human
cccgcaccccccaagcugu

SEQ ID NO: 1422234 - RNA, 14 nt, Human
cccgccugcccuca

SEQ ID NO: 1422235 - RNA, 13 nt, Human
cccgccugcccuc

SEQ ID NO: 1422236 - RNA, 12 nt, Human
cccgcacaccug

SEQ ID NO: 1422237 - RNA, 14 nt, Human
cccgauuguaacuc

SEQ ID NO: 1422238 - RNA, 21 nt, Human
cccgaggaggugucucaggcu

SEQ ID NO: 1422239 - RNA, 12 nt, Human
cccgaggcccgc

SEQ ID NO: 1422240 - RNA, 19 nt, Human
cccgaggaggugucucagg

SEQ ID NO: 1422241 - RNA, 15 nt, Human
cccgaggcccgcaug

SEQ ID NO: 1422242 - RNA, 13 nt, Human
cccgaggcccgca

SEQ ID NO: 1422243 - RNA, 21 nt, Human
cccgcucuacaucuucugccu

SEQ ID NO: 1422244 - RNA, 13 nt, Human
cccgcucaggcug

SEQ ID NO: 1422245 - RNA, 23 nt, Human
cccgcgauguggaacugcugcca

SEQ ID NO: 1422246 - RNA, 22 nt, Human
cccgcgauguggaacugcugcc

SEQ ID NO: 1422247 - RNA, 17 nt, Human
cccgcgauguggaacug

SEQ ID NO: 1422248 - RNA, 14 nt, Human
cccgccuuggccug

SEQ ID NO: 1422249 - RNA, 13 nt, Human
cccgccuuggccu

SEQ ID NO: 1422250 - RNA, 12 nt, Human
cccgccuuggcc

SEQ ID NO: 1422251 - RNA, 17 nt, Human
cccgccugcccucaugg

SEQ ID NO: 1422252 - RNA, 17 nt, Human
ccccuuccgccacuggg

SEQ ID NO: 1422253 - RNA, 16 nt, Human
ccccuuccgccacugg

SEQ ID NO: 1422254 - RNA, 14 nt, Human
ccccuuccgccacu

SEQ ID NO: 1422255 - RNA, 17 nt, Human
ccccuuauccucccugu

SEQ ID NO: 1422256 - RNA, 18 nt, Human
ccccuuauccucccugua

SEQ ID NO: 1422257 - RNA, 15 nt, Human
ccccuuauccucccu

SEQ ID NO: 1422258 - RNA, 14 nt, Human
ccccuuauccuccc

SEQ ID NO: 1422259 - RNA, 24 nt, Human
ccccuuagacagaggcccucaagu

SEQ ID NO: 1422260 - RNA, 17 nt, Human
ccccuuagacagaggcc

SEQ ID NO: 1422261 - RNA, 13 nt, Human
ccccuuagacaga

SEQ ID NO: 1422262 - RNA, 15 nt, Human
ccccuguaggccuca

SEQ ID NO: 1422263 - RNA, 16 nt, Human
ccccuguacacaacuc

SEQ ID NO: 1422264 - RNA, 11 nt, Human
ccccuguacac

SEQ ID NO: 1422265 - RNA, 22 nt, Human
ccccagguccagcucuggaggg

SEQ ID NO: 1422266 - RNA, 21 nt, Human
ccccagguccagcucuggagg

SEQ ID NO: 1422267 - RNA, 17 nt, Human
ccccagguccagcucug

SEQ ID NO: 1422268 - RNA, 23 nt, Human
ccccagguaggggccccucucag

SEQ ID NO: 1422269 - RNA, 20 nt, Human
ccccagguaggggccccucu

SEQ ID NO: 1422270 - RNA, 18 nt, Human
ccccaggguccugggagg

SEQ ID NO: 1422271 - RNA, 20 nt, Human
ccccaggguccugggaggag

SEQ ID NO: 1422272 - RNA, 17 nt, Human
ccccaggguccugggag

SEQ ID NO: 1422273 - RNA, 16 nt, Human
ccccaggguccuggga

SEQ ID NO: 1422274 - RNA, 22 nt, Human
ccccuggcagagaugccucccu

SEQ ID NO: 1422275 - RNA, 22 nt, Human
ccccagggcuguaacugccagg

SEQ ID NO: 1422276 - RNA, 22 nt, Human
ccccagggcagccagggagagc

SEQ ID NO: 1422277 - RNA, 16 nt, Human
ccccagggcagccagg

SEQ ID NO: 1422278 - RNA, 15 nt, Human
ccccagggcagccag

SEQ ID NO: 1422279 - RNA, 12 nt, Human
ccccagggcagc

SEQ ID NO: 1422280 - RNA, 22 nt, Human
ccccagcugucaucaauuaaag

SEQ ID NO: 1422281 - RNA, 21 nt, Human
ccccaggaccuggcugccaua

SEQ ID NO: 1422282 - RNA, 20 nt, Human
ccccaggaccuggcugccau

SEQ ID NO: 1422283 - RNA, 17 nt, Human
ccccaggaccuggcugc

SEQ ID NO: 1422284 - RNA, 15 nt, Human
ccccaggaccuggcu

SEQ ID NO: 1422285 - RNA, 21 nt, Human
ccccaggaccagcucaggaca

SEQ ID NO: 1422286 - RNA, 19 nt, Human
ccccaggaccagcucagga

SEQ ID NO: 1422287 - RNA, 18 nt, Human
ccccaggaccagcucagg

SEQ ID NO: 1422288 - RNA, 16 nt, Human
ccccagcccccuaaga

SEQ ID NO: 1422289 - RNA, 18 nt, Human
ccccaccagccucaccag

SEQ ID NO: 1422290 - RNA, 16 nt, Human
ccccagccugggccua

SEQ ID NO: 1422291 - RNA, 13 nt, Human
ccccagccugggc

SEQ ID NO: 1422292 - RNA, 12 nt, Human
ccccagccuggg

SEQ ID NO: 1422293 - RNA, 11 nt, Human
ccccagccugg

SEQ ID NO: 1422294 - RNA, 15 nt, Human
ccccagccugggccu

SEQ ID NO: 1422295 - RNA, 21 nt, Human
ccccagcuggggccaggcugg

SEQ ID NO: 1422296 - RNA, 22 nt, Human
ccccagcuggggccaggcuggg

SEQ ID NO: 1422297 - RNA, 17 nt, Human
cccggcacccccugcag

SEQ ID NO: 1422298 - RNA, 16 nt, Human
cccggcacccccugca

SEQ ID NO: 1422299 - RNA, 15 nt, Human
cccggcacccccugc

SEQ ID NO: 1422300 - RNA, 13 nt, Human
cccggcacccccu

SEQ ID NO: 1422301 - RNA, 11 nt, Human
cccggcacccc

SEQ ID NO: 1422302 - RNA, 19 nt, Human
cccggaggcggugggccug

SEQ ID NO: 1422303 - RNA, 18 nt, Human
cccggagguugggugggc

SEQ ID NO: 1422304 - RNA, 23 nt, Human
cccggagaagugugccuucucuc

SEQ ID NO: 1422305 - RNA, 20 nt, Human
cccggacgcccaggacccca

SEQ ID NO: 1422306 - RNA, 19 nt, Human
cccggaauuccgucaccac

SEQ ID NO: 1422307 - RNA, 21 nt, Human
cccggcagggcgggcagaggg

SEQ ID NO: 1422308 - RNA, 14 nt, Human
cccggcagggcggg

SEQ ID NO: 1422309 - RNA, 12 nt, Human
cccggcagggcg

SEQ ID NO: 1422310 - RNA, 18 nt, Human
cccggcacccccugcagc

SEQ ID NO: 1422311 - RNA, 19 nt, Human
cccggcacccccugcagcu

SEQ ID NO: 1422312 - RNA, 14 nt, Human
cccguuucuggugg

SEQ ID NO: 1422313 - RNA, 16 nt, Human
cccguuucuccaccua

SEQ ID NO: 1422314 - RNA, 12 nt, Human
cccguuucucca

SEQ ID NO: 1422315 - RNA, 13 nt, Human
cccguggaggcug

SEQ ID NO: 1422316 - RNA, 17 nt, Human
cccguggaggcugcucg

SEQ ID NO: 1422317 - RNA, 22 nt, Human
cccgugccaaguccagguccug

SEQ ID NO: 1422318 - RNA, 21 nt, Human
cccgugccaaguccagguccu

SEQ ID NO: 1422319 - RNA, 15 nt, Human
cccgugccaagucca

SEQ ID NO: 1422320 - RNA, 13 nt, Human
cccguuuugucac

SEQ ID NO: 1422321 - RNA, 20 nt, Human
cccuaaaagaaacccugcac

SEQ ID NO: 1422322 - RNA, 17 nt, Human
cccuaaaguguauuuuu

SEQ ID NO: 1422323 - RNA, 13 nt, Human
cccuaaagccuca

SEQ ID NO: 1422324 - RNA, 19 nt, Human
cccuaaauaauaaaaauaa

SEQ ID NO: 1422325 - RNA, 15 nt, Human
cccuaaccaaguucc

SEQ ID NO: 1422326 - RNA, 22 nt, Human
cccuaaaguguauuuuuuuacu

SEQ ID NO: 1422327 - RNA, 14 nt, Human
cccuagagucccag

SEQ ID NO: 1422328 - RNA, 18 nt, Human
cccucagggcaaagccag

SEQ ID NO: 1422329 - RNA, 16 nt, Human
cccucagggcaaagcc

SEQ ID NO: 1422330 - RNA, 10 nt, Human
cccucagggc

SEQ ID NO: 1422331 - RNA, 21 nt, Human
cccuaagcagaaagugccuuu

SEQ ID NO: 1422332 - RNA, 20 nt, Human
cccuaagcagaaagugccuu

SEQ ID NO: 1422333 - RNA, 16 nt, Human
cccuaagcagaaagug

SEQ ID NO: 1422334 - RNA, 18 nt, Human
cccuaagagagcaccugg

SEQ ID NO: 1422335 - RNA, 14 nt, Human
cccuaagagagcac

SEQ ID NO: 1422336 - RNA, 14 nt, Human
cccuaacccuuugu

SEQ ID NO: 1422337 - RNA, 12 nt, Human
cccuaauaaagc

SEQ ID NO: 1422338 - RNA, 13 nt, Human
cccuaauaaagcu

SEQ ID NO: 1422339 - RNA, 14 nt, Human
cccuaauaaagcug

SEQ ID NO: 1422340 - RNA, 17 nt, Human
cccuagaaacuuccaaa

SEQ ID NO: 1422341 - RNA, 18 nt, Human
cccuacuucuuuugcucu

SEQ ID NO: 1422342 - RNA, 19 nt, Human
cccuacuucuuuugcucuu

SEQ ID NO: 1422343 - RNA, 15 nt, Human
cccuaauaaagcugu

SEQ ID NO: 1422344 - RNA, 18 nt, Human
cccuaauaaagcugugug

SEQ ID NO: 1422345 - RNA, 18 nt, Human
cccuccccuccaucccug

SEQ ID NO: 1422346 - RNA, 20 nt, Human
cccucccuguuccccagaga

SEQ ID NO: 1422347 - RNA, 19 nt, Human
cccucccuguuccccagag

SEQ ID NO: 1422348 - RNA, 14 nt, Human
cccuccgccauucu

SEQ ID NO: 1422349 - RNA, 17 nt, Human
cccuccccgcacccccc

SEQ ID NO: 1422350 - RNA, 16 nt, Human
cccuccccgcaccccc

SEQ ID NO: 1422351 - RNA, 15 nt, Human
cccucccccuugucc

SEQ ID NO: 1422352 - RNA, 13 nt, Human
cccucccccuugu

SEQ ID NO: 1422353 - RNA, 12 nt, Human
cccucccccuug

SEQ ID NO: 1422354 - RNA, 14 nt, Human
cccucccccugcca

SEQ ID NO: 1422355 - RNA, 13 nt, Human
cccucccccugag

SEQ ID NO: 1422356 - RNA, 22 nt, Human
cccuccaucccuggcccccucc

SEQ ID NO: 1422357 - RNA, 17 nt, Human
cccuccaucccuggccc

SEQ ID NO: 1422358 - RNA, 15 nt, Human
cccuccacaccugcg

SEQ ID NO: 1422359 - RNA, 17 nt, Human
cccuccacaccugcggc

SEQ ID NO: 1422360 - RNA, 13 nt, Human
cccuccacaccug

SEQ ID NO: 1422361 - RNA, 14 nt, Human
cccuccaucccugg

SEQ ID NO: 1422362 - RNA, 13 nt, Human
cccuccaucccug

SEQ ID NO: 1422363 - RNA, 12 nt, Human
cccuccaucccu

SEQ ID NO: 1422364 - RNA, 15 nt, Human
cccuccagcucccug

SEQ ID NO: 1422365 - RNA, 17 nt, Human
cccucaucccgagcacc

SEQ ID NO: 1422366 - RNA, 19 nt, Human
cccucaucaaggacacggg

SEQ ID NO: 1422367 - RNA, 16 nt, Human
cccucaucaaggacac

SEQ ID NO: 1422368 - RNA, 19 nt, Human
cccucaguagucccugcac

SEQ ID NO: 1422369 - RNA, 21 nt, Human
cccucagggcaaagccagguc

SEQ ID NO: 1422370 - RNA, 20 nt, Human
cccucagggcaaagccaggu

SEQ ID NO: 1422371 - RNA, 19 nt, Human
cccucagggcaaagccagg

SEQ ID NO: 1422372 - RNA, 21 nt, Human
cccucauggccccucugaccu

SEQ ID NO: 1422373 - RNA, 17 nt, Human
cccucauggccccucug

SEQ ID NO: 1422374 - RNA, 16 nt, Human
cccucauggccccucu

SEQ ID NO: 1422375 - RNA, 14 nt, Human
cccucaucuguccc

SEQ ID NO: 1422376 - RNA, 13 nt, Human
cccucaucugucc

SEQ ID NO: 1422377 - RNA, 17 nt, Human
cccucaucucucugccc

SEQ ID NO: 1422378 - RNA, 14 nt, Human
cccucaucuuucuu

SEQ ID NO: 1422379 - RNA, 12 nt, Human
cccucaugcugu

SEQ ID NO: 1422380 - RNA, 23 nt, Human
cccuggguagcgggggaggguag

SEQ ID NO: 1422381 - RNA, 17 nt, Human
cccugggguggccacca

SEQ ID NO: 1422382 - RNA, 23 nt, Human
cccuggggccuguacugccugcu

SEQ ID NO: 1422383 - RNA, 16 nt, Human
cccuggugggccaaca

SEQ ID NO: 1422384 - RNA, 22 nt, Human
cccugguggcccucuccccugc

SEQ ID NO: 1422385 - RNA, 21 nt, Human
cccugguggcccucuccccug

SEQ ID NO: 1422386 - RNA, 20 nt, Human
cccugguggcccucuccccu

SEQ ID NO: 1422387 - RNA, 19 nt, Human
cccuggaggcacugaagug

SEQ ID NO: 1422388 - RNA, 16 nt, Human
cccugggaggcucugg

SEQ ID NO: 1422389 - RNA, 14 nt, Human
cccuggagcagcca

SEQ ID NO: 1422390 - RNA, 16 nt, Human
cccuggagcagccacc

SEQ ID NO: 1422391 - RNA, 20 nt, Human
cccuggagcagccaccccau

SEQ ID NO: 1422392 - RNA, 22 nt, Human
cccuggggccuguacugccugc

SEQ ID NO: 1422393 - RNA, 21 nt, Human
cccuggggccuguacugccug

SEQ ID NO: 1422394 - RNA, 20 nt, Human
cccuggggccuguacugccu

SEQ ID NO: 1422395 - RNA, 17 nt, Human
cccugggauucaggaaa

SEQ ID NO: 1422396 - RNA, 18 nt, Human
cccugggagggacaugcu

SEQ ID NO: 1422397 - RNA, 23 nt, Human
cccugggagggacaugcuuagca

SEQ ID NO: 1422398 - RNA, 21 nt, Human
cccuggagggggaauggcagc

SEQ ID NO: 1422399 - RNA, 15 nt, Human
cccuggaggcaccug

SEQ ID NO: 1422400 - RNA, 17 nt, Human
cccugggaggcucugga

SEQ ID NO: 1422401 - RNA, 18 nt, Human
cccugggaggcucuggag

SEQ ID NO: 1422402 - RNA, 24 nt, Human
cccugccuggaggaccugagccug

SEQ ID NO: 1422403 - RNA, 23 nt, Human
cccugccuggaggaccugagccu

SEQ ID NO: 1422404 - RNA, 22 nt, Human
cccugccuggaggaccugagcc

SEQ ID NO: 1422405 - RNA, 22 nt, Human
cccugcuuugggcuugggccua

SEQ ID NO: 1422406 - RNA, 18 nt, Human
cccugcuuugggcuuggg

SEQ ID NO: 1422407 - RNA, 17 nt, Human
cccugcuuugggcuugg

SEQ ID NO: 1422408 - RNA, 22 nt, Human
cccuggagaccccaccagccuc

SEQ ID NO: 1422409 - RNA, 10 nt, Human
cccugcuuuu

SEQ ID NO: 1422410 - RNA, 15 nt, Human
cccuggaaaccuucc

SEQ ID NO: 1422411 - RNA, 16 nt, Human
cccuggaaaccuucca

SEQ ID NO: 1422412 - RNA, 19 nt, Human
cccuggaaaccuuccaccc

SEQ ID NO: 1422413 - RNA, 21 nt, Human
cccuggaaaccuuccacccag

SEQ ID NO: 1422414 - RNA, 18 nt, Human
cccuggaacugucucuca

SEQ ID NO: 1422415 - RNA, 15 nt, Human
cccuggaacugucuc

SEQ ID NO: 1422416 - RNA, 22 nt, Human
cccuggaaaccuuccacccagu

SEQ ID NO: 1422417 - RNA, 12 nt, Human
cccugccuggag

SEQ ID NO: 1422418 - RNA, 11 nt, Human
cccugccugga

SEQ ID NO: 1422419 - RNA, 10 nt, Human
cccugccugg

SEQ ID NO: 1422420 - RNA, 18 nt, Human
cccugccuggaccagccu

SEQ ID NO: 1422421 - RNA, 13 nt, Human
cccugccuggacc

SEQ ID NO: 1422422 - RNA, 12 nt, Human
cccugccuggac

SEQ ID NO: 1422423 - RNA, 21 nt, Human
cccugccuggaggaccugagc

SEQ ID NO: 1422424 - RNA, 19 nt, Human
cccugccuggaggaccuga

SEQ ID NO: 1422425 - RNA, 18 nt, Human
cccugccuggaggaccug

SEQ ID NO: 1422426 - RNA, 17 nt, Human
cccugccuggaggaccu

SEQ ID NO: 1422427 - RNA, 16 nt, Human
cccugccuggaggacc

SEQ ID NO: 1422428 - RNA, 15 nt, Human
cccugccuggaggac

SEQ ID NO: 1422429 - RNA, 14 nt, Human
cccugccuggagga

SEQ ID NO: 1422430 - RNA, 13 nt, Human
cccugccuggagg

SEQ ID NO: 1422431 - RNA, 12 nt, Human
cccugccucuca

SEQ ID NO: 1422432 - RNA, 21 nt, Human
cccugccucucugcagguccc

SEQ ID NO: 1422433 - RNA, 22 nt, Human
cccugccucucugcaggucccu

SEQ ID NO: 1422434 - RNA, 23 nt, Human
cccugauuuaggagaagccagga

SEQ ID NO: 1422435 - RNA, 21 nt, Human
cccugauuuaggagaagccag

SEQ ID NO: 1422436 - RNA, 20 nt, Human
cccugaucccagagagcccg

SEQ ID NO: 1422437 - RNA, 17 nt, Human
cccugaucccagagagc

SEQ ID NO: 1422438 - RNA, 14 nt, Human
cccugaucccagag

SEQ ID NO: 1422439 - RNA, 17 nt, Human
cccucucagcuccaggu

SEQ ID NO: 1422440 - RNA, 14 nt, Human
cccucucagcucca

SEQ ID NO: 1422441 - RNA, 13 nt, Human
cccucucagcucc

SEQ ID NO: 1422442 - RNA, 18 nt, Human
cccucucagcccucacac

SEQ ID NO: 1422443 - RNA, 15 nt, Human
cccucucagcccuca

SEQ ID NO: 1422444 - RNA, 14 nt, Human
cccucucagcccuc

SEQ ID NO: 1422445 - RNA, 12 nt, Human
cccucucagccc

SEQ ID NO: 1422446 - RNA, 17 nt, Human
cccucucaacacccagu

SEQ ID NO: 1422447 - RNA, 13 nt, Human
cccucucaccaaa

SEQ ID NO: 1422448 - RNA, 21 nt, Human
cccucuacagagcuucccuga

SEQ ID NO: 1422449 - RNA, 18 nt, Human
cccucuacagagcuuccc

SEQ ID NO: 1422450 - RNA, 13 nt, Human
cccuccgcccugc

SEQ ID NO: 1422451 - RNA, 19 nt, Human
cccugcagacccugcccuu

SEQ ID NO: 1422452 - RNA, 17 nt, Human
cccugcagacccugccc

SEQ ID NO: 1422453 - RNA, 16 nt, Human
cccugcagacccugcc

SEQ ID NO: 1422454 - RNA, 15 nt, Human
cccugcagacccugc

SEQ ID NO: 1422455 - RNA, 14 nt, Human
cccugcagacccug

SEQ ID NO: 1422456 - RNA, 13 nt, Human
cccugcagacccu

SEQ ID NO: 1422457 - RNA, 23 nt, Human
cccugcagaaccggagagccagc

SEQ ID NO: 1422458 - RNA, 20 nt, Human
cccugcaaaaggacucucag

SEQ ID NO: 1422459 - RNA, 18 nt, Human
cccugcaaaaggacucuc

SEQ ID NO: 1422460 - RNA, 14 nt, Human
cccugccaccaggc

SEQ ID NO: 1422461 - RNA, 23 nt, Human
cccugcauuggaacuggaggcag

SEQ ID NO: 1422462 - RNA, 22 nt, Human
cccugcauuggaacuggaggca

SEQ ID NO: 1422463 - RNA, 21 nt, Human
cccugcauuggaacuggaggc

SEQ ID NO: 1422464 - RNA, 16 nt, Human
cccugcauggcugagc

SEQ ID NO: 1422465 - RNA, 21 nt, Human
cccugcauggcugagcugccc

SEQ ID NO: 1422466 - RNA, 15 nt, Human
cccugccaccaggcc

SEQ ID NO: 1422467 - RNA, 14 nt, Human
cccugccaccuccu

SEQ ID NO: 1422468 - RNA, 17 nt, Human
cccugccaccuccugcc

SEQ ID NO: 1422469 - RNA, 22 nt, Human
cccugccaggagcuuuggaccu

SEQ ID NO: 1422470 - RNA, 18 nt, Human
cccugccaccuccugccu

SEQ ID NO: 1422471 - RNA, 12 nt, Human
cccugccagggc

SEQ ID NO: 1422472 - RNA, 14 nt, Human
cccugccagggcag

SEQ ID NO: 1422473 - RNA, 20 nt, Human
cccugcccacccucuggaga

SEQ ID NO: 1422474 - RNA, 11 nt, Human
cccugccucuc

SEQ ID NO: 1422475 - RNA, 18 nt, Human
cccugccucucugcaggu

SEQ ID NO: 1422476 - RNA, 16 nt, Human
ccuacuggucucucua

SEQ ID NO: 1422477 - RNA, 16 nt, Human
ccuacugcccaggcac

SEQ ID NO: 1422478 - RNA, 20 nt, Human
ccuacugcccaggcacugca

SEQ ID NO: 1422479 - RNA, 13 nt, Human
ccuacugcccagg

SEQ ID NO: 1422480 - RNA, 19 nt, Human
ccuacuguaauuugugaua

SEQ ID NO: 1422481 - RNA, 19 nt, Human
ccuacaugaaacagaaaca

SEQ ID NO: 1422482 - RNA, 22 nt, Human
ccuacaguuuuaacuguggaua

SEQ ID NO: 1422483 - RNA, 21 nt, Human
ccuacaguuuuaacuguggau

SEQ ID NO: 1422484 - RNA, 20 nt, Human
ccuacaguuuuaacugugga

SEQ ID NO: 1422485 - RNA, 19 nt, Human
ccuacaguuuuaacugugg

SEQ ID NO: 1422486 - RNA, 17 nt, Human
ccuacaguuuuaacugu

SEQ ID NO: 1422487 - RNA, 15 nt, Human
ccuacaguuuuaacu

SEQ ID NO: 1422488 - RNA, 23 nt, Human
ccuacuguucuaaagcucugaca

SEQ ID NO: 1422489 - RNA, 22 nt, Human
ccuacuguucuaaagcucugac

SEQ ID NO: 1422490 - RNA, 19 nt, Human
ccuacuguucuaaagcucu

SEQ ID NO: 1422491 - RNA, 16 nt, Human
ccuacuguucuaaagc

SEQ ID NO: 1422492 - RNA, 15 nt, Human
ccuacuguucuaaag

SEQ ID NO: 1422493 - RNA, 13 nt, Human
ccuacuguucuaa

SEQ ID NO: 1422494 - RNA, 20 nt, Human
ccuagaaacaacacuguagu

SEQ ID NO: 1422495 - RNA, 19 nt, Human
ccuagaaacaacacuguag

SEQ ID NO: 1422496 - RNA, 18 nt, Human
ccuagaaacaacacugua

SEQ ID NO: 1422497 - RNA, 17 nt, Human
ccuagaaacaacacugu

SEQ ID NO: 1422498 - RNA, 19 nt, Human
ccuagacuguaaaccucuc

SEQ ID NO: 1422499 - RNA, 23 nt, Human
ccuagaccagcagacagagccag

SEQ ID NO: 1422500 - RNA, 13 nt, Human
ccuagaccagcag

SEQ ID NO: 1422501 - RNA, 22 nt, Human
ccuagguauaauucacauugua

SEQ ID NO: 1422502 - RNA, 22 nt, Human
ccgugugguaagcaacauggcu

SEQ ID NO: 1422503 - RNA, 23 nt, Human
ccgugugguaagcaacauggcuu

SEQ ID NO: 1422504 - RNA, 21 nt, Human
ccgugugguaagcaacauggc

SEQ ID NO: 1422505 - RNA, 20 nt, Human
ccgugugggagaccggccug

SEQ ID NO: 1422506 - RNA, 17 nt, Human
ccguuagcuccuguggc

SEQ ID NO: 1422507 - RNA, 15 nt, Human
ccguuagcuccugug

SEQ ID NO: 1422508 - RNA, 14 nt, Human
ccguuagcuccugu

SEQ ID NO: 1422509 - RNA, 13 nt, Human
ccguuagcuccug

SEQ ID NO: 1422510 - RNA, 13 nt, Human
ccuaaacauauga

SEQ ID NO: 1422511 - RNA, 18 nt, Human
ccguuagcuccuguggcc

SEQ ID NO: 1422512 - RNA, 21 nt, Human
ccuacagaaaaaccuuggguu

SEQ ID NO: 1422513 - RNA, 20 nt, Human
ccuacagaacuucagaaaga

SEQ ID NO: 1422514 - RNA, 22 nt, Human
ccuaacaacauuguagccucaa

SEQ ID NO: 1422515 - RNA, 21 nt, Human
ccuaacaacauuguagccuca

SEQ ID NO: 1422516 - RNA, 22 nt, Human
ccuaaauuuuccuguccucuuu

SEQ ID NO: 1422517 - RNA, 20 nt, Human
ccuaaauuuuccuguccucu

SEQ ID NO: 1422518 - RNA, 15 nt, Human
ccuaaauuauuuacu

SEQ ID NO: 1422519 - RNA, 18 nt, Human
ccuaaauggccucaugug

SEQ ID NO: 1422520 - RNA, 14 nt, Human
ccuaaauggccuca

SEQ ID NO: 1422521 - RNA, 12 nt, Human
ccguuauuaaaa

SEQ ID NO: 1422522 - RNA, 14 nt, Human
cccuuucccacccc

SEQ ID NO: 1422523 - RNA, 12 nt, Human
cccuuucccacc

SEQ ID NO: 1422524 - RNA, 20 nt, Human
cccuuucacaggcagccagu

SEQ ID NO: 1422525 - RNA, 15 nt, Human
cccuuucacaggcag

SEQ ID NO: 1422526 - RNA, 18 nt, Human
cccuuuagaucucugaag

SEQ ID NO: 1422527 - RNA, 20 nt, Human
cccuuguuuggggcaggagu

SEQ ID NO: 1422528 - RNA, 21 nt, Human
cccuugugaaucaagggucag

SEQ ID NO: 1422529 - RNA, 23 nt, Human
cccuuguagcuccuccccuggag

SEQ ID NO: 1422530 - RNA, 21 nt, Human
cccuuguagcuccuccccugg

SEQ ID NO: 1422531 - RNA, 18 nt, Human
cccuuguauccccugcag

SEQ ID NO: 1422532 - RNA, 18 nt, Human
cccuuguagcuccucccc

SEQ ID NO: 1422533 - RNA, 17 nt, Human
cccuuguagcuccuccc

SEQ ID NO: 1422534 - RNA, 21 nt, Human
cccuugacaacuggcaggcag

SEQ ID NO: 1422535 - RNA, 18 nt, Human
cccuugacaacuggcagg

SEQ ID NO: 1422536 - RNA, 17 nt, Human
cccuugacaacuggcag

SEQ ID NO: 1422537 - RNA, 12 nt, Human
cccuugaacucu

SEQ ID NO: 1422538 - RNA, 18 nt, Human
cccuuccgccacuggggc

SEQ ID NO: 1422539 - RNA, 11 nt, Human
cccuucuuuuu

SEQ ID NO: 1422540 - RNA, 14 nt, Human
cccuuggacacgcu

SEQ ID NO: 1422541 - RNA, 16 nt, Human
cccuuggacacgcuca

SEQ ID NO: 1422542 - RNA, 19 nt, Human
cccuugacaacuggcaggc

SEQ ID NO: 1422543 - RNA, 15 nt, Human
cccuugacaccugcu

SEQ ID NO: 1422544 - RNA, 16 nt, Human
cccuuccgccacuggg

SEQ ID NO: 1422545 - RNA, 15 nt, Human
cccuuccgccacugg

SEQ ID NO: 1422546 - RNA, 19 nt, Human
cccuucccuugagcccucu

SEQ ID NO: 1422547 - RNA, 23 nt, Human
cccuucccacaggacauuucucu

SEQ ID NO: 1422548 - RNA, 14 nt, Human
cccuucccacagga

SEQ ID NO: 1422549 - RNA, 16 nt, Human
cccuucaugcauggaa

SEQ ID NO: 1422550 - RNA, 17 nt, Human
cccuguguugucucuag

SEQ ID NO: 1422551 - RNA, 16 nt, Human
cccuguguugucucua

SEQ ID NO: 1422552 - RNA, 15 nt, Human
cccuguguugucucu

SEQ ID NO: 1422553 - RNA, 13 nt, Human
cccuguguugucu

SEQ ID NO: 1422554 - RNA, 21 nt, Human
cccuguguugucucuagagca

SEQ ID NO: 1422555 - RNA, 18 nt, Human
cccuguguugucucuaga

SEQ ID NO: 1422556 - RNA, 23 nt, Human
cccuggugggccaacaaagaaca

SEQ ID NO: 1422557 - RNA, 17 nt, Human
cccuucaguacccucuc

SEQ ID NO: 1422558 - RNA, 23 nt, Human
cccuguguugucucuagagcagg

SEQ ID NO: 1422559 - RNA, 21 nt, Human
cccuucaguacccucucagcu

SEQ ID NO: 1422560 - RNA, 20 nt, Human
cccuucaguacccucucagc

SEQ ID NO: 1422561 - RNA, 19 nt, Human
cccuucaguacccucucag

SEQ ID NO: 1422562 - RNA, 14 nt, Human
cccuucaucuggaa

SEQ ID NO: 1422563 - RNA, 16 nt, Human
cccuucaucuggaacc

SEQ ID NO: 1422564 - RNA, 16 nt, Human
ccguggaggcugcucg

SEQ ID NO: 1422565 - RNA, 23 nt, Human
ccguggauugcacguggccucuu

SEQ ID NO: 1422566 - RNA, 22 nt, Human
ccguggauugcacguggccucu

SEQ ID NO: 1422567 - RNA, 20 nt, Human
ccguggauugcacguggccu

SEQ ID NO: 1422568 - RNA, 19 nt, Human
ccguggauugcacguggcc

SEQ ID NO: 1422569 - RNA, 22 nt, Human
ccguggaggcugcucggggugc

SEQ ID NO: 1422570 - RNA, 15 nt, Human
ccguggaggcugcuc

SEQ ID NO: 1422571 - RNA, 14 nt, Human
ccguggaggcugcu

SEQ ID NO: 1422572 - RNA, 12 nt, Human
ccguggaggcug

SEQ ID NO: 1422573 - RNA, 11 nt, Human
ccguggaggcu

SEQ ID NO: 1422574 - RNA, 14 nt, Human
ccgguguucuaaga

SEQ ID NO: 1422575 - RNA, 13 nt, Human
ccgguguucuaag

SEQ ID NO: 1422576 - RNA, 12 nt, Human
ccgguguucuaa

SEQ ID NO: 1422577 - RNA, 22 nt, Human
ccggucgcccuuugcugcaugg

SEQ ID NO: 1422578 - RNA, 23 nt, Human
ccggucgcccuuugcugcauggc

SEQ ID NO: 1422579 - RNA, 18 nt, Human
ccggucgcccuuugcugc

SEQ ID NO: 1422580 - RNA, 14 nt, Human
ccggggcagccccc

SEQ ID NO: 1422581 - RNA, 20 nt, Human
ccggggaacuggccaagcug

SEQ ID NO: 1422582 - RNA, 19 nt, Human
ccggggaacuggccaagcu

SEQ ID NO: 1422583 - RNA, 18 nt, Human
ccggggaacuggccaagc

SEQ ID NO: 1422584 - RNA, 17 nt, Human
ccggggaacuggccaag

SEQ ID NO: 1422585 - RNA, 16 nt, Human
ccggggaacuggccaa

SEQ ID NO: 1422586 - RNA, 19 nt, Human
ccggggccugggcaggagg

SEQ ID NO: 1422587 - RNA, 15 nt, Human
ccggggccagcacuu

SEQ ID NO: 1422588 - RNA, 15 nt, Human
ccggggccugggcag

SEQ ID NO: 1422589 - RNA, 15 nt, Human
ccggggaacuggcca

SEQ ID NO: 1422590 - RNA, 15 nt, Human
ccgggagcucaggaa

SEQ ID NO: 1422591 - RNA, 13 nt, Human
ccgggagcucagg

SEQ ID NO: 1422592 - RNA, 14 nt, Human
ccggagaguggggg

SEQ ID NO: 1422593 - RNA, 16 nt, Human
ccggagagugggggug

SEQ ID NO: 1422594 - RNA, 14 nt, Human
ccggagaggaccgg

SEQ ID NO: 1422595 - RNA, 14 nt, Human
ccggagagccagcu

SEQ ID NO: 1422596 - RNA, 13 nt, Human
ccggagagccagc

SEQ ID NO: 1422597 - RNA, 16 nt, Human
ccggacuuuucugcaa

SEQ ID NO: 1422598 - RNA, 15 nt, Human
ccggacuuuucugca

SEQ ID NO: 1422599 - RNA, 23 nt, Human
ccggacuuagaaaaccagcucag

SEQ ID NO: 1422600 - RNA, 20 nt, Human
ccggacucaagccccggacu

SEQ ID NO: 1422601 - RNA, 23 nt, Human
cccuuucccaccccaaccugcuc

SEQ ID NO: 1422602 - RNA, 20 nt, Human
cccuuucccaccccaaccug

SEQ ID NO: 1422603 - RNA, 17 nt, Human
cccuuucccaccccaac

SEQ ID NO: 1422604 - RNA, 19 nt, Human
ccggcuuuguggcacuggg

SEQ ID NO: 1422605 - RNA, 17 nt, Human
ccggcuuuguggcacug

SEQ ID NO: 1422606 - RNA, 16 nt, Human
ccggcuuuguggcacu

SEQ ID NO: 1422607 - RNA, 16 nt, Human
ccggaucugagggaga

SEQ ID NO: 1422608 - RNA, 20 nt, Human
ccuaucuccagcggcccugu

SEQ ID NO: 1422609 - RNA, 13 nt, Human
ccuaucccaccuc

SEQ ID NO: 1422610 - RNA, 23 nt, Human
ccuagugaaggcuucucucugug

SEQ ID NO: 1422611 - RNA, 22 nt, Human
ccuagugaaggcuucucucugu

SEQ ID NO: 1422612 - RNA, 21 nt, Human
ccuagugaaggcuucucucug

SEQ ID NO: 1422613 - RNA, 19 nt, Human
ccuagugaaggcuucucuc

SEQ ID NO: 1422614 - RNA, 18 nt, Human
ccuagugaaggcuucucu

SEQ ID NO: 1422615 - RNA, 13 nt, Human
ccucacagugaac

SEQ ID NO: 1422616 - RNA, 22 nt, Human
ccuauugcuagagcuccucccu

SEQ ID NO: 1422617 - RNA, 18 nt, Human
ccuauugcuagagcuccu

SEQ ID NO: 1422618 - RNA, 16 nt, Human
ccuauugcuagagcuc

SEQ ID NO: 1422619 - RNA, 12 nt, Human
ccucacacuggg

SEQ ID NO: 1422620 - RNA, 11 nt, Human
ccucacacagc

SEQ ID NO: 1422621 - RNA, 13 nt, Human
ccucacacuggga

SEQ ID NO: 1422622 - RNA, 15 nt, Human
ccucacacugggacu

SEQ ID NO: 1422623 - RNA, 12 nt, Human
ccuaucugggcu

SEQ ID NO: 1422624 - RNA, 19 nt, Human
ccuaucugggcuuccugga

SEQ ID NO: 1422625 - RNA, 18 nt, Human
ccuaucugggcuuccugg

SEQ ID NO: 1422626 - RNA, 17 nt, Human
ccuaucugggcuuccug

SEQ ID NO: 1422627 - RNA, 16 nt, Human
ccuaucugggcuuccu

SEQ ID NO: 1422628 - RNA, 22 nt, Human
ccuauguuuuuguucaaagcca

SEQ ID NO: 1422629 - RNA, 22 nt, Human
ccuaucugggcuuccuggagca

SEQ ID NO: 1422630 - RNA, 20 nt, Human
ccuaucugggcuuccuggag

SEQ ID NO: 1422631 - RNA, 16 nt, Human
ccuauuaucccagcug

SEQ ID NO: 1422632 - RNA, 12 nt, Human
ccuauuauccca

SEQ ID NO: 1422633 - RNA, 16 nt, Human
ccuauuaaccuagaga

SEQ ID NO: 1422634 - RNA, 17 nt, Human
ccuauuaucugucagcu

SEQ ID NO: 1422635 - RNA, 18 nt, Human
ccuauuaucccagcugcc

SEQ ID NO: 1422636 - RNA, 17 nt, Human
ccuauuaucccagcugc

SEQ ID NO: 1422637 - RNA, 21 nt, Human
ccuauucaacacacacaugcu

SEQ ID NO: 1422638 - RNA, 23 nt, Human
ccuauucaacacacacaugcuuc

SEQ ID NO: 1422639 - RNA, 18 nt, Human
ccucagccccgcguggaa

SEQ ID NO: 1422640 - RNA, 14 nt, Human
ccucagccagccuc

SEQ ID NO: 1422641 - RNA, 13 nt, Human
ccucagccagccu

SEQ ID NO: 1422642 - RNA, 12 nt, Human
ccucagccagcc

SEQ ID NO: 1422643 - RNA, 21 nt, Human
ccucagauuccuucccaugga

SEQ ID NO: 1422644 - RNA, 22 nt, Human
ccucagauuccuucccauggag

SEQ ID NO: 1422645 - RNA, 17 nt, Human
ccucagauuccuuccca

SEQ ID NO: 1422646 - RNA, 16 nt, Human
ccucagauuccuuccc

SEQ ID NO: 1422647 - RNA, 23 nt, Human
ccucagauggcagcuuuuaaaag

SEQ ID NO: 1422648 - RNA, 21 nt, Human
ccucagauggcagcuuuuaaa

SEQ ID NO: 1422649 - RNA, 17 nt, Human
ccucagauggcagcuuu

SEQ ID NO: 1422650 - RNA, 16 nt, Human
ccucagauggcagcuu

SEQ ID NO: 1422651 - RNA, 15 nt, Human
ccucagauggcagcu

SEQ ID NO: 1422652 - RNA, 14 nt, Human
ccucagauggcagc

SEQ ID NO: 1422653 - RNA, 20 nt, Human
ccucagaugcacaugagcug

SEQ ID NO: 1422654 - RNA, 16 nt, Human
ccucagggacucaggu

SEQ ID NO: 1422655 - RNA, 15 nt, Human
ccucagggacucagg

SEQ ID NO: 1422656 - RNA, 19 nt, Human
ccucacuggcucuccuggc

SEQ ID NO: 1422657 - RNA, 18 nt, Human
ccucacuggcucuccugg

SEQ ID NO: 1422658 - RNA, 17 nt, Human
ccucacuggcucuccug

SEQ ID NO: 1422659 - RNA, 16 nt, Human
ccucacuggcucuccu

SEQ ID NO: 1422660 - RNA, 13 nt, Human
ccucacuggcucu

SEQ ID NO: 1422661 - RNA, 16 nt, Human
ccucagagacaucagc

SEQ ID NO: 1422662 - RNA, 15 nt, Human
ccucagacuggggca

SEQ ID NO: 1422663 - RNA, 20 nt, Human
ccucacuguauccagguucc

SEQ ID NO: 1422664 - RNA, 21 nt, Human
ccucagagaccagggcuccag

SEQ ID NO: 1422665 - RNA, 19 nt, Human
ccucagagaccagggcucc

SEQ ID NO: 1422666 - RNA, 17 nt, Human
ccucagagaccagggcu

SEQ ID NO: 1422667 - RNA, 16 nt, Human
ccucagagaccagggc

SEQ ID NO: 1422668 - RNA, 14 nt, Human
ccucagagaccagg

SEQ ID NO: 1422669 - RNA, 20 nt, Human
ccucagagacaucagcccuu

SEQ ID NO: 1422670 - RNA, 19 nt, Human
ccucacucgucucccccaa

SEQ ID NO: 1422671 - RNA, 13 nt, Human
ccucaccuccucu

SEQ ID NO: 1422672 - RNA, 22 nt, Human
ccucacccugccuuaucuugca

SEQ ID NO: 1422673 - RNA, 15 nt, Human
ccucacccugccuua

SEQ ID NO: 1422674 - RNA, 14 nt, Human
ccucacccugccuu

SEQ ID NO: 1422675 - RNA, 18 nt, Human
ccucaccgagugggggca

SEQ ID NO: 1422676 - RNA, 12 nt, Human
ccucaccauucc

SEQ ID NO: 1422677 - RNA, 18 nt, Human
ccucaccagcccuggcaa

SEQ ID NO: 1422678 - RNA, 19 nt, Human
ccucugagacuccagaccu

SEQ ID NO: 1422679 - RNA, 15 nt, Human
ccucugagacuccag

SEQ ID NO: 1422680 - RNA, 22 nt, Human
ccucugacucagggcuccuggg

SEQ ID NO: 1422681 - RNA, 21 nt, Human
ccucugacucagggcuccugg

SEQ ID NO: 1422682 - RNA, 19 nt, Human
ccucugacucagggcuccu

SEQ ID NO: 1422683 - RNA, 17 nt, Human
ccucugacucagggcuc

SEQ ID NO: 1422684 - RNA, 16 nt, Human
ccucugacucagggcu

SEQ ID NO: 1422685 - RNA, 12 nt, Human
ccucugacucag

SEQ ID NO: 1422686 - RNA, 17 nt, Human
ccucugaccugcacugg

SEQ ID NO: 1422687 - RNA, 16 nt, Human
ccucugaccugcacug

SEQ ID NO: 1422688 - RNA, 14 nt, Human
ccucugaccugcac

SEQ ID NO: 1422689 - RNA, 19 nt, Human
ccucugacagcagcaucuc

SEQ ID NO: 1422690 - RNA, 20 nt, Human
ccucugacagcagcaucucu

SEQ ID NO: 1422691 - RNA, 18 nt, Human
ccucugacagcagcaucu

SEQ ID NO: 1422692 - RNA, 15 nt, Human
ccucugacagcagca

SEQ ID NO: 1422693 - RNA, 14 nt, Human
ccucugacagcagc

SEQ ID NO: 1422694 - RNA, 13 nt, Human
ccucugacagcag

SEQ ID NO: 1422695 - RNA, 12 nt, Human
ccucugacagca

SEQ ID NO: 1422696 - RNA, 12 nt, Human
ccucugaaauac

SEQ ID NO: 1422697 - RNA, 22 nt, Human
ccucucccuugggcucugauga

SEQ ID NO: 1422698 - RNA, 20 nt, Human
ccucucccuugggcucugau

SEQ ID NO: 1422699 - RNA, 19 nt, Human
ccucucccuugggcucuga

SEQ ID NO: 1422700 - RNA, 22 nt, Human
ccucugaggccagccuggccuc

SEQ ID NO: 1422701 - RNA, 21 nt, Human
ccucugaggccagccuggccu

SEQ ID NO: 1422702 - RNA, 20 nt, Human
ccucugaggccagccuggcc

SEQ ID NO: 1422703 - RNA, 19 nt, Human
ccucugaggccagccuggc

SEQ ID NO: 1422704 - RNA, 18 nt, Human
ccucugaggccagccugg

SEQ ID NO: 1422705 - RNA, 17 nt, Human
ccucugaggccagccug

SEQ ID NO: 1422706 - RNA, 16 nt, Human
ccucugaggccagccu

SEQ ID NO: 1422707 - RNA, 15 nt, Human
ccucugaggccagcc

SEQ ID NO: 1422708 - RNA, 14 nt, Human
ccucugaggccagc

SEQ ID NO: 1422709 - RNA, 12 nt, Human
ccucugaggcca

SEQ ID NO: 1422710 - RNA, 16 nt, Human
ccucugagacuccaga

SEQ ID NO: 1422711 - RNA, 14 nt, Human
ccucugcagcaaua

SEQ ID NO: 1422712 - RNA, 18 nt, Human
ccucugcagcaauaaagc

SEQ ID NO: 1422713 - RNA, 19 nt, Human
ccucugcagcaauaaagca

SEQ ID NO: 1422714 - RNA, 22 nt, Human
ccucuacugggaaggcuacuuc

SEQ ID NO: 1422715 - RNA, 17 nt, Human
ccucuacugggaaggcu

SEQ ID NO: 1422716 - RNA, 16 nt, Human
ccucuacugggaaggc

SEQ ID NO: 1422717 - RNA, 14 nt, Human
ccucuacugggaag

SEQ ID NO: 1422718 - RNA, 15 nt, Human
ccucuaccccaauuu

SEQ ID NO: 1422719 - RNA, 11 nt, Human
ccucuacaggg

SEQ ID NO: 1422720 - RNA, 24 nt, Human
ccucuacagagcuucccugacuca

SEQ ID NO: 1422721 - RNA, 21 nt, Human
ccucuacagagcuucccugac

SEQ ID NO: 1422722 - RNA, 20 nt, Human
ccucuacagagcuucccuga

SEQ ID NO: 1422723 - RNA, 19 nt, Human
ccucucccacccucuuccu

SEQ ID NO: 1422724 - RNA, 18 nt, Human
ccucucccacccucuucc

SEQ ID NO: 1422725 - RNA, 16 nt, Human
ccucucccacccucuu

SEQ ID NO: 1422726 - RNA, 15 nt, Human
ccucucccacccucu

SEQ ID NO: 1422727 - RNA, 14 nt, Human
ccucucccacccuc

SEQ ID NO: 1422728 - RNA, 13 nt, Human
ccucucccacccu

SEQ ID NO: 1422729 - RNA, 12 nt, Human
ccucucccaggc

SEQ ID NO: 1422730 - RNA, 20 nt, Human
ccucucccacccucuuccua

SEQ ID NO: 1422731 - RNA, 14 nt, Human
ccucucccugcaug

SEQ ID NO: 1422732 - RNA, 16 nt, Human
ccucucccugcauggc

SEQ ID NO: 1422733 - RNA, 23 nt, Human
ccucucccuccuccaggaagccu

SEQ ID NO: 1422734 - RNA, 18 nt, Human
ccucucccuccuccagga

SEQ ID NO: 1422735 - RNA, 18 nt, Human
ccucuccccugccugccc

SEQ ID NO: 1422736 - RNA, 17 nt, Human
ccucuccccagcccaga

SEQ ID NO: 1422737 - RNA, 16 nt, Human
ccucuccccagcccag

SEQ ID NO: 1422738 - RNA, 14 nt, Human
ccucuccccagccc

SEQ ID NO: 1422739 - RNA, 12 nt, Human
ccucuccccagc

SEQ ID NO: 1422740 - RNA, 18 nt, Human
ccuccuucuucagggacu

SEQ ID NO: 1422741 - RNA, 22 nt, Human
ccuccuucugagcuccuguccc

SEQ ID NO: 1422742 - RNA, 21 nt, Human
ccuccuucugagcuccugucc

SEQ ID NO: 1422743 - RNA, 20 nt, Human
ccuccuucugagcuccuguc

SEQ ID NO: 1422744 - RNA, 19 nt, Human
ccuccuucugagcuccugu

SEQ ID NO: 1422745 - RNA, 17 nt, Human
ccuccuucugagcuccu

SEQ ID NO: 1422746 - RNA, 19 nt, Human
ccuccucuaagguugggca

SEQ ID NO: 1422747 - RNA, 18 nt, Human
ccuccuccagggacagca

SEQ ID NO: 1422748 - RNA, 23 nt, Human
ccuccucccacccggcugcagag

SEQ ID NO: 1422749 - RNA, 19 nt, Human
ccuccucccacccggcugc

SEQ ID NO: 1422750 - RNA, 16 nt, Human
ccuccucccacccggc

SEQ ID NO: 1422751 - RNA, 16 nt, Human
ccuccuccagggacag

SEQ ID NO: 1422752 - RNA, 15 nt, Human
ccuccuccagggaca

SEQ ID NO: 1422753 - RNA, 14 nt, Human
ccuccuccagggac

SEQ ID NO: 1422754 - RNA, 13 nt, Human
ccuccuccaggga

SEQ ID NO: 1422755 - RNA, 12 nt, Human
ccuccuccaggg

SEQ ID NO: 1422756 - RNA, 19 nt, Human
ccuccuuucaucacacugg

SEQ ID NO: 1422757 - RNA, 14 nt, Human
ccuccuucugcugc

SEQ ID NO: 1422758 - RNA, 18 nt, Human
ccucuacagagcuucccu

SEQ ID NO: 1422759 - RNA, 19 nt, Human
ccucuaagguugggcaggg

SEQ ID NO: 1422760 - RNA, 21 nt, Human
ccucuaacuuggcucacacuc

SEQ ID NO: 1422761 - RNA, 17 nt, Human
ccucuaacuuggcucac

SEQ ID NO: 1422762 - RNA, 15 nt, Human
ccucguggacaccug

SEQ ID NO: 1422763 - RNA, 16 nt, Human
ccucguggacaccugc

SEQ ID NO: 1422764 - RNA, 17 nt, Human
ccucguggacaccugcc

SEQ ID NO: 1422765 - RNA, 18 nt, Human
ccucguggacaccugccc

SEQ ID NO: 1422766 - RNA, 20 nt, Human
ccucguggacaccugcccug

SEQ ID NO: 1422767 - RNA, 21 nt, Human
ccucguggacaccugcccugc

SEQ ID NO: 1422768 - RNA, 22 nt, Human
ccucguggacaccugcccugcc

SEQ ID NO: 1422769 - RNA, 21 nt, Human
ccucccucugcugucaccuug

SEQ ID NO: 1422770 - RNA, 14 nt, Human
ccucccucugcugu

SEQ ID NO: 1422771 - RNA, 22 nt, Human
ccucccucucguaagauuuccu

SEQ ID NO: 1422772 - RNA, 20 nt, Human
ccucccgagcuccucuucca

SEQ ID NO: 1422773 - RNA, 19 nt, Human
ccucccgagcuccucuucc

SEQ ID NO: 1422774 - RNA, 14 nt, Human
ccucccgagcuccu

SEQ ID NO: 1422775 - RNA, 21 nt, Human
ccuccccgcaccccccaagcu

SEQ ID NO: 1422776 - RNA, 15 nt, Human
ccuccccgcaccccc

SEQ ID NO: 1422777 - RNA, 14 nt, Human
ccucccccuguccc

SEQ ID NO: 1422778 - RNA, 16 nt, Human
ccucccccugccagga

SEQ ID NO: 1422779 - RNA, 14 nt, Human
ccucccccugccag

SEQ ID NO: 1422780 - RNA, 13 nt, Human
ccucccccugcca

SEQ ID NO: 1422781 - RNA, 19 nt, Human
ccucccccccaugcacugu

SEQ ID NO: 1422782 - RNA, 17 nt, Human
ccucccccccaugcacu

SEQ ID NO: 1422783 - RNA, 16 nt, Human
ccucccccccaugcac

SEQ ID NO: 1422784 - RNA, 15 nt, Human
ccucccccccaugca

SEQ ID NO: 1422785 - RNA, 12 nt, Human
ccucccccugag

SEQ ID NO: 1422786 - RNA, 12 nt, Human
ccuccaugggcc

SEQ ID NO: 1422787 - RNA, 16 nt, Human
ccuccccuccaucccu

SEQ ID NO: 1422788 - RNA, 20 nt, Human
ccuccccuccaucccuggcc

SEQ ID NO: 1422789 - RNA, 14 nt, Human
ccuccccuccaucc

SEQ ID NO: 1422790 - RNA, 13 nt, Human
ccuccccuccagc

SEQ ID NO: 1422791 - RNA, 12 nt, Human
ccuccccuccag

SEQ ID NO: 1422792 - RNA, 18 nt, Human
ccuccccugccagggcag

SEQ ID NO: 1422793 - RNA, 16 nt, Human
ccuccccugccagggc

SEQ ID NO: 1422794 - RNA, 13 nt, Human
ccuccccugccag

SEQ ID NO: 1422795 - RNA, 17 nt, Human
ccuccccugccaccagg

SEQ ID NO: 1422796 - RNA, 14 nt, Human
ccuccccugccacc

SEQ ID NO: 1422797 - RNA, 13 nt, Human
ccuccccugccac

SEQ ID NO: 1422798 - RNA, 12 nt, Human
ccuccccugcca

SEQ ID NO: 1422799 - RNA, 19 nt, Human
ccucaguuuuaucauuuuc

SEQ ID NO: 1422800 - RNA, 13 nt, Human
ccuccaggaagcc

SEQ ID NO: 1422801 - RNA, 15 nt, Human
ccuccaggaagccuu

SEQ ID NO: 1422802 - RNA, 17 nt, Human
ccuccagcuuuccugua

SEQ ID NO: 1422803 - RNA, 14 nt, Human
ccuccagcuuuccu

SEQ ID NO: 1422804 - RNA, 13 nt, Human
ccuccagcuuucc

SEQ ID NO: 1422805 - RNA, 11 nt, Human
ccuccagcugu

SEQ ID NO: 1422806 - RNA, 12 nt, Human
ccuccagcuguu

SEQ ID NO: 1422807 - RNA, 18 nt, Human
ccuccagcucccugugcc

SEQ ID NO: 1422808 - RNA, 21 nt, Human
ccuccagcucccugugccccc

SEQ ID NO: 1422809 - RNA, 20 nt, Human
ccuccacucuuucuuucaau

SEQ ID NO: 1422810 - RNA, 15 nt, Human
ccuccacucuuucuu

SEQ ID NO: 1422811 - RNA, 18 nt, Human
ccuccaugggccccaggg

SEQ ID NO: 1422812 - RNA, 11 nt, Human
ccuccauggga

SEQ ID NO: 1422813 - RNA, 17 nt, Human
ccuccaucccuggcccc

SEQ ID NO: 1422814 - RNA, 16 nt, Human
ccuccaucccuggccc

SEQ ID NO: 1422815 - RNA, 14 nt, Human
ccuccaucccuggc

SEQ ID NO: 1422816 - RNA, 23 nt, Human
ccuccauccuacccccugugccu

SEQ ID NO: 1422817 - RNA, 22 nt, Human
ccuccauccuacccccugugcc

SEQ ID NO: 1422818 - RNA, 12 nt, Human
ccuccaucccug

SEQ ID NO: 1422819 - RNA, 17 nt, Human
ccuccauccuacccccu

SEQ ID NO: 1422820 - RNA, 17 nt, Human
ccuccagggugugugcu

SEQ ID NO: 1422821 - RNA, 20 nt, Human
ccuccaggguggcagcaaca

SEQ ID NO: 1422822 - RNA, 21 nt, Human
ccuccaggguggcagcaacaa

SEQ ID NO: 1422823 - RNA, 12 nt, Human
cccaguguggcu

SEQ ID NO: 1422824 - RNA, 16 nt, Human
cccaguguuuuaggag

SEQ ID NO: 1422825 - RNA, 17 nt, Human
cccaguguuuuaggagc

SEQ ID NO: 1422826 - RNA, 14 nt, Human
cccaguucacccug

SEQ ID NO: 1422827 - RNA, 14 nt, Human
cccaguuaaucuug

SEQ ID NO: 1422828 - RNA, 18 nt, Human
cccagugcccucuccccu

SEQ ID NO: 1422829 - RNA, 14 nt, Human
cccagugcccccac

SEQ ID NO: 1422830 - RNA, 14 nt, Human
cccagugcccucuc

SEQ ID NO: 1422831 - RNA, 22 nt, Human
cccagugcccccacugaccaga

SEQ ID NO: 1422832 - RNA, 20 nt, Human
cccagugcccccacugacca

SEQ ID NO: 1422833 - RNA, 19 nt, Human
cccagugcccccacugacc

SEQ ID NO: 1422834 - RNA, 22 nt, Human
cccaguacacaggggcuugacu

SEQ ID NO: 1422835 - RNA, 18 nt, Human
cccaguacaccccaccuc

SEQ ID NO: 1422836 - RNA, 19 nt, Human
cccaguacaccccaccucu

SEQ ID NO: 1422837 - RNA, 15 nt, Human
cccaguaacucaucu

SEQ ID NO: 1422838 - RNA, 18 nt, Human
cccaguaaaauugccaua

SEQ ID NO: 1422839 - RNA, 22 nt, Human
cccagguaggggccccucucag

SEQ ID NO: 1422840 - RNA, 14 nt, Human
cccagguccagcuc

SEQ ID NO: 1422841 - RNA, 23 nt, Human
cccagguaggggccccucucagc

SEQ ID NO: 1422842 - RNA, 12 nt, Human
cccaguaaaauu

SEQ ID NO: 1422843 - RNA, 13 nt, Human
cccaguaaaauug

SEQ ID NO: 1422844 - RNA, 16 nt, Human
cccaguaaaauugcca

SEQ ID NO: 1422845 - RNA, 17 nt, Human
cccaguaaaauugccau

SEQ ID NO: 1422846 - RNA, 21 nt, Human
cccagguaggggccccucuca

SEQ ID NO: 1422847 - RNA, 20 nt, Human
cccagguaggggccccucuc

SEQ ID NO: 1422848 - RNA, 17 nt, Human
cccagguaggggccccu

SEQ ID NO: 1422849 - RNA, 20 nt, Human
cccagguaggccaagguguc

SEQ ID NO: 1422850 - RNA, 17 nt, Human
cccagguaggccaaggu

SEQ ID NO: 1422851 - RNA, 19 nt, Human
cccauggggagggauucug

SEQ ID NO: 1422852 - RNA, 12 nt, Human
cccaucuugcuu

SEQ ID NO: 1422853 - RNA, 14 nt, Human
cccaucucaugccc

SEQ ID NO: 1422854 - RNA, 20 nt, Human
cccaucucaugccccuggcu

SEQ ID NO: 1422855 - RNA, 23 nt, Human
cccaucucaggccagagccaagg

SEQ ID NO: 1422856 - RNA, 16 nt, Human
cccaucucaggccaga

SEQ ID NO: 1422857 - RNA, 11 nt, Human
cccaucucagg

SEQ ID NO: 1422858 - RNA, 22 nt, Human
cccaucguugcccccauuucug

SEQ ID NO: 1422859 - RNA, 20 nt, Human
cccaucguugcccccauuuc

SEQ ID NO: 1422860 - RNA, 22 nt, Human
cccaucgucucggccuucacaa

SEQ ID NO: 1422861 - RNA, 19 nt, Human
cccaucgucucggccuuca

SEQ ID NO: 1422862 - RNA, 20 nt, Human
ccccaacuacccccagcugu

SEQ ID NO: 1422863 - RNA, 20 nt, Human
ccccaaccugcucuccucuu

SEQ ID NO: 1422864 - RNA, 21 nt, Human
ccccaaccugcucuccucuuc

SEQ ID NO: 1422865 - RNA, 19 nt, Human
ccccaaccugcucuccucu

SEQ ID NO: 1422866 - RNA, 16 nt, Human
ccccaaccugcucucc

SEQ ID NO: 1422867 - RNA, 15 nt, Human
ccccaaccugcucuc

SEQ ID NO: 1422868 - RNA, 14 nt, Human
ccccaaccugcucu

SEQ ID NO: 1422869 - RNA, 13 nt, Human
ccccaaccugcuc

SEQ ID NO: 1422870 - RNA, 23 nt, Human
ccccaacccguggaggcugcucg

SEQ ID NO: 1422871 - RNA, 20 nt, Human
ccccaacccguggaggcugc

SEQ ID NO: 1422872 - RNA, 21 nt, Human
ccccaaagcuuuccugcccca

SEQ ID NO: 1422873 - RNA, 19 nt, Human
ccccaaagcuuuccugccc

SEQ ID NO: 1422874 - RNA, 18 nt, Human
ccccaaagcuuuccugcc

SEQ ID NO: 1422875 - RNA, 16 nt, Human
ccccaaagcuuuccug

SEQ ID NO: 1422876 - RNA, 17 nt, Human
cccauggugcuaggaag

SEQ ID NO: 1422877 - RNA, 17 nt, Human
cccaugucuacacagau

SEQ ID NO: 1422878 - RNA, 13 nt, Human
cccauguuucaaa

SEQ ID NO: 1422879 - RNA, 18 nt, Human
cccauuagaccaagcuug

SEQ ID NO: 1422880 - RNA, 21 nt, Human
cccauguucugucccuugccc

SEQ ID NO: 1422881 - RNA, 21 nt, Human
cccauguguccugguucccgu

SEQ ID NO: 1422882 - RNA, 15 nt, Human
cccauguucuguccc

SEQ ID NO: 1422883 - RNA, 20 nt, Human
ccaugcgcccccuccgcccu

SEQ ID NO: 1422884 - RNA, 14 nt, Human
ccaugcgcccccuc

SEQ ID NO: 1422885 - RNA, 15 nt, Human
ccaugaaccaagacc

SEQ ID NO: 1422886 - RNA, 17 nt, Human
ccaugcugaggccuggg

SEQ ID NO: 1422887 - RNA, 16 nt, Human
ccaugcugaggccugg

SEQ ID NO: 1422888 - RNA, 15 nt, Human
ccaugcugaggccug

SEQ ID NO: 1422889 - RNA, 21 nt, Human
ccaugcugcuggggaagacag

SEQ ID NO: 1422890 - RNA, 20 nt, Human
ccaugcugcuggggaagaca

SEQ ID NO: 1422891 - RNA, 19 nt, Human
ccaugcugcuggggaagac

SEQ ID NO: 1422892 - RNA, 14 nt, Human
ccaugcugcugggg

SEQ ID NO: 1422893 - RNA, 13 nt, Human
ccaugugcccagu

SEQ ID NO: 1422894 - RNA, 23 nt, Human
ccauggaguggcagcccagccag

SEQ ID NO: 1422895 - RNA, 21 nt, Human
ccauggaguggcagcccagcc

SEQ ID NO: 1422896 - RNA, 20 nt, Human
ccauggaguggcagcccagc

SEQ ID NO: 1422897 - RNA, 19 nt, Human
ccauggaguggcagcccag

SEQ ID NO: 1422898 - RNA, 15 nt, Human
ccauggaguggcagc

SEQ ID NO: 1422899 - RNA, 20 nt, Human
ccauggccagcagcaccugc

SEQ ID NO: 1422900 - RNA, 21 nt, Human
ccauggccagcagcaccugcc

SEQ ID NO: 1422901 - RNA, 16 nt, Human
ccauggccagcagcac

SEQ ID NO: 1422902 - RNA, 13 nt, Human
ccauggccagcag

SEQ ID NO: 1422903 - RNA, 14 nt, Human
ccauggcaggaagg

SEQ ID NO: 1422904 - RNA, 22 nt, Human
ccauggaguggcagcccagcca

SEQ ID NO: 1422905 - RNA, 18 nt, Human
ccauggagauugaccugg

SEQ ID NO: 1422906 - RNA, 19 nt, Human
ccauggagauugaccugga

SEQ ID NO: 1422907 - RNA, 14 nt, Human
ccauggaguggcag

SEQ ID NO: 1422908 - RNA, 19 nt, Human
ccauggagggagggagugg

SEQ ID NO: 1422909 - RNA, 23 nt, Human
ccauggagaaagcugacuuggcu

SEQ ID NO: 1422910 - RNA, 20 nt, Human
ccauggagaaagcugacuug

SEQ ID NO: 1422911 - RNA, 19 nt, Human
ccauggagaaagcugacuu

SEQ ID NO: 1422912 - RNA, 18 nt, Human
ccauggagaaagcugacu

SEQ ID NO: 1422913 - RNA, 15 nt, Human
ccauggacaggcugg

SEQ ID NO: 1422914 - RNA, 14 nt, Human
ccauggacaggcug

SEQ ID NO: 1422915 - RNA, 19 nt, Human
ccauggacacuacacccag

SEQ ID NO: 1422916 - RNA, 20 nt, Human
ccauggacacuacacccagc

SEQ ID NO: 1422917 - RNA, 21 nt, Human
ccauggacacuacacccagca

SEQ ID NO: 1422918 - RNA, 22 nt, Human
ccauggacacuacacccagcaa

SEQ ID NO: 1422919 - RNA, 23 nt, Human
ccauggacacuacacccagcaau

SEQ ID NO: 1422920 - RNA, 17 nt, Human
cccagagcaccugcugu

SEQ ID NO: 1422921 - RNA, 20 nt, Human
cccagagcaccugcugucug

SEQ ID NO: 1422922 - RNA, 14 nt, Human
cccagagcaccugc

SEQ ID NO: 1422923 - RNA, 15 nt, Human
cccagagagcccgag

SEQ ID NO: 1422924 - RNA, 13 nt, Human
cccagagagcccg

SEQ ID NO: 1422925 - RNA, 23 nt, Human
cccagacuuguuggcguaggcua

SEQ ID NO: 1422926 - RNA, 10 nt, Human
cccagacuug

SEQ ID NO: 1422927 - RNA, 20 nt, Human
cccagacucagacauuggca

SEQ ID NO: 1422928 - RNA, 16 nt, Human
cccagacucagacauu

SEQ ID NO: 1422929 - RNA, 13 nt, Human
cccagacucagac

SEQ ID NO: 1422930 - RNA, 12 nt, Human
cccagacucaga

SEQ ID NO: 1422931 - RNA, 23 nt, Human
cccagacuagauguaguauuuuu

SEQ ID NO: 1422932 - RNA, 20 nt, Human
cccagacuagauguaguauu

SEQ ID NO: 1422933 - RNA, 19 nt, Human
cccagacgccuggcugcug

SEQ ID NO: 1422934 - RNA, 15 nt, Human
cccagacgccuggcu

SEQ ID NO: 1422935 - RNA, 22 nt, Human
cccagaccuguuagcagacagg

SEQ ID NO: 1422936 - RNA, 21 nt, Human
cccagaccuguuagcagacag

SEQ ID NO: 1422937 - RNA, 19 nt, Human
cccagacauaaaggaaaag

SEQ ID NO: 1422938 - RNA, 17 nt, Human
cccagacauaaaggaaa

SEQ ID NO: 1422939 - RNA, 16 nt, Human
cccagacauaaaggaa

SEQ ID NO: 1422940 - RNA, 16 nt, Human
cccagacacugguuug

SEQ ID NO: 1422941 - RNA, 15 nt, Human
cccacgagggcuggc

SEQ ID NO: 1422942 - RNA, 22 nt, Human
ccauuccugggaaauauucccu

SEQ ID NO: 1422943 - RNA, 16 nt, Human
ccauuccugaagaacc

SEQ ID NO: 1422944 - RNA, 13 nt, Human
ccauuccugaaga

SEQ ID NO: 1422945 - RNA, 18 nt, Human
ccaugugguggcacaggc

SEQ ID NO: 1422946 - RNA, 17 nt, Human
ccaugugguggcacagg

SEQ ID NO: 1422947 - RNA, 15 nt, Human
ccauggagaaagcug

SEQ ID NO: 1422948 - RNA, 18 nt, Human
ccauucauuccauucugg

SEQ ID NO: 1422949 - RNA, 20 nt, Human
ccauguuggccaggaugguc

SEQ ID NO: 1422950 - RNA, 20 nt, Human
ccauucauuccauucuggaa

SEQ ID NO: 1422951 - RNA, 15 nt, Human
cccagccucuggcau

SEQ ID NO: 1422952 - RNA, 18 nt, Human
cccagccucccugaagcc

SEQ ID NO: 1422953 - RNA, 17 nt, Human
cccagccucccugaagc

SEQ ID NO: 1422954 - RNA, 16 nt, Human
cccagccucccugaag

SEQ ID NO: 1422955 - RNA, 19 nt, Human
cccagcccucaucccgagc

SEQ ID NO: 1422956 - RNA, 14 nt, Human
cccagcccucaucc

SEQ ID NO: 1422957 - RNA, 16 nt, Human
cccagcccucaucccg

SEQ ID NO: 1422958 - RNA, 15 nt, Human
cccagcccucauccc

SEQ ID NO: 1422959 - RNA, 21 nt, Human
cccagcccccuaagagagcac

SEQ ID NO: 1422960 - RNA, 18 nt, Human
cccagcccccuaagagag

SEQ ID NO: 1422961 - RNA, 17 nt, Human
cccagccccagccaggg

SEQ ID NO: 1422962 - RNA, 15 nt, Human
cccagccccagccag

SEQ ID NO: 1422963 - RNA, 22 nt, Human
cccagccccacuccucugcuga

SEQ ID NO: 1422964 - RNA, 12 nt, Human
cccagccccagc

SEQ ID NO: 1422965 - RNA, 16 nt, Human
cccagagcccaggcuc

SEQ ID NO: 1422966 - RNA, 19 nt, Human
cccagagcccaggcucggc

SEQ ID NO: 1422967 - RNA, 15 nt, Human
cccagagcccaggcu

SEQ ID NO: 1422968 - RNA, 14 nt, Human
cccagagcccaggc

SEQ ID NO: 1422969 - RNA, 17 nt, Human
cccagagcccagcucca

SEQ ID NO: 1422970 - RNA, 16 nt, Human
cccagagcccagcucc

SEQ ID NO: 1422971 - RNA, 15 nt, Human
cccagagcccagcuc

SEQ ID NO: 1422972 - RNA, 13 nt, Human
cccagagcccagc

SEQ ID NO: 1422973 - RNA, 12 nt, Human
cccagagcccag

SEQ ID NO: 1422974 - RNA, 20 nt, Human
cccagaggagccaccaguuc

SEQ ID NO: 1422975 - RNA, 24 nt, Human
cccagaggaaggggccagaggcuc

SEQ ID NO: 1422976 - RNA, 23 nt, Human
cccagaggaaggggccagaggcu

SEQ ID NO: 1422977 - RNA, 22 nt, Human
cccagaggaaggggccagaggc

SEQ ID NO: 1422978 - RNA, 21 nt, Human
cccagaggaaggggccagagg

SEQ ID NO: 1422979 - RNA, 16 nt, Human
cccagaggauugcugc

SEQ ID NO: 1422980 - RNA, 16 nt, Human
cccagccccacuccuc

SEQ ID NO: 1422981 - RNA, 23 nt, Human
cccagcaaagcccccagagccca

SEQ ID NO: 1422982 - RNA, 17 nt, Human
cccagcaaagcccccag

SEQ ID NO: 1422983 - RNA, 15 nt, Human
cccagcaaagccccc

SEQ ID NO: 1422984 - RNA, 17 nt, Human
cccaggagacaguucaa

SEQ ID NO: 1422985 - RNA, 15 nt, Human
cccaggagacaguuc

SEQ ID NO: 1422986 - RNA, 16 nt, Human
cccaggaccuggcugc

SEQ ID NO: 1422987 - RNA, 18 nt, Human
cccaggaccuggcugcca

SEQ ID NO: 1422988 - RNA, 23 nt, Human
cccaggacccuggacccagccag

SEQ ID NO: 1422989 - RNA, 20 nt, Human
cccaggacccuggacccagc

SEQ ID NO: 1422990 - RNA, 19 nt, Human
cccaggacccuggacccag

SEQ ID NO: 1422991 - RNA, 20 nt, Human
cccaggaccccauggcagug

SEQ ID NO: 1422992 - RNA, 23 nt, Human
cccaggacccugaaggggccaug

SEQ ID NO: 1422993 - RNA, 13 nt, Human
cccaggacccuga

SEQ ID NO: 1422994 - RNA, 12 nt, Human
cccaggacccug

SEQ ID NO: 1422995 - RNA, 11 nt, Human
cccaggacccu

SEQ ID NO: 1422996 - RNA, 12 nt, Human
cccaggacccca

SEQ ID NO: 1422997 - RNA, 22 nt, Human
cccaggaccagcucaggacaga

SEQ ID NO: 1422998 - RNA, 21 nt, Human
cccaggaccagcucaggacag

SEQ ID NO: 1422999 - RNA, 20 nt, Human
cccaggaccagcucaggaca

SEQ ID NO: 1423000 - RNA, 17 nt, Human
cccaggaccagcucagg

SEQ ID NO: 1423001 - RNA, 16 nt, Human
cccaggaccagcucag

SEQ ID NO: 1423002 - RNA, 15 nt, Human
cccaggaccagcuca

SEQ ID NO: 1423003 - RNA, 14 nt, Human
cccaggaccagcuc

SEQ ID NO: 1423004 - RNA, 23 nt, Human
cccaggaccagaagcucccccag

SEQ ID NO: 1423005 - RNA, 12 nt, Human
cccaggaccagc

SEQ ID NO: 1423006 - RNA, 22 nt, Human
cccaggaccagaagcuccccca

SEQ ID NO: 1423007 - RNA, 15 nt, Human
cccaggaccagaagc

SEQ ID NO: 1423008 - RNA, 12 nt, Human
cccaggaccaga

SEQ ID NO: 1423009 - RNA, 23 nt, Human
cccaggaccacaggcucaggcag

SEQ ID NO: 1423010 - RNA, 22 nt, Human
cccaggaccacaggcucaggca

SEQ ID NO: 1423011 - RNA, 21 nt, Human
cccaggaccacaggcucaggc

SEQ ID NO: 1423012 - RNA, 17 nt, Human
cccaggaccacaggcuc

SEQ ID NO: 1423013 - RNA, 16 nt, Human
cccaggaccacaggcu

SEQ ID NO: 1423014 - RNA, 17 nt, Human
cccaggacaggauccag

SEQ ID NO: 1423015 - RNA, 23 nt, Human
cccagcuaggaagagcaggacuc

SEQ ID NO: 1423016 - RNA, 22 nt, Human
cccagcuaggaagagcaggacu

SEQ ID NO: 1423017 - RNA, 18 nt, Human
cccagcuaggaagagcag

SEQ ID NO: 1423018 - RNA, 13 nt, Human
cccagcuaggaag

SEQ ID NO: 1423019 - RNA, 12 nt, Human
cccagcucugaa

SEQ ID NO: 1423020 - RNA, 11 nt, Human
cccagcucaau

SEQ ID NO: 1423021 - RNA, 19 nt, Human
cccagccugucagauccag

SEQ ID NO: 1423022 - RNA, 18 nt, Human
cccagccugucagaucca

SEQ ID NO: 1423023 - RNA, 14 nt, Human
cccagccugucaga

SEQ ID NO: 1423024 - RNA, 12 nt, Human
cccagccuguca

SEQ ID NO: 1423025 - RNA, 11 nt, Human
cccagccuguc

SEQ ID NO: 1423026 - RNA, 10 nt, Human
cccagccugu

SEQ ID NO: 1423027 - RNA, 19 nt, Human
cccagccugggccuaugga

SEQ ID NO: 1423028 - RNA, 18 nt, Human
cccagccugggccuaugg

SEQ ID NO: 1423029 - RNA, 16 nt, Human
cccagccugggccuau

SEQ ID NO: 1423030 - RNA, 15 nt, Human
cccagccugggccua

SEQ ID NO: 1423031 - RNA, 14 nt, Human
cccagccugggccu

SEQ ID NO: 1423032 - RNA, 12 nt, Human
cccagccugggc

SEQ ID NO: 1423033 - RNA, 13 nt, Human
cccagccugggcc

SEQ ID NO: 1423034 - RNA, 11 nt, Human
cccagccuggg

SEQ ID NO: 1423035 - RNA, 22 nt, Human
cccagccuuuguuccccacugg

SEQ ID NO: 1423036 - RNA, 22 nt, Human
cccagccugucagauccaggag

SEQ ID NO: 1423037 - RNA, 22 nt, Human
cccagcucugaaaccaguguua

SEQ ID NO: 1423038 - RNA, 14 nt, Human
cccagcucugaaac

SEQ ID NO: 1423039 - RNA, 10 nt, Human
cccaggacag

SEQ ID NO: 1423040 - RNA, 22 nt, Human
ccaggagcacggcucugucccc

SEQ ID NO: 1423041 - RNA, 19 nt, Human
ccaggagcacggcucuguc

SEQ ID NO: 1423042 - RNA, 18 nt, Human
ccaggagcacggcucugu

SEQ ID NO: 1423043 - RNA, 17 nt, Human
ccaggagcacggcucug

SEQ ID NO: 1423044 - RNA, 16 nt, Human
ccaggagcacggcucu

SEQ ID NO: 1423045 - RNA, 21 nt, Human
ccaggacuuauuuaaacucug

SEQ ID NO: 1423046 - RNA, 22 nt, Human
ccaggacucugcagccucagag

SEQ ID NO: 1423047 - RNA, 21 nt, Human
ccaggacucugcagccucaga

SEQ ID NO: 1423048 - RNA, 20 nt, Human
ccaggacucugcagccucag

SEQ ID NO: 1423049 - RNA, 19 nt, Human
ccaggacucugcagccuca

SEQ ID NO: 1423050 - RNA, 18 nt, Human
ccaggacucugcagccuc

SEQ ID NO: 1423051 - RNA, 17 nt, Human
ccaggacucugcagccu

SEQ ID NO: 1423052 - RNA, 16 nt, Human
ccaggacucugcagcc

SEQ ID NO: 1423053 - RNA, 15 nt, Human
ccaggacucugcagc

SEQ ID NO: 1423054 - RNA, 13 nt, Human
ccaggagaagcuc

SEQ ID NO: 1423055 - RNA, 14 nt, Human
ccaggacucugcag

SEQ ID NO: 1423056 - RNA, 14 nt, Human
ccaggagaagcuca

SEQ ID NO: 1423057 - RNA, 11 nt, Human
ccaggagaagc

SEQ ID NO: 1423058 - RNA, 20 nt, Human
ccaggagaagaaagagguga

SEQ ID NO: 1423059 - RNA, 15 nt, Human
ccaggagaagaaaga

SEQ ID NO: 1423060 - RNA, 18 nt, Human
ccaggaccuggcugccau

SEQ ID NO: 1423061 - RNA, 17 nt, Human
ccaggaccuggcugcca

SEQ ID NO: 1423062 - RNA, 15 nt, Human
ccaggaccuggcugc

SEQ ID NO: 1423063 - RNA, 19 nt, Human
ccaggacccuggacccagc

SEQ ID NO: 1423064 - RNA, 18 nt, Human
ccaggacccuggacccag

SEQ ID NO: 1423065 - RNA, 11 nt, Human
ccaggacccca

SEQ ID NO: 1423066 - RNA, 23 nt, Human
ccaggacccugaaggggccauga

SEQ ID NO: 1423067 - RNA, 19 nt, Human
ccaggacccugaaggggcc

SEQ ID NO: 1423068 - RNA, 18 nt, Human
ccaggacccugaaggggc

SEQ ID NO: 1423069 - RNA, 16 nt, Human
ccaggacccugaaggg

SEQ ID NO: 1423070 - RNA, 14 nt, Human
ccaggacccugaag

SEQ ID NO: 1423071 - RNA, 23 nt, Human
ccaggaccagucaaccugggcaa

SEQ ID NO: 1423072 - RNA, 21 nt, Human
ccaggaccacaggcucaggca

SEQ ID NO: 1423073 - RNA, 20 nt, Human
ccaggaccagcucaggacag

SEQ ID NO: 1423074 - RNA, 17 nt, Human
ccaggaccagcucagga

SEQ ID NO: 1423075 - RNA, 16 nt, Human
ccaggaccagcucagg

SEQ ID NO: 1423076 - RNA, 15 nt, Human
ccaggaccagcucag

SEQ ID NO: 1423077 - RNA, 14 nt, Human
ccaggaccagcuca

SEQ ID NO: 1423078 - RNA, 13 nt, Human
ccaggaccagcuc

SEQ ID NO: 1423079 - RNA, 19 nt, Human
ccaggaccacaggcucagg

SEQ ID NO: 1423080 - RNA, 18 nt, Human
ccaggaccacaggcucag

SEQ ID NO: 1423081 - RNA, 17 nt, Human
ccaggaccacaggcuca

SEQ ID NO: 1423082 - RNA, 16 nt, Human
ccaggaccacaggcuc

SEQ ID NO: 1423083 - RNA, 14 nt, Human
ccagcuguguccaa

SEQ ID NO: 1423084 - RNA, 13 nt, Human
ccaggaccacagg

SEQ ID NO: 1423085 - RNA, 13 nt, Human
ccagcugugucca

SEQ ID NO: 1423086 - RNA, 23 nt, Human
ccagcugugguuuucuuuugcca

SEQ ID NO: 1423087 - RNA, 15 nt, Human
ccagcugugguuuuc

SEQ ID NO: 1423088 - RNA, 14 nt, Human
ccagcugugguuuu

SEQ ID NO: 1423089 - RNA, 13 nt, Human
ccagcugugguuu

SEQ ID NO: 1423090 - RNA, 21 nt, Human
ccagcugugcuuaugguacca

SEQ ID NO: 1423091 - RNA, 15 nt, Human
ccagcugugcuuaug

SEQ ID NO: 1423092 - RNA, 14 nt, Human
ccagcugugcuuau

SEQ ID NO: 1423093 - RNA, 15 nt, Human
ccagccucuggcauu

SEQ ID NO: 1423094 - RNA, 23 nt, Human
ccagccucgcccauccccuugag

SEQ ID NO: 1423095 - RNA, 20 nt, Human
ccagcugagcgccaggaugg

SEQ ID NO: 1423096 - RNA, 17 nt, Human
ccagcugagcgccagga

SEQ ID NO: 1423097 - RNA, 15 nt, Human
ccagcugagcgccag

SEQ ID NO: 1423098 - RNA, 23 nt, Human
ccagcugacuaaacuuuuuuucu

SEQ ID NO: 1423099 - RNA, 17 nt, Human
ccagcugacuaaacuuu

SEQ ID NO: 1423100 - RNA, 14 nt, Human
ccagcugacuaaac

SEQ ID NO: 1423101 - RNA, 23 nt, Human
ccagcucuguucuuccucagcca

SEQ ID NO: 1423102 - RNA, 22 nt, Human
ccagcucuguucuuccucagcc

SEQ ID NO: 1423103 - RNA, 21 nt, Human
ccagcucuguucuuccucagc

SEQ ID NO: 1423104 - RNA, 20 nt, Human
ccagcucuguucuuccucag

SEQ ID NO: 1423105 - RNA, 17 nt, Human
ccagcucuguucuuccu

SEQ ID NO: 1423106 - RNA, 16 nt, Human
ccagcucuguucuucc

SEQ ID NO: 1423107 - RNA, 14 nt, Human
ccagcucuguucuu

SEQ ID NO: 1423108 - RNA, 13 nt, Human
ccagcucuguucu

SEQ ID NO: 1423109 - RNA, 12 nt, Human
ccagcucuguuc

SEQ ID NO: 1423110 - RNA, 21 nt, Human
ccagcucuguaucaggaccca

SEQ ID NO: 1423111 - RNA, 18 nt, Human
ccagcucuguaucaggac

SEQ ID NO: 1423112 - RNA, 14 nt, Human
ccagcucuguauca

SEQ ID NO: 1423113 - RNA, 14 nt, Human
ccagcucuggaggg

SEQ ID NO: 1423114 - RNA, 21 nt, Human
ccagcucugaaaccaguguua

SEQ ID NO: 1423115 - RNA, 20 nt, Human
ccagcucugaaaccaguguu

SEQ ID NO: 1423116 - RNA, 15 nt, Human
ccagcucugaaacca

SEQ ID NO: 1423117 - RNA, 19 nt, Human
ccagccuggccuccugccu

SEQ ID NO: 1423118 - RNA, 18 nt, Human
ccagccuggccuccugcc

SEQ ID NO: 1423119 - RNA, 17 nt, Human
ccagccuggccuccugc

SEQ ID NO: 1423120 - RNA, 16 nt, Human
ccagccuggccuccug

SEQ ID NO: 1423121 - RNA, 15 nt, Human
ccagccuggccuccu

SEQ ID NO: 1423122 - RNA, 14 nt, Human
ccagccuggccucc

SEQ ID NO: 1423123 - RNA, 13 nt, Human
ccagccuggccuc

SEQ ID NO: 1423124 - RNA, 12 nt, Human
ccagccuggccu

SEQ ID NO: 1423125 - RNA, 13 nt, Human
ccagccuggccca

SEQ ID NO: 1423126 - RNA, 12 nt, Human
ccagccuggccc

SEQ ID NO: 1423127 - RNA, 17 nt, Human
ccagcugggucaggcag

SEQ ID NO: 1423128 - RNA, 16 nt, Human
ccagcugggucaggca

SEQ ID NO: 1423129 - RNA, 14 nt, Human
ccagcugggcucug

SEQ ID NO: 1423130 - RNA, 19 nt, Human
ccagcuguccccccacucc

SEQ ID NO: 1423131 - RNA, 18 nt, Human
ccagcuguccccccacuc

SEQ ID NO: 1423132 - RNA, 15 nt, Human
ccagcugucccccca

SEQ ID NO: 1423133 - RNA, 18 nt, Human
ccagcugggucaggcagg

SEQ ID NO: 1423134 - RNA, 13 nt, Human
ccagcugcacuga

SEQ ID NO: 1423135 - RNA, 23 nt, Human
ccaggccucucccuccuccagga

SEQ ID NO: 1423136 - RNA, 19 nt, Human
ccaggccugaaagaggcug

SEQ ID NO: 1423137 - RNA, 20 nt, Human
ccagggacagaggccccagc

SEQ ID NO: 1423138 - RNA, 18 nt, Human
ccagggacagaggcccca

SEQ ID NO: 1423139 - RNA, 13 nt, Human
ccagggacagagg

SEQ ID NO: 1423140 - RNA, 18 nt, Human
ccagggacaccugggaga

SEQ ID NO: 1423141 - RNA, 20 nt, Human
ccagggacaccugggagaaa

SEQ ID NO: 1423142 - RNA, 23 nt, Human
ccagggacagaggccccagccuc

SEQ ID NO: 1423143 - RNA, 22 nt, Human
ccagggacagaggccccagccu

SEQ ID NO: 1423144 - RNA, 21 nt, Human
ccagggacagaggccccagcc

SEQ ID NO: 1423145 - RNA, 15 nt, Human
ccagggacucugccg

SEQ ID NO: 1423146 - RNA, 15 nt, Human
ccagggagaagcucc

SEQ ID NO: 1423147 - RNA, 14 nt, Human
ccagggagaagcuc

SEQ ID NO: 1423148 - RNA, 13 nt, Human
ccagggagaagcu

SEQ ID NO: 1423149 - RNA, 14 nt, Human
ccagggaccggcgg

SEQ ID NO: 1423150 - RNA, 12 nt, Human
ccagugcugaau

SEQ ID NO: 1423151 - RNA, 22 nt, Human
ccagugcugaauuucccucucu

SEQ ID NO: 1423152 - RNA, 14 nt, Human
ccaguggauuccca

SEQ ID NO: 1423153 - RNA, 20 nt, Human
ccagugggaggugagaccac

SEQ ID NO: 1423154 - RNA, 23 nt, Human
ccagugggaggugagaccaccuc

SEQ ID NO: 1423155 - RNA, 17 nt, Human
ccaucaacaaaaauugu

SEQ ID NO: 1423156 - RNA, 19 nt, Human
ccaucaaaaugcuuuuuau

SEQ ID NO: 1423157 - RNA, 16 nt, Human
ccaucaaaaugcuuuu

SEQ ID NO: 1423158 - RNA, 20 nt, Human
ccauauuuguaaaaugacaa

SEQ ID NO: 1423159 - RNA, 22 nt, Human
ccauauuuguaaaaugacaauc

SEQ ID NO: 1423160 - RNA, 19 nt, Human
ccauauuuguaaaaugaca

SEQ ID NO: 1423161 - RNA, 17 nt, Human
ccauauuuguaaaauga

SEQ ID NO: 1423162 - RNA, 16 nt, Human
ccauauuuguaaaaug

SEQ ID NO: 1423163 - RNA, 15 nt, Human
ccauauuuguaaaau

SEQ ID NO: 1423164 - RNA, 14 nt, Human
ccauauuuguaaaa

SEQ ID NO: 1423165 - RNA, 13 nt, Human
ccauauuuguaaa

SEQ ID NO: 1423166 - RNA, 12 nt, Human
ccauauuuguaa

SEQ ID NO: 1423167 - RNA, 20 nt, Human
ccauauuuaccucagccugg

SEQ ID NO: 1423168 - RNA, 21 nt, Human
ccauauuuaccucagccuggg

SEQ ID NO: 1423169 - RNA, 19 nt, Human
ccauauuuaccucagccug

SEQ ID NO: 1423170 - RNA, 18 nt, Human
ccauauuuaccucagccu

SEQ ID NO: 1423171 - RNA, 18 nt, Human
ccaucacugaguuuucca

SEQ ID NO: 1423172 - RNA, 17 nt, Human
ccaucaccucagauggc

SEQ ID NO: 1423173 - RNA, 16 nt, Human
ccaucaccucagaugg

SEQ ID NO: 1423174 - RNA, 21 nt, Human
ccaucaccuacucacacaggc

SEQ ID NO: 1423175 - RNA, 19 nt, Human
ccaucaccuacucacacag

SEQ ID NO: 1423176 - RNA, 13 nt, Human
ccaucaaccucug

SEQ ID NO: 1423177 - RNA, 18 nt, Human
ccaucaacaaaaauuguc

SEQ ID NO: 1423178 - RNA, 22 nt, Human
ccauccuguguguuaagcucug

SEQ ID NO: 1423179 - RNA, 14 nt, Human
ccauccuguguguu

SEQ ID NO: 1423180 - RNA, 13 nt, Human
ccauccugugugu

SEQ ID NO: 1423181 - RNA, 14 nt, Human
ccaucucaggccag

SEQ ID NO: 1423182 - RNA, 21 nt, Human
ccaucucaugccccuggcugg

SEQ ID NO: 1423183 - RNA, 20 nt, Human
ccaucucaugccccuggcug

SEQ ID NO: 1423184 - RNA, 18 nt, Human
ccaucucaggccagagcc

SEQ ID NO: 1423185 - RNA, 11 nt, Human
ccaucucaggc

SEQ ID NO: 1423186 - RNA, 12 nt, Human
ccauccugacca

SEQ ID NO: 1423187 - RNA, 20 nt, Human
ccaucagaaacacccucaca

SEQ ID NO: 1423188 - RNA, 18 nt, Human
ccaucagaaacacccuca

SEQ ID NO: 1423189 - RNA, 13 nt, Human
ccaagacucuaga

SEQ ID NO: 1423190 - RNA, 18 nt, Human
ccaagagcaucaugccuc

SEQ ID NO: 1423191 - RNA, 17 nt, Human
ccaagagcaucaugccu

SEQ ID NO: 1423192 - RNA, 16 nt, Human
ccaagagcaucaugcc

SEQ ID NO: 1423193 - RNA, 23 nt, Human
ccaagagcaucaugccucugagg

SEQ ID NO: 1423194 - RNA, 22 nt, Human
ccaagagcaucaugccucugag

SEQ ID NO: 1423195 - RNA, 21 nt, Human
ccaagagcaucaugccucuga

SEQ ID NO: 1423196 - RNA, 19 nt, Human
ccaagagcaucaugccucu

SEQ ID NO: 1423197 - RNA, 17 nt, Human
ccaacacgcaccugccu

SEQ ID NO: 1423198 - RNA, 16 nt, Human
ccaacacgcaccugcc

SEQ ID NO: 1423199 - RNA, 18 nt, Human
ccaacaucacagcccagc

SEQ ID NO: 1423200 - RNA, 17 nt, Human
ccaacaucacagcccag

SEQ ID NO: 1423201 - RNA, 15 nt, Human
ccaacauaaaaauga

SEQ ID NO: 1423202 - RNA, 22 nt, Human
ccaacaguuuaaugaagaucua

SEQ ID NO: 1423203 - RNA, 11 nt, Human
ccaaauuuaaa

SEQ ID NO: 1423204 - RNA, 18 nt, Human
ccaaauuuaaaacuguug

SEQ ID NO: 1423205 - RNA, 13 nt, Human
ccaaagcacauuu

SEQ ID NO: 1423206 - RNA, 14 nt, Human
ccaaagcagacagc

SEQ ID NO: 1423207 - RNA, 13 nt, Human
ccaaagcagacag

SEQ ID NO: 1423208 - RNA, 17 nt, Human
ccaaagcaagcaagagg

SEQ ID NO: 1423209 - RNA, 16 nt, Human
ccaaagcaagcaagag

SEQ ID NO: 1423210 - RNA, 22 nt, Human
ccaaagaguagaauugcauuga

SEQ ID NO: 1423211 - RNA, 18 nt, Human
ccaaccugcucuccucuu

SEQ ID NO: 1423212 - RNA, 20 nt, Human
ccaaccugcucuccucuucu

SEQ ID NO: 1423213 - RNA, 17 nt, Human
ccaaccugcucuccucu

SEQ ID NO: 1423214 - RNA, 16 nt, Human
ccaaccugcucuccuc

SEQ ID NO: 1423215 - RNA, 15 nt, Human
ccaaccugcucuccu

SEQ ID NO: 1423216 - RNA, 13 nt, Human
ccaaccugcucuc

SEQ ID NO: 1423217 - RNA, 12 nt, Human
ccaaccugcucu

SEQ ID NO: 1423218 - RNA, 19 nt, Human
ccaaccugcaaagaucugu

SEQ ID NO: 1423219 - RNA, 18 nt, Human
ccaaccugcaaagaucug

SEQ ID NO: 1423220 - RNA, 17 nt, Human
ccaaccugcaaagaucu

SEQ ID NO: 1423221 - RNA, 23 nt, Human
ccaaccuuagauguucuaagucu

SEQ ID NO: 1423222 - RNA, 15 nt, Human
ccaaccuguuaccua

SEQ ID NO: 1423223 - RNA, 23 nt, Human
ccaagacaugucuguucuacaua

SEQ ID NO: 1423224 - RNA, 21 nt, Human
ccaagacaugucuguucuaca

SEQ ID NO: 1423225 - RNA, 16 nt, Human
ccaacccuguccuccc

SEQ ID NO: 1423226 - RNA, 21 nt, Human
ccaacaugcacugauguugug

SEQ ID NO: 1423227 - RNA, 17 nt, Human
ccaacaugcacugaugu

SEQ ID NO: 1423228 - RNA, 13 nt, Human
ccaacaugcacug

SEQ ID NO: 1423229 - RNA, 23 nt, Human
ccaacaugcacugauguuguguu

SEQ ID NO: 1423230 - RNA, 9 nt, Human
ccaaagagu

SEQ ID NO: 1423231 - RNA, 23 nt, Human
ccaaagaggcugccccucucacc

SEQ ID NO: 1423232 - RNA, 22 nt, Human
ccaaagaggcugccccucucac

SEQ ID NO: 1423233 - RNA, 21 nt, Human
ccaaagaggcugccccucuca

SEQ ID NO: 1423234 - RNA, 20 nt, Human
ccaaagaggcugccccucuc

SEQ ID NO: 1423235 - RNA, 17 nt, Human
ccaaagaggcugccccu

SEQ ID NO: 1423236 - RNA, 18 nt, Human
ccaagcaggaaaugaaaa

SEQ ID NO: 1423237 - RNA, 22 nt, Human
ccaagagcuacguauuuaauag

SEQ ID NO: 1423238 - RNA, 13 nt, Human
ccaaggccagguu

SEQ ID NO: 1423239 - RNA, 17 nt, Human
ccaagcuccaagcccca

SEQ ID NO: 1423240 - RNA, 15 nt, Human
ccaagcuccaagccc

SEQ ID NO: 1423241 - RNA, 13 nt, Human
ccaagcuccaagc

SEQ ID NO: 1423242 - RNA, 13 nt, Human
ccacaaaaacagg

SEQ ID NO: 1423243 - RNA, 14 nt, Human
ccacaaacuguaau

SEQ ID NO: 1423244 - RNA, 23 nt, Human
ccacaaaauaaccaauccuggac

SEQ ID NO: 1423245 - RNA, 22 nt, Human
ccacaaaaacagguauauacuu

SEQ ID NO: 1423246 - RNA, 23 nt, Human
ccaauuuuuuaagugaaaauaua

SEQ ID NO: 1423247 - RNA, 22 nt, Human
ccaauuucggauuuuuuccaaa

SEQ ID NO: 1423248 - RNA, 23 nt, Human
ccaauuucggauuuuuuccaaaa

SEQ ID NO: 1423249 - RNA, 21 nt, Human
ccaauuucggauuuuuuccaa

SEQ ID NO: 1423250 - RNA, 20 nt, Human
ccaauuucggauuuuuucca

SEQ ID NO: 1423251 - RNA, 16 nt, Human
ccaauuucagacuccc

SEQ ID NO: 1423252 - RNA, 19 nt, Human
ccaauuucaaguuccaagu

SEQ ID NO: 1423253 - RNA, 15 nt, Human
ccacaacuauuuuca

SEQ ID NO: 1423254 - RNA, 16 nt, Human
ccacaacaugaggcca

SEQ ID NO: 1423255 - RNA, 17 nt, Human
ccacaacaugaggccac

SEQ ID NO: 1423256 - RNA, 12 nt, Human
ccacaacaugag

SEQ ID NO: 1423257 - RNA, 22 nt, Human
ccacaaaugggaaaaccagacu

SEQ ID NO: 1423258 - RNA, 22 nt, Human
ccaagugaccuauaccuguguu

SEQ ID NO: 1423259 - RNA, 20 nt, Human
ccaagugagucucucugggc

SEQ ID NO: 1423260 - RNA, 22 nt, Human
ccaagguuuaaagagucuagau

SEQ ID NO: 1423261 - RNA, 16 nt, Human
ccaaguuaaauguaga

SEQ ID NO: 1423262 - RNA, 23 nt, Human
ccaagguuuaaagagucuagauu

SEQ ID NO: 1423263 - RNA, 20 nt, Human
ccaagguuuaaagagucuag

SEQ ID NO: 1423264 - RNA, 19 nt, Human
ccaagguuuaaagagucua

SEQ ID NO: 1423265 - RNA, 16 nt, Human
ccaagguucuccaaca

SEQ ID NO: 1423266 - RNA, 22 nt, Human
ccaagguguccuacagaaaaac

SEQ ID NO: 1423267 - RNA, 21 nt, Human
ccaagguguccuacagaaaaa

SEQ ID NO: 1423268 - RNA, 20 nt, Human
ccaagguguccuacagaaaa

SEQ ID NO: 1423269 - RNA, 19 nt, Human
ccaagguguccuacagaaa

SEQ ID NO: 1423270 - RNA, 18 nt, Human
ccaagguguccuacagaa

SEQ ID NO: 1423271 - RNA, 17 nt, Human
ccaagguguccuacaga

SEQ ID NO: 1423272 - RNA, 16 nt, Human
ccaagguguccuacag

SEQ ID NO: 1423273 - RNA, 15 nt, Human
ccaagguguccuaca

SEQ ID NO: 1423274 - RNA, 13 nt, Human
ccaagguguccua

SEQ ID NO: 1423275 - RNA, 20 nt, Human
ccacacaaggauagaugcug

SEQ ID NO: 1423276 - RNA, 22 nt, Human
ccacacaaggauagaugcuggc

SEQ ID NO: 1423277 - RNA, 20 nt, Human
ccacaagugcccuccaggcu

SEQ ID NO: 1423278 - RNA, 16 nt, Human
ccacaagugcccucca

SEQ ID NO: 1423279 - RNA, 21 nt, Human
ccacaaggacuuccuguccag

SEQ ID NO: 1423280 - RNA, 17 nt, Human
ccacaaggacuuccugu

SEQ ID NO: 1423281 - RNA, 20 nt, Human
ccacaagccugagggaaagg

SEQ ID NO: 1423282 - RNA, 21 nt, Human
ccacaagccugagggaaaggc

SEQ ID NO: 1423283 - RNA, 14 nt, Human
ccacaagccugagg

SEQ ID NO: 1423284 - RNA, 21 nt, Human
ccacaagccucugcccaggca

SEQ ID NO: 1423285 - RNA, 12 nt, Human
ccacaagccucu

SEQ ID NO: 1423286 - RNA, 17 nt, Human
ccacaacuauuuucaga

SEQ ID NO: 1423287 - RNA, 19 nt, Human
cauuugacccuugcuguga

SEQ ID NO: 1423288 - RNA, 13 nt, Human
cauuugaaugcau

SEQ ID NO: 1423289 - RNA, 14 nt, Human
cauuugaaugcauu

SEQ ID NO: 1423290 - RNA, 15 nt, Human
cauuugaaugcauuu

SEQ ID NO: 1423291 - RNA, 18 nt, Human
cauuugaaugcauuuugu

SEQ ID NO: 1423292 - RNA, 23 nt, Human
cauuugaaugcauuuuguuuggu

SEQ ID NO: 1423293 - RNA, 17 nt, Human
cauuugaggucuguucu

SEQ ID NO: 1423294 - RNA, 18 nt, Human
cauuugaggucuguucuu

SEQ ID NO: 1423295 - RNA, 19 nt, Human
cauuugaggucuguucuuu

SEQ ID NO: 1423296 - RNA, 15 nt, Human
ccaaagagugauagu

SEQ ID NO: 1423297 - RNA, 16 nt, Human
ccaaagaggcugcccc

SEQ ID NO: 1423298 - RNA, 14 nt, Human
ccaaagaggcugcc

SEQ ID NO: 1423299 - RNA, 13 nt, Human
ccaaagaggcugc

SEQ ID NO: 1423300 - RNA, 12 nt, Human
ccaaagaggcug

SEQ ID NO: 1423301 - RNA, 15 nt, Human
ccaaagaaccaaaga

SEQ ID NO: 1423302 - RNA, 19 nt, Human
ccaaagaaccaaagaagaa

SEQ ID NO: 1423303 - RNA, 14 nt, Human
ccaaagaacagccu

SEQ ID NO: 1423304 - RNA, 22 nt, Human
ccaaacgcccuuuccuccucag

SEQ ID NO: 1423305 - RNA, 14 nt, Human
ccaaacuaauuuuu

SEQ ID NO: 1423306 - RNA, 21 nt, Human
ccaaacgcccuuuccuccuca

SEQ ID NO: 1423307 - RNA, 14 nt, Human
ccaaacugccuaag

SEQ ID NO: 1423308 - RNA, 19 nt, Human
ccaaacugccuaagcccuc

SEQ ID NO: 1423309 - RNA, 16 nt, Human
ccaaaccucaccaacu

SEQ ID NO: 1423310 - RNA, 15 nt, Human
ccaaaccucaccaac

SEQ ID NO: 1423311 - RNA, 13 nt, Human
ccaaaccucacca

SEQ ID NO: 1423312 - RNA, 23 nt, Human
ccaaaauaaauaaggaaaagcuu

SEQ ID NO: 1423313 - RNA, 20 nt, Human
ccaaaaguuacauguuugca

SEQ ID NO: 1423314 - RNA, 18 nt, Human
ccaaaauaaaacuuuuua

SEQ ID NO: 1423315 - RNA, 21 nt, Human
ccaaaauaaaacuuuuuaaaa

SEQ ID NO: 1423316 - RNA, 14 nt, Human
cauuuugguacuuu

SEQ ID NO: 1423317 - RNA, 16 nt, Human
cauuuugguacuuugg

SEQ ID NO: 1423318 - RNA, 19 nt, Human
cauuuuguuugguauugua

SEQ ID NO: 1423319 - RNA, 20 nt, Human
cauuuuguuugguauuguau

SEQ ID NO: 1423320 - RNA, 21 nt, Human
cauuuuguuugguauuguauu

SEQ ID NO: 1423321 - RNA, 22 nt, Human
cauuuuguuugguauuguauuu

SEQ ID NO: 1423322 - RNA, 23 nt, Human
cauuuuguuugguauuguauuua

SEQ ID NO: 1423323 - RNA, 15 nt, Human
cauuuuuaagugcug

SEQ ID NO: 1423324 - RNA, 20 nt, Human
cauuuuuaagugcugcauuu

SEQ ID NO: 1423325 - RNA, 21 nt, Human
cauuuuuaagugcugcauuua

SEQ ID NO: 1423326 - RNA, 22 nt, Human
cauuuuggagaguuuccugaaa

SEQ ID NO: 1423327 - RNA, 20 nt, Human
cauuuuggagaguuuccuga

SEQ ID NO: 1423328 - RNA, 15 nt, Human
cauuuugaaucacau

SEQ ID NO: 1423329 - RNA, 23 nt, Human
cauuuugaaucacaugaauuauu

SEQ ID NO: 1423330 - RNA, 21 nt, Human
cauuuugaaagucuguccuug

SEQ ID NO: 1423331 - RNA, 19 nt, Human
cauuuugaaagucuguccu

SEQ ID NO: 1423332 - RNA, 12 nt, Human
cauuuugaaagu

SEQ ID NO: 1423333 - RNA, 22 nt, Human
cauuuucuggccaguguuuaaa

SEQ ID NO: 1423334 - RNA, 23 nt, Human
cauuuucuggccaguguuuaaaa

SEQ ID NO: 1423335 - RNA, 10 nt, Human
cauuuucugg

SEQ ID NO: 1423336 - RNA, 22 nt, Human
cauuuuauuuuauuaugcauga

SEQ ID NO: 1423337 - RNA, 21 nt, Human
cauuuuauuuuauuaugcaug

SEQ ID NO: 1423338 - RNA, 19 nt, Human
cauuuuauuuuauuaugca

SEQ ID NO: 1423339 - RNA, 17 nt, Human
cauuuuaauuauuauuc

SEQ ID NO: 1423340 - RNA, 16 nt, Human
cauuuuaacaucugag

SEQ ID NO: 1423341 - RNA, 17 nt, Human
cauuuuaaaguuaguau

SEQ ID NO: 1423342 - RNA, 18 nt, Human
cauuugcucauggaauug

SEQ ID NO: 1423343 - RNA, 22 nt, Human
cauuugaggucuguucuuucca

SEQ ID NO: 1423344 - RNA, 16 nt, Human
cauuugcucauggaau

SEQ ID NO: 1423345 - RNA, 15 nt, Human
cauuugcucauggaa

SEQ ID NO: 1423346 - RNA, 16 nt, Human
cauugacuuuccccac

SEQ ID NO: 1423347 - RNA, 21 nt, Human
cauugacuuuccccaccagau

SEQ ID NO: 1423348 - RNA, 16 nt, Human
cauugcaucaaagcau

SEQ ID NO: 1423349 - RNA, 18 nt, Human
cauuucccaacacaaaga

SEQ ID NO: 1423350 - RNA, 17 nt, Human
cauuuaaauacagucuu

SEQ ID NO: 1423351 - RNA, 23 nt, Human
cauuucuucuacaacucauacac

SEQ ID NO: 1423352 - RNA, 18 nt, Human
cauuucugaggugcacug

SEQ ID NO: 1423353 - RNA, 21 nt, Human
cauuucugaggugcacuggga

SEQ ID NO: 1423354 - RNA, 13 nt, Human
cauuucugaggug

SEQ ID NO: 1423355 - RNA, 15 nt, Human
cauuucucuaagaga

SEQ ID NO: 1423356 - RNA, 12 nt, Human
cauuucucaucc

SEQ ID NO: 1423357 - RNA, 19 nt, Human
cauuucuauuucuccucca

SEQ ID NO: 1423358 - RNA, 15 nt, Human
cauuuccccuccuuc

SEQ ID NO: 1423359 - RNA, 15 nt, Human
cauuuccuaaauaua

SEQ ID NO: 1423360 - RNA, 22 nt, Human
cauugaccgcgacuaauuucaa

SEQ ID NO: 1423361 - RNA, 21 nt, Human
cauugaccgcgacuaauuuca

SEQ ID NO: 1423362 - RNA, 18 nt, Human
cauugaacacaaacugua

SEQ ID NO: 1423363 - RNA, 17 nt, Human
cauugaacacaaacugu

SEQ ID NO: 1423364 - RNA, 16 nt, Human
cauugaacacaaacug

SEQ ID NO: 1423365 - RNA, 15 nt, Human
cauugaacacaaacu

SEQ ID NO: 1423366 - RNA, 14 nt, Human
cauugaacacaaac

SEQ ID NO: 1423367 - RNA, 15 nt, Human
cauugaccuauuucc

SEQ ID NO: 1423368 - RNA, 21 nt, Human
cauugaccuauuuccagaaau

SEQ ID NO: 1423369 - RNA, 16 nt, Human
cauugaaaagagcuga

SEQ ID NO: 1423370 - RNA, 22 nt, Human
caugcaucuguuuauucuauag

SEQ ID NO: 1423371 - RNA, 15 nt, Human
caugcaucuguuuau

SEQ ID NO: 1423372 - RNA, 13 nt, Human
caugcaucuguuu

SEQ ID NO: 1423373 - RNA, 14 nt, Human
caugcaucaucuca

SEQ ID NO: 1423374 - RNA, 15 nt, Human
caugcauacacucuc

SEQ ID NO: 1423375 - RNA, 19 nt, Human
caugccauuuguacugacc

SEQ ID NO: 1423376 - RNA, 18 nt, Human
caugccauuuguacugac

SEQ ID NO: 1423377 - RNA, 17 nt, Human
caugccauuuguacuga

SEQ ID NO: 1423378 - RNA, 17 nt, Human
caugccaguaacaggcu

SEQ ID NO: 1423379 - RNA, 19 nt, Human
caugccaguaacaggcuca

SEQ ID NO: 1423380 - RNA, 18 nt, Human
caugccaggcuaauuuuu

SEQ ID NO: 1423381 - RNA, 16 nt, Human
caugccaggcuaauuu

SEQ ID NO: 1423382 - RNA, 18 nt, Human
caugcccagagacccagc

SEQ ID NO: 1423383 - RNA, 18 nt, Human
caugccccaucccaugcu

SEQ ID NO: 1423384 - RNA, 19 nt, Human
caugcccagagacccagcg

SEQ ID NO: 1423385 - RNA, 17 nt, Human
caugcccagagacccag

SEQ ID NO: 1423386 - RNA, 16 nt, Human
caugcccagagaccca

SEQ ID NO: 1423387 - RNA, 14 nt, Human
caugcccagagacc

SEQ ID NO: 1423388 - RNA, 13 nt, Human
caugccccugaac

SEQ ID NO: 1423389 - RNA, 21 nt, Human
caugccagcuacuuccuccuc

SEQ ID NO: 1423390 - RNA, 21 nt, Human
caugccacaaggacuuccugu

SEQ ID NO: 1423391 - RNA, 17 nt, Human
caugccacaaggacuuc

SEQ ID NO: 1423392 - RNA, 20 nt, Human
caugcauuacugcaugcacu

SEQ ID NO: 1423393 - RNA, 17 nt, Human
caugcauuacugcaugc

SEQ ID NO: 1423394 - RNA, 15 nt, Human
caugcauuacugcau

SEQ ID NO: 1423395 - RNA, 21 nt, Human
caugcauguccuguaaagguu

SEQ ID NO: 1423396 - RNA, 18 nt, Human
caugcauguccuguaaag

SEQ ID NO: 1423397 - RNA, 17 nt, Human
caugcauguccuguaaa

SEQ ID NO: 1423398 - RNA, 15 nt, Human
caugcauggaaauuc

SEQ ID NO: 1423399 - RNA, 16 nt, Human
caugcauguccuguaa

SEQ ID NO: 1423400 - RNA, 17 nt, Human
caugcauggaaauuccc

SEQ ID NO: 1423401 - RNA, 14 nt, Human
caugccccuggcug

SEQ ID NO: 1423402 - RNA, 21 nt, Human
caugccucugaggccagccug

SEQ ID NO: 1423403 - RNA, 20 nt, Human
caugccucugaggccagccu

SEQ ID NO: 1423404 - RNA, 19 nt, Human
caugccucugaggccagcc

SEQ ID NO: 1423405 - RNA, 18 nt, Human
caugccucugaggccagc

SEQ ID NO: 1423406 - RNA, 17 nt, Human
caugccucugaggccag

SEQ ID NO: 1423407 - RNA, 16 nt, Human
caugccucugaggcca

SEQ ID NO: 1423408 - RNA, 15 nt, Human
caugccucugaggcc

SEQ ID NO: 1423409 - RNA, 14 nt, Human
caugccucugaggc

SEQ ID NO: 1423410 - RNA, 13 nt, Human
caugccucugagg

SEQ ID NO: 1423411 - RNA, 22 nt, Human
caugccucugaggccagccugg

SEQ ID NO: 1423412 - RNA, 23 nt, Human
caugccucugaggccagccuggc

SEQ ID NO: 1423413 - RNA, 19 nt, Human
caugcccugugcaaccucu

SEQ ID NO: 1423414 - RNA, 18 nt, Human
caugcccugugcaaccuc

SEQ ID NO: 1423415 - RNA, 14 nt, Human
caugcccugugcaa

SEQ ID NO: 1423416 - RNA, 21 nt, Human
caugcccggcuaauuuuugua

SEQ ID NO: 1423417 - RNA, 16 nt, Human
caugccccuggcuggg

SEQ ID NO: 1423418 - RNA, 15 nt, Human
caugccccuggcugg

SEQ ID NO: 1423419 - RNA, 18 nt, Human
caugccucagaagugcau

SEQ ID NO: 1423420 - RNA, 16 nt, Human
caugccucagaagugc

SEQ ID NO: 1423421 - RNA, 23 nt, Human
caugcccugugcaaccucuuggc

SEQ ID NO: 1423422 - RNA, 20 nt, Human
caugggccccaggggaacac

SEQ ID NO: 1423423 - RNA, 20 nt, Human
caugggcccaggccucacca

SEQ ID NO: 1423424 - RNA, 20 nt, Human
cauggggagggauucugguu

SEQ ID NO: 1423425 - RNA, 11 nt, Human
cauggggaggg

SEQ ID NO: 1423426 - RNA, 13 nt, Human
caugggggagggg

SEQ ID NO: 1423427 - RNA, 23 nt, Human
cauggggagggauucugguucca

SEQ ID NO: 1423428 - RNA, 15 nt, Human
cauggucccacaucc

SEQ ID NO: 1423429 - RNA, 19 nt, Human
cauggucagcccuagggug

SEQ ID NO: 1423430 - RNA, 16 nt, Human
cauggucagcccuagg

SEQ ID NO: 1423431 - RNA, 21 nt, Human
cauggucacacacugaugcuu

SEQ ID NO: 1423432 - RNA, 17 nt, Human
cauggucacacacugau

SEQ ID NO: 1423433 - RNA, 21 nt, Human
caugggggagggggcagaagu

SEQ ID NO: 1423434 - RNA, 19 nt, Human
caugggggagggggcagaa

SEQ ID NO: 1423435 - RNA, 17 nt, Human
caugggggagggggcag

SEQ ID NO: 1423436 - RNA, 17 nt, Human
cauggucggaaaacaug

SEQ ID NO: 1423437 - RNA, 22 nt, Human
cauggagaaagcugacuuggcu

SEQ ID NO: 1423438 - RNA, 23 nt, Human
cauggagaaagcugacuuggcug

SEQ ID NO: 1423439 - RNA, 18 nt, Human
cauggagauugaccugga

SEQ ID NO: 1423440 - RNA, 21 nt, Human
cauggagaaagcugacuuggc

SEQ ID NO: 1423441 - RNA, 20 nt, Human
cauggagaaagcugacuugg

SEQ ID NO: 1423442 - RNA, 19 nt, Human
cauggagaaagcugacuug

SEQ ID NO: 1423443 - RNA, 18 nt, Human
cauggagaaagcugacuu

SEQ ID NO: 1423444 - RNA, 17 nt, Human
cauggagaaagcugacu

SEQ ID NO: 1423445 - RNA, 15 nt, Human
cauggagaaagcuga

SEQ ID NO: 1423446 - RNA, 14 nt, Human
cauggagaaagcug

SEQ ID NO: 1423447 - RNA, 13 nt, Human
cauggagaaagcu

SEQ ID NO: 1423448 - RNA, 22 nt, Human
cauggcacagagauucugaacu

SEQ ID NO: 1423449 - RNA, 13 nt, Human
cauggauuucuuu

SEQ ID NO: 1423450 - RNA, 12 nt, Human
cauggauuucuu

SEQ ID NO: 1423451 - RNA, 19 nt, Human
cauggaugggggaacucag

SEQ ID NO: 1423452 - RNA, 13 nt, Human
cauggcagaaggc

SEQ ID NO: 1423453 - RNA, 18 nt, Human
cauggauauaguuuuacu

SEQ ID NO: 1423454 - RNA, 22 nt, Human
cauggaguggcagcccagccag

SEQ ID NO: 1423455 - RNA, 23 nt, Human
cauggaguggcagcccagccagc

SEQ ID NO: 1423456 - RNA, 21 nt, Human
cauggaguggcagcccagcca

SEQ ID NO: 1423457 - RNA, 20 nt, Human
cauggaguggcagcccagcc

SEQ ID NO: 1423458 - RNA, 19 nt, Human
cauggaguggcagcccagc

SEQ ID NO: 1423459 - RNA, 17 nt, Human
cauggaguggcagccca

SEQ ID NO: 1423460 - RNA, 15 nt, Human
cauggaguggcagcc

SEQ ID NO: 1423461 - RNA, 14 nt, Human
cauggaguggcagc

SEQ ID NO: 1423462 - RNA, 13 nt, Human
cauggaguggcag

SEQ ID NO: 1423463 - RNA, 18 nt, Human
cauggagguucuaaggcc

SEQ ID NO: 1423464 - RNA, 17 nt, Human
cauggagguucuaaggc

SEQ ID NO: 1423465 - RNA, 17 nt, Human
cauggagauucucauaa

SEQ ID NO: 1423466 - RNA, 14 nt, Human
caugcgcucagggc

SEQ ID NO: 1423467 - RNA, 23 nt, Human
caugcgcccccuccgcccugcca

SEQ ID NO: 1423468 - RNA, 21 nt, Human
caugcgcccccuccgcccugc

SEQ ID NO: 1423469 - RNA, 21 nt, Human
caugcuaagagaaguagaaau

SEQ ID NO: 1423470 - RNA, 17 nt, Human
caugcuaagagaaguag

SEQ ID NO: 1423471 - RNA, 16 nt, Human
caugcuaagagaagua

SEQ ID NO: 1423472 - RNA, 13 nt, Human
caugcuaagagaa

SEQ ID NO: 1423473 - RNA, 17 nt, Human
caugcguguuucugacu

SEQ ID NO: 1423474 - RNA, 16 nt, Human
caugcguguuucugac

SEQ ID NO: 1423475 - RNA, 21 nt, Human
caugcgguagccagcacacag

SEQ ID NO: 1423476 - RNA, 19 nt, Human
caugcgguagccagcacac

SEQ ID NO: 1423477 - RNA, 17 nt, Human
caugcgguagccagcac

SEQ ID NO: 1423478 - RNA, 16 nt, Human
caugcgguagccagca

SEQ ID NO: 1423479 - RNA, 15 nt, Human
caugcgguagccagc

SEQ ID NO: 1423480 - RNA, 14 nt, Human
caugcgguagccag

SEQ ID NO: 1423481 - RNA, 13 nt, Human
caugcgguagcca

SEQ ID NO: 1423482 - RNA, 15 nt, Human
caugcgcucagggcc

SEQ ID NO: 1423483 - RNA, 22 nt, Human
caugcgcucagggccaugcuga

SEQ ID NO: 1423484 - RNA, 19 nt, Human
caugcuaagagaaguagaa

SEQ ID NO: 1423485 - RNA, 23 nt, Human
caugcugucuacacuaagagaga

SEQ ID NO: 1423486 - RNA, 15 nt, Human
cauggaacacuucga

SEQ ID NO: 1423487 - RNA, 20 nt, Human
caugcuucccuuuccugagu

SEQ ID NO: 1423488 - RNA, 23 nt, Human
caugcuuagcaguccccuucccu

SEQ ID NO: 1423489 - RNA, 17 nt, Human
caugcuuagcagucccc

SEQ ID NO: 1423490 - RNA, 16 nt, Human
caugcuucacaauguu

SEQ ID NO: 1423491 - RNA, 19 nt, Human
caugcuuauuccaugacug

SEQ ID NO: 1423492 - RNA, 17 nt, Human
caugcuuauuccaugac

SEQ ID NO: 1423493 - RNA, 16 nt, Human
caugcuuauuccauga

SEQ ID NO: 1423494 - RNA, 21 nt, Human
caugcuuauuccaugacugcu

SEQ ID NO: 1423495 - RNA, 15 nt, Human
caugcuucccuuucc

SEQ ID NO: 1423496 - RNA, 18 nt, Human
cauggacaggcuggcucc

SEQ ID NO: 1423497 - RNA, 16 nt, Human
cauggacaggcuggcu

SEQ ID NO: 1423498 - RNA, 15 nt, Human
cauggacaggcuggc

SEQ ID NO: 1423499 - RNA, 14 nt, Human
cauggacaggcugg

SEQ ID NO: 1423500 - RNA, 21 nt, Human
cauggacacuacacccagcaa

SEQ ID NO: 1423501 - RNA, 22 nt, Human
cauggacacuacacccagcaau

SEQ ID NO: 1423502 - RNA, 23 nt, Human
cauggacacuacacccagcaaua

SEQ ID NO: 1423503 - RNA, 18 nt, Human
caugugugcaacagggua

SEQ ID NO: 1423504 - RNA, 23 nt, Human
caugugguggcacaggcccccuu

SEQ ID NO: 1423505 - RNA, 22 nt, Human
caugugguggcacaggcccccu

SEQ ID NO: 1423506 - RNA, 18 nt, Human
cauguggggccaggucac

SEQ ID NO: 1423507 - RNA, 23 nt, Human
cauguggggccaggucacccuuu

SEQ ID NO: 1423508 - RNA, 17 nt, Human
cauguggggccagguca

SEQ ID NO: 1423509 - RNA, 15 nt, Human
cauguggggccaggu

SEQ ID NO: 1423510 - RNA, 14 nt, Human
cauguggggccagg

SEQ ID NO: 1423511 - RNA, 15 nt, Human
cauguggcuggaaga

SEQ ID NO: 1423512 - RNA, 13 nt, Human
cauguggcuggaa

SEQ ID NO: 1423513 - RNA, 12 nt, Human
cauguggcugga

SEQ ID NO: 1423514 - RNA, 24 nt, Human
caugugcugcccuacagcacccug

SEQ ID NO: 1423515 - RNA, 24 nt, Human
caugugccagggcaaugaugaaug

SEQ ID NO: 1423516 - RNA, 22 nt, Human
caugugccagggcaaugaugaa

SEQ ID NO: 1423517 - RNA, 18 nt, Human
caugugaccacucugucu

SEQ ID NO: 1423518 - RNA, 12 nt, Human
caugugacauuu

SEQ ID NO: 1423519 - RNA, 16 nt, Human
caugugaccacucugu

SEQ ID NO: 1423520 - RNA, 16 nt, Human
caugugacauuuauau

SEQ ID NO: 1423521 - RNA, 14 nt, Human
caugugacauuuau

SEQ ID NO: 1423522 - RNA, 13 nt, Human
caugugacauuua

SEQ ID NO: 1423523 - RNA, 21 nt, Human
cauguuuucugaaaauauaac

SEQ ID NO: 1423524 - RNA, 22 nt, Human
cauguuucuuuguaaugaaaac

SEQ ID NO: 1423525 - RNA, 22 nt, Human
cauguguguccacgacugucuc

SEQ ID NO: 1423526 - RNA, 21 nt, Human
cauguguguccacgacugucu

SEQ ID NO: 1423527 - RNA, 12 nt, Human
caugugugucca

SEQ ID NO: 1423528 - RNA, 13 nt, Human
cauguguggaagu

SEQ ID NO: 1423529 - RNA, 21 nt, Human
caugugugguacaugguguuu

SEQ ID NO: 1423530 - RNA, 19 nt, Human
cauguuuagacuuuaacau

SEQ ID NO: 1423531 - RNA, 12 nt, Human
cauguguggaag

SEQ ID NO: 1423532 - RNA, 23 nt, Human
cauguguguccacgacugucucc

SEQ ID NO: 1423533 - RNA, 15 nt, Human
cauguuuaucugcuu

SEQ ID NO: 1423534 - RNA, 21 nt, Human
cauguuucuuuguaaugaaaa

SEQ ID NO: 1423535 - RNA, 14 nt, Human
cauguaauccucaa

SEQ ID NO: 1423536 - RNA, 21 nt, Human
cauguaacugccuagaaacaa

SEQ ID NO: 1423537 - RNA, 20 nt, Human
cauguaacugccuagaaaca

SEQ ID NO: 1423538 - RNA, 19 nt, Human
cauguaacugccuagaaac

SEQ ID NO: 1423539 - RNA, 16 nt, Human
cauguaacugccuaga

SEQ ID NO: 1423540 - RNA, 15 nt, Human
cauguaacugccuag

SEQ ID NO: 1423541 - RNA, 14 nt, Human
cauguaacugccua

SEQ ID NO: 1423542 - RNA, 20 nt, Human
cauguaacgcaaguucccag

SEQ ID NO: 1423543 - RNA, 19 nt, Human
cauguaacgcaaguuccca

SEQ ID NO: 1423544 - RNA, 19 nt, Human
caugguuaccaugucuuuc

SEQ ID NO: 1423545 - RNA, 18 nt, Human
caugguuaccaugucuuu

SEQ ID NO: 1423546 - RNA, 17 nt, Human
caugguuaccaugucuu

SEQ ID NO: 1423547 - RNA, 19 nt, Human
caugguuaagaguccaaga

SEQ ID NO: 1423548 - RNA, 16 nt, Human
caugguuaagagucca

SEQ ID NO: 1423549 - RNA, 13 nt, Human
caugguuaagagu

SEQ ID NO: 1423550 - RNA, 19 nt, Human
caugguguucuccugcugc

SEQ ID NO: 1423551 - RNA, 17 nt, Human
caugguguucuccugcu

SEQ ID NO: 1423552 - RNA, 16 nt, Human
caugguguucuccugc

SEQ ID NO: 1423553 - RNA, 15 nt, Human
caugguguucuccug

SEQ ID NO: 1423554 - RNA, 14 nt, Human
caugguguucuccu

SEQ ID NO: 1423555 - RNA, 18 nt, Human
cauggugugaucgucuga

SEQ ID NO: 1423556 - RNA, 16 nt, Human
caugguguccagacag

SEQ ID NO: 1423557 - RNA, 22 nt, Human
cauggugccccaggaccagcuc

SEQ ID NO: 1423558 - RNA, 20 nt, Human
cauggugccccaggaccagc

SEQ ID NO: 1423559 - RNA, 19 nt, Human
cauggugccccaggaccag

SEQ ID NO: 1423560 - RNA, 18 nt, Human
cauggugccccaggacca

SEQ ID NO: 1423561 - RNA, 17 nt, Human
cauggugccccaggacc

SEQ ID NO: 1423562 - RNA, 16 nt, Human
cauggugccccaggac

SEQ ID NO: 1423563 - RNA, 22 nt, Human
cauggucccacaucccugggcc

SEQ ID NO: 1423564 - RNA, 21 nt, Human
cauggucccacaucccugggc

SEQ ID NO: 1423565 - RNA, 20 nt, Human
cauggucccacaucccuggg

SEQ ID NO: 1423566 - RNA, 15 nt, Human
cauggugccccagga

SEQ ID NO: 1423567 - RNA, 23 nt, Human
cauggucccacaucccugggccu

SEQ ID NO: 1423568 - RNA, 19 nt, Human
cauggucccacaucccugg

SEQ ID NO: 1423569 - RNA, 18 nt, Human
cauggucccacaucccug

SEQ ID NO: 1423570 - RNA, 17 nt, Human
cauggucccacaucccu

SEQ ID NO: 1423571 - RNA, 16 nt, Human
cauggucccacauccc

SEQ ID NO: 1423572 - RNA, 16 nt, Human
cauggucggaaaacau

SEQ ID NO: 1423573 - RNA, 17 nt, Human
cauguccuucugagccc

SEQ ID NO: 1423574 - RNA, 15 nt, Human
cauguacaugaagaa

SEQ ID NO: 1423575 - RNA, 15 nt, Human
caugugaaaucauuc

SEQ ID NO: 1423576 - RNA, 16 nt, Human
caugugaaaucauuca

SEQ ID NO: 1423577 - RNA, 17 nt, Human
caugugaaaucauucau

SEQ ID NO: 1423578 - RNA, 13 nt, Human
cauuaaauucaca

SEQ ID NO: 1423579 - RNA, 20 nt, Human
cauuaaauuacagaaauuua

SEQ ID NO: 1423580 - RNA, 11 nt, Human
cauuaaauaaa

SEQ ID NO: 1423581 - RNA, 13 nt, Human
cauuaaauaaauu

SEQ ID NO: 1423582 - RNA, 14 nt, Human
cauuaaagaagacc

SEQ ID NO: 1423583 - RNA, 15 nt, Human
cauuaaagaagaccu

SEQ ID NO: 1423584 - RNA, 11 nt, Human
cauuaaagaag

SEQ ID NO: 1423585 - RNA, 22 nt, Human
cauuaaacgauuuuuaaaaugu

SEQ ID NO: 1423586 - RNA, 18 nt, Human
cauuaaucugccucccuc

SEQ ID NO: 1423587 - RNA, 20 nt, Human
cauuaaucaguucauuagaa

SEQ ID NO: 1423588 - RNA, 18 nt, Human
cauuaauagcagccuuuc

SEQ ID NO: 1423589 - RNA, 20 nt, Human
cauuaauagcagccuuucuc

SEQ ID NO: 1423590 - RNA, 17 nt, Human
cauuaauagcagccuuu

SEQ ID NO: 1423591 - RNA, 15 nt, Human
cauuaauagcagccu

SEQ ID NO: 1423592 - RNA, 14 nt, Human
cauuaaauuacaga

SEQ ID NO: 1423593 - RNA, 21 nt, Human
cauuaaauucacaaacuuuua

SEQ ID NO: 1423594 - RNA, 18 nt, Human
cauuaaauucacaaacuu

SEQ ID NO: 1423595 - RNA, 17 nt, Human
cauuaaauucacaaacu

SEQ ID NO: 1423596 - RNA, 14 nt, Human
cauuaaauucacaa

SEQ ID NO: 1423597 - RNA, 12 nt, Human
cauuaaucugcc

SEQ ID NO: 1423598 - RNA, 15 nt, Human
cauuaccauguaaug

SEQ ID NO: 1423599 - RNA, 12 nt, Human
cauuaauucuau

SEQ ID NO: 1423600 - RNA, 20 nt, Human
cauuagacuggaacuugaac

SEQ ID NO: 1423601 - RNA, 16 nt, Human
cauuagacuggaacuu

SEQ ID NO: 1423602 - RNA, 15 nt, Human
cauuacuauaagaac

SEQ ID NO: 1423603 - RNA, 18 nt, Human
cauuagaccaagcuuguc

SEQ ID NO: 1423604 - RNA, 16 nt, Human
cauuauuuauguauug

SEQ ID NO: 1423605 - RNA, 15 nt, Human
cauuauuuauguauu

SEQ ID NO: 1423606 - RNA, 22 nt, Human
cauuauuuauguauugugcaau

SEQ ID NO: 1423607 - RNA, 21 nt, Human
cauccaaggccagguucuccg

SEQ ID NO: 1423608 - RNA, 21 nt, Human
cauccaaagcagacagcucca

SEQ ID NO: 1423609 - RNA, 18 nt, Human
cauccaaagcagacagcu

SEQ ID NO: 1423610 - RNA, 17 nt, Human
cauccaaagcagacagc

SEQ ID NO: 1423611 - RNA, 16 nt, Human
cauccaaagcagacag

SEQ ID NO: 1423612 - RNA, 15 nt, Human
cauccaaagcagaca

SEQ ID NO: 1423613 - RNA, 23 nt, Human
cauccaaaaucuugaucaguuaa

SEQ ID NO: 1423614 - RNA, 17 nt, Human
cauccaaaaucuugauc

SEQ ID NO: 1423615 - RNA, 23 nt, Human
cauccaaaauaguuaagacauga

SEQ ID NO: 1423616 - RNA, 14 nt, Human
caucauuuuuuacu

SEQ ID NO: 1423617 - RNA, 20 nt, Human
caucauuucuuuuugggaga

SEQ ID NO: 1423618 - RNA, 15 nt, Human
caucauuucacuugu

SEQ ID NO: 1423619 - RNA, 12 nt, Human
caucauuucacu

SEQ ID NO: 1423620 - RNA, 24 nt, Human
caucauucucugucucauccauca

SEQ ID NO: 1423621 - RNA, 22 nt, Human
caucauucucugucucauccau

SEQ ID NO: 1423622 - RNA, 21 nt, Human
caucauucucugucucaucca

SEQ ID NO: 1423623 - RNA, 16 nt, Human
caucacagcccagccc

SEQ ID NO: 1423624 - RNA, 14 nt, Human
caucccuccccagu

SEQ ID NO: 1423625 - RNA, 13 nt, Human
caucccucaccca

SEQ ID NO: 1423626 - RNA, 14 nt, Human
caucccucacccau

SEQ ID NO: 1423627 - RNA, 13 nt, Human
caucccuccccag

SEQ ID NO: 1423628 - RNA, 20 nt, Human
caucccucacccauccuaga

SEQ ID NO: 1423629 - RNA, 14 nt, Human
cauccaccccaucc

SEQ ID NO: 1423630 - RNA, 12 nt, Human
cauccaccccau

SEQ ID NO: 1423631 - RNA, 20 nt, Human
cauccacauacccugaccug

SEQ ID NO: 1423632 - RNA, 17 nt, Human
cauccacaugggagccg

SEQ ID NO: 1423633 - RNA, 14 nt, Human
cauccacacaugaa

SEQ ID NO: 1423634 - RNA, 14 nt, Human
cauccaaguuaaau

SEQ ID NO: 1423635 - RNA, 15 nt, Human
cauccagcucacuca

SEQ ID NO: 1423636 - RNA, 23 nt, Human
cauccagcagauuuccagccuuc

SEQ ID NO: 1423637 - RNA, 11 nt, Human
cauccagggcc

SEQ ID NO: 1423638 - RNA, 22 nt, Human
cauccaggaggaauaagcuccc

SEQ ID NO: 1423639 - RNA, 21 nt, Human
cauccagggcccccaucucau

SEQ ID NO: 1423640 - RNA, 13 nt, Human
cauccagggggca

SEQ ID NO: 1423641 - RNA, 12 nt, Human
cauccuccagcc

SEQ ID NO: 1423642 - RNA, 17 nt, Human
cauccuccagauagugu

SEQ ID NO: 1423643 - RNA, 21 nt, Human
cauccuccacguucugcucau

SEQ ID NO: 1423644 - RNA, 20 nt, Human
cauccuccacguucugcuca

SEQ ID NO: 1423645 - RNA, 18 nt, Human
cauccuccacguucugcu

SEQ ID NO: 1423646 - RNA, 22 nt, Human
cauccucaaagaaaguguauug

SEQ ID NO: 1423647 - RNA, 15 nt, Human
cauccuccagccccu

SEQ ID NO: 1423648 - RNA, 14 nt, Human
cauccuccagcccc

SEQ ID NO: 1423649 - RNA, 13 nt, Human
cauccuccagccc

SEQ ID NO: 1423650 - RNA, 19 nt, Human
cauccuacccccugugccu

SEQ ID NO: 1423651 - RNA, 20 nt, Human
cauccucaaagaaaguguau

SEQ ID NO: 1423652 - RNA, 14 nt, Human
cauccucaaagaaa

SEQ ID NO: 1423653 - RNA, 17 nt, Human
cauccuaggcugacacc

SEQ ID NO: 1423654 - RNA, 15 nt, Human
cauccuaccgucuuu

SEQ ID NO: 1423655 - RNA, 20 nt, Human
caucucauuuaauccucccu

SEQ ID NO: 1423656 - RNA, 22 nt, Human
caucucaugccccuggcuggga

SEQ ID NO: 1423657 - RNA, 22 nt, Human
caucucagugaagaauacuucu

SEQ ID NO: 1423658 - RNA, 21 nt, Human
caucucagugaagaauacuuc

SEQ ID NO: 1423659 - RNA, 17 nt, Human
caucucaguaugaauua

SEQ ID NO: 1423660 - RNA, 18 nt, Human
caucucaggccagagcca

SEQ ID NO: 1423661 - RNA, 17 nt, Human
caucucaggccagagcc

SEQ ID NO: 1423662 - RNA, 14 nt, Human
caucucaggccaga

SEQ ID NO: 1423663 - RNA, 19 nt, Human
caucucagcucacugcaac

SEQ ID NO: 1423664 - RNA, 20 nt, Human
caucucagcucacugcaacc

SEQ ID NO: 1423665 - RNA, 21 nt, Human
caucucaacaggccucagggc

SEQ ID NO: 1423666 - RNA, 22 nt, Human
caucucaacaggccucagggcu

SEQ ID NO: 1423667 - RNA, 20 nt, Human
caucucaacaggccucaggg

SEQ ID NO: 1423668 - RNA, 19 nt, Human
caucucaacaggccucagg

SEQ ID NO: 1423669 - RNA, 15 nt, Human
caucucaacaggccu

SEQ ID NO: 1423670 - RNA, 16 nt, Human
caucuauuuuggauug

SEQ ID NO: 1423671 - RNA, 14 nt, Human
caucuauuuuggau

SEQ ID NO: 1423672 - RNA, 22 nt, Human
caucuagugagcagucaggaaa

SEQ ID NO: 1423673 - RNA, 17 nt, Human
caucuauagaaagcuau

SEQ ID NO: 1423674 - RNA, 20 nt, Human
cauccuccucccacccggcu

SEQ ID NO: 1423675 - RNA, 16 nt, Human
cauccuccucccaccc

SEQ ID NO: 1423676 - RNA, 13 nt, Human
cauccuccuccca

SEQ ID NO: 1423677 - RNA, 20 nt, Human
caucuaaguuauaagacucu

SEQ ID NO: 1423678 - RNA, 23 nt, Human
cauccucuggcuuggccacagcc

SEQ ID NO: 1423679 - RNA, 19 nt, Human
cauccucuggagccagccg

SEQ ID NO: 1423680 - RNA, 18 nt, Human
cauccucuggagccagcc

SEQ ID NO: 1423681 - RNA, 17 nt, Human
cauccucuggagccagc

SEQ ID NO: 1423682 - RNA, 11 nt, Human
cauccucucca

SEQ ID NO: 1423683 - RNA, 19 nt, Human
caucuagaggcuuccuuca

SEQ ID NO: 1423684 - RNA, 20 nt, Human
caucuaccuagauuuaauau

SEQ ID NO: 1423685 - RNA, 19 nt, Human
caucuaccuagauuuaaua

SEQ ID NO: 1423686 - RNA, 23 nt, Human
caucuagaggcuuccuucauuuc

SEQ ID NO: 1423687 - RNA, 22 nt, Human
caucuagaggcuuccuucauuu

SEQ ID NO: 1423688 - RNA, 21 nt, Human
caucuagaggcuuccuucauu

SEQ ID NO: 1423689 - RNA, 20 nt, Human
caucuagaggcuuccuucau

SEQ ID NO: 1423690 - RNA, 12 nt, Human
caucuaggauuu

SEQ ID NO: 1423691 - RNA, 14 nt, Human
caucuagugagcag

SEQ ID NO: 1423692 - RNA, 18 nt, Human
caucuagguaaauuacag

SEQ ID NO: 1423693 - RNA, 17 nt, Human
caucuagguaaauuaca

SEQ ID NO: 1423694 - RNA, 12 nt, Human
caucuugcuacc

SEQ ID NO: 1423695 - RNA, 19 nt, Human
caucuugcccgcucaggcu

SEQ ID NO: 1423696 - RNA, 20 nt, Human
caucuugcccgcucaggcug

SEQ ID NO: 1423697 - RNA, 18 nt, Human
caucuugcccgcucaggc

SEQ ID NO: 1423698 - RNA, 17 nt, Human
caucuugcauuaugcaa

SEQ ID NO: 1423699 - RNA, 16 nt, Human
caucuugcauuaugca

SEQ ID NO: 1423700 - RNA, 13 nt, Human
caucuugcauuau

SEQ ID NO: 1423701 - RNA, 13 nt, Human
caucuucugccuu

SEQ ID NO: 1423702 - RNA, 21 nt, Human
caucuucuaaacccaauccaa

SEQ ID NO: 1423703 - RNA, 11 nt, Human
caucuuggggg

SEQ ID NO: 1423704 - RNA, 16 nt, Human
caucuuggaacugcau

SEQ ID NO: 1423705 - RNA, 15 nt, Human
caucuugcuucccua

SEQ ID NO: 1423706 - RNA, 14 nt, Human
caucuugcuucccu

SEQ ID NO: 1423707 - RNA, 13 nt, Human
caucuugcuuccc

SEQ ID NO: 1423708 - RNA, 23 nt, Human
caucuugcuaccaguauuuagaa

SEQ ID NO: 1423709 - RNA, 22 nt, Human
caucuugcuaccaguauuuaga

SEQ ID NO: 1423710 - RNA, 20 nt, Human
caucuugcuaccaguauuua

SEQ ID NO: 1423711 - RNA, 18 nt, Human
caucuugcuaccaguauu

SEQ ID NO: 1423712 - RNA, 17 nt, Human
caucuugcuaccaguau

SEQ ID NO: 1423713 - RNA, 16 nt, Human
caucuugcuaccagua

SEQ ID NO: 1423714 - RNA, 14 nt, Human
caucuugcuaccag

SEQ ID NO: 1423715 - RNA, 23 nt, Human
caucucugggcuggaugagcucc

SEQ ID NO: 1423716 - RNA, 22 nt, Human
caucucccagauaaugugaaaa

SEQ ID NO: 1423717 - RNA, 18 nt, Human
caucucccagauaaugug

SEQ ID NO: 1423718 - RNA, 17 nt, Human
caucucccagauaaugu

SEQ ID NO: 1423719 - RNA, 21 nt, Human
caucucccaccuagcagcacc

SEQ ID NO: 1423720 - RNA, 13 nt, Human
caucuccaagcag

SEQ ID NO: 1423721 - RNA, 19 nt, Human
caucucauuuaauccuccc

SEQ ID NO: 1423722 - RNA, 23 nt, Human
caucuucaguugucucugaugca

SEQ ID NO: 1423723 - RNA, 22 nt, Human
caucuucaguugucucugaugc

SEQ ID NO: 1423724 - RNA, 20 nt, Human
caucuucaguugucucugau

SEQ ID NO: 1423725 - RNA, 15 nt, Human
caucuucaguugucu

SEQ ID NO: 1423726 - RNA, 14 nt, Human
caucuucaguuguc

SEQ ID NO: 1423727 - RNA, 15 nt, Human
caucugaguccugga

SEQ ID NO: 1423728 - RNA, 13 nt, Human
caucugauuaaaa

SEQ ID NO: 1423729 - RNA, 21 nt, Human
caucugaguccuggaugauac

SEQ ID NO: 1423730 - RNA, 21 nt, Human
caucugagguuuuauuucauu

SEQ ID NO: 1423731 - RNA, 15 nt, Human
caucugagguuuuau

SEQ ID NO: 1423732 - RNA, 23 nt, Human
caucugagaaaagcuuugaaccc

SEQ ID NO: 1423733 - RNA, 14 nt, Human
caucugagaaaagc

SEQ ID NO: 1423734 - RNA, 16 nt, Human
caucucuuguuuaaau

SEQ ID NO: 1423735 - RNA, 23 nt, Human
cauagaucagcaaaccggggccu

SEQ ID NO: 1423736 - RNA, 21 nt, Human
cauagauaaaacaucuuugaa

SEQ ID NO: 1423737 - RNA, 21 nt, Human
cauagagccggguguccccaa

SEQ ID NO: 1423738 - RNA, 22 nt, Human
cauagagccggguguccccaac

SEQ ID NO: 1423739 - RNA, 20 nt, Human
cauagagccgggugucccca

SEQ ID NO: 1423740 - RNA, 18 nt, Human
cauagauaaaacaucuuu

SEQ ID NO: 1423741 - RNA, 12 nt, Human
cauauaaaguau

SEQ ID NO: 1423742 - RNA, 13 nt, Human
cauaguucagaau

SEQ ID NO: 1423743 - RNA, 12 nt, Human
cauaguucagaa

SEQ ID NO: 1423744 - RNA, 17 nt, Human
cauauauauacuauuaa

SEQ ID NO: 1423745 - RNA, 17 nt, Human
cauauacagcucagaag

SEQ ID NO: 1423746 - RNA, 16 nt, Human
cauauaauuauauguu

SEQ ID NO: 1423747 - RNA, 22 nt, Human
cauauaauuauauguuguaagc

SEQ ID NO: 1423748 - RNA, 15 nt, Human
cauauaauuauaugu

SEQ ID NO: 1423749 - RNA, 18 nt, Human
cauauaauguuguuauuu

SEQ ID NO: 1423750 - RNA, 17 nt, Human
cauauaauguuguuauu

SEQ ID NO: 1423751 - RNA, 15 nt, Human
cauauaauguuguua

SEQ ID NO: 1423752 - RNA, 18 nt, Human
cauaucacacacauugcu

SEQ ID NO: 1423753 - RNA, 16 nt, Human
cauaucacacacauug

SEQ ID NO: 1423754 - RNA, 14 nt, Human
cauaucacacacau

SEQ ID NO: 1423755 - RNA, 14 nt, Human
cauauauauacuau

SEQ ID NO: 1423756 - RNA, 22 nt, Human
cauaugaguaagggcacugacg

SEQ ID NO: 1423757 - RNA, 20 nt, Human
cauaucauccacacaugaau

SEQ ID NO: 1423758 - RNA, 18 nt, Human
cauaucauccacacauga

SEQ ID NO: 1423759 - RNA, 17 nt, Human
cauaucauccacacaug

SEQ ID NO: 1423760 - RNA, 14 nt, Human
cauaucauccacac

SEQ ID NO: 1423761 - RNA, 15 nt, Human
cauaugauguacaug

SEQ ID NO: 1423762 - RNA, 17 nt, Human
cauaugauguacaugua

SEQ ID NO: 1423763 - RNA, 14 nt, Human
cauaugauuuacau

SEQ ID NO: 1423764 - RNA, 15 nt, Human
cauaugaucugucug

SEQ ID NO: 1423765 - RNA, 21 nt, Human
cauaugauguacauguacuga

SEQ ID NO: 1423766 - RNA, 17 nt, Human
cauacuguaacauucag

SEQ ID NO: 1423767 - RNA, 22 nt, Human
cauacuggccuggacuguuuuc

SEQ ID NO: 1423768 - RNA, 18 nt, Human
cauacuggccuggacugu

SEQ ID NO: 1423769 - RNA, 15 nt, Human
cauacuggccuggac

SEQ ID NO: 1423770 - RNA, 13 nt, Human
cauacuggccugg

SEQ ID NO: 1423771 - RNA, 22 nt, Human
cauacucauuuuucaugauaau

SEQ ID NO: 1423772 - RNA, 23 nt, Human
cauacuugaacguuuucuaauug

SEQ ID NO: 1423773 - RNA, 23 nt, Human
cauacuugaagggccagagccag

SEQ ID NO: 1423774 - RNA, 22 nt, Human
cauacuugaagggccagagcca

SEQ ID NO: 1423775 - RNA, 21 nt, Human
cauacuugaagggccagagcc

SEQ ID NO: 1423776 - RNA, 20 nt, Human
cauacuugaagggccagagc

SEQ ID NO: 1423777 - RNA, 18 nt, Human
cauacuugaagggccaga

SEQ ID NO: 1423778 - RNA, 17 nt, Human
cauacuugaagggccag

SEQ ID NO: 1423779 - RNA, 14 nt, Human
cauacuugaagggc

SEQ ID NO: 1423780 - RNA, 13 nt, Human
cauacuugaaggg

SEQ ID NO: 1423781 - RNA, 22 nt, Human
cauacuugaacguuuucuaauu

SEQ ID NO: 1423782 - RNA, 21 nt, Human
cauacuugaacguuuucuaau

SEQ ID NO: 1423783 - RNA, 20 nt, Human
cauacuugaacguuuucuaa

SEQ ID NO: 1423784 - RNA, 20 nt, Human
cauacuuuuuaaauguaaag

SEQ ID NO: 1423785 - RNA, 16 nt, Human
cauacuuuuuaaaugu

SEQ ID NO: 1423786 - RNA, 14 nt, Human
cauacuuuccugua

SEQ ID NO: 1423787 - RNA, 22 nt, Human
cauacuuuuuaaauguaaagau

SEQ ID NO: 1423788 - RNA, 19 nt, Human
cauagacagaagaaacaag

SEQ ID NO: 1423789 - RNA, 23 nt, Human
cauagaaauguaacuuuuguaag

SEQ ID NO: 1423790 - RNA, 14 nt, Human
cauagaauaaaauu

SEQ ID NO: 1423791 - RNA, 20 nt, Human
cauagacagaagaaacaagg

SEQ ID NO: 1423792 - RNA, 15 nt, Human
cauagacagaagaaa

SEQ ID NO: 1423793 - RNA, 20 nt, Human
cauagaauaaaauuuuuaau

SEQ ID NO: 1423794 - RNA, 17 nt, Human
cauauuuaccucagccu

SEQ ID NO: 1423795 - RNA, 12 nt, Human
cauauuuauaaa

SEQ ID NO: 1423796 - RNA, 18 nt, Human
cauauuuaccucagccug

SEQ ID NO: 1423797 - RNA, 19 nt, Human
cauauuuaccucagccugg

SEQ ID NO: 1423798 - RNA, 17 nt, Human
cauauuuauaaaaauaa

SEQ ID NO: 1423799 - RNA, 17 nt, Human
caucacagcccagcccg

SEQ ID NO: 1423800 - RNA, 14 nt, Human
caucacagcccagc

SEQ ID NO: 1423801 - RNA, 13 nt, Human
caucacagcccag

SEQ ID NO: 1423802 - RNA, 19 nt, Human
caucacacugggugguggc

SEQ ID NO: 1423803 - RNA, 14 nt, Human
caucacacugggug

SEQ ID NO: 1423804 - RNA, 12 nt, Human
caucacagaaug

SEQ ID NO: 1423805 - RNA, 16 nt, Human
caucaauuaaaggcaa

SEQ ID NO: 1423806 - RNA, 19 nt, Human
caucaauggggccagucag

SEQ ID NO: 1423807 - RNA, 22 nt, Human
caucaauggggccagucaggcc

SEQ ID NO: 1423808 - RNA, 19 nt, Human
caucaaguugugccaaauu

SEQ ID NO: 1423809 - RNA, 15 nt, Human
caucaaaaugcuuuu

SEQ ID NO: 1423810 - RNA, 13 nt, Human
caucaaaaugcuu

SEQ ID NO: 1423811 - RNA, 15 nt, Human
caucaagacuuugcu

SEQ ID NO: 1423812 - RNA, 23 nt, Human
caucaaagaggcugaggcuggca

SEQ ID NO: 1423813 - RNA, 11 nt, Human
caucaaagagg

SEQ ID NO: 1423814 - RNA, 14 nt, Human
caucaaguaauaca

SEQ ID NO: 1423815 - RNA, 21 nt, Human
caucaaggacacgggccuguc

SEQ ID NO: 1423816 - RNA, 20 nt, Human
caucaaggacacgggccugu

SEQ ID NO: 1423817 - RNA, 12 nt, Human
caucaagagaau

SEQ ID NO: 1423818 - RNA, 17 nt, Human
caucaagagacugaguc

SEQ ID NO: 1423819 - RNA, 22 nt, Human
caucaagacuuugcuaaagaca

SEQ ID NO: 1423820 - RNA, 16 nt, Human
caucaagacuuugcua

SEQ ID NO: 1423821 - RNA, 22 nt, Human
caucaagucuuucacauuuaaa

SEQ ID NO: 1423822 - RNA, 18 nt, Human
caucaaaaacuuuggagu

SEQ ID NO: 1423823 - RNA, 21 nt, Human
caucaaaaaaggcaguuacca

SEQ ID NO: 1423824 - RNA, 15 nt, Human
caucaaaaaaggcag

SEQ ID NO: 1423825 - RNA, 16 nt, Human
cauauuuaccucagcc

SEQ ID NO: 1423826 - RNA, 18 nt, Human
cauauuuucaccauuuga

SEQ ID NO: 1423827 - RNA, 12 nt, Human
cauauuuucaug

SEQ ID NO: 1423828 - RNA, 19 nt, Human
cauacccugaccuggcccc

SEQ ID NO: 1423829 - RNA, 18 nt, Human
cauacccugaccuggccc

SEQ ID NO: 1423830 - RNA, 16 nt, Human
cauacccugaccuggc

SEQ ID NO: 1423831 - RNA, 15 nt, Human
cauacccugaccugg

SEQ ID NO: 1423832 - RNA, 14 nt, Human
cauacccugaccug

SEQ ID NO: 1423833 - RNA, 20 nt, Human
cauaccccuuacaaaugaaa

SEQ ID NO: 1423834 - RNA, 18 nt, Human
cauaccccuuacaaauga

SEQ ID NO: 1423835 - RNA, 15 nt, Human
cauacccccuccccc

SEQ ID NO: 1423836 - RNA, 13 nt, Human
cauacccccuccc

SEQ ID NO: 1423837 - RNA, 21 nt, Human
cauaccuccuauggguuguca

SEQ ID NO: 1423838 - RNA, 22 nt, Human
cauacccuggccgcccccugcc

SEQ ID NO: 1423839 - RNA, 17 nt, Human
cauacgcucagcucauc

SEQ ID NO: 1423840 - RNA, 13 nt, Human
cauacguacacau

SEQ ID NO: 1423841 - RNA, 15 nt, Human
cauacguacacauuu

SEQ ID NO: 1423842 - RNA, 16 nt, Human
cauacguacacauuuu

SEQ ID NO: 1423843 - RNA, 17 nt, Human
cauacguacacauuuua

SEQ ID NO: 1423844 - RNA, 18 nt, Human
cauacguacacauuuuau

SEQ ID NO: 1423845 - RNA, 14 nt, Human
cauacuaaccagca

SEQ ID NO: 1423846 - RNA, 21 nt, Human
cauacuaaccagcagaaaugc

SEQ ID NO: 1423847 - RNA, 22 nt, Human
caguuggaguuuuuuguaccaa

SEQ ID NO: 1423848 - RNA, 22 nt, Human
caguuggagcuccagccugaca

SEQ ID NO: 1423849 - RNA, 21 nt, Human
caguuggagcuccagccugac

SEQ ID NO: 1423850 - RNA, 17 nt, Human
caguuggagcuccagcc

SEQ ID NO: 1423851 - RNA, 20 nt, Human
caguuggacuuuuuaaaaau

SEQ ID NO: 1423852 - RNA, 15 nt, Human
caguuggacuuuuua

SEQ ID NO: 1423853 - RNA, 13 nt, Human
caguuggacuuuu

SEQ ID NO: 1423854 - RNA, 13 nt, Human
caguugccuuuua

SEQ ID NO: 1423855 - RNA, 22 nt, Human
caguugccuuuuaucccaaagu

SEQ ID NO: 1423856 - RNA, 23 nt, Human
caguugcauguaguaacacuaau

SEQ ID NO: 1423857 - RNA, 17 nt, Human
caguugucucugaugca

SEQ ID NO: 1423858 - RNA, 15 nt, Human
caguugucucugaug

SEQ ID NO: 1423859 - RNA, 14 nt, Human
caguugucucugau

SEQ ID NO: 1423860 - RNA, 13 nt, Human
caguugucucuga

SEQ ID NO: 1423861 - RNA, 11 nt, Human
caguugucucu

SEQ ID NO: 1423862 - RNA, 22 nt, Human
caguugucccgauuguaacuca

SEQ ID NO: 1423863 - RNA, 21 nt, Human
caguugucccgauuguaacuc

SEQ ID NO: 1423864 - RNA, 20 nt, Human
caguugucccgauuguaacu

SEQ ID NO: 1423865 - RNA, 18 nt, Human
caguugucccgauuguaa

SEQ ID NO: 1423866 - RNA, 21 nt, Human
caguuguauuuaacagaaauu

SEQ ID NO: 1423867 - RNA, 18 nt, Human
caguuguauuuaacagaa

SEQ ID NO: 1423868 - RNA, 14 nt, Human
caguuguauuuaac

SEQ ID NO: 1423869 - RNA, 17 nt, Human
caguugguaacuuuugu

SEQ ID NO: 1423870 - RNA, 16 nt, Human
caguugguaacuuuug

SEQ ID NO: 1423871 - RNA, 14 nt, Human
caguugguaacuuu

SEQ ID NO: 1423872 - RNA, 13 nt, Human
caguugucucugu

SEQ ID NO: 1423873 - RNA, 22 nt, Human
caguugucucugaugcagcuua

SEQ ID NO: 1423874 - RNA, 21 nt, Human
caguugucucugaugcagcuu

SEQ ID NO: 1423875 - RNA, 15 nt, Human
caguugucucuguuu

SEQ ID NO: 1423876 - RNA, 23 nt, Human
caguuuuuuuuuucuugucuaua

SEQ ID NO: 1423877 - RNA, 18 nt, Human
caguuuuuuuuuucuugu

SEQ ID NO: 1423878 - RNA, 16 nt, Human
caguuuuuuaugcuaa

SEQ ID NO: 1423879 - RNA, 19 nt, Human
caguuuuuucaccuggaag

SEQ ID NO: 1423880 - RNA, 13 nt, Human
caguuuuuauuaa

SEQ ID NO: 1423881 - RNA, 22 nt, Human
caguucuuugggccagacaugc

SEQ ID NO: 1423882 - RNA, 21 nt, Human
caguucuuugggccagacaug

SEQ ID NO: 1423883 - RNA, 20 nt, Human
caguucuuugggccagacau

SEQ ID NO: 1423884 - RNA, 14 nt, Human
caguugaauuucau

SEQ ID NO: 1423885 - RNA, 19 nt, Human
caguugaagggaggggcug

SEQ ID NO: 1423886 - RNA, 17 nt, Human
caguugauuuucuggau

SEQ ID NO: 1423887 - RNA, 16 nt, Human
caguugauuuucugga

SEQ ID NO: 1423888 - RNA, 16 nt, Human
caguugagacaagaaa

SEQ ID NO: 1423889 - RNA, 18 nt, Human
caguugagacaagaaaau

SEQ ID NO: 1423890 - RNA, 21 nt, Human
caguugcauguaguaacacua

SEQ ID NO: 1423891 - RNA, 20 nt, Human
caguugcauguaguaacacu

SEQ ID NO: 1423892 - RNA, 19 nt, Human
caguugcauguaguaacac

SEQ ID NO: 1423893 - RNA, 18 nt, Human
caguugcauguaguaaca

SEQ ID NO: 1423894 - RNA, 16 nt, Human
caguugcauguaguaa

SEQ ID NO: 1423895 - RNA, 19 nt, Human
caguugcagucacucuagu

SEQ ID NO: 1423896 - RNA, 14 nt, Human
caguugcagucacu

SEQ ID NO: 1423897 - RNA, 11 nt, Human
caguugcaguc

SEQ ID NO: 1423898 - RNA, 11 nt, Human
caguugcagcc

SEQ ID NO: 1423899 - RNA, 15 nt, Human
cauaaaaaugaucua

SEQ ID NO: 1423900 - RNA, 12 nt, Human
cauaaaacaggu

SEQ ID NO: 1423901 - RNA, 22 nt, Human
cauaaaaaggacaucagcaaac

SEQ ID NO: 1423902 - RNA, 21 nt, Human
caguuuuuuuuuucuugucua

SEQ ID NO: 1423903 - RNA, 20 nt, Human
caguuuuuuuuuucuugucu

SEQ ID NO: 1423904 - RNA, 19 nt, Human
caguuuuuuuuuucuuguc

SEQ ID NO: 1423905 - RNA, 13 nt, Human
cauaaaaaggaca

SEQ ID NO: 1423906 - RNA, 19 nt, Human
cauaaaaaggacaucagca

SEQ ID NO: 1423907 - RNA, 20 nt, Human
cauaaaaaggacaucagcaa

SEQ ID NO: 1423908 - RNA, 21 nt, Human
cauaaaaaggacaucagcaaa

SEQ ID NO: 1423909 - RNA, 21 nt, Human
cauaaacccaguugccaucug

SEQ ID NO: 1423910 - RNA, 22 nt, Human
cauaaacaagaccacguuucua

SEQ ID NO: 1423911 - RNA, 20 nt, Human
cauaaacaagaccacguuuc

SEQ ID NO: 1423912 - RNA, 21 nt, Human
cauaaacaagaccacguuucu

SEQ ID NO: 1423913 - RNA, 14 nt, Human
cauaaagcaggcag

SEQ ID NO: 1423914 - RNA, 16 nt, Human
cauaaagcaggcagaa

SEQ ID NO: 1423915 - RNA, 18 nt, Human
cauaaccuuaccagauuu

SEQ ID NO: 1423916 - RNA, 23 nt, Human
cauaaccugucucaccuggacuu

SEQ ID NO: 1423917 - RNA, 17 nt, Human
cauaacggaucagaaau

SEQ ID NO: 1423918 - RNA, 21 nt, Human
cauaacggaucagaaauacag

SEQ ID NO: 1423919 - RNA, 12 nt, Human
cauaaccugucu

SEQ ID NO: 1423920 - RNA, 22 nt, Human
cauaacccaagguaccauccua

SEQ ID NO: 1423921 - RNA, 15 nt, Human
cauaaccacugcuuc

SEQ ID NO: 1423922 - RNA, 14 nt, Human
cauaaccacugcuu

SEQ ID NO: 1423923 - RNA, 13 nt, Human
cauaaccacugcu

SEQ ID NO: 1423924 - RNA, 16 nt, Human
cauaacaauuccucua

SEQ ID NO: 1423925 - RNA, 15 nt, Human
cauaacaauuccucu

SEQ ID NO: 1423926 - RNA, 14 nt, Human
cauaacaauuccuc

SEQ ID NO: 1423927 - RNA, 15 nt, Human
cauaacaacuucaua

SEQ ID NO: 1423928 - RNA, 20 nt, Human
cauaaauuuaguauuuuguu

SEQ ID NO: 1423929 - RNA, 19 nt, Human
cauaaauuuaguauuuugu

SEQ ID NO: 1423930 - RNA, 17 nt, Human
cauaacaauuccucuac

SEQ ID NO: 1423931 - RNA, 21 nt, Human
cauaaaggaaaagacacauuu

SEQ ID NO: 1423932 - RNA, 19 nt, Human
cauaaaggaaaagacacau

SEQ ID NO: 1423933 - RNA, 15 nt, Human
cauaaaggaaaagac

SEQ ID NO: 1423934 - RNA, 13 nt, Human
cauaaaggaaaag

SEQ ID NO: 1423935 - RNA, 21 nt, Human
cauaaaguugauaaagauuuu

SEQ ID NO: 1423936 - RNA, 14 nt, Human
cauaaagucuugcc

SEQ ID NO: 1423937 - RNA, 12 nt, Human
cauaaauuauug

SEQ ID NO: 1423938 - RNA, 11 nt, Human
cauaaauuauu

SEQ ID NO: 1423939 - RNA, 16 nt, Human
cauaaauccuugauga

SEQ ID NO: 1423940 - RNA, 19 nt, Human
cauaagaaaacuaagaaau

SEQ ID NO: 1423941 - RNA, 14 nt, Human
cauaacugaacauc

SEQ ID NO: 1423942 - RNA, 14 nt, Human
cauaacugaaaaug

SEQ ID NO: 1423943 - RNA, 11 nt, Human
cauaacugaaa

SEQ ID NO: 1423944 - RNA, 22 nt, Human
cauaacggaucagaaauacaga

SEQ ID NO: 1423945 - RNA, 12 nt, Human
cauaaguuucug

SEQ ID NO: 1423946 - RNA, 15 nt, Human
cauaaguauuucaaa

SEQ ID NO: 1423947 - RNA, 19 nt, Human
cauaaguauuaugucucuu

SEQ ID NO: 1423948 - RNA, 19 nt, Human
cauaaggcuucaaaauguu

SEQ ID NO: 1423949 - RNA, 15 nt, Human
cauaaggcuucaaaa

SEQ ID NO: 1423950 - RNA, 18 nt, Human
cauaagcuauuuuucuaa

SEQ ID NO: 1423951 - RNA, 20 nt, Human
cauaagcuauuuuucuaacu

SEQ ID NO: 1423952 - RNA, 17 nt, Human
cauaagcuauuuuucua

SEQ ID NO: 1423953 - RNA, 16 nt, Human
cauaagcuauuuuucu

SEQ ID NO: 1423954 - RNA, 18 nt, Human
cauaagcuuaugcuuaaa

SEQ ID NO: 1423955 - RNA, 14 nt, Human
cauaccaaugaaaa

SEQ ID NO: 1423956 - RNA, 18 nt, Human
cauacauuuucuaagaaa

SEQ ID NO: 1423957 - RNA, 19 nt, Human
cauaccacuuuuguucuug

SEQ ID NO: 1423958 - RNA, 13 nt, Human
cauaccacuuuug

SEQ ID NO: 1423959 - RNA, 14 nt, Human
cauaccacuuuugu

SEQ ID NO: 1423960 - RNA, 15 nt, Human
cauaccacuuuuguu

SEQ ID NO: 1423961 - RNA, 18 nt, Human
cauaccacuuuuguucuu

SEQ ID NO: 1423962 - RNA, 16 nt, Human
cauacauuuucuaaga

SEQ ID NO: 1423963 - RNA, 14 nt, Human
cauacauuuucuaa

SEQ ID NO: 1423964 - RNA, 16 nt, Human
cauaaucacucuaauu

SEQ ID NO: 1423965 - RNA, 15 nt, Human
cauaaucacucuaau

SEQ ID NO: 1423966 - RNA, 17 nt, Human
cauaauccaguaaaaua

SEQ ID NO: 1423967 - RNA, 18 nt, Human
cauaauccaguaaaauaa

SEQ ID NO: 1423968 - RNA, 15 nt, Human
cauaauacuugcuuu

SEQ ID NO: 1423969 - RNA, 20 nt, Human
caguucugugguuucauguu

SEQ ID NO: 1423970 - RNA, 19 nt, Human
caguucuuugggccagaca

SEQ ID NO: 1423971 - RNA, 18 nt, Human
caguucuuugggccagac

SEQ ID NO: 1423972 - RNA, 17 nt, Human
caguucuuugggccaga

SEQ ID NO: 1423973 - RNA, 16 nt, Human
caguucuuugggccag

SEQ ID NO: 1423974 - RNA, 12 nt, Human
caguucuaggaa

SEQ ID NO: 1423975 - RNA, 15 nt, Human
caguucuaggaaaau

SEQ ID NO: 1423976 - RNA, 11 nt, Human
caguucuagga

SEQ ID NO: 1423977 - RNA, 18 nt, Human
caguucuaaccuccuaag

SEQ ID NO: 1423978 - RNA, 15 nt, Human
caguucuaaccuccu

SEQ ID NO: 1423979 - RNA, 22 nt, Human
caguucgcagccacccugagga

SEQ ID NO: 1423980 - RNA, 21 nt, Human
caguucgcagccacccugagg

SEQ ID NO: 1423981 - RNA, 19 nt, Human
caguucgcagccacccuga

SEQ ID NO: 1423982 - RNA, 18 nt, Human
caguucgcagccacccug

SEQ ID NO: 1423983 - RNA, 16 nt, Human
caguucgcagccaccc

SEQ ID NO: 1423984 - RNA, 15 nt, Human
caguucgcagccacc

SEQ ID NO: 1423985 - RNA, 14 nt, Human
caguucgcagccac

SEQ ID NO: 1423986 - RNA, 13 nt, Human
caguucgcagcca

SEQ ID NO: 1423987 - RNA, 21 nt, Human
caguucgacucugugcuggcc

SEQ ID NO: 1423988 - RNA, 22 nt, Human
caguucggugagcuacaaaugc

SEQ ID NO: 1423989 - RNA, 12 nt, Human
caguucugaaga

SEQ ID NO: 1423990 - RNA, 14 nt, Human
caguucugaagaag

SEQ ID NO: 1423991 - RNA, 13 nt, Human
caguucugaagaa

SEQ ID NO: 1423992 - RNA, 20 nt, Human
caguucucauggguggcacu

SEQ ID NO: 1423993 - RNA, 22 nt, Human
caguucugaagaagaugguacc

SEQ ID NO: 1423994 - RNA, 16 nt, Human
caguucugaagaagau

SEQ ID NO: 1423995 - RNA, 15 nt, Human
caguucugaagaaga

SEQ ID NO: 1423996 - RNA, 19 nt, Human
caguuaauuuuuccaacua

SEQ ID NO: 1423997 - RNA, 16 nt, Human
caguuaauuuuuccaa

SEQ ID NO: 1423998 - RNA, 14 nt, Human
caguuaauuuuucc

SEQ ID NO: 1423999 - RNA, 13 nt, Human
caguuaauuuuuc

SEQ ID NO: 1424000 - RNA, 12 nt, Human
caguuaauuuuu

SEQ ID NO: 1424001 - RNA, 12 nt, Human
caguuaaucuug

SEQ ID NO: 1424002 - RNA, 15 nt, Human
caguuaaucuugcuu

SEQ ID NO: 1424003 - RNA, 16 nt, Human
caguuaagaaauuuca

SEQ ID NO: 1424004 - RNA, 15 nt, Human
caguuaagaaauuuc

SEQ ID NO: 1424005 - RNA, 19 nt, Human
caguuccuguggcucccuc

SEQ ID NO: 1424006 - RNA, 18 nt, Human
caguuccuguggcucccu

SEQ ID NO: 1424007 - RNA, 23 nt, Human
caguuaccauuaaaccaucuccc

SEQ ID NO: 1424008 - RNA, 20 nt, Human
caguuaccauuaaaccaucu

SEQ ID NO: 1424009 - RNA, 19 nt, Human
caguuaccauuaaaccauc

SEQ ID NO: 1424010 - RNA, 18 nt, Human
caguuaccauuaaaccau

SEQ ID NO: 1424011 - RNA, 22 nt, Human
caguuacauaauucacucugag

SEQ ID NO: 1424012 - RNA, 21 nt, Human
caguuaccucugccucagaaa

SEQ ID NO: 1424013 - RNA, 14 nt, Human
caguuacucagaau

SEQ ID NO: 1424014 - RNA, 19 nt, Human
caguguuaaaugugaugaa

SEQ ID NO: 1424015 - RNA, 14 nt, Human
caguguuaaaugug

SEQ ID NO: 1424016 - RNA, 19 nt, Human
caguguuagggaagggccu

SEQ ID NO: 1424017 - RNA, 18 nt, Human
caguguugagccuuuucc

SEQ ID NO: 1424018 - RNA, 19 nt, Human
caguguuguggauuuaaca

SEQ ID NO: 1424019 - RNA, 20 nt, Human
caguguuguggauuuaacag

SEQ ID NO: 1424020 - RNA, 22 nt, Human
caguguuguggauuuaacagaa

SEQ ID NO: 1424021 - RNA, 14 nt, Human
caguguuuaaaacu

SEQ ID NO: 1424022 - RNA, 18 nt, Human
caguguuuauccuuucau

SEQ ID NO: 1424023 - RNA, 20 nt, Human
caguguugucaccagaucug

SEQ ID NO: 1424024 - RNA, 14 nt, Human
caguguugucacca

SEQ ID NO: 1424025 - RNA, 18 nt, Human
caguguuggggaugccuu

SEQ ID NO: 1424026 - RNA, 20 nt, Human
caguguuuuaggagcaugag

SEQ ID NO: 1424027 - RNA, 21 nt, Human
caguguuuuuagaccuguguu

SEQ ID NO: 1424028 - RNA, 22 nt, Human
caguguuuucugggauaaguaa

SEQ ID NO: 1424029 - RNA, 15 nt, Human
caguguuuucuggga

SEQ ID NO: 1424030 - RNA, 16 nt, Human
caguguuuuaggagca

SEQ ID NO: 1424031 - RNA, 19 nt, Human
caguuaaaaaaaauuuuaa

SEQ ID NO: 1424032 - RNA, 16 nt, Human
caguuaaaaaaaauuu

SEQ ID NO: 1424033 - RNA, 15 nt, Human
caguuaaaaaaaauu

SEQ ID NO: 1424034 - RNA, 21 nt, Human
caguuaacuauugcauuuaua

SEQ ID NO: 1424035 - RNA, 24 nt, Human
caguuaacuauugcauuuauaugu

SEQ ID NO: 1424036 - RNA, 22 nt, Human
caguguguggcuuucagagccu

SEQ ID NO: 1424037 - RNA, 21 nt, Human
caguguguggcuuucagagcc

SEQ ID NO: 1424038 - RNA, 20 nt, Human
caguguggaggccacuguuu

SEQ ID NO: 1424039 - RNA, 19 nt, Human
caguguggaggccacuguu

SEQ ID NO: 1424040 - RNA, 18 nt, Human
caguguggaggccacugu

SEQ ID NO: 1424041 - RNA, 21 nt, Human
cagugugcaaggcagccgugg

SEQ ID NO: 1424042 - RNA, 20 nt, Human
cagugugcaaggcagccgug

SEQ ID NO: 1424043 - RNA, 18 nt, Human
cagugugcaaggcagccg

SEQ ID NO: 1424044 - RNA, 14 nt, Human
cagugugcaaggca

SEQ ID NO: 1424045 - RNA, 19 nt, Human
cagugugaggccagggcag

SEQ ID NO: 1424046 - RNA, 18 nt, Human
cagugugaggccagggca

SEQ ID NO: 1424047 - RNA, 17 nt, Human
cagugugaggccagggc

SEQ ID NO: 1424048 - RNA, 16 nt, Human
cagugugaggccaggg

SEQ ID NO: 1424049 - RNA, 23 nt, Human
cagugucuguguuuugaaagaau

SEQ ID NO: 1424050 - RNA, 13 nt, Human
cagugucuguguu

SEQ ID NO: 1424051 - RNA, 21 nt, Human
cagugucuuuuuuuguauagu

SEQ ID NO: 1424052 - RNA, 23 nt, Human
cagugucuuuuuuuguauaguua

SEQ ID NO: 1424053 - RNA, 19 nt, Human
cagugucuuuuuuuguaua

SEQ ID NO: 1424054 - RNA, 17 nt, Human
cagugucuuuuuuugua

SEQ ID NO: 1424055 - RNA, 12 nt, Human
cagugucuuuuu

SEQ ID NO: 1424056 - RNA, 20 nt, Human
caguguccuuggcaggcuga

SEQ ID NO: 1424057 - RNA, 19 nt, Human
caguguccugagcucagcg

SEQ ID NO: 1424058 - RNA, 22 nt, Human
caguguccugagcucagcgugg

SEQ ID NO: 1424059 - RNA, 18 nt, Human
caguguccugagcucagc

SEQ ID NO: 1424060 - RNA, 16 nt, Human
caguguccugagcuca

SEQ ID NO: 1424061 - RNA, 15 nt, Human
caguguccugagcuc

SEQ ID NO: 1424062 - RNA, 14 nt, Human
caguguccugagcu

SEQ ID NO: 1424063 - RNA, 13 nt, Human
caguguccugagc

SEQ ID NO: 1424064 - RNA, 22 nt, Human
cagugucauuucucauccacau

SEQ ID NO: 1424065 - RNA, 17 nt, Human
caguguauggaaauaaa

SEQ ID NO: 1424066 - RNA, 16 nt, Human
cagugucauuucucau

SEQ ID NO: 1424067 - RNA, 16 nt, Human
cagugucaggcacugg

SEQ ID NO: 1424068 - RNA, 13 nt, Human
cagugucaggcac

SEQ ID NO: 1424069 - RNA, 21 nt, Human
cagugcuuuuggcggggagga

SEQ ID NO: 1424070 - RNA, 12 nt, Human
cagugcuuuugg

SEQ ID NO: 1424071 - RNA, 20 nt, Human
cagugcuuuuaagugaaaau

SEQ ID NO: 1424072 - RNA, 17 nt, Human
caguggaucacaaagug

SEQ ID NO: 1424073 - RNA, 20 nt, Human
caguggaggaagagggacag

SEQ ID NO: 1424074 - RNA, 15 nt, Human
caguggaggaagagg

SEQ ID NO: 1424075 - RNA, 19 nt, Human
cagugggaaaaauguagga

SEQ ID NO: 1424076 - RNA, 18 nt, Human
cagugggaaaaauguagg

SEQ ID NO: 1424077 - RNA, 20 nt, Human
caguggcugguccagggcua

SEQ ID NO: 1424078 - RNA, 19 nt, Human
caguggcugguccagggcu

SEQ ID NO: 1424079 - RNA, 18 nt, Human
caguggcugguccagggc

SEQ ID NO: 1424080 - RNA, 21 nt, Human
caguggcaggcagaggcccag

SEQ ID NO: 1424081 - RNA, 20 nt, Human
caguggcaggcagaggccca

SEQ ID NO: 1424082 - RNA, 14 nt, Human
caguggcaggcaga

SEQ ID NO: 1424083 - RNA, 13 nt, Human
caguggcaggcag

SEQ ID NO: 1424084 - RNA, 21 nt, Human
caguggcccauggcauuuuau

SEQ ID NO: 1424085 - RNA, 21 nt, Human
caguggcaucaucucagcuca

SEQ ID NO: 1424086 - RNA, 11 nt, Human
caguggccuua

SEQ ID NO: 1424087 - RNA, 16 nt, Human
caguggcccauggcau

SEQ ID NO: 1424088 - RNA, 21 nt, Human
caguggcgcgaucucagcuca

SEQ ID NO: 1424089 - RNA, 21 nt, Human
caguggcgugaucucagcuca

SEQ ID NO: 1424090 - RNA, 21 nt, Human
cgcggcccucaguagucccug

SEQ ID NO: 1424091 - RNA, 14 nt, Human
cgcggcccucagua

SEQ ID NO: 1424092 - RNA, 21 nt, Human
cgcuaaucccgauucacccug

SEQ ID NO: 1424093 - RNA, 23 nt, Human
cgcucagcucauccaugccucag

SEQ ID NO: 1424094 - RNA, 22 nt, Human
cgcucagggccaugcugaggcc

SEQ ID NO: 1424095 - RNA, 21 nt, Human
cgcucagggccaugcugaggc

SEQ ID NO: 1424096 - RNA, 20 nt, Human
cgcucagggccaugcugagg

SEQ ID NO: 1424097 - RNA, 19 nt, Human
cgcucagggccaugcugag

SEQ ID NO: 1424098 - RNA, 15 nt, Human
cgcuccagcugcccc

SEQ ID NO: 1424099 - RNA, 23 nt, Human
cgcuacaccacucuggcagccac

SEQ ID NO: 1424100 - RNA, 20 nt, Human
cgcuacaccacucuggcagc

SEQ ID NO: 1424101 - RNA, 17 nt, Human
cgcuacaccacucuggc

SEQ ID NO: 1424102 - RNA, 16 nt, Human
cgcuacaccacucugg

SEQ ID NO: 1424103 - RNA, 23 nt, Human
cgcuaauucaaggaauuucuuaa

SEQ ID NO: 1424104 - RNA, 20 nt, Human
cgcuuggcgaugccagccaa

SEQ ID NO: 1424105 - RNA, 22 nt, Human
cgcuuggcgaugccagccaagc

SEQ ID NO: 1424106 - RNA, 15 nt, Human
cggaaaacaugcuac

SEQ ID NO: 1424107 - RNA, 20 nt, Human
cggaaaacaugcuacacacu

SEQ ID NO: 1424108 - RNA, 22 nt, Human
cgcuuggagcuauuuuccaggc

SEQ ID NO: 1424109 - RNA, 14 nt, Human
cgcuuggagcagag

SEQ ID NO: 1424110 - RNA, 22 nt, Human
cgcuucuugccucugugcugug

SEQ ID NO: 1424111 - RNA, 16 nt, Human
cgcuugaagccugaac

SEQ ID NO: 1424112 - RNA, 19 nt, Human
cgcuucuugccucugugcu

SEQ ID NO: 1424113 - RNA, 18 nt, Human
cgcuucuugccucugugc

SEQ ID NO: 1424114 - RNA, 16 nt, Human
cgcuguccuuucuaga

SEQ ID NO: 1424115 - RNA, 17 nt, Human
cgcuguccuuucuagag

SEQ ID NO: 1424116 - RNA, 20 nt, Human
cgcugucaggauugcgagag

SEQ ID NO: 1424117 - RNA, 22 nt, Human
cgcugggugguacccucuggag

SEQ ID NO: 1424118 - RNA, 19 nt, Human
cgcugggugguacccucug

SEQ ID NO: 1424119 - RNA, 14 nt, Human
cgcugggugguacc

SEQ ID NO: 1424120 - RNA, 13 nt, Human
cgcuccagcugcc

SEQ ID NO: 1424121 - RNA, 18 nt, Human
cgcugucaggauugcgag

SEQ ID NO: 1424122 - RNA, 13 nt, Human
cgcugucacaggc

SEQ ID NO: 1424123 - RNA, 18 nt, Human
cgcugguccuuucuuccg

SEQ ID NO: 1424124 - RNA, 21 nt, Human
cgccaggauggaacacggcca

SEQ ID NO: 1424125 - RNA, 22 nt, Human
cgcccacaggaagccugcaguc

SEQ ID NO: 1424126 - RNA, 21 nt, Human
cgcccacaggaagccugcagu

SEQ ID NO: 1424127 - RNA, 20 nt, Human
cgcccacaggaagccugcag

SEQ ID NO: 1424128 - RNA, 14 nt, Human
cgccagcucuguuc

SEQ ID NO: 1424129 - RNA, 19 nt, Human
cgccagcucuguucuuccu

SEQ ID NO: 1424130 - RNA, 12 nt, Human
cgccagcucugu

SEQ ID NO: 1424131 - RNA, 22 nt, Human
ccucugcccaggcacugcuagg

SEQ ID NO: 1424132 - RNA, 22 nt, Human
cgcccagagacccaagcugccu

SEQ ID NO: 1424133 - RNA, 20 nt, Human
cgcccaggcuggagugcagu

SEQ ID NO: 1424134 - RNA, 18 nt, Human
cgcccccugucucucagg

SEQ ID NO: 1424135 - RNA, 13 nt, Human
cgcccccugucuc

SEQ ID NO: 1424136 - RNA, 23 nt, Human
cgcgauguggaacugcugccacu

SEQ ID NO: 1424137 - RNA, 22 nt, Human
cgcgauguggaacugcugccac

SEQ ID NO: 1424138 - RNA, 21 nt, Human
cgcgauguggaacugcugcca

SEQ ID NO: 1424139 - RNA, 20 nt, Human
cgcgauguggaacugcugcc

SEQ ID NO: 1424140 - RNA, 18 nt, Human
cgcgauguggaacugcug

SEQ ID NO: 1424141 - RNA, 19 nt, Human
cgcccuuuccuccucaggc

SEQ ID NO: 1424142 - RNA, 17 nt, Human
cgcccuuuccuccucag

SEQ ID NO: 1424143 - RNA, 16 nt, Human
cgcccuuuccuccuca

SEQ ID NO: 1424144 - RNA, 14 nt, Human
cgcccuuuccuccu

SEQ ID NO: 1424145 - RNA, 16 nt, Human
cgcccuggacugugug

SEQ ID NO: 1424146 - RNA, 18 nt, Human
cggcugggaggagggcag

SEQ ID NO: 1424147 - RNA, 18 nt, Human
cggccacacagcugccgg

SEQ ID NO: 1424148 - RNA, 16 nt, Human
cggccacacagcugcc

SEQ ID NO: 1424149 - RNA, 15 nt, Human
cggccacacagcugc

SEQ ID NO: 1424150 - RNA, 13 nt, Human
cggcauuuguuuc

SEQ ID NO: 1424151 - RNA, 21 nt, Human
cggcauggacaauggaccgga

SEQ ID NO: 1424152 - RNA, 23 nt, Human
cggcagcuucugcccccugcaga

SEQ ID NO: 1424153 - RNA, 22 nt, Human
cggcagcuucugcccccugcag

SEQ ID NO: 1424154 - RNA, 21 nt, Human
cggcagcuucugcccccugca

SEQ ID NO: 1424155 - RNA, 20 nt, Human
cggcagcuucugcccccugc

SEQ ID NO: 1424156 - RNA, 17 nt, Human
cggcagcuucugccccc

SEQ ID NO: 1424157 - RNA, 13 nt, Human
cggcagcagcccc

SEQ ID NO: 1424158 - RNA, 22 nt, Human
cggcaccugggcccuggggccu

SEQ ID NO: 1424159 - RNA, 23 nt, Human
cggcaccugggcccuggggccug

SEQ ID NO: 1424160 - RNA, 20 nt, Human
cggcaccugggcccuggggc

SEQ ID NO: 1424161 - RNA, 19 nt, Human
cggcaccugggcccugggg

SEQ ID NO: 1424162 - RNA, 17 nt, Human
cggcaccugggcccugg

SEQ ID NO: 1424163 - RNA, 13 nt, Human
cggcaccugggcc

SEQ ID NO: 1424164 - RNA, 20 nt, Human
cggcacccccugcagcuugu

SEQ ID NO: 1424165 - RNA, 19 nt, Human
cggcacccccugcagcuug

SEQ ID NO: 1424166 - RNA, 17 nt, Human
cggcacccccugcagcu

SEQ ID NO: 1424167 - RNA, 16 nt, Human
cggcacccccugcagc

SEQ ID NO: 1424168 - RNA, 15 nt, Human
cggcacccccugcag

SEQ ID NO: 1424169 - RNA, 21 nt, Human
cggcacagggucugcucuuuc

SEQ ID NO: 1424170 - RNA, 19 nt, Human
cggaaggguaaacaauaua

SEQ ID NO: 1424171 - RNA, 18 nt, Human
cggaaggguaaacaauau

SEQ ID NO: 1424172 - RNA, 17 nt, Human
cggaaggguaaacaaua

SEQ ID NO: 1424173 - RNA, 15 nt, Human
cggaaggguaaacaa

SEQ ID NO: 1424174 - RNA, 16 nt, Human
cgcuuuuugaaaaagc

SEQ ID NO: 1424175 - RNA, 11 nt, Human
cgcuuuuugaa

SEQ ID NO: 1424176 - RNA, 23 nt, Human
cggccggccagccccuggcccca

SEQ ID NO: 1424177 - RNA, 16 nt, Human
cggccggccagccccu

SEQ ID NO: 1424178 - RNA, 14 nt, Human
cggccggccagccc

SEQ ID NO: 1424179 - RNA, 20 nt, Human
cggcugcagaggccagaggc

SEQ ID NO: 1424180 - RNA, 15 nt, Human
cggcugcagaggcca

SEQ ID NO: 1424181 - RNA, 12 nt, Human
cggcugcagagg

SEQ ID NO: 1424182 - RNA, 19 nt, Human
cggccuaugacuugggcac

SEQ ID NO: 1424183 - RNA, 18 nt, Human
cggccuaugacuugggca

SEQ ID NO: 1424184 - RNA, 17 nt, Human
cggccuaugacuugggc

SEQ ID NO: 1424185 - RNA, 17 nt, Human
cggcccaauccaaggug

SEQ ID NO: 1424186 - RNA, 15 nt, Human
cggcccaauccaagg

SEQ ID NO: 1424187 - RNA, 17 nt, Human
cggcccaggauggcuuu

SEQ ID NO: 1424188 - RNA, 17 nt, Human
cggccacacagcugccg

SEQ ID NO: 1424189 - RNA, 16 nt, Human
cggccagggagaagcu

SEQ ID NO: 1424190 - RNA, 17 nt, Human
cggccagggagaagcuc

SEQ ID NO: 1424191 - RNA, 17 nt, Human
cggcccacaauuaauuu

SEQ ID NO: 1424192 - RNA, 16 nt, Human
cgggcagagggcugga

SEQ ID NO: 1424193 - RNA, 15 nt, Human
cgggcagagggcugg

SEQ ID NO: 1424194 - RNA, 14 nt, Human
cgggcagagggcug

SEQ ID NO: 1424195 - RNA, 16 nt, Human
cgggaugguucuggcu

SEQ ID NO: 1424196 - RNA, 12 nt, Human
cggcugggagga

SEQ ID NO: 1424197 - RNA, 22 nt, Human
cgggagccaugcgcccccuccg

SEQ ID NO: 1424198 - RNA, 17 nt, Human
cgggagccugacccuca

SEQ ID NO: 1424199 - RNA, 12 nt, Human
cgggagacagca

SEQ ID NO: 1424200 - RNA, 13 nt, Human
cgggacugcggag

SEQ ID NO: 1424201 - RNA, 18 nt, Human
cggggugcacaggagggg

SEQ ID NO: 1424202 - RNA, 16 nt, Human
cggggugcccacaggc

SEQ ID NO: 1424203 - RNA, 17 nt, Human
cggggugcacaggaggg

SEQ ID NO: 1424204 - RNA, 16 nt, Human
cggggugcacaggagg

SEQ ID NO: 1424205 - RNA, 15 nt, Human
cggggugcacaggag

SEQ ID NO: 1424206 - RNA, 22 nt, Human
cggggugagggggggcucccug

SEQ ID NO: 1424207 - RNA, 22 nt, Human
cggggguuccguguccaccccc

SEQ ID NO: 1424208 - RNA, 20 nt, Human
cggggguuccguguccaccc

SEQ ID NO: 1424209 - RNA, 19 nt, Human
cggggguuccguguccacc

SEQ ID NO: 1424210 - RNA, 21 nt, Human
cggggguggcggcggccccua

SEQ ID NO: 1424211 - RNA, 17 nt, Human
cggggguggcggcggcc

SEQ ID NO: 1424212 - RNA, 21 nt, Human
cgggggcagucugagagaggc

SEQ ID NO: 1424213 - RNA, 18 nt, Human
cgggggcagucugagaga

SEQ ID NO: 1424214 - RNA, 17 nt, Human
cgggggcagucugagag

SEQ ID NO: 1424215 - RNA, 19 nt, Human
cgggggaggguaggcagga

SEQ ID NO: 1424216 - RNA, 18 nt, Human
cggggcuugccuucuggu

SEQ ID NO: 1424217 - RNA, 16 nt, Human
cggggcuugccuucug

SEQ ID NO: 1424218 - RNA, 15 nt, Human
cggggcuugccuucu

SEQ ID NO: 1424219 - RNA, 12 nt, Human
cggggcuugccu

SEQ ID NO: 1424220 - RNA, 13 nt, Human
cggggcugggaag

SEQ ID NO: 1424221 - RNA, 19 nt, Human
cggggccugggcaggaggg

SEQ ID NO: 1424222 - RNA, 22 nt, Human
cgggcagagggcuggaggccca

SEQ ID NO: 1424223 - RNA, 23 nt, Human
cgggcagagggcuggaggcccag

SEQ ID NO: 1424224 - RNA, 19 nt, Human
cgggcagagggcuggaggc

SEQ ID NO: 1424225 - RNA, 18 nt, Human
cgggcagagggcuggagg

SEQ ID NO: 1424226 - RNA, 17 nt, Human
cggggccugggcaggag

SEQ ID NO: 1424227 - RNA, 14 nt, Human
cggggacucagccc

SEQ ID NO: 1424228 - RNA, 17 nt, Human
cggguugugugucuguu

SEQ ID NO: 1424229 - RNA, 16 nt, Human
cggguugugugucugu

SEQ ID NO: 1424230 - RNA, 20 nt, Human
cggguggggcuuggggcuca

SEQ ID NO: 1424231 - RNA, 16 nt, Human
cggguggggcuugggg

SEQ ID NO: 1424232 - RNA, 16 nt, Human
cgggugccagaagcua

SEQ ID NO: 1424233 - RNA, 21 nt, Human
cgggugaacaaagcagccacg

SEQ ID NO: 1424234 - RNA, 22 nt, Human
cggggugggguggcugcagccu

SEQ ID NO: 1424235 - RNA, 16 nt, Human
cggggugggggcagca

SEQ ID NO: 1424236 - RNA, 20 nt, Human
cgggugaacaaagcagccac

SEQ ID NO: 1424237 - RNA, 14 nt, Human
cgggucugcuccca

SEQ ID NO: 1424238 - RNA, 17 nt, Human
cgggucugcucccaagg

SEQ ID NO: 1424239 - RNA, 13 nt, Human
cgggucugcuccc

SEQ ID NO: 1424240 - RNA, 13 nt, Human
cgggucugccucu

SEQ ID NO: 1424241 - RNA, 22 nt, Human
cgguauccccccaucuugcuuc

SEQ ID NO: 1424242 - RNA, 18 nt, Human
cgguauccccccaucuug

SEQ ID NO: 1424243 - RNA, 18 nt, Human
cgguagguucagccaagg

SEQ ID NO: 1424244 - RNA, 22 nt, Human
cgguagccagcacacagggcag

SEQ ID NO: 1424245 - RNA, 21 nt, Human
cgguagccagcacacagggca

SEQ ID NO: 1424246 - RNA, 15 nt, Human
cgguagccagcacac

SEQ ID NO: 1424247 - RNA, 14 nt, Human
cggucugugccccu

SEQ ID NO: 1424248 - RNA, 21 nt, Human
cggucuguucuguuucaaggc

SEQ ID NO: 1424249 - RNA, 20 nt, Human
cggugcccaagccagaggcu

SEQ ID NO: 1424250 - RNA, 18 nt, Human
cggugcccaagccagagg

SEQ ID NO: 1424251 - RNA, 15 nt, Human
cggugcccaagccag

SEQ ID NO: 1424252 - RNA, 14 nt, Human
cggugcccaagcca

SEQ ID NO: 1424253 - RNA, 17 nt, Human
cggugagcuacaaaugc

SEQ ID NO: 1424254 - RNA, 13 nt, Human
cggucugugcccc

SEQ ID NO: 1424255 - RNA, 24 nt, Human
cggucgcccuuugcugcauggcag

SEQ ID NO: 1424256 - RNA, 17 nt, Human
cggucggggcaucuggc

SEQ ID NO: 1424257 - RNA, 22 nt, Human
cuacagagaaaccagcuuccuu

SEQ ID NO: 1424258 - RNA, 20 nt, Human
cgugccaaguccagguccug

SEQ ID NO: 1424259 - RNA, 15 nt, Human
cgugccaaguccagg

SEQ ID NO: 1424260 - RNA, 21 nt, Human
cgugcauugugcuucuuucuu

SEQ ID NO: 1424261 - RNA, 12 nt, Human
cgugcauugugc

SEQ ID NO: 1424262 - RNA, 15 nt, Human
cgugcauugugcuuc

SEQ ID NO: 1424263 - RNA, 13 nt, Human
cgucuucuccaac

SEQ ID NO: 1424264 - RNA, 19 nt, Human
cgugaaaacacauuugcuu

SEQ ID NO: 1424265 - RNA, 18 nt, Human
cgucuuuuccuguuuccu

SEQ ID NO: 1424266 - RNA, 23 nt, Human
cggugccuuuauuuccacugugc

SEQ ID NO: 1424267 - RNA, 21 nt, Human
cggugccuuuauuuccacugu

SEQ ID NO: 1424268 - RNA, 17 nt, Human
cggugccuuuauuucca

SEQ ID NO: 1424269 - RNA, 23 nt, Human
cggugcccaagccagaggcuggg

SEQ ID NO: 1424270 - RNA, 13 nt, Human
cguccugccugug

SEQ ID NO: 1424271 - RNA, 13 nt, Human
cguccugagaaag

SEQ ID NO: 1424272 - RNA, 15 nt, Human
cguccuccucuguga

SEQ ID NO: 1424273 - RNA, 14 nt, Human
cguccuccucugug

SEQ ID NO: 1424274 - RNA, 13 nt, Human
cguccuccucugu

SEQ ID NO: 1424275 - RNA, 12 nt, Human
cguccuccucug

SEQ ID NO: 1424276 - RNA, 22 nt, Human
cguccuuacuccugugggagcc

SEQ ID NO: 1424277 - RNA, 20 nt, Human
cguccuuacuccugugggag

SEQ ID NO: 1424278 - RNA, 17 nt, Human
cguccuuacuccugugg

SEQ ID NO: 1424279 - RNA, 16 nt, Human
cguccuuacuccugug

SEQ ID NO: 1424280 - RNA, 15 nt, Human
cguccuuacuccugu

SEQ ID NO: 1424281 - RNA, 15 nt, Human
cguccugccuguggc

SEQ ID NO: 1424282 - RNA, 14 nt, Human
cguccugccugugg

SEQ ID NO: 1424283 - RNA, 16 nt, Human
cguccugccuguggcg

SEQ ID NO: 1424284 - RNA, 21 nt, Human
cgucuccaggggcugcuuccu

SEQ ID NO: 1424285 - RNA, 20 nt, Human
cgucuccaggggcugcuucc

SEQ ID NO: 1424286 - RNA, 19 nt, Human
cgucuccaggggcugcuuc

SEQ ID NO: 1424287 - RNA, 14 nt, Human
cgucuccaggggcu

SEQ ID NO: 1424288 - RNA, 11 nt, Human
cgucucagugu

SEQ ID NO: 1424289 - RNA, 21 nt, Human
cguccuuacuccugugggagc

SEQ ID NO: 1424290 - RNA, 21 nt, Human
cguggagggguaggggcuggg

SEQ ID NO: 1424291 - RNA, 23 nt, Human
cguggagggguaggggcugggaa

SEQ ID NO: 1424292 - RNA, 17 nt, Human
cguggauugcacguggc

SEQ ID NO: 1424293 - RNA, 20 nt, Human
cguggagggguaggggcugg

SEQ ID NO: 1424294 - RNA, 19 nt, Human
cguggagggguaggggcug

SEQ ID NO: 1424295 - RNA, 18 nt, Human
cguggagggguaggggcu

SEQ ID NO: 1424296 - RNA, 14 nt, Human
cguggaggcugcuc

SEQ ID NO: 1424297 - RNA, 15 nt, Human
cguggaggcugcucg

SEQ ID NO: 1424298 - RNA, 13 nt, Human
cguggaggcugcu

SEQ ID NO: 1424299 - RNA, 23 nt, Human
cguggcuguggcauccagagucc

SEQ ID NO: 1424300 - RNA, 15 nt, Human
cguggcccagagaag

SEQ ID NO: 1424301 - RNA, 16 nt, Human
cguggcccagagaagc

SEQ ID NO: 1424302 - RNA, 13 nt, Human
cgugggcucccug

SEQ ID NO: 1424303 - RNA, 21 nt, Human
cgugggccccacccucgggga

SEQ ID NO: 1424304 - RNA, 14 nt, Human
cgugggcauugucu

SEQ ID NO: 1424305 - RNA, 20 nt, Human
cgugggacggugcccaagcc

SEQ ID NO: 1424306 - RNA, 19 nt, Human
cgugggacggugcccaagc

SEQ ID NO: 1424307 - RNA, 16 nt, Human
cguugcccccauuucu

SEQ ID NO: 1424308 - RNA, 21 nt, Human
cguugcccccauuucugaggu

SEQ ID NO: 1424309 - RNA, 12 nt, Human
cguugcccccau

SEQ ID NO: 1424310 - RNA, 11 nt, Human
cguggggaggu

SEQ ID NO: 1424311 - RNA, 17 nt, Human
cgugggcucccugacug

SEQ ID NO: 1424312 - RNA, 21 nt, Human
cgugccaaguccagguccugg

SEQ ID NO: 1424313 - RNA, 23 nt, Human
cgugccaaguccagguccuggug

SEQ ID NO: 1424314 - RNA, 23 nt, Human
cgugcucuuuguuuugugucucu

SEQ ID NO: 1424315 - RNA, 22 nt, Human
cgugcucuuuguuuugugucuc

SEQ ID NO: 1424316 - RNA, 17 nt, Human
cgugcucuuuguuuugu

SEQ ID NO: 1424317 - RNA, 16 nt, Human
cgugcucuuuguuuug

SEQ ID NO: 1424318 - RNA, 14 nt, Human
cgugcucuuuguuu

SEQ ID NO: 1424319 - RNA, 19 nt, Human
cgugcucgccccagcaggu

SEQ ID NO: 1424320 - RNA, 18 nt, Human
cguggagagcuaggagca

SEQ ID NO: 1424321 - RNA, 19 nt, Human
cguggagagcuaggagcaa

SEQ ID NO: 1424322 - RNA, 15 nt, Human
cguggagagcuagga

SEQ ID NO: 1424323 - RNA, 21 nt, Human
cguggacugagugggaagccc

SEQ ID NO: 1424324 - RNA, 19 nt, Human
cguggacugagugggaagc

SEQ ID NO: 1424325 - RNA, 15 nt, Human
cguggacugaguggg

SEQ ID NO: 1424326 - RNA, 22 nt, Human
cguggaaugcccuucacuguca

SEQ ID NO: 1424327 - RNA, 12 nt, Human
cguggacaccug

SEQ ID NO: 1424328 - RNA, 13 nt, Human
cguggacaccugc

SEQ ID NO: 1424329 - RNA, 14 nt, Human
cguggacaccugcc

SEQ ID NO: 1424330 - RNA, 15 nt, Human
cguggacaccugccc

SEQ ID NO: 1424331 - RNA, 17 nt, Human
cguggacaccugcccug

SEQ ID NO: 1424332 - RNA, 18 nt, Human
cguggacaccugcccugc

SEQ ID NO: 1424333 - RNA, 19 nt, Human
cguggacaccugcccugcc

SEQ ID NO: 1424334 - RNA, 14 nt, Human
cuaaaagaaacuuu

SEQ ID NO: 1424335 - RNA, 16 nt, Human
cuaaaagauauaagug

SEQ ID NO: 1424336 - RNA, 13 nt, Human
cuaaaagaaacuu

SEQ ID NO: 1424337 - RNA, 17 nt, Human
cuaaaacucuuucggua

SEQ ID NO: 1424338 - RNA, 12 nt, Human
cuaaacauccau

SEQ ID NO: 1424339 - RNA, 23 nt, Human
cuaaacaucauucauuuuuguug

SEQ ID NO: 1424340 - RNA, 17 nt, Human
cuaaacacgugacacaa

SEQ ID NO: 1424341 - RNA, 18 nt, Human
cuaaacacgugacacaaa

SEQ ID NO: 1424342 - RNA, 16 nt, Human
cuaaacccaauccaaa

SEQ ID NO: 1424343 - RNA, 19 nt, Human
cuaaacccaauccaaaugg

SEQ ID NO: 1424344 - RNA, 15 nt, Human
cuaaacccaauccaa

SEQ ID NO: 1424345 - RNA, 13 nt, Human
cuaaacaucauuc

SEQ ID NO: 1424346 - RNA, 22 nt, Human
cguuuaagccaaaacaauguuu

SEQ ID NO: 1424347 - RNA, 18 nt, Human
cguuuaagccaaaacaau

SEQ ID NO: 1424348 - RNA, 17 nt, Human
cguuuaagccaaaacaa

SEQ ID NO: 1424349 - RNA, 16 nt, Human
cguuggagaagcccgu

SEQ ID NO: 1424350 - RNA, 16 nt, Human
cguuguccucagcccc

SEQ ID NO: 1424351 - RNA, 16 nt, Human
cuaaauggccucaugu

SEQ ID NO: 1424352 - RNA, 13 nt, Human
cuaaauggccuca

SEQ ID NO: 1424353 - RNA, 12 nt, Human
cuaaauggccuc

SEQ ID NO: 1424354 - RNA, 13 nt, Human
cuaaaugcccugc

SEQ ID NO: 1424355 - RNA, 18 nt, Human
cuaaauggaaccacucua

SEQ ID NO: 1424356 - RNA, 16 nt, Human
cuaaauggaaccacuc

SEQ ID NO: 1424357 - RNA, 17 nt, Human
cuaaauggaaccacucu

SEQ ID NO: 1424358 - RNA, 14 nt, Human
cuaaaugcccugcu

SEQ ID NO: 1424359 - RNA, 16 nt, Human
cuaaaugaauguuuac

SEQ ID NO: 1424360 - RNA, 15 nt, Human
cuaaauggaaccacu

SEQ ID NO: 1424361 - RNA, 20 nt, Human
cuaaaucuccaaaauaaaac

SEQ ID NO: 1424362 - RNA, 17 nt, Human
cuaaacggauuccaaag

SEQ ID NO: 1424363 - RNA, 16 nt, Human
cuaaacggauuccaaa

SEQ ID NO: 1424364 - RNA, 15 nt, Human
cuaaacggauuccaa

SEQ ID NO: 1424365 - RNA, 18 nt, Human
cuaaauauauuuuaagac

SEQ ID NO: 1424366 - RNA, 20 nt, Human
cuaaauauauuuuaagacga

SEQ ID NO: 1424367 - RNA, 20 nt, Human
cuaaauauuaugagaugcug

SEQ ID NO: 1424368 - RNA, 22 nt, Human
cuaaauauggacugcucaggaa

SEQ ID NO: 1424369 - RNA, 16 nt, Human
cuaaauauggacugcu

SEQ ID NO: 1424370 - RNA, 21 nt, Human
cuaaauccuuuacuguuaguc

SEQ ID NO: 1424371 - RNA, 17 nt, Human
cuaaauccuuuacuguu

SEQ ID NO: 1424372 - RNA, 23 nt, Human
cuaaauuauuuacugcaaaaaga

SEQ ID NO: 1424373 - RNA, 15 nt, Human
cuaaauuauuuacug

SEQ ID NO: 1424374 - RNA, 14 nt, Human
cuaaauuauuuacu

SEQ ID NO: 1424375 - RNA, 19 nt, Human
cuaaauggccucauguggc

SEQ ID NO: 1424376 - RNA, 17 nt, Human
cuaaauggccucaugug

SEQ ID NO: 1424377 - RNA, 21 nt, Human
cuaaaugugcaauagaaggug

SEQ ID NO: 1424378 - RNA, 18 nt, Human
cuaaaugugcaauagaag

SEQ ID NO: 1424379 - RNA, 22 nt, Human
cuaaauguaguucugcuccaga

SEQ ID NO: 1424380 - RNA, 17 nt, Human
cuaacacucagaagccu

SEQ ID NO: 1424381 - RNA, 16 nt, Human
cuaacacucagaagcc

SEQ ID NO: 1424382 - RNA, 23 nt, Human
cuaacacggugcucauuuuuucu

SEQ ID NO: 1424383 - RNA, 14 nt, Human
cuaacacccagucu

SEQ ID NO: 1424384 - RNA, 15 nt, Human
cuaacaaugacauuu

SEQ ID NO: 1424385 - RNA, 13 nt, Human
cuaacaaugacau

SEQ ID NO: 1424386 - RNA, 22 nt, Human
cuaacaaucagcuccuuccugg

SEQ ID NO: 1424387 - RNA, 23 nt, Human
cuaacacucagaagccugggggc

SEQ ID NO: 1424388 - RNA, 22 nt, Human
cuaacacucagaagccuggggg

SEQ ID NO: 1424389 - RNA, 20 nt, Human
cuaacacucagaagccuggg

SEQ ID NO: 1424390 - RNA, 19 nt, Human
cuaacacucagaagccugg

SEQ ID NO: 1424391 - RNA, 15 nt, Human
cuaacaugauuuggg

SEQ ID NO: 1424392 - RNA, 20 nt, Human
cuaugcaugguuucagcacu

SEQ ID NO: 1424393 - RNA, 19 nt, Human
cuaugcaugguuucagcac

SEQ ID NO: 1424394 - RNA, 20 nt, Human
cuaugacuugggcaccccca

SEQ ID NO: 1424395 - RNA, 23 nt, Human
cuaugacuugggcacccccagcc

SEQ ID NO: 1424396 - RNA, 16 nt, Human
cuaugacuugggcacc

SEQ ID NO: 1424397 - RNA, 21 nt, Human
cuaugaccucgcccuccacaa

SEQ ID NO: 1424398 - RNA, 11 nt, Human
cuaugcauuug

SEQ ID NO: 1424399 - RNA, 12 nt, Human
cuaugcauuuga

SEQ ID NO: 1424400 - RNA, 21 nt, Human
cuaugcauuugaaaauuuuga

SEQ ID NO: 1424401 - RNA, 17 nt, Human
cucaagcugcaucuaga

SEQ ID NO: 1424402 - RNA, 20 nt, Human
cucaagcucuuccuuacucc

SEQ ID NO: 1424403 - RNA, 17 nt, Human
cucaagcgauucuccug

SEQ ID NO: 1424404 - RNA, 16 nt, Human
cucaagcgauucuccu

SEQ ID NO: 1424405 - RNA, 16 nt, Human
cucaagaugaaggcaa

SEQ ID NO: 1424406 - RNA, 22 nt, Human
cucaagcccugcagucacagcu

SEQ ID NO: 1424407 - RNA, 23 nt, Human
cucaacugccuacuccaaaaugu

SEQ ID NO: 1424408 - RNA, 15 nt, Human
cucaacugccuacuc

SEQ ID NO: 1424409 - RNA, 13 nt, Human
cucaacugccuac

SEQ ID NO: 1424410 - RNA, 18 nt, Human
cucaacuagcagauacag

SEQ ID NO: 1424411 - RNA, 16 nt, Human
cucaaccuuaagaccu

SEQ ID NO: 1424412 - RNA, 18 nt, Human
cucaacguugcuccccau

SEQ ID NO: 1424413 - RNA, 16 nt, Human
cucaacguauuguuuc

SEQ ID NO: 1424414 - RNA, 15 nt, Human
cucaacguauuguuu

SEQ ID NO: 1424415 - RNA, 24 nt, Human
cucaaauguucuaaguuucuaaga

SEQ ID NO: 1424416 - RNA, 23 nt, Human
cucaaauguucuaaguuucuaag

SEQ ID NO: 1424417 - RNA, 22 nt, Human
cucaaauguucuaaguuucuaa

SEQ ID NO: 1424418 - RNA, 21 nt, Human
cucaaauguucuaaguuucua

SEQ ID NO: 1424419 - RNA, 19 nt, Human
cucaaauguucuaaguuuc

SEQ ID NO: 1424420 - RNA, 17 nt, Human
cucaaauguucuaaguu

SEQ ID NO: 1424421 - RNA, 16 nt, Human
cucaaauguucuaagu

SEQ ID NO: 1424422 - RNA, 15 nt, Human
cucaaauguucuaag

SEQ ID NO: 1424423 - RNA, 13 nt, Human
cucaaauguucua

SEQ ID NO: 1424424 - RNA, 21 nt, Human
cucaaauggggccagauccag

SEQ ID NO: 1424425 - RNA, 20 nt, Human
cucaaauggggccagaucca

SEQ ID NO: 1424426 - RNA, 19 nt, Human
cucaaauggggccagaucc

SEQ ID NO: 1424427 - RNA, 14 nt, Human
cucaaccucuacag

SEQ ID NO: 1424428 - RNA, 13 nt, Human
cucaaauuucuaa

SEQ ID NO: 1424429 - RNA, 23 nt, Human
cuaugcaugguuucagcacuagc

SEQ ID NO: 1424430 - RNA, 21 nt, Human
cuaugcaugguuucagcacua

SEQ ID NO: 1424431 - RNA, 14 nt, Human
cuaugcauuugaaa

SEQ ID NO: 1424432 - RNA, 17 nt, Human
cucaaauggggccagau

SEQ ID NO: 1424433 - RNA, 16 nt, Human
cucaaauggggccaga

SEQ ID NO: 1424434 - RNA, 15 nt, Human
cucaaauggggccag

SEQ ID NO: 1424435 - RNA, 19 nt, Human
cuauuuuguaaacucaaaa

SEQ ID NO: 1424436 - RNA, 12 nt, Human
cuauuuuguaaa

SEQ ID NO: 1424437 - RNA, 17 nt, Human
cuauuuuggauuguaua

SEQ ID NO: 1424438 - RNA, 21 nt, Human
cuauuuuccaggcuucugcug

SEQ ID NO: 1424439 - RNA, 23 nt, Human
cuauuuuccaggcuucugcuggg

SEQ ID NO: 1424440 - RNA, 19 nt, Human
cuauuuuccaggcuucugc

SEQ ID NO: 1424441 - RNA, 22 nt, Human
cuauuuucagaugugaaccauu

SEQ ID NO: 1424442 - RNA, 18 nt, Human
cuauuuucagaugugaac

SEQ ID NO: 1424443 - RNA, 12 nt, Human
cuauuuucagau

SEQ ID NO: 1424444 - RNA, 19 nt, Human
cuauuuguaaaucugccac

SEQ ID NO: 1424445 - RNA, 21 nt, Human
cuauuuguaaaucugccacaa

SEQ ID NO: 1424446 - RNA, 18 nt, Human
cuauuuguaaaucugcca

SEQ ID NO: 1424447 - RNA, 14 nt, Human
cuauuuguaaaucu

SEQ ID NO: 1424448 - RNA, 18 nt, Human
cuauuuuaauaaacacuc

SEQ ID NO: 1424449 - RNA, 16 nt, Human
cuauuuuauuaugaag

SEQ ID NO: 1424450 - RNA, 22 nt, Human
cuauuuuaauaaacacucuuga

SEQ ID NO: 1424451 - RNA, 17 nt, Human
cucacuauaccaguaua

SEQ ID NO: 1424452 - RNA, 23 nt, Human
cucacuaggcccccacuugccuc

SEQ ID NO: 1424453 - RNA, 21 nt, Human
cucacccccuucuccauccac

SEQ ID NO: 1424454 - RNA, 20 nt, Human
cucacccccuucuccaucca

SEQ ID NO: 1424455 - RNA, 19 nt, Human
cucacccccuucuccaucc

SEQ ID NO: 1424456 - RNA, 17 nt, Human
cucacccccuucuccau

SEQ ID NO: 1424457 - RNA, 16 nt, Human
cucacccccuucucca

SEQ ID NO: 1424458 - RNA, 15 nt, Human
cucacccccuucucc

SEQ ID NO: 1424459 - RNA, 14 nt, Human
cucacccccucacc

SEQ ID NO: 1424460 - RNA, 22 nt, Human
cucacccagugcccucuccccu

SEQ ID NO: 1424461 - RNA, 17 nt, Human
cucacccauccuagagg

SEQ ID NO: 1424462 - RNA, 15 nt, Human
cucacagugcuuuua

SEQ ID NO: 1424463 - RNA, 18 nt, Human
cucacagugggagccagg

SEQ ID NO: 1424464 - RNA, 22 nt, Human
cucacagugaacacucaguggc

SEQ ID NO: 1424465 - RNA, 19 nt, Human
cucacagugggagccaggg

SEQ ID NO: 1424466 - RNA, 22 nt, Human
cucacagugggagccagggcug

SEQ ID NO: 1424467 - RNA, 22 nt, Human
cucaaggacuuugcagccggca

SEQ ID NO: 1424468 - RNA, 16 nt, Human
cucaaggacuuugcag

SEQ ID NO: 1424469 - RNA, 22 nt, Human
cucacaugucaguaccuucaaa

SEQ ID NO: 1424470 - RNA, 14 nt, Human
cucacccagugccc

SEQ ID NO: 1424471 - RNA, 14 nt, Human
cucacccauccuag

SEQ ID NO: 1424472 - RNA, 15 nt, Human
cucacccauccuaga

SEQ ID NO: 1424473 - RNA, 16 nt, Human
cucacaucagagugac

SEQ ID NO: 1424474 - RNA, 13 nt, Human
cucacauuuauau

SEQ ID NO: 1424475 - RNA, 19 nt, Human
cuauauuguuugcuaagca

SEQ ID NO: 1424476 - RNA, 22 nt, Human
cuaguuauuuacaggaacuuca

SEQ ID NO: 1424477 - RNA, 20 nt, Human
cuaguuauuuacaggaacuu

SEQ ID NO: 1424478 - RNA, 23 nt, Human
cuaguuauacuuauuuguauaug

SEQ ID NO: 1424479 - RNA, 16 nt, Human
cuaguuauacuuauuu

SEQ ID NO: 1424480 - RNA, 20 nt, Human
cuaucaaccccagacacugg

SEQ ID NO: 1424481 - RNA, 19 nt, Human
cuaucaaccccagacacug

SEQ ID NO: 1424482 - RNA, 17 nt, Human
cuaucaaccccagacac

SEQ ID NO: 1424483 - RNA, 21 nt, Human
cuaucaaccccagacacuggu

SEQ ID NO: 1424484 - RNA, 15 nt, Human
cuaucuuaauacuaa

SEQ ID NO: 1424485 - RNA, 19 nt, Human
cuaucacccaacgcuccaa

SEQ ID NO: 1424486 - RNA, 16 nt, Human
cuaucacccaacgcuc

SEQ ID NO: 1424487 - RNA, 20 nt, Human
cuaucaaguauuauaccuuu

SEQ ID NO: 1424488 - RNA, 17 nt, Human
cuaugaauucuaaguga

SEQ ID NO: 1424489 - RNA, 14 nt, Human
cuaugacacaugca

SEQ ID NO: 1424490 - RNA, 18 nt, Human
cuaugaaauauuauguua

SEQ ID NO: 1424491 - RNA, 17 nt, Human
cuaugaaaaugcuggcu

SEQ ID NO: 1424492 - RNA, 21 nt, Human
cuaugaaaagcuagaauugag

SEQ ID NO: 1424493 - RNA, 16 nt, Human
cuaugaaaagcuagaa

SEQ ID NO: 1424494 - RNA, 21 nt, Human
cuaucuuugccacccucaugc

SEQ ID NO: 1424495 - RNA, 13 nt, Human
cuaugaaauauua

SEQ ID NO: 1424496 - RNA, 14 nt, Human
cuaucuuugccacc

SEQ ID NO: 1424497 - RNA, 15 nt, Human
cuaucuuugccaccc

SEQ ID NO: 1424498 - RNA, 18 nt, Human
cuaucuuugccacccuca

SEQ ID NO: 1424499 - RNA, 19 nt, Human
cuaucuuugccacccucau

SEQ ID NO: 1424500 - RNA, 18 nt, Human
cuaucuuacuauuucaca

SEQ ID NO: 1424501 - RNA, 12 nt, Human
cuaucuuugcca

SEQ ID NO: 1424502 - RNA, 16 nt, Human
cuagucuuuugcuuuu

SEQ ID NO: 1424503 - RNA, 15 nt, Human
cuagucuuuugcuuu

SEQ ID NO: 1424504 - RNA, 14 nt, Human
cuagucuuuugcuu

SEQ ID NO: 1424505 - RNA, 13 nt, Human
cuagucuuuugcu

SEQ ID NO: 1424506 - RNA, 12 nt, Human
cuaguccuuguu

SEQ ID NO: 1424507 - RNA, 14 nt, Human
cuagugugaauuaa

SEQ ID NO: 1424508 - RNA, 13 nt, Human
cuaguguagaauu

SEQ ID NO: 1424509 - RNA, 20 nt, Human
cuaguguagaauugugcaac

SEQ ID NO: 1424510 - RNA, 22 nt, Human
cuaguacuugggagaccuguaa

SEQ ID NO: 1424511 - RNA, 17 nt, Human
cuaggcccccacuugcc

SEQ ID NO: 1424512 - RNA, 16 nt, Human
cuaggcccccacuugc

SEQ ID NO: 1424513 - RNA, 15 nt, Human
cuaggcccccacuug

SEQ ID NO: 1424514 - RNA, 13 nt, Human
cuaggcccccacu

SEQ ID NO: 1424515 - RNA, 15 nt, Human
cuaggccagagccca

SEQ ID NO: 1424516 - RNA, 16 nt, Human
cuaggccagagcccac

SEQ ID NO: 1424517 - RNA, 14 nt, Human
cuaggccagagccc

SEQ ID NO: 1424518 - RNA, 22 nt, Human
cuaggcauucuggaccucuggg

SEQ ID NO: 1424519 - RNA, 21 nt, Human
cuaggcauucuggaccucugg

SEQ ID NO: 1424520 - RNA, 20 nt, Human
cuaggcauucuggaccucug

SEQ ID NO: 1424521 - RNA, 17 nt, Human
cuaggcauucuggaccu

SEQ ID NO: 1424522 - RNA, 14 nt, Human
cuaggcauucugga

SEQ ID NO: 1424523 - RNA, 20 nt, Human
cuaggcaguucaaagcagga

SEQ ID NO: 1424524 - RNA, 23 nt, Human
cuaguauuccagaccugaagaau

SEQ ID NO: 1424525 - RNA, 20 nt, Human
cuaguauuucuaugaaauau

SEQ ID NO: 1424526 - RNA, 19 nt, Human
cuaguauuucuaugaaaua

SEQ ID NO: 1424527 - RNA, 22 nt, Human
cuaguauuucuaugaaauauua

SEQ ID NO: 1424528 - RNA, 19 nt, Human
cuagcagcaccguucugug

SEQ ID NO: 1424529 - RNA, 12 nt, Human
cuagcagcaccg

SEQ ID NO: 1424530 - RNA, 21 nt, Human
cuagcagcaccguucugugca

SEQ ID NO: 1424531 - RNA, 20 nt, Human
cuagcagcaccguucugugc

SEQ ID NO: 1424532 - RNA, 15 nt, Human
cuaggaagaggagug

SEQ ID NO: 1424533 - RNA, 23 nt, Human
cuaggaagagcaggacuccaggc

SEQ ID NO: 1424534 - RNA, 19 nt, Human
cuaggaagagcaggacucc

SEQ ID NO: 1424535 - RNA, 22 nt, Human
cuagcagcaccguucugugcac

SEQ ID NO: 1424536 - RNA, 21 nt, Human
cuaggcacuguaguucuaaga

SEQ ID NO: 1424537 - RNA, 20 nt, Human
cuaggcacuguaguucuaag

SEQ ID NO: 1424538 - RNA, 19 nt, Human
cuaggcacuguaguucuaa

SEQ ID NO: 1424539 - RNA, 13 nt, Human
cuaggcaacauag

SEQ ID NO: 1424540 - RNA, 13 nt, Human
cuaggauucuaaa

SEQ ID NO: 1424541 - RNA, 13 nt, Human
cuaggauuucaug

SEQ ID NO: 1424542 - RNA, 22 nt, Human
cuaggaugugcauucuccagcc

SEQ ID NO: 1424543 - RNA, 16 nt, Human
cuaggaggguccucug

SEQ ID NO: 1424544 - RNA, 20 nt, Human
cuaggaggguccucugagac

SEQ ID NO: 1424545 - RNA, 15 nt, Human
cuaggaggguccucu

SEQ ID NO: 1424546 - RNA, 23 nt, Human
cuaggagcuuugacucaggagcc

SEQ ID NO: 1424547 - RNA, 23 nt, Human
cuaggagggagacacuggccccu

SEQ ID NO: 1424548 - RNA, 20 nt, Human
cuaggagcuuugacucagga

SEQ ID NO: 1424549 - RNA, 17 nt, Human
cuaggagcuuugacuca

SEQ ID NO: 1424550 - RNA, 18 nt, Human
cuaggagcaaagccuguu

SEQ ID NO: 1424551 - RNA, 20 nt, Human
cuaggagcaaagccuguuca

SEQ ID NO: 1424552 - RNA, 17 nt, Human
cuaggagcaaagccugu

SEQ ID NO: 1424553 - RNA, 16 nt, Human
cuaggagcaaagccug

SEQ ID NO: 1424554 - RNA, 15 nt, Human
cuaggagcaaagccu

SEQ ID NO: 1424555 - RNA, 13 nt, Human
cuaggagcaaagc

SEQ ID NO: 1424556 - RNA, 22 nt, Human
cuaggagggagacacuggcccc

SEQ ID NO: 1424557 - RNA, 18 nt, Human
cuaggagggagacacugg

SEQ ID NO: 1424558 - RNA, 13 nt, Human
cuaggagggagac

SEQ ID NO: 1424559 - RNA, 22 nt, Human
cuaggagcuuugacucaggagc

SEQ ID NO: 1424560 - RNA, 21 nt, Human
cuaggagcuuugacucaggag

SEQ ID NO: 1424561 - RNA, 17 nt, Human
cuaggaaugaaauccug

SEQ ID NO: 1424562 - RNA, 16 nt, Human
cuaggaaugaaauccu

SEQ ID NO: 1424563 - RNA, 15 nt, Human
cuaggaagccucaga

SEQ ID NO: 1424564 - RNA, 16 nt, Human
cuaggaagccucagau

SEQ ID NO: 1424565 - RNA, 14 nt, Human
cuaggaagccucag

SEQ ID NO: 1424566 - RNA, 16 nt, Human
cuaggaagaggagugg

SEQ ID NO: 1424567 - RNA, 23 nt, Human
cuaggaccaugguuaagagucca

SEQ ID NO: 1424568 - RNA, 21 nt, Human
cuaggaccaugguuaagaguc

SEQ ID NO: 1424569 - RNA, 23 nt, Human
cuaggagaaccaaaucuggaagc

SEQ ID NO: 1424570 - RNA, 21 nt, Human
cuaggagaaccaaaucuggaa

SEQ ID NO: 1424571 - RNA, 18 nt, Human
cuaggagaaccaaaucug

SEQ ID NO: 1424572 - RNA, 22 nt, Human
cuaggacugaauuaugaaacuu

SEQ ID NO: 1424573 - RNA, 20 nt, Human
cuagagucugaacagcugua

SEQ ID NO: 1424574 - RNA, 19 nt, Human
cuagagucugaacagcugu

SEQ ID NO: 1424575 - RNA, 16 nt, Human
cuagagucugaacagc

SEQ ID NO: 1424576 - RNA, 21 nt, Human
cuagagucccagguuggcucu

SEQ ID NO: 1424577 - RNA, 23 nt, Human
cuagaguccaagguuuaaagagu

SEQ ID NO: 1424578 - RNA, 20 nt, Human
cuagaguccaagguuuaaag

SEQ ID NO: 1424579 - RNA, 15 nt, Human
cuagaguccaagguu

SEQ ID NO: 1424580 - RNA, 19 nt, Human
cuagaggugagaaauuuaa

SEQ ID NO: 1424581 - RNA, 17 nt, Human
cuagaggugagaaauuu

SEQ ID NO: 1424582 - RNA, 15 nt, Human
cuagaggugagaaau

SEQ ID NO: 1424583 - RNA, 15 nt, Human
cuagagguucaaaga

SEQ ID NO: 1424584 - RNA, 16 nt, Human
cuagaggaagcagcca

SEQ ID NO: 1424585 - RNA, 20 nt, Human
cuagagcuccucccucucaa

SEQ ID NO: 1424586 - RNA, 19 nt, Human
cuagagcuccucccucuca

SEQ ID NO: 1424587 - RNA, 17 nt, Human
cuagagcuccucccucu

SEQ ID NO: 1424588 - RNA, 15 nt, Human
cuagagcuccucccu

SEQ ID NO: 1424589 - RNA, 13 nt, Human
cuagagcuccucc

SEQ ID NO: 1424590 - RNA, 12 nt, Human
cuagagcuccuc

SEQ ID NO: 1424591 - RNA, 11 nt, Human
cuagagcuccu

SEQ ID NO: 1424592 - RNA, 17 nt, Human
cuagaccuccagcuguu

SEQ ID NO: 1424593 - RNA, 16 nt, Human
cuagaccuccagcugu

SEQ ID NO: 1424594 - RNA, 21 nt, Human
cuacuuugauaugacuguuuu

SEQ ID NO: 1424595 - RNA, 17 nt, Human
cuacuuugauaugacug

SEQ ID NO: 1424596 - RNA, 23 nt, Human
cuagauguuuauucuucuagagu

SEQ ID NO: 1424597 - RNA, 21 nt, Human
cuagauguuuauucuucuaga

SEQ ID NO: 1424598 - RNA, 21 nt, Human
cuagauguauaacuaggagcu

SEQ ID NO: 1424599 - RNA, 23 nt, Human
cuagauguaguauuuuuuguaua

SEQ ID NO: 1424600 - RNA, 22 nt, Human
cuagauguaguauuuuuuguau

SEQ ID NO: 1424601 - RNA, 20 nt, Human
cuagauguaguauuuuuugu

SEQ ID NO: 1424602 - RNA, 16 nt, Human
cuagauguaguauuuu

SEQ ID NO: 1424603 - RNA, 18 nt, Human
cuagauggaccugccugc

SEQ ID NO: 1424604 - RNA, 16 nt, Human
cuagauggaccugccu

SEQ ID NO: 1424605 - RNA, 13 nt, Human
cuagauggaccug

SEQ ID NO: 1424606 - RNA, 22 nt, Human
cuagaugauuaaauaagauucu

SEQ ID NO: 1424607 - RNA, 23 nt, Human
cuagaugauuaaauaagauucua

SEQ ID NO: 1424608 - RNA, 21 nt, Human
cuagaugauuaaauaagauuc

SEQ ID NO: 1424609 - RNA, 20 nt, Human
cuagaugauuaaauaagauu

SEQ ID NO: 1424610 - RNA, 17 nt, Human
cuagauccuaagggucg

SEQ ID NO: 1424611 - RNA, 17 nt, Human
cuagaugaaguuuuaca

SEQ ID NO: 1424612 - RNA, 16 nt, Human
cuagauccuaaggguc

SEQ ID NO: 1424613 - RNA, 15 nt, Human
cuagauccuaagggu

SEQ ID NO: 1424614 - RNA, 22 nt, Human
cuagaucauaaggcuucaaaau

SEQ ID NO: 1424615 - RNA, 18 nt, Human
cuagaucauaaggcuuca

SEQ ID NO: 1424616 - RNA, 17 nt, Human
cuagaucauaaggcuuc

SEQ ID NO: 1424617 - RNA, 15 nt, Human
cuagaucauaaggcu

SEQ ID NO: 1424618 - RNA, 20 nt, Human
cuagaucagaugcuccaaga

SEQ ID NO: 1424619 - RNA, 18 nt, Human
cuagaucagaugcuccaa

SEQ ID NO: 1424620 - RNA, 15 nt, Human
cuagaucagaugcuc

SEQ ID NO: 1424621 - RNA, 18 nt, Human
cuagauuuaauauaaagu

SEQ ID NO: 1424622 - RNA, 14 nt, Human
cuagauuuaauaua

SEQ ID NO: 1424623 - RNA, 12 nt, Human
cuagauuuaaua

SEQ ID NO: 1424624 - RNA, 21 nt, Human
cuagauugcuaaggagcugau

SEQ ID NO: 1424625 - RNA, 24 nt, Human
cuagauugagagaagagacaaaca

SEQ ID NO: 1424626 - RNA, 23 nt, Human
cuagauuccauugguccaagauu

SEQ ID NO: 1424627 - RNA, 22 nt, Human
cuagauuccauugguccaagau

SEQ ID NO: 1424628 - RNA, 14 nt, Human
cuagauucagggaa

SEQ ID NO: 1424629 - RNA, 21 nt, Human
cuagauucaaagguucuaggu

SEQ ID NO: 1424630 - RNA, 20 nt, Human
cuagauucaaagguucuagg

SEQ ID NO: 1424631 - RNA, 18 nt, Human
cuagauucaaagguucua

SEQ ID NO: 1424632 - RNA, 17 nt, Human
cuagauucaaagguucu

SEQ ID NO: 1424633 - RNA, 16 nt, Human
cuagauucaaagguuc

SEQ ID NO: 1424634 - RNA, 15 nt, Human
cuagauucaaagguu

SEQ ID NO: 1424635 - RNA, 14 nt, Human
cuagauucaaaggu

SEQ ID NO: 1424636 - RNA, 12 nt, Human
cuagauucaaag

SEQ ID NO: 1424637 - RNA, 22 nt, Human
cuagauguuuauucuucuagag

SEQ ID NO: 1424638 - RNA, 14 nt, Human
cuagcacagauggc

SEQ ID NO: 1424639 - RNA, 17 nt, Human
cuagcaaaagugcaaga

SEQ ID NO: 1424640 - RNA, 16 nt, Human
cuagcaaaagugcaag

SEQ ID NO: 1424641 - RNA, 15 nt, Human
cuacccuaaccaagu

SEQ ID NO: 1424642 - RNA, 15 nt, Human
cuacugaaugucauu

SEQ ID NO: 1424643 - RNA, 14 nt, Human
cuacugaagcccuu

SEQ ID NO: 1424644 - RNA, 13 nt, Human
cuacugaagcccu

SEQ ID NO: 1424645 - RNA, 22 nt, Human
cuacugacggaguccuguguuu

SEQ ID NO: 1424646 - RNA, 20 nt, Human
cuacugacauguggggccag

SEQ ID NO: 1424647 - RNA, 15 nt, Human
cuacugacauguggg

SEQ ID NO: 1424648 - RNA, 14 nt, Human
cuacugacaugugg

SEQ ID NO: 1424649 - RNA, 21 nt, Human
cuacuguaaggcaaucauggu

SEQ ID NO: 1424650 - RNA, 16 nt, Human
cuacuguaauuuguga

SEQ ID NO: 1424651 - RNA, 17 nt, Human
cuacuguaauuugugau

SEQ ID NO: 1424652 - RNA, 20 nt, Human
cuacuuccuccuccccacuu

SEQ ID NO: 1424653 - RNA, 19 nt, Human
cuacuuccuccuccccacu

SEQ ID NO: 1424654 - RNA, 17 nt, Human
cuacuuccuccucccca

SEQ ID NO: 1424655 - RNA, 18 nt, Human
cuacuucuguaauugugu

SEQ ID NO: 1424656 - RNA, 17 nt, Human
cuacuucuguaauugug

SEQ ID NO: 1424657 - RNA, 17 nt, Human
cuacuucggggcuggga

SEQ ID NO: 1424658 - RNA, 13 nt, Human
cuacuuccuccuc

SEQ ID NO: 1424659 - RNA, 23 nt, Human
cuacuuccccauggcccugagcg

SEQ ID NO: 1424660 - RNA, 22 nt, Human
cuacuuccccauggcccugagc

SEQ ID NO: 1424661 - RNA, 16 nt, Human
cuacuguguuaugcaa

SEQ ID NO: 1424662 - RNA, 20 nt, Human
cuacugugugugugaaugaa

SEQ ID NO: 1424663 - RNA, 19 nt, Human
cuacugugugugugaauga

SEQ ID NO: 1424664 - RNA, 17 nt, Human
cuacugugugugugaau

SEQ ID NO: 1424665 - RNA, 15 nt, Human
cuacuguguguguga

SEQ ID NO: 1424666 - RNA, 23 nt, Human
cuacuguguuaugcaaaagcaag

SEQ ID NO: 1424667 - RNA, 19 nt, Human
cuacuuccaaacuaauuuu

SEQ ID NO: 1424668 - RNA, 16 nt, Human
cuacuuccaaacuaau

SEQ ID NO: 1424669 - RNA, 22 nt, Human
cuacuuauuguagcauccugga

SEQ ID NO: 1424670 - RNA, 21 nt, Human
cuacuuugacuuuuugcauuu

SEQ ID NO: 1424671 - RNA, 20 nt, Human
cuacuuugacuuuuugcauu

SEQ ID NO: 1424672 - RNA, 19 nt, Human
cuacuuugacuuuuugcau

SEQ ID NO: 1424673 - RNA, 18 nt, Human
cuacuuugacuuuuugca

SEQ ID NO: 1424674 - RNA, 18 nt, Human
cuacuuuauaacuaacau

SEQ ID NO: 1424675 - RNA, 14 nt, Human
cuacuuuauaacua

SEQ ID NO: 1424676 - RNA, 19 nt, Human
cuacuuuauaacuaacaug

SEQ ID NO: 1424677 - RNA, 22 nt, Human
cuacuuucugugucuauggauu

SEQ ID NO: 1424678 - RNA, 14 nt, Human
cuacuugcucaggu

SEQ ID NO: 1424679 - RNA, 22 nt, Human
cuacuucuuuugcucuuagcug

SEQ ID NO: 1424680 - RNA, 23 nt, Human
cuacuucuuuuuucaaaagaaag

SEQ ID NO: 1424681 - RNA, 21 nt, Human
cuacuguaauuugugauacaa

SEQ ID NO: 1424682 - RNA, 19 nt, Human
cuaagccagcaccggacca

SEQ ID NO: 1424683 - RNA, 14 nt, Human
cuaagcaucuaagu

SEQ ID NO: 1424684 - RNA, 15 nt, Human
cuaagcaucuaaguu

SEQ ID NO: 1424685 - RNA, 13 nt, Human
cuaagcaucuaag

SEQ ID NO: 1424686 - RNA, 21 nt, Human
cuaagcauaaaagaugaaaga

SEQ ID NO: 1424687 - RNA, 22 nt, Human
cuaagcagaaagugccuuucag

SEQ ID NO: 1424688 - RNA, 23 nt, Human
cuaagcagaaagugccuuucagg

SEQ ID NO: 1424689 - RNA, 21 nt, Human
cuaagcagaaagugccuuuca

SEQ ID NO: 1424690 - RNA, 19 nt, Human
cuaagcagaaagugccuuu

SEQ ID NO: 1424691 - RNA, 18 nt, Human
cuaagcagaaagugccuu

SEQ ID NO: 1424692 - RNA, 17 nt, Human
cuaagcagaaagugccu

SEQ ID NO: 1424693 - RNA, 16 nt, Human
cuaagcagaaagugcc

SEQ ID NO: 1424694 - RNA, 15 nt, Human
cuaagcagaaagugc

SEQ ID NO: 1424695 - RNA, 14 nt, Human
cuaagcagaaagug

SEQ ID NO: 1424696 - RNA, 13 nt, Human
cuaagcagaaagu

SEQ ID NO: 1424697 - RNA, 23 nt, Human
cuaagcacgggccauaugaauaa

SEQ ID NO: 1424698 - RNA, 16 nt, Human
cuaagcaacuaggccu

SEQ ID NO: 1424699 - RNA, 19 nt, Human
cuaagauucugauuuuagg

SEQ ID NO: 1424700 - RNA, 20 nt, Human
cuaagcacgggccauaugaa

SEQ ID NO: 1424701 - RNA, 18 nt, Human
cuaagauucugauuuuag

SEQ ID NO: 1424702 - RNA, 12 nt, Human
cuaagauucuga

SEQ ID NO: 1424703 - RNA, 11 nt, Human
cuaagauucug

SEQ ID NO: 1424704 - RNA, 22 nt, Human
cuaagauucuagaucagaugcu

SEQ ID NO: 1424705 - RNA, 18 nt, Human
cuaagauucuagaucaga

SEQ ID NO: 1424706 - RNA, 16 nt, Human
cuaagauucuagauca

SEQ ID NO: 1424707 - RNA, 15 nt, Human
cuaagauucuagauc

SEQ ID NO: 1424708 - RNA, 14 nt, Human
cuaagauucuagau

SEQ ID NO: 1424709 - RNA, 13 nt, Human
cuaagauucuaga

SEQ ID NO: 1424710 - RNA, 12 nt, Human
cuaagauucuag

SEQ ID NO: 1424711 - RNA, 21 nt, Human
cuaagauucuaaugaugauca

SEQ ID NO: 1424712 - RNA, 15 nt, Human
cuaagauucuaauga

SEQ ID NO: 1424713 - RNA, 13 nt, Human
cuaagauucuaau

SEQ ID NO: 1424714 - RNA, 18 nt, Human
cuaagauucuaaaggucc

SEQ ID NO: 1424715 - RNA, 17 nt, Human
cuaaccagcagaaaugc

SEQ ID NO: 1424716 - RNA, 17 nt, Human
cuaacauguccugccua

SEQ ID NO: 1424717 - RNA, 16 nt, Human
cuaaccagcagaaaug

SEQ ID NO: 1424718 - RNA, 21 nt, Human
cuaaggcucugagagucuaga

SEQ ID NO: 1424719 - RNA, 20 nt, Human
cuaaggcucugagagucuag

SEQ ID NO: 1424720 - RNA, 23 nt, Human
cuaaggcucugagagucuagauu

SEQ ID NO: 1424721 - RNA, 22 nt, Human
cuaaggcucugagagucuagau

SEQ ID NO: 1424722 - RNA, 23 nt, Human
cuaaggaguguagcaacuacagu

SEQ ID NO: 1424723 - RNA, 23 nt, Human
cuaagggucgaaagcucuagaau

SEQ ID NO: 1424724 - RNA, 21 nt, Human
cuaagggucgaaagcucuaga

SEQ ID NO: 1424725 - RNA, 19 nt, Human
cuaagggucgaaagcucua

SEQ ID NO: 1424726 - RNA, 18 nt, Human
cuaagggucgaaagcucu

SEQ ID NO: 1424727 - RNA, 17 nt, Human
cuaagggucgaaagcuc

SEQ ID NO: 1424728 - RNA, 22 nt, Human
cuaagguccgguguucuaagau

SEQ ID NO: 1424729 - RNA, 21 nt, Human
cuaagguccgguguucuaaga

SEQ ID NO: 1424730 - RNA, 20 nt, Human
cuaagguccgguguucuaag

SEQ ID NO: 1424731 - RNA, 19 nt, Human
cuaagguccgguguucuaa

SEQ ID NO: 1424732 - RNA, 22 nt, Human
cuaagggucgaaagcucuagaa

SEQ ID NO: 1424733 - RNA, 14 nt, Human
cuaagcuaggaaug

SEQ ID NO: 1424734 - RNA, 23 nt, Human
cuaagcgcuagaggaagcagcca

SEQ ID NO: 1424735 - RNA, 15 nt, Human
cuaagccccagcaag

SEQ ID NO: 1424736 - RNA, 16 nt, Human
cuaagccccagcaagc

SEQ ID NO: 1424737 - RNA, 17 nt, Human
cuaagccccagcaagca

SEQ ID NO: 1424738 - RNA, 19 nt, Human
cuaagccccagcaagcaau

SEQ ID NO: 1424739 - RNA, 22 nt, Human
cuaagcuaggaaugaaauccug

SEQ ID NO: 1424740 - RNA, 17 nt, Human
cuaagcuaggaaugaaa

SEQ ID NO: 1424741 - RNA, 23 nt, Human
cuaaggucuuggaacuugccugc

SEQ ID NO: 1424742 - RNA, 21 nt, Human
cuaaggucuuggaacuugccu

SEQ ID NO: 1424743 - RNA, 12 nt, Human
cuaauaaagcug

SEQ ID NO: 1424744 - RNA, 17 nt, Human
cuaauauuuuccuccug

SEQ ID NO: 1424745 - RNA, 13 nt, Human
cuaauauuuuccu

SEQ ID NO: 1424746 - RNA, 21 nt, Human
cuaauaaacuaauaauugcag

SEQ ID NO: 1424747 - RNA, 19 nt, Human
cuaauaaacuaauaauugc

SEQ ID NO: 1424748 - RNA, 18 nt, Human
cuaauaaacuaauaauug

SEQ ID NO: 1424749 - RNA, 13 nt, Human
cuaauaaagcugu

SEQ ID NO: 1424750 - RNA, 17 nt, Human
cuaauaaacuaauaauu

SEQ ID NO: 1424751 - RNA, 15 nt, Human
cuaauaaacuaauaa

SEQ ID NO: 1424752 - RNA, 12 nt, Human
cuaagguucuaa

SEQ ID NO: 1424753 - RNA, 11 nt, Human
cuaagguucua

SEQ ID NO: 1424754 - RNA, 14 nt, Human
cuaauaaagcugug

SEQ ID NO: 1424755 - RNA, 20 nt, Human
cuaauccccuucuccccugc

SEQ ID NO: 1424756 - RNA, 18 nt, Human
cuaauccccuucuccccu

SEQ ID NO: 1424757 - RNA, 16 nt, Human
cuaauccccuucuccc

SEQ ID NO: 1424758 - RNA, 15 nt, Human
cuaauccccuucucc

SEQ ID NO: 1424759 - RNA, 18 nt, Human
cuaaucccgauucacccu

SEQ ID NO: 1424760 - RNA, 23 nt, Human
cuaauccaggcagauccaggacu

SEQ ID NO: 1424761 - RNA, 20 nt, Human
cuaauccaggcagauccagg

SEQ ID NO: 1424762 - RNA, 19 nt, Human
cuaauccaggcagauccag

SEQ ID NO: 1424763 - RNA, 18 nt, Human
cuaauccaggcagaucca

SEQ ID NO: 1424764 - RNA, 17 nt, Human
cuaauccaggcagaucc

SEQ ID NO: 1424765 - RNA, 20 nt, Human
cuaaucucuguaaagcuaaa

SEQ ID NO: 1424766 - RNA, 14 nt, Human
cuaaucucuguaaa

SEQ ID NO: 1424767 - RNA, 20 nt, Human
cuaaucuauggucgggagac

SEQ ID NO: 1424768 - RNA, 18 nt, Human
cuaaucuauggucgggag

SEQ ID NO: 1424769 - RNA, 19 nt, Human
cuaaucuagauaucgacuu

SEQ ID NO: 1424770 - RNA, 16 nt, Human
cuaaucuacuuucugu

SEQ ID NO: 1424771 - RNA, 21 nt, Human
cuaaucuuauucauuuucucu

SEQ ID NO: 1424772 - RNA, 19 nt, Human
cuaaucuuauucauuuucu

SEQ ID NO: 1424773 - RNA, 18 nt, Human
cuaaucuuauucauuuuc

SEQ ID NO: 1424774 - RNA, 17 nt, Human
cuaaucuuauucauuuu

SEQ ID NO: 1424775 - RNA, 19 nt, Human
cuacaagcuaaaauuagau

SEQ ID NO: 1424776 - RNA, 17 nt, Human
cuacaagcuaaaauuag

SEQ ID NO: 1424777 - RNA, 19 nt, Human
cuaauuaauuguaaucuga

SEQ ID NO: 1424778 - RNA, 17 nt, Human
cuaauuaauuguaaucu

SEQ ID NO: 1424779 - RNA, 23 nt, Human
cuaauguggaccuuagaauacag

SEQ ID NO: 1424780 - RNA, 15 nt, Human
cuacagagaaaccag

SEQ ID NO: 1424781 - RNA, 14 nt, Human
cuacagagaaacca

SEQ ID NO: 1424782 - RNA, 12 nt, Human
cuacagagaaac

SEQ ID NO: 1424783 - RNA, 11 nt, Human
cuacagagaaa

SEQ ID NO: 1424784 - RNA, 10 nt, Human
cuacagagaa

SEQ ID NO: 1424785 - RNA, 19 nt, Human
cuacagaacuucagaaaga

SEQ ID NO: 1424786 - RNA, 20 nt, Human
cuacagaacuucagaaagac

SEQ ID NO: 1424787 - RNA, 17 nt, Human
cuacagaacuucagaaa

SEQ ID NO: 1424788 - RNA, 17 nt, Human
cuacagaaaaaccuugg

SEQ ID NO: 1424789 - RNA, 20 nt, Human
cuacagaaaaaccuuggguu

SEQ ID NO: 1424790 - RNA, 16 nt, Human
cuacagaaaaaccuug

SEQ ID NO: 1424791 - RNA, 15 nt, Human
cuacagaaaaaccuu

SEQ ID NO: 1424792 - RNA, 14 nt, Human
cuacagaaaaaccu

SEQ ID NO: 1424793 - RNA, 13 nt, Human
cuacagaaaaacc

SEQ ID NO: 1424794 - RNA, 12 nt, Human
cuacagaaaaac

SEQ ID NO: 1424795 - RNA, 23 nt, Human
cuacagagaagccuucaagcucu

SEQ ID NO: 1424796 - RNA, 15 nt, Human
cuacagagaagccuu

SEQ ID NO: 1424797 - RNA, 14 nt, Human
cuacagagaagccu

SEQ ID NO: 1424798 - RNA, 13 nt, Human
cuacagagaagcc

SEQ ID NO: 1424799 - RNA, 12 nt, Human
cuacagagaagc

SEQ ID NO: 1424800 - RNA, 11 nt, Human
cuacagagaag

SEQ ID NO: 1424801 - RNA, 21 nt, Human
cuacagagaaaccagcuuccu

SEQ ID NO: 1424802 - RNA, 20 nt, Human
cuacagagaaaccagcuucc

SEQ ID NO: 1424803 - RNA, 19 nt, Human
cuacagagaaaccagcuuc

SEQ ID NO: 1424804 - RNA, 18 nt, Human
cuacagagaaaccagcuu

SEQ ID NO: 1424805 - RNA, 17 nt, Human
cuacagagaaaccagcu

SEQ ID NO: 1424806 - RNA, 16 nt, Human
cuacagagaaaccagc

SEQ ID NO: 1424807 - RNA, 18 nt, Human
cuacagagcuucccugac

SEQ ID NO: 1424808 - RNA, 17 nt, Human
cuacagagcuucccuga

SEQ ID NO: 1424809 - RNA, 16 nt, Human
cuacagagcuucccug

SEQ ID NO: 1424810 - RNA, 17 nt, Human
cuacagagaagccuuca

SEQ ID NO: 1424811 - RNA, 16 nt, Human
cuacagagaagccuuc

SEQ ID NO: 1424812 - RNA, 21 nt, Human
cuacacacugcauguuuguga

SEQ ID NO: 1424813 - RNA, 12 nt, Human
cuacacacccug

SEQ ID NO: 1424814 - RNA, 16 nt, Human
cuacaauucauugugu

SEQ ID NO: 1424815 - RNA, 13 nt, Human
cuacacacugcau

SEQ ID NO: 1424816 - RNA, 15 nt, Human
cuacacacugcaugu

SEQ ID NO: 1424817 - RNA, 20 nt, Human
cuaccccgcagacaccuugg

SEQ ID NO: 1424818 - RNA, 15 nt, Human
cuaccccgcagacac

SEQ ID NO: 1424819 - RNA, 14 nt, Human
cuacccccugugcc

SEQ ID NO: 1424820 - RNA, 13 nt, Human
cuacccccugugc

SEQ ID NO: 1424821 - RNA, 15 nt, Human
cuacccgcagaguuc

SEQ ID NO: 1424822 - RNA, 22 nt, Human
cuacagagaagccuucaagcuc

SEQ ID NO: 1424823 - RNA, 20 nt, Human
cuacagagcuucccugacuc

SEQ ID NO: 1424824 - RNA, 20 nt, Human
cuaccaguauuuagaagcca

SEQ ID NO: 1424825 - RNA, 19 nt, Human
cuaccaguauuuagaagcc

SEQ ID NO: 1424826 - RNA, 13 nt, Human
cuaccaguauuua

SEQ ID NO: 1424827 - RNA, 22 nt, Human
cuaccaggucaaaauagugcca

SEQ ID NO: 1424828 - RNA, 12 nt, Human
cuaccaggaaag

SEQ ID NO: 1424829 - RNA, 14 nt, Human
cuccccagggaagc

SEQ ID NO: 1424830 - RNA, 15 nt, Human
cuccccagcucccag

SEQ ID NO: 1424831 - RNA, 16 nt, Human
cuccccagcucccagg

SEQ ID NO: 1424832 - RNA, 14 nt, Human
cuccccagcuccca

SEQ ID NO: 1424833 - RNA, 18 nt, Human
cuccccagggaagcagca

SEQ ID NO: 1424834 - RNA, 21 nt, Human
cuccccacucugcucugaugc

SEQ ID NO: 1424835 - RNA, 15 nt, Human
cuccccaacccccaa

SEQ ID NO: 1424836 - RNA, 16 nt, Human
cucccauuuuggaauu

SEQ ID NO: 1424837 - RNA, 23 nt, Human
cuccccaacugaccaccuuuguu

SEQ ID NO: 1424838 - RNA, 20 nt, Human
cuccccaacugaccaccuuu

SEQ ID NO: 1424839 - RNA, 22 nt, Human
cuccccacucugcucugaugca

SEQ ID NO: 1424840 - RNA, 20 nt, Human
cuccccacucugcucugaug

SEQ ID NO: 1424841 - RNA, 20 nt, Human
cucccggagguugggugggc

SEQ ID NO: 1424842 - RNA, 19 nt, Human
cucccggagguuggguggg

SEQ ID NO: 1424843 - RNA, 22 nt, Human
cucccggaauuccgucaccacg

SEQ ID NO: 1424844 - RNA, 19 nt, Human
cucccuauuaaccuagaga

SEQ ID NO: 1424845 - RNA, 18 nt, Human
cucccuauacugcuugga

SEQ ID NO: 1424846 - RNA, 21 nt, Human
cucccuauacugcuuggagcu

SEQ ID NO: 1424847 - RNA, 17 nt, Human
cucccuaguuccuucau

SEQ ID NO: 1424848 - RNA, 13 nt, Human
cucccuacccuaa

SEQ ID NO: 1424849 - RNA, 21 nt, Human
cucccaggguuuuaacuuugu

SEQ ID NO: 1424850 - RNA, 22 nt, Human
cucccaggguuuuaacuuuguu

SEQ ID NO: 1424851 - RNA, 20 nt, Human
cucccaggguuuuaacuuug

SEQ ID NO: 1424852 - RNA, 16 nt, Human
cucccaggguuuuaac

SEQ ID NO: 1424853 - RNA, 15 nt, Human
cucccaggguuuuaa

SEQ ID NO: 1424854 - RNA, 12 nt, Human
cucccaggguuu

SEQ ID NO: 1424855 - RNA, 21 nt, Human
cucccaggggcucccuccgcc

SEQ ID NO: 1424856 - RNA, 19 nt, Human
cucccaggggcucccuccg

SEQ ID NO: 1424857 - RNA, 22 nt, Human
cucccaaagugcugggauuaca

SEQ ID NO: 1424858 - RNA, 22 nt, Human
cucccaggggcucccuccgccc

SEQ ID NO: 1424859 - RNA, 18 nt, Human
cucccaggggcucccucc

SEQ ID NO: 1424860 - RNA, 17 nt, Human
cucccaggggcucccuc

SEQ ID NO: 1424861 - RNA, 16 nt, Human
cucccaggggcucccu

SEQ ID NO: 1424862 - RNA, 21 nt, Human
cucccaaagugcugggauuaa

SEQ ID NO: 1424863 - RNA, 22 nt, Human
cucccaagcaccugggauuaca

SEQ ID NO: 1424864 - RNA, 22 nt, Human
cuccauccuacccccugugccu

SEQ ID NO: 1424865 - RNA, 20 nt, Human
cuccauccuacccccugugc

SEQ ID NO: 1424866 - RNA, 23 nt, Human
cuccauccuacccccugugccuu

SEQ ID NO: 1424867 - RNA, 18 nt, Human
cuccauccuacccccugu

SEQ ID NO: 1424868 - RNA, 23 nt, Human
cuccaucugguagaagggaaagc

SEQ ID NO: 1424869 - RNA, 15 nt, Human
cuccaucugguagaa

SEQ ID NO: 1424870 - RNA, 14 nt, Human
cuccaucugguaga

SEQ ID NO: 1424871 - RNA, 20 nt, Human
cuccauggcccugccaugcu

SEQ ID NO: 1424872 - RNA, 15 nt, Human
cuccugcagccccag

SEQ ID NO: 1424873 - RNA, 14 nt, Human
cuccugcagaccac

SEQ ID NO: 1424874 - RNA, 17 nt, Human
cuccugcacuuacuugc

SEQ ID NO: 1424875 - RNA, 15 nt, Human
cuccugcacuuacuu

SEQ ID NO: 1424876 - RNA, 16 nt, Human
cuccugagugcuugcu

SEQ ID NO: 1424877 - RNA, 19 nt, Human
cuccugagugcuugcuuuu

SEQ ID NO: 1424878 - RNA, 23 nt, Human
cuccucuccccagcccagagaca

SEQ ID NO: 1424879 - RNA, 22 nt, Human
cuccucuccccagcccagagac

SEQ ID NO: 1424880 - RNA, 21 nt, Human
cuccucuccccagcccagaga

SEQ ID NO: 1424881 - RNA, 20 nt, Human
cuccucuccccagcccagag

SEQ ID NO: 1424882 - RNA, 19 nt, Human
cuccucuccccagcccaga

SEQ ID NO: 1424883 - RNA, 18 nt, Human
cuccucuccccagcccag

SEQ ID NO: 1424884 - RNA, 17 nt, Human
cuccucuccccagccca

SEQ ID NO: 1424885 - RNA, 22 nt, Human
cuccugcacuuacuugcuuauu

SEQ ID NO: 1424886 - RNA, 20 nt, Human
cuccugcacuuacuugcuua

SEQ ID NO: 1424887 - RNA, 19 nt, Human
cuccugcacuuacuugcuu

SEQ ID NO: 1424888 - RNA, 18 nt, Human
cuccugcacuuacuugcu

SEQ ID NO: 1424889 - RNA, 20 nt, Human
cuccuguggccccacccugg

SEQ ID NO: 1424890 - RNA, 19 nt, Human
cuccuguggccccacccug

SEQ ID NO: 1424891 - RNA, 13 nt, Human
cuccuguggcccc

SEQ ID NO: 1424892 - RNA, 22 nt, Human
cuccugugcucagcccugagga

SEQ ID NO: 1424893 - RNA, 20 nt, Human
cuccugugcucagcccugag

SEQ ID NO: 1424894 - RNA, 19 nt, Human
cuccugugcucagcccuga

SEQ ID NO: 1424895 - RNA, 17 nt, Human
cuccugugcucagcccu

SEQ ID NO: 1424896 - RNA, 16 nt, Human
cuccugugcucagccc

SEQ ID NO: 1424897 - RNA, 14 nt, Human
cuccugugcucagc

SEQ ID NO: 1424898 - RNA, 11 nt, Human
cuccugugacc

SEQ ID NO: 1424899 - RNA, 19 nt, Human
cuccugugggagccucgca

SEQ ID NO: 1424900 - RNA, 18 nt, Human
cuccugugggagccucgc

SEQ ID NO: 1424901 - RNA, 17 nt, Human
cuccugugggagccucg

SEQ ID NO: 1424902 - RNA, 16 nt, Human
cuccugugggagccuc

SEQ ID NO: 1424903 - RNA, 15 nt, Human
cuccugugggagccu

SEQ ID NO: 1424904 - RNA, 13 nt, Human
cuccugugggagc

SEQ ID NO: 1424905 - RNA, 22 nt, Human
cuccuguggccccacccugggc

SEQ ID NO: 1424906 - RNA, 21 nt, Human
cuccuguggccccacccuggg

SEQ ID NO: 1424907 - RNA, 23 nt, Human
cuccugcuaacggugcucagggg

SEQ ID NO: 1424908 - RNA, 14 nt, Human
cuccugccuugaaa

SEQ ID NO: 1424909 - RNA, 21 nt, Human
cuccugccuugaaaaagacau

SEQ ID NO: 1424910 - RNA, 20 nt, Human
cuccugccuuccuccugggc

SEQ ID NO: 1424911 - RNA, 19 nt, Human
cuccugccuuccuccuggg

SEQ ID NO: 1424912 - RNA, 18 nt, Human
cuccugccuuccuccugg

SEQ ID NO: 1424913 - RNA, 16 nt, Human
cuccugccuuccuccu

SEQ ID NO: 1424914 - RNA, 15 nt, Human
cuccugccucuacug

SEQ ID NO: 1424915 - RNA, 22 nt, Human
cuccugccucuacugggaaggc

SEQ ID NO: 1424916 - RNA, 12 nt, Human
cuccugccucua

SEQ ID NO: 1424917 - RNA, 21 nt, Human
cuccucacccccagcuuugcu

SEQ ID NO: 1424918 - RNA, 20 nt, Human
cuccucacccccagcuuugc

SEQ ID NO: 1424919 - RNA, 17 nt, Human
cuccucacccccagcuu

SEQ ID NO: 1424920 - RNA, 12 nt, Human
cuccucaucccg

SEQ ID NO: 1424921 - RNA, 16 nt, Human
cuccgcccccagguag

SEQ ID NO: 1424922 - RNA, 15 nt, Human
cuccgcccccaggua

SEQ ID NO: 1424923 - RNA, 13 nt, Human
cuccgccauccac

SEQ ID NO: 1424924 - RNA, 23 nt, Human
cuccgccauucucaagcccugca

SEQ ID NO: 1424925 - RNA, 14 nt, Human
cuccgcccugccac

SEQ ID NO: 1424926 - RNA, 13 nt, Human
cuccgcccugcca

SEQ ID NO: 1424927 - RNA, 16 nt, Human
cuccgcccugccacuc

SEQ ID NO: 1424928 - RNA, 15 nt, Human
cuccgcccugccacu

SEQ ID NO: 1424929 - RNA, 17 nt, Human
cuccgcccugccacuca

SEQ ID NO: 1424930 - RNA, 23 nt, Human
cucccucagugcccucauuuuau

SEQ ID NO: 1424931 - RNA, 14 nt, Human
cucccucagugccc

SEQ ID NO: 1424932 - RNA, 23 nt, Human
cucccucaucaaggacacgggcc

SEQ ID NO: 1424933 - RNA, 22 nt, Human
cucccucaucaaggacacgggc

SEQ ID NO: 1424934 - RNA, 10 nt, Human
cuccucccuc

SEQ ID NO: 1424935 - RNA, 15 nt, Human
cuccuccccuggagg

SEQ ID NO: 1424936 - RNA, 19 nt, Human
cuccuccccaacugugggg

SEQ ID NO: 1424937 - RNA, 21 nt, Human
cuccucccaggguuuuaacuu

SEQ ID NO: 1424938 - RNA, 22 nt, Human
cuccucccaggguuuuaacuuu

SEQ ID NO: 1424939 - RNA, 23 nt, Human
cuccuccccuggagggggaaugg

SEQ ID NO: 1424940 - RNA, 14 nt, Human
cuccuccccuggag

SEQ ID NO: 1424941 - RNA, 15 nt, Human
cuccucuccccagcc

SEQ ID NO: 1424942 - RNA, 24 nt, Human
cuccucgagaucccaacacugcca

SEQ ID NO: 1424943 - RNA, 21 nt, Human
cuccucgagaucccaacacug

SEQ ID NO: 1424944 - RNA, 15 nt, Human
cuccuccuuuuucca

SEQ ID NO: 1424945 - RNA, 15 nt, Human
cuccuccuuuuuccu

SEQ ID NO: 1424946 - RNA, 17 nt, Human
cuccucgagaucccaac

SEQ ID NO: 1424947 - RNA, 18 nt, Human
cuccucauucacaucgca

SEQ ID NO: 1424948 - RNA, 20 nt, Human
cuccucauguacauacccug

SEQ ID NO: 1424949 - RNA, 11 nt, Human
cuccucaugua

SEQ ID NO: 1424950 - RNA, 15 nt, Human
cuccucaucccgugu

SEQ ID NO: 1424951 - RNA, 14 nt, Human
cuccuccagggaca

SEQ ID NO: 1424952 - RNA, 13 nt, Human
cuccuccagggac

SEQ ID NO: 1424953 - RNA, 16 nt, Human
cuccuccaggaagccu

SEQ ID NO: 1424954 - RNA, 15 nt, Human
cuccuccaccucaac

SEQ ID NO: 1424955 - RNA, 15 nt, Human
cuccuccaggaagcc

SEQ ID NO: 1424956 - RNA, 14 nt, Human
cuccuccaccucaa

SEQ ID NO: 1424957 - RNA, 13 nt, Human
cuccuccagggug

SEQ ID NO: 1424958 - RNA, 21 nt, Human
cuccuccaggguggcagcaac

SEQ ID NO: 1424959 - RNA, 14 nt, Human
cuccucccaggguu

SEQ ID NO: 1424960 - RNA, 12 nt, Human
cuccucccaggg

SEQ ID NO: 1424961 - RNA, 18 nt, Human
cuccuccaugggagaaaa

SEQ ID NO: 1424962 - RNA, 15 nt, Human
cuccuccaugggaga

SEQ ID NO: 1424963 - RNA, 22 nt, Human
cuccuccaggguggcagcaaca

SEQ ID NO: 1424964 - RNA, 16 nt, Human
cucuaacgccugagcc

SEQ ID NO: 1424965 - RNA, 15 nt, Human
cucuaacgccugagc

SEQ ID NO: 1424966 - RNA, 13 nt, Human
cucuaacgccuga

SEQ ID NO: 1424967 - RNA, 12 nt, Human
cucuaacgccug

SEQ ID NO: 1424968 - RNA, 13 nt, Human
cucuaacauuucc

SEQ ID NO: 1424969 - RNA, 22 nt, Human
cucuaagaucuuagauucucug

SEQ ID NO: 1424970 - RNA, 19 nt, Human
cucuaagaucuuagauucu

SEQ ID NO: 1424971 - RNA, 16 nt, Human
cucuaagaucuuagau

SEQ ID NO: 1424972 - RNA, 14 nt, Human
cucuaagaucuuag

SEQ ID NO: 1424973 - RNA, 14 nt, Human
cucuaagaaagaac

SEQ ID NO: 1424974 - RNA, 12 nt, Human
cucuaagaaaga

SEQ ID NO: 1424975 - RNA, 20 nt, Human
cucuaacuuggcucacacuc

SEQ ID NO: 1424976 - RNA, 22 nt, Human
cucuaacgccugagcccaggga

SEQ ID NO: 1424977 - RNA, 21 nt, Human
cucuaacgccugagcccaggg

SEQ ID NO: 1424978 - RNA, 20 nt, Human
cucuaacgccugagcccagg

SEQ ID NO: 1424979 - RNA, 18 nt, Human
cucuaacgccugagccca

SEQ ID NO: 1424980 - RNA, 17 nt, Human
cucuaacgccugagccc

SEQ ID NO: 1424981 - RNA, 20 nt, Human
cucuaauucacagugcucuu

SEQ ID NO: 1424982 - RNA, 17 nt, Human
cucuacaaacucccacu

SEQ ID NO: 1424983 - RNA, 16 nt, Human
cucuacaaacucccac

SEQ ID NO: 1424984 - RNA, 18 nt, Human
cucuaauucuauuaaagu

SEQ ID NO: 1424985 - RNA, 22 nt, Human
cucuacagagcuucccugacuc

SEQ ID NO: 1424986 - RNA, 20 nt, Human
cucuacagagcuucccugac

SEQ ID NO: 1424987 - RNA, 18 nt, Human
cucuacagagcuucccug

SEQ ID NO: 1424988 - RNA, 17 nt, Human
cucuacagagcuucccu

SEQ ID NO: 1424989 - RNA, 15 nt, Human
cucuacaucuucugc

SEQ ID NO: 1424990 - RNA, 23 nt, Human
cucuacagagcuucccugacuca

SEQ ID NO: 1424991 - RNA, 17 nt, Human
cucggaggaagccccca

SEQ ID NO: 1424992 - RNA, 13 nt, Human
cucggaggaagcc

SEQ ID NO: 1424993 - RNA, 13 nt, Human
cucgcuguugcug

SEQ ID NO: 1424994 - RNA, 15 nt, Human
cucgcuguugcugaa

SEQ ID NO: 1424995 - RNA, 16 nt, Human
cucgcuguugcugaau

SEQ ID NO: 1424996 - RNA, 22 nt, Human
cucggcuccccauguguccugg

SEQ ID NO: 1424997 - RNA, 19 nt, Human
cucggcuccccaugugucc

SEQ ID NO: 1424998 - RNA, 18 nt, Human
cucgcuguccuuucuaga

SEQ ID NO: 1424999 - RNA, 12 nt, Human
cucgcuguugcu

SEQ ID NO: 1425000 - RNA, 19 nt, Human
cucgcuggacucucagucu

SEQ ID NO: 1425001 - RNA, 16 nt, Human
cucgcuggacucucag

SEQ ID NO: 1425002 - RNA, 15 nt, Human
cucgcuggacucuca

SEQ ID NO: 1425003 - RNA, 21 nt, Human
cuccuucaacaauucuaaaau

SEQ ID NO: 1425004 - RNA, 19 nt, Human
cucgcugccagcucuguau

SEQ ID NO: 1425005 - RNA, 16 nt, Human
cucgcugccagcucug

SEQ ID NO: 1425006 - RNA, 13 nt, Human
cucgcugccagcu

SEQ ID NO: 1425007 - RNA, 19 nt, Human
cucuacugggaaggcuacu

SEQ ID NO: 1425008 - RNA, 16 nt, Human
cucuacugggaaggcu

SEQ ID NO: 1425009 - RNA, 13 nt, Human
cucuacugggaag

SEQ ID NO: 1425010 - RNA, 12 nt, Human
cucuacugggaa

SEQ ID NO: 1425011 - RNA, 20 nt, Human
cucuacugaaugucauugaa

SEQ ID NO: 1425012 - RNA, 17 nt, Human
cucuacugaaugucauu

SEQ ID NO: 1425013 - RNA, 20 nt, Human
cucuacuaaugccucuucau

SEQ ID NO: 1425014 - RNA, 21 nt, Human
cucuacuaacaaucagcuccu

SEQ ID NO: 1425015 - RNA, 22 nt, Human
cucuaccuucuccccagcuccc

SEQ ID NO: 1425016 - RNA, 21 nt, Human
cucuaccuucuccccagcucc

SEQ ID NO: 1425017 - RNA, 18 nt, Human
cucuaccuucuccccagc

SEQ ID NO: 1425018 - RNA, 16 nt, Human
cucuaccuucucccca

SEQ ID NO: 1425019 - RNA, 15 nt, Human
cucuaccuucucccc

SEQ ID NO: 1425020 - RNA, 14 nt, Human
cucuaccuucuccc

SEQ ID NO: 1425021 - RNA, 22 nt, Human
cucuacccugcauggcugagcu

SEQ ID NO: 1425022 - RNA, 18 nt, Human
cucuacuuaauccaaugg

SEQ ID NO: 1425023 - RNA, 17 nt, Human
cucuacuuaauccaaug

SEQ ID NO: 1425024 - RNA, 14 nt, Human
cucuaccccaauuu

SEQ ID NO: 1425025 - RNA, 16 nt, Human
cucuacccauauuaca

SEQ ID NO: 1425026 - RNA, 19 nt, Human
cucuacccauauuacagau

SEQ ID NO: 1425027 - RNA, 22 nt, Human
cucuaccugacacucccuuggg

SEQ ID NO: 1425028 - RNA, 12 nt, Human
cucuaccugaca

SEQ ID NO: 1425029 - RNA, 18 nt, Human
cucuacaucuucugccuu

SEQ ID NO: 1425030 - RNA, 17 nt, Human
cucuacaucuucugccu

SEQ ID NO: 1425031 - RNA, 22 nt, Human
cucuagucaaugacaugaauuu

SEQ ID NO: 1425032 - RNA, 18 nt, Human
cucuagucaaugacauga

SEQ ID NO: 1425033 - RNA, 15 nt, Human
cucuagucaaugaca

SEQ ID NO: 1425034 - RNA, 15 nt, Human
cucuaguauuccaga

SEQ ID NO: 1425035 - RNA, 23 nt, Human
cucuagguacgaugacaguguuc

SEQ ID NO: 1425036 - RNA, 21 nt, Human
cucuaggguacauggugcugg

SEQ ID NO: 1425037 - RNA, 16 nt, Human
cucuagcugugggggu

SEQ ID NO: 1425038 - RNA, 17 nt, Human
cucuaggaaauauuuau

SEQ ID NO: 1425039 - RNA, 22 nt, Human
cucuagagcagacuacagcugg

SEQ ID NO: 1425040 - RNA, 16 nt, Human
cucuagagcagggauu

SEQ ID NO: 1425041 - RNA, 13 nt, Human
cucuagagcaggg

SEQ ID NO: 1425042 - RNA, 19 nt, Human
cucuagagcagacuacagc

SEQ ID NO: 1425043 - RNA, 21 nt, Human
cucuagagaaauaagaucuuu

SEQ ID NO: 1425044 - RNA, 21 nt, Human
cucuagacacugccacacagg

SEQ ID NO: 1425045 - RNA, 16 nt, Human
cucuagacacugccac

SEQ ID NO: 1425046 - RNA, 12 nt, Human
cucuagaaucug

SEQ ID NO: 1425047 - RNA, 12 nt, Human
cucuagauucca

SEQ ID NO: 1425048 - RNA, 14 nt, Human
cucuagaucauaag

SEQ ID NO: 1425049 - RNA, 16 nt, Human
cucuagaguccaaggu

SEQ ID NO: 1425050 - RNA, 15 nt, Human
cucuagaguccaagg

SEQ ID NO: 1425051 - RNA, 13 nt, Human
cucuagaguccaa

SEQ ID NO: 1425052 - RNA, 15 nt, Human
cucuaggaaauauuu

SEQ ID NO: 1425053 - RNA, 17 nt, Human
cucuagugcgguuuacu

SEQ ID NO: 1425054 - RNA, 18 nt, Human
cucuaguucuuuguucau

SEQ ID NO: 1425055 - RNA, 15 nt, Human
cucuaguucuuuguu

SEQ ID NO: 1425056 - RNA, 13 nt, Human
cucuaguucuuug

SEQ ID NO: 1425057 - RNA, 21 nt, Human
cucuaguuugauuaaauucuu

SEQ ID NO: 1425058 - RNA, 19 nt, Human
cucuaguuugauuaaauuc

SEQ ID NO: 1425059 - RNA, 20 nt, Human
cucuaguuugauuaaauucu

SEQ ID NO: 1425060 - RNA, 15 nt, Human
cucuaguuugauuaa

SEQ ID NO: 1425061 - RNA, 15 nt, Human
cucuauaccaauaaa

SEQ ID NO: 1425062 - RNA, 16 nt, Human
cucuauaccaauaaag

SEQ ID NO: 1425063 - RNA, 17 nt, Human
cucuauaccaauaaagu

SEQ ID NO: 1425064 - RNA, 21 nt, Human
cucuccacucaugugacucuu

SEQ ID NO: 1425065 - RNA, 22 nt, Human
cucuccacucaugugacucuuu

SEQ ID NO: 1425066 - RNA, 17 nt, Human
cucucauuuagccuguc

SEQ ID NO: 1425067 - RNA, 18 nt, Human
cucucauuuagccugucc

SEQ ID NO: 1425068 - RNA, 15 nt, Human
cucuccaaaccacuu

SEQ ID NO: 1425069 - RNA, 16 nt, Human
cucuccaaaccacuuu

SEQ ID NO: 1425070 - RNA, 15 nt, Human
cucuccugccccuug

SEQ ID NO: 1425071 - RNA, 12 nt, Human
cucuccucuucu

SEQ ID NO: 1425072 - RNA, 16 nt, Human
cucuccagcugacuaa

SEQ ID NO: 1425073 - RNA, 15 nt, Human
cucuccagcugacua

SEQ ID NO: 1425074 - RNA, 14 nt, Human
cucuccagcugacu

SEQ ID NO: 1425075 - RNA, 18 nt, Human
cucuccagccucagcucu

SEQ ID NO: 1425076 - RNA, 22 nt, Human
cucuccuggcuucccaucccca

SEQ ID NO: 1425077 - RNA, 13 nt, Human
cucuccuggcuuc

SEQ ID NO: 1425078 - RNA, 12 nt, Human
cucuccuggcuu

SEQ ID NO: 1425079 - RNA, 14 nt, Human
cucuccuuccugug

SEQ ID NO: 1425080 - RNA, 22 nt, Human
cucuccuucaugacagccucca

SEQ ID NO: 1425081 - RNA, 18 nt, Human
cucuccugucucccuccu

SEQ ID NO: 1425082 - RNA, 17 nt, Human
cucuccuggcuucccau

SEQ ID NO: 1425083 - RNA, 16 nt, Human
cucuccuggcuuccca

SEQ ID NO: 1425084 - RNA, 17 nt, Human
cucuccugucucccucc

SEQ ID NO: 1425085 - RNA, 15 nt, Human
cucuccugucucccu

SEQ ID NO: 1425086 - RNA, 22 nt, Human
cucucuaggguacauggugcug

SEQ ID NO: 1425087 - RNA, 14 nt, Human
cucucuaugccucu

SEQ ID NO: 1425088 - RNA, 24 nt, Human
cucucuauccucucuuccucuucc

SEQ ID NO: 1425089 - RNA, 14 nt, Human
cucucuauccucuc

SEQ ID NO: 1425090 - RNA, 23 nt, Human
cucucuaggguacauggugcugg

SEQ ID NO: 1425091 - RNA, 21 nt, Human
cucucucauacccucccuccc

SEQ ID NO: 1425092 - RNA, 21 nt, Human
cugacuagggagccauguuuc

SEQ ID NO: 1425093 - RNA, 15 nt, Human
cugaccacacgcggg

SEQ ID NO: 1425094 - RNA, 15 nt, Human
cugaccaaacagcca

SEQ ID NO: 1425095 - RNA, 21 nt, Human
cugacauuuggaguguucccc

SEQ ID NO: 1425096 - RNA, 18 nt, Human
cugacauuuggaguguuc

SEQ ID NO: 1425097 - RNA, 21 nt, Human
cugacauguggggccagguca

SEQ ID NO: 1425098 - RNA, 19 nt, Human
cugacauguggggccaggu

SEQ ID NO: 1425099 - RNA, 14 nt, Human
cugacauguggggc

SEQ ID NO: 1425100 - RNA, 23 nt, Human
cugacaugaagcuguugugugag

SEQ ID NO: 1425101 - RNA, 17 nt, Human
cugacaucaaaaaaggc

SEQ ID NO: 1425102 - RNA, 15 nt, Human
cugacaucaaaaaag

SEQ ID NO: 1425103 - RNA, 13 nt, Human
cugacaucaaaaa

SEQ ID NO: 1425104 - RNA, 19 nt, Human
cugacaguuuacagacgcu

SEQ ID NO: 1425105 - RNA, 21 nt, Human
cugacaggugaggucuguucc

SEQ ID NO: 1425106 - RNA, 17 nt, Human
cugacagcagcaucucu

SEQ ID NO: 1425107 - RNA, 16 nt, Human
cugacagcagcaucuc

SEQ ID NO: 1425108 - RNA, 15 nt, Human
cugacagcagcaucu

SEQ ID NO: 1425109 - RNA, 11 nt, Human
cugacagcagc

SEQ ID NO: 1425110 - RNA, 14 nt, Human
cugacuuggcuggu

SEQ ID NO: 1425111 - RNA, 12 nt, Human
cugacuuggcug

SEQ ID NO: 1425112 - RNA, 19 nt, Human
cugacuucugccuggagac

SEQ ID NO: 1425113 - RNA, 18 nt, Human
cugacuucugccuggaga

SEQ ID NO: 1425114 - RNA, 16 nt, Human
cugacuucugccugga

SEQ ID NO: 1425115 - RNA, 15 nt, Human
cugacuucugccugg

SEQ ID NO: 1425116 - RNA, 14 nt, Human
cugacuucugccug

SEQ ID NO: 1425117 - RNA, 13 nt, Human
cugacuucugccu

SEQ ID NO: 1425118 - RNA, 12 nt, Human
cugacuucugcc

SEQ ID NO: 1425119 - RNA, 11 nt, Human
cugacuucugc

SEQ ID NO: 1425120 - RNA, 23 nt, Human
cugacuucaucucccaccuagca

SEQ ID NO: 1425121 - RNA, 17 nt, Human
cugacuucaucucccac

SEQ ID NO: 1425122 - RNA, 15 nt, Human
cugacucagggcucc

SEQ ID NO: 1425123 - RNA, 14 nt, Human
cugacucagggcuc

SEQ ID NO: 1425124 - RNA, 12 nt, Human
cugacucagggc

SEQ ID NO: 1425125 - RNA, 22 nt, Human
cugacucacaccugaacugaac

SEQ ID NO: 1425126 - RNA, 23 nt, Human
cugacuauucuugauguaaaauc

SEQ ID NO: 1425127 - RNA, 22 nt, Human
cugacuauucuugauguaaaau

SEQ ID NO: 1425128 - RNA, 21 nt, Human
cugacuauucuugauguaaaa

SEQ ID NO: 1425129 - RNA, 20 nt, Human
cugacuauucuugauguaaa

SEQ ID NO: 1425130 - RNA, 19 nt, Human
cugacuauucuugauguaa

SEQ ID NO: 1425131 - RNA, 18 nt, Human
cugacuauucuugaugua

SEQ ID NO: 1425132 - RNA, 18 nt, Human
cugacuagggagccaugu

SEQ ID NO: 1425133 - RNA, 17 nt, Human
cugacucuuaagaagac

SEQ ID NO: 1425134 - RNA, 20 nt, Human
cugagaaccuggccuucagu

SEQ ID NO: 1425135 - RNA, 19 nt, Human
cugagaaccuggccuucag

SEQ ID NO: 1425136 - RNA, 18 nt, Human
cugagaaccuggccuuca

SEQ ID NO: 1425137 - RNA, 17 nt, Human
cugagaaccuggccuuc

SEQ ID NO: 1425138 - RNA, 16 nt, Human
cugagaaccuggccuu

SEQ ID NO: 1425139 - RNA, 15 nt, Human
cugagaaccuggccu

SEQ ID NO: 1425140 - RNA, 14 nt, Human
cugagaaccuggcc

SEQ ID NO: 1425141 - RNA, 13 nt, Human
cugagaaccuggc

SEQ ID NO: 1425142 - RNA, 12 nt, Human
cugagaaccugg

SEQ ID NO: 1425143 - RNA, 21 nt, Human
cugagaauuguugagauacuu

SEQ ID NO: 1425144 - RNA, 17 nt, Human
cugagacaaauggaggc

SEQ ID NO: 1425145 - RNA, 16 nt, Human
cugagaaucagacuga

SEQ ID NO: 1425146 - RNA, 19 nt, Human
cugacuuucuuuuuugaua

SEQ ID NO: 1425147 - RNA, 22 nt, Human
cugacuuggcuggugugguaca

SEQ ID NO: 1425148 - RNA, 20 nt, Human
cugacuuggcugguguggua

SEQ ID NO: 1425149 - RNA, 17 nt, Human
cugacuuggcuggugug

SEQ ID NO: 1425150 - RNA, 16 nt, Human
cugacuuggcuggugu

SEQ ID NO: 1425151 - RNA, 15 nt, Human
cugacuuggcuggug

SEQ ID NO: 1425152 - RNA, 22 nt, Human
cugagaaccguagaugauuuca

SEQ ID NO: 1425153 - RNA, 16 nt, Human
cugagaaagcucaaag

SEQ ID NO: 1425154 - RNA, 11 nt, Human
cugagaaauuu

SEQ ID NO: 1425155 - RNA, 14 nt, Human
cugagaaauuuaua

SEQ ID NO: 1425156 - RNA, 21 nt, Human
cugagcuauuucaucuauuuu

SEQ ID NO: 1425157 - RNA, 16 nt, Human
cugagcuauuucaucu

SEQ ID NO: 1425158 - RNA, 13 nt, Human
cugagcuauuuca

SEQ ID NO: 1425159 - RNA, 15 nt, Human
cugagcuagaacccu

SEQ ID NO: 1425160 - RNA, 18 nt, Human
cugagcgaguggagucug

SEQ ID NO: 1425161 - RNA, 22 nt, Human
cugagcgccuccauccaaggcc

SEQ ID NO: 1425162 - RNA, 15 nt, Human
cugagcgccuccauc

SEQ ID NO: 1425163 - RNA, 13 nt, Human
cugagcgccucca

SEQ ID NO: 1425164 - RNA, 15 nt, Human
cugagcgccaggaug

SEQ ID NO: 1425165 - RNA, 21 nt, Human
cugagcgaguggagucugcca

SEQ ID NO: 1425166 - RNA, 20 nt, Human
cugagcgaggagaugcuccu

SEQ ID NO: 1425167 - RNA, 21 nt, Human
cugagccuuguaauucuaaau

SEQ ID NO: 1425168 - RNA, 22 nt, Human
cugagcuccuguccccugcuac

SEQ ID NO: 1425169 - RNA, 17 nt, Human
cugagcuccuguccccu

SEQ ID NO: 1425170 - RNA, 12 nt, Human
cugagcuccugu

SEQ ID NO: 1425171 - RNA, 17 nt, Human
cugagcuccagcuccuu

SEQ ID NO: 1425172 - RNA, 22 nt, Human
cugagcuccagcuccuuugggc

SEQ ID NO: 1425173 - RNA, 17 nt, Human
cugagcucagcguggag

SEQ ID NO: 1425174 - RNA, 16 nt, Human
cugagcucagcgugga

SEQ ID NO: 1425175 - RNA, 15 nt, Human
cugagcucagcgugg

SEQ ID NO: 1425176 - RNA, 22 nt, Human
cugagcucacaaggcagcaagg

SEQ ID NO: 1425177 - RNA, 23 nt, Human
cugagcucacaaggcagcaaggc

SEQ ID NO: 1425178 - RNA, 20 nt, Human
cugagcucacaaggcagcaa

SEQ ID NO: 1425179 - RNA, 19 nt, Human
cugagcucacaaggcagca

SEQ ID NO: 1425180 - RNA, 18 nt, Human
cugagcucacaaggcagc

SEQ ID NO: 1425181 - RNA, 17 nt, Human
cugagcucacaaggcag

SEQ ID NO: 1425182 - RNA, 14 nt, Human
cugagcucacaagg

SEQ ID NO: 1425183 - RNA, 19 nt, Human
cugagccugccgagcaacc

SEQ ID NO: 1425184 - RNA, 16 nt, Human
cugagccugccgagca

SEQ ID NO: 1425185 - RNA, 15 nt, Human
cugagccugccgagc

SEQ ID NO: 1425186 - RNA, 14 nt, Human
cugagccugccgag

SEQ ID NO: 1425187 - RNA, 13 nt, Human
cugagccugccga

SEQ ID NO: 1425188 - RNA, 12 nt, Human
cugagccugccg

SEQ ID NO: 1425189 - RNA, 16 nt, Human
cugagccuuguaauuc

SEQ ID NO: 1425190 - RNA, 15 nt, Human
cugagccuuguaauu

SEQ ID NO: 1425191 - RNA, 16 nt, Human
cugagccggccccagg

SEQ ID NO: 1425192 - RNA, 23 nt, Human
cugagccggccccaggcucgugg

SEQ ID NO: 1425193 - RNA, 19 nt, Human
cugagccggccccaggcuc

SEQ ID NO: 1425194 - RNA, 18 nt, Human
cugagccggccccaggcu

SEQ ID NO: 1425195 - RNA, 23 nt, Human
cugagcccgguaagagcaaaaga

SEQ ID NO: 1425196 - RNA, 20 nt, Human
cugagccagggucuccagaa

SEQ ID NO: 1425197 - RNA, 22 nt, Human
cugagccagugucaggaggaag

SEQ ID NO: 1425198 - RNA, 16 nt, Human
cugagccagugucagg

SEQ ID NO: 1425199 - RNA, 22 nt, Human
cugagccagggucuccagaaag

SEQ ID NO: 1425200 - RNA, 19 nt, Human
cugagccagggucuccaga

SEQ ID NO: 1425201 - RNA, 18 nt, Human
cugagccagggucuccag

SEQ ID NO: 1425202 - RNA, 17 nt, Human
cugagccagggucucca

SEQ ID NO: 1425203 - RNA, 15 nt, Human
cugagacaaugccuu

SEQ ID NO: 1425204 - RNA, 20 nt, Human
cugagacaaauggaggccug

SEQ ID NO: 1425205 - RNA, 22 nt, Human
cugaggccagccuggccuccug

SEQ ID NO: 1425206 - RNA, 20 nt, Human
cugaggccagccuggccucc

SEQ ID NO: 1425207 - RNA, 19 nt, Human
cugaggccagccuggccuc

SEQ ID NO: 1425208 - RNA, 18 nt, Human
cugaggccagccuggccu

SEQ ID NO: 1425209 - RNA, 17 nt, Human
cugaggccagccuggcc

SEQ ID NO: 1425210 - RNA, 16 nt, Human
cugaggccagccuggc

SEQ ID NO: 1425211 - RNA, 15 nt, Human
cugaggccagccugg

SEQ ID NO: 1425212 - RNA, 14 nt, Human
cugaggccagccug

SEQ ID NO: 1425213 - RNA, 24 nt, Human
cugaggcagcagugugaggccagg

SEQ ID NO: 1425214 - RNA, 23 nt, Human
cugaggcagcagugugaggccag

SEQ ID NO: 1425215 - RNA, 22 nt, Human
cugaggcagcagugugaggcca

SEQ ID NO: 1425216 - RNA, 17 nt, Human
cugaggcagcaguguga

SEQ ID NO: 1425217 - RNA, 15 nt, Human
cugaggcagcagugu

SEQ ID NO: 1425218 - RNA, 13 nt, Human
cugaggccagccu

SEQ ID NO: 1425219 - RNA, 12 nt, Human
cugaggccagcc

SEQ ID NO: 1425220 - RNA, 17 nt, Human
cugaggccacccagagg

SEQ ID NO: 1425221 - RNA, 24 nt, Human
cugaggccacacucagcacaaggc

SEQ ID NO: 1425222 - RNA, 21 nt, Human
cugaggccacacucagcacaa

SEQ ID NO: 1425223 - RNA, 20 nt, Human
cugaggccacacucagcaca

SEQ ID NO: 1425224 - RNA, 14 nt, Human
cugaggccacacuc

SEQ ID NO: 1425225 - RNA, 12 nt, Human
cugaggccacac

SEQ ID NO: 1425226 - RNA, 22 nt, Human
cugagcucugagaggcccugga

SEQ ID NO: 1425227 - RNA, 23 nt, Human
cugagcucugagaggcccuggau

SEQ ID NO: 1425228 - RNA, 21 nt, Human
cugagcucugagaggcccugg

SEQ ID NO: 1425229 - RNA, 20 nt, Human
cugagcucugagaggcccug

SEQ ID NO: 1425230 - RNA, 19 nt, Human
cugagcucugagaggcccu

SEQ ID NO: 1425231 - RNA, 18 nt, Human
cugagcucugagaggccc

SEQ ID NO: 1425232 - RNA, 17 nt, Human
cugagcucugagaggcc

SEQ ID NO: 1425233 - RNA, 16 nt, Human
cugagcucugagaggc

SEQ ID NO: 1425234 - RNA, 15 nt, Human
cugagcucugagagg

SEQ ID NO: 1425235 - RNA, 14 nt, Human
cugagcucugagag

SEQ ID NO: 1425236 - RNA, 13 nt, Human
cugagcucugaga

SEQ ID NO: 1425237 - RNA, 12 nt, Human
cugagcucugag

SEQ ID NO: 1425238 - RNA, 19 nt, Human
cugaggagucugagguccu

SEQ ID NO: 1425239 - RNA, 15 nt, Human
cugagcugaggcagc

SEQ ID NO: 1425240 - RNA, 13 nt, Human
cugagcugaggca

SEQ ID NO: 1425241 - RNA, 12 nt, Human
cugagcugaggc

SEQ ID NO: 1425242 - RNA, 15 nt, Human
cugagcugaccagcc

SEQ ID NO: 1425243 - RNA, 17 nt, Human
cugaggaucagaguaau

SEQ ID NO: 1425244 - RNA, 20 nt, Human
cugaggagucugagguccug

SEQ ID NO: 1425245 - RNA, 19 nt, Human
cugaggaucagaguaaucc

SEQ ID NO: 1425246 - RNA, 21 nt, Human
cucugcuucucugacuucugc

SEQ ID NO: 1425247 - RNA, 17 nt, Human
cucugcuucucugacuu

SEQ ID NO: 1425248 - RNA, 16 nt, Human
cucugcuucucugacu

SEQ ID NO: 1425249 - RNA, 15 nt, Human
cucugcuucucugac

SEQ ID NO: 1425250 - RNA, 14 nt, Human
cucugcuucucuga

SEQ ID NO: 1425251 - RNA, 13 nt, Human
cucugcuucucug

SEQ ID NO: 1425252 - RNA, 12 nt, Human
cucugcuucucu

SEQ ID NO: 1425253 - RNA, 14 nt, Human
cucugcuucucacg

SEQ ID NO: 1425254 - RNA, 13 nt, Human
cucucucccuuuu

SEQ ID NO: 1425255 - RNA, 21 nt, Human
cucuggagggguguggcuccu

SEQ ID NO: 1425256 - RNA, 20 nt, Human
cucuggagggguguggcucc

SEQ ID NO: 1425257 - RNA, 19 nt, Human
cucuggagggguguggcuc

SEQ ID NO: 1425258 - RNA, 16 nt, Human
cucuggaggggagggg

SEQ ID NO: 1425259 - RNA, 15 nt, Human
cucuggaggggaggg

SEQ ID NO: 1425260 - RNA, 14 nt, Human
cucuggaggggagg

SEQ ID NO: 1425261 - RNA, 22 nt, Human
cucuggcagccacacuucucag

SEQ ID NO: 1425262 - RNA, 17 nt, Human
cucuggcagccacacuu

SEQ ID NO: 1425263 - RNA, 16 nt, Human
cucuguucauuuccuc

SEQ ID NO: 1425264 - RNA, 17 nt, Human
cucuguucauuuccuca

SEQ ID NO: 1425265 - RNA, 17 nt, Human
cucugugggcuggcagu

SEQ ID NO: 1425266 - RNA, 22 nt, Human
cucugugcuuuuaaaugcauaa

SEQ ID NO: 1425267 - RNA, 19 nt, Human
cucuguguauuugcuuuuu

SEQ ID NO: 1425268 - RNA, 18 nt, Human
cucuguguauuugcuuuu

SEQ ID NO: 1425269 - RNA, 22 nt, Human
cucuguucaaagcugccugucc

SEQ ID NO: 1425270 - RNA, 15 nt, Human
cucuguucaaagcug

SEQ ID NO: 1425271 - RNA, 22 nt, Human
cucuguuacacuuuuuggaagu

SEQ ID NO: 1425272 - RNA, 18 nt, Human
cucuguucaaagcugccu

SEQ ID NO: 1425273 - RNA, 15 nt, Human
cucuguucauuccuc

SEQ ID NO: 1425274 - RNA, 17 nt, Human
cucuguucauuccucca

SEQ ID NO: 1425275 - RNA, 14 nt, Human
cucuguucauuucc

SEQ ID NO: 1425276 - RNA, 13 nt, Human
cucuguucauuuc

SEQ ID NO: 1425277 - RNA, 18 nt, Human
cucuguucauuccuccag

SEQ ID NO: 1425278 - RNA, 19 nt, Human
cucuguucauuccuccagg

SEQ ID NO: 1425279 - RNA, 19 nt, Human
cucugugccagagccuggg

SEQ ID NO: 1425280 - RNA, 18 nt, Human
cucugugccagagccugg

SEQ ID NO: 1425281 - RNA, 17 nt, Human
cucugugccagagccug

SEQ ID NO: 1425282 - RNA, 16 nt, Human
cucugugccagagccu

SEQ ID NO: 1425283 - RNA, 15 nt, Human
cucugugccagagcc

SEQ ID NO: 1425284 - RNA, 14 nt, Human
cucugugccagagc

SEQ ID NO: 1425285 - RNA, 20 nt, Human
cucugugcacuuauuuauga

SEQ ID NO: 1425286 - RNA, 17 nt, Human
cucugucuucuggacug

SEQ ID NO: 1425287 - RNA, 14 nt, Human
cucugucuucugga

SEQ ID NO: 1425288 - RNA, 13 nt, Human
cucugucuucugg

SEQ ID NO: 1425289 - RNA, 20 nt, Human
cucugucuggcaaugccaca

SEQ ID NO: 1425290 - RNA, 17 nt, Human
cucugucuggcaaugcc

SEQ ID NO: 1425291 - RNA, 23 nt, Human
cucugucuucuuugcccacaaug

SEQ ID NO: 1425292 - RNA, 13 nt, Human
cucugugcugugu

SEQ ID NO: 1425293 - RNA, 16 nt, Human
cucugugcuggccagc

SEQ ID NO: 1425294 - RNA, 19 nt, Human
cucugugcuggccagcgag

SEQ ID NO: 1425295 - RNA, 15 nt, Human
cucugugcuggccag

SEQ ID NO: 1425296 - RNA, 12 nt, Human
cucugugcuggc

SEQ ID NO: 1425297 - RNA, 13 nt, Human
cucugugccuucg

SEQ ID NO: 1425298 - RNA, 21 nt, Human
cucugugccagagccuggggc

SEQ ID NO: 1425299 - RNA, 20 nt, Human
cucugugccagagccugggg

SEQ ID NO: 1425300 - RNA, 21 nt, Human
cucuggcuuggccacagccag

SEQ ID NO: 1425301 - RNA, 20 nt, Human
cucuggcuuggccacagcca

SEQ ID NO: 1425302 - RNA, 22 nt, Human
cucuggcuguaaggcucuagau

SEQ ID NO: 1425303 - RNA, 21 nt, Human
cucuggcuguaaggcucuaga

SEQ ID NO: 1425304 - RNA, 20 nt, Human
cucuggcuguaaggcucuag

SEQ ID NO: 1425305 - RNA, 19 nt, Human
cucuggcuguaaggcucua

SEQ ID NO: 1425306 - RNA, 15 nt, Human
cucugucucauccau

SEQ ID NO: 1425307 - RNA, 14 nt, Human
cucugucucaucca

SEQ ID NO: 1425308 - RNA, 22 nt, Human
cucuggcuuggccacagccagg

SEQ ID NO: 1425309 - RNA, 23 nt, Human
cucugucucgagcgcccugcaga

SEQ ID NO: 1425310 - RNA, 22 nt, Human
cucugucucgagcgcccugcag

SEQ ID NO: 1425311 - RNA, 21 nt, Human
cucugucucgagcgcccugca

SEQ ID NO: 1425312 - RNA, 20 nt, Human
cucugucucgagcgcccugc

SEQ ID NO: 1425313 - RNA, 18 nt, Human
cucugucucgagcgcccu

SEQ ID NO: 1425314 - RNA, 13 nt, Human
cucugucucgagc

SEQ ID NO: 1425315 - RNA, 22 nt, Human
cucugucuccuaagcuggagug

SEQ ID NO: 1425316 - RNA, 15 nt, Human
cugaacuaaagugcu

SEQ ID NO: 1425317 - RNA, 19 nt, Human
cugaacagcugguguagcu

SEQ ID NO: 1425318 - RNA, 12 nt, Human
cugaacagugga

SEQ ID NO: 1425319 - RNA, 13 nt, Human
cugaacagcugua

SEQ ID NO: 1425320 - RNA, 16 nt, Human
cugaacagcuggugua

SEQ ID NO: 1425321 - RNA, 15 nt, Human
cugaacagcuggugu

SEQ ID NO: 1425322 - RNA, 17 nt, Human
cugaacaucacagcuua

SEQ ID NO: 1425323 - RNA, 13 nt, Human
cugaacucacuuu

SEQ ID NO: 1425324 - RNA, 18 nt, Human
cugaacucaaacugagga

SEQ ID NO: 1425325 - RNA, 15 nt, Human
cugaacucaaacuga

SEQ ID NO: 1425326 - RNA, 19 nt, Human
cugaacuaaagugcugcac

SEQ ID NO: 1425327 - RNA, 23 nt, Human
cugaagacaccguucauucaggc

SEQ ID NO: 1425328 - RNA, 19 nt, Human
cugaacugauggguuucuc

SEQ ID NO: 1425329 - RNA, 13 nt, Human
cugaacugaacac

SEQ ID NO: 1425330 - RNA, 21 nt, Human
cugaacuccugccauagucuu

SEQ ID NO: 1425331 - RNA, 23 nt, Human
cugaagaagcaccaaucaugaau

SEQ ID NO: 1425332 - RNA, 14 nt, Human
cugaacagcuggug

SEQ ID NO: 1425333 - RNA, 13 nt, Human
cugaacagcuggu

SEQ ID NO: 1425334 - RNA, 12 nt, Human
cugaacagcugg

SEQ ID NO: 1425335 - RNA, 20 nt, Human
cugaacaccauugaaggcuu

SEQ ID NO: 1425336 - RNA, 19 nt, Human
cugaacaccauugaaggcu

SEQ ID NO: 1425337 - RNA, 18 nt, Human
cugaacaccauugaaggc

SEQ ID NO: 1425338 - RNA, 22 nt, Human
cugaacaccauagguagaaugu

SEQ ID NO: 1425339 - RNA, 19 nt, Human
cugaaauuuuauaugcuua

SEQ ID NO: 1425340 - RNA, 13 nt, Human
cugaaauuuuaua

SEQ ID NO: 1425341 - RNA, 14 nt, Human
cugaaauuucagau

SEQ ID NO: 1425342 - RNA, 16 nt, Human
cugaaauuuccuggga

SEQ ID NO: 1425343 - RNA, 20 nt, Human
cugaaauucuccuggagguc

SEQ ID NO: 1425344 - RNA, 13 nt, Human
cugaaaugaagau

SEQ ID NO: 1425345 - RNA, 18 nt, Human
cugaaaucaauuaaaagu

SEQ ID NO: 1425346 - RNA, 23 nt, Human
cugaaauuuccugggagcuuuug

SEQ ID NO: 1425347 - RNA, 13 nt, Human
cugaaauuucaga

SEQ ID NO: 1425348 - RNA, 13 nt, Human
cugaaauuuccug

SEQ ID NO: 1425349 - RNA, 14 nt, Human
cucuuugagaaaua

SEQ ID NO: 1425350 - RNA, 10 nt, Human
cucuuugaga

SEQ ID NO: 1425351 - RNA, 12 nt, Human
cucuuugccuca

SEQ ID NO: 1425352 - RNA, 12 nt, Human
cucuuugagaaa

SEQ ID NO: 1425353 - RNA, 13 nt, Human
cucuuugccucaa

SEQ ID NO: 1425354 - RNA, 17 nt, Human
cucuuucccuggucccu

SEQ ID NO: 1425355 - RNA, 15 nt, Human
cucuuucccuggucc

SEQ ID NO: 1425356 - RNA, 14 nt, Human
cucuuucccugguc

SEQ ID NO: 1425357 - RNA, 13 nt, Human
cucuuucccuggu

SEQ ID NO: 1425358 - RNA, 17 nt, Human
cucuuuaugaucuggcc

SEQ ID NO: 1425359 - RNA, 21 nt, Human
cucuuuaugcuugcaaaaacu

SEQ ID NO: 1425360 - RNA, 15 nt, Human
cucuuucuguauaua

SEQ ID NO: 1425361 - RNA, 15 nt, Human
cucuuucugucuucu

SEQ ID NO: 1425362 - RNA, 15 nt, Human
cucuuucuucccaug

SEQ ID NO: 1425363 - RNA, 17 nt, Human
cucuuucuuucaauaaa

SEQ ID NO: 1425364 - RNA, 16 nt, Human
cugaaagccauggaga

SEQ ID NO: 1425365 - RNA, 21 nt, Human
cugaaauaaacgucuuaaaua

SEQ ID NO: 1425366 - RNA, 23 nt, Human
cucuuggggaguuuagggugggg

SEQ ID NO: 1425367 - RNA, 12 nt, Human
cucuucuuuaga

SEQ ID NO: 1425368 - RNA, 17 nt, Human
cucuucuuuagaacagg

SEQ ID NO: 1425369 - RNA, 23 nt, Human
cucuucuuuuaaaccauuuucuu

SEQ ID NO: 1425370 - RNA, 22 nt, Human
cucuugaaauauaggaacuuaa

SEQ ID NO: 1425371 - RNA, 20 nt, Human
cucuucuugaaauuuuaacc

SEQ ID NO: 1425372 - RNA, 15 nt, Human
cucuucuugaaauuu

SEQ ID NO: 1425373 - RNA, 20 nt, Human
cucuucuuccagguagcuga

SEQ ID NO: 1425374 - RNA, 20 nt, Human
cucuuccuacuggucucucu

SEQ ID NO: 1425375 - RNA, 18 nt, Human
cucuuccuacuggucucu

SEQ ID NO: 1425376 - RNA, 16 nt, Human
cucuuccuacuggucu

SEQ ID NO: 1425377 - RNA, 20 nt, Human
cucuuccgugacgucacugg

SEQ ID NO: 1425378 - RNA, 14 nt, Human
cucuucccucuucc

SEQ ID NO: 1425379 - RNA, 14 nt, Human
cucuuuauacagcu

SEQ ID NO: 1425380 - RNA, 15 nt, Human
cucuuuagaguuaga

SEQ ID NO: 1425381 - RNA, 17 nt, Human
cucuuuagaguuagacu

SEQ ID NO: 1425382 - RNA, 18 nt, Human
cucuuuagaguuagacug

SEQ ID NO: 1425383 - RNA, 19 nt, Human
cucuuuagaguuagacugu

SEQ ID NO: 1425384 - RNA, 21 nt, Human
cucuuuagaguuagacuguug

SEQ ID NO: 1425385 - RNA, 20 nt, Human
cucuuuaaaaggaaagaaaa

SEQ ID NO: 1425386 - RNA, 23 nt, Human
cucuuuaaaaggaaagaaaacau

SEQ ID NO: 1425387 - RNA, 21 nt, Human
cucuuguugagccgugggcaa

SEQ ID NO: 1425388 - RNA, 16 nt, Human
cucuuguugagccgug

SEQ ID NO: 1425389 - RNA, 19 nt, Human
cucuucuuucauuucuucu

SEQ ID NO: 1425390 - RNA, 19 nt, Human
cucuuuaaaaggaaagaaa

SEQ ID NO: 1425391 - RNA, 17 nt, Human
cugcugguccgugggac

SEQ ID NO: 1425392 - RNA, 16 nt, Human
cugcugguccguggga

SEQ ID NO: 1425393 - RNA, 19 nt, Human
cugcuggggccugggacaa

SEQ ID NO: 1425394 - RNA, 22 nt, Human
cugcuggggccugggacaacug

SEQ ID NO: 1425395 - RNA, 18 nt, Human
cugcuggggccugggaca

SEQ ID NO: 1425396 - RNA, 17 nt, Human
cugcuggggccugggac

SEQ ID NO: 1425397 - RNA, 16 nt, Human
cugcuggggccuggga

SEQ ID NO: 1425398 - RNA, 15 nt, Human
cugcuggggccuggg

SEQ ID NO: 1425399 - RNA, 14 nt, Human
cugcuggggccugg

SEQ ID NO: 1425400 - RNA, 13 nt, Human
cugcuggggccug

SEQ ID NO: 1425401 - RNA, 16 nt, Human
cugcugggcucaguga

SEQ ID NO: 1425402 - RNA, 18 nt, Human
cugcugggcucagugaag

SEQ ID NO: 1425403 - RNA, 15 nt, Human
cugcugggcucagug

SEQ ID NO: 1425404 - RNA, 14 nt, Human
cugcugggcucagu

SEQ ID NO: 1425405 - RNA, 13 nt, Human
cugcugccugccu

SEQ ID NO: 1425406 - RNA, 19 nt, Human
cugcuucucccaggcaagg

SEQ ID NO: 1425407 - RNA, 18 nt, Human
cugcuucucccaggcaag

SEQ ID NO: 1425408 - RNA, 17 nt, Human
cugcuucucccaggcaa

SEQ ID NO: 1425409 - RNA, 15 nt, Human
cugcuucucccaggc

SEQ ID NO: 1425410 - RNA, 14 nt, Human
cugcuucucccagg

SEQ ID NO: 1425411 - RNA, 13 nt, Human
cugcuucucccag

SEQ ID NO: 1425412 - RNA, 14 nt, Human
cugcuuccugcuug

SEQ ID NO: 1425413 - RNA, 15 nt, Human
cugcuuccugcuugc

SEQ ID NO: 1425414 - RNA, 13 nt, Human
cugcuuccugcuu

SEQ ID NO: 1425415 - RNA, 12 nt, Human
cugcuuccugcu

SEQ ID NO: 1425416 - RNA, 20 nt, Human
cugcugucccucccccuugu

SEQ ID NO: 1425417 - RNA, 17 nt, Human
cugcugucccucccccu

SEQ ID NO: 1425418 - RNA, 16 nt, Human
cugcuugaggaaaaca

SEQ ID NO: 1425419 - RNA, 14 nt, Human
cugcuugaggaaaa

SEQ ID NO: 1425420 - RNA, 13 nt, Human
cugcuugaggaaa

SEQ ID NO: 1425421 - RNA, 12 nt, Human
cugcuugaggaa

SEQ ID NO: 1425422 - RNA, 20 nt, Human
cugcuucucugacuucugcc

SEQ ID NO: 1425423 - RNA, 19 nt, Human
cugcuucucugacuucugc

SEQ ID NO: 1425424 - RNA, 17 nt, Human
cugcuucucugacuucu

SEQ ID NO: 1425425 - RNA, 16 nt, Human
cugcuucucugacuuc

SEQ ID NO: 1425426 - RNA, 15 nt, Human
cugcuucucugacuu

SEQ ID NO: 1425427 - RNA, 14 nt, Human
cugcuucucugacu

SEQ ID NO: 1425428 - RNA, 13 nt, Human
cugcuucucugac

SEQ ID NO: 1425429 - RNA, 21 nt, Human
cugcuucucccaggcaaggcu

SEQ ID NO: 1425430 - RNA, 20 nt, Human
cugcuucucccaggcaaggc

SEQ ID NO: 1425431 - RNA, 22 nt, Human
cugcuucucccaggcaaggcug

SEQ ID NO: 1425432 - RNA, 23 nt, Human
cugcuucucugacuucugccugg

SEQ ID NO: 1425433 - RNA, 22 nt, Human
cugcuucucugacuucugccug

SEQ ID NO: 1425434 - RNA, 21 nt, Human
cugcuucucugacuucugccu

SEQ ID NO: 1425435 - RNA, 19 nt, Human
cugcuucugacauaaucca

SEQ ID NO: 1425436 - RNA, 18 nt, Human
cugcuugguccuugauuu

SEQ ID NO: 1425437 - RNA, 21 nt, Human
cugcuuggggggugaugaggg

SEQ ID NO: 1425438 - RNA, 22 nt, Human
cugcuuggggggugaugagggc

SEQ ID NO: 1425439 - RNA, 19 nt, Human
cugcuuggggggugaugag

SEQ ID NO: 1425440 - RNA, 16 nt, Human
cugcuuggagcugagc

SEQ ID NO: 1425441 - RNA, 17 nt, Human
cugcuuggagcugagca

SEQ ID NO: 1425442 - RNA, 20 nt, Human
cugcuugcccuaagcagaaa

SEQ ID NO: 1425443 - RNA, 22 nt, Human
cugcuugcccuaagcagaaagu

SEQ ID NO: 1425444 - RNA, 19 nt, Human
cugcuugcccuaagcagaa

SEQ ID NO: 1425445 - RNA, 16 nt, Human
cugcuugcccuaagca

SEQ ID NO: 1425446 - RNA, 15 nt, Human
cugcuugcccuaagc

SEQ ID NO: 1425447 - RNA, 13 nt, Human
cugcuugcccuaa

SEQ ID NO: 1425448 - RNA, 21 nt, Human
cugcuugccaaggcagaggcc

SEQ ID NO: 1425449 - RNA, 18 nt, Human
cugcuugccaaggcagag

SEQ ID NO: 1425450 - RNA, 20 nt, Human
cugcuugauuuuugccucuu

SEQ ID NO: 1425451 - RNA, 23 nt, Human
cugcuugccaaggcagaggccug

SEQ ID NO: 1425452 - RNA, 13 nt, Human
cugcuugauuuuu

SEQ ID NO: 1425453 - RNA, 23 nt, Human
cugcuugaugggauucuggacag

SEQ ID NO: 1425454 - RNA, 21 nt, Human
cugcuugaugggauucuggac

SEQ ID NO: 1425455 - RNA, 20 nt, Human
cugcuuugggaagccgugcu

SEQ ID NO: 1425456 - RNA, 21 nt, Human
cugcuuugcucuucaagaaau

SEQ ID NO: 1425457 - RNA, 12 nt, Human
cugcuuugggcu

SEQ ID NO: 1425458 - RNA, 17 nt, Human
cugcuuuaaccacccca

SEQ ID NO: 1425459 - RNA, 17 nt, Human
cugcuuucuguuccaaa

SEQ ID NO: 1425460 - RNA, 18 nt, Human
cugcuuucuguuccaaau

SEQ ID NO: 1425461 - RNA, 17 nt, Human
cuggaagcuaauuugca

SEQ ID NO: 1425462 - RNA, 17 nt, Human
cuggaagccagcuuucc

SEQ ID NO: 1425463 - RNA, 16 nt, Human
cuggaagccagcuuuc

SEQ ID NO: 1425464 - RNA, 15 nt, Human
cuggaagccagcuuu

SEQ ID NO: 1425465 - RNA, 22 nt, Human
cuggaagccaaaauguaggcuu

SEQ ID NO: 1425466 - RNA, 20 nt, Human
cuggaagcugggaggucagg

SEQ ID NO: 1425467 - RNA, 15 nt, Human
cuggaagcugggagg

SEQ ID NO: 1425468 - RNA, 22 nt, Human
cuggaagcuaauuugcauuaaa

SEQ ID NO: 1425469 - RNA, 19 nt, Human
cuggaagcuaauuugcauu

SEQ ID NO: 1425470 - RNA, 18 nt, Human
cuggaagcuaauuugcau

SEQ ID NO: 1425471 - RNA, 19 nt, Human
cuggaaggggaagggacac

SEQ ID NO: 1425472 - RNA, 15 nt, Human
cuggaagggaggugg

SEQ ID NO: 1425473 - RNA, 19 nt, Human
cuggaaguccaauguggca

SEQ ID NO: 1425474 - RNA, 16 nt, Human
cuggaaguccaaugug

SEQ ID NO: 1425475 - RNA, 15 nt, Human
cuggaagugacuuug

SEQ ID NO: 1425476 - RNA, 18 nt, Human
cuggaagugacuuuggcu

SEQ ID NO: 1425477 - RNA, 14 nt, Human
cugccugcucccau

SEQ ID NO: 1425478 - RNA, 13 nt, Human
cugccugcuccca

SEQ ID NO: 1425479 - RNA, 21 nt, Human
cugccugccagcugcacugau

SEQ ID NO: 1425480 - RNA, 20 nt, Human
cugccugccagcugcacuga

SEQ ID NO: 1425481 - RNA, 16 nt, Human
cugccugccagcugca

SEQ ID NO: 1425482 - RNA, 15 nt, Human
cugccugccagcugc

SEQ ID NO: 1425483 - RNA, 17 nt, Human
cugccugcauaggaguu

SEQ ID NO: 1425484 - RNA, 14 nt, Human
cugcccugcccugc

SEQ ID NO: 1425485 - RNA, 15 nt, Human
cugcccugcccugcc

SEQ ID NO: 1425486 - RNA, 22 nt, Human
cugcccucucccaaaaaacuac

SEQ ID NO: 1425487 - RNA, 22 nt, Human
cugcgcccuuaacugcauccag

SEQ ID NO: 1425488 - RNA, 12 nt, Human
cugcgcacugug

SEQ ID NO: 1425489 - RNA, 20 nt, Human
cugccuucgcuucuugccuc

SEQ ID NO: 1425490 - RNA, 17 nt, Human
cugccuucgcuucuugc

SEQ ID NO: 1425491 - RNA, 15 nt, Human
cugccuucgcuucuu

SEQ ID NO: 1425492 - RNA, 14 nt, Human
cugccuucgcuucu

SEQ ID NO: 1425493 - RNA, 13 nt, Human
cugccuucgcuuc

SEQ ID NO: 1425494 - RNA, 21 nt, Human
cugccuuccuccugggcccuc

SEQ ID NO: 1425495 - RNA, 18 nt, Human
cugccuuccuccugggcc

SEQ ID NO: 1425496 - RNA, 16 nt, Human
cugccuuccuccuggg

SEQ ID NO: 1425497 - RNA, 15 nt, Human
cugccuuccuccugg

SEQ ID NO: 1425498 - RNA, 14 nt, Human
cugccuuccuccug

SEQ ID NO: 1425499 - RNA, 13 nt, Human
cugccuuccuccu

SEQ ID NO: 1425500 - RNA, 19 nt, Human
cugccuggaagagcagccc

SEQ ID NO: 1425501 - RNA, 13 nt, Human
cugccugcuuggg

SEQ ID NO: 1425502 - RNA, 12 nt, Human
cugccugcuugg

SEQ ID NO: 1425503 - RNA, 18 nt, Human
cugccugcucgcucccug

SEQ ID NO: 1425504 - RNA, 18 nt, Human
cugccugcucccauccug

SEQ ID NO: 1425505 - RNA, 15 nt, Human
cugccugcucccauc

SEQ ID NO: 1425506 - RNA, 22 nt, Human
cugccugcuuuuuauggccugu

SEQ ID NO: 1425507 - RNA, 17 nt, Human
cugcucuaacagcccuc

SEQ ID NO: 1425508 - RNA, 12 nt, Human
cugcucuaacag

SEQ ID NO: 1425509 - RNA, 22 nt, Human
cugcucguccccaagugaccua

SEQ ID NO: 1425510 - RNA, 21 nt, Human
cugcucguccccaagugaccu

SEQ ID NO: 1425511 - RNA, 18 nt, Human
cugcucguccccaaguga

SEQ ID NO: 1425512 - RNA, 23 nt, Human
cugcucggggugcacaggagggg

SEQ ID NO: 1425513 - RNA, 22 nt, Human
cugcucggggugcacaggaggg

SEQ ID NO: 1425514 - RNA, 21 nt, Human
cugcucggggugcacaggagg

SEQ ID NO: 1425515 - RNA, 20 nt, Human
cugcucggggugcacaggag

SEQ ID NO: 1425516 - RNA, 19 nt, Human
cugcucggggugcacagga

SEQ ID NO: 1425517 - RNA, 18 nt, Human
cugcucggggugcacagg

SEQ ID NO: 1425518 - RNA, 18 nt, Human
cugcucccauccugugug

SEQ ID NO: 1425519 - RNA, 19 nt, Human
cugcucccauccugugugu

SEQ ID NO: 1425520 - RNA, 14 nt, Human
cugcucccauccug

SEQ ID NO: 1425521 - RNA, 23 nt, Human
cugcgggugaacaaagcagccac

SEQ ID NO: 1425522 - RNA, 22 nt, Human
cugcgggugaacaaagcagcca

SEQ ID NO: 1425523 - RNA, 22 nt, Human
cugcucugcgugucaccugugc

SEQ ID NO: 1425524 - RNA, 21 nt, Human
cugcucugcgugucaccugug

SEQ ID NO: 1425525 - RNA, 20 nt, Human
cugcucugcgugucaccugu

SEQ ID NO: 1425526 - RNA, 18 nt, Human
cugcucugaugcaucaga

SEQ ID NO: 1425527 - RNA, 13 nt, Human
cugcucugaugca

SEQ ID NO: 1425528 - RNA, 12 nt, Human
cugcucugaugc

SEQ ID NO: 1425529 - RNA, 17 nt, Human
cugcucggggugcacag

SEQ ID NO: 1425530 - RNA, 15 nt, Human
cugcucuuggcugga

SEQ ID NO: 1425531 - RNA, 22 nt, Human
cugcucugguuguuucuguucc

SEQ ID NO: 1425532 - RNA, 21 nt, Human
cugcucugguuguuucuguuc

SEQ ID NO: 1425533 - RNA, 18 nt, Human
cugcucugguuguuucug

SEQ ID NO: 1425534 - RNA, 17 nt, Human
cugcucugguuguuucu

SEQ ID NO: 1425535 - RNA, 20 nt, Human
cugcucuuggcuggacccag

SEQ ID NO: 1425536 - RNA, 19 nt, Human
cugcucuuggcuggaccca

SEQ ID NO: 1425537 - RNA, 17 nt, Human
cugcucuuggcuggacc

SEQ ID NO: 1425538 - RNA, 16 nt, Human
cugcucuuggcuggac

SEQ ID NO: 1425539 - RNA, 22 nt, Human
cugcucuuggcuggacccagcc

SEQ ID NO: 1425540 - RNA, 21 nt, Human
cugcucuuggcuggacccagc

SEQ ID NO: 1425541 - RNA, 15 nt, Human
cugcugccucccucu

SEQ ID NO: 1425542 - RNA, 11 nt, Human
cugcugccugc

SEQ ID NO: 1425543 - RNA, 14 nt, Human
cugcugccugcuuu

SEQ ID NO: 1425544 - RNA, 23 nt, Human
cugcugccugcuuuuuauggccu

SEQ ID NO: 1425545 - RNA, 15 nt, Human
cugccauuaaagaau

SEQ ID NO: 1425546 - RNA, 17 nt, Human
cugccagcugcacugau

SEQ ID NO: 1425547 - RNA, 16 nt, Human
cugccagcugcacuga

SEQ ID NO: 1425548 - RNA, 11 nt, Human
cugccaggaga

SEQ ID NO: 1425549 - RNA, 13 nt, Human
cugccagcugcac

SEQ ID NO: 1425550 - RNA, 12 nt, Human
cugccagcugca

SEQ ID NO: 1425551 - RNA, 11 nt, Human
cugccagcugc

SEQ ID NO: 1425552 - RNA, 17 nt, Human
cugccagcucuguauca

SEQ ID NO: 1425553 - RNA, 17 nt, Human
cugccaccuccccccac

SEQ ID NO: 1425554 - RNA, 21 nt, Human
cugccaccuccccccacaagu

SEQ ID NO: 1425555 - RNA, 14 nt, Human
cugccacccuugac

SEQ ID NO: 1425556 - RNA, 16 nt, Human
cugccacccaggaucc

SEQ ID NO: 1425557 - RNA, 14 nt, Human
cugccacccaggau

SEQ ID NO: 1425558 - RNA, 12 nt, Human
cugccacccagg

SEQ ID NO: 1425559 - RNA, 23 nt, Human
cugccacccagccccagccaggg

SEQ ID NO: 1425560 - RNA, 20 nt, Human
cugccacccagccccagcca

SEQ ID NO: 1425561 - RNA, 18 nt, Human
cugccacccagccccagc

SEQ ID NO: 1425562 - RNA, 17 nt, Human
cugccacccagccccag

SEQ ID NO: 1425563 - RNA, 21 nt, Human
cugcauauguugaauacuuuu

SEQ ID NO: 1425564 - RNA, 14 nt, Human
cugcauauguugaa

SEQ ID NO: 1425565 - RNA, 23 nt, Human
cugcauaggaguuuggaggaagu

SEQ ID NO: 1425566 - RNA, 22 nt, Human
cugcauaggaguuuggaggaag

SEQ ID NO: 1425567 - RNA, 20 nt, Human
cugcauaggaguuuggagga

SEQ ID NO: 1425568 - RNA, 22 nt, Human
cugcauaauguuucuggauuuc

SEQ ID NO: 1425569 - RNA, 15 nt, Human
cugcauaauguuucu

SEQ ID NO: 1425570 - RNA, 20 nt, Human
cugcauacuuuuuaaaugua

SEQ ID NO: 1425571 - RNA, 14 nt, Human
cugcauacuuuuua

SEQ ID NO: 1425572 - RNA, 17 nt, Human
cugcccuaccugcccca

SEQ ID NO: 1425573 - RNA, 19 nt, Human
cugcccgggagcucaggaa

SEQ ID NO: 1425574 - RNA, 22 nt, Human
cugccccuuggacacgcucagu

SEQ ID NO: 1425575 - RNA, 21 nt, Human
cugcccaccucagccucccaa

SEQ ID NO: 1425576 - RNA, 15 nt, Human
cugcccacagcaggc

SEQ ID NO: 1425577 - RNA, 17 nt, Human
cugccauuaaagaauau

SEQ ID NO: 1425578 - RNA, 17 nt, Human
cugccauucacuucaua

SEQ ID NO: 1425579 - RNA, 20 nt, Human
cugccccacuuguccuuagc

SEQ ID NO: 1425580 - RNA, 21 nt, Human
cugccccacuuguccuuagcc

SEQ ID NO: 1425581 - RNA, 18 nt, Human
cugccccacuuguccuua

SEQ ID NO: 1425582 - RNA, 24 nt, Human
cugccccaacuccuuccagcuagu

SEQ ID NO: 1425583 - RNA, 13 nt, Human
cugccccaacucu

SEQ ID NO: 1425584 - RNA, 22 nt, Human
cugccccaacuccuuccagcua

SEQ ID NO: 1425585 - RNA, 20 nt, Human
cugccccaacuccuuccagc

SEQ ID NO: 1425586 - RNA, 15 nt, Human
cugccccaacuccuu

SEQ ID NO: 1425587 - RNA, 21 nt, Human
cugcagaggccagaggccccc

SEQ ID NO: 1425588 - RNA, 20 nt, Human
cugcagaggccagaggcccc

SEQ ID NO: 1425589 - RNA, 17 nt, Human
cugcagaggccagaggc

SEQ ID NO: 1425590 - RNA, 15 nt, Human
cugcagcaauaaagc

SEQ ID NO: 1425591 - RNA, 16 nt, Human
cugcagcaauaaagca

SEQ ID NO: 1425592 - RNA, 16 nt, Human
cugcagacuucccagc

SEQ ID NO: 1425593 - RNA, 15 nt, Human
cugcagacuucccag

SEQ ID NO: 1425594 - RNA, 14 nt, Human
cugcagacuuccca

SEQ ID NO: 1425595 - RNA, 15 nt, Human
cugcagacucacugu

SEQ ID NO: 1425596 - RNA, 21 nt, Human
cugcagacccugcccuuguuu

SEQ ID NO: 1425597 - RNA, 17 nt, Human
cugcagacccugcccuu

SEQ ID NO: 1425598 - RNA, 16 nt, Human
cugcagacccugcccu

SEQ ID NO: 1425599 - RNA, 13 nt, Human
cugcagaggccag

SEQ ID NO: 1425600 - RNA, 11 nt, Human
cugcagaggcc

SEQ ID NO: 1425601 - RNA, 12 nt, Human
cugcagaggacg

SEQ ID NO: 1425602 - RNA, 17 nt, Human
cugcagacuucccagcu

SEQ ID NO: 1425603 - RNA, 15 nt, Human
cugcagacccugccc

SEQ ID NO: 1425604 - RNA, 14 nt, Human
cugcagacccugcc

SEQ ID NO: 1425605 - RNA, 13 nt, Human
cugcagacccugc

SEQ ID NO: 1425606 - RNA, 15 nt, Human
cugcagaccacgccc

SEQ ID NO: 1425607 - RNA, 22 nt, Human
cugcagaauuuggguucugccu

SEQ ID NO: 1425608 - RNA, 18 nt, Human
cugcacuguaaaaugugg

SEQ ID NO: 1425609 - RNA, 16 nt, Human
cugcacuguaaaaugu

SEQ ID NO: 1425610 - RNA, 20 nt, Human
cugcacuguaaaauguggga

SEQ ID NO: 1425611 - RNA, 15 nt, Human
cugcacuguaaaaug

SEQ ID NO: 1425612 - RNA, 14 nt, Human
cugcacuguaaaau

SEQ ID NO: 1425613 - RNA, 13 nt, Human
cugcacuguaaaa

SEQ ID NO: 1425614 - RNA, 11 nt, Human
cugcacuguaa

SEQ ID NO: 1425615 - RNA, 22 nt, Human
cugcacuggggagcccgucuca

SEQ ID NO: 1425616 - RNA, 16 nt, Human
cugcacuggggagccc

SEQ ID NO: 1425617 - RNA, 22 nt, Human
cugcacucccaccugacacacc

SEQ ID NO: 1425618 - RNA, 19 nt, Human
cugcacucccaccugacac

SEQ ID NO: 1425619 - RNA, 18 nt, Human
cugcacucccaccugaca

SEQ ID NO: 1425620 - RNA, 16 nt, Human
cugcacucccaccuga

SEQ ID NO: 1425621 - RNA, 20 nt, Human
cugcacuccagucuggguga

SEQ ID NO: 1425622 - RNA, 23 nt, Human
cugaggccagccuggccuccugc

SEQ ID NO: 1425623 - RNA, 23 nt, Human
cugcagggggugugucugcucag

SEQ ID NO: 1425624 - RNA, 20 nt, Human
cugcagggggugugucugcu

SEQ ID NO: 1425625 - RNA, 17 nt, Human
cugcagggggugugucu

SEQ ID NO: 1425626 - RNA, 17 nt, Human
cugcagcaauaaagcag

SEQ ID NO: 1425627 - RNA, 11 nt, Human
cugcagguccc

SEQ ID NO: 1425628 - RNA, 12 nt, Human
cugcaggucccu

SEQ ID NO: 1425629 - RNA, 13 nt, Human
cugcaggucccua

SEQ ID NO: 1425630 - RNA, 14 nt, Human
cugcaggucccuaa

SEQ ID NO: 1425631 - RNA, 15 nt, Human
cugcaggucccuaau

SEQ ID NO: 1425632 - RNA, 16 nt, Human
cugcaggucccuaaua

SEQ ID NO: 1425633 - RNA, 17 nt, Human
cugcaggucccuaauaa

SEQ ID NO: 1425634 - RNA, 18 nt, Human
cugcaggucccuaauaaa

SEQ ID NO: 1425635 - RNA, 21 nt, Human
cugcaguucgacucugugcug

SEQ ID NO: 1425636 - RNA, 20 nt, Human
cugcaguucgacucugugcu

SEQ ID NO: 1425637 - RNA, 17 nt, Human
cugcaguucgacucugu

SEQ ID NO: 1425638 - RNA, 15 nt, Human
cugcaguucgacucu

SEQ ID NO: 1425639 - RNA, 23 nt, Human
cugcagucccagcggugggaccu

SEQ ID NO: 1425640 - RNA, 13 nt, Human
cugcaguccugga

SEQ ID NO: 1425641 - RNA, 17 nt, Human
cugcagucucuauacca

SEQ ID NO: 1425642 - RNA, 13 nt, Human
cugcagucacagc

SEQ ID NO: 1425643 - RNA, 14 nt, Human
cugcagucacagcu

SEQ ID NO: 1425644 - RNA, 21 nt, Human
cugcagucucuauaccaauaa

SEQ ID NO: 1425645 - RNA, 23 nt, Human
cugcagucucuauaccaauaaag

SEQ ID NO: 1425646 - RNA, 19 nt, Human
cugcaggucccuaauaaag

SEQ ID NO: 1425647 - RNA, 20 nt, Human
cugcaggucccuaauaaagc

SEQ ID NO: 1425648 - RNA, 21 nt, Human
cugcaggucccuaauaaagcu

SEQ ID NO: 1425649 - RNA, 22 nt, Human
cugcaggucccuaauaaagcug

SEQ ID NO: 1425650 - RNA, 17 nt, Human
cugcaguaaaucuuuua

SEQ ID NO: 1425651 - RNA, 14 nt, Human
cugcaguaaaucuu

SEQ ID NO: 1425652 - RNA, 23 nt, Human
cugcaggucccuaauaaagcugu

SEQ ID NO: 1425653 - RNA, 14 nt, Human
cuggccuggacugu

SEQ ID NO: 1425654 - RNA, 20 nt, Human
cuggccccaggaccuggcug

SEQ ID NO: 1425655 - RNA, 16 nt, Human
cuggccccaggaccug

SEQ ID NO: 1425656 - RNA, 18 nt, Human
cuggccaguccaggcugc

SEQ ID NO: 1425657 - RNA, 17 nt, Human
cuggccaguccaggcug

SEQ ID NO: 1425658 - RNA, 16 nt, Human
cuggccaguccaggcu

SEQ ID NO: 1425659 - RNA, 15 nt, Human
cuggccaguccaggc

SEQ ID NO: 1425660 - RNA, 23 nt, Human
cuggccagggccacgcuccagcu

SEQ ID NO: 1425661 - RNA, 22 nt, Human
cuggccagggccacgcuccagc

SEQ ID NO: 1425662 - RNA, 20 nt, Human
cuggccagggccacgcucca

SEQ ID NO: 1425663 - RNA, 18 nt, Human
cuggccagggccacgcuc

SEQ ID NO: 1425664 - RNA, 17 nt, Human
cuggccagggccacgcu

SEQ ID NO: 1425665 - RNA, 14 nt, Human
cuggccagggccac

SEQ ID NO: 1425666 - RNA, 13 nt, Human
cuggccagggcca

SEQ ID NO: 1425667 - RNA, 23 nt, Human
cuggccagcgagcgcccagcucc

SEQ ID NO: 1425668 - RNA, 20 nt, Human
cuggccagcgagcgcccagc

SEQ ID NO: 1425669 - RNA, 12 nt, Human
cuggccagcgag

SEQ ID NO: 1425670 - RNA, 14 nt, Human
cuggccucccaaau

SEQ ID NO: 1425671 - RNA, 19 nt, Human
cuggcccccucccuggaug

SEQ ID NO: 1425672 - RNA, 22 nt, Human
cuggccucacccaccccugcac

SEQ ID NO: 1425673 - RNA, 18 nt, Human
cuggcccccucccuggau

SEQ ID NO: 1425674 - RNA, 17 nt, Human
cuggcccccucccugga

SEQ ID NO: 1425675 - RNA, 16 nt, Human
cuggccucccaaauga

SEQ ID NO: 1425676 - RNA, 17 nt, Human
cuggccccauggucagc

SEQ ID NO: 1425677 - RNA, 21 nt, Human
cuggccccaggaccuggcugc

SEQ ID NO: 1425678 - RNA, 16 nt, Human
cuggcccccucccugg

SEQ ID NO: 1425679 - RNA, 15 nt, Human
cuggcccccucccug

SEQ ID NO: 1425680 - RNA, 13 nt, Human
cuggcccccuccc

SEQ ID NO: 1425681 - RNA, 22 nt, Human
cuggccccccugguccccuccu

SEQ ID NO: 1425682 - RNA, 19 nt, Human
cuggccccccugguccccu

SEQ ID NO: 1425683 - RNA, 13 nt, Human
cuggccccccugg

SEQ ID NO: 1425684 - RNA, 16 nt, Human
cuggcauuacagcugg

SEQ ID NO: 1425685 - RNA, 15 nt, Human
cuggcauuacagcug

SEQ ID NO: 1425686 - RNA, 22 nt, Human
cuggccaagcugaggugcccag

SEQ ID NO: 1425687 - RNA, 23 nt, Human
cuggccaagcugaggugcccagg

SEQ ID NO: 1425688 - RNA, 21 nt, Human
cuggccaagcugaggugccca

SEQ ID NO: 1425689 - RNA, 19 nt, Human
cuggccaagcugaggugcc

SEQ ID NO: 1425690 - RNA, 19 nt, Human
cuggcauuagaauuauuua

SEQ ID NO: 1425691 - RNA, 18 nt, Human
cuggcaugucaacagcgu

SEQ ID NO: 1425692 - RNA, 18 nt, Human
cuggcauuagaauuauuu

SEQ ID NO: 1425693 - RNA, 23 nt, Human
cuggcauuacaggugugagccac

SEQ ID NO: 1425694 - RNA, 15 nt, Human
cuggcacagccuggc

SEQ ID NO: 1425695 - RNA, 20 nt, Human
cuggcaaggacuuuguacau

SEQ ID NO: 1425696 - RNA, 19 nt, Human
cuggcaaggacuuuguaca

SEQ ID NO: 1425697 - RNA, 21 nt, Human
cuggcacagccuggcuguggc

SEQ ID NO: 1425698 - RNA, 16 nt, Human
cuggcacagccuggcu

SEQ ID NO: 1425699 - RNA, 23 nt, Human
cuggcacagccuggcuguggccu

SEQ ID NO: 1425700 - RNA, 17 nt, Human
cuggcaacaucuuuauc

SEQ ID NO: 1425701 - RNA, 14 nt, Human
cuggcaacaucuuu

SEQ ID NO: 1425702 - RNA, 16 nt, Human
cuggcaacacagaggc

SEQ ID NO: 1425703 - RNA, 15 nt, Human
cuggcaacacagagg

SEQ ID NO: 1425704 - RNA, 24 nt, Human
cuggaaugaguugaggccacugug

SEQ ID NO: 1425705 - RNA, 19 nt, Human
cuggaaugaguugaggcca

SEQ ID NO: 1425706 - RNA, 20 nt, Human
cuggaagugcuaauuuugaa

SEQ ID NO: 1425707 - RNA, 18 nt, Human
cuggaauauauaaccagu

SEQ ID NO: 1425708 - RNA, 20 nt, Human
cuggaaucagcucaggacug

SEQ ID NO: 1425709 - RNA, 23 nt, Human
cuggaaucaggaauauuuuccaa

SEQ ID NO: 1425710 - RNA, 18 nt, Human
cuggaauacaugaaauau

SEQ ID NO: 1425711 - RNA, 17 nt, Human
cuggcuggcugagggca

SEQ ID NO: 1425712 - RNA, 15 nt, Human
cuggcuggcugaggg

SEQ ID NO: 1425713 - RNA, 14 nt, Human
cuggcuggcugagg

SEQ ID NO: 1425714 - RNA, 11 nt, Human
cuggcuggcug

SEQ ID NO: 1425715 - RNA, 13 nt, Human
cuggcuggccuca

SEQ ID NO: 1425716 - RNA, 17 nt, Human
cuggcuggccucaccca

SEQ ID NO: 1425717 - RNA, 22 nt, Human
cuggcgacacguagcagcuuag

SEQ ID NO: 1425718 - RNA, 21 nt, Human
cuggccuuuuucauuuaucua

SEQ ID NO: 1425719 - RNA, 20 nt, Human
cuggccuuuuucauuuaucu

SEQ ID NO: 1425720 - RNA, 19 nt, Human
cuggccuuuuucauuuauc

SEQ ID NO: 1425721 - RNA, 17 nt, Human
cuggccuuuuucauuua

SEQ ID NO: 1425722 - RNA, 20 nt, Human
cuggcuguaaggcucuagau

SEQ ID NO: 1425723 - RNA, 19 nt, Human
cuggcuguaaggcucuaga

SEQ ID NO: 1425724 - RNA, 18 nt, Human
cuggcuguggccuaaccu

SEQ ID NO: 1425725 - RNA, 18 nt, Human
cuggcugguagagcaggu

SEQ ID NO: 1425726 - RNA, 17 nt, Human
cuggcugguagagcagg

SEQ ID NO: 1425727 - RNA, 16 nt, Human
cuggcuggcugagggc

SEQ ID NO: 1425728 - RNA, 23 nt, Human
cuggcugggacguggcucagcca

SEQ ID NO: 1425729 - RNA, 21 nt, Human
cuggcugggacguggcucagc

SEQ ID NO: 1425730 - RNA, 19 nt, Human
cuggcugggacguggcuca

SEQ ID NO: 1425731 - RNA, 16 nt, Human
cuggcugggacguggc

SEQ ID NO: 1425732 - RNA, 12 nt, Human
cuggcugggacg

SEQ ID NO: 1425733 - RNA, 17 nt, Human
cuggcuguaaggcucua

SEQ ID NO: 1425734 - RNA, 16 nt, Human
cuggcuguaaggcucu

SEQ ID NO: 1425735 - RNA, 15 nt, Human
cuggcuguaaggcuc

SEQ ID NO: 1425736 - RNA, 22 nt, Human
cuggcugguguuaacagaaggg

SEQ ID NO: 1425737 - RNA, 21 nt, Human
cuggcugguguuaacagaagg

SEQ ID NO: 1425738 - RNA, 18 nt, Human
cuggcugguguuaacaga

SEQ ID NO: 1425739 - RNA, 16 nt, Human
cuggcugguguuaaca

SEQ ID NO: 1425740 - RNA, 12 nt, Human
cuggcugguguu

SEQ ID NO: 1425741 - RNA, 13 nt, Human
cugggagaggcag

SEQ ID NO: 1425742 - RNA, 16 nt, Human
cugggaaagccccugc

SEQ ID NO: 1425743 - RNA, 18 nt, Human
cugggaaagccccugccc

SEQ ID NO: 1425744 - RNA, 20 nt, Human
cugggaaagggauuuucagc

SEQ ID NO: 1425745 - RNA, 22 nt, Human
cugggaaaaacuuuggaaccag

SEQ ID NO: 1425746 - RNA, 23 nt, Human
cugggaaaaacuuuggaaccaga

SEQ ID NO: 1425747 - RNA, 23 nt, Human
cuggcuuuuauuaaugcacuuuc

SEQ ID NO: 1425748 - RNA, 22 nt, Human
cuggcuuuuauuaaugcacuuu

SEQ ID NO: 1425749 - RNA, 14 nt, Human
cuggcuuuuauuaa

SEQ ID NO: 1425750 - RNA, 23 nt, Human
cuggcuuucauuuucucucaggu

SEQ ID NO: 1425751 - RNA, 22 nt, Human
cuggcuuucauuuucucucagg

SEQ ID NO: 1425752 - RNA, 21 nt, Human
cuggcuuucauuuucucucag

SEQ ID NO: 1425753 - RNA, 23 nt, Human
cuggcuugggacuaaaugcccug

SEQ ID NO: 1425754 - RNA, 16 nt, Human
cuggcuugggcagcau

SEQ ID NO: 1425755 - RNA, 20 nt, Human
cuggcuuggccacagccagg

SEQ ID NO: 1425756 - RNA, 18 nt, Human
cuggcuuggccacagcca

SEQ ID NO: 1425757 - RNA, 22 nt, Human
cugggagucacacaguguugga

SEQ ID NO: 1425758 - RNA, 17 nt, Human
cugggagucacacagug

SEQ ID NO: 1425759 - RNA, 16 nt, Human
cugggagucacacagu

SEQ ID NO: 1425760 - RNA, 19 nt, Human
cugggccuauggagagccc

SEQ ID NO: 1425761 - RNA, 18 nt, Human
cugggccuauggagagcc

SEQ ID NO: 1425762 - RNA, 17 nt, Human
cugggccuauggagagc

SEQ ID NO: 1425763 - RNA, 16 nt, Human
cugggccuauggagag

SEQ ID NO: 1425764 - RNA, 12 nt, Human
cugggccuaugg

SEQ ID NO: 1425765 - RNA, 16 nt, Human
cugggccgcugccacg

SEQ ID NO: 1425766 - RNA, 15 nt, Human
cugggccgcugccac

SEQ ID NO: 1425767 - RNA, 22 nt, Human
cugggcccuggggccuguacug

SEQ ID NO: 1425768 - RNA, 20 nt, Human
cugggcccuggggccuguac

SEQ ID NO: 1425769 - RNA, 18 nt, Human
cugggcccuggggccugu

SEQ ID NO: 1425770 - RNA, 17 nt, Human
cugggcccuggggccug

SEQ ID NO: 1425771 - RNA, 15 nt, Human
cugggcccuggggcc

SEQ ID NO: 1425772 - RNA, 14 nt, Human
cugggcccuggggc

SEQ ID NO: 1425773 - RNA, 13 nt, Human
cugggcccugggg

SEQ ID NO: 1425774 - RNA, 12 nt, Human
cugggcccuggg

SEQ ID NO: 1425775 - RNA, 18 nt, Human
cugggcccugggcuggaa

SEQ ID NO: 1425776 - RNA, 16 nt, Human
cugggcccugggcugg

SEQ ID NO: 1425777 - RNA, 15 nt, Human
cugggcccugggcug

SEQ ID NO: 1425778 - RNA, 14 nt, Human
cugggcccugggcu

SEQ ID NO: 1425779 - RNA, 13 nt, Human
cugggcccugggc

SEQ ID NO: 1425780 - RNA, 10 nt, Human
cugggccccu

SEQ ID NO: 1425781 - RNA, 13 nt, Human
cugggcccaugaa

SEQ ID NO: 1425782 - RNA, 23 nt, Human
cugggauuacaggugugagccac

SEQ ID NO: 1425783 - RNA, 16 nt, Human
cugggagcccccagcc

SEQ ID NO: 1425784 - RNA, 19 nt, Human
cugggagauucaagggacc

SEQ ID NO: 1425785 - RNA, 15 nt, Human
cugggagauucaagg

SEQ ID NO: 1425786 - RNA, 20 nt, Human
cugggagaggcagcccagga

SEQ ID NO: 1425787 - RNA, 23 nt, Human
cugggagaggcagcccaggaagu

SEQ ID NO: 1425788 - RNA, 19 nt, Human
cugggagaggcagcccagg

SEQ ID NO: 1425789 - RNA, 18 nt, Human
cugggagaggcagcccag

SEQ ID NO: 1425790 - RNA, 15 nt, Human
cugggagaggcagcc

SEQ ID NO: 1425791 - RNA, 14 nt, Human
cugggagaggcagc

SEQ ID NO: 1425792 - RNA, 20 nt, Human
cugggagcccccagccuguc

SEQ ID NO: 1425793 - RNA, 19 nt, Human
cugggagcccccagccugu

SEQ ID NO: 1425794 - RNA, 18 nt, Human
cugggagcccccagccug

SEQ ID NO: 1425795 - RNA, 17 nt, Human
cugggagcccccagccu

SEQ ID NO: 1425796 - RNA, 22 nt, Human
cugggaggaaggacuucccugu

SEQ ID NO: 1425797 - RNA, 21 nt, Human
cugggagcccccagccuguca

SEQ ID NO: 1425798 - RNA, 21 nt, Human
cugggagcuccacucugcuuc

SEQ ID NO: 1425799 - RNA, 20 nt, Human
cugggagcuccacucugcuu

SEQ ID NO: 1425800 - RNA, 17 nt, Human
cugggagcuccacucug

SEQ ID NO: 1425801 - RNA, 16 nt, Human
cugggagcuccacucu

SEQ ID NO: 1425802 - RNA, 23 nt, Human
cugggagcccccagccugucaga

SEQ ID NO: 1425803 - RNA, 14 nt, Human
cugggaggaaggac

SEQ ID NO: 1425804 - RNA, 19 nt, Human
cugggaggagggcaggcau

SEQ ID NO: 1425805 - RNA, 14 nt, Human
cugggagucacaca

SEQ ID NO: 1425806 - RNA, 23 nt, Human
cugggaguaguugucuuuccugg

SEQ ID NO: 1425807 - RNA, 21 nt, Human
cugggaguaguugucuuuccu

SEQ ID NO: 1425808 - RNA, 22 nt, Human
cugggaggcucuggagcccacu

SEQ ID NO: 1425809 - RNA, 18 nt, Human
cugggaggcucuggagcc

SEQ ID NO: 1425810 - RNA, 20 nt, Human
cugggaggcucuggagccca

SEQ ID NO: 1425811 - RNA, 21 nt, Human
cugggaggcucuggagcccac

SEQ ID NO: 1425812 - RNA, 16 nt, Human
cuguaccaguuaauuu

SEQ ID NO: 1425813 - RNA, 12 nt, Human
cuguaccaguua

SEQ ID NO: 1425814 - RNA, 15 nt, Human
cuguacauuguggga

SEQ ID NO: 1425815 - RNA, 13 nt, Human
cuguacaguguua

SEQ ID NO: 1425816 - RNA, 21 nt, Human
cuguacagugucuuuuuuugu

SEQ ID NO: 1425817 - RNA, 13 nt, Human
cuguacccaguuu

SEQ ID NO: 1425818 - RNA, 18 nt, Human
cuguaccaguuaauuuuu

SEQ ID NO: 1425819 - RNA, 17 nt, Human
cuguaccaguuaauuuu

SEQ ID NO: 1425820 - RNA, 21 nt, Human
cuguaccucuugagccuugaa

SEQ ID NO: 1425821 - RNA, 15 nt, Human
cuguacaguguuacc

SEQ ID NO: 1425822 - RNA, 16 nt, Human
cuguacagugucuuuu

SEQ ID NO: 1425823 - RNA, 15 nt, Human
cuguacagugucuuu

SEQ ID NO: 1425824 - RNA, 14 nt, Human
cuguacagugucuu

SEQ ID NO: 1425825 - RNA, 11 nt, Human
cuguacagugu

SEQ ID NO: 1425826 - RNA, 18 nt, Human
cuguacagcuggcucuac

SEQ ID NO: 1425827 - RNA, 17 nt, Human
cuguacagcuggcucua

SEQ ID NO: 1425828 - RNA, 16 nt, Human
cuguacagcuggcucu

SEQ ID NO: 1425829 - RNA, 15 nt, Human
cuguacagcuggcuc

SEQ ID NO: 1425830 - RNA, 22 nt, Human
cuguacaugaaaacacauuuuu

SEQ ID NO: 1425831 - RNA, 23 nt, Human
cuguacaugaaaacacauuuuuc

SEQ ID NO: 1425832 - RNA, 24 nt, Human
cuguaaguugggcuugcuauucug

SEQ ID NO: 1425833 - RNA, 22 nt, Human
cuguaaguugggcuugcuauuc

SEQ ID NO: 1425834 - RNA, 21 nt, Human
cuguaaguugggcuugcuauu

SEQ ID NO: 1425835 - RNA, 22 nt, Human
cuguaauaaacucauuucuagc

SEQ ID NO: 1425836 - RNA, 21 nt, Human
cuguaauuugugauacaaugc

SEQ ID NO: 1425837 - RNA, 22 nt, Human
cuguaauuugugauacaaugcu

SEQ ID NO: 1425838 - RNA, 20 nt, Human
cuguaaguagaugcauuugg

SEQ ID NO: 1425839 - RNA, 22 nt, Human
cuguaaggcucuagaucauaag

SEQ ID NO: 1425840 - RNA, 20 nt, Human
cuguaaggcucuagaucaua

SEQ ID NO: 1425841 - RNA, 18 nt, Human
cuguaaggcucuagauca

SEQ ID NO: 1425842 - RNA, 17 nt, Human
cuguaaggcucuagauc

SEQ ID NO: 1425843 - RNA, 16 nt, Human
cuguaaggcucuagau

SEQ ID NO: 1425844 - RNA, 15 nt, Human
cuguaaggcucuaga

SEQ ID NO: 1425845 - RNA, 14 nt, Human
cuguaaggcucuag

SEQ ID NO: 1425846 - RNA, 13 nt, Human
cuguaaggcucua

SEQ ID NO: 1425847 - RNA, 18 nt, Human
cuguaauuugugauacaa

SEQ ID NO: 1425848 - RNA, 17 nt, Human
cuguaauuugugauaca

SEQ ID NO: 1425849 - RNA, 22 nt, Human
cuggugugguacagagaagcca

SEQ ID NO: 1425850 - RNA, 21 nt, Human
cuggugugguacagagaagcc

SEQ ID NO: 1425851 - RNA, 20 nt, Human
cuggugugguacagagaagc

SEQ ID NO: 1425852 - RNA, 19 nt, Human
cuggugugguacagagaag

SEQ ID NO: 1425853 - RNA, 18 nt, Human
cuggugugguacagagaa

SEQ ID NO: 1425854 - RNA, 17 nt, Human
cuggugugguacagaga

SEQ ID NO: 1425855 - RNA, 16 nt, Human
cuggugugguacagag

SEQ ID NO: 1425856 - RNA, 14 nt, Human
cuggugugguacag

SEQ ID NO: 1425857 - RNA, 15 nt, Human
cugguggcacaggag

SEQ ID NO: 1425858 - RNA, 18 nt, Human
cuggucucacccuggagg

SEQ ID NO: 1425859 - RNA, 23 nt, Human
cuggucucacccuggaggcaccu

SEQ ID NO: 1425860 - RNA, 17 nt, Human
cuggucucacccuggag

SEQ ID NO: 1425861 - RNA, 16 nt, Human
cuggucucacccugga

SEQ ID NO: 1425862 - RNA, 13 nt, Human
cuggucucacccu

SEQ ID NO: 1425863 - RNA, 23 nt, Human
cuggucucaaacuccugaccuca

SEQ ID NO: 1425864 - RNA, 14 nt, Human
cugguggcacagga

SEQ ID NO: 1425865 - RNA, 22 nt, Human
cugguuagguuaggacuugccc

SEQ ID NO: 1425866 - RNA, 19 nt, Human
cugguuaaauaaggcaggg

SEQ ID NO: 1425867 - RNA, 22 nt, Human
cugguguuaacagaagggaggg

SEQ ID NO: 1425868 - RNA, 17 nt, Human
cugguguuaacagaagg

SEQ ID NO: 1425869 - RNA, 16 nt, Human
cugguguuaacagaag

SEQ ID NO: 1425870 - RNA, 15 nt, Human
cugguguuaacagaa

SEQ ID NO: 1425871 - RNA, 14 nt, Human
cugguguuaacaga

SEQ ID NO: 1425872 - RNA, 13 nt, Human
cugguguuaacag

SEQ ID NO: 1425873 - RNA, 12 nt, Human
cugguguuaaca

SEQ ID NO: 1425874 - RNA, 23 nt, Human
cuggugugguacagagaagccag

SEQ ID NO: 1425875 - RNA, 22 nt, Human
cugguguuggacaagcuucuga

SEQ ID NO: 1425876 - RNA, 20 nt, Human
cugguguuggacaagcuucu

SEQ ID NO: 1425877 - RNA, 13 nt, Human
cugguguuucuug

SEQ ID NO: 1425878 - RNA, 14 nt, Human
cugguguuucuuga

SEQ ID NO: 1425879 - RNA, 22 nt, Human
cugguuccagggucccucugug

SEQ ID NO: 1425880 - RNA, 18 nt, Human
cugguuccagggucccuc

SEQ ID NO: 1425881 - RNA, 16 nt, Human
cugguuccaggguccc

SEQ ID NO: 1425882 - RNA, 15 nt, Human
cugguuccagggucc

SEQ ID NO: 1425883 - RNA, 14 nt, Human
cugguuccaggguc

SEQ ID NO: 1425884 - RNA, 13 nt, Human
cugguuccagggu

SEQ ID NO: 1425885 - RNA, 20 nt, Human
cugguucacacugaccaaga

SEQ ID NO: 1425886 - RNA, 21 nt, Human
cuguaaggauccggaaagaag

SEQ ID NO: 1425887 - RNA, 23 nt, Human
cugguuccagggucccucugugu

SEQ ID NO: 1425888 - RNA, 16 nt, Human
cugguuccauggccuc

SEQ ID NO: 1425889 - RNA, 18 nt, Human
cuguaaggcaaucauggu

SEQ ID NO: 1425890 - RNA, 18 nt, Human
cugguaggaccaagcauc

SEQ ID NO: 1425891 - RNA, 17 nt, Human
cugguaggaccaagcau

SEQ ID NO: 1425892 - RNA, 15 nt, Human
cugguaggaccaagc

SEQ ID NO: 1425893 - RNA, 23 nt, Human
cugguaggaauagcaugucacua

SEQ ID NO: 1425894 - RNA, 22 nt, Human
cugguaggaauagcaugucacu

SEQ ID NO: 1425895 - RNA, 20 nt, Human
cugguaggaauagcauguca

SEQ ID NO: 1425896 - RNA, 13 nt, Human
cugguagagcagg

SEQ ID NO: 1425897 - RNA, 22 nt, Human
cugguagaagggaaagcccaua

SEQ ID NO: 1425898 - RNA, 21 nt, Human
cugguagaagggaaagcccau

SEQ ID NO: 1425899 - RNA, 17 nt, Human
cugguagaagggaaagc

SEQ ID NO: 1425900 - RNA, 23 nt, Human
cuggucaccuaggaagccucaga

SEQ ID NO: 1425901 - RNA, 18 nt, Human
cuggucacggauuugugu

SEQ ID NO: 1425902 - RNA, 22 nt, Human
cuggucaccuaggaagccucag

SEQ ID NO: 1425903 - RNA, 19 nt, Human
cuggucaccuaggaagccu

SEQ ID NO: 1425904 - RNA, 18 nt, Human
cuggucaccuaggaagcc

SEQ ID NO: 1425905 - RNA, 17 nt, Human
cuggucaccuaggaagc

SEQ ID NO: 1425906 - RNA, 16 nt, Human
cuggucaccuaggaag

SEQ ID NO: 1425907 - RNA, 14 nt, Human
cuggucaccuagga

SEQ ID NO: 1425908 - RNA, 22 nt, Human
cugguccaaaagauugcugaaa

SEQ ID NO: 1425909 - RNA, 15 nt, Human
cugguccaaaagauu

SEQ ID NO: 1425910 - RNA, 22 nt, Human
cugggcuccggaggacucacca

SEQ ID NO: 1425911 - RNA, 22 nt, Human
cugggccuauggagagcccugg

SEQ ID NO: 1425912 - RNA, 23 nt, Human
cugggccuauggagagcccuggg

SEQ ID NO: 1425913 - RNA, 21 nt, Human
cugggccuauggagagcccug

SEQ ID NO: 1425914 - RNA, 20 nt, Human
cugggccuauggagagcccu

SEQ ID NO: 1425915 - RNA, 23 nt, Human
cuggguugggaucagggguagga

SEQ ID NO: 1425916 - RNA, 16 nt, Human
cuggguugggaucagg

SEQ ID NO: 1425917 - RNA, 14 nt, Human
cuggguugggauca

SEQ ID NO: 1425918 - RNA, 17 nt, Human
cugggucgcccuggacu

SEQ ID NO: 1425919 - RNA, 18 nt, Human
cugggucgcccuggacug

SEQ ID NO: 1425920 - RNA, 19 nt, Human
cugggucucaccggcucuc

SEQ ID NO: 1425921 - RNA, 23 nt, Human
cugggucucaccggcucucaccu

SEQ ID NO: 1425922 - RNA, 22 nt, Human
cugggucgcccuggacugugug

SEQ ID NO: 1425923 - RNA, 21 nt, Human
cugucccuugccucaaugcca

SEQ ID NO: 1425924 - RNA, 20 nt, Human
cugucccuugccucaaugcc

SEQ ID NO: 1425925 - RNA, 16 nt, Human
cugucccuugccucaa

SEQ ID NO: 1425926 - RNA, 15 nt, Human
cugucccuugccuca

SEQ ID NO: 1425927 - RNA, 13 nt, Human
cugucccuugccu

SEQ ID NO: 1425928 - RNA, 22 nt, Human
cugucccuugccccccuggccu

SEQ ID NO: 1425929 - RNA, 21 nt, Human
cugucccuugccccccuggcc

SEQ ID NO: 1425930 - RNA, 20 nt, Human
cugucccuugccccccuggc

SEQ ID NO: 1425931 - RNA, 18 nt, Human
cugucccuugccccccug

SEQ ID NO: 1425932 - RNA, 12 nt, Human
cugucccuccgg

SEQ ID NO: 1425933 - RNA, 15 nt, Human
cugucccucccccuu

SEQ ID NO: 1425934 - RNA, 11 nt, Human
cugucccuagg

SEQ ID NO: 1425935 - RNA, 21 nt, Human
cuguccccccacucccucaca

SEQ ID NO: 1425936 - RNA, 16 nt, Human
cuguccccccacuccc

SEQ ID NO: 1425937 - RNA, 15 nt, Human
cuguccccccacucc

SEQ ID NO: 1425938 - RNA, 13 nt, Human
cuguccccccacu

SEQ ID NO: 1425939 - RNA, 15 nt, Human
cuguccccagccugg

SEQ ID NO: 1425940 - RNA, 16 nt, Human
cuguccccagccuggg

SEQ ID NO: 1425941 - RNA, 14 nt, Human
cuguccccagccug

SEQ ID NO: 1425942 - RNA, 12 nt, Human
cuguccccagcc

SEQ ID NO: 1425943 - RNA, 17 nt, Human
cugucucucaugaaccu

SEQ ID NO: 1425944 - RNA, 13 nt, Human
cugucucucauga

SEQ ID NO: 1425945 - RNA, 20 nt, Human
cugucucucagggccaggcc

SEQ ID NO: 1425946 - RNA, 19 nt, Human
cugucucucagggccaggc

SEQ ID NO: 1425947 - RNA, 22 nt, Human
cugucucgagcgcccugcagac

SEQ ID NO: 1425948 - RNA, 23 nt, Human
cugucucgagcgcccugcagacc

SEQ ID NO: 1425949 - RNA, 21 nt, Human
cugucucgagcgcccugcaga

SEQ ID NO: 1425950 - RNA, 20 nt, Human
cugucucgagcgcccugcag

SEQ ID NO: 1425951 - RNA, 19 nt, Human
cugucucgagcgcccugca

SEQ ID NO: 1425952 - RNA, 18 nt, Human
cugucucgagcgcccugc

SEQ ID NO: 1425953 - RNA, 17 nt, Human
cugucucgagcgcccug

SEQ ID NO: 1425954 - RNA, 16 nt, Human
cugucucgagcgcccu

SEQ ID NO: 1425955 - RNA, 15 nt, Human
cugucucgagcgccc

SEQ ID NO: 1425956 - RNA, 20 nt, Human
cugucuccucucucuguaau

SEQ ID NO: 1425957 - RNA, 21 nt, Human
cugucucauccaucaucaugu

SEQ ID NO: 1425958 - RNA, 20 nt, Human
cugucucauccaucaucaug

SEQ ID NO: 1425959 - RNA, 17 nt, Human
cugucucauccaucauc

SEQ ID NO: 1425960 - RNA, 16 nt, Human
cugucucauccaucau

SEQ ID NO: 1425961 - RNA, 15 nt, Human
cugucucauccauca

SEQ ID NO: 1425962 - RNA, 12 nt, Human
cugucucaucca

SEQ ID NO: 1425963 - RNA, 13 nt, Human
cuguccucagccu

SEQ ID NO: 1425964 - RNA, 23 nt, Human
cugucccuugccccccuggccuc

SEQ ID NO: 1425965 - RNA, 12 nt, Human
cuguccagaaag

SEQ ID NO: 1425966 - RNA, 22 nt, Human
cuguccacaggcuucugagcag

SEQ ID NO: 1425967 - RNA, 17 nt, Human
cuguccacaggcuucug

SEQ ID NO: 1425968 - RNA, 16 nt, Human
cugucccacccccacc

SEQ ID NO: 1425969 - RNA, 14 nt, Human
cugucccaccccca

SEQ ID NO: 1425970 - RNA, 19 nt, Human
cuguauuuuaaaagaauga

SEQ ID NO: 1425971 - RNA, 15 nt, Human
cuguccaaacugccu

SEQ ID NO: 1425972 - RNA, 20 nt, Human
cuguccaaacugccuaagcc

SEQ ID NO: 1425973 - RNA, 19 nt, Human
cuguauuuguucccaagag

SEQ ID NO: 1425974 - RNA, 18 nt, Human
cuguauuuguucccaaga

SEQ ID NO: 1425975 - RNA, 17 nt, Human
cuguauuuguucccaag

SEQ ID NO: 1425976 - RNA, 16 nt, Human
cuguauuuguucccaa

SEQ ID NO: 1425977 - RNA, 15 nt, Human
cuguauuuguuccca

SEQ ID NO: 1425978 - RNA, 16 nt, Human
cuguauuuuaaaagaa

SEQ ID NO: 1425979 - RNA, 13 nt, Human
cuguauuuuaaaa

SEQ ID NO: 1425980 - RNA, 18 nt, Human
cuguauuugaaucagccu

SEQ ID NO: 1425981 - RNA, 22 nt, Human
cuguauuugaaauaagaauuca

SEQ ID NO: 1425982 - RNA, 18 nt, Human
cuguauuugaaauaagaa

SEQ ID NO: 1425983 - RNA, 15 nt, Human
cuguauuaagccacu

SEQ ID NO: 1425984 - RNA, 16 nt, Human
cuguauguucaacuag

SEQ ID NO: 1425985 - RNA, 13 nt, Human
cuguauauacuuu

SEQ ID NO: 1425986 - RNA, 15 nt, Human
cuguaugauucccag

SEQ ID NO: 1425987 - RNA, 20 nt, Human
cuguaccuuuugaggagccc

SEQ ID NO: 1425988 - RNA, 14 nt, Human
cuguaccugagagg

SEQ ID NO: 1425989 - RNA, 22 nt, Human
cuguaccucuugagccuugaac

SEQ ID NO: 1425990 - RNA, 20 nt, Human
cuguauagcugcuuccagug

SEQ ID NO: 1425991 - RNA, 22 nt, Human
cuguaccuuuugaggagcccca

SEQ ID NO: 1425992 - RNA, 19 nt, Human
cuugcacgaccgccccagu

SEQ ID NO: 1425993 - RNA, 20 nt, Human
cuugcacgaccgccccaguu

SEQ ID NO: 1425994 - RNA, 22 nt, Human
cuugagugggguuaucucugug

SEQ ID NO: 1425995 - RNA, 23 nt, Human
cuugagugggguuaucucugugu

SEQ ID NO: 1425996 - RNA, 21 nt, Human
cuugagugggguuaucucugu

SEQ ID NO: 1425997 - RNA, 16 nt, Human
cuugaggucucagccc

SEQ ID NO: 1425998 - RNA, 16 nt, Human
cuugagugcucaguag

SEQ ID NO: 1425999 - RNA, 22 nt, Human
cuugcaaaguaucccuacugua

SEQ ID NO: 1426000 - RNA, 23 nt, Human
cuugcaggaaggacuaugaaaag

SEQ ID NO: 1426001 - RNA, 16 nt, Human
cuugagcaguggcugg

SEQ ID NO: 1426002 - RNA, 14 nt, Human
cuugagcaguggcu

SEQ ID NO: 1426003 - RNA, 13 nt, Human
cuugagcaguggc

SEQ ID NO: 1426004 - RNA, 21 nt, Human
cuugaccaggcugccucccuu

SEQ ID NO: 1426005 - RNA, 16 nt, Human
cuugagccaguaauug

SEQ ID NO: 1426006 - RNA, 13 nt, Human
cuugagccaguaa

SEQ ID NO: 1426007 - RNA, 22 nt, Human
cuugagcauguuacugacagag

SEQ ID NO: 1426008 - RNA, 16 nt, Human
cuugagcauguuacug

SEQ ID NO: 1426009 - RNA, 21 nt, Human
cuugagcaguggcugguccag

SEQ ID NO: 1426010 - RNA, 19 nt, Human
cuugagccuugaacuuuga

SEQ ID NO: 1426011 - RNA, 12 nt, Human
cuugaggacaca

SEQ ID NO: 1426012 - RNA, 13 nt, Human
cuugaggacacau

SEQ ID NO: 1426013 - RNA, 14 nt, Human
cuugaggacacaug

SEQ ID NO: 1426014 - RNA, 15 nt, Human
cuugaggacacaugu

SEQ ID NO: 1426015 - RNA, 16 nt, Human
cuugaggacacauguc

SEQ ID NO: 1426016 - RNA, 20 nt, Human
cuugagccuugaacuuugac

SEQ ID NO: 1426017 - RNA, 22 nt, Human
cuugagccuugaacuuugaccu

SEQ ID NO: 1426018 - RNA, 18 nt, Human
cuugaggucucagccccu

SEQ ID NO: 1426019 - RNA, 18 nt, Human
cuugagggcaagagccac

SEQ ID NO: 1426020 - RNA, 17 nt, Human
cuugaggacacaugucc

SEQ ID NO: 1426021 - RNA, 18 nt, Human
cuugaggacacaugucca

SEQ ID NO: 1426022 - RNA, 14 nt, Human
cuucuuuugcucuu

SEQ ID NO: 1426023 - RNA, 13 nt, Human
cuucuuuugcucu

SEQ ID NO: 1426024 - RNA, 19 nt, Human
cuucuuuuaaaccauuuuc

SEQ ID NO: 1426025 - RNA, 21 nt, Human
cuugaaauuaagaaggcaaaa

SEQ ID NO: 1426026 - RNA, 19 nt, Human
cuugaaauauccugcuuga

SEQ ID NO: 1426027 - RNA, 18 nt, Human
cuugaaauauccugcuug

SEQ ID NO: 1426028 - RNA, 19 nt, Human
cuugaaauauaggaacuua

SEQ ID NO: 1426029 - RNA, 19 nt, Human
cuucuuuuuucaaaagaaa

SEQ ID NO: 1426030 - RNA, 20 nt, Human
cuucuuuuuucaaaagaaag

SEQ ID NO: 1426031 - RNA, 16 nt, Human
cuucuuucuagaaaga

SEQ ID NO: 1426032 - RNA, 21 nt, Human
cuucuuucuuugggaauauuu

SEQ ID NO: 1426033 - RNA, 17 nt, Human
cuucuuucauuucuucu

SEQ ID NO: 1426034 - RNA, 19 nt, Human
cuucuuuccacagaagcuc

SEQ ID NO: 1426035 - RNA, 13 nt, Human
cuucuuuccacag

SEQ ID NO: 1426036 - RNA, 14 nt, Human
cuugaaauuuuaac

SEQ ID NO: 1426037 - RNA, 13 nt, Human
cuugaaauuuuaa

SEQ ID NO: 1426038 - RNA, 20 nt, Human
cuugaaauuaagaaggcaaa

SEQ ID NO: 1426039 - RNA, 13 nt, Human
cuugaccaggcug

SEQ ID NO: 1426040 - RNA, 14 nt, Human
cuugaacugauuca

SEQ ID NO: 1426041 - RNA, 15 nt, Human
cuugaacuuugaccu

SEQ ID NO: 1426042 - RNA, 21 nt, Human
cuuggauucuuuccauuugca

SEQ ID NO: 1426043 - RNA, 18 nt, Human
cuuggauucuuuccauuu

SEQ ID NO: 1426044 - RNA, 17 nt, Human
cuuggauucuuuccauu

SEQ ID NO: 1426045 - RNA, 16 nt, Human
cuuggauucuuuccau

SEQ ID NO: 1426046 - RNA, 17 nt, Human
cuuggauuccugauagu

SEQ ID NO: 1426047 - RNA, 18 nt, Human
cuuggauguaccugcccc

SEQ ID NO: 1426048 - RNA, 16 nt, Human
cuuggauacuuggauu

SEQ ID NO: 1426049 - RNA, 20 nt, Human
cuuggagcuauuuuccaggc

SEQ ID NO: 1426050 - RNA, 19 nt, Human
cuuggagcuauuuuccagg

SEQ ID NO: 1426051 - RNA, 22 nt, Human
cuuggcucgaaucucugugccu

SEQ ID NO: 1426052 - RNA, 21 nt, Human
cuuggcucgaaucucugugcc

SEQ ID NO: 1426053 - RNA, 20 nt, Human
cuuggcucgaaucucugugc

SEQ ID NO: 1426054 - RNA, 19 nt, Human
cuuggcucgaaucucugug

SEQ ID NO: 1426055 - RNA, 18 nt, Human
cuuggcucgaaucucugu

SEQ ID NO: 1426056 - RNA, 23 nt, Human
cuuggcucacacucgacaugaaa

SEQ ID NO: 1426057 - RNA, 21 nt, Human
cuugcuuucuuuguuuggcug

SEQ ID NO: 1426058 - RNA, 18 nt, Human
cuugcuuggggaacuugu

SEQ ID NO: 1426059 - RNA, 16 nt, Human
cuugcuggucuaguca

SEQ ID NO: 1426060 - RNA, 22 nt, Human
cuuggacauccuccucccaccc

SEQ ID NO: 1426061 - RNA, 21 nt, Human
cuuggacauccuccucccacc

SEQ ID NO: 1426062 - RNA, 20 nt, Human
cuuggacauccuccucccac

SEQ ID NO: 1426063 - RNA, 19 nt, Human
cuuggacauccuccuccca

SEQ ID NO: 1426064 - RNA, 17 nt, Human
cuuggacauccuccucc

SEQ ID NO: 1426065 - RNA, 16 nt, Human
cuuggacauccuccuc

SEQ ID NO: 1426066 - RNA, 15 nt, Human
cuuggacauccuccu

SEQ ID NO: 1426067 - RNA, 14 nt, Human
cuugcuuuucaugc

SEQ ID NO: 1426068 - RNA, 13 nt, Human
cuugcuuuucaug

SEQ ID NO: 1426069 - RNA, 15 nt, Human
cuugcuuuuaaaauc

SEQ ID NO: 1426070 - RNA, 13 nt, Human
cuugcuggaagac

SEQ ID NO: 1426071 - RNA, 13 nt, Human
cuugcauguaacg

SEQ ID NO: 1426072 - RNA, 14 nt, Human
cuugcauugcagag

SEQ ID NO: 1426073 - RNA, 17 nt, Human
cuugccaaauauaaaua

SEQ ID NO: 1426074 - RNA, 23 nt, Human
cuuggcuggugugguacagagaa

SEQ ID NO: 1426075 - RNA, 22 nt, Human
cuuggcuggugugguacagaga

SEQ ID NO: 1426076 - RNA, 21 nt, Human
cuuggcuggugugguacagag

SEQ ID NO: 1426077 - RNA, 20 nt, Human
cuuggcuggugugguacaga

SEQ ID NO: 1426078 - RNA, 14 nt, Human
cuuggcuggugugg

SEQ ID NO: 1426079 - RNA, 13 nt, Human
cuuggcuggugug

SEQ ID NO: 1426080 - RNA, 12 nt, Human
cuuggcuggugu

SEQ ID NO: 1426081 - RNA, 13 nt, Human
cuuggcugcagga

SEQ ID NO: 1426082 - RNA, 21 nt, Human
cuuggggauucuuccaucuga

SEQ ID NO: 1426083 - RNA, 19 nt, Human
cuuggggauucuuccaucu

SEQ ID NO: 1426084 - RNA, 21 nt, Human
cuuggggaguuuagggugggg

SEQ ID NO: 1426085 - RNA, 20 nt, Human
cuuggggaguuuaggguggg

SEQ ID NO: 1426086 - RNA, 23 nt, Human
cuuggggaguuaagaccuggcag

SEQ ID NO: 1426087 - RNA, 22 nt, Human
cuuggggaguuaagaccuggca

SEQ ID NO: 1426088 - RNA, 20 nt, Human
cuugguuuuuacugcucuga

SEQ ID NO: 1426089 - RNA, 21 nt, Human
cuugguuuugcuacauaauua

SEQ ID NO: 1426090 - RNA, 22 nt, Human
cuugguuuuuacugcucugaga

SEQ ID NO: 1426091 - RNA, 21 nt, Human
cuugguuuuuacugcucugag

SEQ ID NO: 1426092 - RNA, 12 nt, Human
cuuguaaauaua

SEQ ID NO: 1426093 - RNA, 23 nt, Human
cuugguuuuuacugcucugagaa

SEQ ID NO: 1426094 - RNA, 18 nt, Human
cuuguaaaggaauuuaaa

SEQ ID NO: 1426095 - RNA, 20 nt, Human
cuugucaggaguguguguga

SEQ ID NO: 1426096 - RNA, 21 nt, Human
cuugucaggagugugugugag

SEQ ID NO: 1426097 - RNA, 17 nt, Human
cuugucaggagugugug

SEQ ID NO: 1426098 - RNA, 22 nt, Human
cuugucacugguagaccaaaau

SEQ ID NO: 1426099 - RNA, 23 nt, Human
cuugucacugguagaccaaaaua

SEQ ID NO: 1426100 - RNA, 15 nt, Human
cuugucacugguaga

SEQ ID NO: 1426101 - RNA, 23 nt, Human
cuugucacgccagacuucccacg

SEQ ID NO: 1426102 - RNA, 18 nt, Human
cuuguauuauguguguuu

SEQ ID NO: 1426103 - RNA, 19 nt, Human
cuuguaaauauaaagacgu

SEQ ID NO: 1426104 - RNA, 22 nt, Human
cuuguaacuaaaauaauuuugu

SEQ ID NO: 1426105 - RNA, 17 nt, Human
cuuguaacuaaaauaau

SEQ ID NO: 1426106 - RNA, 16 nt, Human
cuuguaacuaaaauaa

SEQ ID NO: 1426107 - RNA, 14 nt, Human
cuuguaacuaaaau

SEQ ID NO: 1426108 - RNA, 23 nt, Human
cuuguaaauuauuaauuuaugca

SEQ ID NO: 1426109 - RNA, 17 nt, Human
cuuguaaauauaaagac

SEQ ID NO: 1426110 - RNA, 16 nt, Human
cuuguaaauauaaaga

SEQ ID NO: 1426111 - RNA, 14 nt, Human
cuuguaaauauaaa

SEQ ID NO: 1426112 - RNA, 13 nt, Human
cuuguaaauauaa

SEQ ID NO: 1426113 - RNA, 18 nt, Human
cuuguauccccugcaggc

SEQ ID NO: 1426114 - RNA, 13 nt, Human
cuuguauuaugug

SEQ ID NO: 1426115 - RNA, 22 nt, Human
cuuuccacggagccacuccucu

SEQ ID NO: 1426116 - RNA, 21 nt, Human
cuuuccacggagccacuccuc

SEQ ID NO: 1426117 - RNA, 18 nt, Human
cuuucauuccuucagauu

SEQ ID NO: 1426118 - RNA, 16 nt, Human
cuuuccaaaguacacu

SEQ ID NO: 1426119 - RNA, 22 nt, Human
cuuuccaaaguacacuguuuca

SEQ ID NO: 1426120 - RNA, 23 nt, Human
cuuucccuuguagcuccuccccu

SEQ ID NO: 1426121 - RNA, 21 nt, Human
cuuucccuuguagcuccuccc

SEQ ID NO: 1426122 - RNA, 19 nt, Human
cuuuccccaccagaugcug

SEQ ID NO: 1426123 - RNA, 22 nt, Human
cuuuccccaccagaugcugaaa

SEQ ID NO: 1426124 - RNA, 18 nt, Human
cuuuccccaccagaugcu

SEQ ID NO: 1426125 - RNA, 17 nt, Human
cuuucccauggggaggg

SEQ ID NO: 1426126 - RNA, 21 nt, Human
cuuucauguaaacugugcacc

SEQ ID NO: 1426127 - RNA, 20 nt, Human
cuuucauguaaacugugcac

SEQ ID NO: 1426128 - RNA, 19 nt, Human
cuuucauguaaacugugca

SEQ ID NO: 1426129 - RNA, 17 nt, Human
cuuucauguaaacugug

SEQ ID NO: 1426130 - RNA, 23 nt, Human
cuuucaagcagucgugccugugu

SEQ ID NO: 1426131 - RNA, 22 nt, Human
cuuucaagcagucgugccugug

SEQ ID NO: 1426132 - RNA, 20 nt, Human
cuuucaagcagucgugccug

SEQ ID NO: 1426133 - RNA, 19 nt, Human
cuuucaagcagucgugccu

SEQ ID NO: 1426134 - RNA, 19 nt, Human
cuuucaaaaccuuuugaaa

SEQ ID NO: 1426135 - RNA, 11 nt, Human
cuuuauuuuga

SEQ ID NO: 1426136 - RNA, 21 nt, Human
cuuguguguaugcacaugaac

SEQ ID NO: 1426137 - RNA, 20 nt, Human
cuuguguguaugcacaugaa

SEQ ID NO: 1426138 - RNA, 21 nt, Human
cuugugucucugugcuuuuaa

SEQ ID NO: 1426139 - RNA, 18 nt, Human
cuugugucucugugcuuu

SEQ ID NO: 1426140 - RNA, 17 nt, Human
cuugugucucugugcuu

SEQ ID NO: 1426141 - RNA, 14 nt, Human
cuugucaugugaca

SEQ ID NO: 1426142 - RNA, 13 nt, Human
cuuuauuuugaga

SEQ ID NO: 1426143 - RNA, 22 nt, Human
cuuguguguaugcacaugaacu

SEQ ID NO: 1426144 - RNA, 19 nt, Human
cuuuauuuuguguuuagga

SEQ ID NO: 1426145 - RNA, 16 nt, Human
cuuugaauguguuuca

SEQ ID NO: 1426146 - RNA, 14 nt, Human
cuuugaauguguuu

SEQ ID NO: 1426147 - RNA, 16 nt, Human
cuuugaaugcggccca

SEQ ID NO: 1426148 - RNA, 23 nt, Human
cuuugaauccucucucuguguua

SEQ ID NO: 1426149 - RNA, 19 nt, Human
cuuugaauccucucucugu

SEQ ID NO: 1426150 - RNA, 18 nt, Human
cuuugaauccucucucug

SEQ ID NO: 1426151 - RNA, 19 nt, Human
cuuugaauaaaugucacuu

SEQ ID NO: 1426152 - RNA, 18 nt, Human
cuuugaauaaaugucacu

SEQ ID NO: 1426153 - RNA, 16 nt, Human
cuuugaauaaauguca

SEQ ID NO: 1426154 - RNA, 14 nt, Human
cuuugaauaaaugu

SEQ ID NO: 1426155 - RNA, 12 nt, Human
cuuugaauaaau

SEQ ID NO: 1426156 - RNA, 21 nt, Human
cuuugaaguuagcuuuaacuu

SEQ ID NO: 1426157 - RNA, 11 nt, Human
cuuugaauaaa

SEQ ID NO: 1426158 - RNA, 16 nt, Human
cuuugaagucauacca

SEQ ID NO: 1426159 - RNA, 17 nt, Human
cuuugaaguagcucuuu

SEQ ID NO: 1426160 - RNA, 13 nt, Human
cuuugaaguagcu

SEQ ID NO: 1426161 - RNA, 18 nt, Human
cuuugaaggggccucacc

SEQ ID NO: 1426162 - RNA, 18 nt, Human
cuuugaauguguuucaca

SEQ ID NO: 1426163 - RNA, 23 nt, Human
cuuugaauguguuucacaguuug

SEQ ID NO: 1426164 - RNA, 24 nt, Human
cuuuggaaaguacacucugcuguu

SEQ ID NO: 1426165 - RNA, 23 nt, Human
cuuuggaaaguacacucugcugu

SEQ ID NO: 1426166 - RNA, 22 nt, Human
cuuuggaaaguacacucugcug

SEQ ID NO: 1426167 - RNA, 11 nt, Human
cuuugccucaa

SEQ ID NO: 1426168 - RNA, 16 nt, Human
cuuugcccuucuuucu

SEQ ID NO: 1426169 - RNA, 19 nt, Human
cuuugcccuucuuucuacc

SEQ ID NO: 1426170 - RNA, 18 nt, Human
cuuugcccaguuggagac

SEQ ID NO: 1426171 - RNA, 15 nt, Human
cuuugcccagaaaga

SEQ ID NO: 1426172 - RNA, 14 nt, Human
cuuugcccacaaug

SEQ ID NO: 1426173 - RNA, 22 nt, Human
cuuugccaggugacugucuggg

SEQ ID NO: 1426174 - RNA, 21 nt, Human
cuuugccaggugacugucugg

SEQ ID NO: 1426175 - RNA, 16 nt, Human
cuuugcacugauauau

SEQ ID NO: 1426176 - RNA, 13 nt, Human
cuuugccagguga

SEQ ID NO: 1426177 - RNA, 21 nt, Human
cuuugccacccucaugcugug

SEQ ID NO: 1426178 - RNA, 23 nt, Human
cuuucuguuccaaauucaguuuc

SEQ ID NO: 1426179 - RNA, 11 nt, Human
cuuucuuagaa

SEQ ID NO: 1426180 - RNA, 13 nt, Human
cuuucuuagaaau

SEQ ID NO: 1426181 - RNA, 14 nt, Human
cuuucuuagaaauu

SEQ ID NO: 1426182 - RNA, 22 nt, Human
cuuucuuccaaacaggcucaga

SEQ ID NO: 1426183 - RNA, 19 nt, Human
cuuucuuccaaacaggcuc

SEQ ID NO: 1426184 - RNA, 13 nt, Human
cuuucuuccaaac

SEQ ID NO: 1426185 - RNA, 17 nt, Human
cuuucuuagaaauuuau

SEQ ID NO: 1426186 - RNA, 16 nt, Human
cuuugaaggggccuca

SEQ ID NO: 1426187 - RNA, 20 nt, Human
cuuugaaauugaaccuuugu

SEQ ID NO: 1426188 - RNA, 23 nt, Human
cuuugaaauugaaccuuugugcc

SEQ ID NO: 1426189 - RNA, 18 nt, Human
cuuugaaauugaaccuuu

SEQ ID NO: 1426190 - RNA, 20 nt, Human
cuuugaaauuauguaaauua

SEQ ID NO: 1426191 - RNA, 22 nt, Human
cuuucuuuucuggaauguaauc

SEQ ID NO: 1426192 - RNA, 18 nt, Human
cuuucuuuguuuggcugg

SEQ ID NO: 1426193 - RNA, 23 nt, Human
cuuucuuugggaauauuugaauc

SEQ ID NO: 1426194 - RNA, 18 nt, Human
cuuucuuugggaauauuu

SEQ ID NO: 1426195 - RNA, 20 nt, Human
cuuucuuugggaauauuuga

SEQ ID NO: 1426196 - RNA, 21 nt, Human
cuuucuuugggaauauuugaa

SEQ ID NO: 1426197 - RNA, 22 nt, Human
cuuucuuugggaauauuugaau

SEQ ID NO: 1426198 - RNA, 15 nt, Human
cuuucuuuauuuuga

SEQ ID NO: 1426199 - RNA, 13 nt, Human
cuuucuuucuuua

SEQ ID NO: 1426200 - RNA, 16 nt, Human
cuuucuuucuuagaaa

SEQ ID NO: 1426201 - RNA, 17 nt, Human
cuuucuuucuuagaaau

SEQ ID NO: 1426202 - RNA, 21 nt, Human
cuuucuuucaauaaaacgcag

SEQ ID NO: 1426203 - RNA, 15 nt, Human
cuuucuuucuuagaa

SEQ ID NO: 1426204 - RNA, 20 nt, Human
cuuuucuaacagaaagcaug

SEQ ID NO: 1426205 - RNA, 16 nt, Human
cuuuucuaacagaaag

SEQ ID NO: 1426206 - RNA, 24 nt, Human
cuuuugcaaccaggaacagcaaau

SEQ ID NO: 1426207 - RNA, 17 nt, Human
cuuuugcaaccaggaac

SEQ ID NO: 1426208 - RNA, 16 nt, Human
cuuuugcaaccaggaa

SEQ ID NO: 1426209 - RNA, 15 nt, Human
cuuuugcaaccagga

SEQ ID NO: 1426210 - RNA, 21 nt, Human
cuuuugcaaagaaagaaaaaa

SEQ ID NO: 1426211 - RNA, 20 nt, Human
cuuuugcaaagaaagaaaaa

SEQ ID NO: 1426212 - RNA, 13 nt, Human
cuuuugauauuaa

SEQ ID NO: 1426213 - RNA, 16 nt, Human
cuuuugauauuaaauu

SEQ ID NO: 1426214 - RNA, 23 nt, Human
cuuuugauaugcauauuuguuua

SEQ ID NO: 1426215 - RNA, 15 nt, Human
cuuuugauaugcaua

SEQ ID NO: 1426216 - RNA, 13 nt, Human
cuuuucuuuucuu

SEQ ID NO: 1426217 - RNA, 14 nt, Human
cuuuuuaauaugcu

SEQ ID NO: 1426218 - RNA, 21 nt, Human
cuuuuuaaauguaaagauauu

SEQ ID NO: 1426219 - RNA, 20 nt, Human
cuuuuuaaauguaaagauau

SEQ ID NO: 1426220 - RNA, 18 nt, Human
cuuuugcaacuuaauacu

SEQ ID NO: 1426221 - RNA, 16 nt, Human
cuuuuuaccuuucaua

SEQ ID NO: 1426222 - RNA, 17 nt, Human
cuuuuuaccuuucauac

SEQ ID NO: 1426223 - RNA, 15 nt, Human
cuuuuuaccuuucau

SEQ ID NO: 1426224 - RNA, 16 nt, Human
cuuuuuaauaugcuua

SEQ ID NO: 1426225 - RNA, 15 nt, Human
cuuuuuaauaugcuu

SEQ ID NO: 1426226 - RNA, 23 nt, Human
cuuuuuccaacuuggcugcagga

SEQ ID NO: 1426227 - RNA, 17 nt, Human
cuuuuuccaacaagaag

SEQ ID NO: 1426228 - RNA, 14 nt, Human
cuuuuuauauauau

SEQ ID NO: 1426229 - RNA, 23 nt, Human
cuuuuucauuuaucuauaauuua

SEQ ID NO: 1426230 - RNA, 15 nt, Human
cuuuuucauuuaucu

SEQ ID NO: 1426231 - RNA, 13 nt, Human
cuuuuucauuuau

SEQ ID NO: 1426232 - RNA, 12 nt, Human
cuuuuucauuua

SEQ ID NO: 1426233 - RNA, 20 nt, Human
cuuuuuauauauauauauaa

SEQ ID NO: 1426234 - RNA, 13 nt, Human
cuuuuuccagagg

SEQ ID NO: 1426235 - RNA, 15 nt, Human
cuuuuuuauacauaa

SEQ ID NO: 1426236 - RNA, 16 nt, Human
cuuuuuuauacauaaa

SEQ ID NO: 1426237 - RNA, 17 nt, Human
cuuuuuuauacauaaac

SEQ ID NO: 1426238 - RNA, 21 nt, Human
cuuuuucuccagcugggcucu

SEQ ID NO: 1426239 - RNA, 22 nt, Human
cuuuuuccaacucagaaauuca

SEQ ID NO: 1426240 - RNA, 18 nt, Human
cuuuuuuauacauaaaca

SEQ ID NO: 1426241 - RNA, 19 nt, Human
cuuuuuuaucaugugaaau

SEQ ID NO: 1426242 - RNA, 16 nt, Human
cuuuuuucaaaagaaa

SEQ ID NO: 1426243 - RNA, 16 nt, Human
cuuuuccucucucccg

SEQ ID NO: 1426244 - RNA, 19 nt, Human
cuuuucccuuugugaguca

SEQ ID NO: 1426245 - RNA, 20 nt, Human
cuuuuccuucccuuuucugu

SEQ ID NO: 1426246 - RNA, 22 nt, Human
cuuuuccuucccuuuucuguuc

SEQ ID NO: 1426247 - RNA, 16 nt, Human
cuuuuccuucccuuuu

SEQ ID NO: 1426248 - RNA, 15 nt, Human
cuuuuccuucccaaa

SEQ ID NO: 1426249 - RNA, 18 nt, Human
cuuuuccucucucccgga

SEQ ID NO: 1426250 - RNA, 21 nt, Human
cuuuucacauccauuuccccu

SEQ ID NO: 1426251 - RNA, 18 nt, Human
cuuuuaaugaacaaaugg

SEQ ID NO: 1426252 - RNA, 16 nt, Human
cuuuuaaugaacaaau

SEQ ID NO: 1426253 - RNA, 15 nt, Human
cuuuuaaugaacaaa

SEQ ID NO: 1426254 - RNA, 16 nt, Human
cuuuggaccuaaucca

SEQ ID NO: 1426255 - RNA, 21 nt, Human
cuuuggaccuaaauggccuca

SEQ ID NO: 1426256 - RNA, 22 nt, Human
cuuuggaaccagacucuugccu

SEQ ID NO: 1426257 - RNA, 23 nt, Human
cuuuggaaccagacucuugccug

SEQ ID NO: 1426258 - RNA, 21 nt, Human
cuuuggaaccagacucuugcc

SEQ ID NO: 1426259 - RNA, 16 nt, Human
cuuuggaaccagacuc

SEQ ID NO: 1426260 - RNA, 15 nt, Human
cuuuggaaccagacu

SEQ ID NO: 1426261 - RNA, 14 nt, Human
cuuuggaaccagac

SEQ ID NO: 1426262 - RNA, 17 nt, Human
cuuuggaccuaauccaa

SEQ ID NO: 1426263 - RNA, 12 nt, Human
cuuuggacuugu

SEQ ID NO: 1426264 - RNA, 18 nt, Human
cuuuggaguccccucacc

SEQ ID NO: 1426265 - RNA, 16 nt, Human
cuuuggaguccccuca

SEQ ID NO: 1426266 - RNA, 14 nt, Human
cuuuggaguccccu

SEQ ID NO: 1426267 - RNA, 22 nt, Human
cuuuggaguccccucaccuccu

SEQ ID NO: 1426268 - RNA, 22 nt, Human
cuuuuaacagagucugaaccua

SEQ ID NO: 1426269 - RNA, 22 nt, Human
cuuuuaacuguuguagaagaca

SEQ ID NO: 1426270 - RNA, 15 nt, Human
cuuuuaaacugugua

SEQ ID NO: 1426271 - RNA, 13 nt, Human
cuuuuaaacugug

SEQ ID NO: 1426272 - RNA, 12 nt, Human
cuuuuaaacugu

SEQ ID NO: 1426273 - RNA, 17 nt, Human
cuuuuaaaccauuuucu

SEQ ID NO: 1426274 - RNA, 15 nt, Human
cuuuuaaaagauuuu

SEQ ID NO: 1426275 - RNA, 22 nt, Human
cuuuuaaagaaaaaaauugaaa

SEQ ID NO: 1426276 - RNA, 21 nt, Human
cuuuuaaagaaaaaaauugaa

SEQ ID NO: 1426277 - RNA, 15 nt, Human
cuuuuaaagaaaaaa

SEQ ID NO: 1426278 - RNA, 23 nt, Human
cuuuuaaagaaaaaaauugaaau

SEQ ID NO: 1426279 - RNA, 22 nt, Human
cuuuuaaaugauugaauuauau

SEQ ID NO: 1426280 - RNA, 15 nt, Human
gaaacugcagggaaa

SEQ ID NO: 1426281 - RNA, 22 nt, Human
gaaacugaggaauuuucuuugu

SEQ ID NO: 1426282 - RNA, 18 nt, Human
gaaacugaggaauuuucu

SEQ ID NO: 1426283 - RNA, 20 nt, Human
gaaagcaagaaucagagaag

SEQ ID NO: 1426284 - RNA, 18 nt, Human
gaaagcaaagcacagaga

SEQ ID NO: 1426285 - RNA, 16 nt, Human
gaaagcaaagcacaga

SEQ ID NO: 1426286 - RNA, 15 nt, Human
gaaagcaaagcacag

SEQ ID NO: 1426287 - RNA, 12 nt, Human
gaaagcaaagca

SEQ ID NO: 1426288 - RNA, 16 nt, Human
gaaagagauacagagg

SEQ ID NO: 1426289 - RNA, 17 nt, Human
gaaagauaauucacugu

SEQ ID NO: 1426290 - RNA, 14 nt, Human
gaaagauaacuagg

SEQ ID NO: 1426291 - RNA, 12 nt, Human
gaaaaagaagca

SEQ ID NO: 1426292 - RNA, 15 nt, Human
gaaaaagacauucag

SEQ ID NO: 1426293 - RNA, 14 nt, Human
gaaaaagaagaauc

SEQ ID NO: 1426294 - RNA, 22 nt, Human
gaaaaacuuuggaaccagacuc

SEQ ID NO: 1426295 - RNA, 21 nt, Human
gaaaaacuuuggaaccagacu

SEQ ID NO: 1426296 - RNA, 20 nt, Human
gaaaaaucuaagugauauaa

SEQ ID NO: 1426297 - RNA, 16 nt, Human
gaaaaaucuaagugau

SEQ ID NO: 1426298 - RNA, 17 nt, Human
gaaaaauguaggagacu

SEQ ID NO: 1426299 - RNA, 14 nt, Human
gaaaaauguaggag

SEQ ID NO: 1426300 - RNA, 12 nt, Human
gaaaaauguagg

SEQ ID NO: 1426301 - RNA, 15 nt, Human
gaaaccuuccaccca

SEQ ID NO: 1426302 - RNA, 17 nt, Human
gaaaccuuccacccagu

SEQ ID NO: 1426303 - RNA, 16 nt, Human
gaaacugacacaugcu

SEQ ID NO: 1426304 - RNA, 23 nt, Human
gaaacgagacuuuccauuacaag

SEQ ID NO: 1426305 - RNA, 20 nt, Human
gaaacuaggugcauauuuau

SEQ ID NO: 1426306 - RNA, 21 nt, Human
gaaacgagacuuuccauuaca

SEQ ID NO: 1426307 - RNA, 23 nt, Human
gaaaguguauuuggaaauaaagu

SEQ ID NO: 1426308 - RNA, 15 nt, Human
gaaaguguauuugga

SEQ ID NO: 1426309 - RNA, 11 nt, Human
gaaaguguauu

SEQ ID NO: 1426310 - RNA, 18 nt, Human
gaaagugggcaaaagcuu

SEQ ID NO: 1426311 - RNA, 17 nt, Human
gaaagugggcaaaagcu

SEQ ID NO: 1426312 - RNA, 22 nt, Human
gaaagugccuuucaggaucuau

SEQ ID NO: 1426313 - RNA, 21 nt, Human
gaaagugccuuucaggaucua

SEQ ID NO: 1426314 - RNA, 17 nt, Human
gaaagugccuuucagga

SEQ ID NO: 1426315 - RNA, 23 nt, Human
gaaagucuguccuugaaggacua

SEQ ID NO: 1426316 - RNA, 16 nt, Human
gaaagucuguccuuga

SEQ ID NO: 1426317 - RNA, 15 nt, Human
gaaagucuguccuug

SEQ ID NO: 1426318 - RNA, 16 nt, Human
gaaagugccuuucagg

SEQ ID NO: 1426319 - RNA, 15 nt, Human
gaaagugccuuucag

SEQ ID NO: 1426320 - RNA, 13 nt, Human
gaaagugccugac

SEQ ID NO: 1426321 - RNA, 21 nt, Human
gaaagugauaucccccagccu

SEQ ID NO: 1426322 - RNA, 19 nt, Human
gaaauaaaaggaagccaaa

SEQ ID NO: 1426323 - RNA, 18 nt, Human
gaaauaaaaggaagccaa

SEQ ID NO: 1426324 - RNA, 17 nt, Human
gaaauaaaaggaagcca

SEQ ID NO: 1426325 - RNA, 16 nt, Human
gaaauaaaaggaagcc

SEQ ID NO: 1426326 - RNA, 23 nt, Human
gaaagccaaggagucacugagac

SEQ ID NO: 1426327 - RNA, 21 nt, Human
gaaagcauuugaaugcauuuu

SEQ ID NO: 1426328 - RNA, 18 nt, Human
gaaagcauuugaaugcau

SEQ ID NO: 1426329 - RNA, 20 nt, Human
gaaagcauuugaaugcauuu

SEQ ID NO: 1426330 - RNA, 12 nt, Human
gaaagcauuuga

SEQ ID NO: 1426331 - RNA, 14 nt, Human
gaaagcauuugaau

SEQ ID NO: 1426332 - RNA, 15 nt, Human
gaaagcauuugaaug

SEQ ID NO: 1426333 - RNA, 16 nt, Human
gaaagcauuugaaugc

SEQ ID NO: 1426334 - RNA, 17 nt, Human
gaaagcauuugaaugca

SEQ ID NO: 1426335 - RNA, 12 nt, Human
gaaaggagaugu

SEQ ID NO: 1426336 - RNA, 21 nt, Human
gaaaggaagcauuguaaaaua

SEQ ID NO: 1426337 - RNA, 23 nt, Human
gaaaggaagcauuguaaaauaau

SEQ ID NO: 1426338 - RNA, 14 nt, Human
gaaagucuguccuu

SEQ ID NO: 1426339 - RNA, 13 nt, Human
gaaagucuguccu

SEQ ID NO: 1426340 - RNA, 18 nt, Human
gaaagucauuggcuuuau

SEQ ID NO: 1426341 - RNA, 21 nt, Human
gaaagucauuggcuuuauccu

SEQ ID NO: 1426342 - RNA, 20 nt, Human
gaaagucagccauaucucca

SEQ ID NO: 1426343 - RNA, 14 nt, Human
gaaagucauuggcu

SEQ ID NO: 1426344 - RNA, 17 nt, Human
gaaagucauuggcuuua

SEQ ID NO: 1426345 - RNA, 19 nt, Human
gaacagcugguguagcuac

SEQ ID NO: 1426346 - RNA, 15 nt, Human
gaacagcugguguag

SEQ ID NO: 1426347 - RNA, 15 nt, Human
gaacagcuguaaucu

SEQ ID NO: 1426348 - RNA, 24 nt, Human
gaacagcugguguagcuacagaga

SEQ ID NO: 1426349 - RNA, 23 nt, Human
gaacagcugguguagcuacagag

SEQ ID NO: 1426350 - RNA, 22 nt, Human
gaacagcugguguagcuacaga

SEQ ID NO: 1426351 - RNA, 20 nt, Human
gaacagcugguguagcuaca

SEQ ID NO: 1426352 - RNA, 17 nt, Human
gaacaggauauucucac

SEQ ID NO: 1426353 - RNA, 21 nt, Human
gaacagggaaaauaggcagga

SEQ ID NO: 1426354 - RNA, 20 nt, Human
gaacagggaaaauaggcagg

SEQ ID NO: 1426355 - RNA, 20 nt, Human
gaacaguuguguuugaagca

SEQ ID NO: 1426356 - RNA, 24 nt, Human
gaacaguuaccucugccucagaaa

SEQ ID NO: 1426357 - RNA, 15 nt, Human
gaaccaacacuaaca

SEQ ID NO: 1426358 - RNA, 19 nt, Human
gaaccaacaaguaaauauu

SEQ ID NO: 1426359 - RNA, 24 nt, Human
gaaccaacaaccucaacugccuac

SEQ ID NO: 1426360 - RNA, 17 nt, Human
gaaccaaaucuggaagc

SEQ ID NO: 1426361 - RNA, 16 nt, Human
gaaccaaaucuggaag

SEQ ID NO: 1426362 - RNA, 19 nt, Human
gaacaugugagagguuuga

SEQ ID NO: 1426363 - RNA, 15 nt, Human
gaacauggggaggag

SEQ ID NO: 1426364 - RNA, 19 nt, Human
gaacauggccuaagggcca

SEQ ID NO: 1426365 - RNA, 18 nt, Human
gaacaucugaguccugga

SEQ ID NO: 1426366 - RNA, 21 nt, Human
gaacaucugaguccuggauga

SEQ ID NO: 1426367 - RNA, 17 nt, Human
gaacaucugaguccugg

SEQ ID NO: 1426368 - RNA, 17 nt, Human
gaacaucccuuuuucaa

SEQ ID NO: 1426369 - RNA, 22 nt, Human
gaacaguuguguuugaagcaca

SEQ ID NO: 1426370 - RNA, 21 nt, Human
gaaauuuccugggagcuuuug

SEQ ID NO: 1426371 - RNA, 19 nt, Human
gaaauuaccuguggauauu

SEQ ID NO: 1426372 - RNA, 23 nt, Human
gaaauuaguacuccccuccuuga

SEQ ID NO: 1426373 - RNA, 22 nt, Human
gaaauuaugugacauuuuacau

SEQ ID NO: 1426374 - RNA, 23 nt, Human
gaaauuaugugacauuuuacauu

SEQ ID NO: 1426375 - RNA, 12 nt, Human
gaaauuccaaag

SEQ ID NO: 1426376 - RNA, 17 nt, Human
gaaauucccuucaucug

SEQ ID NO: 1426377 - RNA, 21 nt, Human
gaaauucccuucaucuggaac

SEQ ID NO: 1426378 - RNA, 22 nt, Human
gaaauucccuucaucuggaacc

SEQ ID NO: 1426379 - RNA, 18 nt, Human
gaaauuaccuguggauau

SEQ ID NO: 1426380 - RNA, 17 nt, Human
gaaauuaccuguggaua

SEQ ID NO: 1426381 - RNA, 16 nt, Human
gaaauuaccuguggau

SEQ ID NO: 1426382 - RNA, 23 nt, Human
gaaaugugguagccucacuuuua

SEQ ID NO: 1426383 - RNA, 17 nt, Human
gaaauguacagcaagga

SEQ ID NO: 1426384 - RNA, 22 nt, Human
gaaaugaggccauggacucugu

SEQ ID NO: 1426385 - RNA, 13 nt, Human
gaaauauuuauuu

SEQ ID NO: 1426386 - RNA, 15 nt, Human
gaaaugaauuaaagu

SEQ ID NO: 1426387 - RNA, 15 nt, Human
gaaauauccugcuug

SEQ ID NO: 1426388 - RNA, 16 nt, Human
gaaauauuuauuuuaa

SEQ ID NO: 1426389 - RNA, 15 nt, Human
gaaauauuuauuuua

SEQ ID NO: 1426390 - RNA, 15 nt, Human
gaaauauauauuaua

SEQ ID NO: 1426391 - RNA, 22 nt, Human
gaaauauauauuauacuuguaa

SEQ ID NO: 1426392 - RNA, 14 nt, Human
gaaauauauauuau

SEQ ID NO: 1426393 - RNA, 13 nt, Human
gaaauauauauua

SEQ ID NO: 1426394 - RNA, 12 nt, Human
gaaauauauauu

SEQ ID NO: 1426395 - RNA, 11 nt, Human
gaaauauauau

SEQ ID NO: 1426396 - RNA, 20 nt, Human
gaaauaaaggaugugauugu

SEQ ID NO: 1426397 - RNA, 17 nt, Human
gaaauaaaggaugugau

SEQ ID NO: 1426398 - RNA, 21 nt, Human
gaaauaaacgucuuaaauauu

SEQ ID NO: 1426399 - RNA, 18 nt, Human
gaaauaaacgucuuaaau

SEQ ID NO: 1426400 - RNA, 17 nt, Human
gaaauaaacgucuuaaa

SEQ ID NO: 1426401 - RNA, 16 nt, Human
gaaauaaacgucuuaa

SEQ ID NO: 1426402 - RNA, 23 nt, Human
gaaauaaaaggaagccaaagagu

SEQ ID NO: 1426403 - RNA, 14 nt, Human
gaaauaaacgucuu

SEQ ID NO: 1426404 - RNA, 10 nt, Human
gaagccuucc

SEQ ID NO: 1426405 - RNA, 20 nt, Human
gaagccuucaagcucugagg

SEQ ID NO: 1426406 - RNA, 22 nt, Human
gaagccuucaagcucugaggga

SEQ ID NO: 1426407 - RNA, 19 nt, Human
gaagccuucaagcucugag

SEQ ID NO: 1426408 - RNA, 18 nt, Human
gaagccuucaagcucuga

SEQ ID NO: 1426409 - RNA, 17 nt, Human
gaagccuucaagcucug

SEQ ID NO: 1426410 - RNA, 16 nt, Human
gaagccuucaagcucu

SEQ ID NO: 1426411 - RNA, 21 nt, Human
gaagccugggggccuggcugg

SEQ ID NO: 1426412 - RNA, 22 nt, Human
gaagccugggggccuggcuggc

SEQ ID NO: 1426413 - RNA, 20 nt, Human
gaagccugggggccuggcug

SEQ ID NO: 1426414 - RNA, 19 nt, Human
gaagccugggggccuggcu

SEQ ID NO: 1426415 - RNA, 18 nt, Human
gaagccugggggccuggc

SEQ ID NO: 1426416 - RNA, 17 nt, Human
gaagccugggggccugg

SEQ ID NO: 1426417 - RNA, 16 nt, Human
gaagccugggggccug

SEQ ID NO: 1426418 - RNA, 13 nt, Human
gaagccugggggc

SEQ ID NO: 1426419 - RNA, 12 nt, Human
gaagccuggggg

SEQ ID NO: 1426420 - RNA, 16 nt, Human
gaagcuguugugugag

SEQ ID NO: 1426421 - RNA, 13 nt, Human
gaagcauuuguuu

SEQ ID NO: 1426422 - RNA, 19 nt, Human
gaagcauuuguuucuacuu

SEQ ID NO: 1426423 - RNA, 13 nt, Human
gaagccaaagagu

SEQ ID NO: 1426424 - RNA, 13 nt, Human
gaaggaggaccca

SEQ ID NO: 1426425 - RNA, 14 nt, Human
gaaggaggacccag

SEQ ID NO: 1426426 - RNA, 15 nt, Human
gaaggaggacccagg

SEQ ID NO: 1426427 - RNA, 16 nt, Human
gaaggaggacccagga

SEQ ID NO: 1426428 - RNA, 17 nt, Human
gaaggaggacccaggac

SEQ ID NO: 1426429 - RNA, 22 nt, Human
gaaggaggagccuguccugccu

SEQ ID NO: 1426430 - RNA, 16 nt, Human
gaaggaggagccuguc

SEQ ID NO: 1426431 - RNA, 15 nt, Human
gaaggaggagccugu

SEQ ID NO: 1426432 - RNA, 18 nt, Human
gaaggaggacccaggaca

SEQ ID NO: 1426433 - RNA, 19 nt, Human
gaaggaggacccaggacag

SEQ ID NO: 1426434 - RNA, 18 nt, Human
gaaggaaggcagggagga

SEQ ID NO: 1426435 - RNA, 19 nt, Human
gaaggaaggcagggaggag

SEQ ID NO: 1426436 - RNA, 20 nt, Human
gaaggaaggcagggaggagg

SEQ ID NO: 1426437 - RNA, 22 nt, Human
gaaggaaggcuccaucuccagu

SEQ ID NO: 1426438 - RNA, 21 nt, Human
gaaggcagggggaaggugggg

SEQ ID NO: 1426439 - RNA, 21 nt, Human
gaaggauucugcuggccucug

SEQ ID NO: 1426440 - RNA, 16 nt, Human
gaaggauucugcuggc

SEQ ID NO: 1426441 - RNA, 21 nt, Human
gaaggaucccaugagcuccuu

SEQ ID NO: 1426442 - RNA, 14 nt, Human
gaaggaugcugucu

SEQ ID NO: 1426443 - RNA, 21 nt, Human
gaaggaggcuaugcucagggg

SEQ ID NO: 1426444 - RNA, 17 nt, Human
gaaggggccagaggcuc

SEQ ID NO: 1426445 - RNA, 16 nt, Human
gaaggggccagaggcu

SEQ ID NO: 1426446 - RNA, 14 nt, Human
gaaggggccagagg

SEQ ID NO: 1426447 - RNA, 23 nt, Human
gaaggcauuugcaggguccucuu

SEQ ID NO: 1426448 - RNA, 17 nt, Human
gaaggcauuugcagggu

SEQ ID NO: 1426449 - RNA, 13 nt, Human
gaaggcauggcgg

SEQ ID NO: 1426450 - RNA, 22 nt, Human
gaaggcagggggaagguggggu

SEQ ID NO: 1426451 - RNA, 19 nt, Human
gaaggcauuugcagggucc

SEQ ID NO: 1426452 - RNA, 22 nt, Human
gaaggggccucaccgagugggg

SEQ ID NO: 1426453 - RNA, 22 nt, Human
gaaggugaauagccauauuugu

SEQ ID NO: 1426454 - RNA, 12 nt, Human
gaaggugaauag

SEQ ID NO: 1426455 - RNA, 14 nt, Human
gaagggggcggccu

SEQ ID NO: 1426456 - RNA, 15 nt, Human
gaagucacagggcag

SEQ ID NO: 1426457 - RNA, 13 nt, Human
gaagucacagggc

SEQ ID NO: 1426458 - RNA, 16 nt, Human
gaagucaaagcaagga

SEQ ID NO: 1426459 - RNA, 15 nt, Human
gaagucaaagcaagg

SEQ ID NO: 1426460 - RNA, 21 nt, Human
gaaguauuuuuucaguauuau

SEQ ID NO: 1426461 - RNA, 19 nt, Human
gaaguauuuugcuggaaua

SEQ ID NO: 1426462 - RNA, 21 nt, Human
gaaguaauaugcacacauuuu

SEQ ID NO: 1426463 - RNA, 21 nt, Human
gaaggugaggagcuugaaacc

SEQ ID NO: 1426464 - RNA, 21 nt, Human
gaaggugauuuaagggcccag

SEQ ID NO: 1426465 - RNA, 19 nt, Human
gaaggugauguugccaucc

SEQ ID NO: 1426466 - RNA, 14 nt, Human
gaaguaacuacagu

SEQ ID NO: 1426467 - RNA, 19 nt, Human
gaaguaauaugcacacauu

SEQ ID NO: 1426468 - RNA, 20 nt, Human
gaaguaauaugcacacauuu

SEQ ID NO: 1426469 - RNA, 20 nt, Human
gaagucacauuccugaacag

SEQ ID NO: 1426470 - RNA, 16 nt, Human
gaagucacauuccuga

SEQ ID NO: 1426471 - RNA, 21 nt, Human
gaagucacauuccugaacagg

SEQ ID NO: 1426472 - RNA, 20 nt, Human
gaagucacagggcaguaccu

SEQ ID NO: 1426473 - RNA, 16 nt, Human
gaagucacagggcagu

SEQ ID NO: 1426474 - RNA, 24 nt, Human
gaagucguccuuacuccuguggga

SEQ ID NO: 1426475 - RNA, 23 nt, Human
gaagucguccuuacuccuguggg

SEQ ID NO: 1426476 - RNA, 22 nt, Human
gaagucguccuuacuccugugg

SEQ ID NO: 1426477 - RNA, 15 nt, Human
gaaguccggccccag

SEQ ID NO: 1426478 - RNA, 17 nt, Human
gaaguccaauguggcaa

SEQ ID NO: 1426479 - RNA, 14 nt, Human
gaaguccaaugugg

SEQ ID NO: 1426480 - RNA, 23 nt, Human
gaaguccaagcauuuagauguau

SEQ ID NO: 1426481 - RNA, 13 nt, Human
gaagaaccagucc

SEQ ID NO: 1426482 - RNA, 15 nt, Human
gaagaaaguggaaaa

SEQ ID NO: 1426483 - RNA, 17 nt, Human
gaagaaagaggugaccc

SEQ ID NO: 1426484 - RNA, 23 nt, Human
gaagaaagaggugaccccagggc

SEQ ID NO: 1426485 - RNA, 14 nt, Human
gaagaaagaagaca

SEQ ID NO: 1426486 - RNA, 20 nt, Human
gaagaaagaacggaagaaga

SEQ ID NO: 1426487 - RNA, 16 nt, Human
gaacuuugaccucugc

SEQ ID NO: 1426488 - RNA, 22 nt, Human
gaacuuugaccucugcagcaau

SEQ ID NO: 1426489 - RNA, 22 nt, Human
gaacuuggggaguuaagaccug

SEQ ID NO: 1426490 - RNA, 24 nt, Human
gaacuuuccacauucagagcuuac

SEQ ID NO: 1426491 - RNA, 20 nt, Human
gaacuugugucccuaaugug

SEQ ID NO: 1426492 - RNA, 19 nt, Human
gaaccaauaaaauaauuuu

SEQ ID NO: 1426493 - RNA, 15 nt, Human
gaaccacaagacugc

SEQ ID NO: 1426494 - RNA, 14 nt, Human
gaaccacaagacug

SEQ ID NO: 1426495 - RNA, 16 nt, Human
gaacuugaacugauuc

SEQ ID NO: 1426496 - RNA, 15 nt, Human
gaacuugaacugauu

SEQ ID NO: 1426497 - RNA, 22 nt, Human
gaacuugaaauauccugcuuga

SEQ ID NO: 1426498 - RNA, 14 nt, Human
gaacuuaaauaaug

SEQ ID NO: 1426499 - RNA, 17 nt, Human
gaacuuaaauaauguga

SEQ ID NO: 1426500 - RNA, 10 nt, Human
gaagaggacu

SEQ ID NO: 1426501 - RNA, 22 nt, Human
gaagagccuuccacccaggggc

SEQ ID NO: 1426502 - RNA, 22 nt, Human
gaagagcgagagaucaaagaug

SEQ ID NO: 1426503 - RNA, 19 nt, Human
gaagagccuuccacccagg

SEQ ID NO: 1426504 - RNA, 17 nt, Human
gaagagccuuccaccca

SEQ ID NO: 1426505 - RNA, 16 nt, Human
gaagaagggcacccua

SEQ ID NO: 1426506 - RNA, 14 nt, Human
gaagaaggugaaua

SEQ ID NO: 1426507 - RNA, 15 nt, Human
gaagagccuuccacc

SEQ ID NO: 1426508 - RNA, 19 nt, Human
gaagaaguuucaucauuuu

SEQ ID NO: 1426509 - RNA, 14 nt, Human
gaagaugacugagg

SEQ ID NO: 1426510 - RNA, 13 nt, Human
gaagaugacugag

SEQ ID NO: 1426511 - RNA, 14 nt, Human
gaagauucuuuccc

SEQ ID NO: 1426512 - RNA, 17 nt, Human
gaagauugagauguguu

SEQ ID NO: 1426513 - RNA, 22 nt, Human
gaagauugagauguguucacaa

SEQ ID NO: 1426514 - RNA, 21 nt, Human
gaagaucuaaauaaaaugcua

SEQ ID NO: 1426515 - RNA, 14 nt, Human
gaagauccugcggg

SEQ ID NO: 1426516 - RNA, 22 nt, Human
gaagauccugcggguggggcuu

SEQ ID NO: 1426517 - RNA, 14 nt, Human
gaagaucccccaga

SEQ ID NO: 1426518 - RNA, 15 nt, Human
gaagaucccccagaa

SEQ ID NO: 1426519 - RNA, 18 nt, Human
gaagaucccccagaaaag

SEQ ID NO: 1426520 - RNA, 19 nt, Human
gacacggucggggcaucug

SEQ ID NO: 1426521 - RNA, 22 nt, Human
gacagccaacuauggccugugg

SEQ ID NO: 1426522 - RNA, 20 nt, Human
gacagaugaggcuuuccaug

SEQ ID NO: 1426523 - RNA, 15 nt, Human
gacagaugaggcuuu

SEQ ID NO: 1426524 - RNA, 20 nt, Human
gacagaugaaugccguggau

SEQ ID NO: 1426525 - RNA, 19 nt, Human
gacagaugaaugccgugga

SEQ ID NO: 1426526 - RNA, 16 nt, Human
gacagaugaggcuuuc

SEQ ID NO: 1426527 - RNA, 12 nt, Human
gacagcaugaga

SEQ ID NO: 1426528 - RNA, 19 nt, Human
gacagccaacuauggccug

SEQ ID NO: 1426529 - RNA, 24 nt, Human
gacaggacuaacacucagaagccu

SEQ ID NO: 1426530 - RNA, 23 nt, Human
gacaggacuaacacucagaagcc

SEQ ID NO: 1426531 - RNA, 22 nt, Human
gacaggacuaacacucagaagc

SEQ ID NO: 1426532 - RNA, 21 nt, Human
gacaggacuaacacucagaag

SEQ ID NO: 1426533 - RNA, 19 nt, Human
gacaggacuaacacucaga

SEQ ID NO: 1426534 - RNA, 22 nt, Human
gacagcuucucauccugcaggc

SEQ ID NO: 1426535 - RNA, 21 nt, Human
gacagcuucucauccugcagg

SEQ ID NO: 1426536 - RNA, 19 nt, Human
gacagcugugccucgcucc

SEQ ID NO: 1426537 - RNA, 17 nt, Human
gacagcugugccucgcu

SEQ ID NO: 1426538 - RNA, 15 nt, Human
gacagcugugccucg

SEQ ID NO: 1426539 - RNA, 14 nt, Human
gacagcugugccuc

SEQ ID NO: 1426540 - RNA, 13 nt, Human
gacagcugugccu

SEQ ID NO: 1426541 - RNA, 18 nt, Human
gacaggauccaggccggc

SEQ ID NO: 1426542 - RNA, 13 nt, Human
gacaggauccagg

SEQ ID NO: 1426543 - RNA, 15 nt, Human
gacaggauccaggcc

SEQ ID NO: 1426544 - RNA, 17 nt, Human
gacauacccccuccccc

SEQ ID NO: 1426545 - RNA, 22 nt, Human
gacaggcuggcuccagaugcag

SEQ ID NO: 1426546 - RNA, 21 nt, Human
gacaggcuggcuccagaugca

SEQ ID NO: 1426547 - RNA, 14 nt, Human
gacaggcuggcucc

SEQ ID NO: 1426548 - RNA, 12 nt, Human
gacaggcuggcu

SEQ ID NO: 1426549 - RNA, 15 nt, Human
gacauacuaaccagc

SEQ ID NO: 1426550 - RNA, 16 nt, Human
gacauacuaaccagca

SEQ ID NO: 1426551 - RNA, 17 nt, Human
gacaggcucuuagcagc

SEQ ID NO: 1426552 - RNA, 13 nt, Human
gacaggcucuuag

SEQ ID NO: 1426553 - RNA, 19 nt, Human
gacaggcucuuagcagcuu

SEQ ID NO: 1426554 - RNA, 18 nt, Human
gacaggcucuuagcagcu

SEQ ID NO: 1426555 - RNA, 22 nt, Human
gacaggcuggaagauagcugug

SEQ ID NO: 1426556 - RNA, 21 nt, Human
gacaggcuggaagauagcugu

SEQ ID NO: 1426557 - RNA, 20 nt, Human
gacaugaagauucuuuccca

SEQ ID NO: 1426558 - RNA, 17 nt, Human
gacaucuugucauuuuu

SEQ ID NO: 1426559 - RNA, 19 nt, Human
gacaucaaaaaaggcaguu

SEQ ID NO: 1426560 - RNA, 18 nt, Human
gacaucaaaaaaggcagu

SEQ ID NO: 1426561 - RNA, 23 nt, Human
gacauacuaaccagcagaaaugc

SEQ ID NO: 1426562 - RNA, 17 nt, Human
gacaugucuguucuaca

SEQ ID NO: 1426563 - RNA, 15 nt, Human
gacaugucuguucua

SEQ ID NO: 1426564 - RNA, 21 nt, Human
gaccaaagggagucugccagg

SEQ ID NO: 1426565 - RNA, 16 nt, Human
gaccaaagggagucug

SEQ ID NO: 1426566 - RNA, 19 nt, Human
gaccaaaaguuacauguuu

SEQ ID NO: 1426567 - RNA, 14 nt, Human
gaccaaaaguuaca

SEQ ID NO: 1426568 - RNA, 19 nt, Human
gacauggagguucuaaggc

SEQ ID NO: 1426569 - RNA, 16 nt, Human
gacauggagguucuaa

SEQ ID NO: 1426570 - RNA, 15 nt, Human
gacauggagguucua

SEQ ID NO: 1426571 - RNA, 14 nt, Human
gacauggagguucu

SEQ ID NO: 1426572 - RNA, 23 nt, Human
gacaugcgguagccagcacacag

SEQ ID NO: 1426573 - RNA, 22 nt, Human
gacaugcgguagccagcacaca

SEQ ID NO: 1426574 - RNA, 19 nt, Human
gacaugcgguagccagcac

SEQ ID NO: 1426575 - RNA, 22 nt, Human
gacaugaagccacgggugccag

SEQ ID NO: 1426576 - RNA, 18 nt, Human
gacaugcgguagccagca

SEQ ID NO: 1426577 - RNA, 16 nt, Human
gacaugaagcuguugu

SEQ ID NO: 1426578 - RNA, 13 nt, Human
gacaugaagccac

SEQ ID NO: 1426579 - RNA, 21 nt, Human
gacauggagguucuaaggccu

SEQ ID NO: 1426580 - RNA, 20 nt, Human
gacauggagguucuaaggcc

SEQ ID NO: 1426581 - RNA, 22 nt, Human
gacaugggacauuugcucaugg

SEQ ID NO: 1426582 - RNA, 17 nt, Human
gacacacacagacuauu

SEQ ID NO: 1426583 - RNA, 13 nt, Human
gacaauuuauuau

SEQ ID NO: 1426584 - RNA, 19 nt, Human
gacaauuuauuauggcaca

SEQ ID NO: 1426585 - RNA, 15 nt, Human
gacaaucaugugugu

SEQ ID NO: 1426586 - RNA, 12 nt, Human
gacaauuuauua

SEQ ID NO: 1426587 - RNA, 17 nt, Human
gacaaugacuuacugua

SEQ ID NO: 1426588 - RNA, 20 nt, Human
gacaaugacuuacuguacau

SEQ ID NO: 1426589 - RNA, 21 nt, Human
gacaaugacuuacuguacaug

SEQ ID NO: 1426590 - RNA, 14 nt, Human
gacaauaaaacauu

SEQ ID NO: 1426591 - RNA, 20 nt, Human
gacaaguggacucagggcag

SEQ ID NO: 1426592 - RNA, 15 nt, Human
gacaaguggacucag

SEQ ID NO: 1426593 - RNA, 20 nt, Human
gacaagugcugaacagugga

SEQ ID NO: 1426594 - RNA, 14 nt, Human
gacaaucaugugug

SEQ ID NO: 1426595 - RNA, 13 nt, Human
gacaaucaugugu

SEQ ID NO: 1426596 - RNA, 16 nt, Human
gacaagccagaacuug

SEQ ID NO: 1426597 - RNA, 21 nt, Human
gacaagcauggucccacaucc

SEQ ID NO: 1426598 - RNA, 15 nt, Human
gacaagcucacagac

SEQ ID NO: 1426599 - RNA, 22 nt, Human
gacacggucggggcaucuggcc

SEQ ID NO: 1426600 - RNA, 19 nt, Human
gacaccuuuuuucaacagu

SEQ ID NO: 1426601 - RNA, 13 nt, Human
gacaccugcccug

SEQ ID NO: 1426602 - RNA, 14 nt, Human
gacaccugcccugc

SEQ ID NO: 1426603 - RNA, 15 nt, Human
gacaccugcccugcc

SEQ ID NO: 1426604 - RNA, 16 nt, Human
gacaccugcccugccc

SEQ ID NO: 1426605 - RNA, 22 nt, Human
gacaccugcccugcccugccac

SEQ ID NO: 1426606 - RNA, 14 nt, Human
gacaccuuuagguu

SEQ ID NO: 1426607 - RNA, 12 nt, Human
gacaccugggag

SEQ ID NO: 1426608 - RNA, 14 nt, Human
gacaccuuggacau

SEQ ID NO: 1426609 - RNA, 18 nt, Human
gacaccugggagaaaucu

SEQ ID NO: 1426610 - RNA, 23 nt, Human
gacaccugcccugcccugccacc

SEQ ID NO: 1426611 - RNA, 19 nt, Human
gacacauacucauuuuuca

SEQ ID NO: 1426612 - RNA, 21 nt, Human
gacacaggccuguguagcugu

SEQ ID NO: 1426613 - RNA, 17 nt, Human
gacacaggccuguguag

SEQ ID NO: 1426614 - RNA, 16 nt, Human
gacacaggccugugua

SEQ ID NO: 1426615 - RNA, 15 nt, Human
gacacaggccugugu

SEQ ID NO: 1426616 - RNA, 14 nt, Human
gacacaggccugug

SEQ ID NO: 1426617 - RNA, 13 nt, Human
gacacaggccugu

SEQ ID NO: 1426618 - RNA, 12 nt, Human
gacacaggccug

SEQ ID NO: 1426619 - RNA, 23 nt, Human
gacacccuucucccacucuccua

SEQ ID NO: 1426620 - RNA, 19 nt, Human
gacacccuucucccacucu

SEQ ID NO: 1426621 - RNA, 15 nt, Human
gacacccuucuccca

SEQ ID NO: 1426622 - RNA, 15 nt, Human
gacaccuaacucuuc

SEQ ID NO: 1426623 - RNA, 13 nt, Human
gacaccucuuuuu

SEQ ID NO: 1426624 - RNA, 18 nt, Human
gacaccuaacucuucuuu

SEQ ID NO: 1426625 - RNA, 16 nt, Human
gacaccuaacucuucu

SEQ ID NO: 1426626 - RNA, 20 nt, Human
gacaccuaggcuaggguggg

SEQ ID NO: 1426627 - RNA, 16 nt, Human
gacaccuaggcuaggg

SEQ ID NO: 1426628 - RNA, 15 nt, Human
gacaccuaggcuagg

SEQ ID NO: 1426629 - RNA, 9 nt, Human
gacaccugc

SEQ ID NO: 1426630 - RNA, 10 nt, Human
gacaccugcc

SEQ ID NO: 1426631 - RNA, 11 nt, Human
gacaccugccc

SEQ ID NO: 1426632 - RNA, 12 nt, Human
gacaccugcccu

SEQ ID NO: 1426633 - RNA, 19 nt, Human
gaccccaucaccuacucac

SEQ ID NO: 1426634 - RNA, 21 nt, Human
gaccccagggcacaggagcua

SEQ ID NO: 1426635 - RNA, 19 nt, Human
gaccccagggcacaggagc

SEQ ID NO: 1426636 - RNA, 18 nt, Human
gaccccagggcacaggag

SEQ ID NO: 1426637 - RNA, 17 nt, Human
gaccccagggcacagga

SEQ ID NO: 1426638 - RNA, 16 nt, Human
gaccccagggcacagg

SEQ ID NO: 1426639 - RNA, 15 nt, Human
gaccccagggcacag

SEQ ID NO: 1426640 - RNA, 14 nt, Human
gaccccagggcaca

SEQ ID NO: 1426641 - RNA, 13 nt, Human
gaccccagggcac

SEQ ID NO: 1426642 - RNA, 11 nt, Human
gaccccagggc

SEQ ID NO: 1426643 - RNA, 20 nt, Human
gaccaagauggcccauccug

SEQ ID NO: 1426644 - RNA, 16 nt, Human
gacccagcggacacac

SEQ ID NO: 1426645 - RNA, 12 nt, Human
gacccacaugcu

SEQ ID NO: 1426646 - RNA, 23 nt, Human
gacccacaugccauuuguacuga

SEQ ID NO: 1426647 - RNA, 14 nt, Human
gacccacaugccau

SEQ ID NO: 1426648 - RNA, 21 nt, Human
gacccaggaaaggcaggauug

SEQ ID NO: 1426649 - RNA, 15 nt, Human
gacccaggaaaggca

SEQ ID NO: 1426650 - RNA, 12 nt, Human
gacccaggacag

SEQ ID NO: 1426651 - RNA, 13 nt, Human
gacccaggacagg

SEQ ID NO: 1426652 - RNA, 22 nt, Human
gacccaggacaggauccaggcc

SEQ ID NO: 1426653 - RNA, 17 nt, Human
gaccugaggcugugguc

SEQ ID NO: 1426654 - RNA, 15 nt, Human
gaccugaggcugugg

SEQ ID NO: 1426655 - RNA, 14 nt, Human
gaccugaggcugug

SEQ ID NO: 1426656 - RNA, 13 nt, Human
gaccugaggcugu

SEQ ID NO: 1426657 - RNA, 18 nt, Human
gaccucaggcaaucugcc

SEQ ID NO: 1426658 - RNA, 20 nt, Human
gaccugcacuggggagcccg

SEQ ID NO: 1426659 - RNA, 16 nt, Human
gaccugcacuggggag

SEQ ID NO: 1426660 - RNA, 21 nt, Human
gaccugauccuggaggcccag

SEQ ID NO: 1426661 - RNA, 18 nt, Human
gaccugauccuggaggcc

SEQ ID NO: 1426662 - RNA, 15 nt, Human
gaccugauccuggag

SEQ ID NO: 1426663 - RNA, 14 nt, Human
gaccugauccugga

SEQ ID NO: 1426664 - RNA, 23 nt, Human
gaccugauuucugagcauuuaau

SEQ ID NO: 1426665 - RNA, 11 nt, Human
gaccugccucc

SEQ ID NO: 1426666 - RNA, 22 nt, Human
gaccugccucccuucaugcaug

SEQ ID NO: 1426667 - RNA, 16 nt, Human
gaccucagaaguaaag

SEQ ID NO: 1426668 - RNA, 13 nt, Human
gaccucagaagua

SEQ ID NO: 1426669 - RNA, 21 nt, Human
gaccucaccaagcugcugugg

SEQ ID NO: 1426670 - RNA, 23 nt, Human
gaccuacagggggucuggcuggu

SEQ ID NO: 1426671 - RNA, 22 nt, Human
gaccuacagggggucuggcugg

SEQ ID NO: 1426672 - RNA, 21 nt, Human
gaccuacagggggucuggcug

SEQ ID NO: 1426673 - RNA, 20 nt, Human
gaccuacagggggucuggcu

SEQ ID NO: 1426674 - RNA, 13 nt, Human
gaccuacaggggg

SEQ ID NO: 1426675 - RNA, 20 nt, Human
gaccuaaauggccucaugug

SEQ ID NO: 1426676 - RNA, 16 nt, Human
gaccuaaauggccuca

SEQ ID NO: 1426677 - RNA, 17 nt, Human
gaccggagagugggggu

SEQ ID NO: 1426678 - RNA, 17 nt, Human
gacccuugacaccugcu

SEQ ID NO: 1426679 - RNA, 19 nt, Human
gacccuucccuugagcccu

SEQ ID NO: 1426680 - RNA, 21 nt, Human
gacccuguugcuaagccccag

SEQ ID NO: 1426681 - RNA, 15 nt, Human
gacccuguugcuaag

SEQ ID NO: 1426682 - RNA, 16 nt, Human
gacccuguugcuaagc

SEQ ID NO: 1426683 - RNA, 19 nt, Human
gaccggccugccaggagga

SEQ ID NO: 1426684 - RNA, 15 nt, Human
gaccggcggcucgga

SEQ ID NO: 1426685 - RNA, 18 nt, Human
gaccggccugccaggagg

SEQ ID NO: 1426686 - RNA, 17 nt, Human
gaccggccugccaggag

SEQ ID NO: 1426687 - RNA, 16 nt, Human
gaccggccugccagga

SEQ ID NO: 1426688 - RNA, 15 nt, Human
gaccggccugccagg

SEQ ID NO: 1426689 - RNA, 19 nt, Human
gaccggcggaccccagcca

SEQ ID NO: 1426690 - RNA, 20 nt, Human
gaccggcggaccccagccau

SEQ ID NO: 1426691 - RNA, 19 nt, Human
gacucagggcuccuggguu

SEQ ID NO: 1426692 - RNA, 17 nt, Human
gacucagggcuccuggg

SEQ ID NO: 1426693 - RNA, 16 nt, Human
gacucagggcuccugg

SEQ ID NO: 1426694 - RNA, 14 nt, Human
gacucagggcuccu

SEQ ID NO: 1426695 - RNA, 13 nt, Human
gacucagggcucc

SEQ ID NO: 1426696 - RNA, 12 nt, Human
gacucagggcuc

SEQ ID NO: 1426697 - RNA, 23 nt, Human
gacucagggcagcgccaggcuga

SEQ ID NO: 1426698 - RNA, 18 nt, Human
gacucagggcagcgccag

SEQ ID NO: 1426699 - RNA, 17 nt, Human
gacucagggcagcgcca

SEQ ID NO: 1426700 - RNA, 16 nt, Human
gacucagggcagcgcc

SEQ ID NO: 1426701 - RNA, 13 nt, Human
gacucagggcagc

SEQ ID NO: 1426702 - RNA, 12 nt, Human
gacucagggcag

SEQ ID NO: 1426703 - RNA, 23 nt, Human
gacucaggcccccaccuggcuca

SEQ ID NO: 1426704 - RNA, 22 nt, Human
gacucaggcccccaccuggcuc

SEQ ID NO: 1426705 - RNA, 15 nt, Human
gacucaggagccugu

SEQ ID NO: 1426706 - RNA, 16 nt, Human
gacucaggagccugug

SEQ ID NO: 1426707 - RNA, 23 nt, Human
gacucagcucugacauucugauu

SEQ ID NO: 1426708 - RNA, 22 nt, Human
gacucagcucugacauucugau

SEQ ID NO: 1426709 - RNA, 19 nt, Human
gacuagaccuccagcuguu

SEQ ID NO: 1426710 - RNA, 20 nt, Human
gacuagaaaauuuaaaacau

SEQ ID NO: 1426711 - RNA, 20 nt, Human
gacuacuugggagcaccgcc

SEQ ID NO: 1426712 - RNA, 18 nt, Human
gacuacuugggagcaccg

SEQ ID NO: 1426713 - RNA, 22 nt, Human
gacuacagcuggggugcaggga

SEQ ID NO: 1426714 - RNA, 19 nt, Human
gacuacagcuggggugcag

SEQ ID NO: 1426715 - RNA, 22 nt, Human
gacuaauuucaaaaugcuuuuu

SEQ ID NO: 1426716 - RNA, 13 nt, Human
gacuaauuucaaa

SEQ ID NO: 1426717 - RNA, 12 nt, Human
gacuaauuucaa

SEQ ID NO: 1426718 - RNA, 23 nt, Human
gacucccauuccugaagaaccag

SEQ ID NO: 1426719 - RNA, 22 nt, Human
gacucccauuccugaagaacca

SEQ ID NO: 1426720 - RNA, 13 nt, Human
gacucccauuccu

SEQ ID NO: 1426721 - RNA, 18 nt, Human
gacuccaggcccaaggcu

SEQ ID NO: 1426722 - RNA, 19 nt, Human
gacuccaggcccaaggcuc

SEQ ID NO: 1426723 - RNA, 19 nt, Human
gacucagguggcccuacug

SEQ ID NO: 1426724 - RNA, 14 nt, Human
gacuccaggcccaa

SEQ ID NO: 1426725 - RNA, 12 nt, Human
gacuccaggccc

SEQ ID NO: 1426726 - RNA, 17 nt, Human
gacucauucugaaggag

SEQ ID NO: 1426727 - RNA, 16 nt, Human
gacucauucugaagga

SEQ ID NO: 1426728 - RNA, 13 nt, Human
gacucauucugaa

SEQ ID NO: 1426729 - RNA, 20 nt, Human
gaccuggaagggaggugggc

SEQ ID NO: 1426730 - RNA, 19 nt, Human
gaccugcugagcucugaga

SEQ ID NO: 1426731 - RNA, 22 nt, Human
gaccugcugagcucugagaggc

SEQ ID NO: 1426732 - RNA, 18 nt, Human
gaccugcugagcucugag

SEQ ID NO: 1426733 - RNA, 17 nt, Human
gaccugcugagcucuga

SEQ ID NO: 1426734 - RNA, 16 nt, Human
gaccugcugagcucug

SEQ ID NO: 1426735 - RNA, 14 nt, Human
gaccugcugagcuc

SEQ ID NO: 1426736 - RNA, 13 nt, Human
gaccugcugagcu

SEQ ID NO: 1426737 - RNA, 11 nt, Human
gaccugcugag

SEQ ID NO: 1426738 - RNA, 19 nt, Human
gaccugcugaccugugcac

SEQ ID NO: 1426739 - RNA, 18 nt, Human
gaccugcugaccugugca

SEQ ID NO: 1426740 - RNA, 21 nt, Human
gaccugcuaggccagagccca

SEQ ID NO: 1426741 - RNA, 10 nt, Human
gaccugcuga

SEQ ID NO: 1426742 - RNA, 23 nt, Human
gaccugcuaggccagagcccacu

SEQ ID NO: 1426743 - RNA, 19 nt, Human
gaccugcuaggccagagcc

SEQ ID NO: 1426744 - RNA, 18 nt, Human
gaccugcuaggccagagc

SEQ ID NO: 1426745 - RNA, 17 nt, Human
gaccugcuaggccagag

SEQ ID NO: 1426746 - RNA, 15 nt, Human
gaccugcuaggccag

SEQ ID NO: 1426747 - RNA, 12 nt, Human
gaccugccugua

SEQ ID NO: 1426748 - RNA, 18 nt, Human
gaccugccugcauaggag

SEQ ID NO: 1426749 - RNA, 21 nt, Human
gacgacaagugcugaacagug

SEQ ID NO: 1426750 - RNA, 18 nt, Human
gaccuuuccaccacagcc

SEQ ID NO: 1426751 - RNA, 17 nt, Human
gaccuuuccaccacagc

SEQ ID NO: 1426752 - RNA, 13 nt, Human
gaccuuuccacca

SEQ ID NO: 1426753 - RNA, 23 nt, Human
gaccuuuccaccacagccagcac

SEQ ID NO: 1426754 - RNA, 21 nt, Human
gaccuuuccaccacagccagc

SEQ ID NO: 1426755 - RNA, 16 nt, Human
gaccuuguuacuucug

SEQ ID NO: 1426756 - RNA, 17 nt, Human
gaccuuguuacuucuga

SEQ ID NO: 1426757 - RNA, 23 nt, Human
gacggugcccaagccagaggcug

SEQ ID NO: 1426758 - RNA, 18 nt, Human
gacggugcccaagccaga

SEQ ID NO: 1426759 - RNA, 16 nt, Human
gacggugcccaagcca

SEQ ID NO: 1426760 - RNA, 12 nt, Human
gacgcacugagc

SEQ ID NO: 1426761 - RNA, 19 nt, Human
gacgcaagggccugauggg

SEQ ID NO: 1426762 - RNA, 18 nt, Human
gacgaggggugucuuggg

SEQ ID NO: 1426763 - RNA, 22 nt, Human
gacgacacggucggggcaucug

SEQ ID NO: 1426764 - RNA, 15 nt, Human
gacgcauaugaguaa

SEQ ID NO: 1426765 - RNA, 15 nt, Human
gacgcacugagcaac

SEQ ID NO: 1426766 - RNA, 17 nt, Human
gacgggguuucaccaug

SEQ ID NO: 1426767 - RNA, 16 nt, Human
gacggguuucaccaug

SEQ ID NO: 1426768 - RNA, 21 nt, Human
gagacuuagggcaccaggggu

SEQ ID NO: 1426769 - RNA, 18 nt, Human
gagacuuagggcaccagg

SEQ ID NO: 1426770 - RNA, 16 nt, Human
gagacuguuuggaaau

SEQ ID NO: 1426771 - RNA, 14 nt, Human
gagacuguuuggaa

SEQ ID NO: 1426772 - RNA, 23 nt, Human
gagacugugugugcccucugggc

SEQ ID NO: 1426773 - RNA, 22 nt, Human
gagacugugugugcccucuggg

SEQ ID NO: 1426774 - RNA, 21 nt, Human
gagacugugugugcccucugg

SEQ ID NO: 1426775 - RNA, 19 nt, Human
gagacugugugugcccucu

SEQ ID NO: 1426776 - RNA, 17 nt, Human
gagacugugugugcccu

SEQ ID NO: 1426777 - RNA, 22 nt, Human
gagacugucuggccccccuggu

SEQ ID NO: 1426778 - RNA, 21 nt, Human
gagacugucuggccccccugg

SEQ ID NO: 1426779 - RNA, 15 nt, Human
gagacugcccagcua

SEQ ID NO: 1426780 - RNA, 12 nt, Human
gagaccagggcu

SEQ ID NO: 1426781 - RNA, 12 nt, Human
gagaccaccagg

SEQ ID NO: 1426782 - RNA, 13 nt, Human
gagaccagggcuc

SEQ ID NO: 1426783 - RNA, 22 nt, Human
gagaccaagauggcccauccug

SEQ ID NO: 1426784 - RNA, 12 nt, Human
gagaccaccucu

SEQ ID NO: 1426785 - RNA, 21 nt, Human
gagacauacuugaagggccag

SEQ ID NO: 1426786 - RNA, 20 nt, Human
gagacauacuugaagggcca

SEQ ID NO: 1426787 - RNA, 18 nt, Human
gagacauacuugaagggc

SEQ ID NO: 1426788 - RNA, 15 nt, Human
gagacauacuugaag

SEQ ID NO: 1426789 - RNA, 16 nt, Human
gagacauuaacucauu

SEQ ID NO: 1426790 - RNA, 22 nt, Human
gagacauuaacucauuagacug

SEQ ID NO: 1426791 - RNA, 14 nt, Human
gagacaugugacau

SEQ ID NO: 1426792 - RNA, 13 nt, Human
gagacaucagccc

SEQ ID NO: 1426793 - RNA, 19 nt, Human
gagacauaaccacugcuuc

SEQ ID NO: 1426794 - RNA, 11 nt, Human
gagacauccag

SEQ ID NO: 1426795 - RNA, 13 nt, Human
gagacaugugaca

SEQ ID NO: 1426796 - RNA, 12 nt, Human
gagacauccagc

SEQ ID NO: 1426797 - RNA, 21 nt, Human
gagagggcucgaggggugggc

SEQ ID NO: 1426798 - RNA, 18 nt, Human
gagagggcgcaggccgug

SEQ ID NO: 1426799 - RNA, 17 nt, Human
gagagggcgcaggccgu

SEQ ID NO: 1426800 - RNA, 16 nt, Human
gagagggcgcaggccg

SEQ ID NO: 1426801 - RNA, 15 nt, Human
gagagggcgcaggcc

SEQ ID NO: 1426802 - RNA, 23 nt, Human
gagaggugggccagucuguggau

SEQ ID NO: 1426803 - RNA, 22 nt, Human
gagaggugggccagucugugga

SEQ ID NO: 1426804 - RNA, 14 nt, Human
gagaggugggccag

SEQ ID NO: 1426805 - RNA, 20 nt, Human
gagagggcucgagggguggg

SEQ ID NO: 1426806 - RNA, 20 nt, Human
gagagguuugcagucccaag

SEQ ID NO: 1426807 - RNA, 17 nt, Human
gagagguugucuguggc

SEQ ID NO: 1426808 - RNA, 14 nt, Human
gagaguuuccugaa

SEQ ID NO: 1426809 - RNA, 17 nt, Human
gagauacagaauuuuau

SEQ ID NO: 1426810 - RNA, 21 nt, Human
gagacuuuccauuacaaguau

SEQ ID NO: 1426811 - RNA, 11 nt, Human
gagacuuguuu

SEQ ID NO: 1426812 - RNA, 19 nt, Human
gagagacacacugaagaag

SEQ ID NO: 1426813 - RNA, 22 nt, Human
gagagccagcuaaggggugggg

SEQ ID NO: 1426814 - RNA, 21 nt, Human
gagagaggccauucuuuccca

SEQ ID NO: 1426815 - RNA, 13 nt, Human
gagagaggccauu

SEQ ID NO: 1426816 - RNA, 17 nt, Human
gagagagguugaaaaac

SEQ ID NO: 1426817 - RNA, 16 nt, Human
gagagccaccaagagg

SEQ ID NO: 1426818 - RNA, 13 nt, Human
gagagcagugcuu

SEQ ID NO: 1426819 - RNA, 16 nt, Human
gagagcagugcuuuug

SEQ ID NO: 1426820 - RNA, 21 nt, Human
gagagaguuguuuuaauaacu

SEQ ID NO: 1426821 - RNA, 16 nt, Human
gagagaguugaaccua

SEQ ID NO: 1426822 - RNA, 19 nt, Human
gagagagguugaaaaacaa

SEQ ID NO: 1426823 - RNA, 24 nt, Human
gagaaacuuaaauguuauuaucug

SEQ ID NO: 1426824 - RNA, 23 nt, Human
gagaaaccagcuuccuucagaga

SEQ ID NO: 1426825 - RNA, 21 nt, Human
gagaaaccagcuuccuucaga

SEQ ID NO: 1426826 - RNA, 19 nt, Human
gagaaaccagcuuccuuca

SEQ ID NO: 1426827 - RNA, 17 nt, Human
gagaaaccagcuuccuu

SEQ ID NO: 1426828 - RNA, 16 nt, Human
gagaaaccagcuuccu

SEQ ID NO: 1426829 - RNA, 15 nt, Human
gagaaaccagcuucc

SEQ ID NO: 1426830 - RNA, 14 nt, Human
gagaaaccagcuuc

SEQ ID NO: 1426831 - RNA, 13 nt, Human
gagaaaccagcuu

SEQ ID NO: 1426832 - RNA, 22 nt, Human
gagaaacaguugguaacuuuug

SEQ ID NO: 1426833 - RNA, 21 nt, Human
gagaaacaguugguaacuuuu

SEQ ID NO: 1426834 - RNA, 19 nt, Human
gagaaacaguugguaacuu

SEQ ID NO: 1426835 - RNA, 18 nt, Human
gagaaacaguugguaacu

SEQ ID NO: 1426836 - RNA, 17 nt, Human
gagaaacaguugguaac

SEQ ID NO: 1426837 - RNA, 20 nt, Human
gagaaauauggacacuuaau

SEQ ID NO: 1426838 - RNA, 23 nt, Human
gagaaauagcuuaugaaaagaau

SEQ ID NO: 1426839 - RNA, 15 nt, Human
gagaaauacaaaaau

SEQ ID NO: 1426840 - RNA, 14 nt, Human
gagaaauacaaaaa

SEQ ID NO: 1426841 - RNA, 18 nt, Human
gagaaauaagugcccucu

SEQ ID NO: 1426842 - RNA, 18 nt, Human
gagaaccaaaucuggaag

SEQ ID NO: 1426843 - RNA, 17 nt, Human
gagaaccaaaucuggaa

SEQ ID NO: 1426844 - RNA, 13 nt, Human
gagaaccaaaucu

SEQ ID NO: 1426845 - RNA, 17 nt, Human
gagaacaaacagaucga

SEQ ID NO: 1426846 - RNA, 23 nt, Human
gagaaaucuggcuucuggccagg

SEQ ID NO: 1426847 - RNA, 12 nt, Human
gagaaaugaaaa

SEQ ID NO: 1426848 - RNA, 16 nt, Human
gacucgggggugggga

SEQ ID NO: 1426849 - RNA, 14 nt, Human
gacucggggguggg

SEQ ID NO: 1426850 - RNA, 15 nt, Human
gacuuguuuuugcac

SEQ ID NO: 1426851 - RNA, 16 nt, Human
gacuuguuuuugcaca

SEQ ID NO: 1426852 - RNA, 19 nt, Human
gacuuguauauuuuaagaa

SEQ ID NO: 1426853 - RNA, 13 nt, Human
gacucgguuucuc

SEQ ID NO: 1426854 - RNA, 19 nt, Human
gacucgguuucuccaaacu

SEQ ID NO: 1426855 - RNA, 18 nt, Human
gacuugucccgggacacc

SEQ ID NO: 1426856 - RNA, 16 nt, Human
gacuugugucucugug

SEQ ID NO: 1426857 - RNA, 13 nt, Human
gacuugugucucu

SEQ ID NO: 1426858 - RNA, 18 nt, Human
gacuugugucccaugauc

SEQ ID NO: 1426859 - RNA, 13 nt, Human
gacuuguguccca

SEQ ID NO: 1426860 - RNA, 23 nt, Human
gacuuguuggcguaggcuacaga

SEQ ID NO: 1426861 - RNA, 17 nt, Human
gagacaacgugcucuuu

SEQ ID NO: 1426862 - RNA, 16 nt, Human
gagacaaauggaggcc

SEQ ID NO: 1426863 - RNA, 22 nt, Human
gagacaaacaccucccaggaga

SEQ ID NO: 1426864 - RNA, 20 nt, Human
gagacaaacaccucccagga

SEQ ID NO: 1426865 - RNA, 19 nt, Human
gagacaaacaccucccagg

SEQ ID NO: 1426866 - RNA, 21 nt, Human
gagaauuucuaccauuucaga

SEQ ID NO: 1426867 - RNA, 15 nt, Human
gagacacaccugagg

SEQ ID NO: 1426868 - RNA, 18 nt, Human
gagacacacugaagaagc

SEQ ID NO: 1426869 - RNA, 9 nt, Human
gagacagag

SEQ ID NO: 1426870 - RNA, 15 nt, Human
gagacagacuagaag

SEQ ID NO: 1426871 - RNA, 17 nt, Human
gagacacugguggggau

SEQ ID NO: 1426872 - RNA, 14 nt, Human
gagacacugguggg

SEQ ID NO: 1426873 - RNA, 17 nt, Human
gagacacuggccccuca

SEQ ID NO: 1426874 - RNA, 15 nt, Human
gagacacuggccccu

SEQ ID NO: 1426875 - RNA, 17 nt, Human
gagacagacuagaaguu

SEQ ID NO: 1426876 - RNA, 16 nt, Human
gagacagccaacuaug

SEQ ID NO: 1426877 - RNA, 12 nt, Human
gagaagccuuca

SEQ ID NO: 1426878 - RNA, 16 nt, Human
gagaagcccgugugag

SEQ ID NO: 1426879 - RNA, 15 nt, Human
gagaagcccguguga

SEQ ID NO: 1426880 - RNA, 14 nt, Human
gagaagcccgugug

SEQ ID NO: 1426881 - RNA, 22 nt, Human
gagaagccaucaccucagaugg

SEQ ID NO: 1426882 - RNA, 23 nt, Human
gagaagccaucaccucagauggc

SEQ ID NO: 1426883 - RNA, 20 nt, Human
gagaagccaucaccucagau

SEQ ID NO: 1426884 - RNA, 19 nt, Human
gagaagccaucaccucaga

SEQ ID NO: 1426885 - RNA, 17 nt, Human
gagaagccaucaccuca

SEQ ID NO: 1426886 - RNA, 23 nt, Human
gagaagccaggaauuucccagga

SEQ ID NO: 1426887 - RNA, 22 nt, Human
gagaagccaggaauuucccagg

SEQ ID NO: 1426888 - RNA, 12 nt, Human
gagaagccagga

SEQ ID NO: 1426889 - RNA, 20 nt, Human
gagaagccagcuuguuuaca

SEQ ID NO: 1426890 - RNA, 16 nt, Human
gagaagccagcuuguu

SEQ ID NO: 1426891 - RNA, 13 nt, Human
gagaaugagccuc

SEQ ID NO: 1426892 - RNA, 20 nt, Human
gagaacccagcccacccccg

SEQ ID NO: 1426893 - RNA, 16 nt, Human
gagaagaacugaaauc

SEQ ID NO: 1426894 - RNA, 14 nt, Human
gagaagaacugaaa

SEQ ID NO: 1426895 - RNA, 22 nt, Human
gagaagcaaguaaaaaggcuaa

SEQ ID NO: 1426896 - RNA, 13 nt, Human
gagauacauacag

SEQ ID NO: 1426897 - RNA, 16 nt, Human
gagauacauacagaau

SEQ ID NO: 1426898 - RNA, 14 nt, Human
gagaguuuuggaug

SEQ ID NO: 1426899 - RNA, 17 nt, Human
gagauaguuuucaucca

SEQ ID NO: 1426900 - RNA, 16 nt, Human
gagauaguuuucaucc

SEQ ID NO: 1426901 - RNA, 15 nt, Human
gagauaguuuucauc

SEQ ID NO: 1426902 - RNA, 15 nt, Human
gagcagaggggcuga

SEQ ID NO: 1426903 - RNA, 20 nt, Human
gagcagaggggcagaggccc

SEQ ID NO: 1426904 - RNA, 16 nt, Human
gagcagaggggcagag

SEQ ID NO: 1426905 - RNA, 20 nt, Human
gagcagccaccccaugcugg

SEQ ID NO: 1426906 - RNA, 16 nt, Human
gagcagaggggcugaa

SEQ ID NO: 1426907 - RNA, 20 nt, Human
gagcagagcugauggagaag

SEQ ID NO: 1426908 - RNA, 23 nt, Human
gagcagagcugauggagaaggaa

SEQ ID NO: 1426909 - RNA, 15 nt, Human
gagcagccuggagcc

SEQ ID NO: 1426910 - RNA, 21 nt, Human
gagcagccuggagcccuggag

SEQ ID NO: 1426911 - RNA, 22 nt, Human
gagcagccuggagcccuggaga

SEQ ID NO: 1426912 - RNA, 12 nt, Human
gagccagggucu

SEQ ID NO: 1426913 - RNA, 17 nt, Human
gagccaggagaagcuca

SEQ ID NO: 1426914 - RNA, 18 nt, Human
gagccagcuaaggggugg

SEQ ID NO: 1426915 - RNA, 20 nt, Human
gagccagccgagcaggaggc

SEQ ID NO: 1426916 - RNA, 21 nt, Human
gagccagccgagcaggaggcc

SEQ ID NO: 1426917 - RNA, 19 nt, Human
gagccagccgagcaggagg

SEQ ID NO: 1426918 - RNA, 14 nt, Human
gagccagccgagca

SEQ ID NO: 1426919 - RNA, 14 nt, Human
gagcagcgagccug

SEQ ID NO: 1426920 - RNA, 22 nt, Human
gagccagcuaagggguggggcu

SEQ ID NO: 1426921 - RNA, 21 nt, Human
gagccagcuaagggguggggc

SEQ ID NO: 1426922 - RNA, 20 nt, Human
gagccaggaagaucccccag

SEQ ID NO: 1426923 - RNA, 21 nt, Human
gagccaggagaagcucagcug

SEQ ID NO: 1426924 - RNA, 15 nt, Human
gagccaggagaagcu

SEQ ID NO: 1426925 - RNA, 14 nt, Human
gagccaggagaagc

SEQ ID NO: 1426926 - RNA, 13 nt, Human
gagccaggagaag

SEQ ID NO: 1426927 - RNA, 12 nt, Human
gagccaggagaa

SEQ ID NO: 1426928 - RNA, 21 nt, Human
gagccaggaagaucccccaga

SEQ ID NO: 1426929 - RNA, 19 nt, Human
gagccugaauuuuguugcu

SEQ ID NO: 1426930 - RNA, 21 nt, Human
gagccugacccucaucuuucu

SEQ ID NO: 1426931 - RNA, 15 nt, Human
gagccugagggaucu

SEQ ID NO: 1426932 - RNA, 12 nt, Human
gagccugaggga

SEQ ID NO: 1426933 - RNA, 10 nt, Human
gagccugagg

SEQ ID NO: 1426934 - RNA, 23 nt, Human
gagccucgcaacccgugccaagu

SEQ ID NO: 1426935 - RNA, 20 nt, Human
gagccucgcaacccgugcca

SEQ ID NO: 1426936 - RNA, 19 nt, Human
gagccucgcaacccgugcc

SEQ ID NO: 1426937 - RNA, 22 nt, Human
gagccuccucucucaaacuggg

SEQ ID NO: 1426938 - RNA, 17 nt, Human
gagccgugguccuuugg

SEQ ID NO: 1426939 - RNA, 13 nt, Human
gagccgugguccu

SEQ ID NO: 1426940 - RNA, 22 nt, Human
gagccggggugggguggcugca

SEQ ID NO: 1426941 - RNA, 20 nt, Human
gagccggguggaucgccuga

SEQ ID NO: 1426942 - RNA, 19 nt, Human
gagccggguguccccaaca

SEQ ID NO: 1426943 - RNA, 22 nt, Human
gagccgggucugccucuucugg

SEQ ID NO: 1426944 - RNA, 21 nt, Human
gagccgggucugccucuucug

SEQ ID NO: 1426945 - RNA, 20 nt, Human
gagccgggucugccucuucu

SEQ ID NO: 1426946 - RNA, 17 nt, Human
gagccgggucugccucu

SEQ ID NO: 1426947 - RNA, 20 nt, Human
gagccggggugggguggcug

SEQ ID NO: 1426948 - RNA, 23 nt, Human
gagccggccccaggcucguggac

SEQ ID NO: 1426949 - RNA, 16 nt, Human
gagccggccccaggcu

SEQ ID NO: 1426950 - RNA, 22 nt, Human
gagccgauuguccuaucuccag

SEQ ID NO: 1426951 - RNA, 22 nt, Human
gagcccacuccaucugguagaa

SEQ ID NO: 1426952 - RNA, 14 nt, Human
gagcccacuccauc

SEQ ID NO: 1426953 - RNA, 20 nt, Human
gagcccacgacacugcagcc

SEQ ID NO: 1426954 - RNA, 18 nt, Human
gagcccacuguacuugcu

SEQ ID NO: 1426955 - RNA, 21 nt, Human
gagcccacuguacuugcucuu

SEQ ID NO: 1426956 - RNA, 11 nt, Human
gagcccacugu

SEQ ID NO: 1426957 - RNA, 23 nt, Human
gagcccacuguacuugcucuuga

SEQ ID NO: 1426958 - RNA, 23 nt, Human
gagcccuucuauacccacccaga

SEQ ID NO: 1426959 - RNA, 17 nt, Human
gaggaaaucccuucaua

SEQ ID NO: 1426960 - RNA, 20 nt, Human
gaggaaaucccuucauacuu

SEQ ID NO: 1426961 - RNA, 15 nt, Human
gaggaaaucccuuca

SEQ ID NO: 1426962 - RNA, 13 nt, Human
gaggaaaucccuu

SEQ ID NO: 1426963 - RNA, 12 nt, Human
gaggaaagucau

SEQ ID NO: 1426964 - RNA, 18 nt, Human
gaggaaagucauuggcuu

SEQ ID NO: 1426965 - RNA, 20 nt, Human
gaggaaagucauuggcuuua

SEQ ID NO: 1426966 - RNA, 13 nt, Human
gaggaagaauggu

SEQ ID NO: 1426967 - RNA, 15 nt, Human
gagcuuugacucagg

SEQ ID NO: 1426968 - RNA, 23 nt, Human
gagcuuucugaacagcuggugua

SEQ ID NO: 1426969 - RNA, 22 nt, Human
gagcuuucugaacagcuggugu

SEQ ID NO: 1426970 - RNA, 20 nt, Human
gagcuuucugaacagcuggu

SEQ ID NO: 1426971 - RNA, 19 nt, Human
gagcuuucugaacagcugg

SEQ ID NO: 1426972 - RNA, 17 nt, Human
gagcuuucugaacagcu

SEQ ID NO: 1426973 - RNA, 13 nt, Human
gagcuugggaaug

SEQ ID NO: 1426974 - RNA, 16 nt, Human
gagcugccuggacccg

SEQ ID NO: 1426975 - RNA, 15 nt, Human
gagcugccuggaccc

SEQ ID NO: 1426976 - RNA, 14 nt, Human
gagcugccuggacc

SEQ ID NO: 1426977 - RNA, 12 nt, Human
gagcugccugga

SEQ ID NO: 1426978 - RNA, 18 nt, Human
gagcuuugacucaggagc

SEQ ID NO: 1426979 - RNA, 21 nt, Human
gagcuuugacucaggagccug

SEQ ID NO: 1426980 - RNA, 23 nt, Human
gagcuuugucuacuucaaaaguu

SEQ ID NO: 1426981 - RNA, 14 nt, Human
gagcuuuuguagaa

SEQ ID NO: 1426982 - RNA, 19 nt, Human
gagcucagaaaauaucccu

SEQ ID NO: 1426983 - RNA, 22 nt, Human
gagcucacaaggcagcaaggcc

SEQ ID NO: 1426984 - RNA, 23 nt, Human
gagcucacaaggcagcaaggccc

SEQ ID NO: 1426985 - RNA, 21 nt, Human
gagcucacaaggcagcaaggc

SEQ ID NO: 1426986 - RNA, 20 nt, Human
gagcucacaaggcagcaagg

SEQ ID NO: 1426987 - RNA, 18 nt, Human
gagcucacaaggcagcaa

SEQ ID NO: 1426988 - RNA, 17 nt, Human
gagcucacaaggcagca

SEQ ID NO: 1426989 - RNA, 16 nt, Human
gagcucacaaggcagc

SEQ ID NO: 1426990 - RNA, 14 nt, Human
gagcucacaaggca

SEQ ID NO: 1426991 - RNA, 13 nt, Human
gagcuauugcugu

SEQ ID NO: 1426992 - RNA, 20 nt, Human
gagcuaggagcaaagccugu

SEQ ID NO: 1426993 - RNA, 21 nt, Human
gagcuaggagcaaagccuguu

SEQ ID NO: 1426994 - RNA, 19 nt, Human
gagcuaggagcaaagccug

SEQ ID NO: 1426995 - RNA, 18 nt, Human
gagcuaggagcaaagccu

SEQ ID NO: 1426996 - RNA, 17 nt, Human
gagcuaggagcaaagcc

SEQ ID NO: 1426997 - RNA, 12 nt, Human
gagcuaggagca

SEQ ID NO: 1426998 - RNA, 22 nt, Human
gagcucaggaaccgaggcaggg

SEQ ID NO: 1426999 - RNA, 21 nt, Human
gagcucaggaaccgaggcagg

SEQ ID NO: 1427000 - RNA, 22 nt, Human
gagcuccacucugcuucucuga

SEQ ID NO: 1427001 - RNA, 20 nt, Human
gagcucagaaaauaucccuc

SEQ ID NO: 1427002 - RNA, 23 nt, Human
gagcucagaaaauaucccuccug

SEQ ID NO: 1427003 - RNA, 13 nt, Human
gagcucagcgugg

SEQ ID NO: 1427004 - RNA, 20 nt, Human
gagcucaggaaccgaggcag

SEQ ID NO: 1427005 - RNA, 22 nt, Human
gagccugccgagcaaccguggc

SEQ ID NO: 1427006 - RNA, 23 nt, Human
gagccugccgagcaaccguggcc

SEQ ID NO: 1427007 - RNA, 21 nt, Human
gagccugccgagcaaccgugg

SEQ ID NO: 1427008 - RNA, 18 nt, Human
gagccugccgagcaaccg

SEQ ID NO: 1427009 - RNA, 16 nt, Human
gagccugccgagcaac

SEQ ID NO: 1427010 - RNA, 15 nt, Human
gagccugccgagcaa

SEQ ID NO: 1427011 - RNA, 14 nt, Human
gagccugccgagca

SEQ ID NO: 1427012 - RNA, 13 nt, Human
gagccugccgagc

SEQ ID NO: 1427013 - RNA, 14 nt, Human
gagcugaccagccg

SEQ ID NO: 1427014 - RNA, 20 nt, Human
gagcugaagguuguggccuu

SEQ ID NO: 1427015 - RNA, 22 nt, Human
gagcugaagguuguggccuuug

SEQ ID NO: 1427016 - RNA, 21 nt, Human
gagcucuugugaggaaaguca

SEQ ID NO: 1427017 - RNA, 17 nt, Human
gagcugaggccacacuc

SEQ ID NO: 1427018 - RNA, 16 nt, Human
gagcugaggcagcagu

SEQ ID NO: 1427019 - RNA, 15 nt, Human
gagcugauggagaag

SEQ ID NO: 1427020 - RNA, 16 nt, Human
gagcugauggagaagg

SEQ ID NO: 1427021 - RNA, 20 nt, Human
gagcucccacaagccugagg

SEQ ID NO: 1427022 - RNA, 19 nt, Human
gagcucccacaagccugag

SEQ ID NO: 1427023 - RNA, 17 nt, Human
gagcucccacaagccug

SEQ ID NO: 1427024 - RNA, 20 nt, Human
gagcuccuuaaggcucuuuu

SEQ ID NO: 1427025 - RNA, 23 nt, Human
gagcuccaguguccugagcucag

SEQ ID NO: 1427026 - RNA, 22 nt, Human
gagcuccaguguccugagcuca

SEQ ID NO: 1427027 - RNA, 19 nt, Human
gagcuccaguguccugagc

SEQ ID NO: 1427028 - RNA, 18 nt, Human
gagcuccaguguccugag

SEQ ID NO: 1427029 - RNA, 16 nt, Human
gagcuccaguguccug

SEQ ID NO: 1427030 - RNA, 14 nt, Human
gagcuccagugucc

SEQ ID NO: 1427031 - RNA, 20 nt, Human
gagcuccagcuccuuugggc

SEQ ID NO: 1427032 - RNA, 19 nt, Human
gagcuccagcuccuuuggg

SEQ ID NO: 1427033 - RNA, 14 nt, Human
gagcuccagcuccu

SEQ ID NO: 1427034 - RNA, 14 nt, Human
gagcuccagccuga

SEQ ID NO: 1427035 - RNA, 16 nt, Human
gagcucgugggacagu

SEQ ID NO: 1427036 - RNA, 17 nt, Human
gagcucuugugaggaaa

SEQ ID NO: 1427037 - RNA, 23 nt, Human
gaucagccccacccuggccuaga

SEQ ID NO: 1427038 - RNA, 22 nt, Human
gaucagccccacccuggccuag

SEQ ID NO: 1427039 - RNA, 21 nt, Human
gaucagccccacccuggccua

SEQ ID NO: 1427040 - RNA, 16 nt, Human
gaucagccccacccug

SEQ ID NO: 1427041 - RNA, 18 nt, Human
gaucagccagugaccaac

SEQ ID NO: 1427042 - RNA, 19 nt, Human
gaucagcaaaccggggccu

SEQ ID NO: 1427043 - RNA, 22 nt, Human
gaucagaugcuccaagauucua

SEQ ID NO: 1427044 - RNA, 21 nt, Human
gaucagaugcuccaagauucu

SEQ ID NO: 1427045 - RNA, 17 nt, Human
gaucagaugcuccaaga

SEQ ID NO: 1427046 - RNA, 19 nt, Human
gaucaauuauaguuucuga

SEQ ID NO: 1427047 - RNA, 18 nt, Human
gaucaauuauaguuucug

SEQ ID NO: 1427048 - RNA, 16 nt, Human
gaucaauuauaguuuc

SEQ ID NO: 1427049 - RNA, 22 nt, Human
gaucaaggccuuauuggaaagc

SEQ ID NO: 1427050 - RNA, 23 nt, Human
gaucaaggccuuauuggaaagca

SEQ ID NO: 1427051 - RNA, 13 nt, Human
gaucaaggccuua

SEQ ID NO: 1427052 - RNA, 23 nt, Human
gauagucuuuugcuuuuggcaaa

SEQ ID NO: 1427053 - RNA, 21 nt, Human
gaucaaguuauuuuuaauuug

SEQ ID NO: 1427054 - RNA, 23 nt, Human
gaucagugggccuccaaggaggg

SEQ ID NO: 1427055 - RNA, 19 nt, Human
gaucaguauuuaacuaauu

SEQ ID NO: 1427056 - RNA, 17 nt, Human
gaucaguauuuaacuaa

SEQ ID NO: 1427057 - RNA, 18 nt, Human
gaucaguuauaaguagca

SEQ ID NO: 1427058 - RNA, 21 nt, Human
gaucaguuaagaaauuucaca

SEQ ID NO: 1427059 - RNA, 20 nt, Human
gaucaguguaccauuugccu

SEQ ID NO: 1427060 - RNA, 14 nt, Human
gaucaguuaacuau

SEQ ID NO: 1427061 - RNA, 21 nt, Human
gaucauguguggaaguuauua

SEQ ID NO: 1427062 - RNA, 14 nt, Human
gaucauugugaaau

SEQ ID NO: 1427063 - RNA, 18 nt, Human
gaucauuuguuggaauga

SEQ ID NO: 1427064 - RNA, 15 nt, Human
gaucauguguggaag

SEQ ID NO: 1427065 - RNA, 20 nt, Human
gaucauugugaaauuauuca

SEQ ID NO: 1427066 - RNA, 17 nt, Human
gaucccaugagcuccuu

SEQ ID NO: 1427067 - RNA, 12 nt, Human
gaucccccagaa

SEQ ID NO: 1427068 - RNA, 22 nt, Human
gauaaguguucugucugacuuu

SEQ ID NO: 1427069 - RNA, 20 nt, Human
gauaagguaaaaugccauga

SEQ ID NO: 1427070 - RNA, 15 nt, Human
gauaaggccuguggg

SEQ ID NO: 1427071 - RNA, 13 nt, Human
gauaaggaaauca

SEQ ID NO: 1427072 - RNA, 20 nt, Human
gauaagaucuuuuauuuugc

SEQ ID NO: 1427073 - RNA, 14 nt, Human
gauaagaucuuuua

SEQ ID NO: 1427074 - RNA, 16 nt, Human
gauaagaguuggcugg

SEQ ID NO: 1427075 - RNA, 22 nt, Human
gauaagaguagaaacugcaggg

SEQ ID NO: 1427076 - RNA, 21 nt, Human
gauaaauauugagcagaucua

SEQ ID NO: 1427077 - RNA, 17 nt, Human
gauaaagauuuuuuaau

SEQ ID NO: 1427078 - RNA, 17 nt, Human
gauaaagccucaagguu

SEQ ID NO: 1427079 - RNA, 19 nt, Human
gauaaagauuuuuuaauaa

SEQ ID NO: 1427080 - RNA, 19 nt, Human
gauaaaguugguaaaccuu

SEQ ID NO: 1427081 - RNA, 18 nt, Human
gauagaugcuggcccagg

SEQ ID NO: 1427082 - RNA, 17 nt, Human
gauagaugcuggcccag

SEQ ID NO: 1427083 - RNA, 16 nt, Human
gauagaugcuggccca

SEQ ID NO: 1427084 - RNA, 12 nt, Human
gauagaugcugg

SEQ ID NO: 1427085 - RNA, 21 nt, Human
gauagaugcuggcccagggcc

SEQ ID NO: 1427086 - RNA, 20 nt, Human
gauagaugcuggcccagggc

SEQ ID NO: 1427087 - RNA, 19 nt, Human
gauaaguguucugucugac

SEQ ID NO: 1427088 - RNA, 17 nt, Human
gauaagguaaaaugcca

SEQ ID NO: 1427089 - RNA, 11 nt, Human
gauacagaaaa

SEQ ID NO: 1427090 - RNA, 18 nt, Human
gauaauacaccacuacau

SEQ ID NO: 1427091 - RNA, 21 nt, Human
gauaauacaccacuacauucu

SEQ ID NO: 1427092 - RNA, 22 nt, Human
gauaauacaccacuacauucug

SEQ ID NO: 1427093 - RNA, 23 nt, Human
gauggaugccaauauuaaaucug

SEQ ID NO: 1427094 - RNA, 12 nt, Human
gaugccagccaa

SEQ ID NO: 1427095 - RNA, 18 nt, Human
gauggcucccaggggcuc

SEQ ID NO: 1427096 - RNA, 23 nt, Human
gauggcucccaggggcucccucc

SEQ ID NO: 1427097 - RNA, 13 nt, Human
gauggcucccagg

SEQ ID NO: 1427098 - RNA, 15 nt, Human
gaugccacacaagga

SEQ ID NO: 1427099 - RNA, 19 nt, Human
gaugccaauauuaaaucug

SEQ ID NO: 1427100 - RNA, 19 nt, Human
gaugccaaaaaaaaauaca

SEQ ID NO: 1427101 - RNA, 22 nt, Human
gaugcauuuggguccaggagga

SEQ ID NO: 1427102 - RNA, 21 nt, Human
gaugcauuuggguccaggagg

SEQ ID NO: 1427103 - RNA, 20 nt, Human
gaugcauuuggguccaggag

SEQ ID NO: 1427104 - RNA, 19 nt, Human
gaugcauuuggguccagga

SEQ ID NO: 1427105 - RNA, 18 nt, Human
gaugcauuuggguccagg

SEQ ID NO: 1427106 - RNA, 16 nt, Human
gaugcauuugggucca

SEQ ID NO: 1427107 - RNA, 15 nt, Human
gaugcauuugggucc

SEQ ID NO: 1427108 - RNA, 17 nt, Human
gaugaaguuuuacauug

SEQ ID NO: 1427109 - RNA, 16 nt, Human
gaugaaguuuuacauu

SEQ ID NO: 1427110 - RNA, 16 nt, Human
gaugcacaucccugga

SEQ ID NO: 1427111 - RNA, 15 nt, Human
gaugcacaucccugg

SEQ ID NO: 1427112 - RNA, 16 nt, Human
gaugcaccaccaagcc

SEQ ID NO: 1427113 - RNA, 22 nt, Human
gaugcacagaguuguuacauuu

SEQ ID NO: 1427114 - RNA, 16 nt, Human
gaugaagggcccgaga

SEQ ID NO: 1427115 - RNA, 21 nt, Human
gaugaagagagagagggccug

SEQ ID NO: 1427116 - RNA, 15 nt, Human
gaucuuuuauuuugc

SEQ ID NO: 1427117 - RNA, 14 nt, Human
gaucuuuuauuuug

SEQ ID NO: 1427118 - RNA, 19 nt, Human
gaugaaaauaaagaaugga

SEQ ID NO: 1427119 - RNA, 18 nt, Human
gaugaaaauaaagaaugg

SEQ ID NO: 1427120 - RNA, 17 nt, Human
gaucuguuuugaaggca

SEQ ID NO: 1427121 - RNA, 13 nt, Human
gaucuguuuugaa

SEQ ID NO: 1427122 - RNA, 13 nt, Human
gaucugucugugg

SEQ ID NO: 1427123 - RNA, 19 nt, Human
gaucuguuuugaaggcaaa

SEQ ID NO: 1427124 - RNA, 18 nt, Human
gaucuguuuugaaggcaa

SEQ ID NO: 1427125 - RNA, 15 nt, Human
gaucccuagcuguga

SEQ ID NO: 1427126 - RNA, 12 nt, Human
gaucccucaucu

SEQ ID NO: 1427127 - RNA, 21 nt, Human
gaucccuagcugugaccucuc

SEQ ID NO: 1427128 - RNA, 19 nt, Human
gaucccuagcugugaccuc

SEQ ID NO: 1427129 - RNA, 13 nt, Human
gauccuggaaauc

SEQ ID NO: 1427130 - RNA, 16 nt, Human
gaucguucaaagcaug

SEQ ID NO: 1427131 - RNA, 18 nt, Human
gaucgucugacugguguu

SEQ ID NO: 1427132 - RNA, 19 nt, Human
gaucggcaggacacccuga

SEQ ID NO: 1427133 - RNA, 13 nt, Human
gaucggcaggaca

SEQ ID NO: 1427134 - RNA, 17 nt, Human
gaucgccuuccccaccc

SEQ ID NO: 1427135 - RNA, 17 nt, Human
gaucggagccuccucuc

SEQ ID NO: 1427136 - RNA, 20 nt, Human
gaucggagccuccucucuca

SEQ ID NO: 1427137 - RNA, 16 nt, Human
gaucgccuuccccacc

SEQ ID NO: 1427138 - RNA, 14 nt, Human
gaucgccuucccca

SEQ ID NO: 1427139 - RNA, 13 nt, Human
gaucgccuucccc

SEQ ID NO: 1427140 - RNA, 18 nt, Human
gauccugcggguggggcu

SEQ ID NO: 1427141 - RNA, 17 nt, Human
gauccugcggguggggc

SEQ ID NO: 1427142 - RNA, 19 nt, Human
gaucucaccaggcagccuc

SEQ ID NO: 1427143 - RNA, 16 nt, Human
gaucucaccaggcagc

SEQ ID NO: 1427144 - RNA, 15 nt, Human
gaucucaccaggcag

SEQ ID NO: 1427145 - RNA, 14 nt, Human
gaucucaccaggca

SEQ ID NO: 1427146 - RNA, 16 nt, Human
gaucuauuucauguuu

SEQ ID NO: 1427147 - RNA, 14 nt, Human
gaucuauuucaugu

SEQ ID NO: 1427148 - RNA, 13 nt, Human
gaucuauuucaug

SEQ ID NO: 1427149 - RNA, 17 nt, Human
gaucuaaauaaaaugcu

SEQ ID NO: 1427150 - RNA, 16 nt, Human
gaucuaaauaaaaugc

SEQ ID NO: 1427151 - RNA, 14 nt, Human
gaucuaaauaaaau

SEQ ID NO: 1427152 - RNA, 11 nt, Human
gaucuaaauaa

SEQ ID NO: 1427153 - RNA, 20 nt, Human
gaucucaccaggcagccucu

SEQ ID NO: 1427154 - RNA, 23 nt, Human
gaucucaccaggcagccucuggg

SEQ ID NO: 1427155 - RNA, 12 nt, Human
gaucucagcuca

SEQ ID NO: 1427156 - RNA, 17 nt, Human
gaucucagcucacuaca

SEQ ID NO: 1427157 - RNA, 17 nt, Human
gaucucagcucacugca

SEQ ID NO: 1427158 - RNA, 19 nt, Human
gaucucagcucacugcaac

SEQ ID NO: 1427159 - RNA, 15 nt, Human
gcaaggcagccgugg

SEQ ID NO: 1427160 - RNA, 13 nt, Human
gcaaggcagccgu

SEQ ID NO: 1427161 - RNA, 19 nt, Human
gcaaggacuuuguacauuu

SEQ ID NO: 1427162 - RNA, 16 nt, Human
gcaaggacuuuguaca

SEQ ID NO: 1427163 - RNA, 14 nt, Human
gcaaggacuuugua

SEQ ID NO: 1427164 - RNA, 17 nt, Human
gcaaggaccuaaaacau

SEQ ID NO: 1427165 - RNA, 18 nt, Human
gcaaggagauuuacaacu

SEQ ID NO: 1427166 - RNA, 18 nt, Human
gcaagcauucagaagaaa

SEQ ID NO: 1427167 - RNA, 10 nt, Human
gcaagccaga

SEQ ID NO: 1427168 - RNA, 23 nt, Human
gcaaggcccgagcagcugagcag

SEQ ID NO: 1427169 - RNA, 22 nt, Human
gcaaggcccgagcagcugagca

SEQ ID NO: 1427170 - RNA, 21 nt, Human
gcaaggcccgagcagcugagc

SEQ ID NO: 1427171 - RNA, 20 nt, Human
gcaaggcccgagcagcugag

SEQ ID NO: 1427172 - RNA, 19 nt, Human
gcaaggcccgagcagcuga

SEQ ID NO: 1427173 - RNA, 18 nt, Human
gcaaggcccgagcagcug

SEQ ID NO: 1427174 - RNA, 17 nt, Human
gcaaggcccgagcagcu

SEQ ID NO: 1427175 - RNA, 16 nt, Human
gcaaggcccgagcagc

SEQ ID NO: 1427176 - RNA, 14 nt, Human
gcaaggcccgagca

SEQ ID NO: 1427177 - RNA, 24 nt, Human
gcaaggcccgagcagcugagcagg

SEQ ID NO: 1427178 - RNA, 20 nt, Human
gcaaggccugguguuucuug

SEQ ID NO: 1427179 - RNA, 19 nt, Human
gcaaugccaucaucuccug

SEQ ID NO: 1427180 - RNA, 18 nt, Human
gcaaugccaucaucuccu

SEQ ID NO: 1427181 - RNA, 15 nt, Human
gcaaugccaucaucu

SEQ ID NO: 1427182 - RNA, 21 nt, Human
gcaaugccacagcccugucag

SEQ ID NO: 1427183 - RNA, 19 nt, Human
gcaaugccacagcccuguc

SEQ ID NO: 1427184 - RNA, 17 nt, Human
gcaaugccacagcccug

SEQ ID NO: 1427185 - RNA, 13 nt, Human
gcaaugccacagc

SEQ ID NO: 1427186 - RNA, 17 nt, Human
gcaaugaugaaugagaa

SEQ ID NO: 1427187 - RNA, 16 nt, Human
gcaaugaugaaugaga

SEQ ID NO: 1427188 - RNA, 17 nt, Human
gcaagguacucugguga

SEQ ID NO: 1427189 - RNA, 15 nt, Human
gcaagguacucuggu

SEQ ID NO: 1427190 - RNA, 14 nt, Human
gcaaggucauuuuu

SEQ ID NO: 1427191 - RNA, 13 nt, Human
gcaacagaucugg

SEQ ID NO: 1427192 - RNA, 12 nt, Human
gcaacagaucug

SEQ ID NO: 1427193 - RNA, 15 nt, Human
gcaacagaucaguaa

SEQ ID NO: 1427194 - RNA, 19 nt, Human
gcaacacuggucugcuguu

SEQ ID NO: 1427195 - RNA, 18 nt, Human
gcaacacuggucugcugu

SEQ ID NO: 1427196 - RNA, 22 nt, Human
gcaaaucgaaugaaauuaacug

SEQ ID NO: 1427197 - RNA, 16 nt, Human
gcaacagaucaguaaa

SEQ ID NO: 1427198 - RNA, 22 nt, Human
gcaacagaucuggaaccucagc

SEQ ID NO: 1427199 - RNA, 20 nt, Human
gcaacagaucuggaaccuca

SEQ ID NO: 1427200 - RNA, 18 nt, Human
gcaacagaucuggaaccu

SEQ ID NO: 1427201 - RNA, 17 nt, Human
gcaacagaucuggaacc

SEQ ID NO: 1427202 - RNA, 16 nt, Human
gcaacagaucuggaac

SEQ ID NO: 1427203 - RNA, 14 nt, Human
gcaacagaucugga

SEQ ID NO: 1427204 - RNA, 23 nt, Human
gcaagaaggcaaaaauaguuugg

SEQ ID NO: 1427205 - RNA, 20 nt, Human
gcaagaaggcaaaaauaguu

SEQ ID NO: 1427206 - RNA, 16 nt, Human
gcaagaaggcaaaaau

SEQ ID NO: 1427207 - RNA, 14 nt, Human
gcaagaaggaggcu

SEQ ID NO: 1427208 - RNA, 23 nt, Human
gcaagaggccguggcugcugugg

SEQ ID NO: 1427209 - RNA, 22 nt, Human
gcaagaggccguggcugcugug

SEQ ID NO: 1427210 - RNA, 20 nt, Human
gcaagaggccguggcugcug

SEQ ID NO: 1427211 - RNA, 18 nt, Human
gcaagaggccguggcugc

SEQ ID NO: 1427212 - RNA, 22 nt, Human
gcaagacuucucuuugccucaa

SEQ ID NO: 1427213 - RNA, 21 nt, Human
gcaagacuucucuuugccuca

SEQ ID NO: 1427214 - RNA, 19 nt, Human
gcaagacuucucuuugccu

SEQ ID NO: 1427215 - RNA, 15 nt, Human
gcaagaccaguugaa

SEQ ID NO: 1427216 - RNA, 21 nt, Human
gcaagaaggcaaaaauaguuu

SEQ ID NO: 1427217 - RNA, 21 nt, Human
gcaagaaucagagaaggaaca

SEQ ID NO: 1427218 - RNA, 21 nt, Human
gcaaaucaccacaaacuguaa

SEQ ID NO: 1427219 - RNA, 17 nt, Human
gcaaaucaggcuuuugu

SEQ ID NO: 1427220 - RNA, 14 nt, Human
gcaaaucauuuguu

SEQ ID NO: 1427221 - RNA, 18 nt, Human
gcaaaucauuuguuuaaa

SEQ ID NO: 1427222 - RNA, 19 nt, Human
gcaaagccuguucauggca

SEQ ID NO: 1427223 - RNA, 12 nt, Human
gcaaagccuguu

SEQ ID NO: 1427224 - RNA, 11 nt, Human
gcaaagccugu

SEQ ID NO: 1427225 - RNA, 23 nt, Human
gcaaagcccccagagcccaggcu

SEQ ID NO: 1427226 - RNA, 19 nt, Human
gcaaagcccccagagccca

SEQ ID NO: 1427227 - RNA, 15 nt, Human
gcaaagcccccagag

SEQ ID NO: 1427228 - RNA, 13 nt, Human
gcaaagcccccag

SEQ ID NO: 1427229 - RNA, 16 nt, Human
gcaaaguaucccuacu

SEQ ID NO: 1427230 - RNA, 12 nt, Human
gcaaacacuuaa

SEQ ID NO: 1427231 - RNA, 17 nt, Human
gcaaaauugcaaaucuu

SEQ ID NO: 1427232 - RNA, 13 nt, Human
gcaaaauugcaaa

SEQ ID NO: 1427233 - RNA, 17 nt, Human
gauuuuuuaauaauuua

SEQ ID NO: 1427234 - RNA, 16 nt, Human
gauuuuuuaauaauuu

SEQ ID NO: 1427235 - RNA, 22 nt, Human
gauuuuuguuuuguuuuuacaa

SEQ ID NO: 1427236 - RNA, 13 nt, Human
gauuuuugccucu

SEQ ID NO: 1427237 - RNA, 15 nt, Human
gauuuuucuuuacaa

SEQ ID NO: 1427238 - RNA, 16 nt, Human
gcaaagccaggucccu

SEQ ID NO: 1427239 - RNA, 21 nt, Human
gcaaacaggaucaguuaacua

SEQ ID NO: 1427240 - RNA, 18 nt, Human
gauugcaauaucugaagc

SEQ ID NO: 1427241 - RNA, 14 nt, Human
gauucuaaagauuc

SEQ ID NO: 1427242 - RNA, 13 nt, Human
gauucuaaagauu

SEQ ID NO: 1427243 - RNA, 12 nt, Human
gauucuaaagau

SEQ ID NO: 1427244 - RNA, 11 nt, Human
gauucuaaaga

SEQ ID NO: 1427245 - RNA, 22 nt, Human
gauucuaaaaugugauguucua

SEQ ID NO: 1427246 - RNA, 12 nt, Human
gauucuaaaaug

SEQ ID NO: 1427247 - RNA, 11 nt, Human
gauucuaaaau

SEQ ID NO: 1427248 - RNA, 17 nt, Human
gauucgguaucccccca

SEQ ID NO: 1427249 - RNA, 16 nt, Human
gauucgguaucccccc

SEQ ID NO: 1427250 - RNA, 16 nt, Human
gauucgaaugacacug

SEQ ID NO: 1427251 - RNA, 17 nt, Human
gauucgaaugacacugu

SEQ ID NO: 1427252 - RNA, 20 nt, Human
gauuccuuuaacaacauguu

SEQ ID NO: 1427253 - RNA, 21 nt, Human
gauuccuuuaacaacauguuu

SEQ ID NO: 1427254 - RNA, 15 nt, Human
gauuccuuuaacaac

SEQ ID NO: 1427255 - RNA, 14 nt, Human
gauuccuuuaacaa

SEQ ID NO: 1427256 - RNA, 13 nt, Human
gauuccuuuaaca

SEQ ID NO: 1427257 - RNA, 12 nt, Human
gauuccuuccca

SEQ ID NO: 1427258 - RNA, 13 nt, Human
gauuccuucccau

SEQ ID NO: 1427259 - RNA, 18 nt, Human
gauuccuuagacucuuuu

SEQ ID NO: 1427260 - RNA, 22 nt, Human
gaugggggaacucagauccagg

SEQ ID NO: 1427261 - RNA, 20 nt, Human
gaugggggaacucagaucca

SEQ ID NO: 1427262 - RNA, 19 nt, Human
gaugggggaacucagaucc

SEQ ID NO: 1427263 - RNA, 16 nt, Human
gaugggggaacucaga

SEQ ID NO: 1427264 - RNA, 23 nt, Human
gauggggcaggccaccuggcucu

SEQ ID NO: 1427265 - RNA, 21 nt, Human
gauggcuuugaaugcggccca

SEQ ID NO: 1427266 - RNA, 16 nt, Human
gauggggaccagcagc

SEQ ID NO: 1427267 - RNA, 18 nt, Human
gauggggaccagcagccc

SEQ ID NO: 1427268 - RNA, 18 nt, Human
gauggggguuucaccaua

SEQ ID NO: 1427269 - RNA, 16 nt, Human
gauggggucuguaaaa

SEQ ID NO: 1427270 - RNA, 19 nt, Human
gauucauaguaacuucuua

SEQ ID NO: 1427271 - RNA, 18 nt, Human
gauuccauugguccaaga

SEQ ID NO: 1427272 - RNA, 19 nt, Human
gauuccagagcacugcucc

SEQ ID NO: 1427273 - RNA, 14 nt, Human
gauuugucccaggu

SEQ ID NO: 1427274 - RNA, 19 nt, Human
gauuuguaacccacugaga

SEQ ID NO: 1427275 - RNA, 14 nt, Human
gauuuguacugaaa

SEQ ID NO: 1427276 - RNA, 22 nt, Human
gauuugugucugugacuuuugu

SEQ ID NO: 1427277 - RNA, 19 nt, Human
gauuuucaaagcuuuuucc

SEQ ID NO: 1427278 - RNA, 18 nt, Human
gauuuucaaagcuuuuuc

SEQ ID NO: 1427279 - RNA, 20 nt, Human
gauuuuucuuuacaaaacaa

SEQ ID NO: 1427280 - RNA, 14 nt, Human
gauuuuucuuuaca

SEQ ID NO: 1427281 - RNA, 15 nt, Human
gauuuuucuuuaacu

SEQ ID NO: 1427282 - RNA, 13 nt, Human
gauuuuucuuuaa

SEQ ID NO: 1427283 - RNA, 12 nt, Human
gauuuuucuuua

SEQ ID NO: 1427284 - RNA, 15 nt, Human
gauuuuuaugucugg

SEQ ID NO: 1427285 - RNA, 16 nt, Human
gauuuucugguucuaa

SEQ ID NO: 1427286 - RNA, 15 nt, Human
gauuuucugguucua

SEQ ID NO: 1427287 - RNA, 20 nt, Human
gauuuucugcuacuuugcug

SEQ ID NO: 1427288 - RNA, 14 nt, Human
gauuuucaguuacu

SEQ ID NO: 1427289 - RNA, 12 nt, Human
gauuuucaguua

SEQ ID NO: 1427290 - RNA, 19 nt, Human
gauuuucagcccucagaau

SEQ ID NO: 1427291 - RNA, 11 nt, Human
gauuuucagcc

SEQ ID NO: 1427292 - RNA, 15 nt, Human
gauuuucagcccuca

SEQ ID NO: 1427293 - RNA, 13 nt, Human
gauuuuccaaaug

SEQ ID NO: 1427294 - RNA, 15 nt, Human
gauuuuccugaaaac

SEQ ID NO: 1427295 - RNA, 21 nt, Human
gauuugcauugaacacaaacu

SEQ ID NO: 1427296 - RNA, 21 nt, Human
gauuucuguuuagauaauaca

SEQ ID NO: 1427297 - RNA, 11 nt, Human
gauuucuguuu

SEQ ID NO: 1427298 - RNA, 19 nt, Human
gauuucuguuuagauaaua

SEQ ID NO: 1427299 - RNA, 20 nt, Human
gauuuggcuugacaaaggca

SEQ ID NO: 1427300 - RNA, 22 nt, Human
gauuuggucaacacuaacauga

SEQ ID NO: 1427301 - RNA, 14 nt, Human
gauuucugaggaaa

SEQ ID NO: 1427302 - RNA, 18 nt, Human
gauuuccguuaaaauacc

SEQ ID NO: 1427303 - RNA, 15 nt, Human
gauuuccguuaaaau

SEQ ID NO: 1427304 - RNA, 19 nt, Human
gauugcagaaaauucugug

SEQ ID NO: 1427305 - RNA, 23 nt, Human
gauugcacguggccucuugagca

SEQ ID NO: 1427306 - RNA, 20 nt, Human
gauugcacguggccucuuga

SEQ ID NO: 1427307 - RNA, 19 nt, Human
gauugcacguggccucuug

SEQ ID NO: 1427308 - RNA, 17 nt, Human
gauugcacguggccucu

SEQ ID NO: 1427309 - RNA, 16 nt, Human
gauugcacguggccuc

SEQ ID NO: 1427310 - RNA, 15 nt, Human
gauugcacguggccu

SEQ ID NO: 1427311 - RNA, 21 nt, Human
gauugcaauaucugaagcccu

SEQ ID NO: 1427312 - RNA, 15 nt, Human
gauuuccagccuucu

SEQ ID NO: 1427313 - RNA, 23 nt, Human
gcagaauccuaggcuccacccca

SEQ ID NO: 1427314 - RNA, 14 nt, Human
gcagaauaguauuu

SEQ ID NO: 1427315 - RNA, 22 nt, Human
gcacuuccucucgcggcccuca

SEQ ID NO: 1427316 - RNA, 20 nt, Human
gcacuuccucucgcggcccu

SEQ ID NO: 1427317 - RNA, 18 nt, Human
gcacuucaaauucaaaua

SEQ ID NO: 1427318 - RNA, 18 nt, Human
gcacuuauuuaaugccga

SEQ ID NO: 1427319 - RNA, 22 nt, Human
gcacuuacugguaggaccaagc

SEQ ID NO: 1427320 - RNA, 23 nt, Human
gcacuguaaaaugugggauuaug

SEQ ID NO: 1427321 - RNA, 16 nt, Human
gcacuguaaaaugugg

SEQ ID NO: 1427322 - RNA, 14 nt, Human
gcacuguaaaaugu

SEQ ID NO: 1427323 - RNA, 13 nt, Human
gcacuguaaaaug

SEQ ID NO: 1427324 - RNA, 12 nt, Human
gcacuguaaaau

SEQ ID NO: 1427325 - RNA, 9 nt, Human
gcacuguaa

SEQ ID NO: 1427326 - RNA, 18 nt, Human
gcacuuaaagcuuucaga

SEQ ID NO: 1427327 - RNA, 20 nt, Human
gcagacaggccccgugaggc

SEQ ID NO: 1427328 - RNA, 15 nt, Human
gcagacagcuccacc

SEQ ID NO: 1427329 - RNA, 13 nt, Human
gcacugcccuggu

SEQ ID NO: 1427330 - RNA, 12 nt, Human
gcacugcccugg

SEQ ID NO: 1427331 - RNA, 21 nt, Human
gcacugcccauggacaggcug

SEQ ID NO: 1427332 - RNA, 23 nt, Human
gcacugccaggagggacaaagga

SEQ ID NO: 1427333 - RNA, 18 nt, Human
gcacugccaggagggaca

SEQ ID NO: 1427334 - RNA, 17 nt, Human
gcacugccaggagggac

SEQ ID NO: 1427335 - RNA, 16 nt, Human
gcacugccaggaggga

SEQ ID NO: 1427336 - RNA, 15 nt, Human
gcacugccaggaggg

SEQ ID NO: 1427337 - RNA, 14 nt, Human
gcacugccaggagg

SEQ ID NO: 1427338 - RNA, 13 nt, Human
gcacugccaggag

SEQ ID NO: 1427339 - RNA, 14 nt, Human
gcacugccacuggg

SEQ ID NO: 1427340 - RNA, 13 nt, Human
gcacugccacugg

SEQ ID NO: 1427341 - RNA, 19 nt, Human
gcacguggccucuugagca

SEQ ID NO: 1427342 - RNA, 17 nt, Human
gcacguggccucuugag

SEQ ID NO: 1427343 - RNA, 15 nt, Human
gcacguggccucuug

SEQ ID NO: 1427344 - RNA, 14 nt, Human
gcacguggccucuu

SEQ ID NO: 1427345 - RNA, 13 nt, Human
gcacguggccucu

SEQ ID NO: 1427346 - RNA, 18 nt, Human
gcacguaaaguacuugua

SEQ ID NO: 1427347 - RNA, 21 nt, Human
gcacguaaaguacuuguaguu

SEQ ID NO: 1427348 - RNA, 17 nt, Human
gcacguaaaguacuugu

SEQ ID NO: 1427349 - RNA, 19 nt, Human
gcacugccugcucccaucc

SEQ ID NO: 1427350 - RNA, 21 nt, Human
gcacugccugcucccauccug

SEQ ID NO: 1427351 - RNA, 19 nt, Human
gcacugcccugguggcccu

SEQ ID NO: 1427352 - RNA, 23 nt, Human
gcaccauucugacucgguuucuc

SEQ ID NO: 1427353 - RNA, 17 nt, Human
gcaccauucugacucgg

SEQ ID NO: 1427354 - RNA, 15 nt, Human
gcaccauucugacuc

SEQ ID NO: 1427355 - RNA, 23 nt, Human
gcaccaugcugcuggggaagaca

SEQ ID NO: 1427356 - RNA, 20 nt, Human
gcaccaugcugcuggggaag

SEQ ID NO: 1427357 - RNA, 18 nt, Human
gcaccaugcugcugggga

SEQ ID NO: 1427358 - RNA, 16 nt, Human
gcaccaugcugcuggg

SEQ ID NO: 1427359 - RNA, 13 nt, Human
gcaccaggaagcc

SEQ ID NO: 1427360 - RNA, 16 nt, Human
gcaccagaauguauau

SEQ ID NO: 1427361 - RNA, 22 nt, Human
gcaaugccacagcccugucagc

SEQ ID NO: 1427362 - RNA, 18 nt, Human
gcaccacuguguauuuaa

SEQ ID NO: 1427363 - RNA, 14 nt, Human
gcaccagacaccca

SEQ ID NO: 1427364 - RNA, 16 nt, Human
gcaccugggcccuggg

SEQ ID NO: 1427365 - RNA, 15 nt, Human
gcaccugggcccugg

SEQ ID NO: 1427366 - RNA, 18 nt, Human
gcaccuggcaucgcacca

SEQ ID NO: 1427367 - RNA, 22 nt, Human
gcaccuggaauauauaaccagu

SEQ ID NO: 1427368 - RNA, 21 nt, Human
gcacccuaguucuaccucagg

SEQ ID NO: 1427369 - RNA, 18 nt, Human
gcaccuggaauauauaac

SEQ ID NO: 1427370 - RNA, 21 nt, Human
gcaccuggaauauauaaccag

SEQ ID NO: 1427371 - RNA, 16 nt, Human
gcacgaccgccccagu

SEQ ID NO: 1427372 - RNA, 15 nt, Human
gcacgaaauguuauu

SEQ ID NO: 1427373 - RNA, 18 nt, Human
gcaccuuucuaguugaaa

SEQ ID NO: 1427374 - RNA, 17 nt, Human
gcaccuuucuaguugaa

SEQ ID NO: 1427375 - RNA, 13 nt, Human
gcaccuuucuagu

SEQ ID NO: 1427376 - RNA, 17 nt, Human
gcaccugggcccugggg

SEQ ID NO: 1427377 - RNA, 13 nt, Human
gcacgacagugga

SEQ ID NO: 1427378 - RNA, 14 nt, Human
gcacggcagccaca

SEQ ID NO: 1427379 - RNA, 12 nt, Human
gcacgauuucug

SEQ ID NO: 1427380 - RNA, 22 nt, Human
gcacggcucuguccccagccug

SEQ ID NO: 1427381 - RNA, 20 nt, Human
gcacggcucuguccccagcc

SEQ ID NO: 1427382 - RNA, 19 nt, Human
gcacggcucuguccccagc

SEQ ID NO: 1427383 - RNA, 18 nt, Human
gcacggcucuguccccag

SEQ ID NO: 1427384 - RNA, 14 nt, Human
gcacggcucugucc

SEQ ID NO: 1427385 - RNA, 16 nt, Human
gcacggcagccacagc

SEQ ID NO: 1427386 - RNA, 16 nt, Human
gcaggcagaggcccag

SEQ ID NO: 1427387 - RNA, 15 nt, Human
gcaggcagaggccca

SEQ ID NO: 1427388 - RNA, 21 nt, Human
gcaggcagccagcaucugggc

SEQ ID NO: 1427389 - RNA, 19 nt, Human
gcaggcagccagcaucugg

SEQ ID NO: 1427390 - RNA, 14 nt, Human
gcaggcagccagca

SEQ ID NO: 1427391 - RNA, 21 nt, Human
gcaggcagaggcccaggcugc

SEQ ID NO: 1427392 - RNA, 20 nt, Human
gcaggcagaggcccaggcug

SEQ ID NO: 1427393 - RNA, 19 nt, Human
gcaggcagaggcccaggcu

SEQ ID NO: 1427394 - RNA, 23 nt, Human
gcaggaaaugaaaaugucuugug

SEQ ID NO: 1427395 - RNA, 21 nt, Human
gcaggaaaugaaaaugucuug

SEQ ID NO: 1427396 - RNA, 19 nt, Human
gcagcuuuagaaucccagc

SEQ ID NO: 1427397 - RNA, 16 nt, Human
gcagcuuuuaaaagau

SEQ ID NO: 1427398 - RNA, 11 nt, Human
gcaggaaggcu

SEQ ID NO: 1427399 - RNA, 22 nt, Human
gcaggaaggagcugccuggacc

SEQ ID NO: 1427400 - RNA, 23 nt, Human
gcaggaaggagcugccuggaccc

SEQ ID NO: 1427401 - RNA, 21 nt, Human
gcaggaaggagcugccuggac

SEQ ID NO: 1427402 - RNA, 20 nt, Human
gcaggaaggagcugccugga

SEQ ID NO: 1427403 - RNA, 19 nt, Human
gcaggaaggagcugccugg

SEQ ID NO: 1427404 - RNA, 18 nt, Human
gcaggaaggagcugccug

SEQ ID NO: 1427405 - RNA, 17 nt, Human
gcaggaaggagcugccu

SEQ ID NO: 1427406 - RNA, 16 nt, Human
gcaggaaggagcugcc

SEQ ID NO: 1427407 - RNA, 15 nt, Human
gcaggaaggagcugc

SEQ ID NO: 1427408 - RNA, 14 nt, Human
gcaggaaggagcug

SEQ ID NO: 1427409 - RNA, 13 nt, Human
gcaggaaggagcu

SEQ ID NO: 1427410 - RNA, 23 nt, Human
gcagcuuguagccagccggggcg

SEQ ID NO: 1427411 - RNA, 22 nt, Human
gcagcuuguagccagccggggc

SEQ ID NO: 1427412 - RNA, 21 nt, Human
gcagcuuguagccagccgggg

SEQ ID NO: 1427413 - RNA, 20 nt, Human
gcagcuuguagccagccggg

SEQ ID NO: 1427414 - RNA, 19 nt, Human
gcagcuuguagccagccgg

SEQ ID NO: 1427415 - RNA, 18 nt, Human
gcagcuuguagccagccg

SEQ ID NO: 1427416 - RNA, 17 nt, Human
gcagcuuguagccagcc

SEQ ID NO: 1427417 - RNA, 16 nt, Human
gcagcuuguagccagc

SEQ ID NO: 1427418 - RNA, 15 nt, Human
gcagcuuguagccag

SEQ ID NO: 1427419 - RNA, 14 nt, Human
gcagcuuguagcca

SEQ ID NO: 1427420 - RNA, 18 nt, Human
gcagcucaagagauccca

SEQ ID NO: 1427421 - RNA, 23 nt, Human
gcagcucaagcagcgaccgcccc

SEQ ID NO: 1427422 - RNA, 16 nt, Human
gcagcucaagagaucc

SEQ ID NO: 1427423 - RNA, 12 nt, Human
gcagccuuguga

SEQ ID NO: 1427424 - RNA, 17 nt, Human
gcagccuggggcuggcc

SEQ ID NO: 1427425 - RNA, 14 nt, Human
gcagccuggggcug

SEQ ID NO: 1427426 - RNA, 10 nt, Human
gcagccuggg

SEQ ID NO: 1427427 - RNA, 20 nt, Human
gcagcccugcugcugccugc

SEQ ID NO: 1427428 - RNA, 21 nt, Human
gcagcccugcugcugccugcc

SEQ ID NO: 1427429 - RNA, 23 nt, Human
gcagcccccagcucccaccuccc

SEQ ID NO: 1427430 - RNA, 19 nt, Human
gcagcccccagcucccacc

SEQ ID NO: 1427431 - RNA, 14 nt, Human
gcagcccccagcuc

SEQ ID NO: 1427432 - RNA, 19 nt, Human
gcagcccccacccccaagg

SEQ ID NO: 1427433 - RNA, 17 nt, Human
gcagcaauuuaaauguu

SEQ ID NO: 1427434 - RNA, 12 nt, Human
gcagcaauuuaa

SEQ ID NO: 1427435 - RNA, 15 nt, Human
gcagcaauuuaaaug

SEQ ID NO: 1427436 - RNA, 16 nt, Human
gcagcaauuuaaaugu

SEQ ID NO: 1427437 - RNA, 16 nt, Human
gcagcaauaaagcagc

SEQ ID NO: 1427438 - RNA, 23 nt, Human
gcagcaauaaagcagcguuucua

SEQ ID NO: 1427439 - RNA, 15 nt, Human
gcagacccugcccuu

SEQ ID NO: 1427440 - RNA, 14 nt, Human
gcagacccugcccu

SEQ ID NO: 1427441 - RNA, 17 nt, Human
gcagaccacauugcuuu

SEQ ID NO: 1427442 - RNA, 23 nt, Human
gcagaccacgcccguccugccug

SEQ ID NO: 1427443 - RNA, 20 nt, Human
gcagaccacgcccguccugc

SEQ ID NO: 1427444 - RNA, 21 nt, Human
gcagaccaccccgccugcccu

SEQ ID NO: 1427445 - RNA, 17 nt, Human
gcagaccaccccgccug

SEQ ID NO: 1427446 - RNA, 13 nt, Human
gcagaccaccccg

SEQ ID NO: 1427447 - RNA, 19 nt, Human
gcagacaugugcacuugaa

SEQ ID NO: 1427448 - RNA, 17 nt, Human
gcagacauuuuaaaaaa

SEQ ID NO: 1427449 - RNA, 14 nt, Human
gcagauccaggacu

SEQ ID NO: 1427450 - RNA, 21 nt, Human
gcagauuuucagcaaacucuu

SEQ ID NO: 1427451 - RNA, 19 nt, Human
gcagauucucccuugcucu

SEQ ID NO: 1427452 - RNA, 21 nt, Human
gcagauucucccuugcucugc

SEQ ID NO: 1427453 - RNA, 19 nt, Human
gcagauucagaaaugaggc

SEQ ID NO: 1427454 - RNA, 21 nt, Human
gcagauucagaaaugaggcca

SEQ ID NO: 1427455 - RNA, 17 nt, Human
gcagauucagaaaugag

SEQ ID NO: 1427456 - RNA, 15 nt, Human
gcaguucugaagaag

SEQ ID NO: 1427457 - RNA, 17 nt, Human
gcaguucugaagaagau

SEQ ID NO: 1427458 - RNA, 13 nt, Human
gcauagaaguaaa

SEQ ID NO: 1427459 - RNA, 22 nt, Human
gcaguggcgugaucucagcuca

SEQ ID NO: 1427460 - RNA, 15 nt, Human
gcagugugaggccag

SEQ ID NO: 1427461 - RNA, 18 nt, Human
gcagugucuguguuuuga

SEQ ID NO: 1427462 - RNA, 18 nt, Human
gcaguggcgcgaucucag

SEQ ID NO: 1427463 - RNA, 22 nt, Human
gcaguggcgcgaucucagcuca

SEQ ID NO: 1427464 - RNA, 23 nt, Human
gcaguggugguuuucuguucuuu

SEQ ID NO: 1427465 - RNA, 23 nt, Human
gcauaugaguaagggcacugacg

SEQ ID NO: 1427466 - RNA, 19 nt, Human
gcauaugaguaagggcacu

SEQ ID NO: 1427467 - RNA, 12 nt, Human
gcauaucugccu

SEQ ID NO: 1427468 - RNA, 14 nt, Human
gcauaucugccuuu

SEQ ID NO: 1427469 - RNA, 15 nt, Human
gcauaucugccuuua

SEQ ID NO: 1427470 - RNA, 16 nt, Human
gcauaucugccuuuau

SEQ ID NO: 1427471 - RNA, 18 nt, Human
gcauaucugccuuuauug

SEQ ID NO: 1427472 - RNA, 21 nt, Human
gcauaucugccuuuauugugu

SEQ ID NO: 1427473 - RNA, 22 nt, Human
gcauaucugccuuuauuguguu

SEQ ID NO: 1427474 - RNA, 13 nt, Human
gcauaucauaaug

SEQ ID NO: 1427475 - RNA, 20 nt, Human
gcauaguaccaaucauuuua

SEQ ID NO: 1427476 - RNA, 13 nt, Human
gcauacuuuuuaa

SEQ ID NO: 1427477 - RNA, 17 nt, Human
gcauagguuuaauaauu

SEQ ID NO: 1427478 - RNA, 14 nt, Human
gcaggggccuggag

SEQ ID NO: 1427479 - RNA, 13 nt, Human
gcaggggccugga

SEQ ID NO: 1427480 - RNA, 15 nt, Human
gcaggggccuccaug

SEQ ID NO: 1427481 - RNA, 20 nt, Human
gcaggggccgggggcagucu

SEQ ID NO: 1427482 - RNA, 19 nt, Human
gcaggggccgggggcaguc

SEQ ID NO: 1427483 - RNA, 20 nt, Human
gcaggggccuggagauccuc

SEQ ID NO: 1427484 - RNA, 16 nt, Human
gcaggggccuggagau

SEQ ID NO: 1427485 - RNA, 22 nt, Human
gcagggccggggaacuggccaa

SEQ ID NO: 1427486 - RNA, 23 nt, Human
gcagggccggggaacuggccaag

SEQ ID NO: 1427487 - RNA, 20 nt, Human
gcagggccggggaacuggcc

SEQ ID NO: 1427488 - RNA, 14 nt, Human
gcagggccggggaa

SEQ ID NO: 1427489 - RNA, 13 nt, Human
gcagggccgggga

SEQ ID NO: 1427490 - RNA, 21 nt, Human
gcagggccccaggcauugcca

SEQ ID NO: 1427491 - RNA, 13 nt, Human
gcagggcagucau

SEQ ID NO: 1427492 - RNA, 22 nt, Human
gcagggugggcuuguggggccu

SEQ ID NO: 1427493 - RNA, 22 nt, Human
gcagggugcaguaucaugcccu

SEQ ID NO: 1427494 - RNA, 22 nt, Human
gcagguaugaucggcaggacac

SEQ ID NO: 1427495 - RNA, 13 nt, Human
gcagugcuuuugg

SEQ ID NO: 1427496 - RNA, 22 nt, Human
gcaguggcaggcagaggcccag

SEQ ID NO: 1427497 - RNA, 15 nt, Human
gcaguggcaggcaga

SEQ ID NO: 1427498 - RNA, 23 nt, Human
gcaguggauggccgugaaugggu

SEQ ID NO: 1427499 - RNA, 12 nt, Human
gcaguggccuua

SEQ ID NO: 1427500 - RNA, 22 nt, Human
gcaguggcaucaucucagcuca

SEQ ID NO: 1427501 - RNA, 22 nt, Human
gcaugagggguuccuccccucc

SEQ ID NO: 1427502 - RNA, 20 nt, Human
gcaugagggguuccuccccu

SEQ ID NO: 1427503 - RNA, 19 nt, Human
gcaugagggguuccucccc

SEQ ID NO: 1427504 - RNA, 17 nt, Human
gcaugagggguuccucc

SEQ ID NO: 1427505 - RNA, 14 nt, Human
gcaugagaaauaca

SEQ ID NO: 1427506 - RNA, 17 nt, Human
gcaugagaaauacaaaa

SEQ ID NO: 1427507 - RNA, 15 nt, Human
gcaugagaggaggca

SEQ ID NO: 1427508 - RNA, 17 nt, Human
gcaugagaggaggcagc

SEQ ID NO: 1427509 - RNA, 15 nt, Human
gcaugcggcccagga

SEQ ID NO: 1427510 - RNA, 20 nt, Human
gcauggauauaguuuuacuu

SEQ ID NO: 1427511 - RNA, 18 nt, Human
gcauggauuucuuugaaa

SEQ ID NO: 1427512 - RNA, 16 nt, Human
gcauggauuucuuuga

SEQ ID NO: 1427513 - RNA, 15 nt, Human
gcauggauuucuuug

SEQ ID NO: 1427514 - RNA, 13 nt, Human
gcauuauauuuau

SEQ ID NO: 1427515 - RNA, 22 nt, Human
gcaucuuggggggguggccgcu

SEQ ID NO: 1427516 - RNA, 19 nt, Human
gcaucuuuuguauuaagaa

SEQ ID NO: 1427517 - RNA, 23 nt, Human
gcaucuuuuguauuaagaaagga

SEQ ID NO: 1427518 - RNA, 16 nt, Human
gcaucuuuuguauuaa

SEQ ID NO: 1427519 - RNA, 12 nt, Human
gcaucuuuugua

SEQ ID NO: 1427520 - RNA, 18 nt, Human
gcaugaaguaauaugcac

SEQ ID NO: 1427521 - RNA, 22 nt, Human
gcaucagaaagggagggcucug

SEQ ID NO: 1427522 - RNA, 23 nt, Human
gcaucagaaagggagggcucuga

SEQ ID NO: 1427523 - RNA, 21 nt, Human
gcaucagaaagggagggcucu

SEQ ID NO: 1427524 - RNA, 19 nt, Human
gcaucagaaagggagggcu

SEQ ID NO: 1427525 - RNA, 22 nt, Human
gcaucagacugugaaccccacg

SEQ ID NO: 1427526 - RNA, 18 nt, Human
gcaucagaaagggagggc

SEQ ID NO: 1427527 - RNA, 16 nt, Human
gcaucagaaagggagg

SEQ ID NO: 1427528 - RNA, 17 nt, Human
gcaucagaaagaggcag

SEQ ID NO: 1427529 - RNA, 13 nt, Human
gcaucagaaagag

SEQ ID NO: 1427530 - RNA, 23 nt, Human
gcaucacuuaacggaccaaagca

SEQ ID NO: 1427531 - RNA, 13 nt, Human
gcaucuguuuauu

SEQ ID NO: 1427532 - RNA, 16 nt, Human
gcaucugaaaauugau

SEQ ID NO: 1427533 - RNA, 17 nt, Human
gccaaaccucaccaacu

SEQ ID NO: 1427534 - RNA, 22 nt, Human
gccaaaaagugaaauaaugugu

SEQ ID NO: 1427535 - RNA, 13 nt, Human
gccaaaaauagcu

SEQ ID NO: 1427536 - RNA, 17 nt, Human
gccaaaaagugaaauaa

SEQ ID NO: 1427537 - RNA, 16 nt, Human
gccaaaaaaaaauaca

SEQ ID NO: 1427538 - RNA, 22 nt, Human
gcauuuguuucuuucucugagg

SEQ ID NO: 1427539 - RNA, 18 nt, Human
gcauuuuguuugguauug

SEQ ID NO: 1427540 - RNA, 21 nt, Human
gcauuuuguuugguauuguau

SEQ ID NO: 1427541 - RNA, 23 nt, Human
gcauuuuguuugguauuguauuu

SEQ ID NO: 1427542 - RNA, 18 nt, Human
gcauuuguuugaacugau

SEQ ID NO: 1427543 - RNA, 19 nt, Human
gcauugaacacaaacugua

SEQ ID NO: 1427544 - RNA, 18 nt, Human
gcauugaacacaaacugu

SEQ ID NO: 1427545 - RNA, 16 nt, Human
gcauugaacacaaacu

SEQ ID NO: 1427546 - RNA, 12 nt, Human
gcauugaacaca

SEQ ID NO: 1427547 - RNA, 16 nt, Human
gcauugaaaagagcug

SEQ ID NO: 1427548 - RNA, 20 nt, Human
gcauuuguuuauguaauuuc

SEQ ID NO: 1427549 - RNA, 19 nt, Human
gcauuuguuuauguaauuu

SEQ ID NO: 1427550 - RNA, 18 nt, Human
gcauuuguuuauguaauu

SEQ ID NO: 1427551 - RNA, 16 nt, Human
gcauuuguguugaaga

SEQ ID NO: 1427552 - RNA, 16 nt, Human
gcauuuguuugaacug

SEQ ID NO: 1427553 - RNA, 22 nt, Human
gcauuauuggaauauaauuguu

SEQ ID NO: 1427554 - RNA, 23 nt, Human
gcauuauuggaauauaauuguuu

SEQ ID NO: 1427555 - RNA, 19 nt, Human
gcauuaucuagauacugua

SEQ ID NO: 1427556 - RNA, 17 nt, Human
gcauuaucuagauacug

SEQ ID NO: 1427557 - RNA, 13 nt, Human
gcauucuucucug

SEQ ID NO: 1427558 - RNA, 14 nt, Human
gcauucuucucugu

SEQ ID NO: 1427559 - RNA, 19 nt, Human
gcauucuggaccucugggu

SEQ ID NO: 1427560 - RNA, 16 nt, Human
gcauucuggaccucug

SEQ ID NO: 1427561 - RNA, 20 nt, Human
gcauucugccucucuaggac

SEQ ID NO: 1427562 - RNA, 16 nt, Human
gcauucagaagaaaaa

SEQ ID NO: 1427563 - RNA, 18 nt, Human
gcauucagaagaaaaaga

SEQ ID NO: 1427564 - RNA, 19 nt, Human
gcauucaaauguauuacag

SEQ ID NO: 1427565 - RNA, 16 nt, Human
gcccccugucucucag

SEQ ID NO: 1427566 - RNA, 14 nt, Human
gcccccugucucuc

SEQ ID NO: 1427567 - RNA, 15 nt, Human
gcccccugcugccau

SEQ ID NO: 1427568 - RNA, 18 nt, Human
gcccccugccccccagcc

SEQ ID NO: 1427569 - RNA, 14 nt, Human
gcccccugcccccc

SEQ ID NO: 1427570 - RNA, 12 nt, Human
gcccccacccug

SEQ ID NO: 1427571 - RNA, 11 nt, Human
gcccccacccu

SEQ ID NO: 1427572 - RNA, 14 nt, Human
gcccccaccccauu

SEQ ID NO: 1427573 - RNA, 22 nt, Human
gcccccaaccauuuccucagac

SEQ ID NO: 1427574 - RNA, 21 nt, Human
gcccccaaccauuuccucaga

SEQ ID NO: 1427575 - RNA, 15 nt, Human
gccccauuccuggga

SEQ ID NO: 1427576 - RNA, 12 nt, Human
gccccauuccug

SEQ ID NO: 1427577 - RNA, 12 nt, Human
gccccaggccug

SEQ ID NO: 1427578 - RNA, 20 nt, Human
gccccagcacagcuugaccu

SEQ ID NO: 1427579 - RNA, 13 nt, Human
gccccagcacagc

SEQ ID NO: 1427580 - RNA, 19 nt, Human
gccccaggggaacacuggg

SEQ ID NO: 1427581 - RNA, 19 nt, Human
gccccaggcucguggacug

SEQ ID NO: 1427582 - RNA, 15 nt, Human
gccccaggccugaaa

SEQ ID NO: 1427583 - RNA, 18 nt, Human
gccccaggggaacacugg

SEQ ID NO: 1427584 - RNA, 14 nt, Human
gccccagugacagc

SEQ ID NO: 1427585 - RNA, 22 nt, Human
gccccaguuccuguggcucccu

SEQ ID NO: 1427586 - RNA, 15 nt, Human
gccccaucagcucca

SEQ ID NO: 1427587 - RNA, 16 nt, Human
gccccaucagcuccag

SEQ ID NO: 1427588 - RNA, 17 nt, Human
gccccaucagcuccagc

SEQ ID NO: 1427589 - RNA, 14 nt, Human
gccccaucagugcu

SEQ ID NO: 1427590 - RNA, 20 nt, Human
gccccacccugggcccuggg

SEQ ID NO: 1427591 - RNA, 19 nt, Human
gccccacccugggcccugg

SEQ ID NO: 1427592 - RNA, 16 nt, Human
gccccacccugggccc

SEQ ID NO: 1427593 - RNA, 15 nt, Human
gccccacccugggcc

SEQ ID NO: 1427594 - RNA, 12 nt, Human
gcccaucagggu

SEQ ID NO: 1427595 - RNA, 21 nt, Human
gcccaucaggguaggcuggag

SEQ ID NO: 1427596 - RNA, 14 nt, Human
gccccacccugggc

SEQ ID NO: 1427597 - RNA, 22 nt, Human
gcccauaugcuaccaccagcug

SEQ ID NO: 1427598 - RNA, 23 nt, Human
gcccauaugcuaccaccagcugu

SEQ ID NO: 1427599 - RNA, 21 nt, Human
gcccauaugcuaccaccagcu

SEQ ID NO: 1427600 - RNA, 20 nt, Human
gcccauaugcuaccaccagc

SEQ ID NO: 1427601 - RNA, 21 nt, Human
gcccagggcugggaggaagga

SEQ ID NO: 1427602 - RNA, 20 nt, Human
gcccagggcugggaggaagg

SEQ ID NO: 1427603 - RNA, 17 nt, Human
gcccagggcugggagga

SEQ ID NO: 1427604 - RNA, 13 nt, Human
gccccacuccucu

SEQ ID NO: 1427605 - RNA, 20 nt, Human
gccccacuccucugcugacc

SEQ ID NO: 1427606 - RNA, 12 nt, Human
gccccacuccuc

SEQ ID NO: 1427607 - RNA, 24 nt, Human
gccccacccugggcccugggcugg

SEQ ID NO: 1427608 - RNA, 23 nt, Human
gccccacccugggcccugggcug

SEQ ID NO: 1427609 - RNA, 22 nt, Human
gccccacccugggcccugggcu

SEQ ID NO: 1427610 - RNA, 17 nt, Human
gccccacuuguccuuag

SEQ ID NO: 1427611 - RNA, 18 nt, Human
gccccacuuguccuuagc

SEQ ID NO: 1427612 - RNA, 16 nt, Human
gccccacuuguccuua

SEQ ID NO: 1427613 - RNA, 14 nt, Human
gccccacuuguccu

SEQ ID NO: 1427614 - RNA, 15 nt, Human
gcccagggcugggag

SEQ ID NO: 1427615 - RNA, 18 nt, Human
gcccagggcuccugcacu

SEQ ID NO: 1427616 - RNA, 16 nt, Human
gcccagggcuccugca

SEQ ID NO: 1427617 - RNA, 15 nt, Human
gcccagggcuccugc

SEQ ID NO: 1427618 - RNA, 14 nt, Human
gcccagggcuccug

SEQ ID NO: 1427619 - RNA, 12 nt, Human
gcccagggcucc

SEQ ID NO: 1427620 - RNA, 21 nt, Human
gcccagggaggccgaagcuaa

SEQ ID NO: 1427621 - RNA, 13 nt, Human
gcccagggaggcc

SEQ ID NO: 1427622 - RNA, 12 nt, Human
gcccagggaggc

SEQ ID NO: 1427623 - RNA, 20 nt, Human
gcccaggcuggagugcagug

SEQ ID NO: 1427624 - RNA, 19 nt, Human
gcccaggcuggagugcagu

SEQ ID NO: 1427625 - RNA, 14 nt, Human
gcccaggccucacc

SEQ ID NO: 1427626 - RNA, 12 nt, Human
gcccaggccuca

SEQ ID NO: 1427627 - RNA, 13 nt, Human
gcccagagcccag

SEQ ID NO: 1427628 - RNA, 19 nt, Human
gcccgggagcucaggaacc

SEQ ID NO: 1427629 - RNA, 17 nt, Human
gcccgggagcucaggaa

SEQ ID NO: 1427630 - RNA, 15 nt, Human
gcccggcuccugguc

SEQ ID NO: 1427631 - RNA, 15 nt, Human
gcccgggagcucagg

SEQ ID NO: 1427632 - RNA, 22 nt, Human
gcccucauggccccucugaccu

SEQ ID NO: 1427633 - RNA, 19 nt, Human
gcccucauggccccucuga

SEQ ID NO: 1427634 - RNA, 14 nt, Human
gcccuccaggcuuu

SEQ ID NO: 1427635 - RNA, 18 nt, Human
gcccuccacaccugcggc

SEQ ID NO: 1427636 - RNA, 19 nt, Human
gcccuccacaccugcggcc

SEQ ID NO: 1427637 - RNA, 16 nt, Human
gcccuccacaccugcg

SEQ ID NO: 1427638 - RNA, 15 nt, Human
gcccuccacaccugc

SEQ ID NO: 1427639 - RNA, 14 nt, Human
gcccuccacaccug

SEQ ID NO: 1427640 - RNA, 13 nt, Human
gcccuccacaccu

SEQ ID NO: 1427641 - RNA, 17 nt, Human
gcccugcagacccugcc

SEQ ID NO: 1427642 - RNA, 16 nt, Human
gcccugcagacccugc

SEQ ID NO: 1427643 - RNA, 23 nt, Human
gcccugagccagggucuccagaa

SEQ ID NO: 1427644 - RNA, 22 nt, Human
gcccugagccagggucuccaga

SEQ ID NO: 1427645 - RNA, 21 nt, Human
gcccugagccagggucuccag

SEQ ID NO: 1427646 - RNA, 19 nt, Human
gcccugagccagggucucc

SEQ ID NO: 1427647 - RNA, 12 nt, Human
gcccugagccag

SEQ ID NO: 1427648 - RNA, 21 nt, Human
gcccucccuguuccccagaga

SEQ ID NO: 1427649 - RNA, 22 nt, Human
gcccucccuguuccccagagaa

SEQ ID NO: 1427650 - RNA, 23 nt, Human
gcccuccgccauucucaagcccu

SEQ ID NO: 1427651 - RNA, 20 nt, Human
gcccucccuguuccccagag

SEQ ID NO: 1427652 - RNA, 18 nt, Human
gcccucccuguuccccag

SEQ ID NO: 1427653 - RNA, 18 nt, Human
gccccucacccugccuua

SEQ ID NO: 1427654 - RNA, 17 nt, Human
gcccccugucucucagg

SEQ ID NO: 1427655 - RNA, 19 nt, Human
gccccucuggucgcuccug

SEQ ID NO: 1427656 - RNA, 18 nt, Human
gccccucuggucgcuccu

SEQ ID NO: 1427657 - RNA, 14 nt, Human
gccccucuggucgc

SEQ ID NO: 1427658 - RNA, 20 nt, Human
gccccucccucccagagcac

SEQ ID NO: 1427659 - RNA, 18 nt, Human
gccccucccucccagagc

SEQ ID NO: 1427660 - RNA, 16 nt, Human
gccccucccucccaga

SEQ ID NO: 1427661 - RNA, 16 nt, Human
gccccuccccuccaaa

SEQ ID NO: 1427662 - RNA, 17 nt, Human
gccccuccccuccaaaa

SEQ ID NO: 1427663 - RNA, 16 nt, Human
gccccucccccugcca

SEQ ID NO: 1427664 - RNA, 23 nt, Human
gccccuuucccuuguagcuccuc

SEQ ID NO: 1427665 - RNA, 21 nt, Human
gccccuuucccuuguagcucc

SEQ ID NO: 1427666 - RNA, 13 nt, Human
gccccuuuauaaa

SEQ ID NO: 1427667 - RNA, 12 nt, Human
gccccuuuauaa

SEQ ID NO: 1427668 - RNA, 15 nt, Human
gccccuuggacacgc

SEQ ID NO: 1427669 - RNA, 19 nt, Human
gccccuugacaacuggcag

SEQ ID NO: 1427670 - RNA, 23 nt, Human
gccccuucugcucagcucugggc

SEQ ID NO: 1427671 - RNA, 20 nt, Human
gccccuucugcucagcucug

SEQ ID NO: 1427672 - RNA, 19 nt, Human
gccccuucugcucagcucu

SEQ ID NO: 1427673 - RNA, 13 nt, Human
gcccgcacaccug

SEQ ID NO: 1427674 - RNA, 23 nt, Human
gcccgaggaggugucucaggcug

SEQ ID NO: 1427675 - RNA, 22 nt, Human
gcccgaggaggugucucaggcu

SEQ ID NO: 1427676 - RNA, 21 nt, Human
gcccgaggaggugucucaggc

SEQ ID NO: 1427677 - RNA, 20 nt, Human
gcccgaggaggugucucagg

SEQ ID NO: 1427678 - RNA, 19 nt, Human
gcccgaggaggugucucag

SEQ ID NO: 1427679 - RNA, 16 nt, Human
gccccugaacaagaau

SEQ ID NO: 1427680 - RNA, 23 nt, Human
gccccucuuggagaagucucagc

SEQ ID NO: 1427681 - RNA, 22 nt, Human
gccccucuuggagaagucucag

SEQ ID NO: 1427682 - RNA, 17 nt, Human
gccccucuuggagaagu

SEQ ID NO: 1427683 - RNA, 22 nt, Human
gccccucuggucgcuccugccc

SEQ ID NO: 1427684 - RNA, 20 nt, Human
gccccucuggucgcuccugc

SEQ ID NO: 1427685 - RNA, 15 nt, Human
gccccugggguggcc

SEQ ID NO: 1427686 - RNA, 22 nt, Human
gccccugagacaaauggaggcc

SEQ ID NO: 1427687 - RNA, 18 nt, Human
gccccuucugcucagcuc

SEQ ID NO: 1427688 - RNA, 17 nt, Human
gccccuucugcucagcu

SEQ ID NO: 1427689 - RNA, 15 nt, Human
gccccuucugcucag

SEQ ID NO: 1427690 - RNA, 14 nt, Human
gccccuucugcuca

SEQ ID NO: 1427691 - RNA, 21 nt, Human
gccccugggguggccaccagu

SEQ ID NO: 1427692 - RNA, 20 nt, Human
gccccuggucccucugcagu

SEQ ID NO: 1427693 - RNA, 13 nt, Human
gccaggcucucuu

SEQ ID NO: 1427694 - RNA, 15 nt, Human
gccaggcuaauuuuu

SEQ ID NO: 1427695 - RNA, 21 nt, Human
gccaggagcacggcucugucc

SEQ ID NO: 1427696 - RNA, 19 nt, Human
gccaggagcacggcucugu

SEQ ID NO: 1427697 - RNA, 18 nt, Human
gccaggagcacggcucug

SEQ ID NO: 1427698 - RNA, 22 nt, Human
gccaggagaagcucagcugcau

SEQ ID NO: 1427699 - RNA, 19 nt, Human
gccaggagaagcucagcug

SEQ ID NO: 1427700 - RNA, 17 nt, Human
gccaggagaagcucagc

SEQ ID NO: 1427701 - RNA, 15 nt, Human
gccaggagaagcuca

SEQ ID NO: 1427702 - RNA, 14 nt, Human
gccaggagaagcuc

SEQ ID NO: 1427703 - RNA, 13 nt, Human
gccaggagaagcu

SEQ ID NO: 1427704 - RNA, 12 nt, Human
gccaggagaagc

SEQ ID NO: 1427705 - RNA, 21 nt, Human
gccaggacucugcagccucag

SEQ ID NO: 1427706 - RNA, 20 nt, Human
gccaggacucugcagccuca

SEQ ID NO: 1427707 - RNA, 19 nt, Human
gccaggacucugcagccuc

SEQ ID NO: 1427708 - RNA, 18 nt, Human
gccaggacucugcagccu

SEQ ID NO: 1427709 - RNA, 17 nt, Human
gccaggacucugcagcc

SEQ ID NO: 1427710 - RNA, 16 nt, Human
gccaggacucugcagc

SEQ ID NO: 1427711 - RNA, 15 nt, Human
gccaggacucugcag

SEQ ID NO: 1427712 - RNA, 14 nt, Human
gccaggacucugca

SEQ ID NO: 1427713 - RNA, 13 nt, Human
gccaggacucugc

SEQ ID NO: 1427714 - RNA, 23 nt, Human
gccaggaccagucccagagcagg

SEQ ID NO: 1427715 - RNA, 22 nt, Human
gccaggaccagucaaccugggc

SEQ ID NO: 1427716 - RNA, 23 nt, Human
gccaggaauuucccaggacccug

SEQ ID NO: 1427717 - RNA, 22 nt, Human
gccaggaauuucccaggacccu

SEQ ID NO: 1427718 - RNA, 21 nt, Human
gccaggaauuucccaggaccc

SEQ ID NO: 1427719 - RNA, 20 nt, Human
gccaggaauuucccaggacc

SEQ ID NO: 1427720 - RNA, 19 nt, Human
gccaggaauuucccaggac

SEQ ID NO: 1427721 - RNA, 18 nt, Human
gccaggaauuucccagga

SEQ ID NO: 1427722 - RNA, 17 nt, Human
gccaggaauuucccagg

SEQ ID NO: 1427723 - RNA, 22 nt, Human
gccaggaagcuuuggugagaac

SEQ ID NO: 1427724 - RNA, 20 nt, Human
gccagcugcacugaugcugc

SEQ ID NO: 1427725 - RNA, 14 nt, Human
gccagcugcacuga

SEQ ID NO: 1427726 - RNA, 23 nt, Human
gccagcucuguucuuccucagcc

SEQ ID NO: 1427727 - RNA, 22 nt, Human
gccagcucuguucuuccucagc

SEQ ID NO: 1427728 - RNA, 21 nt, Human
gccagcucuguucuuccucag

SEQ ID NO: 1427729 - RNA, 18 nt, Human
gccagcucuguucuuccu

SEQ ID NO: 1427730 - RNA, 13 nt, Human
gccagcucuguuc

SEQ ID NO: 1427731 - RNA, 12 nt, Human
gccagcucuguu

SEQ ID NO: 1427732 - RNA, 23 nt, Human
gccagcucuguaucaggacccag

SEQ ID NO: 1427733 - RNA, 22 nt, Human
gccagccuggccuccugccucu

SEQ ID NO: 1427734 - RNA, 23 nt, Human
gccagccuggccuccugccucua

SEQ ID NO: 1427735 - RNA, 20 nt, Human
gccagccuggccuccugccu

SEQ ID NO: 1427736 - RNA, 19 nt, Human
gccagccuggccuccugcc

SEQ ID NO: 1427737 - RNA, 17 nt, Human
gccagccuggccuccug

SEQ ID NO: 1427738 - RNA, 16 nt, Human
gccagccuggccuccu

SEQ ID NO: 1427739 - RNA, 15 nt, Human
gccagccuggccucc

SEQ ID NO: 1427740 - RNA, 14 nt, Human
gccagccuggccuc

SEQ ID NO: 1427741 - RNA, 13 nt, Human
gccagccuggccu

SEQ ID NO: 1427742 - RNA, 12 nt, Human
gccagccuggcc

SEQ ID NO: 1427743 - RNA, 14 nt, Human
gccagccucgccca

SEQ ID NO: 1427744 - RNA, 23 nt, Human
gccagccggggcgaguggcacgu

SEQ ID NO: 1427745 - RNA, 20 nt, Human
gccagccgcgcaucagacug

SEQ ID NO: 1427746 - RNA, 19 nt, Human
gccagccgcgcaucagacu

SEQ ID NO: 1427747 - RNA, 24 nt, Human
gccagccgagcaggaggccuagga

SEQ ID NO: 1427748 - RNA, 21 nt, Human
gccagccgagcaggaggccua

SEQ ID NO: 1427749 - RNA, 22 nt, Human
gccagaggcucguugacuggcu

SEQ ID NO: 1427750 - RNA, 24 nt, Human
gccagaggcccccagcccagggcu

SEQ ID NO: 1427751 - RNA, 23 nt, Human
gccagaggcccccagcccagggc

SEQ ID NO: 1427752 - RNA, 20 nt, Human
gccagaggcccccagcccag

SEQ ID NO: 1427753 - RNA, 19 nt, Human
gccagaggcccccagccca

SEQ ID NO: 1427754 - RNA, 18 nt, Human
gccagaggcccccagccc

SEQ ID NO: 1427755 - RNA, 16 nt, Human
gccagaggcccccagc

SEQ ID NO: 1427756 - RNA, 15 nt, Human
gccagaggcccccag

SEQ ID NO: 1427757 - RNA, 14 nt, Human
gccagaggccccca

SEQ ID NO: 1427758 - RNA, 22 nt, Human
gccagagauccaaaagaagccc

SEQ ID NO: 1427759 - RNA, 21 nt, Human
gccagagauccaaaagaagcc

SEQ ID NO: 1427760 - RNA, 20 nt, Human
gccagagauccaaaagaagc

SEQ ID NO: 1427761 - RNA, 16 nt, Human
gccagagauccaaaag

SEQ ID NO: 1427762 - RNA, 13 nt, Human
gccagagauccaa

SEQ ID NO: 1427763 - RNA, 22 nt, Human
gccagaugcacaucccuggaag

SEQ ID NO: 1427764 - RNA, 21 nt, Human
gccagaugcacaucccuggaa

SEQ ID NO: 1427765 - RNA, 20 nt, Human
gccagauccagccugggguc

SEQ ID NO: 1427766 - RNA, 17 nt, Human
gccagauccagccuggg

SEQ ID NO: 1427767 - RNA, 16 nt, Human
gccagauccagccugg

SEQ ID NO: 1427768 - RNA, 15 nt, Human
gccagauccagccug

SEQ ID NO: 1427769 - RNA, 13 nt, Human
gccagaggcuggg

SEQ ID NO: 1427770 - RNA, 12 nt, Human
gccagaggcugg

SEQ ID NO: 1427771 - RNA, 21 nt, Human
gccacuccucugacucagggc

SEQ ID NO: 1427772 - RNA, 17 nt, Human
gccacuccucugacuca

SEQ ID NO: 1427773 - RNA, 15 nt, Human
gccacuccucugacu

SEQ ID NO: 1427774 - RNA, 14 nt, Human
gccacuccucugac

SEQ ID NO: 1427775 - RNA, 13 nt, Human
gccacuccucuga

SEQ ID NO: 1427776 - RNA, 21 nt, Human
gccacuccgagaggugggcca

SEQ ID NO: 1427777 - RNA, 20 nt, Human
gccaacacgcaccugccuca

SEQ ID NO: 1427778 - RNA, 17 nt, Human
gccaacacgcaccugcc

SEQ ID NO: 1427779 - RNA, 21 nt, Human
gccaaauuuaaaacuguugga

SEQ ID NO: 1427780 - RNA, 23 nt, Human
gccaacacgcaccugccucagga

SEQ ID NO: 1427781 - RNA, 21 nt, Human
gccaacacgcaccugccucag

SEQ ID NO: 1427782 - RNA, 16 nt, Human
gcccagaauaaguuau

SEQ ID NO: 1427783 - RNA, 23 nt, Human
gcccagaauaaguuauugcaguu

SEQ ID NO: 1427784 - RNA, 20 nt, Human
gcccagaauaaguuauugca

SEQ ID NO: 1427785 - RNA, 22 nt, Human
gcccaccccacccacuucugca

SEQ ID NO: 1427786 - RNA, 21 nt, Human
gcccaccccacccacuucugc

SEQ ID NO: 1427787 - RNA, 16 nt, Human
gcccaccccacccacu

SEQ ID NO: 1427788 - RNA, 14 nt, Human
gcccaaggcucccg

SEQ ID NO: 1427789 - RNA, 15 nt, Human
gcccaaggcucccgg

SEQ ID NO: 1427790 - RNA, 23 nt, Human
gcccaagccagaggcuggguuca

SEQ ID NO: 1427791 - RNA, 21 nt, Human
gcccaagccagaggcuggguu

SEQ ID NO: 1427792 - RNA, 18 nt, Human
gcccaagccagaggcugg

SEQ ID NO: 1427793 - RNA, 17 nt, Human
gcccaagccagaggcug

SEQ ID NO: 1427794 - RNA, 16 nt, Human
gcccaagccagaggcu

SEQ ID NO: 1427795 - RNA, 15 nt, Human
gcccaagccagaggc

SEQ ID NO: 1427796 - RNA, 21 nt, Human
gcccaccauuuggcaucccug

SEQ ID NO: 1427797 - RNA, 15 nt, Human
gcccacauuggaaga

SEQ ID NO: 1427798 - RNA, 16 nt, Human
gcccacagugucaggc

SEQ ID NO: 1427799 - RNA, 21 nt, Human
gccaugcuccucuuccccaga

SEQ ID NO: 1427800 - RNA, 20 nt, Human
gccaugcuccucuuccccag

SEQ ID NO: 1427801 - RNA, 18 nt, Human
gccaugcuccucuucccc

SEQ ID NO: 1427802 - RNA, 16 nt, Human
gccaugcuccucuucc

SEQ ID NO: 1427803 - RNA, 21 nt, Human
gccaguccaggcugccguggg

SEQ ID NO: 1427804 - RNA, 20 nt, Human
gccaguccaggcugccgugg

SEQ ID NO: 1427805 - RNA, 14 nt, Human
gccaguccaggcug

SEQ ID NO: 1427806 - RNA, 13 nt, Human
gccaguccaggcu

SEQ ID NO: 1427807 - RNA, 14 nt, Human
gccaguauuuuaaa

SEQ ID NO: 1427808 - RNA, 16 nt, Human
gccaguaacaggcuca

SEQ ID NO: 1427809 - RNA, 22 nt, Human
gccaguaacgcgucuuccugag

SEQ ID NO: 1427810 - RNA, 21 nt, Human
gccaguaacgcgucuuccuga

SEQ ID NO: 1427811 - RNA, 20 nt, Human
gccaguaacgcgucuuccug

SEQ ID NO: 1427812 - RNA, 12 nt, Human
gccaguauuuua

SEQ ID NO: 1427813 - RNA, 23 nt, Human
gccaucaucuccugccuuccucc

SEQ ID NO: 1427814 - RNA, 23 nt, Human
gccaucaccucagauggcagcuu

SEQ ID NO: 1427815 - RNA, 19 nt, Human
gccaucaccucagauggca

SEQ ID NO: 1427816 - RNA, 15 nt, Human
gccaucaccucagau

SEQ ID NO: 1427817 - RNA, 14 nt, Human
gccaucaccucaga

SEQ ID NO: 1427818 - RNA, 12 nt, Human
gccagucaggcc

SEQ ID NO: 1427819 - RNA, 19 nt, Human
gccaguaacgcgucuuccu

SEQ ID NO: 1427820 - RNA, 15 nt, Human
gccaguaacaggcuc

SEQ ID NO: 1427821 - RNA, 23 nt, Human
gccaguaaaugggggugcauuug

SEQ ID NO: 1427822 - RNA, 17 nt, Human
gccaggcuggucuaaaa

SEQ ID NO: 1427823 - RNA, 20 nt, Human
gccaggcugaccacagcaca

SEQ ID NO: 1427824 - RNA, 19 nt, Human
gccaggcugaccacagcac

SEQ ID NO: 1427825 - RNA, 18 nt, Human
gccaggcugaccacagca

SEQ ID NO: 1427826 - RNA, 23 nt, Human
gccaggcugggucgcccuggacu

SEQ ID NO: 1427827 - RNA, 17 nt, Human
gccaggcugaccacagc

SEQ ID NO: 1427828 - RNA, 16 nt, Human
gccaggcugaccacag

SEQ ID NO: 1427829 - RNA, 15 nt, Human
gccaggcugaccaca

SEQ ID NO: 1427830 - RNA, 17 nt, Human
gccaggcugggucgccc

SEQ ID NO: 1427831 - RNA, 21 nt, Human
gccaucugggcuccuccaggg

SEQ ID NO: 1427832 - RNA, 16 nt, Human
gccaucugcuccugga

SEQ ID NO: 1427833 - RNA, 23 nt, Human
gccaugauggcaacagaucugga

SEQ ID NO: 1427834 - RNA, 21 nt, Human
gccaugauggcaacagaucug

SEQ ID NO: 1427835 - RNA, 19 nt, Human
gccaugauggcaacagauc

SEQ ID NO: 1427836 - RNA, 17 nt, Human
gccaugauggcaacaga

SEQ ID NO: 1427837 - RNA, 19 nt, Human
gccaugaugccucugucuu

SEQ ID NO: 1427838 - RNA, 15 nt, Human
gccaugaugccucug

SEQ ID NO: 1427839 - RNA, 13 nt, Human
gccaugaugccuc

SEQ ID NO: 1427840 - RNA, 20 nt, Human
gccaugaguuccagaaagua

SEQ ID NO: 1427841 - RNA, 18 nt, Human
gccaugacccugccucuc

SEQ ID NO: 1427842 - RNA, 17 nt, Human
gccaugacccugccucu

SEQ ID NO: 1427843 - RNA, 16 nt, Human
gccaugacccugccuc

SEQ ID NO: 1427844 - RNA, 21 nt, Human
gccaugacccugccucuccca

SEQ ID NO: 1427845 - RNA, 14 nt, Human
gccaugacccugcc

SEQ ID NO: 1427846 - RNA, 23 nt, Human
gccaugacaacuucuaauugcca

SEQ ID NO: 1427847 - RNA, 19 nt, Human
gccaugacaacuucuaauu

SEQ ID NO: 1427848 - RNA, 12 nt, Human
gccaucugcucc

SEQ ID NO: 1427849 - RNA, 20 nt, Human
gccaugcgcccccuccgccc

SEQ ID NO: 1427850 - RNA, 18 nt, Human
gccaugaugccucugucu

SEQ ID NO: 1427851 - RNA, 24 nt, Human
gccgacccccucucccugcauggc

SEQ ID NO: 1427852 - RNA, 19 nt, Human
gccggcuucaugccagcua

SEQ ID NO: 1427853 - RNA, 13 nt, Human
gccggcuccuugg

SEQ ID NO: 1427854 - RNA, 20 nt, Human
gccgggaccacccugagccg

SEQ ID NO: 1427855 - RNA, 18 nt, Human
gccgggaccacccugagc

SEQ ID NO: 1427856 - RNA, 22 nt, Human
gccggggaacuggccaagcuga

SEQ ID NO: 1427857 - RNA, 20 nt, Human
gccggggaacuggccaagcu

SEQ ID NO: 1427858 - RNA, 17 nt, Human
gccggggaacuggccaa

SEQ ID NO: 1427859 - RNA, 16 nt, Human
gccggggaacuggcca

SEQ ID NO: 1427860 - RNA, 22 nt, Human
gccgggaccacccugagccggc

SEQ ID NO: 1427861 - RNA, 23 nt, Human
gccgacccccucucccugcaugg

SEQ ID NO: 1427862 - RNA, 20 nt, Human
gccgacccccucucccugca

SEQ ID NO: 1427863 - RNA, 19 nt, Human
gccgaagcuaacagggaag

SEQ ID NO: 1427864 - RNA, 15 nt, Human
gccgaagcuaacagg

SEQ ID NO: 1427865 - RNA, 14 nt, Human
gccgaagcuaacag

SEQ ID NO: 1427866 - RNA, 21 nt, Human
gcccuuguuuggggcaggagu

SEQ ID NO: 1427867 - RNA, 20 nt, Human
gcccuuguuuggggcaggag

SEQ ID NO: 1427868 - RNA, 19 nt, Human
gcccuuguuuggggcagga

SEQ ID NO: 1427869 - RNA, 18 nt, Human
gcccuuguuuggggcagg

SEQ ID NO: 1427870 - RNA, 17 nt, Human
gcccuuguuuggggcag

SEQ ID NO: 1427871 - RNA, 23 nt, Human
gcccuugugaaucaagggucagg

SEQ ID NO: 1427872 - RNA, 21 nt, Human
gcccuuggggguccuccucca

SEQ ID NO: 1427873 - RNA, 22 nt, Human
gcccuuggggguccuccuccag

SEQ ID NO: 1427874 - RNA, 20 nt, Human
gcccuuggggguccuccucc

SEQ ID NO: 1427875 - RNA, 18 nt, Human
gcccuugcuuaccucuca

SEQ ID NO: 1427876 - RNA, 22 nt, Human
gcccugcuuccugcuugccaag

SEQ ID NO: 1427877 - RNA, 19 nt, Human
gcccugcuuccugcuugcc

SEQ ID NO: 1427878 - RNA, 16 nt, Human
gcccugcuuccugcuu

SEQ ID NO: 1427879 - RNA, 15 nt, Human
gcccugcuuccugcu

SEQ ID NO: 1427880 - RNA, 20 nt, Human
gcccugcagacccugcccuu

SEQ ID NO: 1427881 - RNA, 19 nt, Human
gcccugcagacccugcccu

SEQ ID NO: 1427882 - RNA, 18 nt, Human
gcccugcagacccugccc

SEQ ID NO: 1427883 - RNA, 17 nt, Human
gccgucagugcugugcu

SEQ ID NO: 1427884 - RNA, 14 nt, Human
gccguaauuuaacu

SEQ ID NO: 1427885 - RNA, 13 nt, Human
gccguaauuuaac

SEQ ID NO: 1427886 - RNA, 21 nt, Human
gccggucgcccuuugcugcau

SEQ ID NO: 1427887 - RNA, 24 nt, Human
gccggucgcccuuugcugcauggc

SEQ ID NO: 1427888 - RNA, 23 nt, Human
gccguccuaaccucgggccugcu

SEQ ID NO: 1427889 - RNA, 20 nt, Human
gccguccccuagagucccag

SEQ ID NO: 1427890 - RNA, 23 nt, Human
gccgugggccccacccucgggga

SEQ ID NO: 1427891 - RNA, 18 nt, Human
gccgugggccccacccuc

SEQ ID NO: 1427892 - RNA, 17 nt, Human
gccgugggccccacccu

SEQ ID NO: 1427893 - RNA, 23 nt, Human
gccgugggcaauugucugaaaag

SEQ ID NO: 1427894 - RNA, 20 nt, Human
gccgugcucgccccagcagg

SEQ ID NO: 1427895 - RNA, 23 nt, Human
gccguggggccgccgccucuuuc

SEQ ID NO: 1427896 - RNA, 20 nt, Human
gccguggggccgccgccucu

SEQ ID NO: 1427897 - RNA, 23 nt, Human
gccguggugauuuagcaggaagc

SEQ ID NO: 1427898 - RNA, 21 nt, Human
gccgugcucgccccagcaggu

SEQ ID NO: 1427899 - RNA, 17 nt, Human
gccgugcucgccccagc

SEQ ID NO: 1427900 - RNA, 22 nt, Human
gccucaagguuuuagguucuaa

SEQ ID NO: 1427901 - RNA, 21 nt, Human
gccucaagguuuuagguucua

SEQ ID NO: 1427902 - RNA, 20 nt, Human
gccucaagguuuuagguucu

SEQ ID NO: 1427903 - RNA, 21 nt, Human
gccuauuaucugucagcugca

SEQ ID NO: 1427904 - RNA, 22 nt, Human
gccuauggagagcccugggacc

SEQ ID NO: 1427905 - RNA, 21 nt, Human
gccuauggagagcccugggac

SEQ ID NO: 1427906 - RNA, 20 nt, Human
gccuauggagagcccuggga

SEQ ID NO: 1427907 - RNA, 19 nt, Human
gccuauggagagcccuggg

SEQ ID NO: 1427908 - RNA, 18 nt, Human
gccuauggagagcccugg

SEQ ID NO: 1427909 - RNA, 17 nt, Human
gccuauggagagcccug

SEQ ID NO: 1427910 - RNA, 16 nt, Human
gccuauggagagcccu

SEQ ID NO: 1427911 - RNA, 14 nt, Human
gccuauggagagcc

SEQ ID NO: 1427912 - RNA, 13 nt, Human
gccuauggagagc

SEQ ID NO: 1427913 - RNA, 15 nt, Human
gccuaaccgagauca

SEQ ID NO: 1427914 - RNA, 17 nt, Human
gccuaaccugccgagag

SEQ ID NO: 1427915 - RNA, 16 nt, Human
gccgugguccuuuggg

SEQ ID NO: 1427916 - RNA, 22 nt, Human
gccgugugugugcguccugucg

SEQ ID NO: 1427917 - RNA, 14 nt, Human
gccucucuacaguc

SEQ ID NO: 1427918 - RNA, 18 nt, Human
gccuccguccccugccca

SEQ ID NO: 1427919 - RNA, 24 nt, Human
gccucuccacucaugugacucuuu

SEQ ID NO: 1427920 - RNA, 21 nt, Human
gccucuccacucaugugacuc

SEQ ID NO: 1427921 - RNA, 23 nt, Human
gccucucuauccucucuuccucu

SEQ ID NO: 1427922 - RNA, 21 nt, Human
gccucucuauccucucuuccu

SEQ ID NO: 1427923 - RNA, 20 nt, Human
gccucucuauccucucuucc

SEQ ID NO: 1427924 - RNA, 17 nt, Human
gccucugaggccagccu

SEQ ID NO: 1427925 - RNA, 16 nt, Human
gccucugaggccagcc

SEQ ID NO: 1427926 - RNA, 15 nt, Human
gccucugaggccagc

SEQ ID NO: 1427927 - RNA, 14 nt, Human
gccucugaggccag

SEQ ID NO: 1427928 - RNA, 13 nt, Human
gccucugaggcca

SEQ ID NO: 1427929 - RNA, 12 nt, Human
gccucugaggcc

SEQ ID NO: 1427930 - RNA, 21 nt, Human
gccucugaggccagccuggcc

SEQ ID NO: 1427931 - RNA, 20 nt, Human
gccucugaggccagccuggc

SEQ ID NO: 1427932 - RNA, 19 nt, Human
gccucugaggccagccugg

SEQ ID NO: 1427933 - RNA, 18 nt, Human
gccucugaggccagccug

SEQ ID NO: 1427934 - RNA, 21 nt, Human
gccugaggucaggaguucaag

SEQ ID NO: 1427935 - RNA, 20 nt, Human
gccugagggaaaggccagca

SEQ ID NO: 1427936 - RNA, 18 nt, Human
gccugagggaaaggccag

SEQ ID NO: 1427937 - RNA, 16 nt, Human
gccugagguuacugga

SEQ ID NO: 1427938 - RNA, 13 nt, Human
gccugagucaccu

SEQ ID NO: 1427939 - RNA, 21 nt, Human
gccugaguagaaaggccuuua

SEQ ID NO: 1427940 - RNA, 13 nt, Human
gccugaguacucc

SEQ ID NO: 1427941 - RNA, 16 nt, Human
gccugaguagaaaggc

SEQ ID NO: 1427942 - RNA, 19 nt, Human
gccugacuagggagccaug

SEQ ID NO: 1427943 - RNA, 20 nt, Human
gccugacuagggagccaugu

SEQ ID NO: 1427944 - RNA, 21 nt, Human
gccucugcccaggcacugcua

SEQ ID NO: 1427945 - RNA, 23 nt, Human
gccucugccaaaggaugugauau

SEQ ID NO: 1427946 - RNA, 22 nt, Human
gccucugaggccagccuggccu

SEQ ID NO: 1427947 - RNA, 23 nt, Human
gccucugaggccagccuggccuc

SEQ ID NO: 1427948 - RNA, 15 nt, Human
gccucccaaaugagc

SEQ ID NO: 1427949 - RNA, 18 nt, Human
gccucagauuccuuccca

SEQ ID NO: 1427950 - RNA, 16 nt, Human
gccucagauuccuucc

SEQ ID NO: 1427951 - RNA, 22 nt, Human
gccucagauuccuucccaugga

SEQ ID NO: 1427952 - RNA, 15 nt, Human
gccucagauuccuuc

SEQ ID NO: 1427953 - RNA, 18 nt, Human
gccucagagaccagggcu

SEQ ID NO: 1427954 - RNA, 17 nt, Human
gccucagagaccagggc

SEQ ID NO: 1427955 - RNA, 15 nt, Human
gccucagagaccagg

SEQ ID NO: 1427956 - RNA, 12 nt, Human
gccucagagacc

SEQ ID NO: 1427957 - RNA, 14 nt, Human
gccucccagguuca

SEQ ID NO: 1427958 - RNA, 19 nt, Human
gccuccucacccccagcuu

SEQ ID NO: 1427959 - RNA, 18 nt, Human
gccuccucacccccagcu

SEQ ID NO: 1427960 - RNA, 17 nt, Human
gccuccucacccccagc

SEQ ID NO: 1427961 - RNA, 16 nt, Human
gccuccucacccccag

SEQ ID NO: 1427962 - RNA, 14 nt, Human
gccuccucaccccc

SEQ ID NO: 1427963 - RNA, 16 nt, Human
gccucucaucaacuga

SEQ ID NO: 1427964 - RNA, 21 nt, Human
gccuccucacccccagcuuug

SEQ ID NO: 1427965 - RNA, 19 nt, Human
gccucucaucaacugaaug

SEQ ID NO: 1427966 - RNA, 18 nt, Human
gccucucaucaacugaau

SEQ ID NO: 1427967 - RNA, 15 nt, Human
gccucccuucaugca

SEQ ID NO: 1427968 - RNA, 18 nt, Human
gccucccuucaugcaugg

SEQ ID NO: 1427969 - RNA, 20 nt, Human
gccucccuucaugcauggaa

SEQ ID NO: 1427970 - RNA, 22 nt, Human
gccucccuucaugcauggaaau

SEQ ID NO: 1427971 - RNA, 14 nt, Human
gccucccuuguggc

SEQ ID NO: 1427972 - RNA, 23 nt, Human
gccucccuucaugcauggaaauu

SEQ ID NO: 1427973 - RNA, 15 nt, Human
gccugccaccuggac

SEQ ID NO: 1427974 - RNA, 14 nt, Human
gccugccaccugga

SEQ ID NO: 1427975 - RNA, 13 nt, Human
gccugccaccugg

SEQ ID NO: 1427976 - RNA, 12 nt, Human
gccugccaccug

SEQ ID NO: 1427977 - RNA, 21 nt, Human
gccugccaccuccccccacaa

SEQ ID NO: 1427978 - RNA, 17 nt, Human
gccugagggaaaggcca

SEQ ID NO: 1427979 - RNA, 13 nt, Human
gccugccaccucc

SEQ ID NO: 1427980 - RNA, 23 nt, Human
gccugcaaacugggaaccccuuu

SEQ ID NO: 1427981 - RNA, 17 nt, Human
gccugcaaacugggaac

SEQ ID NO: 1427982 - RNA, 16 nt, Human
gccugcaaacugggaa

SEQ ID NO: 1427983 - RNA, 14 nt, Human
gccugcaaacuggg

SEQ ID NO: 1427984 - RNA, 13 nt, Human
gccugcaaacugg

SEQ ID NO: 1427985 - RNA, 22 nt, Human
gccugccaccuggaccccugca

SEQ ID NO: 1427986 - RNA, 18 nt, Human
gccugccaccuggacccc

SEQ ID NO: 1427987 - RNA, 17 nt, Human
gccugccaccuggaccc

SEQ ID NO: 1427988 - RNA, 16 nt, Human
gccugccaccuggacc

SEQ ID NO: 1427989 - RNA, 15 nt, Human
gccugccagcugcac

SEQ ID NO: 1427990 - RNA, 14 nt, Human
gccugccagcugca

SEQ ID NO: 1427991 - RNA, 23 nt, Human
gccugccaggaggacccagggcu

SEQ ID NO: 1427992 - RNA, 21 nt, Human
gccugccaggaggacccaggg

SEQ ID NO: 1427993 - RNA, 20 nt, Human
gccugccaggaggacccagg

SEQ ID NO: 1427994 - RNA, 18 nt, Human
gccugccaggaggaccca

SEQ ID NO: 1427995 - RNA, 14 nt, Human
gccugccaggagga

SEQ ID NO: 1427996 - RNA, 13 nt, Human
gccugccaggagg

SEQ ID NO: 1427997 - RNA, 12 nt, Human
gccugccaggag

SEQ ID NO: 1427998 - RNA, 11 nt, Human
gccugccagga

SEQ ID NO: 1427999 - RNA, 23 nt, Human
gccugccaccuggaccccugcau

SEQ ID NO: 1428000 - RNA, 18 nt, Human
gccugccagcugcacuga

SEQ ID NO: 1428001 - RNA, 21 nt, Human
gccugggggugccaggaccag

SEQ ID NO: 1428002 - RNA, 17 nt, Human
gccugggggugccagga

SEQ ID NO: 1428003 - RNA, 16 nt, Human
gccugggggugccagg

SEQ ID NO: 1428004 - RNA, 20 nt, Human
gccuggugcccagcacaugu

SEQ ID NO: 1428005 - RNA, 19 nt, Human
gccuggggugacccggcac

SEQ ID NO: 1428006 - RNA, 22 nt, Human
gccuggggugacccggcacccc

SEQ ID NO: 1428007 - RNA, 18 nt, Human
gccuggggugacccggca

SEQ ID NO: 1428008 - RNA, 14 nt, Human
gccuggggucugga

SEQ ID NO: 1428009 - RNA, 22 nt, Human
gccuggucucacccuggaggca

SEQ ID NO: 1428010 - RNA, 20 nt, Human
gccuggucucacccuggagg

SEQ ID NO: 1428011 - RNA, 19 nt, Human
gccuggucucacccuggag

SEQ ID NO: 1428012 - RNA, 18 nt, Human
gccuggucucacccugga

SEQ ID NO: 1428013 - RNA, 22 nt, Human
gccuuaucuugcaccccaaagc

SEQ ID NO: 1428014 - RNA, 19 nt, Human
gccuuacccucauguucuu

SEQ ID NO: 1428015 - RNA, 12 nt, Human
gccuguuuaaga

SEQ ID NO: 1428016 - RNA, 21 nt, Human
gccuguuuggccucucuaucc

SEQ ID NO: 1428017 - RNA, 16 nt, Human
gccuguuuggccucuc

SEQ ID NO: 1428018 - RNA, 14 nt, Human
gccuguuuggccuc

SEQ ID NO: 1428019 - RNA, 19 nt, Human
gccuguuucccaggcccac

SEQ ID NO: 1428020 - RNA, 13 nt, Human
gccuguuuaagag

SEQ ID NO: 1428021 - RNA, 18 nt, Human
gccuuacccucauguucu

SEQ ID NO: 1428022 - RNA, 11 nt, Human
gccuugcuugu

SEQ ID NO: 1428023 - RNA, 13 nt, Human
gccuugcuuguua

SEQ ID NO: 1428024 - RNA, 19 nt, Human
gccuuccuguuuuucacau

SEQ ID NO: 1428025 - RNA, 21 nt, Human
gccuucauaucauccacacau

SEQ ID NO: 1428026 - RNA, 18 nt, Human
gccuucauaucauccaca

SEQ ID NO: 1428027 - RNA, 17 nt, Human
gccuuccacccaggggc

SEQ ID NO: 1428028 - RNA, 14 nt, Human
gccuuccacccagg

SEQ ID NO: 1428029 - RNA, 12 nt, Human
gccuuccaccca

SEQ ID NO: 1428030 - RNA, 16 nt, Human
gccuucauucugcaag

SEQ ID NO: 1428031 - RNA, 23 nt, Human
gccuuuuuuccccagacuuguug

SEQ ID NO: 1428032 - RNA, 20 nt, Human
gccuuuuuuccccagacuug

SEQ ID NO: 1428033 - RNA, 19 nt, Human
gccuuuuuuccccagacuu

SEQ ID NO: 1428034 - RNA, 17 nt, Human
gccuuuuuuccccagac

SEQ ID NO: 1428035 - RNA, 16 nt, Human
gccuuuuuuccccaga

SEQ ID NO: 1428036 - RNA, 15 nt, Human
gccuuuuuuccccag

SEQ ID NO: 1428037 - RNA, 14 nt, Human
gccuuuuuucccca

SEQ ID NO: 1428038 - RNA, 13 nt, Human
gccuuuuuucccc

SEQ ID NO: 1428039 - RNA, 17 nt, Human
gccuuuuuguuucaaug

SEQ ID NO: 1428040 - RNA, 22 nt, Human
gccuuuuucauuuaucuauaau

SEQ ID NO: 1428041 - RNA, 22 nt, Human
gcgaaaaaaucagguggcuuuu

SEQ ID NO: 1428042 - RNA, 23 nt, Human
gccuuuuuucuguauaaaugucu

SEQ ID NO: 1428043 - RNA, 15 nt, Human
gccuuuuuucuguau

SEQ ID NO: 1428044 - RNA, 19 nt, Human
gccuuuuucauuuaucuau

SEQ ID NO: 1428045 - RNA, 18 nt, Human
gccuuuuucauuuaucua

SEQ ID NO: 1428046 - RNA, 17 nt, Human
gccuuuuucauuuaucu

SEQ ID NO: 1428047 - RNA, 15 nt, Human
gccuuuuucauuuau

SEQ ID NO: 1428048 - RNA, 14 nt, Human
gccuuuuucauuua

SEQ ID NO: 1428049 - RNA, 13 nt, Human
gccuuuggcaggu

SEQ ID NO: 1428050 - RNA, 16 nt, Human
gccuuuggcagaguuc

SEQ ID NO: 1428051 - RNA, 15 nt, Human
gccuuuggcaggugc

SEQ ID NO: 1428052 - RNA, 15 nt, Human
gccuuugcgcuccug

SEQ ID NO: 1428053 - RNA, 15 nt, Human
gccuuugccagguga

SEQ ID NO: 1428054 - RNA, 16 nt, Human
gccuuugccaggugac

SEQ ID NO: 1428055 - RNA, 14 nt, Human
gccuuugccaggug

SEQ ID NO: 1428056 - RNA, 14 nt, Human
gccuuugagcucag

SEQ ID NO: 1428057 - RNA, 21 nt, Human
gccuuugcgcuccuggcccag

SEQ ID NO: 1428058 - RNA, 19 nt, Human
gccuuugcgcuccuggccc

SEQ ID NO: 1428059 - RNA, 18 nt, Human
gccuuugcgcuccuggcc

SEQ ID NO: 1428060 - RNA, 16 nt, Human
gccuuugcgcuccugg

SEQ ID NO: 1428061 - RNA, 23 nt, Human
gccuuugcgcuccuggcccagcc

SEQ ID NO: 1428062 - RNA, 18 nt, Human
gccuuuggacuugucccg

SEQ ID NO: 1428063 - RNA, 23 nt, Human
gccuuggccuguguucuuccugg

SEQ ID NO: 1428064 - RNA, 16 nt, Human
gccuuggccuggagca

SEQ ID NO: 1428065 - RNA, 15 nt, Human
gccuuggccuggagc

SEQ ID NO: 1428066 - RNA, 14 nt, Human
gccuuggccuggag

SEQ ID NO: 1428067 - RNA, 13 nt, Human
gccuuggccugga

SEQ ID NO: 1428068 - RNA, 12 nt, Human
gccuuggccugg

SEQ ID NO: 1428069 - RNA, 11 nt, Human
gccuuggccug

SEQ ID NO: 1428070 - RNA, 15 nt, Human
gccuuggccucccaa

SEQ ID NO: 1428071 - RNA, 15 nt, Human
gccuuggccuguguu

SEQ ID NO: 1428072 - RNA, 16 nt, Human
gccuuugaccugccuc

SEQ ID NO: 1428073 - RNA, 22 nt, Human
gcuaccuguguggacaggacua

SEQ ID NO: 1428074 - RNA, 17 nt, Human
gcuaccuguguggacag

SEQ ID NO: 1428075 - RNA, 14 nt, Human
gcuaccugugugga

SEQ ID NO: 1428076 - RNA, 20 nt, Human
gcuaccugcucagcccugca

SEQ ID NO: 1428077 - RNA, 19 nt, Human
gcuaccugcucagcccugc

SEQ ID NO: 1428078 - RNA, 20 nt, Human
gcuaccuguguggacaggac

SEQ ID NO: 1428079 - RNA, 19 nt, Human
gcuaccuguguggacagga

SEQ ID NO: 1428080 - RNA, 18 nt, Human
gcuaccuguguggacagg

SEQ ID NO: 1428081 - RNA, 16 nt, Human
gcuaccuuuguauucu

SEQ ID NO: 1428082 - RNA, 20 nt, Human
gcuaccuuuguauucucucc

SEQ ID NO: 1428083 - RNA, 21 nt, Human
gcuauagaugucuuuucccau

SEQ ID NO: 1428084 - RNA, 20 nt, Human
gcuauagaugucuuuuccca

SEQ ID NO: 1428085 - RNA, 16 nt, Human
gcuauagaugucuuuu

SEQ ID NO: 1428086 - RNA, 16 nt, Human
gcuagacacaugaagg

SEQ ID NO: 1428087 - RNA, 21 nt, Human
gcuagaauugaguguuuaaag

SEQ ID NO: 1428088 - RNA, 19 nt, Human
gcuacagcaauuucuaauu

SEQ ID NO: 1428089 - RNA, 17 nt, Human
gcuacagcaauuucuaa

SEQ ID NO: 1428090 - RNA, 18 nt, Human
gcuacagagaagccuuca

SEQ ID NO: 1428091 - RNA, 23 nt, Human
gcuacagagaagccuucaagcuc

SEQ ID NO: 1428092 - RNA, 17 nt, Human
gcuacagagaagccuuc

SEQ ID NO: 1428093 - RNA, 16 nt, Human
gcuacagagaagccuu

SEQ ID NO: 1428094 - RNA, 15 nt, Human
gcuacagagaagccu

SEQ ID NO: 1428095 - RNA, 14 nt, Human
gcuacagagaagcc

SEQ ID NO: 1428096 - RNA, 16 nt, Human
gcuacacagaucacag

SEQ ID NO: 1428097 - RNA, 14 nt, Human
gcuaagagaaguag

SEQ ID NO: 1428098 - RNA, 13 nt, Human
gcuaagagaagua

SEQ ID NO: 1428099 - RNA, 13 nt, Human
gcuacacacugca

SEQ ID NO: 1428100 - RNA, 20 nt, Human
gcuacacacugcauguuugu

SEQ ID NO: 1428101 - RNA, 19 nt, Human
gcuaaagcaauaugcauuu

SEQ ID NO: 1428102 - RNA, 17 nt, Human
gcuaaagcaauaugcau

SEQ ID NO: 1428103 - RNA, 15 nt, Human
gcuaaagacaugaag

SEQ ID NO: 1428104 - RNA, 15 nt, Human
gcuaaagcccagaga

SEQ ID NO: 1428105 - RNA, 21 nt, Human
gcgucuggaaguccaaugugg

SEQ ID NO: 1428106 - RNA, 16 nt, Human
gcgucuacccugggau

SEQ ID NO: 1428107 - RNA, 12 nt, Human
gcgguucaggaa

SEQ ID NO: 1428108 - RNA, 22 nt, Human
gcgguuauaaaaaaugguucag

SEQ ID NO: 1428109 - RNA, 23 nt, Human
gcgguuaugaaauucacccccuu

SEQ ID NO: 1428110 - RNA, 19 nt, Human
gcgguuauaaaaaaugguu

SEQ ID NO: 1428111 - RNA, 18 nt, Human
gcgguuauaaaaaauggu

SEQ ID NO: 1428112 - RNA, 21 nt, Human
gcggugucucuccugccccuu

SEQ ID NO: 1428113 - RNA, 14 nt, Human
gcggugggccuggu

SEQ ID NO: 1428114 - RNA, 20 nt, Human
gcggugggaccuagggaggc

SEQ ID NO: 1428115 - RNA, 17 nt, Human
gcggugcuugauagaaa

SEQ ID NO: 1428116 - RNA, 22 nt, Human
gcgggugaacaaagcagccacg

SEQ ID NO: 1428117 - RNA, 21 nt, Human
gcgggugaacaaagcagccac

SEQ ID NO: 1428118 - RNA, 17 nt, Human
gcgggucugcucccaag

SEQ ID NO: 1428119 - RNA, 15 nt, Human
gcgggucugcuccca

SEQ ID NO: 1428120 - RNA, 23 nt, Human
gcguaaguacagagaagccauca

SEQ ID NO: 1428121 - RNA, 21 nt, Human
gcguaaguacagagaagccau

SEQ ID NO: 1428122 - RNA, 20 nt, Human
gcguaaguacagagaagcca

SEQ ID NO: 1428123 - RNA, 19 nt, Human
gcguaaguacagagaagcc

SEQ ID NO: 1428124 - RNA, 18 nt, Human
gcguaaguacagagaagc

SEQ ID NO: 1428125 - RNA, 17 nt, Human
gcguaaguacagagaag

SEQ ID NO: 1428126 - RNA, 16 nt, Human
gcguaaguacagagaa

SEQ ID NO: 1428127 - RNA, 15 nt, Human
gcguaaguacagaga

SEQ ID NO: 1428128 - RNA, 14 nt, Human
gcguaaguacagag

SEQ ID NO: 1428129 - RNA, 21 nt, Human
gcgguuugguuugcagcgacu

SEQ ID NO: 1428130 - RNA, 20 nt, Human
gcgguuuacucacugcugca

SEQ ID NO: 1428131 - RNA, 18 nt, Human
gcgguuccggcauggaca

SEQ ID NO: 1428132 - RNA, 15 nt, Human
gcgucuacccuggga

SEQ ID NO: 1428133 - RNA, 14 nt, Human
gcgucuacccuggg

SEQ ID NO: 1428134 - RNA, 18 nt, Human
gcgggcagagggcuggag

SEQ ID NO: 1428135 - RNA, 23 nt, Human
gcggggguuccguguccaccccc

SEQ ID NO: 1428136 - RNA, 21 nt, Human
gcggggcuugccuucuggugu

SEQ ID NO: 1428137 - RNA, 15 nt, Human
gcgggcgcgugagug

SEQ ID NO: 1428138 - RNA, 19 nt, Human
gcgggcagagggcuggagg

SEQ ID NO: 1428139 - RNA, 17 nt, Human
gcgggcagagggcugga

SEQ ID NO: 1428140 - RNA, 16 nt, Human
gcgggcagagggcugg

SEQ ID NO: 1428141 - RNA, 15 nt, Human
gcgggcagagggcug

SEQ ID NO: 1428142 - RNA, 10 nt, Human
gcggacacac

SEQ ID NO: 1428143 - RNA, 16 nt, Human
gcgcucagggccaugc

SEQ ID NO: 1428144 - RNA, 22 nt, Human
gcgcuaauucaaggaauuucuu

SEQ ID NO: 1428145 - RNA, 19 nt, Human
gcgcgugcaugugugcgug

SEQ ID NO: 1428146 - RNA, 18 nt, Human
gcgcggcugggaggaggg

SEQ ID NO: 1428147 - RNA, 12 nt, Human
gcgcggcuggga

SEQ ID NO: 1428148 - RNA, 22 nt, Human
gcgcucagggccaugcugaggc

SEQ ID NO: 1428149 - RNA, 13 nt, Human
gcgcucagggcca

SEQ ID NO: 1428150 - RNA, 20 nt, Human
gcgcuaucucccugccuccu

SEQ ID NO: 1428151 - RNA, 15 nt, Human
gcgcuaucucccugc

SEQ ID NO: 1428152 - RNA, 15 nt, Human
gcgccgucuccaggg

SEQ ID NO: 1428153 - RNA, 13 nt, Human
gcgccgucuccag

SEQ ID NO: 1428154 - RNA, 22 nt, Human
gcgccgucuccaggggcugcuu

SEQ ID NO: 1428155 - RNA, 20 nt, Human
gcgcgagggccucaaaggcc

SEQ ID NO: 1428156 - RNA, 15 nt, Human
gcgcgaucucagcuc

SEQ ID NO: 1428157 - RNA, 16 nt, Human
gcgcgaucucagcuca

SEQ ID NO: 1428158 - RNA, 13 nt, Human
uuuugaaucaaua

SEQ ID NO: 1428159 - RNA, 13 nt, Human
uuuugaaaaacug

SEQ ID NO: 1428160 - RNA, 20 nt, Human
uuuugacaaggggcaguggu

SEQ ID NO: 1428161 - RNA, 16 nt, Human
uuuuggauuguauauu

SEQ ID NO: 1428162 - RNA, 11 nt, Human
uuuuggaugcc

SEQ ID NO: 1428163 - RNA, 11 nt, Human
uuuuggcaccu

SEQ ID NO: 1428164 - RNA, 19 nt, Human
uuuuggcaaaacucuacuu

SEQ ID NO: 1428165 - RNA, 19 nt, Human
uuuugguaaagacuggcuu

SEQ ID NO: 1428166 - RNA, 22 nt, Human
uuuuggcugaaauucuccugga

SEQ ID NO: 1428167 - RNA, 21 nt, Human
uuuugguccaaguugugcuua

SEQ ID NO: 1428168 - RNA, 14 nt, Human
uuuuggucauugua

SEQ ID NO: 1428169 - RNA, 18 nt, Human
uuuuggucuggagggaag

SEQ ID NO: 1428170 - RNA, 12 nt, Human
uuuuaauucauu

SEQ ID NO: 1428171 - RNA, 23 nt, Human
uuuuaauuauuauuuauauaugu

SEQ ID NO: 1428172 - RNA, 20 nt, Human
uuuuaauuauuauuuauaua

SEQ ID NO: 1428173 - RNA, 17 nt, Human
uuuuaauuauuauucuu

SEQ ID NO: 1428174 - RNA, 16 nt, Human
uuuuaauuauuauucu

SEQ ID NO: 1428175 - RNA, 11 nt, Human
uuuuaauuauu

SEQ ID NO: 1428176 - RNA, 16 nt, Human
uuuuccuucaaaguuu

SEQ ID NO: 1428177 - RNA, 21 nt, Human
uuuuccuguccucuuucagcu

SEQ ID NO: 1428178 - RNA, 22 nt, Human
uuuuccuguccucuuucagcuc

SEQ ID NO: 1428179 - RNA, 20 nt, Human
uuuuccuguccucuuucagc

SEQ ID NO: 1428180 - RNA, 13 nt, Human
uuuuccuguccuc

SEQ ID NO: 1428181 - RNA, 12 nt, Human
uuuuccuguccu

SEQ ID NO: 1428182 - RNA, 17 nt, Human
uuuuaauuuacaaaaau

SEQ ID NO: 1428183 - RNA, 14 nt, Human
uuuuccugaaaacc

SEQ ID NO: 1428184 - RNA, 16 nt, Human
uuuucuuuguguagcu

SEQ ID NO: 1428185 - RNA, 19 nt, Human
uuuucuuuguguagcuuug

SEQ ID NO: 1428186 - RNA, 12 nt, Human
uuuucuuugugu

SEQ ID NO: 1428187 - RNA, 15 nt, Human
uuuucuuugaauaaa

SEQ ID NO: 1428188 - RNA, 20 nt, Human
uuuucuuugaauaaauguca

SEQ ID NO: 1428189 - RNA, 13 nt, Human
uuuucuuugaaua

SEQ ID NO: 1428190 - RNA, 11 nt, Human
uuuucuuucuc

SEQ ID NO: 1428191 - RNA, 18 nt, Human
uuuucuaagaaacauuua

SEQ ID NO: 1428192 - RNA, 16 nt, Human
uuuucuaagaaacauu

SEQ ID NO: 1428193 - RNA, 12 nt, Human
uuuucuaacugg

SEQ ID NO: 1428194 - RNA, 23 nt, Human
uuuucuaacagaaagcaugauuu

SEQ ID NO: 1428195 - RNA, 20 nt, Human
uuuucuaaaggaguuuaugu

SEQ ID NO: 1428196 - RNA, 18 nt, Human
uuuucuaaaguaaaaaca

SEQ ID NO: 1428197 - RNA, 19 nt, Human
uuuuguaauaauaaagaau

SEQ ID NO: 1428198 - RNA, 17 nt, Human
uuuuguaauaauaaaga

SEQ ID NO: 1428199 - RNA, 19 nt, Human
uuuuguaaguugaagcaaa

SEQ ID NO: 1428200 - RNA, 14 nt, Human
uuuuguaagacaaa

SEQ ID NO: 1428201 - RNA, 18 nt, Human
uuuuguaaacucaaaaua

SEQ ID NO: 1428202 - RNA, 20 nt, Human
uuuuguauaguuaacacacu

SEQ ID NO: 1428203 - RNA, 16 nt, Human
uuuuguauaaaauaga

SEQ ID NO: 1428204 - RNA, 24 nt, Human
uuuuguauaauuggauuuccuaau

SEQ ID NO: 1428205 - RNA, 23 nt, Human
uuuuguauaauuggauuuccuaa

SEQ ID NO: 1428206 - RNA, 16 nt, Human
uuuuguauaauuggau

SEQ ID NO: 1428207 - RNA, 14 nt, Human
uuuuguauaauugg

SEQ ID NO: 1428208 - RNA, 21 nt, Human
uuuuguagcuggggcuuugau

SEQ ID NO: 1428209 - RNA, 11 nt, Human
uuuuguaccaa

SEQ ID NO: 1428210 - RNA, 15 nt, Human
uuuugucuacacacc

SEQ ID NO: 1428211 - RNA, 23 nt, Human
uuuugucaaugcaguugucucug

SEQ ID NO: 1428212 - RNA, 18 nt, Human
uuuugucacuuuuucuga

SEQ ID NO: 1428213 - RNA, 17 nt, Human
uuuuguauucucugagc

SEQ ID NO: 1428214 - RNA, 14 nt, Human
uuuuuaaaaagcaa

SEQ ID NO: 1428215 - RNA, 23 nt, Human
uuuuuaaaaaagcuuaaaacuuu

SEQ ID NO: 1428216 - RNA, 22 nt, Human
uuuuuaaaaaagcuuaaaacuu

SEQ ID NO: 1428217 - RNA, 17 nt, Human
uuuuuaaaaaagcuuaa

SEQ ID NO: 1428218 - RNA, 15 nt, Human
uuuuuaaaaaagcuu

SEQ ID NO: 1428219 - RNA, 18 nt, Human
uuuuuaaaaaagaaacau

SEQ ID NO: 1428220 - RNA, 21 nt, Human
uuuuuaaacuguacagugucu

SEQ ID NO: 1428221 - RNA, 19 nt, Human
uuuuuaaacuguacagugu

SEQ ID NO: 1428222 - RNA, 18 nt, Human
uuuuuaaacuguacagug

SEQ ID NO: 1428223 - RNA, 17 nt, Human
uuuuuaaacuguacagu

SEQ ID NO: 1428224 - RNA, 16 nt, Human
uuuuuaaacuguacag

SEQ ID NO: 1428225 - RNA, 15 nt, Human
uuuuuaaacuguaca

SEQ ID NO: 1428226 - RNA, 13 nt, Human
uuuuuaaacugua

SEQ ID NO: 1428227 - RNA, 13 nt, Human
uuuuuaaacauca

SEQ ID NO: 1428228 - RNA, 16 nt, Human
uuuuuaaacaaguauu

SEQ ID NO: 1428229 - RNA, 12 nt, Human
uuuuuaaagacu

SEQ ID NO: 1428230 - RNA, 13 nt, Human
uuuuuaaagacuu

SEQ ID NO: 1428231 - RNA, 18 nt, Human
uuuuuaaagacuuuuaug

SEQ ID NO: 1428232 - RNA, 20 nt, Human
uuuuuaagcucugagcuguc

SEQ ID NO: 1428233 - RNA, 14 nt, Human
uuuuuaagcucuga

SEQ ID NO: 1428234 - RNA, 13 nt, Human
uuuuuaagaauug

SEQ ID NO: 1428235 - RNA, 18 nt, Human
uuuuuaagaauaucugua

SEQ ID NO: 1428236 - RNA, 17 nt, Human
uuuuuaagaauaucugu

SEQ ID NO: 1428237 - RNA, 16 nt, Human
uuuuuaagaauaucug

SEQ ID NO: 1428238 - RNA, 11 nt, Human
uuuuuaaaugc

SEQ ID NO: 1428239 - RNA, 20 nt, Human
uuuuuaagugaaaauauagc

SEQ ID NO: 1428240 - RNA, 13 nt, Human
uuuuuaagugaaa

SEQ ID NO: 1428241 - RNA, 18 nt, Human
uuuuuccuagcccucuca

SEQ ID NO: 1428242 - RNA, 13 nt, Human
uuuuuccucucca

SEQ ID NO: 1428243 - RNA, 13 nt, Human
uuuuucuaaagga

SEQ ID NO: 1428244 - RNA, 16 nt, Human
uuuuucguuuguuugu

SEQ ID NO: 1428245 - RNA, 18 nt, Human
uuuuuccuuuaacugaca

SEQ ID NO: 1428246 - RNA, 10 nt, Human
uuuuuccuuu

SEQ ID NO: 1428247 - RNA, 19 nt, Human
uuuuuccuucaaaguuuaa

SEQ ID NO: 1428248 - RNA, 18 nt, Human
uuuuuccuucaaaguuua

SEQ ID NO: 1428249 - RNA, 22 nt, Human
uuuuuccuucaaaguuuaauaa

SEQ ID NO: 1428250 - RNA, 21 nt, Human
uuuuucuauuaaaagacucau

SEQ ID NO: 1428251 - RNA, 19 nt, Human
uuuuucuauuaaaagacuc

SEQ ID NO: 1428252 - RNA, 18 nt, Human
uuuuucuauuaaaagacu

SEQ ID NO: 1428253 - RNA, 13 nt, Human
uuuuucuauuaaa

SEQ ID NO: 1428254 - RNA, 11 nt, Human
uuuuucuauua

SEQ ID NO: 1428255 - RNA, 14 nt, Human
uuuuucuaaaggag

SEQ ID NO: 1428256 - RNA, 15 nt, Human
uuuuucuaacuacaa

SEQ ID NO: 1428257 - RNA, 18 nt, Human
uuuuucucucaacaccau

SEQ ID NO: 1428258 - RNA, 16 nt, Human
uuuuucucucaacacc

SEQ ID NO: 1428259 - RNA, 21 nt, Human
uuuuucucgcuguccuuucua

SEQ ID NO: 1428260 - RNA, 23 nt, Human
uuuuucucugauacagaaaaguu

SEQ ID NO: 1428261 - RNA, 19 nt, Human
uuuuucucuaggaaauauu

SEQ ID NO: 1428262 - RNA, 21 nt, Human
uuuuuuggccaucugcuccug

SEQ ID NO: 1428263 - RNA, 17 nt, Human
uuuuuugcaguaacugu

SEQ ID NO: 1428264 - RNA, 10 nt, Human
uuuuuugcag

SEQ ID NO: 1428265 - RNA, 9 nt, Human
uuuuuugca

SEQ ID NO: 1428266 - RNA, 15 nt, Human
uuuuugaagcuguau

SEQ ID NO: 1428267 - RNA, 10 nt, Human
uuuuuugaga

SEQ ID NO: 1428268 - RNA, 12 nt, Human
uuuuuuguugac

SEQ ID NO: 1428269 - RNA, 12 nt, Human
uuuuuuguauag

SEQ ID NO: 1428270 - RNA, 15 nt, Human
uuuuuuguauaguua

SEQ ID NO: 1428271 - RNA, 14 nt, Human
uuuuuuguaccauu

SEQ ID NO: 1428272 - RNA, 13 nt, Human
uuuuuuguaccaa

SEQ ID NO: 1428273 - RNA, 16 nt, Human
uuuuuugggcagcaau

SEQ ID NO: 1428274 - RNA, 19 nt, Human
uuuuucuuuauaagaaagc

SEQ ID NO: 1428275 - RNA, 17 nt, Human
uuuuucuugucuauaaa

SEQ ID NO: 1428276 - RNA, 12 nt, Human
uuuuucuuuaca

SEQ ID NO: 1428277 - RNA, 22 nt, Human
uuuuucuugucuauaaagcauu

SEQ ID NO: 1428278 - RNA, 12 nt, Human
uuuuucuugucu

SEQ ID NO: 1428279 - RNA, 17 nt, Human
uuuuucugauaaaagau

SEQ ID NO: 1428280 - RNA, 13 nt, Human
uuuuucugauaaa

SEQ ID NO: 1428281 - RNA, 17 nt, Human
uuuuugaaaaagcgaaa

SEQ ID NO: 1428282 - RNA, 21 nt, Human
uuuuucuuuucggaaaucuua

SEQ ID NO: 1428283 - RNA, 23 nt, Human
uuuuugaaaaagcgaaaaaauca

SEQ ID NO: 1428284 - RNA, 20 nt, Human
uuuuugaaaagcagacauuu

SEQ ID NO: 1428285 - RNA, 16 nt, Human
uuuuaaugaacaaaug

SEQ ID NO: 1428286 - RNA, 21 nt, Human
uuuuaaucucuaacaguggac

SEQ ID NO: 1428287 - RNA, 20 nt, Human
uuuuaauccgccaauauuag

SEQ ID NO: 1428288 - RNA, 19 nt, Human
uuuuaauccgccaauauua

SEQ ID NO: 1428289 - RNA, 18 nt, Human
uuuuaauccgccaauauu

SEQ ID NO: 1428290 - RNA, 22 nt, Human
uuuuaauaugcuuaaaauaagc

SEQ ID NO: 1428291 - RNA, 18 nt, Human
uuuuaaagaccccuaacc

SEQ ID NO: 1428292 - RNA, 13 nt, Human
uuuuaaagaauug

SEQ ID NO: 1428293 - RNA, 11 nt, Human
uuuuaaaugca

SEQ ID NO: 1428294 - RNA, 12 nt, Human
uuuuaaaugcac

SEQ ID NO: 1428295 - RNA, 19 nt, Human
uuuuaaaugcauaaaugca

SEQ ID NO: 1428296 - RNA, 12 nt, Human
uuuuaaauguau

SEQ ID NO: 1428297 - RNA, 21 nt, Human
uuuuaaaugcaccuggaauau

SEQ ID NO: 1428298 - RNA, 20 nt, Human
uuuuaaauucccguuuuguc

SEQ ID NO: 1428299 - RNA, 16 nt, Human
uuuuaaauguauacua

SEQ ID NO: 1428300 - RNA, 14 nt, Human
uuuguaucuugaug

SEQ ID NO: 1428301 - RNA, 20 nt, Human
uuuguauaaaagugugaaau

SEQ ID NO: 1428302 - RNA, 14 nt, Human
uuuguauaaaagug

SEQ ID NO: 1428303 - RNA, 20 nt, Human
uuuguucgcauggucacaca

SEQ ID NO: 1428304 - RNA, 12 nt, Human
uuuuaaagaauu

SEQ ID NO: 1428305 - RNA, 18 nt, Human
uuuuaaagacuuuuauga

SEQ ID NO: 1428306 - RNA, 17 nt, Human
uuuguugacauucugaa

SEQ ID NO: 1428307 - RNA, 16 nt, Human
uuuguugacauucuga

SEQ ID NO: 1428308 - RNA, 15 nt, Human
uuuguugacauucug

SEQ ID NO: 1428309 - RNA, 14 nt, Human
uuuguugacauuag

SEQ ID NO: 1428310 - RNA, 13 nt, Human
uuuguugacauua

SEQ ID NO: 1428311 - RNA, 21 nt, Human
uuuuaaaagaaugauuaugaa

SEQ ID NO: 1428312 - RNA, 15 nt, Human
uuugcauuaaauuac

SEQ ID NO: 1428313 - RNA, 14 nt, Human
uuugcauuaaauua

SEQ ID NO: 1428314 - RNA, 14 nt, Human
uuugcaucucagua

SEQ ID NO: 1428315 - RNA, 15 nt, Human
uuugcuuugugauuu

SEQ ID NO: 1428316 - RNA, 16 nt, Human
uuugcuuugugauuuu

SEQ ID NO: 1428317 - RNA, 19 nt, Human
uuugcauuaaauuacagaa

SEQ ID NO: 1428318 - RNA, 16 nt, Human
uuugcauuaaauuaca

SEQ ID NO: 1428319 - RNA, 22 nt, Human
uuugaaugauuuuucuuuacaa

SEQ ID NO: 1428320 - RNA, 13 nt, Human
uuugaaugcauuu

SEQ ID NO: 1428321 - RNA, 21 nt, Human
uuugaaucuugucucaaugcu

SEQ ID NO: 1428322 - RNA, 17 nt, Human
uuugaaugauuuuucuu

SEQ ID NO: 1428323 - RNA, 14 nt, Human
uuugaaugcauuuu

SEQ ID NO: 1428324 - RNA, 16 nt, Human
uuugaaugcauuuugu

SEQ ID NO: 1428325 - RNA, 15 nt, Human
uuugaauguguuuca

SEQ ID NO: 1428326 - RNA, 21 nt, Human
uuugaauguuaaauaaauugu

SEQ ID NO: 1428327 - RNA, 22 nt, Human
uuugaauguuaaauaaauugua

SEQ ID NO: 1428328 - RNA, 17 nt, Human
uuugaauguguuucaca

SEQ ID NO: 1428329 - RNA, 13 nt, Human
uuugaauguuaaa

SEQ ID NO: 1428330 - RNA, 16 nt, Human
uuugaauguuaaauaa

SEQ ID NO: 1428331 - RNA, 18 nt, Human
uuugaauguuaaauaaau

SEQ ID NO: 1428332 - RNA, 13 nt, Human
uuugcaucucagu

SEQ ID NO: 1428333 - RNA, 15 nt, Human
uuugcaucugaaaau

SEQ ID NO: 1428334 - RNA, 21 nt, Human
uuugguuucccaagagcuacg

SEQ ID NO: 1428335 - RNA, 19 nt, Human
uuuggugguuucagaaaug

SEQ ID NO: 1428336 - RNA, 19 nt, Human
uuugguuuucacauuggaa

SEQ ID NO: 1428337 - RNA, 14 nt, Human
uuuggugagaaccu

SEQ ID NO: 1428338 - RNA, 13 nt, Human
uuugguuucuagc

SEQ ID NO: 1428339 - RNA, 21 nt, Human
uuuggugcuucucagauuucu

SEQ ID NO: 1428340 - RNA, 16 nt, Human
uuuguauaaaauaauu

SEQ ID NO: 1428341 - RNA, 14 nt, Human
uuuguauaaaauaa

SEQ ID NO: 1428342 - RNA, 13 nt, Human
uuuguauaaaaua

SEQ ID NO: 1428343 - RNA, 18 nt, Human
uuuggugauuacauuuua

SEQ ID NO: 1428344 - RNA, 19 nt, Human
uuuggauauguaaaacauu

SEQ ID NO: 1428345 - RNA, 15 nt, Human
uuuggucucuugcuu

SEQ ID NO: 1428346 - RNA, 10 nt, Human
uuuggaugcc

SEQ ID NO: 1428347 - RNA, 21 nt, Human
uuuggauauguaaaacauuua

SEQ ID NO: 1428348 - RNA, 15 nt, Human
uuuggauauguaaaa

SEQ ID NO: 1428349 - RNA, 17 nt, Human
uuuggagguuuauuacg

SEQ ID NO: 1428350 - RNA, 20 nt, Human
uuuggaguccccucaccucc

SEQ ID NO: 1428351 - RNA, 11 nt, Human
uuuggaaugug

SEQ ID NO: 1428352 - RNA, 19 nt, Human
uuuggacaaaauggaauac

SEQ ID NO: 1428353 - RNA, 18 nt, Human
uuuggagaguuuccugaa

SEQ ID NO: 1428354 - RNA, 17 nt, Human
uuuggaguccccucacc

SEQ ID NO: 1428355 - RNA, 18 nt, Human
uuuggagggaagcucuug

SEQ ID NO: 1428356 - RNA, 18 nt, Human
uuucuuaaaccuucaguu

SEQ ID NO: 1428357 - RNA, 16 nt, Human
uuucuuaaaccuucag

SEQ ID NO: 1428358 - RNA, 17 nt, Human
uuucuuaaaaaguuaua

SEQ ID NO: 1428359 - RNA, 12 nt, Human
uuucuguuuucu

SEQ ID NO: 1428360 - RNA, 14 nt, Human
uuucugaccaaaga

SEQ ID NO: 1428361 - RNA, 18 nt, Human
uuucuuagggaaggauac

SEQ ID NO: 1428362 - RNA, 23 nt, Human
uuucuuagggaaggauacaaaag

SEQ ID NO: 1428363 - RNA, 22 nt, Human
uuucuucacugcaacaugauga

SEQ ID NO: 1428364 - RNA, 19 nt, Human
uuucuucacugcaacauga

SEQ ID NO: 1428365 - RNA, 17 nt, Human
uuucuucacugcaacau

SEQ ID NO: 1428366 - RNA, 16 nt, Human
uuucuucacugcaaca

SEQ ID NO: 1428367 - RNA, 18 nt, Human
uuucuucaccaaaucuug

SEQ ID NO: 1428368 - RNA, 23 nt, Human
uuucuuccuaccaagucaaacuu

SEQ ID NO: 1428369 - RNA, 22 nt, Human
uuucuuccuaccaagucaaacu

SEQ ID NO: 1428370 - RNA, 17 nt, Human
uuucuuccuaccaaguc

SEQ ID NO: 1428371 - RNA, 14 nt, Human
uuugaacuuuuuau

SEQ ID NO: 1428372 - RNA, 18 nt, Human
uuugaagaacaugugaga

SEQ ID NO: 1428373 - RNA, 17 nt, Human
uuugaagaacaugugag

SEQ ID NO: 1428374 - RNA, 13 nt, Human
uuucuugccucau

SEQ ID NO: 1428375 - RNA, 17 nt, Human
uuugaacugauaaagau

SEQ ID NO: 1428376 - RNA, 19 nt, Human
uuugaacugauaaagauga

SEQ ID NO: 1428377 - RNA, 12 nt, Human
uuucuugccuca

SEQ ID NO: 1428378 - RNA, 15 nt, Human
uuugaacugauaaag

SEQ ID NO: 1428379 - RNA, 19 nt, Human
uuugaauccucucucugug

SEQ ID NO: 1428380 - RNA, 12 nt, Human
uuugaaucuugu

SEQ ID NO: 1428381 - RNA, 16 nt, Human
uuugaaucuugucuca

SEQ ID NO: 1428382 - RNA, 18 nt, Human
uuugaaucuugucucaau

SEQ ID NO: 1428383 - RNA, 18 nt, Human
uuugaaucacaugaauua

SEQ ID NO: 1428384 - RNA, 19 nt, Human
uuugaaucaauaauauauu

SEQ ID NO: 1428385 - RNA, 18 nt, Human
uuugaagcacagugauca

SEQ ID NO: 1428386 - RNA, 18 nt, Human
uuugaaucaucaagucuu

SEQ ID NO: 1428387 - RNA, 13 nt, Human
uuuccucccucag

SEQ ID NO: 1428388 - RNA, 18 nt, Human
uuuccucauuuuuauaau

SEQ ID NO: 1428389 - RNA, 19 nt, Human
uuuccucagacucuaagaa

SEQ ID NO: 1428390 - RNA, 20 nt, Human
uuuccuggacacucagaccu

SEQ ID NO: 1428391 - RNA, 16 nt, Human
uuuccuggacacucag

SEQ ID NO: 1428392 - RNA, 20 nt, Human
uuaccaaccuguuaccuacu

SEQ ID NO: 1428393 - RNA, 14 nt, Human
uuaccacagacaua

SEQ ID NO: 1428394 - RNA, 17 nt, Human
uuaccacagacauacua

SEQ ID NO: 1428395 - RNA, 12 nt, Human
uuacauuuucag

SEQ ID NO: 1428396 - RNA, 18 nt, Human
uuacauuuuaaacacauu

SEQ ID NO: 1428397 - RNA, 13 nt, Human
uuaccaaccuguu

SEQ ID NO: 1428398 - RNA, 12 nt, Human
uuaccaaccugu

SEQ ID NO: 1428399 - RNA, 23 nt, Human
uuaccaaagaugaaugaagcaaa

SEQ ID NO: 1428400 - RNA, 16 nt, Human
uuaccaaagaugaaug

SEQ ID NO: 1428401 - RNA, 21 nt, Human
uuaccaaaaauaaauauaucu

SEQ ID NO: 1428402 - RNA, 21 nt, Human
uuacauuuuuugggcagcaau

SEQ ID NO: 1428403 - RNA, 16 nt, Human
uuucuagagcacugcc

SEQ ID NO: 1428404 - RNA, 13 nt, Human
uuucuagaccaau

SEQ ID NO: 1428405 - RNA, 13 nt, Human
uuucuagaaagag

SEQ ID NO: 1428406 - RNA, 22 nt, Human
uuucuacuuugaagucauacca

SEQ ID NO: 1428407 - RNA, 18 nt, Human
uuucuacuuugaagucau

SEQ ID NO: 1428408 - RNA, 12 nt, Human
uuucuaaaguaa

SEQ ID NO: 1428409 - RNA, 14 nt, Human
uuucuaaaguaaaa

SEQ ID NO: 1428410 - RNA, 20 nt, Human
uuucuaaaggcuaccuuugu

SEQ ID NO: 1428411 - RNA, 21 nt, Human
uuucuaaaggcuaccuuugua

SEQ ID NO: 1428412 - RNA, 22 nt, Human
uuucugaacagcugguguagcu

SEQ ID NO: 1428413 - RNA, 19 nt, Human
uuucugaacagcuggugua

SEQ ID NO: 1428414 - RNA, 17 nt, Human
uuucugaacagcuggug

SEQ ID NO: 1428415 - RNA, 16 nt, Human
uuucugaacagcuggu

SEQ ID NO: 1428416 - RNA, 15 nt, Human
uuucugaacagcugg

SEQ ID NO: 1428417 - RNA, 13 nt, Human
uuucugaacagcu

SEQ ID NO: 1428418 - RNA, 20 nt, Human
uuucuguucuuucuggcuau

SEQ ID NO: 1428419 - RNA, 21 nt, Human
uuucucugcagaaacuacuga

SEQ ID NO: 1428420 - RNA, 13 nt, Human
uuucucugcagaa

SEQ ID NO: 1428421 - RNA, 11 nt, Human
uuucucugcca

SEQ ID NO: 1428422 - RNA, 21 nt, Human
uuucugaaauuuccugggagc

SEQ ID NO: 1428423 - RNA, 18 nt, Human
uuucucugauacagaaaa

SEQ ID NO: 1428424 - RNA, 17 nt, Human
uuucucugauacagaaa

SEQ ID NO: 1428425 - RNA, 16 nt, Human
uuucucugauacagaa

SEQ ID NO: 1428426 - RNA, 15 nt, Human
uuucucugauacaga

SEQ ID NO: 1428427 - RNA, 17 nt, Human
guauauauuuuuuuuua

SEQ ID NO: 1428428 - RNA, 16 nt, Human
guauaugguauuuauu

SEQ ID NO: 1428429 - RNA, 13 nt, Human
guauauuacaaug

SEQ ID NO: 1428430 - RNA, 14 nt, Human
guauauuacaauga

SEQ ID NO: 1428431 - RNA, 18 nt, Human
guaucuaggcaacauagu

SEQ ID NO: 1428432 - RNA, 21 nt, Human
guaucucagaaagugccugac

SEQ ID NO: 1428433 - RNA, 22 nt, Human
guaucucagaaagugccugaca

SEQ ID NO: 1428434 - RNA, 20 nt, Human
guaucucagaaagugccuga

SEQ ID NO: 1428435 - RNA, 18 nt, Human
guaucucagaaagugccu

SEQ ID NO: 1428436 - RNA, 14 nt, Human
guaucucagaaagu

SEQ ID NO: 1428437 - RNA, 13 nt, Human
guaucucagaaag

SEQ ID NO: 1428438 - RNA, 11 nt, Human
guaucucagaa

SEQ ID NO: 1428439 - RNA, 17 nt, Human
guaucuaugcauuuucu

SEQ ID NO: 1428440 - RNA, 12 nt, Human
guaucucuucag

SEQ ID NO: 1428441 - RNA, 13 nt, Human
guaucucuucagu

SEQ ID NO: 1428442 - RNA, 17 nt, Human
guaucucuucagucucu

SEQ ID NO: 1428443 - RNA, 18 nt, Human
guauauauauauauaugu

SEQ ID NO: 1428444 - RNA, 23 nt, Human
guauauauauauauauguacagu

SEQ ID NO: 1428445 - RNA, 10 nt, Human
guauauauau

SEQ ID NO: 1428446 - RNA, 23 nt, Human
guauauacuuugaaaggagaugu

SEQ ID NO: 1428447 - RNA, 13 nt, Human
guauauacuuuuu

SEQ ID NO: 1428448 - RNA, 12 nt, Human
guauauacuuuu

SEQ ID NO: 1428449 - RNA, 12 nt, Human
guauauacuuug

SEQ ID NO: 1428450 - RNA, 23 nt, Human
guauauacacccaagaugggcau

SEQ ID NO: 1428451 - RNA, 14 nt, Human
guauaguuaacaca

SEQ ID NO: 1428452 - RNA, 18 nt, Human
guauagcugcuuccagug

SEQ ID NO: 1428453 - RNA, 20 nt, Human
guauagcaugcaucuguuua

SEQ ID NO: 1428454 - RNA, 18 nt, Human
guauagcaugcaucuguu

SEQ ID NO: 1428455 - RNA, 17 nt, Human
guaugaaacuaaagccu

SEQ ID NO: 1428456 - RNA, 13 nt, Human
guaucuuuugaua

SEQ ID NO: 1428457 - RNA, 18 nt, Human
guaugaauuauucaauuu

SEQ ID NO: 1428458 - RNA, 14 nt, Human
guaugaauuauuca

SEQ ID NO: 1428459 - RNA, 16 nt, Human
guaugaagaguguuau

SEQ ID NO: 1428460 - RNA, 19 nt, Human
guaugaaacuaaagccuuu

SEQ ID NO: 1428461 - RNA, 13 nt, Human
guaugaggcauuu

SEQ ID NO: 1428462 - RNA, 15 nt, Human
guaugaggcauuugu

SEQ ID NO: 1428463 - RNA, 19 nt, Human
guaugaacuugaggacaca

SEQ ID NO: 1428464 - RNA, 20 nt, Human
guaugaacuugaggacacau

SEQ ID NO: 1428465 - RNA, 22 nt, Human
guaugaacuugaggacacaugu

SEQ ID NO: 1428466 - RNA, 23 nt, Human
guaugaacuugaggacacauguc

SEQ ID NO: 1428467 - RNA, 17 nt, Human
guaugaaccaccgcgcc

SEQ ID NO: 1428468 - RNA, 15 nt, Human
guaugaacuugagga

SEQ ID NO: 1428469 - RNA, 16 nt, Human
guaugaacuugaggac

SEQ ID NO: 1428470 - RNA, 14 nt, Human
guauuaagaaagga

SEQ ID NO: 1428471 - RNA, 12 nt, Human
guauuaagaaag

SEQ ID NO: 1428472 - RNA, 14 nt, Human
guauuaaaauguau

SEQ ID NO: 1428473 - RNA, 17 nt, Human
guauuaaaauguaugca

SEQ ID NO: 1428474 - RNA, 19 nt, Human
guauguucuaaccuuuaca

SEQ ID NO: 1428475 - RNA, 22 nt, Human
guauguucaacuaggaucagaa

SEQ ID NO: 1428476 - RNA, 16 nt, Human
guaugauacuucgaca

SEQ ID NO: 1428477 - RNA, 24 nt, Human
guaugauagguuauuuugauguaa

SEQ ID NO: 1428478 - RNA, 17 nt, Human
guaugaggcauuuguuu

SEQ ID NO: 1428479 - RNA, 20 nt, Human
guaugaggcauuuguuugaa

SEQ ID NO: 1428480 - RNA, 17 nt, Human
guauguuagugcaaauu

SEQ ID NO: 1428481 - RNA, 13 nt, Human
guagggagggcgg

SEQ ID NO: 1428482 - RNA, 22 nt, Human
guaggcuacagagaagccuuca

SEQ ID NO: 1428483 - RNA, 20 nt, Human
guaggcuacagagaagccuu

SEQ ID NO: 1428484 - RNA, 19 nt, Human
guaggcuacagagaagccu

SEQ ID NO: 1428485 - RNA, 18 nt, Human
guaggcuacagagaagcc

SEQ ID NO: 1428486 - RNA, 17 nt, Human
guaggcuacagagaagc

SEQ ID NO: 1428487 - RNA, 16 nt, Human
guaggcuacagagaag

SEQ ID NO: 1428488 - RNA, 15 nt, Human
guaggcuacagagaa

SEQ ID NO: 1428489 - RNA, 14 nt, Human
guaggcuacagaga

SEQ ID NO: 1428490 - RNA, 21 nt, Human
guaggcuacagagaagccuuc

SEQ ID NO: 1428491 - RNA, 16 nt, Human
guagccccagugacag

SEQ ID NO: 1428492 - RNA, 19 nt, Human
guagccccagugacagcua

SEQ ID NO: 1428493 - RNA, 15 nt, Human
guagccccagugaca

SEQ ID NO: 1428494 - RNA, 15 nt, Human
guagccagccggggc

SEQ ID NO: 1428495 - RNA, 21 nt, Human
guagccagccggggcgagugg

SEQ ID NO: 1428496 - RNA, 11 nt, Human
guagccagccg

SEQ ID NO: 1428497 - RNA, 15 nt, Human
guagccacaccagga

SEQ ID NO: 1428498 - RNA, 21 nt, Human
guagccagcacacagggcagu

SEQ ID NO: 1428499 - RNA, 19 nt, Human
guagccagcacacagggca

SEQ ID NO: 1428500 - RNA, 18 nt, Human
guagccagcacacagggc

SEQ ID NO: 1428501 - RNA, 15 nt, Human
guagccagcacacag

SEQ ID NO: 1428502 - RNA, 16 nt, Human
guagccacaccaggau

SEQ ID NO: 1428503 - RNA, 13 nt, Human
guagccacaccag

SEQ ID NO: 1428504 - RNA, 17 nt, Human
guagcaugcuuguugca

SEQ ID NO: 1428505 - RNA, 21 nt, Human
guagcauuuguguugaagagg

SEQ ID NO: 1428506 - RNA, 14 nt, Human
guagauuuuccaaa

SEQ ID NO: 1428507 - RNA, 23 nt, Human
guagauugcagaaaauucugugc

SEQ ID NO: 1428508 - RNA, 21 nt, Human
guagauugcagaaaauucugu

SEQ ID NO: 1428509 - RNA, 13 nt, Human
guagauugcagaa

SEQ ID NO: 1428510 - RNA, 15 nt, Human
guagauugauuguau

SEQ ID NO: 1428511 - RNA, 18 nt, Human
guagauucagguaauaca

SEQ ID NO: 1428512 - RNA, 14 nt, Human
guagauucagguaa

SEQ ID NO: 1428513 - RNA, 13 nt, Human
gcuacagagaagc

SEQ ID NO: 1428514 - RNA, 23 nt, Human
guagcacaaguuauuuaaaucug

SEQ ID NO: 1428515 - RNA, 13 nt, Human
guagcacuuacug

SEQ ID NO: 1428516 - RNA, 16 nt, Human
guagcauccuggaaua

SEQ ID NO: 1428517 - RNA, 21 nt, Human
guagaugggagggaggcucag

SEQ ID NO: 1428518 - RNA, 17 nt, Human
guagaugggagggaggc

SEQ ID NO: 1428519 - RNA, 22 nt, Human
guagaugcauuuggguccagga

SEQ ID NO: 1428520 - RNA, 20 nt, Human
guagaugcauuuggguccag

SEQ ID NO: 1428521 - RNA, 15 nt, Human
guagaugcauuuggg

SEQ ID NO: 1428522 - RNA, 22 nt, Human
guagauauuggacaaagaaccu

SEQ ID NO: 1428523 - RNA, 15 nt, Human
guagaguugcugaga

SEQ ID NO: 1428524 - RNA, 23 nt, Human
guagaguugcugagagggcucga

SEQ ID NO: 1428525 - RNA, 21 nt, Human
guagauaaguguucugucuga

SEQ ID NO: 1428526 - RNA, 14 nt, Human
guagaguugcugag

SEQ ID NO: 1428527 - RNA, 19 nt, Human
guagaguugaucaaaauca

SEQ ID NO: 1428528 - RNA, 12 nt, Human
guaggguuucua

SEQ ID NO: 1428529 - RNA, 13 nt, Human
guaggcuacagag

SEQ ID NO: 1428530 - RNA, 15 nt, Human
guagggugggagugg

SEQ ID NO: 1428531 - RNA, 12 nt, Human
guagggugggag

SEQ ID NO: 1428532 - RNA, 23 nt, Human
guaggguuuaauccccaguaaaa

SEQ ID NO: 1428533 - RNA, 16 nt, Human
guagguucagccaagg

SEQ ID NO: 1428534 - RNA, 15 nt, Human
guagguucagccaag

SEQ ID NO: 1428535 - RNA, 23 nt, Human
guagguggaagcuagacacauga

SEQ ID NO: 1428536 - RNA, 24 nt, Human
guagguggaagcuagacacaugaa

SEQ ID NO: 1428537 - RNA, 22 nt, Human
guaggguaauuaguaacaugug

SEQ ID NO: 1428538 - RNA, 22 nt, Human
guaggguaaaucaguaagaggu

SEQ ID NO: 1428539 - RNA, 20 nt, Human
guagggggcuggaggagccc

SEQ ID NO: 1428540 - RNA, 17 nt, Human
guaggggcugggaacag

SEQ ID NO: 1428541 - RNA, 15 nt, Human
guaggggcugggaac

SEQ ID NO: 1428542 - RNA, 13 nt, Human
guaggggcuggga

SEQ ID NO: 1428543 - RNA, 20 nt, Human
guaggggccccucucagccc

SEQ ID NO: 1428544 - RNA, 13 nt, Human
guaggggccccuc

SEQ ID NO: 1428545 - RNA, 21 nt, Human
guagggggcuggaggagccca

SEQ ID NO: 1428546 - RNA, 19 nt, Human
guagggggcuggaggagcc

SEQ ID NO: 1428547 - RNA, 17 nt, Human
guagggggcuggaggag

SEQ ID NO: 1428548 - RNA, 16 nt, Human
guagggggcuggagga

SEQ ID NO: 1428549 - RNA, 16 nt, Human
guaggggcugggaaca

SEQ ID NO: 1428550 - RNA, 22 nt, Human
guaggggcuuauaauaaaggac

SEQ ID NO: 1428551 - RNA, 16 nt, Human
guaguaccaaaauaaa

SEQ ID NO: 1428552 - RNA, 15 nt, Human
guaguaccaaaauaa

SEQ ID NO: 1428553 - RNA, 15 nt, Human
guaguaacacuaaua

SEQ ID NO: 1428554 - RNA, 15 nt, Human
guaguaauugacaug

SEQ ID NO: 1428555 - RNA, 14 nt, Human
guaguaacacuaau

SEQ ID NO: 1428556 - RNA, 13 nt, Human
guaguaacacuaa

SEQ ID NO: 1428557 - RNA, 21 nt, Human
guaguaaauaaugcuuugaaa

SEQ ID NO: 1428558 - RNA, 17 nt, Human
guaguaaauaaugcuuu

SEQ ID NO: 1428559 - RNA, 15 nt, Human
guaguaaauaaugcu

SEQ ID NO: 1428560 - RNA, 18 nt, Human
guagguugcacacuuugg

SEQ ID NO: 1428561 - RNA, 19 nt, Human
guagguugcacacuuuggu

SEQ ID NO: 1428562 - RNA, 14 nt, Human
guagguugcacacu

SEQ ID NO: 1428563 - RNA, 13 nt, Human
guagguugcacac

SEQ ID NO: 1428564 - RNA, 17 nt, Human
guagguucagccaaggu

SEQ ID NO: 1428565 - RNA, 23 nt, Human
guaguauuuuuuguauaauugga

SEQ ID NO: 1428566 - RNA, 20 nt, Human
guaguauuuuuuguauaauu

SEQ ID NO: 1428567 - RNA, 19 nt, Human
guaguauuuuuuguauaau

SEQ ID NO: 1428568 - RNA, 15 nt, Human
guaguauuuuuugua

SEQ ID NO: 1428569 - RNA, 20 nt, Human
guaguauggccugugucacu

SEQ ID NO: 1428570 - RNA, 17 nt, Human
guaguauggccuguguc

SEQ ID NO: 1428571 - RNA, 13 nt, Human
guaguaugauggg

SEQ ID NO: 1428572 - RNA, 22 nt, Human
guaguaugauagguuauuuuga

SEQ ID NO: 1428573 - RNA, 16 nt, Human
guaguaggcauuuuua

SEQ ID NO: 1428574 - RNA, 22 nt, Human
guaguagcguuuuuuaaaugua

SEQ ID NO: 1428575 - RNA, 12 nt, Human
guaguccuguga

SEQ ID NO: 1428576 - RNA, 12 nt, Human
guagucuugaug

SEQ ID NO: 1428577 - RNA, 16 nt, Human
guagucuugaugacca

SEQ ID NO: 1428578 - RNA, 19 nt, Human
guagugauuuuuaugccac

SEQ ID NO: 1428579 - RNA, 23 nt, Human
guagugcuacaggguccaacaua

SEQ ID NO: 1428580 - RNA, 17 nt, Human
guaguguuggagaagaa

SEQ ID NO: 1428581 - RNA, 15 nt, Human
guaguguuggagaag

SEQ ID NO: 1428582 - RNA, 14 nt, Human
guaguguuggagaa

SEQ ID NO: 1428583 - RNA, 17 nt, Human
guauaauucacauugua

SEQ ID NO: 1428584 - RNA, 13 nt, Human
guagugcuuugag

SEQ ID NO: 1428585 - RNA, 20 nt, Human
guauaauuggauuuccuaau

SEQ ID NO: 1428586 - RNA, 19 nt, Human
guauaauuggauuuccuaa

SEQ ID NO: 1428587 - RNA, 18 nt, Human
guauaauuggauuuccua

SEQ ID NO: 1428588 - RNA, 23 nt, Human
guauacuagggagccauuugaga

SEQ ID NO: 1428589 - RNA, 13 nt, Human
guauaccucacuu

SEQ ID NO: 1428590 - RNA, 15 nt, Human
guauaccugauuuuu

SEQ ID NO: 1428591 - RNA, 15 nt, Human
guauacuguaggcac

SEQ ID NO: 1428592 - RNA, 15 nt, Human
guauacuauaguacc

SEQ ID NO: 1428593 - RNA, 22 nt, Human
gucagagccaugucuucucccu

SEQ ID NO: 1428594 - RNA, 21 nt, Human
gucagagccaugucuucuccc

SEQ ID NO: 1428595 - RNA, 20 nt, Human
gucagagccaugucuucucc

SEQ ID NO: 1428596 - RNA, 18 nt, Human
gucagauccaggagcucc

SEQ ID NO: 1428597 - RNA, 17 nt, Human
gucagauccaggagcuc

SEQ ID NO: 1428598 - RNA, 14 nt, Human
gucagauccaggag

SEQ ID NO: 1428599 - RNA, 20 nt, Human
gucagauccaggagcuccag

SEQ ID NO: 1428600 - RNA, 15 nt, Human
gucagacccuggagg

SEQ ID NO: 1428601 - RNA, 18 nt, Human
gucagacgccugaggaac

SEQ ID NO: 1428602 - RNA, 17 nt, Human
gucagacgccugaggaa

SEQ ID NO: 1428603 - RNA, 16 nt, Human
gucagacgccugagga

SEQ ID NO: 1428604 - RNA, 16 nt, Human
gucagacccuggaggc

SEQ ID NO: 1428605 - RNA, 19 nt, Human
gucacucuagucaaugaca

SEQ ID NO: 1428606 - RNA, 22 nt, Human
gucacuaaagcaggccuuuuga

SEQ ID NO: 1428607 - RNA, 13 nt, Human
gucacucaaggcg

SEQ ID NO: 1428608 - RNA, 16 nt, Human
gucacuacgccuggcu

SEQ ID NO: 1428609 - RNA, 22 nt, Human
gucaauaaaauccauacauuug

SEQ ID NO: 1428610 - RNA, 23 nt, Human
gucaauaaaauccauacauuugu

SEQ ID NO: 1428611 - RNA, 18 nt, Human
gucaaucaagucuguuua

SEQ ID NO: 1428612 - RNA, 23 nt, Human
gucaaugacaugaauuuuagcuu

SEQ ID NO: 1428613 - RNA, 16 nt, Human
gucaaugacaugaauu

SEQ ID NO: 1428614 - RNA, 19 nt, Human
gucaccacgacuggccagg

SEQ ID NO: 1428615 - RNA, 17 nt, Human
gucaccacgacuggcca

SEQ ID NO: 1428616 - RNA, 16 nt, Human
gucaccacgacuggcc

SEQ ID NO: 1428617 - RNA, 17 nt, Human
gucaccacccugcucau

SEQ ID NO: 1428618 - RNA, 13 nt, Human
gucaccagguacu

SEQ ID NO: 1428619 - RNA, 13 nt, Human
gucaccagagacu

SEQ ID NO: 1428620 - RNA, 21 nt, Human
gucaccacgacuggccagggc

SEQ ID NO: 1428621 - RNA, 16 nt, Human
gucaccagagacuuua

SEQ ID NO: 1428622 - RNA, 18 nt, Human
guauuuuguauuguuuca

SEQ ID NO: 1428623 - RNA, 17 nt, Human
guauuuucaauagccac

SEQ ID NO: 1428624 - RNA, 13 nt, Human
guauuuucaauag

SEQ ID NO: 1428625 - RNA, 22 nt, Human
guauuuuauguuauauauaaau

SEQ ID NO: 1428626 - RNA, 17 nt, Human
guauuuuauguuauaua

SEQ ID NO: 1428627 - RNA, 16 nt, Human
guauuuuauguuauau

SEQ ID NO: 1428628 - RNA, 13 nt, Human
guauuuuauguua

SEQ ID NO: 1428629 - RNA, 20 nt, Human
guauuuuagugaacuugaaa

SEQ ID NO: 1428630 - RNA, 19 nt, Human
guauuuuagugaacuugaa

SEQ ID NO: 1428631 - RNA, 21 nt, Human
guauuuuaguaagagauuccu

SEQ ID NO: 1428632 - RNA, 23 nt, Human
guauuuuaaaauagcguucuugu

SEQ ID NO: 1428633 - RNA, 18 nt, Human
guauuuuaaaauagcguu

SEQ ID NO: 1428634 - RNA, 16 nt, Human
guauuacacucuguaa

SEQ ID NO: 1428635 - RNA, 18 nt, Human
guauuacacucuguaauu

SEQ ID NO: 1428636 - RNA, 20 nt, Human
guauuuuaaaagaaugauua

SEQ ID NO: 1428637 - RNA, 16 nt, Human
guauuaagaaaggaag

SEQ ID NO: 1428638 - RNA, 15 nt, Human
guauuaagaaaggaa

SEQ ID NO: 1428639 - RNA, 18 nt, Human
guccagggcuagugacuu

SEQ ID NO: 1428640 - RNA, 14 nt, Human
guccagcuccaacc

SEQ ID NO: 1428641 - RNA, 23 nt, Human
guccagguccugguggggcagcu

SEQ ID NO: 1428642 - RNA, 22 nt, Human
guccagguccugguggggcagc

SEQ ID NO: 1428643 - RNA, 21 nt, Human
guccagguccugguggggcag

SEQ ID NO: 1428644 - RNA, 17 nt, Human
guccagguccugguggg

SEQ ID NO: 1428645 - RNA, 16 nt, Human
guccagguccuggugg

SEQ ID NO: 1428646 - RNA, 15 nt, Human
guccagguccuggug

SEQ ID NO: 1428647 - RNA, 23 nt, Human
guccaguccuaucugggcuuccu

SEQ ID NO: 1428648 - RNA, 19 nt, Human
guccaguccuaucugggcu

SEQ ID NO: 1428649 - RNA, 18 nt, Human
guccaguccuaucugggc

SEQ ID NO: 1428650 - RNA, 17 nt, Human
guccaguccuaucuggg

SEQ ID NO: 1428651 - RNA, 17 nt, Human
guccaguccaguccuau

SEQ ID NO: 1428652 - RNA, 15 nt, Human
guccaguccaguccu

SEQ ID NO: 1428653 - RNA, 18 nt, Human
guccacgacugucuccau

SEQ ID NO: 1428654 - RNA, 16 nt, Human
guccacgacugucucc

SEQ ID NO: 1428655 - RNA, 15 nt, Human
guccacgacugucuc

SEQ ID NO: 1428656 - RNA, 18 nt, Human
guccagagagaccgagga

SEQ ID NO: 1428657 - RNA, 20 nt, Human
guccagagagaccgaggagg

SEQ ID NO: 1428658 - RNA, 22 nt, Human
guccacaggcuucugagcagcg

SEQ ID NO: 1428659 - RNA, 11 nt, Human
gucauuaaaug

SEQ ID NO: 1428660 - RNA, 13 nt, Human
gucauguuuaucu

SEQ ID NO: 1428661 - RNA, 14 nt, Human
gucauguuuaucug

SEQ ID NO: 1428662 - RNA, 22 nt, Human
gucagcugggacaccccgacuu

SEQ ID NO: 1428663 - RNA, 13 nt, Human
gucaggaaagaga

SEQ ID NO: 1428664 - RNA, 21 nt, Human
gucauuguuauauaaucauua

SEQ ID NO: 1428665 - RNA, 14 nt, Human
gucauuggcuuuau

SEQ ID NO: 1428666 - RNA, 17 nt, Human
gucauuggcuuuauccu

SEQ ID NO: 1428667 - RNA, 21 nt, Human
gucauucgcuacuaugauuua

SEQ ID NO: 1428668 - RNA, 16 nt, Human
gucauucguucugugg

SEQ ID NO: 1428669 - RNA, 21 nt, Human
gucauucagauaugauucaaa

SEQ ID NO: 1428670 - RNA, 13 nt, Human
gucauuagccuga

SEQ ID NO: 1428671 - RNA, 19 nt, Human
gucauuagccugaguagaa

SEQ ID NO: 1428672 - RNA, 21 nt, Human
gucauuagccugaguagaaag

SEQ ID NO: 1428673 - RNA, 15 nt, Human
gucccaucccugcgu

SEQ ID NO: 1428674 - RNA, 19 nt, Human
guccccaacagcgcccaaa

SEQ ID NO: 1428675 - RNA, 16 nt, Human
guccccaacagcgccc

SEQ ID NO: 1428676 - RNA, 15 nt, Human
guccccaacagcgcc

SEQ ID NO: 1428677 - RNA, 21 nt, Human
gucccauuuuagccaagcuua

SEQ ID NO: 1428678 - RNA, 13 nt, Human
gucccauguggug

SEQ ID NO: 1428679 - RNA, 17 nt, Human
gucccaugaucccugug

SEQ ID NO: 1428680 - RNA, 16 nt, Human
gucccuaauaaagcug

SEQ ID NO: 1428681 - RNA, 17 nt, Human
gucccuaauaaagcugu

SEQ ID NO: 1428682 - RNA, 13 nt, Human
gucccucugugua

SEQ ID NO: 1428683 - RNA, 12 nt, Human
gucccucugugu

SEQ ID NO: 1428684 - RNA, 11 nt, Human
gucccucugug

SEQ ID NO: 1428685 - RNA, 22 nt, Human
gucccucucauuuagccugucc

SEQ ID NO: 1428686 - RNA, 22 nt, Human
gucccucuguguauuugcuuuu

SEQ ID NO: 1428687 - RNA, 14 nt, Human
gucccucuguguau

SEQ ID NO: 1428688 - RNA, 21 nt, Human
gucccugcacagugacuucug

SEQ ID NO: 1428689 - RNA, 23 nt, Human
gucccuccgggaccuggugcugc

SEQ ID NO: 1428690 - RNA, 16 nt, Human
gucccucccccuuguc

SEQ ID NO: 1428691 - RNA, 21 nt, Human
gucccuaccccauggugcuag

SEQ ID NO: 1428692 - RNA, 18 nt, Human
gucccuaauaaagcugug

SEQ ID NO: 1428693 - RNA, 20 nt, Human
gucccuaauaaagcugugug

SEQ ID NO: 1428694 - RNA, 12 nt, Human
gucucuugcuug

SEQ ID NO: 1428695 - RNA, 19 nt, Human
gucugacuuucuuuuuuga

SEQ ID NO: 1428696 - RNA, 19 nt, Human
gucucuucugaauaaagca

SEQ ID NO: 1428697 - RNA, 20 nt, Human
gucucuucugaauaaagcaa

SEQ ID NO: 1428698 - RNA, 21 nt, Human
gucucuucugaauaaagcaau

SEQ ID NO: 1428699 - RNA, 22 nt, Human
gucucuucugaauaaagcaauu

SEQ ID NO: 1428700 - RNA, 22 nt, Human
gucucuucugagcuauuucauc

SEQ ID NO: 1428701 - RNA, 14 nt, Human
gucucuucugagcu

SEQ ID NO: 1428702 - RNA, 23 nt, Human
gucucuucugaauaaagcaauua

SEQ ID NO: 1428703 - RNA, 21 nt, Human
gucucuggauuauauuaugaa

SEQ ID NO: 1428704 - RNA, 23 nt, Human
gucucucuucucuccagcugacu

SEQ ID NO: 1428705 - RNA, 20 nt, Human
gucucucuucucuccagcug

SEQ ID NO: 1428706 - RNA, 19 nt, Human
gucucucuucucuccagcu

SEQ ID NO: 1428707 - RNA, 15 nt, Human
gucucucuucucucc

SEQ ID NO: 1428708 - RNA, 14 nt, Human
gucucucuucucuc

SEQ ID NO: 1428709 - RNA, 19 nt, Human
gucucucucucucuacaaa

SEQ ID NO: 1428710 - RNA, 18 nt, Human
gucucucugggccuuagg

SEQ ID NO: 1428711 - RNA, 15 nt, Human
gucucugaugcagcu

SEQ ID NO: 1428712 - RNA, 19 nt, Human
gucucugaggggcuaccag

SEQ ID NO: 1428713 - RNA, 19 nt, Human
gucucugaugcagcuuaua

SEQ ID NO: 1428714 - RNA, 16 nt, Human
gucucugaugcagcuu

SEQ ID NO: 1428715 - RNA, 17 nt, Human
gucucuggaauuugaaa

SEQ ID NO: 1428716 - RNA, 19 nt, Human
gucucaccuggacuuaagc

SEQ ID NO: 1428717 - RNA, 20 nt, Human
gucucaccggcucucaccug

SEQ ID NO: 1428718 - RNA, 19 nt, Human
gucucaccggcucucaccu

SEQ ID NO: 1428719 - RNA, 18 nt, Human
gucucaccggcucucacc

SEQ ID NO: 1428720 - RNA, 20 nt, Human
gucucacccuggaggcaccu

SEQ ID NO: 1428721 - RNA, 12 nt, Human
gucucuagagca

SEQ ID NO: 1428722 - RNA, 21 nt, Human
gucucuaauucuauuaaagug

SEQ ID NO: 1428723 - RNA, 15 nt, Human
gucucaggcugccug

SEQ ID NO: 1428724 - RNA, 13 nt, Human
gucucaggcugcc

SEQ ID NO: 1428725 - RNA, 19 nt, Human
gucucagccccuuucccuu

SEQ ID NO: 1428726 - RNA, 14 nt, Human
gucucaggcugccu

SEQ ID NO: 1428727 - RNA, 18 nt, Human
gucucuagagcagggauu

SEQ ID NO: 1428728 - RNA, 15 nt, Human
gucucucucucucua

SEQ ID NO: 1428729 - RNA, 17 nt, Human
gucucuauaccaauaaa

SEQ ID NO: 1428730 - RNA, 18 nt, Human
gucucuauaccaauaaag

SEQ ID NO: 1428731 - RNA, 19 nt, Human
gucucuauaccaauaaagu

SEQ ID NO: 1428732 - RNA, 20 nt, Human
gucucuauaccaauaaagug

SEQ ID NO: 1428733 - RNA, 23 nt, Human
guccuuacuccugugggagccuc

SEQ ID NO: 1428734 - RNA, 22 nt, Human
guccuuacuccugugggagccu

SEQ ID NO: 1428735 - RNA, 18 nt, Human
guccuuacuccuguggga

SEQ ID NO: 1428736 - RNA, 17 nt, Human
guccuuacuccuguggg

SEQ ID NO: 1428737 - RNA, 15 nt, Human
guccuuacuccugug

SEQ ID NO: 1428738 - RNA, 13 nt, Human
guccuuacuccug

SEQ ID NO: 1428739 - RNA, 23 nt, Human
gucccugcacagugacuucugag

SEQ ID NO: 1428740 - RNA, 13 nt, Human
gucccugccugga

SEQ ID NO: 1428741 - RNA, 18 nt, Human
gucggggcaucuggccug

SEQ ID NO: 1428742 - RNA, 14 nt, Human
gucggggcaucugg

SEQ ID NO: 1428743 - RNA, 18 nt, Human
gucggcugaccaugcuca

SEQ ID NO: 1428744 - RNA, 17 nt, Human
gucggcugaccaugcuc

SEQ ID NO: 1428745 - RNA, 14 nt, Human
gucggcugaccaug

SEQ ID NO: 1428746 - RNA, 14 nt, Human
guccuuagccugga

SEQ ID NO: 1428747 - RNA, 13 nt, Human
guccuuagccugg

SEQ ID NO: 1428748 - RNA, 12 nt, Human
gucggagcccug

SEQ ID NO: 1428749 - RNA, 21 nt, Human
gucggaaaacaugcuacacac

SEQ ID NO: 1428750 - RNA, 16 nt, Human
gucggagcccugucuc

SEQ ID NO: 1428751 - RNA, 21 nt, Human
gucuaaagcugguuuaauguu

SEQ ID NO: 1428752 - RNA, 23 nt, Human
gucuaaagauggaguuucuaagg

SEQ ID NO: 1428753 - RNA, 21 nt, Human
gucguggagagcuaggagcaa

SEQ ID NO: 1428754 - RNA, 15 nt, Human
gucucacccuggagg

SEQ ID NO: 1428755 - RNA, 17 nt, Human
gucguggggugugcugg

SEQ ID NO: 1428756 - RNA, 24 nt, Human
gucguggagagcuaggagcaaagc

SEQ ID NO: 1428757 - RNA, 20 nt, Human
gucguggagagcuaggagca

SEQ ID NO: 1428758 - RNA, 19 nt, Human
gucguggagagcuaggagc

SEQ ID NO: 1428759 - RNA, 18 nt, Human
gucguggagagcuaggag

SEQ ID NO: 1428760 - RNA, 23 nt, Human
gucguggacacacacagacuauu

SEQ ID NO: 1428761 - RNA, 18 nt, Human
gucgugccuguguccaug

SEQ ID NO: 1428762 - RNA, 17 nt, Human
gucgugccuguguccau

SEQ ID NO: 1428763 - RNA, 15 nt, Human
gucgugccugugucc

SEQ ID NO: 1428764 - RNA, 14 nt, Human
gucgugccuguguc

SEQ ID NO: 1428765 - RNA, 13 nt, Human
gucgugccugugu

SEQ ID NO: 1428766 - RNA, 12 nt, Human
gucgugccugug

SEQ ID NO: 1428767 - RNA, 17 nt, Human
gucgugagcucuuguga

SEQ ID NO: 1428768 - RNA, 17 nt, Human
gucguccuuacuccugu

SEQ ID NO: 1428769 - RNA, 12 nt, Human
gucguaaagauu

SEQ ID NO: 1428770 - RNA, 14 nt, Human
gucguaaagauuug

SEQ ID NO: 1428771 - RNA, 14 nt, Human
gucggugccuucaa

SEQ ID NO: 1428772 - RNA, 14 nt, Human
gucggucugugccc

SEQ ID NO: 1428773 - RNA, 18 nt, Human
gucgucaaagcugaaaug

SEQ ID NO: 1428774 - RNA, 13 nt, Human
gucuguggauuuu

SEQ ID NO: 1428775 - RNA, 16 nt, Human
gucuguggauuuuuuc

SEQ ID NO: 1428776 - RNA, 13 nt, Human
gucuguggaucag

SEQ ID NO: 1428777 - RNA, 22 nt, Human
gucugugccccuuccgccacug

SEQ ID NO: 1428778 - RNA, 18 nt, Human
gucuguucuguuucaagg

SEQ ID NO: 1428779 - RNA, 21 nt, Human
gucuguuccccauggccacuu

SEQ ID NO: 1428780 - RNA, 17 nt, Human
gucuguucacuuuuccu

SEQ ID NO: 1428781 - RNA, 16 nt, Human
gucuguuaugcuguga

SEQ ID NO: 1428782 - RNA, 17 nt, Human
gucuguguuuugaaaga

SEQ ID NO: 1428783 - RNA, 22 nt, Human
gucuguuggcaggcuggccagu

SEQ ID NO: 1428784 - RNA, 21 nt, Human
gucuguuggcaggcuggccag

SEQ ID NO: 1428785 - RNA, 20 nt, Human
gucuguuggcaggcuggcca

SEQ ID NO: 1428786 - RNA, 13 nt, Human
gucuguuuacugc

SEQ ID NO: 1428787 - RNA, 12 nt, Human
gucuguuuacug

SEQ ID NO: 1428788 - RNA, 19 nt, Human
gucuguuggcaggcuggcc

SEQ ID NO: 1428789 - RNA, 18 nt, Human
gucuguuggcaggcuggc

SEQ ID NO: 1428790 - RNA, 16 nt, Human
gucuguuggcaggcug

SEQ ID NO: 1428791 - RNA, 14 nt, Human
gucuguuggcaggc

SEQ ID NO: 1428792 - RNA, 19 nt, Human
gucuguugauuaaagauga

SEQ ID NO: 1428793 - RNA, 16 nt, Human
gucuguugauuaaaga

SEQ ID NO: 1428794 - RNA, 13 nt, Human
gucuguugauuaa

SEQ ID NO: 1428795 - RNA, 14 nt, Human
gucuguucuuucca

SEQ ID NO: 1428796 - RNA, 17 nt, Human
gucuguucuuuccaaag

SEQ ID NO: 1428797 - RNA, 23 nt, Human
gucugcucagacagaaccccuac

SEQ ID NO: 1428798 - RNA, 16 nt, Human
gucugcuaucauuauu

SEQ ID NO: 1428799 - RNA, 11 nt, Human
gucugccucuu

SEQ ID NO: 1428800 - RNA, 17 nt, Human
gucugcccucugcaucc

SEQ ID NO: 1428801 - RNA, 21 nt, Human
gucugcccucugcauccucug

SEQ ID NO: 1428802 - RNA, 17 nt, Human
gucugccccgcccucau

SEQ ID NO: 1428803 - RNA, 21 nt, Human
gucugccagggccccucuccc

SEQ ID NO: 1428804 - RNA, 10 nt, Human
gucugccagg

SEQ ID NO: 1428805 - RNA, 18 nt, Human
gucugagagaggccauuc

SEQ ID NO: 1428806 - RNA, 15 nt, Human
gucugagagaggcca

SEQ ID NO: 1428807 - RNA, 14 nt, Human
gucugagagaggcc

SEQ ID NO: 1428808 - RNA, 13 nt, Human
gucugagagaggc

SEQ ID NO: 1428809 - RNA, 23 nt, Human
gucugugccccuuccgccacugg

SEQ ID NO: 1428810 - RNA, 20 nt, Human
gucugugccccuuccgccac

SEQ ID NO: 1428811 - RNA, 19 nt, Human
gucugugccccuuccgcca

SEQ ID NO: 1428812 - RNA, 13 nt, Human
gucugugccccuu

SEQ ID NO: 1428813 - RNA, 20 nt, Human
gucuucuuugcccacaaugc

SEQ ID NO: 1428814 - RNA, 20 nt, Human
gucuucuuacuuggaacuga

SEQ ID NO: 1428815 - RNA, 17 nt, Human
gucuucuuugcccacaa

SEQ ID NO: 1428816 - RNA, 17 nt, Human
gucuucuuacuuggaac

SEQ ID NO: 1428817 - RNA, 15 nt, Human
gucuucucccuggaa

SEQ ID NO: 1428818 - RNA, 20 nt, Human
gucuucuccaacaccaccuc

SEQ ID NO: 1428819 - RNA, 18 nt, Human
gucuugaugaccaaaguc

SEQ ID NO: 1428820 - RNA, 16 nt, Human
gucuugagcucuauua

SEQ ID NO: 1428821 - RNA, 14 nt, Human
gucuugagcucuau

SEQ ID NO: 1428822 - RNA, 22 nt, Human
gucuuggaacuugccugccuuu

SEQ ID NO: 1428823 - RNA, 17 nt, Human
gucuuggaacuugccug

SEQ ID NO: 1428824 - RNA, 16 nt, Human
gucuuggaacuugccu

SEQ ID NO: 1428825 - RNA, 20 nt, Human
gucuugggcagagcuggcuc

SEQ ID NO: 1428826 - RNA, 19 nt, Human
gucuugggcagagcuggcu

SEQ ID NO: 1428827 - RNA, 16 nt, Human
gucuugggcagagcug

SEQ ID NO: 1428828 - RNA, 22 nt, Human
gucuugggcagagcuggcucug

SEQ ID NO: 1428829 - RNA, 21 nt, Human
gucuugggcagagcuggcucu

SEQ ID NO: 1428830 - RNA, 16 nt, Human
gugacagacaggcucu

SEQ ID NO: 1428831 - RNA, 15 nt, Human
gugacagacaggcuc

SEQ ID NO: 1428832 - RNA, 21 nt, Human
gugacacaaacacacacaaaa

SEQ ID NO: 1428833 - RNA, 18 nt, Human
gugacacaaacacacaca

SEQ ID NO: 1428834 - RNA, 14 nt, Human
gugacacaaacaca

SEQ ID NO: 1428835 - RNA, 13 nt, Human
gugacacaaacac

SEQ ID NO: 1428836 - RNA, 14 nt, Human
gugacaauaaaaca

SEQ ID NO: 1428837 - RNA, 12 nt, Human
gugacaauaaaa

SEQ ID NO: 1428838 - RNA, 17 nt, Human
gugacagacaggcucuu

SEQ ID NO: 1428839 - RNA, 19 nt, Human
gugaaaacacauuugcuuu

SEQ ID NO: 1428840 - RNA, 22 nt, Human
gucuuuuuuuguauaguuaaca

SEQ ID NO: 1428841 - RNA, 17 nt, Human
gucuuuuuuuguauagu

SEQ ID NO: 1428842 - RNA, 16 nt, Human
gucuuuuuuuguauag

SEQ ID NO: 1428843 - RNA, 15 nt, Human
gucuuuuuuuguaua

SEQ ID NO: 1428844 - RNA, 13 nt, Human
gugaaugaacacu

SEQ ID NO: 1428845 - RNA, 18 nt, Human
gugaacaaagcagccacg

SEQ ID NO: 1428846 - RNA, 17 nt, Human
gugaacaaagcagccac

SEQ ID NO: 1428847 - RNA, 13 nt, Human
gugaauucccuca

SEQ ID NO: 1428848 - RNA, 14 nt, Human
gugaauucccucac

SEQ ID NO: 1428849 - RNA, 21 nt, Human
gugaaugcugggacucagccu

SEQ ID NO: 1428850 - RNA, 20 nt, Human
gugaaugcugggacucagcc

SEQ ID NO: 1428851 - RNA, 15 nt, Human
gugaaugcugggacu

SEQ ID NO: 1428852 - RNA, 13 nt, Human
gugaaugcuggga

SEQ ID NO: 1428853 - RNA, 22 nt, Human
gugaguucucccuguacagugu

SEQ ID NO: 1428854 - RNA, 13 nt, Human
gugaguucucccu

SEQ ID NO: 1428855 - RNA, 17 nt, Human
gugaguguuuuuaucuu

SEQ ID NO: 1428856 - RNA, 20 nt, Human
gugaguuggcuuaccuggcc

SEQ ID NO: 1428857 - RNA, 16 nt, Human
gugaguuggcuuaccu

SEQ ID NO: 1428858 - RNA, 12 nt, Human
gugaguuggcuu

SEQ ID NO: 1428859 - RNA, 15 nt, Human
gugauacaaugcugu

SEQ ID NO: 1428860 - RNA, 17 nt, Human
gugauacaaugcugugc

SEQ ID NO: 1428861 - RNA, 18 nt, Human
gugaucauguguggaagu

SEQ ID NO: 1428862 - RNA, 17 nt, Human
gugaucauguguggaag

SEQ ID NO: 1428863 - RNA, 16 nt, Human
gugaucauguguggaa

SEQ ID NO: 1428864 - RNA, 20 nt, Human
gugaucagaccauaauguua

SEQ ID NO: 1428865 - RNA, 13 nt, Human
gugauauucuaag

SEQ ID NO: 1428866 - RNA, 14 nt, Human
gugauaugcacaau

SEQ ID NO: 1428867 - RNA, 19 nt, Human
gugauaugcacaauguaga

SEQ ID NO: 1428868 - RNA, 23 nt, Human
gugauauauaaguguacauaugu

SEQ ID NO: 1428869 - RNA, 21 nt, Human
gugauauauaaguguacauau

SEQ ID NO: 1428870 - RNA, 22 nt, Human
gugauagucuuuugcuuuuggc

SEQ ID NO: 1428871 - RNA, 19 nt, Human
gugauauaaguguguguuu

SEQ ID NO: 1428872 - RNA, 23 nt, Human
gugacuaacuagacaccaaaguu

SEQ ID NO: 1428873 - RNA, 17 nt, Human
gugacuaauggcaugag

SEQ ID NO: 1428874 - RNA, 21 nt, Human
gugacgucuggguggcccuua

SEQ ID NO: 1428875 - RNA, 19 nt, Human
gugacgucuggguggcccu

SEQ ID NO: 1428876 - RNA, 16 nt, Human
gugacgucuggguggc

SEQ ID NO: 1428877 - RNA, 15 nt, Human
gugacgucugggugg

SEQ ID NO: 1428878 - RNA, 20 nt, Human
gugagcccagcugggucagg

SEQ ID NO: 1428879 - RNA, 18 nt, Human
gugagcccagcuggguca

SEQ ID NO: 1428880 - RNA, 15 nt, Human
gugagcccagcuggg

SEQ ID NO: 1428881 - RNA, 13 nt, Human
gugaggagcuggg

SEQ ID NO: 1428882 - RNA, 14 nt, Human
gugagcuacaaaug

SEQ ID NO: 1428883 - RNA, 18 nt, Human
gugaggagcuugaaaccc

SEQ ID NO: 1428884 - RNA, 21 nt, Human
gugccccucuccuucuuagcu

SEQ ID NO: 1428885 - RNA, 21 nt, Human
gugcccccuucaagccugugc

SEQ ID NO: 1428886 - RNA, 19 nt, Human
gugccaugucaaacaaaua

SEQ ID NO: 1428887 - RNA, 16 nt, Human
gugccaggugagguca

SEQ ID NO: 1428888 - RNA, 22 nt, Human
gugccaggugaggucagcacau

SEQ ID NO: 1428889 - RNA, 14 nt, Human
gugccuucauuugg

SEQ ID NO: 1428890 - RNA, 12 nt, Human
gugccuucauuu

SEQ ID NO: 1428891 - RNA, 11 nt, Human
gugccuucauu

SEQ ID NO: 1428892 - RNA, 22 nt, Human
gugccuucaagaaaacaggcac

SEQ ID NO: 1428893 - RNA, 20 nt, Human
gugccccuuccgccacuggg

SEQ ID NO: 1428894 - RNA, 22 nt, Human
gugccccuuccgccacuggggc

SEQ ID NO: 1428895 - RNA, 19 nt, Human
gugccccuuccgccacugg

SEQ ID NO: 1428896 - RNA, 17 nt, Human
gugccccuuccgccacu

SEQ ID NO: 1428897 - RNA, 15 nt, Human
gugccccuuccgcca

SEQ ID NO: 1428898 - RNA, 15 nt, Human
gugccuucucucucc

SEQ ID NO: 1428899 - RNA, 23 nt, Human
gugccuuccuguuuuucacauuu

SEQ ID NO: 1428900 - RNA, 14 nt, Human
gugccuucucucuc

SEQ ID NO: 1428901 - RNA, 13 nt, Human
gugcgugaauauu

SEQ ID NO: 1428902 - RNA, 13 nt, Human
gugcguccugucg

SEQ ID NO: 1428903 - RNA, 15 nt, Human
gugcguccacgagcu

SEQ ID NO: 1428904 - RNA, 16 nt, Human
gugcggcuggccaugg

SEQ ID NO: 1428905 - RNA, 15 nt, Human
gugcggaccacccuc

SEQ ID NO: 1428906 - RNA, 13 nt, Human
gugcgcccagggc

SEQ ID NO: 1428907 - RNA, 12 nt, Human
gugcgcccaggg

SEQ ID NO: 1428908 - RNA, 18 nt, Human
gugcgagggacccagcua

SEQ ID NO: 1428909 - RNA, 16 nt, Human
gugcgcccagggcugg

SEQ ID NO: 1428910 - RNA, 15 nt, Human
gugcgcccagggcug

SEQ ID NO: 1428911 - RNA, 14 nt, Human
gugcgcccagggcu

SEQ ID NO: 1428912 - RNA, 20 nt, Human
gugcgugguggucccugggu

SEQ ID NO: 1428913 - RNA, 19 nt, Human
gugcgugguggucccuggg

SEQ ID NO: 1428914 - RNA, 15 nt, Human
gugcguggugguccc

SEQ ID NO: 1428915 - RNA, 13 nt, Human
gugcguggugcga

SEQ ID NO: 1428916 - RNA, 21 nt, Human
gugcguggaaugcccuucacu

SEQ ID NO: 1428917 - RNA, 16 nt, Human
gugcuaagguucuaag

SEQ ID NO: 1428918 - RNA, 20 nt, Human
gugcuaagugugaacuggac

SEQ ID NO: 1428919 - RNA, 17 nt, Human
gugcuaagugugaacug

SEQ ID NO: 1428920 - RNA, 18 nt, Human
gugcuaagugugaacugg

SEQ ID NO: 1428921 - RNA, 17 nt, Human
gugcuaagguucuaagg

SEQ ID NO: 1428922 - RNA, 13 nt, Human
gugcuaaguguga

SEQ ID NO: 1428923 - RNA, 14 nt, Human
gugcuaagugugaa

SEQ ID NO: 1428924 - RNA, 16 nt, Human
gugcuaagugugaacu

SEQ ID NO: 1428925 - RNA, 15 nt, Human
gugcuaagguucuaa

SEQ ID NO: 1428926 - RNA, 14 nt, Human
gugcuaagguucua

SEQ ID NO: 1428927 - RNA, 13 nt, Human
gugcuaagguucu

SEQ ID NO: 1428928 - RNA, 16 nt, Human
gugccaggaccaguca

SEQ ID NO: 1428929 - RNA, 13 nt, Human
gugccaggaccag

SEQ ID NO: 1428930 - RNA, 20 nt, Human
gugcaucaggcuuucuuuuu

SEQ ID NO: 1428931 - RNA, 11 nt, Human
gugcaucaggc

SEQ ID NO: 1428932 - RNA, 22 nt, Human
gugcauaccacuuuuguucuug

SEQ ID NO: 1428933 - RNA, 18 nt, Human
gugcagccgcugagcgag

SEQ ID NO: 1428934 - RNA, 17 nt, Human
gugcagccgcugagcga

SEQ ID NO: 1428935 - RNA, 19 nt, Human
gugcagcccccacugccuu

SEQ ID NO: 1428936 - RNA, 18 nt, Human
gugauuuacgcucauugu

SEQ ID NO: 1428937 - RNA, 20 nt, Human
gugauccacccgccucagcc

SEQ ID NO: 1428938 - RNA, 24 nt, Human
gugauccacccgccucagccuccc

SEQ ID NO: 1428939 - RNA, 13 nt, Human
gugauuuuuguaa

SEQ ID NO: 1428940 - RNA, 18 nt, Human
gugauuuuuguaauuuuu

SEQ ID NO: 1428941 - RNA, 21 nt, Human
gugauuuuuaugccaccugaa

SEQ ID NO: 1428942 - RNA, 15 nt, Human
gugcacugcccaugg

SEQ ID NO: 1428943 - RNA, 20 nt, Human
gugcacugcccauggacagg

SEQ ID NO: 1428944 - RNA, 19 nt, Human
gugcacugcccauggacag

SEQ ID NO: 1428945 - RNA, 21 nt, Human
gugcacugcccauggacaggc

SEQ ID NO: 1428946 - RNA, 13 nt, Human
gugcacuggcccc

SEQ ID NO: 1428947 - RNA, 20 nt, Human
gugcacugggaggcuccccu

SEQ ID NO: 1428948 - RNA, 21 nt, Human
gugcacugggaggcuccccuu

SEQ ID NO: 1428949 - RNA, 16 nt, Human
gugcacuggccccacc

SEQ ID NO: 1428950 - RNA, 17 nt, Human
gugcacuggccccaccc

SEQ ID NO: 1428951 - RNA, 15 nt, Human
gugcacugggaggcu

SEQ ID NO: 1428952 - RNA, 13 nt, Human
gugcacugggagg

SEQ ID NO: 1428953 - RNA, 18 nt, Human
gugcacuggccccacccu

SEQ ID NO: 1428954 - RNA, 17 nt, Human
guggcuggaagauccug

SEQ ID NO: 1428955 - RNA, 12 nt, Human
guggcuggaaga

SEQ ID NO: 1428956 - RNA, 20 nt, Human
guggcuggaagauccugcgg

SEQ ID NO: 1428957 - RNA, 17 nt, Human
guggcugguccagggcu

SEQ ID NO: 1428958 - RNA, 15 nt, Human
guggcugguccaggg

SEQ ID NO: 1428959 - RNA, 18 nt, Human
guggcuggguuuacacgc

SEQ ID NO: 1428960 - RNA, 22 nt, Human
guggcucacucagcacuuggcc

SEQ ID NO: 1428961 - RNA, 15 nt, Human
guggcucagccagca

SEQ ID NO: 1428962 - RNA, 16 nt, Human
guggcucgggaggcga

SEQ ID NO: 1428963 - RNA, 15 nt, Human
guggcugcuguggga

SEQ ID NO: 1428964 - RNA, 13 nt, Human
guggcuccuuccc

SEQ ID NO: 1428965 - RNA, 23 nt, Human
guggcuacucugugccagagccu

SEQ ID NO: 1428966 - RNA, 22 nt, Human
guggcuacucugugccagagcc

SEQ ID NO: 1428967 - RNA, 21 nt, Human
guggcuacucugugccagagc

SEQ ID NO: 1428968 - RNA, 20 nt, Human
guggcuacucugugccagag

SEQ ID NO: 1428969 - RNA, 18 nt, Human
guggcuacucugugccag

SEQ ID NO: 1428970 - RNA, 17 nt, Human
guggcuacucugugcca

SEQ ID NO: 1428971 - RNA, 16 nt, Human
guggcuacucugugcc

SEQ ID NO: 1428972 - RNA, 15 nt, Human
guggcuacucugugc

SEQ ID NO: 1428973 - RNA, 13 nt, Human
gugcuaauuuuga

SEQ ID NO: 1428974 - RNA, 15 nt, Human
gugcuaauuuugaaa

SEQ ID NO: 1428975 - RNA, 12 nt, Human
guggggaguggg

SEQ ID NO: 1428976 - RNA, 19 nt, Human
guggggauaggccagccgc

SEQ ID NO: 1428977 - RNA, 22 nt, Human
gugggcuuguggggccugggag

SEQ ID NO: 1428978 - RNA, 14 nt, Human
gugggcuugauucu

SEQ ID NO: 1428979 - RNA, 17 nt, Human
guggggagacugggcug

SEQ ID NO: 1428980 - RNA, 21 nt, Human
guggggagagacgggcccugg

SEQ ID NO: 1428981 - RNA, 13 nt, Human
guggggcagaggc

SEQ ID NO: 1428982 - RNA, 15 nt, Human
guggguuccacagac

SEQ ID NO: 1428983 - RNA, 14 nt, Human
guggguuccacaga

SEQ ID NO: 1428984 - RNA, 17 nt, Human
guggggcagcuccucug

SEQ ID NO: 1428985 - RNA, 14 nt, Human
guggggccagguca

SEQ ID NO: 1428986 - RNA, 18 nt, Human
guggguuuuuuaguugaa

SEQ ID NO: 1428987 - RNA, 12 nt, Human
gugguaaaaagg

SEQ ID NO: 1428988 - RNA, 21 nt, Human
gugggccugggcuccuggacc

SEQ ID NO: 1428989 - RNA, 20 nt, Human
gugggccugggcuccuggac

SEQ ID NO: 1428990 - RNA, 18 nt, Human
gugggccugggcuccugg

SEQ ID NO: 1428991 - RNA, 17 nt, Human
gugggccugggcuccug

SEQ ID NO: 1428992 - RNA, 15 nt, Human
gugggcucccugacu

SEQ ID NO: 1428993 - RNA, 14 nt, Human
gugggcucccugac

SEQ ID NO: 1428994 - RNA, 13 nt, Human
gugggcucccuga

SEQ ID NO: 1428995 - RNA, 12 nt, Human
gugggcuaagca

SEQ ID NO: 1428996 - RNA, 14 nt, Human
gugggccccacccu

SEQ ID NO: 1428997 - RNA, 18 nt, Human
gugggccagucuguggau

SEQ ID NO: 1428998 - RNA, 17 nt, Human
gugggccagucugugga

SEQ ID NO: 1428999 - RNA, 13 nt, Human
gugggccugggcu

SEQ ID NO: 1429000 - RNA, 16 nt, Human
gugggccagucugugg

SEQ ID NO: 1429001 - RNA, 15 nt, Human
gugggccagucugug

SEQ ID NO: 1429002 - RNA, 17 nt, Human
gugggccaacaaagaac

SEQ ID NO: 1429003 - RNA, 15 nt, Human
gugggcauucaaaug

SEQ ID NO: 1429004 - RNA, 21 nt, Human
gugguauuuucaauagccacu

SEQ ID NO: 1429005 - RNA, 14 nt, Human
guggucacagcugu

SEQ ID NO: 1429006 - RNA, 22 nt, Human
guggucacagcggaggugugga

SEQ ID NO: 1429007 - RNA, 18 nt, Human
guggucacagcggaggug

SEQ ID NO: 1429008 - RNA, 16 nt, Human
guggucacagcggagg

SEQ ID NO: 1429009 - RNA, 15 nt, Human
guggucacagcggag

SEQ ID NO: 1429010 - RNA, 23 nt, Human
gugguauuuucaauagccacuaa

SEQ ID NO: 1429011 - RNA, 14 nt, Human
gugguauuuucaau

SEQ ID NO: 1429012 - RNA, 23 nt, Human
gugguacagagaagccagcuugu

SEQ ID NO: 1429013 - RNA, 22 nt, Human
gugguacagagaagccagcuug

SEQ ID NO: 1429014 - RNA, 18 nt, Human
gugguacagagaagccag

SEQ ID NO: 1429015 - RNA, 17 nt, Human
gugguacagagaagcca

SEQ ID NO: 1429016 - RNA, 16 nt, Human
gugguacagagaagcc

SEQ ID NO: 1429017 - RNA, 15 nt, Human
gugguacagagaagc

SEQ ID NO: 1429018 - RNA, 14 nt, Human
gugguacagagaag

SEQ ID NO: 1429019 - RNA, 13 nt, Human
gugguacagagaa

SEQ ID NO: 1429020 - RNA, 12 nt, Human
gugguacagaga

SEQ ID NO: 1429021 - RNA, 21 nt, Human
gugguaagcaacauggcuuug

SEQ ID NO: 1429022 - RNA, 14 nt, Human
gugguacccucugg

SEQ ID NO: 1429023 - RNA, 13 nt, Human
gugguagagaagc

SEQ ID NO: 1429024 - RNA, 19 nt, Human
guggucuguuggcaggcug

SEQ ID NO: 1429025 - RNA, 17 nt, Human
guggucuguuggcaggc

SEQ ID NO: 1429026 - RNA, 13 nt, Human
guggucuguuggc

SEQ ID NO: 1429027 - RNA, 23 nt, Human
guggucuguuggcaggcuggcca

SEQ ID NO: 1429028 - RNA, 22 nt, Human
guggucuguuggcaggcuggcc

SEQ ID NO: 1429029 - RNA, 21 nt, Human
guggucuguuggcaggcuggc

SEQ ID NO: 1429030 - RNA, 20 nt, Human
guggucuguuggcaggcugg

SEQ ID NO: 1429031 - RNA, 21 nt, Human
guguaaguagauaggccaugg

SEQ ID NO: 1429032 - RNA, 19 nt, Human
guguaagggccagaaauau

SEQ ID NO: 1429033 - RNA, 21 nt, Human
guguaagauuuguuuuuaaac

SEQ ID NO: 1429034 - RNA, 17 nt, Human
guggugcgagugcguga

SEQ ID NO: 1429035 - RNA, 17 nt, Human
guguaagacaaaaagcu

SEQ ID NO: 1429036 - RNA, 18 nt, Human
guguaauugagaaggaaa

SEQ ID NO: 1429037 - RNA, 14 nt, Human
guguacauaacuga

SEQ ID NO: 1429038 - RNA, 15 nt, Human
guguacauaugugcu

SEQ ID NO: 1429039 - RNA, 12 nt, Human
guguacauaugu

SEQ ID NO: 1429040 - RNA, 16 nt, Human
guguacauaacugaaa

SEQ ID NO: 1429041 - RNA, 20 nt, Human
guguagcuacagagaaacca

SEQ ID NO: 1429042 - RNA, 18 nt, Human
guguagcuacagagaaac

SEQ ID NO: 1429043 - RNA, 17 nt, Human
guguagcuacagagaaa

SEQ ID NO: 1429044 - RNA, 16 nt, Human
guguagcuacagagaa

SEQ ID NO: 1429045 - RNA, 15 nt, Human
guguagcuacagaga

SEQ ID NO: 1429046 - RNA, 20 nt, Human
guguagccuuuuuguauaaa

SEQ ID NO: 1429047 - RNA, 13 nt, Human
guguagccuuuuu

SEQ ID NO: 1429048 - RNA, 12 nt, Human
guguagccuuuu

SEQ ID NO: 1429049 - RNA, 11 nt, Human
guguagccuuu

SEQ ID NO: 1429050 - RNA, 17 nt, Human
guguagccacaccagga

SEQ ID NO: 1429051 - RNA, 16 nt, Human
guguagcaacuacagu

SEQ ID NO: 1429052 - RNA, 19 nt, Human
guguagaacacuaauucau

SEQ ID NO: 1429053 - RNA, 15 nt, Human
guguagaacacuaau

SEQ ID NO: 1429054 - RNA, 14 nt, Human
guguagaacacuaa

SEQ ID NO: 1429055 - RNA, 22 nt, Human
guguaccgcgucuacccuggga

SEQ ID NO: 1429056 - RNA, 20 nt, Human
guguaccgcgucuacccugg

SEQ ID NO: 1429057 - RNA, 17 nt, Human
guguaccauuugccucc

SEQ ID NO: 1429058 - RNA, 14 nt, Human
guguauaaacaaga

SEQ ID NO: 1429059 - RNA, 12 nt, Human
guguauaaacaa

SEQ ID NO: 1429060 - RNA, 18 nt, Human
guguauaaaaauaaaaaa

SEQ ID NO: 1429061 - RNA, 14 nt, Human
guguauaaaaauaa

SEQ ID NO: 1429062 - RNA, 12 nt, Human
guguauaaaaau

SEQ ID NO: 1429063 - RNA, 17 nt, Human
guguaguucauguaaau

SEQ ID NO: 1429064 - RNA, 15 nt, Human
guguaguucauguaa

SEQ ID NO: 1429065 - RNA, 23 nt, Human
guguagcugugaccugcugagcu

SEQ ID NO: 1429066 - RNA, 14 nt, Human
guguagcuuugcuc

SEQ ID NO: 1429067 - RNA, 22 nt, Human
guguagcugugaccugcugagc

SEQ ID NO: 1429068 - RNA, 21 nt, Human
guguagcugugaccugcugag

SEQ ID NO: 1429069 - RNA, 20 nt, Human
guguagcugugaccugcuga

SEQ ID NO: 1429070 - RNA, 19 nt, Human
guguagcugugaccugcug

SEQ ID NO: 1429071 - RNA, 18 nt, Human
guguagcugugaccugcu

SEQ ID NO: 1429072 - RNA, 16 nt, Human
guguagcugugaccug

SEQ ID NO: 1429073 - RNA, 15 nt, Human
guguagcugugaccu

SEQ ID NO: 1429074 - RNA, 12 nt, Human
guguagcuguga

SEQ ID NO: 1429075 - RNA, 22 nt, Human
guguagcuacagagaaaccagc

SEQ ID NO: 1429076 - RNA, 13 nt, Human
guguauauggaca

SEQ ID NO: 1429077 - RNA, 12 nt, Human
guguauauauau

SEQ ID NO: 1429078 - RNA, 19 nt, Human
guguauaaacaagaaaaau

SEQ ID NO: 1429079 - RNA, 17 nt, Human
guguauaaacaagaaaa

SEQ ID NO: 1429080 - RNA, 14 nt, Human
gugucccccucugu

SEQ ID NO: 1429081 - RNA, 18 nt, Human
gugucccccucuguccag

SEQ ID NO: 1429082 - RNA, 19 nt, Human
guguccccaacagcgccca

SEQ ID NO: 1429083 - RNA, 18 nt, Human
guguccccaacagcgccc

SEQ ID NO: 1429084 - RNA, 12 nt, Human
guguccccaaca

SEQ ID NO: 1429085 - RNA, 18 nt, Human
gugucccagaagaugacu

SEQ ID NO: 1429086 - RNA, 22 nt, Human
gugucccagaagaugacugagg

SEQ ID NO: 1429087 - RNA, 19 nt, Human
guguauggaaauaaaugua

SEQ ID NO: 1429088 - RNA, 17 nt, Human
guguaugcacaugaacu

SEQ ID NO: 1429089 - RNA, 14 nt, Human
guguaugcacagua

SEQ ID NO: 1429090 - RNA, 22 nt, Human
guguuagggaagggccugccac

SEQ ID NO: 1429091 - RNA, 16 nt, Human
guguuagggaagggcc

SEQ ID NO: 1429092 - RNA, 21 nt, Human
guguuagccuuuuuuccccag

SEQ ID NO: 1429093 - RNA, 15 nt, Human
guguuacuguaauuc

SEQ ID NO: 1429094 - RNA, 19 nt, Human
guguuacuguaauuccuca

SEQ ID NO: 1429095 - RNA, 23 nt, Human
guguuagggaagggccugccaca

SEQ ID NO: 1429096 - RNA, 21 nt, Human
guguuacuaaaaaaaagauga

SEQ ID NO: 1429097 - RNA, 20 nt, Human
guguuacuaaaaaaaagaug

SEQ ID NO: 1429098 - RNA, 12 nt, Human
guguuaccugua

SEQ ID NO: 1429099 - RNA, 14 nt, Human
guguuacuaaguuu

SEQ ID NO: 1429100 - RNA, 16 nt, Human
guguuaccugaaaaca

SEQ ID NO: 1429101 - RNA, 23 nt, Human
guguuacccaguaacucaucugu

SEQ ID NO: 1429102 - RNA, 15 nt, Human
guguuaauuuuugau

SEQ ID NO: 1429103 - RNA, 12 nt, Human
guguuaauuuuu

SEQ ID NO: 1429104 - RNA, 12 nt, Human
guguuacuaagu

SEQ ID NO: 1429105 - RNA, 13 nt, Human
guguguuuuaaaa

SEQ ID NO: 1429106 - RNA, 16 nt, Human
guguguuuuaaaauga

SEQ ID NO: 1429107 - RNA, 19 nt, Human
guguguuuuaaaaugagaa

SEQ ID NO: 1429108 - RNA, 14 nt, Human
guguuaagcucugc

SEQ ID NO: 1429109 - RNA, 15 nt, Human
guguuaagcucugcu

SEQ ID NO: 1429110 - RNA, 17 nt, Human
guguuaacauuccaaga

SEQ ID NO: 1429111 - RNA, 14 nt, Human
guguuaacauucca

SEQ ID NO: 1429112 - RNA, 23 nt, Human
guguuaacagaagggagggcaga

SEQ ID NO: 1429113 - RNA, 22 nt, Human
guguuaacagaagggagggcag

SEQ ID NO: 1429114 - RNA, 14 nt, Human
guguuaacagaagg

SEQ ID NO: 1429115 - RNA, 21 nt, Human
guguuaaaugugaugaauacu

SEQ ID NO: 1429116 - RNA, 21 nt, Human
guguguuuuucuauuaaaaga

SEQ ID NO: 1429117 - RNA, 20 nt, Human
guguguuuuucuauuaaaag

SEQ ID NO: 1429118 - RNA, 16 nt, Human
guguguuuuucuauua

SEQ ID NO: 1429119 - RNA, 15 nt, Human
guguguuuuucuauu

SEQ ID NO: 1429120 - RNA, 14 nt, Human
guguguuuuucuau

SEQ ID NO: 1429121 - RNA, 14 nt, Human
guguguuuuucaua

SEQ ID NO: 1429122 - RNA, 16 nt, Human
guguucuccuuuuccu

SEQ ID NO: 1429123 - RNA, 11 nt, Human
guguucuccuu

SEQ ID NO: 1429124 - RNA, 23 nt, Human
guguucuccugcugcucccucag

SEQ ID NO: 1429125 - RNA, 22 nt, Human
guguucuccugcugcucccuca

SEQ ID NO: 1429126 - RNA, 20 nt, Human
guguucuccugcugcucccu

SEQ ID NO: 1429127 - RNA, 15 nt, Human
guguucuccugcugc

SEQ ID NO: 1429128 - RNA, 22 nt, Human
guguucuaagaugugauauucu

SEQ ID NO: 1429129 - RNA, 13 nt, Human
guguucuaagaug

SEQ ID NO: 1429130 - RNA, 14 nt, Human
guguuccuuccgcu

SEQ ID NO: 1429131 - RNA, 15 nt, Human
guguucccuauccaa

SEQ ID NO: 1429132 - RNA, 23 nt, Human
guguuccccuuccacugagggca

SEQ ID NO: 1429133 - RNA, 22 nt, Human
guguuccccuuccacugagggc

SEQ ID NO: 1429134 - RNA, 19 nt, Human
guguuccccuuccacugag

SEQ ID NO: 1429135 - RNA, 18 nt, Human
guguuccccuuccacuga

SEQ ID NO: 1429136 - RNA, 21 nt, Human
guguucccauuucagcugauc

SEQ ID NO: 1429137 - RNA, 17 nt, Human
guguuccccacuguauc

SEQ ID NO: 1429138 - RNA, 17 nt, Human
guguucccauuucagcu

SEQ ID NO: 1429139 - RNA, 14 nt, Human
guguucauuguuuc

SEQ ID NO: 1429140 - RNA, 16 nt, Human
guguucaauauuuucu

SEQ ID NO: 1429141 - RNA, 14 nt, Human
guguucaauauuuu

SEQ ID NO: 1429142 - RNA, 23 nt, Human
guguuauuuuguuuuuccuucca

SEQ ID NO: 1429143 - RNA, 20 nt, Human
guguuauuuucauucaaagu

SEQ ID NO: 1429144 - RNA, 21 nt, Human
guguuauuuggaaccuuguuu

SEQ ID NO: 1429145 - RNA, 16 nt, Human
guguuaucaccuagcu

SEQ ID NO: 1429146 - RNA, 16 nt, Human
guguuuuguucaccau

SEQ ID NO: 1429147 - RNA, 20 nt, Human
guguuuugaaagaauagaac

SEQ ID NO: 1429148 - RNA, 15 nt, Human
guguuuugaaagaau

SEQ ID NO: 1429149 - RNA, 15 nt, Human
guguuuuaauuuaaa

SEQ ID NO: 1429150 - RNA, 13 nt, Human
guguucugugaua

SEQ ID NO: 1429151 - RNA, 14 nt, Human
guguuuuaauuuaa

SEQ ID NO: 1429152 - RNA, 19 nt, Human
guguuuuuuuaugaauggg

SEQ ID NO: 1429153 - RNA, 22 nt, Human
guguuuuucuauuaaaagacuc

SEQ ID NO: 1429154 - RNA, 23 nt, Human
guguuuuucuauuaaaagacuca

SEQ ID NO: 1429155 - RNA, 21 nt, Human
guguuuuucuauuaaaagacu

SEQ ID NO: 1429156 - RNA, 19 nt, Human
guguuuuucuauuaaaaga

SEQ ID NO: 1429157 - RNA, 18 nt, Human
guguuuuucuauuaaaag

SEQ ID NO: 1429158 - RNA, 17 nt, Human
guguuuuucuauuaaaa

SEQ ID NO: 1429159 - RNA, 15 nt, Human
guguuuuucuauuaa

SEQ ID NO: 1429160 - RNA, 14 nt, Human
guguuuuucuauua

SEQ ID NO: 1429161 - RNA, 21 nt, Human
guguuuuguucaccauuauaa

SEQ ID NO: 1429162 - RNA, 18 nt, Human
guguuuuucauaaagcag

SEQ ID NO: 1429163 - RNA, 15 nt, Human
guuaagaaauuucac

SEQ ID NO: 1429164 - RNA, 15 nt, Human
guuaagaaaauaaau

SEQ ID NO: 1429165 - RNA, 14 nt, Human
guuaagaaaauaaa

SEQ ID NO: 1429166 - RNA, 22 nt, Human
guuacacuuuuuggaagugaaa

SEQ ID NO: 1429167 - RNA, 18 nt, Human
guuacacuuuuuggaagu

SEQ ID NO: 1429168 - RNA, 17 nt, Human
guuacacuuuuuggaag

SEQ ID NO: 1429169 - RNA, 21 nt, Human
guuaacacacuaccgaaugug

SEQ ID NO: 1429170 - RNA, 12 nt, Human
guuaaauguaga

SEQ ID NO: 1429171 - RNA, 23 nt, Human
guuaacauuccaagacucuagag

SEQ ID NO: 1429172 - RNA, 23 nt, Human
guuaacagaagggagggcagagc

SEQ ID NO: 1429173 - RNA, 21 nt, Human
guuaacagaagggagggcaga

SEQ ID NO: 1429174 - RNA, 20 nt, Human
guuaacagaagggagggcag

SEQ ID NO: 1429175 - RNA, 23 nt, Human
guuaacugaauaccacucuguaa

SEQ ID NO: 1429176 - RNA, 22 nt, Human
guuaacugaauaccacucugua

SEQ ID NO: 1429177 - RNA, 20 nt, Human
guuaacugaauaccacucug

SEQ ID NO: 1429178 - RNA, 16 nt, Human
guuaacugaauaccac

SEQ ID NO: 1429179 - RNA, 14 nt, Human
guuaacugaauacc

SEQ ID NO: 1429180 - RNA, 24 nt, Human
guuaacauuccaagacucuagagu

SEQ ID NO: 1429181 - RNA, 17 nt, Human
guuaacuauugcauuua

SEQ ID NO: 1429182 - RNA, 20 nt, Human
guuaaaaacagauuuggaaa

SEQ ID NO: 1429183 - RNA, 12 nt, Human
guuaaaaugugu

SEQ ID NO: 1429184 - RNA, 22 nt, Human
guuaaaauaccagccaguaaau

SEQ ID NO: 1429185 - RNA, 20 nt, Human
guuaaauacaggaaacaguu

SEQ ID NO: 1429186 - RNA, 16 nt, Human
guuaaauacaggaaac

SEQ ID NO: 1429187 - RNA, 22 nt, Human
guuaaauaaauuguauauucac

SEQ ID NO: 1429188 - RNA, 20 nt, Human
guuaaauaaauuguauauuc

SEQ ID NO: 1429189 - RNA, 21 nt, Human
guuaaauaaauuguauauuca

SEQ ID NO: 1429190 - RNA, 18 nt, Human
guuaaaggugaacauugg

SEQ ID NO: 1429191 - RNA, 13 nt, Human
guuaaauaaauug

SEQ ID NO: 1429192 - RNA, 17 nt, Human
guuaaauaaauuguaua

SEQ ID NO: 1429193 - RNA, 18 nt, Human
guuaaauaaauuguauau

SEQ ID NO: 1429194 - RNA, 19 nt, Human
guuaaauaaauuguauauu

SEQ ID NO: 1429195 - RNA, 15 nt, Human
guuaaacuagcauau

SEQ ID NO: 1429196 - RNA, 19 nt, Human
guuaaacuagcauaucugc

SEQ ID NO: 1429197 - RNA, 20 nt, Human
guuaaacuagcauaucugcc

SEQ ID NO: 1429198 - RNA, 21 nt, Human
guuaaacuagcauaucugccu

SEQ ID NO: 1429199 - RNA, 22 nt, Human
guuaaacuagcauaucugccuu

SEQ ID NO: 1429200 - RNA, 23 nt, Human
guuaaacuagcauaucugccuuu

SEQ ID NO: 1429201 - RNA, 15 nt, Human
guuaaagcugccggc

SEQ ID NO: 1429202 - RNA, 13 nt, Human
gugugcaggagcg

SEQ ID NO: 1429203 - RNA, 19 nt, Human
gugugcacgcgugugcagg

SEQ ID NO: 1429204 - RNA, 16 nt, Human
gugugcaccaggguug

SEQ ID NO: 1429205 - RNA, 20 nt, Human
gugugcacaaauauuuauuu

SEQ ID NO: 1429206 - RNA, 17 nt, Human
gugugcaaggcagccgu

SEQ ID NO: 1429207 - RNA, 14 nt, Human
gugugcaaggcagc

SEQ ID NO: 1429208 - RNA, 14 nt, Human
gugugaucgucuga

SEQ ID NO: 1429209 - RNA, 15 nt, Human
gugucugcucaguaa

SEQ ID NO: 1429210 - RNA, 17 nt, Human
gugucuggcacagccug

SEQ ID NO: 1429211 - RNA, 16 nt, Human
gugucugagagauuca

SEQ ID NO: 1429212 - RNA, 15 nt, Human
guguccugagcucag

SEQ ID NO: 1429213 - RNA, 13 nt, Human
guguccugagcuc

SEQ ID NO: 1429214 - RNA, 23 nt, Human
guguccugagccccagggagagg

SEQ ID NO: 1429215 - RNA, 22 nt, Human
guguccugagcucagcguggag

SEQ ID NO: 1429216 - RNA, 21 nt, Human
guguccugcaccggggccugg

SEQ ID NO: 1429217 - RNA, 13 nt, Human
guguccugacacu

SEQ ID NO: 1429218 - RNA, 18 nt, Human
guguccucuucccucucu

SEQ ID NO: 1429219 - RNA, 20 nt, Human
guguccuccugggguucuuu

SEQ ID NO: 1429220 - RNA, 13 nt, Human
guguccuacagaa

SEQ ID NO: 1429221 - RNA, 14 nt, Human
guguccuacagaaa

SEQ ID NO: 1429222 - RNA, 12 nt, Human
guguccuacaga

SEQ ID NO: 1429223 - RNA, 14 nt, Human
gugucccuaaugug

SEQ ID NO: 1429224 - RNA, 16 nt, Human
gugucucaggcugccu

SEQ ID NO: 1429225 - RNA, 15 nt, Human
gugucucaggcugcc

SEQ ID NO: 1429226 - RNA, 14 nt, Human
gugucucaggcugc

SEQ ID NO: 1429227 - RNA, 12 nt, Human
gugucucaggcu

SEQ ID NO: 1429228 - RNA, 11 nt, Human
gugucucaggc

SEQ ID NO: 1429229 - RNA, 20 nt, Human
gugucuaagauucuagauca

SEQ ID NO: 1429230 - RNA, 19 nt, Human
gugucuaagauucuagauc

SEQ ID NO: 1429231 - RNA, 18 nt, Human
gugucuaagauucuagau

SEQ ID NO: 1429232 - RNA, 17 nt, Human
gugucuaagauucuaga

SEQ ID NO: 1429233 - RNA, 16 nt, Human
gugucuaagauucuag

SEQ ID NO: 1429234 - RNA, 15 nt, Human
gugucuaagauucua

SEQ ID NO: 1429235 - RNA, 14 nt, Human
gugucuaagauucu

SEQ ID NO: 1429236 - RNA, 20 nt, Human
gugucucaggcugccugagu

SEQ ID NO: 1429237 - RNA, 19 nt, Human
gugucucaggcugccugag

SEQ ID NO: 1429238 - RNA, 17 nt, Human
gugucucaggcugccug

SEQ ID NO: 1429239 - RNA, 17 nt, Human
gugugcuuuuuuugugu

SEQ ID NO: 1429240 - RNA, 19 nt, Human
gugugcugggagcuccacu

SEQ ID NO: 1429241 - RNA, 12 nt, Human
gugugcugggag

SEQ ID NO: 1429242 - RNA, 11 nt, Human
gugugcuggga

SEQ ID NO: 1429243 - RNA, 23 nt, Human
gugugcucuccauucugcuccuu

SEQ ID NO: 1429244 - RNA, 22 nt, Human
gugugcucuccauucugcuccu

SEQ ID NO: 1429245 - RNA, 21 nt, Human
gugugcucuccauucugcucc

SEQ ID NO: 1429246 - RNA, 16 nt, Human
gugugcucuccauucu

SEQ ID NO: 1429247 - RNA, 15 nt, Human
gugugcucuccauuc

SEQ ID NO: 1429248 - RNA, 18 nt, Human
gugugcucaggagcccug

SEQ ID NO: 1429249 - RNA, 19 nt, Human
gugugcucaggagcccugg

SEQ ID NO: 1429250 - RNA, 21 nt, Human
gugugcccucugggcucugag

SEQ ID NO: 1429251 - RNA, 22 nt, Human
gugugcccucugggcucugagu

SEQ ID NO: 1429252 - RNA, 17 nt, Human
gugugcccucugggcuc

SEQ ID NO: 1429253 - RNA, 16 nt, Human
gugugcccucugggcu

SEQ ID NO: 1429254 - RNA, 13 nt, Human
gugugcccucugg

SEQ ID NO: 1429255 - RNA, 16 nt, Human
gugugcccccuucaag

SEQ ID NO: 1429256 - RNA, 16 nt, Human
gugugcggcugugugu

SEQ ID NO: 1429257 - RNA, 14 nt, Human
gugugcguccuguc

SEQ ID NO: 1429258 - RNA, 16 nt, Human
gugugcguccugucgg

SEQ ID NO: 1429259 - RNA, 16 nt, Human
gugugcucaggagccc

SEQ ID NO: 1429260 - RNA, 17 nt, Human
gugugcucaggagcccu

SEQ ID NO: 1429261 - RNA, 14 nt, Human
guguggcuccuucc

SEQ ID NO: 1429262 - RNA, 21 nt, Human
guguggagagggaaugugaaa

SEQ ID NO: 1429263 - RNA, 11 nt, Human
gugugggagac

SEQ ID NO: 1429264 - RNA, 19 nt, Human
guguggcuuucagagccuc

SEQ ID NO: 1429265 - RNA, 16 nt, Human
guguguugauacuguu

SEQ ID NO: 1429266 - RNA, 20 nt, Human
guguggagagggaaugugaa

SEQ ID NO: 1429267 - RNA, 18 nt, Human
guguggagagggaaugug

SEQ ID NO: 1429268 - RNA, 13 nt, Human
guguggacaggac

SEQ ID NO: 1429269 - RNA, 14 nt, Human
guguggacaggacu

SEQ ID NO: 1429270 - RNA, 21 nt, Human
guguggaaguuauuaacuuua

SEQ ID NO: 1429271 - RNA, 16 nt, Human
gugugcuuuuuuugug

SEQ ID NO: 1429272 - RNA, 16 nt, Human
guguguugucucuuga

SEQ ID NO: 1429273 - RNA, 14 nt, Human
guguguugucucuu

SEQ ID NO: 1429274 - RNA, 22 nt, Human
guguguugauacuguugcacgu

SEQ ID NO: 1429275 - RNA, 23 nt, Human
guguguugauacuguugcacgug

SEQ ID NO: 1429276 - RNA, 21 nt, Human
guguguugauacuguugcacg

SEQ ID NO: 1429277 - RNA, 20 nt, Human
guguguugauacuguugcac

SEQ ID NO: 1429278 - RNA, 19 nt, Human
guguguugauacuguugca

SEQ ID NO: 1429279 - RNA, 17 nt, Human
guguguugauacuguug

SEQ ID NO: 1429280 - RNA, 12 nt, Human
guguguuuuaaa

SEQ ID NO: 1429281 - RNA, 17 nt, Human
guuccugcugcugucug

SEQ ID NO: 1429282 - RNA, 22 nt, Human
guuccugcugcugucugggugc

SEQ ID NO: 1429283 - RNA, 15 nt, Human
guuccugcugcuguc

SEQ ID NO: 1429284 - RNA, 14 nt, Human
guuccugcugcugu

SEQ ID NO: 1429285 - RNA, 11 nt, Human
guuccugcugc

SEQ ID NO: 1429286 - RNA, 12 nt, Human
guuccugcaugc

SEQ ID NO: 1429287 - RNA, 12 nt, Human
guuccuucccaa

SEQ ID NO: 1429288 - RNA, 16 nt, Human
guuccuguggcucccu

SEQ ID NO: 1429289 - RNA, 14 nt, Human
guuccuguggcucc

SEQ ID NO: 1429290 - RNA, 23 nt, Human
guuccuccccuccagcucccugu

SEQ ID NO: 1429291 - RNA, 16 nt, Human
guuccuccccuccagc

SEQ ID NO: 1429292 - RNA, 19 nt, Human
guuccagggucccucugug

SEQ ID NO: 1429293 - RNA, 17 nt, Human
guuccagggucccucug

SEQ ID NO: 1429294 - RNA, 14 nt, Human
guuccagaaaguaa

SEQ ID NO: 1429295 - RNA, 19 nt, Human
guuccacuuauagccucug

SEQ ID NO: 1429296 - RNA, 17 nt, Human
guuccagaagugugacu

SEQ ID NO: 1429297 - RNA, 21 nt, Human
guuccagggucccucugugua

SEQ ID NO: 1429298 - RNA, 20 nt, Human
guuccagggucccucugugu

SEQ ID NO: 1429299 - RNA, 19 nt, Human
guuccuaagagugcugggc

SEQ ID NO: 1429300 - RNA, 15 nt, Human
guuccggcauggaca

SEQ ID NO: 1429301 - RNA, 14 nt, Human
guuccuagagaaga

SEQ ID NO: 1429302 - RNA, 23 nt, Human
guuccuagugauggcuuaugaua

SEQ ID NO: 1429303 - RNA, 18 nt, Human
guuccacuuauagccucu

SEQ ID NO: 1429304 - RNA, 14 nt, Human
guuccacugagacc

SEQ ID NO: 1429305 - RNA, 13 nt, Human
guuccacugagac

SEQ ID NO: 1429306 - RNA, 12 nt, Human
guuccacugaga

SEQ ID NO: 1429307 - RNA, 12 nt, Human
guuccacagacg

SEQ ID NO: 1429308 - RNA, 14 nt, Human
guuccacagaggac

SEQ ID NO: 1429309 - RNA, 11 nt, Human
guuccacagac

SEQ ID NO: 1429310 - RNA, 20 nt, Human
guuccaagagucuaaagaug

SEQ ID NO: 1429311 - RNA, 18 nt, Human
guuccaagagucuaaaga

SEQ ID NO: 1429312 - RNA, 16 nt, Human
guuccaagagucuaaa

SEQ ID NO: 1429313 - RNA, 14 nt, Human
guuccaagagucua

SEQ ID NO: 1429314 - RNA, 20 nt, Human
guuccaaauucaguuucaua

SEQ ID NO: 1429315 - RNA, 15 nt, Human
guuccaaauucaguu

SEQ ID NO: 1429316 - RNA, 14 nt, Human
guuccaaauucagu

SEQ ID NO: 1429317 - RNA, 19 nt, Human
guucauuagaaauauuuua

SEQ ID NO: 1429318 - RNA, 16 nt, Human
guucauuagaaauauu

SEQ ID NO: 1429319 - RNA, 18 nt, Human
guucauuagaaauauuuu

SEQ ID NO: 1429320 - RNA, 13 nt, Human
guucauuccucca

SEQ ID NO: 1429321 - RNA, 14 nt, Human
guucauuccuccag

SEQ ID NO: 1429322 - RNA, 13 nt, Human
guucauuugugua

SEQ ID NO: 1429323 - RNA, 13 nt, Human
guucauuuccuca

SEQ ID NO: 1429324 - RNA, 16 nt, Human
guucauugcacuuuga

SEQ ID NO: 1429325 - RNA, 15 nt, Human
guucauuccuccagg

SEQ ID NO: 1429326 - RNA, 22 nt, Human
guucagcacugucccuugccuc

SEQ ID NO: 1429327 - RNA, 16 nt, Human
guucagcacugucccu

SEQ ID NO: 1429328 - RNA, 15 nt, Human
guucagcacuguccc

SEQ ID NO: 1429329 - RNA, 14 nt, Human
guucagcacugucc

SEQ ID NO: 1429330 - RNA, 12 nt, Human
guucagccaagg

SEQ ID NO: 1429331 - RNA, 19 nt, Human
guucagcauggcauccaag

SEQ ID NO: 1429332 - RNA, 12 nt, Human
guucagaauuua

SEQ ID NO: 1429333 - RNA, 18 nt, Human
guucagcacugucccuug

SEQ ID NO: 1429334 - RNA, 15 nt, Human
guucagccaagguuu

SEQ ID NO: 1429335 - RNA, 12 nt, Human
guucaugaaaga

SEQ ID NO: 1429336 - RNA, 16 nt, Human
guucaugcagcugugg

SEQ ID NO: 1429337 - RNA, 15 nt, Human
guucaugcagcugug

SEQ ID NO: 1429338 - RNA, 14 nt, Human
guucaugagaaucu

SEQ ID NO: 1429339 - RNA, 19 nt, Human
guucaugagaaucuauauu

SEQ ID NO: 1429340 - RNA, 12 nt, Human
guucaugagaau

SEQ ID NO: 1429341 - RNA, 20 nt, Human
guucaugggggagggggcag

SEQ ID NO: 1429342 - RNA, 16 nt, Human
guucauguaaauaaua

SEQ ID NO: 1429343 - RNA, 22 nt, Human
guucauggcagauguaggaggg

SEQ ID NO: 1429344 - RNA, 19 nt, Human
guucagaguccuuaaaaug

SEQ ID NO: 1429345 - RNA, 22 nt, Human
guucagaauuuaguguauccau

SEQ ID NO: 1429346 - RNA, 20 nt, Human
guucagaauuaaacuuuuaa

SEQ ID NO: 1429347 - RNA, 20 nt, Human
guucacuuuugacaaaggca

SEQ ID NO: 1429348 - RNA, 16 nt, Human
guucacuuuugacaaa

SEQ ID NO: 1429349 - RNA, 17 nt, Human
guucaccauuauaauga

SEQ ID NO: 1429350 - RNA, 16 nt, Human
guucacaccagagaac

SEQ ID NO: 1429351 - RNA, 12 nt, Human
guucaauauuuu

SEQ ID NO: 1429352 - RNA, 21 nt, Human
guucaauauaagcuuuucuuu

SEQ ID NO: 1429353 - RNA, 13 nt, Human
guuaugcugugac

SEQ ID NO: 1429354 - RNA, 16 nt, Human
guuaugcaaaagcaag

SEQ ID NO: 1429355 - RNA, 20 nt, Human
guuaugauuuuuuuuucaua

SEQ ID NO: 1429356 - RNA, 19 nt, Human
guuauuaaaaaucucaaau

SEQ ID NO: 1429357 - RNA, 22 nt, Human
guuauuagagauuaccuccuga

SEQ ID NO: 1429358 - RNA, 21 nt, Human
guuauuaacuuuaauguuuuu

SEQ ID NO: 1429359 - RNA, 17 nt, Human
guuauuauauuuacaaa

SEQ ID NO: 1429360 - RNA, 13 nt, Human
guuauauauaaau

SEQ ID NO: 1429361 - RNA, 14 nt, Human
guuauauaauuuag

SEQ ID NO: 1429362 - RNA, 15 nt, Human
guuauauaauuuaga

SEQ ID NO: 1429363 - RNA, 12 nt, Human
guuauauaauuu

SEQ ID NO: 1429364 - RNA, 13 nt, Human
guuauauaaucau

SEQ ID NO: 1429365 - RNA, 21 nt, Human
guuauagugaauacugcuaca

SEQ ID NO: 1429366 - RNA, 20 nt, Human
guuauagacagucguuccca

SEQ ID NO: 1429367 - RNA, 14 nt, Human
guuauaagacucuc

SEQ ID NO: 1429368 - RNA, 13 nt, Human
guuauaagacucu

SEQ ID NO: 1429369 - RNA, 14 nt, Human
guuauauuuugcag

SEQ ID NO: 1429370 - RNA, 19 nt, Human
guuauauugaaaaaauaga

SEQ ID NO: 1429371 - RNA, 22 nt, Human
guuauauauggggaugguaguu

SEQ ID NO: 1429372 - RNA, 22 nt, Human
guuauauauaaauauauuauua

SEQ ID NO: 1429373 - RNA, 19 nt, Human
guuauauauaaauauauua

SEQ ID NO: 1429374 - RNA, 16 nt, Human
guuauauauaaauaua

SEQ ID NO: 1429375 - RNA, 14 nt, Human
guuauauauaaaua

SEQ ID NO: 1429376 - RNA, 20 nt, Human
guuaucaccuagcugaaugu

SEQ ID NO: 1429377 - RNA, 22 nt, Human
guuaucaccgugggcucccuga

SEQ ID NO: 1429378 - RNA, 20 nt, Human
guuaucaccgugggcucccu

SEQ ID NO: 1429379 - RNA, 17 nt, Human
guuaucagugcuucccg

SEQ ID NO: 1429380 - RNA, 16 nt, Human
guuaucagugcuuccc

SEQ ID NO: 1429381 - RNA, 13 nt, Human
guuaucagugcuu

SEQ ID NO: 1429382 - RNA, 17 nt, Human
guuaugacuauguaaac

SEQ ID NO: 1429383 - RNA, 23 nt, Human
guuaucuucucaaguucuaagau

SEQ ID NO: 1429384 - RNA, 21 nt, Human
guuaucuucucaaguucuaag

SEQ ID NO: 1429385 - RNA, 19 nt, Human
guuaucuucucaaguucua

SEQ ID NO: 1429386 - RNA, 18 nt, Human
guuaucuucucaaguucu

SEQ ID NO: 1429387 - RNA, 20 nt, Human
guuaugaaauucacccccuu

SEQ ID NO: 1429388 - RNA, 22 nt, Human
guuaucuucucaaguucuaaga

SEQ ID NO: 1429389 - RNA, 15 nt, Human
guuaugacuauguaa

SEQ ID NO: 1429390 - RNA, 20 nt, Human
guuauccaccugccuuggcu

SEQ ID NO: 1429391 - RNA, 21 nt, Human
guuaucuaaguuaauuuaaag

SEQ ID NO: 1429392 - RNA, 18 nt, Human
guuaucuaaguuaauuua

SEQ ID NO: 1429393 - RNA, 15 nt, Human
guuaucuaaguuaau

SEQ ID NO: 1429394 - RNA, 12 nt, Human
guuaucucugug

SEQ ID NO: 1429395 - RNA, 19 nt, Human
guuaucuaauagggcaauu

SEQ ID NO: 1429396 - RNA, 14 nt, Human
guuaucucuguguu

SEQ ID NO: 1429397 - RNA, 13 nt, Human
guuaucucugugu

SEQ ID NO: 1429398 - RNA, 15 nt, Human
guuauaaagauacag

SEQ ID NO: 1429399 - RNA, 14 nt, Human
guuauaaagauaca

SEQ ID NO: 1429400 - RNA, 16 nt, Human
guuauaaaaaaugguu

SEQ ID NO: 1429401 - RNA, 22 nt, Human
guuauaaaaaaugguucagaau

SEQ ID NO: 1429402 - RNA, 15 nt, Human
guuauaaaaaauggu

SEQ ID NO: 1429403 - RNA, 21 nt, Human
guuaguuuguauauauuauua

SEQ ID NO: 1429404 - RNA, 17 nt, Human
guuaguuuguauauauu

SEQ ID NO: 1429405 - RNA, 16 nt, Human
guuaguuuguauauau

SEQ ID NO: 1429406 - RNA, 16 nt, Human
guuaguuccacugaga

SEQ ID NO: 1429407 - RNA, 18 nt, Human
guuacguagccuaaggcu

SEQ ID NO: 1429408 - RNA, 22 nt, Human
guuaccuuauaguuacugugua

SEQ ID NO: 1429409 - RNA, 20 nt, Human
guuaccuuauaguuacugug

SEQ ID NO: 1429410 - RNA, 18 nt, Human
guuaccuuauaguuacug

SEQ ID NO: 1429411 - RNA, 15 nt, Human
guuaccuuauaguua

SEQ ID NO: 1429412 - RNA, 15 nt, Human
guuacuacaugcacu

SEQ ID NO: 1429413 - RNA, 22 nt, Human
guuacuaaguuuuuauggcuuu

SEQ ID NO: 1429414 - RNA, 15 nt, Human
guuacucagaauucu

SEQ ID NO: 1429415 - RNA, 16 nt, Human
guuacauguuugcacc

SEQ ID NO: 1429416 - RNA, 14 nt, Human
guuacauguuugca

SEQ ID NO: 1429417 - RNA, 15 nt, Human
guuacaguucugugg

SEQ ID NO: 1429418 - RNA, 14 nt, Human
guuacaguucugug

SEQ ID NO: 1429419 - RNA, 13 nt, Human
guuacaguucugu

SEQ ID NO: 1429420 - RNA, 13 nt, Human
guuacagaagcug

SEQ ID NO: 1429421 - RNA, 21 nt, Human
guuaccauuaaaccaucuccc

SEQ ID NO: 1429422 - RNA, 19 nt, Human
guuaccauuaaaccaucuc

SEQ ID NO: 1429423 - RNA, 16 nt, Human
guuaccauuaaaccau

SEQ ID NO: 1429424 - RNA, 15 nt, Human
guuaccaugucuuuc

SEQ ID NO: 1429425 - RNA, 21 nt, Human
guuacauuuuuaagugcugca

SEQ ID NO: 1429426 - RNA, 23 nt, Human
guuaccauuaaaccaucucccug

SEQ ID NO: 1429427 - RNA, 16 nt, Human
guuacccaaauuaaga

SEQ ID NO: 1429428 - RNA, 16 nt, Human
guuaccuacuuugacu

SEQ ID NO: 1429429 - RNA, 13 nt, Human
guuaccuacuuug

SEQ ID NO: 1429430 - RNA, 20 nt, Human
guuacccaguaacucaucug

SEQ ID NO: 1429431 - RNA, 16 nt, Human
guuaccauuuacaugu

SEQ ID NO: 1429432 - RNA, 13 nt, Human
guuaccuguagau

SEQ ID NO: 1429433 - RNA, 22 nt, Human
guuaccugaaaacacugugcac

SEQ ID NO: 1429434 - RNA, 21 nt, Human
guuaccucuauauaccaaagc

SEQ ID NO: 1429435 - RNA, 17 nt, Human
guuaccucuauauacca

SEQ ID NO: 1429436 - RNA, 23 nt, Human
guuaccucugccucagaaaacaa

SEQ ID NO: 1429437 - RNA, 20 nt, Human
guuggcaggcuggccagucc

SEQ ID NO: 1429438 - RNA, 17 nt, Human
guuggcaggcuggccag

SEQ ID NO: 1429439 - RNA, 16 nt, Human
guuggcaggcuggcca

SEQ ID NO: 1429440 - RNA, 15 nt, Human
guuggcaggcuggcc

SEQ ID NO: 1429441 - RNA, 14 nt, Human
guuggcaggcuggc

SEQ ID NO: 1429442 - RNA, 13 nt, Human
guuggcaggcugg

SEQ ID NO: 1429443 - RNA, 18 nt, Human
guuggcauagcucugggg

SEQ ID NO: 1429444 - RNA, 15 nt, Human
guuggcauagcucug

SEQ ID NO: 1429445 - RNA, 19 nt, Human
guuggcauagcucuggggu

SEQ ID NO: 1429446 - RNA, 19 nt, Human
guugccaagcuccaagccc

SEQ ID NO: 1429447 - RNA, 18 nt, Human
guugccaagcuccaagcc

SEQ ID NO: 1429448 - RNA, 15 nt, Human
guugccaagcuccaa

SEQ ID NO: 1429449 - RNA, 21 nt, Human
guugccaaauauguccugggg

SEQ ID NO: 1429450 - RNA, 23 nt, Human
guugccauccuaccgucuuuucc

SEQ ID NO: 1429451 - RNA, 21 nt, Human
guuggacaccuuuagguucuu

SEQ ID NO: 1429452 - RNA, 17 nt, Human
guuggacaagcuucuga

SEQ ID NO: 1429453 - RNA, 22 nt, Human
guuggaauggauuuuucuuuaa

SEQ ID NO: 1429454 - RNA, 17 nt, Human
guuggagcuccagccug

SEQ ID NO: 1429455 - RNA, 13 nt, Human
guuggagcuccag

SEQ ID NO: 1429456 - RNA, 14 nt, Human
guuggagugcagug

SEQ ID NO: 1429457 - RNA, 15 nt, Human
guuggagugcagugg

SEQ ID NO: 1429458 - RNA, 23 nt, Human
guugcacguguguuuuucuauua

SEQ ID NO: 1429459 - RNA, 22 nt, Human
guugcacguguguuuuucuauu

SEQ ID NO: 1429460 - RNA, 21 nt, Human
guugcacguguguuuuucuau

SEQ ID NO: 1429461 - RNA, 19 nt, Human
guugcacguguguuuuucu

SEQ ID NO: 1429462 - RNA, 17 nt, Human
guugcacguguguuuuu

SEQ ID NO: 1429463 - RNA, 15 nt, Human
guugcagacaggaau

SEQ ID NO: 1429464 - RNA, 14 nt, Human
guugcagacaggaa

SEQ ID NO: 1429465 - RNA, 20 nt, Human
guugccaaauauguccuggg

SEQ ID NO: 1429466 - RNA, 19 nt, Human
guugccaaauauguccugg

SEQ ID NO: 1429467 - RNA, 23 nt, Human
guugcauuuguuuuguuuacaga

SEQ ID NO: 1429468 - RNA, 16 nt, Human
guugcauguaguaaca

SEQ ID NO: 1429469 - RNA, 20 nt, Human
guugcauuaaaaaugcauau

SEQ ID NO: 1429470 - RNA, 20 nt, Human
guugcauguaguaacacuaa

SEQ ID NO: 1429471 - RNA, 17 nt, Human
guugcagucacucuagu

SEQ ID NO: 1429472 - RNA, 23 nt, Human
guugcagcuguuuuguugacauu

SEQ ID NO: 1429473 - RNA, 20 nt, Human
guugcagcuguuuuguugac

SEQ ID NO: 1429474 - RNA, 20 nt, Human
guugcagacaggaaucuuaa

SEQ ID NO: 1429475 - RNA, 16 nt, Human
guugcagacaggaauc

SEQ ID NO: 1429476 - RNA, 23 nt, Human
guugcagcccugcugcugccugc

SEQ ID NO: 1429477 - RNA, 15 nt, Human
guugcacacuuuggu

SEQ ID NO: 1429478 - RNA, 14 nt, Human
guugcacacuuugg

SEQ ID NO: 1429479 - RNA, 16 nt, Human
guugcacagcuaugaa

SEQ ID NO: 1429480 - RNA, 23 nt, Human
guugauuuuuuuuuuuuuuuccu

SEQ ID NO: 1429481 - RNA, 16 nt, Human
guugcaacuuuguaua

SEQ ID NO: 1429482 - RNA, 23 nt, Human
guugauucgguauccccccaucu

SEQ ID NO: 1429483 - RNA, 16 nt, Human
guugauuacagugcag

SEQ ID NO: 1429484 - RNA, 22 nt, Human
guugauuuuuuuuuuuuuuucc

SEQ ID NO: 1429485 - RNA, 14 nt, Human
guugcaacuuugua

SEQ ID NO: 1429486 - RNA, 23 nt, Human
guugaaagguuuuuuuucaguug

SEQ ID NO: 1429487 - RNA, 18 nt, Human
guugaagcaaaucgaaug

SEQ ID NO: 1429488 - RNA, 18 nt, Human
guugaagagguuuuaaag

SEQ ID NO: 1429489 - RNA, 14 nt, Human
guugaaagguuuuu

SEQ ID NO: 1429490 - RNA, 13 nt, Human
guugaaagguuuu

SEQ ID NO: 1429491 - RNA, 16 nt, Human
guugaaauaugauguu

SEQ ID NO: 1429492 - RNA, 21 nt, Human
guugaaagguuuuuuuucagu

SEQ ID NO: 1429493 - RNA, 20 nt, Human
guugaaagguuuuuuuucag

SEQ ID NO: 1429494 - RNA, 14 nt, Human
guugauuaaagaug

SEQ ID NO: 1429495 - RNA, 21 nt, Human
guugauggugguauguuuuca

SEQ ID NO: 1429496 - RNA, 20 nt, Human
guugauggugguauguuuuc

SEQ ID NO: 1429497 - RNA, 23 nt, Human
guugaagcaaaucgaaugaaauu

SEQ ID NO: 1429498 - RNA, 17 nt, Human
guugaauacuuuuuaca

SEQ ID NO: 1429499 - RNA, 13 nt, Human
guugaauacuuuu

SEQ ID NO: 1429500 - RNA, 17 nt, Human
guucugcuccagacagg

SEQ ID NO: 1429501 - RNA, 20 nt, Human
guucugcuccagacagggaa

SEQ ID NO: 1429502 - RNA, 16 nt, Human
guucugcuccagacag

SEQ ID NO: 1429503 - RNA, 23 nt, Human
guucugcucaucauucucugucu

SEQ ID NO: 1429504 - RNA, 18 nt, Human
guucugcucaucauucuc

SEQ ID NO: 1429505 - RNA, 15 nt, Human
guucugcucaucauu

SEQ ID NO: 1429506 - RNA, 22 nt, Human
guucugcucugguuguuucugu

SEQ ID NO: 1429507 - RNA, 14 nt, Human
guucugcucugguu

SEQ ID NO: 1429508 - RNA, 21 nt, Human
guugaaaaaguuuguuuuugc

SEQ ID NO: 1429509 - RNA, 22 nt, Human
guugaaaauaaaguguauauuu

SEQ ID NO: 1429510 - RNA, 19 nt, Human
guugaaaaaguuuguuuuu

SEQ ID NO: 1429511 - RNA, 20 nt, Human
guucuuuguucauagcccag

SEQ ID NO: 1429512 - RNA, 13 nt, Human
guucuuuguucau

SEQ ID NO: 1429513 - RNA, 22 nt, Human
guucuuugggccagacaugcca

SEQ ID NO: 1429514 - RNA, 17 nt, Human
guucuuugggccagaca

SEQ ID NO: 1429515 - RNA, 16 nt, Human
guucuuugggccagac

SEQ ID NO: 1429516 - RNA, 15 nt, Human
guucuuugggccaga

SEQ ID NO: 1429517 - RNA, 11 nt, Human
guucuuuggaa

SEQ ID NO: 1429518 - RNA, 23 nt, Human
guucuuugcugcauucugccucu

SEQ ID NO: 1429519 - RNA, 19 nt, Human
guucuuuuugaaguauuua

SEQ ID NO: 1429520 - RNA, 21 nt, Human
guucuuuguucauagcccagu

SEQ ID NO: 1429521 - RNA, 22 nt, Human
guucuuucauuugcuuuggaag

SEQ ID NO: 1429522 - RNA, 20 nt, Human
guucuuucauuugcuuugga

SEQ ID NO: 1429523 - RNA, 16 nt, Human
guucuggcuguuugag

SEQ ID NO: 1429524 - RNA, 13 nt, Human
guucuuuccaaag

SEQ ID NO: 1429525 - RNA, 14 nt, Human
guucuuuccaaagu

SEQ ID NO: 1429526 - RNA, 18 nt, Human
guucuuuccaaaguacac

SEQ ID NO: 1429527 - RNA, 20 nt, Human
guucuuuccaaaguacacug

SEQ ID NO: 1429528 - RNA, 23 nt, Human
guucugccugccagcugcacuga

SEQ ID NO: 1429529 - RNA, 22 nt, Human
guucugccugccagcugcacug

SEQ ID NO: 1429530 - RNA, 19 nt, Human
guucugccugccagcugca

SEQ ID NO: 1429531 - RNA, 17 nt, Human
guucugccugccagcug

SEQ ID NO: 1429532 - RNA, 15 nt, Human
guucugccugccagc

SEQ ID NO: 1429533 - RNA, 13 nt, Human
guucugccugcca

SEQ ID NO: 1429534 - RNA, 14 nt, Human
guucugccaggaga

SEQ ID NO: 1429535 - RNA, 13 nt, Human
guucugccaggag

SEQ ID NO: 1429536 - RNA, 12 nt, Human
guucugccagga

SEQ ID NO: 1429537 - RNA, 20 nt, Human
guucugagauggcucccagg

SEQ ID NO: 1429538 - RNA, 21 nt, Human
guucugagauggcucccaggg

SEQ ID NO: 1429539 - RNA, 15 nt, Human
guucugaagaagaug

SEQ ID NO: 1429540 - RNA, 14 nt, Human
guucugaagaagau

SEQ ID NO: 1429541 - RNA, 19 nt, Human
guucuaauaauuucuaaug

SEQ ID NO: 1429542 - RNA, 17 nt, Human
guucuaauaauuucuaa

SEQ ID NO: 1429543 - RNA, 22 nt, Human
guucuaaguuucuaagauucua

SEQ ID NO: 1429544 - RNA, 21 nt, Human
guucuaaguuucuaagauucu

SEQ ID NO: 1429545 - RNA, 19 nt, Human
guucuaaguuucuaagauu

SEQ ID NO: 1429546 - RNA, 18 nt, Human
guucuaaguuucuaagau

SEQ ID NO: 1429547 - RNA, 17 nt, Human
guucuaaguuucuaaga

SEQ ID NO: 1429548 - RNA, 16 nt, Human
guucuaaguuucuaag

SEQ ID NO: 1429549 - RNA, 15 nt, Human
guucuaaguuucuaa

SEQ ID NO: 1429550 - RNA, 14 nt, Human
guucuaaguuucua

SEQ ID NO: 1429551 - RNA, 19 nt, Human
guucuaagucuuuccauug

SEQ ID NO: 1429552 - RNA, 17 nt, Human
guucuaagucuuuccau

SEQ ID NO: 1429553 - RNA, 13 nt, Human
guucugaagaaga

SEQ ID NO: 1429554 - RNA, 12 nt, Human
guucugaagaag

SEQ ID NO: 1429555 - RNA, 16 nt, Human
guucuaagucuuucca

SEQ ID NO: 1429556 - RNA, 17 nt, Human
guucuaaggcucugaga

SEQ ID NO: 1429557 - RNA, 16 nt, Human
guucuaaggcucugag

SEQ ID NO: 1429558 - RNA, 14 nt, Human
guucuaaggcucug

SEQ ID NO: 1429559 - RNA, 13 nt, Human
guucuaaggcucu

SEQ ID NO: 1429560 - RNA, 12 nt, Human
guucuaaggcuc

SEQ ID NO: 1429561 - RNA, 11 nt, Human
guucuaaggcu

SEQ ID NO: 1429562 - RNA, 23 nt, Human
guucuaaggccuaggauucuaaa

SEQ ID NO: 1429563 - RNA, 22 nt, Human
guucuaaggccuaggauucuaa

SEQ ID NO: 1429564 - RNA, 21 nt, Human
guucuaaggccuaggauucua

SEQ ID NO: 1429565 - RNA, 20 nt, Human
guucuaaggccuaggauucu

SEQ ID NO: 1429566 - RNA, 13 nt, Human
guucuaaggccua

SEQ ID NO: 1429567 - RNA, 11 nt, Human
guucuaaggcc

SEQ ID NO: 1429568 - RNA, 15 nt, Human
guucuaagauucuga

SEQ ID NO: 1429569 - RNA, 14 nt, Human
guucuaagauucug

SEQ ID NO: 1429570 - RNA, 20 nt, Human
guucuaagauucuaaugaug

SEQ ID NO: 1429571 - RNA, 17 nt, Human
guucuaagauucuaaug

SEQ ID NO: 1429572 - RNA, 15 nt, Human
guucuaagauucuaa

SEQ ID NO: 1429573 - RNA, 14 nt, Human
guucuaagauucua

SEQ ID NO: 1429574 - RNA, 13 nt, Human
guucuaagauucu

SEQ ID NO: 1429575 - RNA, 22 nt, Human
guucuaagaugugauauucuaa

SEQ ID NO: 1429576 - RNA, 21 nt, Human
guucuaagaugugauauucua

SEQ ID NO: 1429577 - RNA, 13 nt, Human
guucuaagaugug

SEQ ID NO: 1429578 - RNA, 21 nt, Human
guucuaagacucaaauguucu

SEQ ID NO: 1429579 - RNA, 20 nt, Human
guucuaagacucaaauguuc

SEQ ID NO: 1429580 - RNA, 17 nt, Human
guucuaagacucaaaug

SEQ ID NO: 1429581 - RNA, 15 nt, Human
guucuaagacucaaa

SEQ ID NO: 1429582 - RNA, 16 nt, Human
guucuaaccuuuacau

SEQ ID NO: 1429583 - RNA, 13 nt, Human
guucuaaccuccu

SEQ ID NO: 1429584 - RNA, 21 nt, Human
guucuaaaguucuaagauucu

SEQ ID NO: 1429585 - RNA, 19 nt, Human
guucuaaaguucuaagauu

SEQ ID NO: 1429586 - RNA, 18 nt, Human
guucuaaaguucuaagau

SEQ ID NO: 1429587 - RNA, 17 nt, Human
guucuaaaguucuaaga

SEQ ID NO: 1429588 - RNA, 16 nt, Human
guucuaaaguucuaag

SEQ ID NO: 1429589 - RNA, 15 nt, Human
guucuaaaguucuaa

SEQ ID NO: 1429590 - RNA, 14 nt, Human
guucuaaaguucua

SEQ ID NO: 1429591 - RNA, 13 nt, Human
guucuaaaguucu

SEQ ID NO: 1429592 - RNA, 12 nt, Human
guucuaaaguuc

SEQ ID NO: 1429593 - RNA, 16 nt, Human
guucuaaagcucugac

SEQ ID NO: 1429594 - RNA, 14 nt, Human
guucuaaagcucug

SEQ ID NO: 1429595 - RNA, 12 nt, Human
guucuaaagcuc

SEQ ID NO: 1429596 - RNA, 10 nt, Human
guucuaaagc

SEQ ID NO: 1429597 - RNA, 16 nt, Human
guucuaaaagguguga

SEQ ID NO: 1429598 - RNA, 19 nt, Human
guucuaaaaauugugauca

SEQ ID NO: 1429599 - RNA, 20 nt, Human
guucgcagccacccugagga

SEQ ID NO: 1429600 - RNA, 20 nt, Human
guucgcauggucacacacug

SEQ ID NO: 1429601 - RNA, 14 nt, Human
guucgcauggucac

SEQ ID NO: 1429602 - RNA, 19 nt, Human
guucgcagccacccugagg

SEQ ID NO: 1429603 - RNA, 17 nt, Human
guucgcagccacccuga

SEQ ID NO: 1429604 - RNA, 16 nt, Human
guucgcagccacccug

SEQ ID NO: 1429605 - RNA, 15 nt, Human
guucgcagccacccu

SEQ ID NO: 1429606 - RNA, 13 nt, Human
guucgcagccacc

SEQ ID NO: 1429607 - RNA, 20 nt, Human
guuccuucccugugccuccu

SEQ ID NO: 1429608 - RNA, 17 nt, Human
guuccuucccaauccag

SEQ ID NO: 1429609 - RNA, 14 nt, Human
guuccuucccaauc

SEQ ID NO: 1429610 - RNA, 13 nt, Human
guuccuucccaau

SEQ ID NO: 1429611 - RNA, 13 nt, Human
guuccuuucuuuu

SEQ ID NO: 1429612 - RNA, 18 nt, Human
guuccuuggccaugcaga

SEQ ID NO: 1429613 - RNA, 21 nt, Human
uaaacauuaauagcagccuuu

SEQ ID NO: 1429614 - RNA, 22 nt, Human
uaaacauuaauagcagccuuuc

SEQ ID NO: 1429615 - RNA, 20 nt, Human
uaaacauuaauagcagccuu

SEQ ID NO: 1429616 - RNA, 22 nt, Human
uaaacuguguauuccaagacau

SEQ ID NO: 1429617 - RNA, 17 nt, Human
uaaacuguguauuccaa

SEQ ID NO: 1429618 - RNA, 18 nt, Human
uaaacuguguacauaacu

SEQ ID NO: 1429619 - RNA, 15 nt, Human
uaaacuguguacaua

SEQ ID NO: 1429620 - RNA, 20 nt, Human
uaaacuguacagugucuuuu

SEQ ID NO: 1429621 - RNA, 14 nt, Human
uaaacugugcacca

SEQ ID NO: 1429622 - RNA, 12 nt, Human
uaaacugugcac

SEQ ID NO: 1429623 - RNA, 19 nt, Human
uaaacuguacagugucuuu

SEQ ID NO: 1429624 - RNA, 15 nt, Human
uaaagaaaaacaaac

SEQ ID NO: 1429625 - RNA, 14 nt, Human
uaaagaaaaacaaa

SEQ ID NO: 1429626 - RNA, 23 nt, Human
uaaagaaaaaaauugaaauguaa

SEQ ID NO: 1429627 - RNA, 22 nt, Human
uaaagaaaaaaauugaaaugua

SEQ ID NO: 1429628 - RNA, 21 nt, Human
uaaagaaaaaaauugaaaugu

SEQ ID NO: 1429629 - RNA, 20 nt, Human
uaaagaaaaaaauugaaaug

SEQ ID NO: 1429630 - RNA, 18 nt, Human
uaaagaaaaaaauugaaa

SEQ ID NO: 1429631 - RNA, 17 nt, Human
uaaagaaaaaaauugaa

SEQ ID NO: 1429632 - RNA, 16 nt, Human
uaaagaaaaaaauuga

SEQ ID NO: 1429633 - RNA, 15 nt, Human
uaaagaaaaaaauug

SEQ ID NO: 1429634 - RNA, 23 nt, Human
uaaagaaaaaaauguauuuuaug

SEQ ID NO: 1429635 - RNA, 17 nt, Human
uaaagaaaaaaauguau

SEQ ID NO: 1429636 - RNA, 16 nt, Human
uaaagaaaaaaaugua

SEQ ID NO: 1429637 - RNA, 11 nt, Human
uaaagaaaaaa

SEQ ID NO: 1429638 - RNA, 12 nt, Human
uaaagaaaaaaa

SEQ ID NO: 1429639 - RNA, 9 nt, Human
uaaagaaaa

SEQ ID NO: 1429640 - RNA, 20 nt, Human
uaaacuuuuuuucuguacca

SEQ ID NO: 1429641 - RNA, 18 nt, Human
uaaacuuccccaucuucu

SEQ ID NO: 1429642 - RNA, 18 nt, Human
uaaacuguacagugucuu

SEQ ID NO: 1429643 - RNA, 16 nt, Human
uaaacuuauaacccac

SEQ ID NO: 1429644 - RNA, 13 nt, Human
uaaacuuaaucua

SEQ ID NO: 1429645 - RNA, 19 nt, Human
uaaaaucuugucaugugua

SEQ ID NO: 1429646 - RNA, 14 nt, Human
uaaaaucuugucau

SEQ ID NO: 1429647 - RNA, 12 nt, Human
uaaaaucuuguc

SEQ ID NO: 1429648 - RNA, 11 nt, Human
uaaaaucuugu

SEQ ID NO: 1429649 - RNA, 20 nt, Human
uaaacaagaccacguuucua

SEQ ID NO: 1429650 - RNA, 21 nt, Human
uaaacaagaccacguuucuaa

SEQ ID NO: 1429651 - RNA, 22 nt, Human
uaaacaagaccacguuucuaaa

SEQ ID NO: 1429652 - RNA, 19 nt, Human
uaaaaucuuauaguucuag

SEQ ID NO: 1429653 - RNA, 18 nt, Human
uaaaaucuuauaguucua

SEQ ID NO: 1429654 - RNA, 17 nt, Human
uaaaaucuuauaguucu

SEQ ID NO: 1429655 - RNA, 13 nt, Human
uaaaaucuuauag

SEQ ID NO: 1429656 - RNA, 14 nt, Human
uaaaaucugucacg

SEQ ID NO: 1429657 - RNA, 13 nt, Human
uaaaaucugucac

SEQ ID NO: 1429658 - RNA, 18 nt, Human
uaaaauccauacauuugu

SEQ ID NO: 1429659 - RNA, 18 nt, Human
uaaaaucuugucaugugu

SEQ ID NO: 1429660 - RNA, 16 nt, Human
uaaaaucuugucaugu

SEQ ID NO: 1429661 - RNA, 15 nt, Human
uaaaaucuugucaug

SEQ ID NO: 1429662 - RNA, 23 nt, Human
uaaacaagaccacguuucuaaag

SEQ ID NO: 1429663 - RNA, 15 nt, Human
uaaacacucuugaaa

SEQ ID NO: 1429664 - RNA, 17 nt, Human
uaaacacucuugaaaaa

SEQ ID NO: 1429665 - RNA, 17 nt, Human
uaaacaucauucauuuu

SEQ ID NO: 1429666 - RNA, 15 nt, Human
uaaacaucauucauu

SEQ ID NO: 1429667 - RNA, 18 nt, Human
uaaacaucaaucuuuaaa

SEQ ID NO: 1429668 - RNA, 15 nt, Human
uaaacaucaaucuuu

SEQ ID NO: 1429669 - RNA, 18 nt, Human
uaaacacucuugaaaaau

SEQ ID NO: 1429670 - RNA, 17 nt, Human
uaaagcaauaugcauuu

SEQ ID NO: 1429671 - RNA, 15 nt, Human
uaaagcaauaugcau

SEQ ID NO: 1429672 - RNA, 18 nt, Human
uaaagaaaagaugcacuu

SEQ ID NO: 1429673 - RNA, 18 nt, Human
uaaagaaaaucucuguga

SEQ ID NO: 1429674 - RNA, 15 nt, Human
uaaagaaaagaugca

SEQ ID NO: 1429675 - RNA, 14 nt, Human
uaaagaaaagaugc

SEQ ID NO: 1429676 - RNA, 13 nt, Human
uaaagaaaagaug

SEQ ID NO: 1429677 - RNA, 12 nt, Human
uaaagaaaagau

SEQ ID NO: 1429678 - RNA, 18 nt, Human
uaaagcaggcagaacuca

SEQ ID NO: 1429679 - RNA, 19 nt, Human
uaaagcagcguuucuauga

SEQ ID NO: 1429680 - RNA, 16 nt, Human
uaaagcagcguuucua

SEQ ID NO: 1429681 - RNA, 17 nt, Human
uaaagcagcguuucuau

SEQ ID NO: 1429682 - RNA, 16 nt, Human
uaaagcagguucuugu

SEQ ID NO: 1429683 - RNA, 20 nt, Human
uaaagcaggccuuuugauau

SEQ ID NO: 1429684 - RNA, 19 nt, Human
uaaagcaggccuuuugaua

SEQ ID NO: 1429685 - RNA, 18 nt, Human
uaaagcaggccuuuugau

SEQ ID NO: 1429686 - RNA, 12 nt, Human
uaaagccuccuc

SEQ ID NO: 1429687 - RNA, 11 nt, Human
uaaagccucaa

SEQ ID NO: 1429688 - RNA, 15 nt, Human
uaaagccaugcugga

SEQ ID NO: 1429689 - RNA, 17 nt, Human
uaaagcagguucuuguu

SEQ ID NO: 1429690 - RNA, 12 nt, Human
uaaaguucuaag

SEQ ID NO: 1429691 - RNA, 18 nt, Human
uaaaguucaacauguuau

SEQ ID NO: 1429692 - RNA, 15 nt, Human
uaaaguucaacaugu

SEQ ID NO: 1429693 - RNA, 20 nt, Human
uaaaguuaguaucuuuugau

SEQ ID NO: 1429694 - RNA, 14 nt, Human
uaaaguuaaguuga

SEQ ID NO: 1429695 - RNA, 14 nt, Human
uaaaguguuugaaa

SEQ ID NO: 1429696 - RNA, 17 nt, Human
uaaaggcuaccuuugua

SEQ ID NO: 1429697 - RNA, 23 nt, Human
uaaagcuuucagaauaugucagu

SEQ ID NO: 1429698 - RNA, 19 nt, Human
uaaagcuuucagaauaugu

SEQ ID NO: 1429699 - RNA, 11 nt, Human
uaaagcuuguc

SEQ ID NO: 1429700 - RNA, 19 nt, Human
uaaagcuugcaacaaaauu

SEQ ID NO: 1429701 - RNA, 19 nt, Human
uaaagcugguuuaauguuu

SEQ ID NO: 1429702 - RNA, 15 nt, Human
uaaagcugguuuaau

SEQ ID NO: 1429703 - RNA, 21 nt, Human
uaaagccucaagguuuuaggu

SEQ ID NO: 1429704 - RNA, 17 nt, Human
uaaaggcaguuuucuaa

SEQ ID NO: 1429705 - RNA, 15 nt, Human
uaaaggcuaccuuug

SEQ ID NO: 1429706 - RNA, 14 nt, Human
uaaaggcaguuuuc

SEQ ID NO: 1429707 - RNA, 16 nt, Human
uaaaggaaaagacaca

SEQ ID NO: 1429708 - RNA, 17 nt, Human
uaaaggaaaagacacau

SEQ ID NO: 1429709 - RNA, 14 nt, Human
uaaaggaaaagaca

SEQ ID NO: 1429710 - RNA, 11 nt, Human
uaaaggaaaag

SEQ ID NO: 1429711 - RNA, 14 nt, Human
uaaaggaauuuaaa

SEQ ID NO: 1429712 - RNA, 21 nt, Human
uaaaacagguagaauuaucua

SEQ ID NO: 1429713 - RNA, 19 nt, Human
uaaaacagacacuggcaug

SEQ ID NO: 1429714 - RNA, 18 nt, Human
uaaaacagacacuggcau

SEQ ID NO: 1429715 - RNA, 17 nt, Human
uaaaacagacacuggca

SEQ ID NO: 1429716 - RNA, 15 nt, Human
uaaaacagacacugg

SEQ ID NO: 1429717 - RNA, 13 nt, Human
uaaaacagacacu

SEQ ID NO: 1429718 - RNA, 14 nt, Human
uaaaacagaagccu

SEQ ID NO: 1429719 - RNA, 11 nt, Human
uaaaacacuug

SEQ ID NO: 1429720 - RNA, 14 nt, Human
uaaaacacacaggu

SEQ ID NO: 1429721 - RNA, 13 nt, Human
uaaaacaaugaau

SEQ ID NO: 1429722 - RNA, 22 nt, Human
uaaaaauuguuaauuuuuccua

SEQ ID NO: 1429723 - RNA, 17 nt, Human
uaaaaauugugaucaga

SEQ ID NO: 1429724 - RNA, 23 nt, Human
uaaaaauuaaauuggaaagcagg

SEQ ID NO: 1429725 - RNA, 21 nt, Human
uaaaaauguucuauuuuaauu

SEQ ID NO: 1429726 - RNA, 22 nt, Human
uaaaacaagcacuaaacaaaga

SEQ ID NO: 1429727 - RNA, 20 nt, Human
uaaaaagauugaaguauuuu

SEQ ID NO: 1429728 - RNA, 18 nt, Human
uaaaaagauugaaguauu

SEQ ID NO: 1429729 - RNA, 14 nt, Human
uaaaaagaucacuu

SEQ ID NO: 1429730 - RNA, 13 nt, Human
uaaaaagaaaggc

SEQ ID NO: 1429731 - RNA, 15 nt, Human
uaaaaagaagugcug

SEQ ID NO: 1429732 - RNA, 22 nt, Human
uaaaaacagauuuggaaagacu

SEQ ID NO: 1429733 - RNA, 20 nt, Human
uaaaaacagauuuggaaaga

SEQ ID NO: 1429734 - RNA, 20 nt, Human
guuuuguuucgcucuuugag

SEQ ID NO: 1429735 - RNA, 14 nt, Human
guuuuguuuacaga

SEQ ID NO: 1429736 - RNA, 21 nt, Human
guuuuuacaaauguuaaaaug

SEQ ID NO: 1429737 - RNA, 13 nt, Human
guuuuuaauguau

SEQ ID NO: 1429738 - RNA, 12 nt, Human
guuuuuaaugua

SEQ ID NO: 1429739 - RNA, 13 nt, Human
guuuuguuuacag

SEQ ID NO: 1429740 - RNA, 19 nt, Human
guuuuuaauaaaagaaaau

SEQ ID NO: 1429741 - RNA, 18 nt, Human
guuuuuaauguauaguaa

SEQ ID NO: 1429742 - RNA, 21 nt, Human
uaaaaacaaagaaauuaugug

SEQ ID NO: 1429743 - RNA, 20 nt, Human
uaaaacauuuauuuugacau

SEQ ID NO: 1429744 - RNA, 14 nt, Human
uaaaacauuuauuu

SEQ ID NO: 1429745 - RNA, 12 nt, Human
uaaaacauuaau

SEQ ID NO: 1429746 - RNA, 19 nt, Human
uaaaacauuaaaauauaau

SEQ ID NO: 1429747 - RNA, 16 nt, Human
uaaaacauuaaaauau

SEQ ID NO: 1429748 - RNA, 15 nt, Human
uaaaacauuaaaaua

SEQ ID NO: 1429749 - RNA, 12 nt, Human
uaaaacauuaaa

SEQ ID NO: 1429750 - RNA, 19 nt, Human
uaaaacaucuuugaaauua

SEQ ID NO: 1429751 - RNA, 17 nt, Human
uaaaacaucauuacuau

SEQ ID NO: 1429752 - RNA, 22 nt, Human
uaaaacagguagaauuaucuaa

SEQ ID NO: 1429753 - RNA, 21 nt, Human
uaaaacagguuauaacagugu

SEQ ID NO: 1429754 - RNA, 17 nt, Human
uaaaagcaaaaaagaaa

SEQ ID NO: 1429755 - RNA, 16 nt, Human
uaaaagcaaaaaagaa

SEQ ID NO: 1429756 - RNA, 12 nt, Human
uaaaagcaaaaa

SEQ ID NO: 1429757 - RNA, 18 nt, Human
uaaaagauauaagugcug

SEQ ID NO: 1429758 - RNA, 19 nt, Human
uaaaagauauaagugcugu

SEQ ID NO: 1429759 - RNA, 20 nt, Human
uaaaagauauaagugcugua

SEQ ID NO: 1429760 - RNA, 21 nt, Human
uaaaagauauaagugcuguau

SEQ ID NO: 1429761 - RNA, 21 nt, Human
uaaaagauacaguuacucaga

SEQ ID NO: 1429762 - RNA, 12 nt, Human
uaaaagauauaa

SEQ ID NO: 1429763 - RNA, 13 nt, Human
uaaaagauauaag

SEQ ID NO: 1429764 - RNA, 16 nt, Human
uaaaagauauaagugc

SEQ ID NO: 1429765 - RNA, 17 nt, Human
uaaaagauacaguuacu

SEQ ID NO: 1429766 - RNA, 20 nt, Human
uaaaagauacaguuacucag

SEQ ID NO: 1429767 - RNA, 14 nt, Human
uaaaagauacaguu

SEQ ID NO: 1429768 - RNA, 14 nt, Human
uaaaaggaagccaa

SEQ ID NO: 1429769 - RNA, 21 nt, Human
uaaaagcaaaucauuuguuua

SEQ ID NO: 1429770 - RNA, 20 nt, Human
uaaaagcaaaucauuuguuu

SEQ ID NO: 1429771 - RNA, 15 nt, Human
uaaaagcaaaucauu

SEQ ID NO: 1429772 - RNA, 14 nt, Human
uaaaagcaaaucau

SEQ ID NO: 1429773 - RNA, 13 nt, Human
uaaaagcaaauca

SEQ ID NO: 1429774 - RNA, 23 nt, Human
uaaaagcaaaaaagaaaaccuuu

SEQ ID NO: 1429775 - RNA, 22 nt, Human
uaaaagcaaaaaagaaaaccuu

SEQ ID NO: 1429776 - RNA, 20 nt, Human
uaaaagcaaaaaagaaaacc

SEQ ID NO: 1429777 - RNA, 19 nt, Human
uaaaagcaaaaaagaaaac

SEQ ID NO: 1429778 - RNA, 18 nt, Human
uaaaagcaaaaaagaaaa

SEQ ID NO: 1429779 - RNA, 15 nt, Human
uaaaaggaaagaaaa

SEQ ID NO: 1429780 - RNA, 13 nt, Human
uaaaagcacgaca

SEQ ID NO: 1429781 - RNA, 19 nt, Human
uaaaaggaagccaaagagu

SEQ ID NO: 1429782 - RNA, 21 nt, Human
uaaaaggaaagaaaacaucuu

SEQ ID NO: 1429783 - RNA, 20 nt, Human
uaaaaucagcuauuuuguga

SEQ ID NO: 1429784 - RNA, 22 nt, Human
uaaaagguauuaaauugauguu

SEQ ID NO: 1429785 - RNA, 17 nt, Human
uaaaauccauacauuug

SEQ ID NO: 1429786 - RNA, 15 nt, Human
uaaaauccauacauu

SEQ ID NO: 1429787 - RNA, 18 nt, Human
guuugucgcucaugugug

SEQ ID NO: 1429788 - RNA, 13 nt, Human
guuugucauuagc

SEQ ID NO: 1429789 - RNA, 15 nt, Human
guuugucauuagccu

SEQ ID NO: 1429790 - RNA, 21 nt, Human
guuugucauuagccugaguag

SEQ ID NO: 1429791 - RNA, 13 nt, Human
guuuguaugaaac

SEQ ID NO: 1429792 - RNA, 22 nt, Human
guuuguagugccacuguuguuu

SEQ ID NO: 1429793 - RNA, 15 nt, Human
guuugugugucuuaa

SEQ ID NO: 1429794 - RNA, 14 nt, Human
guuugugugucuua

SEQ ID NO: 1429795 - RNA, 13 nt, Human
guuugugugucuu

SEQ ID NO: 1429796 - RNA, 22 nt, Human
guuuguguauuuacgcuuugau

SEQ ID NO: 1429797 - RNA, 17 nt, Human
guuuguguucuguuuug

SEQ ID NO: 1429798 - RNA, 15 nt, Human
guuuguguucuguuu

SEQ ID NO: 1429799 - RNA, 20 nt, Human
guuuguguguugucucuuga

SEQ ID NO: 1429800 - RNA, 17 nt, Human
guuuggguuuuuuuccu

SEQ ID NO: 1429801 - RNA, 15 nt, Human
guuugguauuguauu

SEQ ID NO: 1429802 - RNA, 20 nt, Human
guuuggguaaaauacuuuua

SEQ ID NO: 1429803 - RNA, 19 nt, Human
guuuggguaaaauacuuuu

SEQ ID NO: 1429804 - RNA, 23 nt, Human
guuuggggcaggaguagcugagc

SEQ ID NO: 1429805 - RNA, 21 nt, Human
guuuggggcaggaguagcuga

SEQ ID NO: 1429806 - RNA, 17 nt, Human
guuuggggcaggaguag

SEQ ID NO: 1429807 - RNA, 15 nt, Human
guuuggggcaggagu

SEQ ID NO: 1429808 - RNA, 19 nt, Human
guuuggggcagaaaggacu

SEQ ID NO: 1429809 - RNA, 13 nt, Human
guuuggugcuucu

SEQ ID NO: 1429810 - RNA, 17 nt, Human
guuugguauuguauuua

SEQ ID NO: 1429811 - RNA, 18 nt, Human
guuugguauuguauuuau

SEQ ID NO: 1429812 - RNA, 19 nt, Human
guuugacuagaugauggau

SEQ ID NO: 1429813 - RNA, 23 nt, Human
guuugauuaaauucuugcaaagu

SEQ ID NO: 1429814 - RNA, 18 nt, Human
guuugacuagaugaugga

SEQ ID NO: 1429815 - RNA, 16 nt, Human
guuugacuagaugaug

SEQ ID NO: 1429816 - RNA, 17 nt, Human
guuugaauguuaaauaa

SEQ ID NO: 1429817 - RNA, 19 nt, Human
guuucuuuguaaugaaaac

SEQ ID NO: 1429818 - RNA, 16 nt, Human
guuugaauguuaaaua

SEQ ID NO: 1429819 - RNA, 22 nt, Human
guuucuugccucauuuuuuucc

SEQ ID NO: 1429820 - RNA, 14 nt, Human
guuucuugccucau

SEQ ID NO: 1429821 - RNA, 13 nt, Human
guuucuugccuca

SEQ ID NO: 1429822 - RNA, 23 nt, Human
guuucuugccucauuuuuuuccu

SEQ ID NO: 1429823 - RNA, 21 nt, Human
guuucuuaaauaagaaacuuu

SEQ ID NO: 1429824 - RNA, 22 nt, Human
guuucuuaaauaagaaacuuuu

SEQ ID NO: 1429825 - RNA, 18 nt, Human
guuucccuacugaagccc

SEQ ID NO: 1429826 - RNA, 22 nt, Human
guuuccucuguucaaagcugcc

SEQ ID NO: 1429827 - RNA, 20 nt, Human
guuuccucuguucaaagcug

SEQ ID NO: 1429828 - RNA, 13 nt, Human
guuuccucuguuc

SEQ ID NO: 1429829 - RNA, 22 nt, Human
guuuccucuaguucuuuguuca

SEQ ID NO: 1429830 - RNA, 18 nt, Human
guuuccucuaguucuuug

SEQ ID NO: 1429831 - RNA, 17 nt, Human
guuuccuccaagcuauu

SEQ ID NO: 1429832 - RNA, 22 nt, Human
guuuuguugacauucugaaugc

SEQ ID NO: 1429833 - RNA, 21 nt, Human
guuuuguugacauucugaaug

SEQ ID NO: 1429834 - RNA, 18 nt, Human
guuuuguugacauucuga

SEQ ID NO: 1429835 - RNA, 17 nt, Human
guuuuguugacauucug

SEQ ID NO: 1429836 - RNA, 16 nt, Human
guuuuguugacauucu

SEQ ID NO: 1429837 - RNA, 14 nt, Human
guuuuguugacauu

SEQ ID NO: 1429838 - RNA, 21 nt, Human
guuuuguucaccauuauaaug

SEQ ID NO: 1429839 - RNA, 14 nt, Human
guuuuguucaccau

SEQ ID NO: 1429840 - RNA, 17 nt, Human
guuuuguuauauaauuu

SEQ ID NO: 1429841 - RNA, 18 nt, Human
guuuuguguuuguuguag

SEQ ID NO: 1429842 - RNA, 17 nt, Human
guuuuguguuuguugua

SEQ ID NO: 1429843 - RNA, 17 nt, Human
guuuuccuaugcuuuga

SEQ ID NO: 1429844 - RNA, 21 nt, Human
guuuuccuaugcuuugaaaca

SEQ ID NO: 1429845 - RNA, 12 nt, Human
guuuguuuuugg

SEQ ID NO: 1429846 - RNA, 14 nt, Human
guuuguuuuugcgu

SEQ ID NO: 1429847 - RNA, 13 nt, Human
guuuguuuguugc

SEQ ID NO: 1429848 - RNA, 15 nt, Human
guuuuaaaaagccag

SEQ ID NO: 1429849 - RNA, 16 nt, Human
guuuuaaaaagccagu

SEQ ID NO: 1429850 - RNA, 15 nt, Human
guuuuaaaaugagaa

SEQ ID NO: 1429851 - RNA, 16 nt, Human
guuuuaaaaugagaaa

SEQ ID NO: 1429852 - RNA, 20 nt, Human
guuuucaaaauuguuacaaa

SEQ ID NO: 1429853 - RNA, 17 nt, Human
guuuuaaaaugagaaau

SEQ ID NO: 1429854 - RNA, 14 nt, Human
guuguccuuuucau

SEQ ID NO: 1429855 - RNA, 23 nt, Human
guuguccucagccccgcguggaa

SEQ ID NO: 1429856 - RNA, 17 nt, Human
guuguccucagccccgc

SEQ ID NO: 1429857 - RNA, 16 nt, Human
guugucaccagaucug

SEQ ID NO: 1429858 - RNA, 22 nt, Human
guugucaagaauagcauuguaa

SEQ ID NO: 1429859 - RNA, 18 nt, Human
guugucaagaauagcauu

SEQ ID NO: 1429860 - RNA, 14 nt, Human
guugucaagaauag

SEQ ID NO: 1429861 - RNA, 23 nt, Human
guuggccauauuuaccucagccu

SEQ ID NO: 1429862 - RNA, 22 nt, Human
guuggccauauuuaccucagcc

SEQ ID NO: 1429863 - RNA, 18 nt, Human
guuggccaggcuggucua

SEQ ID NO: 1429864 - RNA, 21 nt, Human
guuggcguaggcuacagagaa

SEQ ID NO: 1429865 - RNA, 20 nt, Human
guuggcguaggcuacagaga

SEQ ID NO: 1429866 - RNA, 19 nt, Human
guuggcguaggcuacagag

SEQ ID NO: 1429867 - RNA, 18 nt, Human
guuggcguaggcuacaga

SEQ ID NO: 1429868 - RNA, 23 nt, Human
guuggcucugccaguccuguccu

SEQ ID NO: 1429869 - RNA, 19 nt, Human
guuggcucugccaguccug

SEQ ID NO: 1429870 - RNA, 15 nt, Human
guuggcucugccagu

SEQ ID NO: 1429871 - RNA, 23 nt, Human
guuggcguaggcuacagagaagc

SEQ ID NO: 1429872 - RNA, 22 nt, Human
guuggcguaggcuacagagaag

SEQ ID NO: 1429873 - RNA, 24 nt, Human
guuggcguaggcuacagagaagcc

SEQ ID NO: 1429874 - RNA, 22 nt, Human
guuggcucugccaguccugucc

SEQ ID NO: 1429875 - RNA, 24 nt, Human
guuguggccuuugcgcuccuggcc

SEQ ID NO: 1429876 - RNA, 21 nt, Human
guuguggccuuugcgcuccug

SEQ ID NO: 1429877 - RNA, 13 nt, Human
guuguggccuuug

SEQ ID NO: 1429878 - RNA, 22 nt, Human
guuguggauuuaacagaaaugu

SEQ ID NO: 1429879 - RNA, 12 nt, Human
guugugccaaau

SEQ ID NO: 1429880 - RNA, 20 nt, Human
guugugaguuuaccuuguau

SEQ ID NO: 1429881 - RNA, 16 nt, Human
guugucuggcaaggac

SEQ ID NO: 1429882 - RNA, 14 nt, Human
guugucuggcaagg

SEQ ID NO: 1429883 - RNA, 20 nt, Human
guugucucugaugcagcuua

SEQ ID NO: 1429884 - RNA, 14 nt, Human
guugucucugaugc

SEQ ID NO: 1429885 - RNA, 11 nt, Human
guugucucuga

SEQ ID NO: 1429886 - RNA, 18 nt, Human
guugucucuagagcaggg

SEQ ID NO: 1429887 - RNA, 18 nt, Human
guugucuaagaaauugaa

SEQ ID NO: 1429888 - RNA, 21 nt, Human
guugucuaagaaauugaauac

SEQ ID NO: 1429889 - RNA, 15 nt, Human
guugucuaagaaauu

SEQ ID NO: 1429890 - RNA, 14 nt, Human
guugucuaagaaau

SEQ ID NO: 1429891 - RNA, 17 nt, Human
guugucguaaagauuug

SEQ ID NO: 1429892 - RNA, 15 nt, Human
guuguccuuuucaua

SEQ ID NO: 1429893 - RNA, 13 nt, Human
guugucucuguuu

SEQ ID NO: 1429894 - RNA, 18 nt, Human
guugucucugaugcagcu

SEQ ID NO: 1429895 - RNA, 15 nt, Human
guugucucugaugca

SEQ ID NO: 1429896 - RNA, 19 nt, Human
guugucugcaacucugaag

SEQ ID NO: 1429897 - RNA, 22 nt, Human
guuuacuagggaucccucaucu

SEQ ID NO: 1429898 - RNA, 12 nt, Human
guuuaccuugua

SEQ ID NO: 1429899 - RNA, 15 nt, Human
guuuaccaguugccu

SEQ ID NO: 1429900 - RNA, 18 nt, Human
guuuaccaguugccuuuu

SEQ ID NO: 1429901 - RNA, 15 nt, Human
guuuaccagaaagca

SEQ ID NO: 1429902 - RNA, 16 nt, Human
guuuagaacacacaca

SEQ ID NO: 1429903 - RNA, 14 nt, Human
guuuagauaauaca

SEQ ID NO: 1429904 - RNA, 15 nt, Human
guuuagauaauacac

SEQ ID NO: 1429905 - RNA, 13 nt, Human
guuguuucuguuc

SEQ ID NO: 1429906 - RNA, 10 nt, Human
guuguucuuu

SEQ ID NO: 1429907 - RNA, 18 nt, Human
guuguucuguuaacugaa

SEQ ID NO: 1429908 - RNA, 15 nt, Human
guuguucuguuaacu

SEQ ID NO: 1429909 - RNA, 14 nt, Human
guuguucuguuaac

SEQ ID NO: 1429910 - RNA, 12 nt, Human
guuguucuguua

SEQ ID NO: 1429911 - RNA, 13 nt, Human
guuguucgggcca

SEQ ID NO: 1429912 - RNA, 14 nt, Human
guuguuucuguucc

SEQ ID NO: 1429913 - RNA, 17 nt, Human
guuguuucuguuccaaa

SEQ ID NO: 1429914 - RNA, 16 nt, Human
guuguucgggccaagg

SEQ ID NO: 1429915 - RNA, 17 nt, Human
guuguuaugugaucaug

SEQ ID NO: 1429916 - RNA, 14 nt, Human
guuguuacauuuuu

SEQ ID NO: 1429917 - RNA, 15 nt, Human
guuguuacauuuuua

SEQ ID NO: 1429918 - RNA, 19 nt, Human
guuuauacacuguguaaau

SEQ ID NO: 1429919 - RNA, 18 nt, Human
guuuaguggcucaacauu

SEQ ID NO: 1429920 - RNA, 15 nt, Human
guuuauacacugugu

SEQ ID NO: 1429921 - RNA, 20 nt, Human
guuuauauaagcuuguauuc

SEQ ID NO: 1429922 - RNA, 19 nt, Human
guuuaggaacuacugagga

SEQ ID NO: 1429923 - RNA, 21 nt, Human
guuuagcuggaaaaguauguu

SEQ ID NO: 1429924 - RNA, 20 nt, Human
guuuagcuggaaaaguaugu

SEQ ID NO: 1429925 - RNA, 18 nt, Human
guuuaugaaaaagaagaa

SEQ ID NO: 1429926 - RNA, 15 nt, Human
guuuauccuuucaua

SEQ ID NO: 1429927 - RNA, 22 nt, Human
guuuauccuuucauauaguuag

SEQ ID NO: 1429928 - RNA, 20 nt, Human
guuuaucauucaaguguaaa

SEQ ID NO: 1429929 - RNA, 17 nt, Human
guuuaucauucaagugu

SEQ ID NO: 1429930 - RNA, 16 nt, Human
guuuaucauucaagug

SEQ ID NO: 1429931 - RNA, 15 nt, Human
guuuaucauucaagu

SEQ ID NO: 1429932 - RNA, 14 nt, Human
guuuaucauucaag

SEQ ID NO: 1429933 - RNA, 14 nt, Human
guuuaucaguaaau

SEQ ID NO: 1429934 - RNA, 21 nt, Human
guuucauguuaguuaccuuau

SEQ ID NO: 1429935 - RNA, 17 nt, Human
guuucauguuaguuacc

SEQ ID NO: 1429936 - RNA, 18 nt, Human
guuucauguaauccucaa

SEQ ID NO: 1429937 - RNA, 22 nt, Human
guuucauauuuuucauagcuaa

SEQ ID NO: 1429938 - RNA, 12 nt, Human
uaaccacugcuu

SEQ ID NO: 1429939 - RNA, 13 nt, Human
uaaccacugcuuc

SEQ ID NO: 1429940 - RNA, 17 nt, Human
uaacauuugcuguuuua

SEQ ID NO: 1429941 - RNA, 22 nt, Human
uaacauuugcuguuuuaaacau

SEQ ID NO: 1429942 - RNA, 16 nt, Human
uaacauuugcuguuuu

SEQ ID NO: 1429943 - RNA, 14 nt, Human
uaacauuugcuguu

SEQ ID NO: 1429944 - RNA, 13 nt, Human
uaacauuugcugu

SEQ ID NO: 1429945 - RNA, 23 nt, Human
uaacauuccucaugaauguaaau

SEQ ID NO: 1429946 - RNA, 22 nt, Human
uaacauuccucaugaauguaaa

SEQ ID NO: 1429947 - RNA, 21 nt, Human
uaacauuccucaugaauguaa

SEQ ID NO: 1429948 - RNA, 20 nt, Human
uaacauuccucaugaaugua

SEQ ID NO: 1429949 - RNA, 11 nt, Human
uaacauuccuc

SEQ ID NO: 1429950 - RNA, 12 nt, Human
uaacagaaaugu

SEQ ID NO: 1429951 - RNA, 11 nt, Human
uaacagaaaug

SEQ ID NO: 1429952 - RNA, 17 nt, Human
uaacccacugagaggac

SEQ ID NO: 1429953 - RNA, 19 nt, Human
uaaccauguguuauguuuu

SEQ ID NO: 1429954 - RNA, 22 nt, Human
uaaccagacacauacucauuuu

SEQ ID NO: 1429955 - RNA, 20 nt, Human
uaaccagacacauacucauu

SEQ ID NO: 1429956 - RNA, 22 nt, Human
uaaccagaucuagucaaucaag

SEQ ID NO: 1429957 - RNA, 23 nt, Human
uaaccaguguuguggauuuaaca

SEQ ID NO: 1429958 - RNA, 13 nt, Human
uaaccagaucauu

SEQ ID NO: 1429959 - RNA, 23 nt, Human
uaacugaacauccaaaaucuuga

SEQ ID NO: 1429960 - RNA, 20 nt, Human
uaacugaaaauuauuuaaac

SEQ ID NO: 1429961 - RNA, 21 nt, Human
uaacugaaaaugugcuauacu

SEQ ID NO: 1429962 - RNA, 20 nt, Human
uaacugaaaaugugcuauac

SEQ ID NO: 1429963 - RNA, 14 nt, Human
uaacugaaaaugug

SEQ ID NO: 1429964 - RNA, 22 nt, Human
uaacucuucuuucauuucuucu

SEQ ID NO: 1429965 - RNA, 14 nt, Human
uaacucucuuuaug

SEQ ID NO: 1429966 - RNA, 18 nt, Human
uaacuccucccaggguuu

SEQ ID NO: 1429967 - RNA, 21 nt, Human
uaacuccucccaggguuuuaa

SEQ ID NO: 1429968 - RNA, 16 nt, Human
uaacuccucccagggu

SEQ ID NO: 1429969 - RNA, 15 nt, Human
uaacuccucccaggg

SEQ ID NO: 1429970 - RNA, 18 nt, Human
uaacugaauaccacucug

SEQ ID NO: 1429971 - RNA, 16 nt, Human
uaacugaauaccacuc

SEQ ID NO: 1429972 - RNA, 15 nt, Human
uaacugaauaccacu

SEQ ID NO: 1429973 - RNA, 14 nt, Human
uaacugaauaccac

SEQ ID NO: 1429974 - RNA, 21 nt, Human
uaacugaauaccacucuguaa

SEQ ID NO: 1429975 - RNA, 19 nt, Human
uaacugaauaccacucugu

SEQ ID NO: 1429976 - RNA, 22 nt, Human
uaacugaauaccacucuguaau

SEQ ID NO: 1429977 - RNA, 22 nt, Human
uaacugacuauucuugauguaa

SEQ ID NO: 1429978 - RNA, 17 nt, Human
uaacugacaagccaucu

SEQ ID NO: 1429979 - RNA, 16 nt, Human
uaacugacaagccauc

SEQ ID NO: 1429980 - RNA, 20 nt, Human
uaacugacaagccaucuuga

SEQ ID NO: 1429981 - RNA, 21 nt, Human
uaacugacuauucuugaugua

SEQ ID NO: 1429982 - RNA, 14 nt, Human
uaacugacuauucu

SEQ ID NO: 1429983 - RNA, 17 nt, Human
uaaccccccuguacaca

SEQ ID NO: 1429984 - RNA, 16 nt, Human
uaaccccccuguacac

SEQ ID NO: 1429985 - RNA, 15 nt, Human
uaacuauugcauuua

SEQ ID NO: 1429986 - RNA, 12 nt, Human
uaacuccuccca

SEQ ID NO: 1429987 - RNA, 14 nt, Human
uaacucccauuacc

SEQ ID NO: 1429988 - RNA, 16 nt, Human
uaacuauugcauuuau

SEQ ID NO: 1429989 - RNA, 21 nt, Human
uaacuauugcauuuauaugua

SEQ ID NO: 1429990 - RNA, 23 nt, Human
uaacuauugcauuuauauguacc

SEQ ID NO: 1429991 - RNA, 16 nt, Human
uaacuuuuuuuuuucu

SEQ ID NO: 1429992 - RNA, 19 nt, Human
uaagaaaaaggaugcacag

SEQ ID NO: 1429993 - RNA, 23 nt, Human
uaagaaaaaggaugcacagaguu

SEQ ID NO: 1429994 - RNA, 19 nt, Human
uaacuuuuuuuuuucuuua

SEQ ID NO: 1429995 - RNA, 22 nt, Human
uaacuuuugugaauuaggcugu

SEQ ID NO: 1429996 - RNA, 16 nt, Human
uaacuuuugugaauua

SEQ ID NO: 1429997 - RNA, 16 nt, Human
uaagaaaaaggaugca

SEQ ID NO: 1429998 - RNA, 18 nt, Human
uaagaaaaaggaugcaca

SEQ ID NO: 1429999 - RNA, 12 nt, Human
uaacuuuuguga

SEQ ID NO: 1430000 - RNA, 18 nt, Human
uaacuuuuguaagacaaa

SEQ ID NO: 1430001 - RNA, 13 nt, Human
uaacuuuuguaag

SEQ ID NO: 1430002 - RNA, 14 nt, Human
uaacuggaaagaag

SEQ ID NO: 1430003 - RNA, 15 nt, Human
uaacuggaaagaagu

SEQ ID NO: 1430004 - RNA, 13 nt, Human
uaacuggaaagaa

SEQ ID NO: 1430005 - RNA, 22 nt, Human
uaacuggaaaacagaacacuua

SEQ ID NO: 1430006 - RNA, 21 nt, Human
uaacuggaaaacagaacacuu

SEQ ID NO: 1430007 - RNA, 20 nt, Human
uaacuggaaaacagaacacu

SEQ ID NO: 1430008 - RNA, 18 nt, Human
uaacuggagccccaucag

SEQ ID NO: 1430009 - RNA, 19 nt, Human
uaacuggaaaacagaacac

SEQ ID NO: 1430010 - RNA, 18 nt, Human
uaacuggaaaacagaaca

SEQ ID NO: 1430011 - RNA, 15 nt, Human
uaacuggaaaacaga

SEQ ID NO: 1430012 - RNA, 21 nt, Human
uaacugcuuucuguuccaaau

SEQ ID NO: 1430013 - RNA, 20 nt, Human
uaacugcuuucuguuccaaa

SEQ ID NO: 1430014 - RNA, 17 nt, Human
uaacugcuuucuguucc

SEQ ID NO: 1430015 - RNA, 14 nt, Human
uaacugcuuucugu

SEQ ID NO: 1430016 - RNA, 15 nt, Human
uaacuggaaacuuca

SEQ ID NO: 1430017 - RNA, 21 nt, Human
uaagaaacuuuuuuauuuaaa

SEQ ID NO: 1430018 - RNA, 19 nt, Human
uaagaaacuuuuuuauuua

SEQ ID NO: 1430019 - RNA, 23 nt, Human
uaagaaaccuacugcccaggcac

SEQ ID NO: 1430020 - RNA, 17 nt, Human
uaagaaauugaauacuu

SEQ ID NO: 1430021 - RNA, 15 nt, Human
uaagaaauugaauac

SEQ ID NO: 1430022 - RNA, 14 nt, Human
uaagaaauugaaua

SEQ ID NO: 1430023 - RNA, 20 nt, Human
uaagaaacuuuuuuauuuaa

SEQ ID NO: 1430024 - RNA, 21 nt, Human
uaagaaacaacucuuugagaa

SEQ ID NO: 1430025 - RNA, 20 nt, Human
uaagaaacaacucuuugaga

SEQ ID NO: 1430026 - RNA, 15 nt, Human
uaagaaaauaaaugu

SEQ ID NO: 1430027 - RNA, 21 nt, Human
uaagaaaauaucacuugucaa

SEQ ID NO: 1430028 - RNA, 14 nt, Human
uaagaaauuucaca

SEQ ID NO: 1430029 - RNA, 23 nt, Human
uaagaaauugaauacuuugaaug

SEQ ID NO: 1430030 - RNA, 22 nt, Human
uaagaaauugaauacuuugaau

SEQ ID NO: 1430031 - RNA, 21 nt, Human
uaagaaauugaauacuuugaa

SEQ ID NO: 1430032 - RNA, 18 nt, Human
uaagaaauugaauacuuu

SEQ ID NO: 1430033 - RNA, 14 nt, Human
uaagaaccuggaac

SEQ ID NO: 1430034 - RNA, 13 nt, Human
uaagagagaauga

SEQ ID NO: 1430035 - RNA, 23 nt, Human
uaagagagaaugagagacacacu

SEQ ID NO: 1430036 - RNA, 14 nt, Human
uaagagagaaugag

SEQ ID NO: 1430037 - RNA, 13 nt, Human
uaaaugcccugcu

SEQ ID NO: 1430038 - RNA, 12 nt, Human
uaaaugcccugc

SEQ ID NO: 1430039 - RNA, 22 nt, Human
uaaauggccucauguggcugga

SEQ ID NO: 1430040 - RNA, 16 nt, Human
uaaauggccucaugug

SEQ ID NO: 1430041 - RNA, 12 nt, Human
uaaauggccuca

SEQ ID NO: 1430042 - RNA, 16 nt, Human
uaaauggaaccacucu

SEQ ID NO: 1430043 - RNA, 18 nt, Human
uaaaguuguuugugccuu

SEQ ID NO: 1430044 - RNA, 22 nt, Human
uaaaguucuaagauucugauuu

SEQ ID NO: 1430045 - RNA, 19 nt, Human
uaaaguucuaagauucuga

SEQ ID NO: 1430046 - RNA, 18 nt, Human
uaaaguucuaagauucug

SEQ ID NO: 1430047 - RNA, 17 nt, Human
uaaaguucuaagauucu

SEQ ID NO: 1430048 - RNA, 16 nt, Human
uaaaguucuaagauuc

SEQ ID NO: 1430049 - RNA, 15 nt, Human
uaaaguucuaagauu

SEQ ID NO: 1430050 - RNA, 14 nt, Human
uaaaguucuaagau

SEQ ID NO: 1430051 - RNA, 13 nt, Human
uaaaguucuaaga

SEQ ID NO: 1430052 - RNA, 16 nt, Human
uaaaguugguaaaccu

SEQ ID NO: 1430053 - RNA, 20 nt, Human
uaaaguugauaaagauuuuu

SEQ ID NO: 1430054 - RNA, 16 nt, Human
uaaaguugauaaagau

SEQ ID NO: 1430055 - RNA, 23 nt, Human
uaaaguucuguacucaaauguag

SEQ ID NO: 1430056 - RNA, 17 nt, Human
uaaaguugguaaaccuu

SEQ ID NO: 1430057 - RNA, 17 nt, Human
uaaauggggcucacaaa

SEQ ID NO: 1430058 - RNA, 18 nt, Human
uaaaugggggugcauuug

SEQ ID NO: 1430059 - RNA, 19 nt, Human
uaaaugggggugcauuuga

SEQ ID NO: 1430060 - RNA, 13 nt, Human
uaaauggcuguaa

SEQ ID NO: 1430061 - RNA, 23 nt, Human
uaaauggccucauguggcuggaa

SEQ ID NO: 1430062 - RNA, 20 nt, Human
uaaauggcuuccuggcaaua

SEQ ID NO: 1430063 - RNA, 14 nt, Human
uaaaugggggugca

SEQ ID NO: 1430064 - RNA, 17 nt, Human
uaaaugggggugcauuu

SEQ ID NO: 1430065 - RNA, 23 nt, Human
uaaaugucacuuuuugaggcaaa

SEQ ID NO: 1430066 - RNA, 22 nt, Human
uaaaugucacuuuuugaggcaa

SEQ ID NO: 1430067 - RNA, 21 nt, Human
uaaaugucacuuuuugaggca

SEQ ID NO: 1430068 - RNA, 17 nt, Human
uaaaugucacuuuuuga

SEQ ID NO: 1430069 - RNA, 15 nt, Human
uaaauguauacuaua

SEQ ID NO: 1430070 - RNA, 17 nt, Human
uaaauguauacuauagu

SEQ ID NO: 1430071 - RNA, 20 nt, Human
uaaauguauacuauaguacc

SEQ ID NO: 1430072 - RNA, 17 nt, Human
uaaauguaaagauauuu

SEQ ID NO: 1430073 - RNA, 16 nt, Human
uaaauguaaagauauu

SEQ ID NO: 1430074 - RNA, 13 nt, Human
uaaauguaaagau

SEQ ID NO: 1430075 - RNA, 17 nt, Human
uaaauguaaagacaaaa

SEQ ID NO: 1430076 - RNA, 18 nt, Human
uaaauguagaguuuuuaa

SEQ ID NO: 1430077 - RNA, 17 nt, Human
uaaauguagaguuuuua

SEQ ID NO: 1430078 - RNA, 21 nt, Human
uaaauguaguucugcuccaga

SEQ ID NO: 1430079 - RNA, 12 nt, Human
uaaauguauacu

SEQ ID NO: 1430080 - RNA, 13 nt, Human
uaaauguauacua

SEQ ID NO: 1430081 - RNA, 18 nt, Human
uaaauucacaaacuuuua

SEQ ID NO: 1430082 - RNA, 16 nt, Human
uaaauucacaaacuuu

SEQ ID NO: 1430083 - RNA, 22 nt, Human
uaaaugugcaauagaaggugau

SEQ ID NO: 1430084 - RNA, 19 nt, Human
uaaaugugcaauagaaggu

SEQ ID NO: 1430085 - RNA, 19 nt, Human
uaaaugugauucaccucuu

SEQ ID NO: 1430086 - RNA, 19 nt, Human
uaaaugugaugaauacugu

SEQ ID NO: 1430087 - RNA, 19 nt, Human
uaaaugucuuuaaugcaau

SEQ ID NO: 1430088 - RNA, 18 nt, Human
uaaaugucuuuaaugcaa

SEQ ID NO: 1430089 - RNA, 20 nt, Human
uaaaugucuuuaaugcaaua

SEQ ID NO: 1430090 - RNA, 19 nt, Human
uaaauucccguuuugucac

SEQ ID NO: 1430091 - RNA, 18 nt, Human
uaaauucccguuuuguca

SEQ ID NO: 1430092 - RNA, 22 nt, Human
uaaauucucucucuugcaggaa

SEQ ID NO: 1430093 - RNA, 16 nt, Human
uaaauucuugcaaagu

SEQ ID NO: 1430094 - RNA, 17 nt, Human
uaaauucuugcaaagua

SEQ ID NO: 1430095 - RNA, 18 nt, Human
uaaauucuugcaaaguau

SEQ ID NO: 1430096 - RNA, 22 nt, Human
uaaauucuugcaaaguaucccu

SEQ ID NO: 1430097 - RNA, 21 nt, Human
uaacacucagaagccuggggg

SEQ ID NO: 1430098 - RNA, 20 nt, Human
uaacacucagaagccugggg

SEQ ID NO: 1430099 - RNA, 19 nt, Human
uaacacucagaagccuggg

SEQ ID NO: 1430100 - RNA, 18 nt, Human
uaacacucagaagccugg

SEQ ID NO: 1430101 - RNA, 14 nt, Human
uaacacucagaagc

SEQ ID NO: 1430102 - RNA, 23 nt, Human
uaacacuaauauauuuaaaaaua

SEQ ID NO: 1430103 - RNA, 22 nt, Human
uaacacuaauauauuuaaaaau

SEQ ID NO: 1430104 - RNA, 20 nt, Human
uaacacuaauauauuuaaaa

SEQ ID NO: 1430105 - RNA, 16 nt, Human
uaacacuaauauauuu

SEQ ID NO: 1430106 - RNA, 13 nt, Human
uaacacuaauaua

SEQ ID NO: 1430107 - RNA, 18 nt, Human
uaaauuugacuuuucugu

SEQ ID NO: 1430108 - RNA, 19 nt, Human
uaaauuugacuuuucugua

SEQ ID NO: 1430109 - RNA, 17 nt, Human
uaaauuugacuuuucug

SEQ ID NO: 1430110 - RNA, 20 nt, Human
uaaauuucuauuuuuaucug

SEQ ID NO: 1430111 - RNA, 15 nt, Human
uaaauuuauuuucuu

SEQ ID NO: 1430112 - RNA, 13 nt, Human
uaaauucuuucau

SEQ ID NO: 1430113 - RNA, 22 nt, Human
uaauguuucaaacauauauaac

SEQ ID NO: 1430114 - RNA, 18 nt, Human
uaauguuguuauuuaaag

SEQ ID NO: 1430115 - RNA, 14 nt, Human
uaauguuguuauuu

SEQ ID NO: 1430116 - RNA, 21 nt, Human
uaauguuggacaccuuuaggu

SEQ ID NO: 1430117 - RNA, 21 nt, Human
uaauguuggguagaaagagau

SEQ ID NO: 1430118 - RNA, 23 nt, Human
uaaugguacugacuuugcuugcu

SEQ ID NO: 1430119 - RNA, 19 nt, Human
uaaugguacugacuuugcu

SEQ ID NO: 1430120 - RNA, 22 nt, Human
uaauggcugauaauuuuaaauu

SEQ ID NO: 1430121 - RNA, 15 nt, Human
uaaugggauuuucuu

SEQ ID NO: 1430122 - RNA, 22 nt, Human
uaauguuucuggauuucauacu

SEQ ID NO: 1430123 - RNA, 23 nt, Human
uaauguuuuuugccacagcuuuu

SEQ ID NO: 1430124 - RNA, 21 nt, Human
uaauguuuuuugccacagcuu

SEQ ID NO: 1430125 - RNA, 22 nt, Human
uaauguuuuuugccacagcuuu

SEQ ID NO: 1430126 - RNA, 15 nt, Human
uaaugcuuugaaauu

SEQ ID NO: 1430127 - RNA, 15 nt, Human
uaauggcaugagaaa

SEQ ID NO: 1430128 - RNA, 21 nt, Human
uaauggcaguuauauuuugca

SEQ ID NO: 1430129 - RNA, 15 nt, Human
uaauggcaguuauau

SEQ ID NO: 1430130 - RNA, 21 nt, Human
uaauggcugauaauuuuaaau

SEQ ID NO: 1430131 - RNA, 17 nt, Human
uaauggcaugagaaaua

SEQ ID NO: 1430132 - RNA, 23 nt, Human
uaaugauaacuggaaacuucagc

SEQ ID NO: 1430133 - RNA, 15 nt, Human
uaaugcgugcauacc

SEQ ID NO: 1430134 - RNA, 22 nt, Human
uaaugauaacuggaaacuucag

SEQ ID NO: 1430135 - RNA, 17 nt, Human
uaaugauaacuggaaac

SEQ ID NO: 1430136 - RNA, 19 nt, Human
uaaugcgugcauaccacuu

SEQ ID NO: 1430137 - RNA, 22 nt, Human
uaaugcgugcauaccacuuuug

SEQ ID NO: 1430138 - RNA, 23 nt, Human
uaaugcgugcauaccacuuuugu

SEQ ID NO: 1430139 - RNA, 15 nt, Human
uaaucugccucccuc

SEQ ID NO: 1430140 - RNA, 22 nt, Human
uaaucuagauaucgacuuguuu

SEQ ID NO: 1430141 - RNA, 17 nt, Human
uaaucuagauaucgacu

SEQ ID NO: 1430142 - RNA, 22 nt, Human
uaaucuagaacacaggcaaaau

SEQ ID NO: 1430143 - RNA, 14 nt, Human
uaaucuagaacaca

SEQ ID NO: 1430144 - RNA, 18 nt, Human
uaauccgccaauauuagu

SEQ ID NO: 1430145 - RNA, 13 nt, Human
uaaucugccuccc

SEQ ID NO: 1430146 - RNA, 16 nt, Human
uaauccgccaauauua

SEQ ID NO: 1430147 - RNA, 21 nt, Human
uaauccgaaucucuuuuugcu

SEQ ID NO: 1430148 - RNA, 19 nt, Human
uaauccgaaucucuuuuug

SEQ ID NO: 1430149 - RNA, 21 nt, Human
uaaucccugcuuuuuguguuu

SEQ ID NO: 1430150 - RNA, 17 nt, Human
uaaucccugcuuuuugu

SEQ ID NO: 1430151 - RNA, 14 nt, Human
uaaucccugcuuuu

SEQ ID NO: 1430152 - RNA, 13 nt, Human
uaaucccugcuuu

SEQ ID NO: 1430153 - RNA, 21 nt, Human
uaauccccuucuccccugcac

SEQ ID NO: 1430154 - RNA, 17 nt, Human
uaaucccgauucacccu

SEQ ID NO: 1430155 - RNA, 13 nt, Human
uaaucuaaaugga

SEQ ID NO: 1430156 - RNA, 18 nt, Human
uaauccccuucuccccug

SEQ ID NO: 1430157 - RNA, 17 nt, Human
uaauccccuucuccccu

SEQ ID NO: 1430158 - RNA, 15 nt, Human
uaauccccuucuccc

SEQ ID NO: 1430159 - RNA, 14 nt, Human
uaauccccuucucc

SEQ ID NO: 1430160 - RNA, 18 nt, Human
uaauaugcuuaaaauaag

SEQ ID NO: 1430161 - RNA, 19 nt, Human
uaauaugcacacauuuuuu

SEQ ID NO: 1430162 - RNA, 22 nt, Human
uaauauggccacaguagucuug

SEQ ID NO: 1430163 - RNA, 15 nt, Human
uaauaugcacacauu

SEQ ID NO: 1430164 - RNA, 16 nt, Human
uaauaugcacacauuu

SEQ ID NO: 1430165 - RNA, 17 nt, Human
uaauaugcacacauuuu

SEQ ID NO: 1430166 - RNA, 18 nt, Human
uaauaugcacacauuuuu

SEQ ID NO: 1430167 - RNA, 15 nt, Human
uaauauccuaaacau

SEQ ID NO: 1430168 - RNA, 17 nt, Human
uaauauccuaaacauca

SEQ ID NO: 1430169 - RNA, 14 nt, Human
uaauauccuaaaca

SEQ ID NO: 1430170 - RNA, 12 nt, Human
uaauauccuaaa

SEQ ID NO: 1430171 - RNA, 18 nt, Human
uaauaucccuacauguau

SEQ ID NO: 1430172 - RNA, 17 nt, Human
uaauaucccuacaugua

SEQ ID NO: 1430173 - RNA, 23 nt, Human
uaauaucccacugggagaaagga

SEQ ID NO: 1430174 - RNA, 14 nt, Human
uaauaauguuucaa

SEQ ID NO: 1430175 - RNA, 21 nt, Human
uaaguauuuuccuguugucaa

SEQ ID NO: 1430176 - RNA, 20 nt, Human
uaaguauuuuccuguuguca

SEQ ID NO: 1430177 - RNA, 17 nt, Human
uaagucaaccugccuga

SEQ ID NO: 1430178 - RNA, 15 nt, Human
uaagucaaccugccu

SEQ ID NO: 1430179 - RNA, 16 nt, Human
uaagucaacaguaaac

SEQ ID NO: 1430180 - RNA, 15 nt, Human
uaagucaacaguaaa

SEQ ID NO: 1430181 - RNA, 14 nt, Human
uaagucaacaguaa

SEQ ID NO: 1430182 - RNA, 14 nt, Human
uaagucagaacagc

SEQ ID NO: 1430183 - RNA, 17 nt, Human
uaagucaacaguaaacc

SEQ ID NO: 1430184 - RNA, 21 nt, Human
uaagguguagccacaccagga

SEQ ID NO: 1430185 - RNA, 19 nt, Human
uaagguguagccacaccag

SEQ ID NO: 1430186 - RNA, 13 nt, Human
uaagguguagcca

SEQ ID NO: 1430187 - RNA, 21 nt, Human
uaaggugcucucuuucugucu

SEQ ID NO: 1430188 - RNA, 21 nt, Human
uaagguccgguguucuaagau

SEQ ID NO: 1430189 - RNA, 20 nt, Human
uaagguccgguguucuaaga

SEQ ID NO: 1430190 - RNA, 18 nt, Human
uaagguccgguguucuaa

SEQ ID NO: 1430191 - RNA, 17 nt, Human
uaagguccgguguucua

SEQ ID NO: 1430192 - RNA, 19 nt, Human
uaagguacaagaagcauuu

SEQ ID NO: 1430193 - RNA, 18 nt, Human
uaagguacaagaagcauu

SEQ ID NO: 1430194 - RNA, 17 nt, Human
uaagggucgaaagcucu

SEQ ID NO: 1430195 - RNA, 13 nt, Human
uaagggguggggc

SEQ ID NO: 1430196 - RNA, 13 nt, Human
uaagggaagaauu

SEQ ID NO: 1430197 - RNA, 16 nt, Human
uaagggcccaggucag

SEQ ID NO: 1430198 - RNA, 14 nt, Human
uaagggcacugacg

SEQ ID NO: 1430199 - RNA, 19 nt, Human
uaagggccagaaauaucuu

SEQ ID NO: 1430200 - RNA, 19 nt, Human
uaaggggaggaaccagagu

SEQ ID NO: 1430201 - RNA, 16 nt, Human
uaagccuaaaaguggg

SEQ ID NO: 1430202 - RNA, 22 nt, Human
uaagcgcuagaggaagcagcca

SEQ ID NO: 1430203 - RNA, 18 nt, Human
uaagcccagugcacugaa

SEQ ID NO: 1430204 - RNA, 16 nt, Human
uaagccccagcaagca

SEQ ID NO: 1430205 - RNA, 17 nt, Human
uaagccccagcaagcaa

SEQ ID NO: 1430206 - RNA, 22 nt, Human
uaagccccagcaagcaauccua

SEQ ID NO: 1430207 - RNA, 15 nt, Human
uaagccaugggagac

SEQ ID NO: 1430208 - RNA, 22 nt, Human
uaaggcuguguaagauuuguuu

SEQ ID NO: 1430209 - RNA, 16 nt, Human
uaaggcuguguaagau

SEQ ID NO: 1430210 - RNA, 13 nt, Human
uaaggcuguguaa

SEQ ID NO: 1430211 - RNA, 24 nt, Human
uaaggcucugagagucuagauucu

SEQ ID NO: 1430212 - RNA, 22 nt, Human
uaaggcucugagagucuagauu

SEQ ID NO: 1430213 - RNA, 19 nt, Human
uaaggcucugagagucuag

SEQ ID NO: 1430214 - RNA, 20 nt, Human
uaaggcaacaaaagaagccc

SEQ ID NO: 1430215 - RNA, 15 nt, Human
uaaggcucugagagu

SEQ ID NO: 1430216 - RNA, 14 nt, Human
uaaggcucugagag

SEQ ID NO: 1430217 - RNA, 22 nt, Human
uaaggcucuaugagucuagaug

SEQ ID NO: 1430218 - RNA, 19 nt, Human
uaaggcucuaugagucuag

SEQ ID NO: 1430219 - RNA, 14 nt, Human
uaaggcaaucaugg

SEQ ID NO: 1430220 - RNA, 18 nt, Human
uaaguguacauaugugcu

SEQ ID NO: 1430221 - RNA, 14 nt, Human
uaaguguacauaug

SEQ ID NO: 1430222 - RNA, 12 nt, Human
uaagugugaacu

SEQ ID NO: 1430223 - RNA, 14 nt, Human
uaagugugaacugg

SEQ ID NO: 1430224 - RNA, 15 nt, Human
uaagugugaacugga

SEQ ID NO: 1430225 - RNA, 14 nt, Human
uaagugcuguauaa

SEQ ID NO: 1430226 - RNA, 12 nt, Human
uaagugcuguau

SEQ ID NO: 1430227 - RNA, 15 nt, Human
uaagugcugcauuua

SEQ ID NO: 1430228 - RNA, 16 nt, Human
uaagugcugcauuuaa

SEQ ID NO: 1430229 - RNA, 18 nt, Human
uaagugcugcauuuaaaa

SEQ ID NO: 1430230 - RNA, 22 nt, Human
uaagugcugcauuuaaaagaua

SEQ ID NO: 1430231 - RNA, 12 nt, Human
uaauaaagcugu

SEQ ID NO: 1430232 - RNA, 12 nt, Human
uaauaaaggacu

SEQ ID NO: 1430233 - RNA, 13 nt, Human
uaauaaaggacug

SEQ ID NO: 1430234 - RNA, 22 nt, Human
uaagugugaacuggacccuguu

SEQ ID NO: 1430235 - RNA, 16 nt, Human
uaauaaaggacuguaa

SEQ ID NO: 1430236 - RNA, 20 nt, Human
uaauaaaggacuguaaucuu

SEQ ID NO: 1430237 - RNA, 21 nt, Human
uaagugcccucucccacccuc

SEQ ID NO: 1430238 - RNA, 15 nt, Human
uaagugcccucuccc

SEQ ID NO: 1430239 - RNA, 14 nt, Human
uaagugcccucucc

SEQ ID NO: 1430240 - RNA, 16 nt, Human
uaagugcccucuccca

SEQ ID NO: 1430241 - RNA, 14 nt, Human
uaagugcugcauuu

SEQ ID NO: 1430242 - RNA, 18 nt, Human
uaagugaacacccaugaa

SEQ ID NO: 1430243 - RNA, 22 nt, Human
uaagugauugcugguuuuaguu

SEQ ID NO: 1430244 - RNA, 15 nt, Human
uaagugaaaauauag

SEQ ID NO: 1430245 - RNA, 22 nt, Human
uaaguccaguccaguccuaucu

SEQ ID NO: 1430246 - RNA, 14 nt, Human
uaaguccaguccag

SEQ ID NO: 1430247 - RNA, 13 nt, Human
uaagucagaacag

SEQ ID NO: 1430248 - RNA, 12 nt, Human
uaaguccagugu

SEQ ID NO: 1430249 - RNA, 13 nt, Human
uacuaauuccaca

SEQ ID NO: 1430250 - RNA, 16 nt, Human
uacuaaugaaaacaga

SEQ ID NO: 1430251 - RNA, 13 nt, Human
uacuaaugaaaac

SEQ ID NO: 1430252 - RNA, 16 nt, Human
uacuaauuccacaccu

SEQ ID NO: 1430253 - RNA, 13 nt, Human
uacuacaguuugu

SEQ ID NO: 1430254 - RNA, 14 nt, Human
uacuacaguuuguu

SEQ ID NO: 1430255 - RNA, 20 nt, Human
uacuacaguuuguuaguaug

SEQ ID NO: 1430256 - RNA, 20 nt, Human
uacucccaggcacugucuua

SEQ ID NO: 1430257 - RNA, 17 nt, Human
uacuccacacugcacaa

SEQ ID NO: 1430258 - RNA, 16 nt, Human
uacucauuuuucauga

SEQ ID NO: 1430259 - RNA, 14 nt, Human
uacucauuuuucau

SEQ ID NO: 1430260 - RNA, 11 nt, Human
uacucauuuuu

SEQ ID NO: 1430261 - RNA, 14 nt, Human
uacuccacacugca

SEQ ID NO: 1430262 - RNA, 13 nt, Human
uacuccacacugc

SEQ ID NO: 1430263 - RNA, 14 nt, Human
uacucccucucagg

SEQ ID NO: 1430264 - RNA, 13 nt, Human
uacucccaggcac

SEQ ID NO: 1430265 - RNA, 19 nt, Human
uacuccuaugaucugaguc

SEQ ID NO: 1430266 - RNA, 17 nt, Human
uacugcagccuccagag

SEQ ID NO: 1430267 - RNA, 12 nt, Human
uacugcagccuc

SEQ ID NO: 1430268 - RNA, 21 nt, Human
uacugcaagguucaacuuauu

SEQ ID NO: 1430269 - RNA, 22 nt, Human
uacugcaaaucaggcuuuuguu

SEQ ID NO: 1430270 - RNA, 13 nt, Human
uacugcaugcacu

SEQ ID NO: 1430271 - RNA, 23 nt, Human
uacugcaaaucaggcuuuuguuu

SEQ ID NO: 1430272 - RNA, 21 nt, Human
uacugcaaaucaggcuuuugu

SEQ ID NO: 1430273 - RNA, 14 nt, Human
uacugcaaaucagg

SEQ ID NO: 1430274 - RNA, 16 nt, Human
uacugcaaaaagaaaa

SEQ ID NO: 1430275 - RNA, 22 nt, Human
uacucuaagaucuuagauucuc

SEQ ID NO: 1430276 - RNA, 21 nt, Human
uacucuaagaucuuagauucu

SEQ ID NO: 1430277 - RNA, 20 nt, Human
uacucuaagaucuuagauuc

SEQ ID NO: 1430278 - RNA, 18 nt, Human
uacucuaagaucuuagau

SEQ ID NO: 1430279 - RNA, 15 nt, Human
uacucuaagaucuua

SEQ ID NO: 1430280 - RNA, 13 nt, Human
uacucuaagaucu

SEQ ID NO: 1430281 - RNA, 17 nt, Human
uacuccuaugaucugag

SEQ ID NO: 1430282 - RNA, 22 nt, Human
uacugccgucagugcugugcug

SEQ ID NO: 1430283 - RNA, 20 nt, Human
uacugccauucacuucauaa

SEQ ID NO: 1430284 - RNA, 14 nt, Human
uacugccuauuuua

SEQ ID NO: 1430285 - RNA, 16 nt, Human
uacugccugcuugggg

SEQ ID NO: 1430286 - RNA, 14 nt, Human
uacugccugcuugg

SEQ ID NO: 1430287 - RNA, 12 nt, Human
uacugccugcuu

SEQ ID NO: 1430288 - RNA, 11 nt, Human
uacugccugcu

SEQ ID NO: 1430289 - RNA, 10 nt, Human
uacugccugc

SEQ ID NO: 1430290 - RNA, 21 nt, Human
uacugccuauuuuaauaaaca

SEQ ID NO: 1430291 - RNA, 17 nt, Human
uacuugaagggccagag

SEQ ID NO: 1430292 - RNA, 16 nt, Human
uacuugaagggccaga

SEQ ID NO: 1430293 - RNA, 15 nt, Human
uacuugaagggccag

SEQ ID NO: 1430294 - RNA, 14 nt, Human
uacuugaagggcca

SEQ ID NO: 1430295 - RNA, 12 nt, Human
uacuugaagggc

SEQ ID NO: 1430296 - RNA, 11 nt, Human
uacuugaaggg

SEQ ID NO: 1430297 - RNA, 24 nt, Human
uacuugaacguuuucuaauugcuu

SEQ ID NO: 1430298 - RNA, 23 nt, Human
uacuugaacguuuucuaauugcu

SEQ ID NO: 1430299 - RNA, 21 nt, Human
uacuugaacguuuucuaauug

SEQ ID NO: 1430300 - RNA, 20 nt, Human
uacuugaacguuuucuaauu

SEQ ID NO: 1430301 - RNA, 19 nt, Human
uacuugaacguuuucuaau

SEQ ID NO: 1430302 - RNA, 18 nt, Human
uacuugaacguuuucuaa

SEQ ID NO: 1430303 - RNA, 16 nt, Human
uacuugaacguuuucu

SEQ ID NO: 1430304 - RNA, 19 nt, Human
uacuguuuauuaaaguaca

SEQ ID NO: 1430305 - RNA, 14 nt, Human
uacuuguaauuaug

SEQ ID NO: 1430306 - RNA, 15 nt, Human
uacuuguaauuaugg

SEQ ID NO: 1430307 - RNA, 13 nt, Human
uacuuguaauuau

SEQ ID NO: 1430308 - RNA, 12 nt, Human
uacuuguaauua

SEQ ID NO: 1430309 - RNA, 20 nt, Human
uacuuguaaauauaaagacg

SEQ ID NO: 1430310 - RNA, 19 nt, Human
uacuuguaaauauaaagac

SEQ ID NO: 1430311 - RNA, 20 nt, Human
uacuugaagggccagagcca

SEQ ID NO: 1430312 - RNA, 19 nt, Human
uacuugaagggccagagcc

SEQ ID NO: 1430313 - RNA, 18 nt, Human
uacuugaagggccagagc

SEQ ID NO: 1430314 - RNA, 20 nt, Human
uacuugcucuugaugccugg

SEQ ID NO: 1430315 - RNA, 13 nt, Human
uacuugcucuuga

SEQ ID NO: 1430316 - RNA, 14 nt, Human
uacuugcucuugau

SEQ ID NO: 1430317 - RNA, 18 nt, Human
uacuugcucuugaugccu

SEQ ID NO: 1430318 - RNA, 19 nt, Human
uacuugcucuugaugccug

SEQ ID NO: 1430319 - RNA, 22 nt, Human
uacuguguuaugcaaaagcaag

SEQ ID NO: 1430320 - RNA, 17 nt, Human
uacuguguuaugcaaaa

SEQ ID NO: 1430321 - RNA, 16 nt, Human
uacuguguuaugcaaa

SEQ ID NO: 1430322 - RNA, 15 nt, Human
uacuguguuaugcaa

SEQ ID NO: 1430323 - RNA, 23 nt, Human
uacugugugugugaaugaacacu

SEQ ID NO: 1430324 - RNA, 22 nt, Human
uacugugugugugaaugaacac

SEQ ID NO: 1430325 - RNA, 23 nt, Human
uacugucauccucaaagaaagug

SEQ ID NO: 1430326 - RNA, 18 nt, Human
uacuggaaauuaggggau

SEQ ID NO: 1430327 - RNA, 14 nt, Human
uacuggaaagcuuu

SEQ ID NO: 1430328 - RNA, 19 nt, Human
uacugcuuggagcugagca

SEQ ID NO: 1430329 - RNA, 24 nt, Human
uacugcuuggagcugagcaaauca

SEQ ID NO: 1430330 - RNA, 21 nt, Human
uacugcugagauacauacaga

SEQ ID NO: 1430331 - RNA, 20 nt, Human
uacugcugagauacauacag

SEQ ID NO: 1430332 - RNA, 13 nt, Human
uacugcuuaauuc

SEQ ID NO: 1430333 - RNA, 19 nt, Human
uacugcuuaauucaaauaa

SEQ ID NO: 1430334 - RNA, 20 nt, Human
uacugcuuaauucaaauaau

SEQ ID NO: 1430335 - RNA, 22 nt, Human
uacugcgacuuucugccuggag

SEQ ID NO: 1430336 - RNA, 21 nt, Human
uacugcgacuuucugccugga

SEQ ID NO: 1430337 - RNA, 20 nt, Human
uacugcgacuuucugccugg

SEQ ID NO: 1430338 - RNA, 19 nt, Human
uacugcgacuuucugccug

SEQ ID NO: 1430339 - RNA, 18 nt, Human
uacugcgacuuucugccu

SEQ ID NO: 1430340 - RNA, 17 nt, Human
uacugcgacuuucugcc

SEQ ID NO: 1430341 - RNA, 16 nt, Human
uacugcgacuuucugc

SEQ ID NO: 1430342 - RNA, 12 nt, Human
uacugcgacuuu

SEQ ID NO: 1430343 - RNA, 20 nt, Human
uacugcuacagcaauuucua

SEQ ID NO: 1430344 - RNA, 14 nt, Human
uacugcucugagaa

SEQ ID NO: 1430345 - RNA, 13 nt, Human
uacugcucugaga

SEQ ID NO: 1430346 - RNA, 12 nt, Human
uacugcucugag

SEQ ID NO: 1430347 - RNA, 15 nt, Human
uacugcucuccucca

SEQ ID NO: 1430348 - RNA, 17 nt, Human
uaccuuauaguuacugu

SEQ ID NO: 1430349 - RNA, 16 nt, Human
uaccuuauaguuacug

SEQ ID NO: 1430350 - RNA, 18 nt, Human
uaccuuauaguuacugug

SEQ ID NO: 1430351 - RNA, 21 nt, Human
uaccuuuugaggagccccagc

SEQ ID NO: 1430352 - RNA, 13 nt, Human
uaccuuuuuuaga

SEQ ID NO: 1430353 - RNA, 19 nt, Human
uaccuuuuuuagaguugau

SEQ ID NO: 1430354 - RNA, 22 nt, Human
uaccuuuuuuagaguugauacu

SEQ ID NO: 1430355 - RNA, 14 nt, Human
uaccuccugagaaa

SEQ ID NO: 1430356 - RNA, 13 nt, Human
uaccuccugagaa

SEQ ID NO: 1430357 - RNA, 16 nt, Human
uaccucuauauaccaa

SEQ ID NO: 1430358 - RNA, 15 nt, Human
uaccucuauauacca

SEQ ID NO: 1430359 - RNA, 23 nt, Human
uaccucuccagccucagcucuca

SEQ ID NO: 1430360 - RNA, 21 nt, Human
uaccucuugagccuugaacuu

SEQ ID NO: 1430361 - RNA, 20 nt, Human
uaccuuuuuauuugcaugug

SEQ ID NO: 1430362 - RNA, 17 nt, Human
uaccuuuuuuauacaua

SEQ ID NO: 1430363 - RNA, 13 nt, Human
uaccuuuuuuaua

SEQ ID NO: 1430364 - RNA, 16 nt, Human
uaccuuuuuuauacau

SEQ ID NO: 1430365 - RNA, 20 nt, Human
uacgaaauaauuguuguucu

SEQ ID NO: 1430366 - RNA, 22 nt, Human
uacgaaauaauuguuguucugu

SEQ ID NO: 1430367 - RNA, 17 nt, Human
uacgaaauaauuguugu

SEQ ID NO: 1430368 - RNA, 16 nt, Human
uacgaaauaauuguug

SEQ ID NO: 1430369 - RNA, 16 nt, Human
uacuaaggacguuguu

SEQ ID NO: 1430370 - RNA, 19 nt, Human
uacuaaggaagauuacuca

SEQ ID NO: 1430371 - RNA, 20 nt, Human
uacuaagcauugaauggcua

SEQ ID NO: 1430372 - RNA, 21 nt, Human
uacuaauagacaauuuauuau

SEQ ID NO: 1430373 - RNA, 14 nt, Human
uacuaaagccaaac

SEQ ID NO: 1430374 - RNA, 17 nt, Human
uacuaaccagcagaaau

SEQ ID NO: 1430375 - RNA, 23 nt, Human
uacuaacaaucagcuccuuccug

SEQ ID NO: 1430376 - RNA, 18 nt, Human
uacuaaagccaaacauau

SEQ ID NO: 1430377 - RNA, 22 nt, Human
uacgaaccuacaguuuuaacug

SEQ ID NO: 1430378 - RNA, 17 nt, Human
uaccucagccugggcgc

SEQ ID NO: 1430379 - RNA, 18 nt, Human
uaccucaggcagcucaag

SEQ ID NO: 1430380 - RNA, 17 nt, Human
uaccucaggcagcucaa

SEQ ID NO: 1430381 - RNA, 16 nt, Human
uaccucaggcagcuca

SEQ ID NO: 1430382 - RNA, 14 nt, Human
uaccucaggcagcu

SEQ ID NO: 1430383 - RNA, 21 nt, Human
uaccucagccugggcgcuggu

SEQ ID NO: 1430384 - RNA, 15 nt, Human
uaccucagccugggc

SEQ ID NO: 1430385 - RNA, 14 nt, Human
uaccucagccuggg

SEQ ID NO: 1430386 - RNA, 21 nt, Human
uaccuaucccaccuccauccc

SEQ ID NO: 1430387 - RNA, 13 nt, Human
uaccucagccugg

SEQ ID NO: 1430388 - RNA, 11 nt, Human
uaccucagccu

SEQ ID NO: 1430389 - RNA, 22 nt, Human
uaccuagcgggauggggcuccc

SEQ ID NO: 1430390 - RNA, 18 nt, Human
uaccuagauuuaauauaa

SEQ ID NO: 1430391 - RNA, 21 nt, Human
uaccuacuuugacuuuuugca

SEQ ID NO: 1430392 - RNA, 14 nt, Human
uaccuacuuugacu

SEQ ID NO: 1430393 - RNA, 13 nt, Human
uaccuacuuugac

SEQ ID NO: 1430394 - RNA, 17 nt, Human
uaccuaagaaguacauu

SEQ ID NO: 1430395 - RNA, 22 nt, Human
uaccuaagauuacaaaucagaa

SEQ ID NO: 1430396 - RNA, 20 nt, Human
uaccuaagauuacaaaucag

SEQ ID NO: 1430397 - RNA, 17 nt, Human
uaccuaagauuacaaau

SEQ ID NO: 1430398 - RNA, 16 nt, Human
uaccgaaugugucuuu

SEQ ID NO: 1430399 - RNA, 17 nt, Human
uaccgaaugugucuuua

SEQ ID NO: 1430400 - RNA, 15 nt, Human
uaccgaaugugucuu

SEQ ID NO: 1430401 - RNA, 14 nt, Human
uaccgaaugugucu

SEQ ID NO: 1430402 - RNA, 20 nt, Human
uaccgaguucaagugauuuu

SEQ ID NO: 1430403 - RNA, 19 nt, Human
uaccgcgucuacccuggga

SEQ ID NO: 1430404 - RNA, 20 nt, Human
uaccguaggcuuuguauuca

SEQ ID NO: 1430405 - RNA, 15 nt, Human
uaccaaaaauaaaua

SEQ ID NO: 1430406 - RNA, 20 nt, Human
uacauuuuuugggcagcaau

SEQ ID NO: 1430407 - RNA, 23 nt, Human
uacauuuuuaagugcugcauuua

SEQ ID NO: 1430408 - RNA, 22 nt, Human
uaccaaaaaucucaauauuuca

SEQ ID NO: 1430409 - RNA, 14 nt, Human
uacaaagguuuaaa

SEQ ID NO: 1430410 - RNA, 18 nt, Human
uacaaaggcuuauuaauu

SEQ ID NO: 1430411 - RNA, 17 nt, Human
uacaaagcccuuuuaua

SEQ ID NO: 1430412 - RNA, 15 nt, Human
uacaaacugaagagu

SEQ ID NO: 1430413 - RNA, 19 nt, Human
uacaaacucccacuuguca

SEQ ID NO: 1430414 - RNA, 19 nt, Human
uacaaacugaagaguaauc

SEQ ID NO: 1430415 - RNA, 18 nt, Human
uacaaagguuuaaaugaa

SEQ ID NO: 1430416 - RNA, 17 nt, Human
uacaaagguuuaaauga

SEQ ID NO: 1430417 - RNA, 16 nt, Human
uacaaagguuuaaaug

SEQ ID NO: 1430418 - RNA, 15 nt, Human
uacaaagguuuaaau

SEQ ID NO: 1430419 - RNA, 12 nt, Human
uacaaaugaaaa

SEQ ID NO: 1430420 - RNA, 22 nt, Human
uacaaaucagaagucaucuugc

SEQ ID NO: 1430421 - RNA, 21 nt, Human
uacaaaucagaagucaucuug

SEQ ID NO: 1430422 - RNA, 20 nt, Human
uacaaaucagaagucaucuu

SEQ ID NO: 1430423 - RNA, 19 nt, Human
uacaaaucagaagucaucu

SEQ ID NO: 1430424 - RNA, 17 nt, Human
uacaaaucagaagucau

SEQ ID NO: 1430425 - RNA, 16 nt, Human
uacaaaucagaaguca

SEQ ID NO: 1430426 - RNA, 16 nt, Human
uacaaaucaaguauuu

SEQ ID NO: 1430427 - RNA, 20 nt, Human
uacaaagguuuaaaugaaca

SEQ ID NO: 1430428 - RNA, 19 nt, Human
uacaaagguuuaaaugaac

SEQ ID NO: 1430429 - RNA, 22 nt, Human
uaauuuuuacagaauugcuugu

SEQ ID NO: 1430430 - RNA, 17 nt, Human
uaauuuuuauauuugaa

SEQ ID NO: 1430431 - RNA, 16 nt, Human
uaauuuuuauauuuga

SEQ ID NO: 1430432 - RNA, 17 nt, Human
uaauuuuuacagaauug

SEQ ID NO: 1430433 - RNA, 16 nt, Human
uaauuuuuacagaauu

SEQ ID NO: 1430434 - RNA, 12 nt, Human
uaauuuuuauau

SEQ ID NO: 1430435 - RNA, 20 nt, Human
uaauuuuguguaagaaauac

SEQ ID NO: 1430436 - RNA, 19 nt, Human
uaauuuuguguaagaaaua

SEQ ID NO: 1430437 - RNA, 13 nt, Human
uaauuuuguguaa

SEQ ID NO: 1430438 - RNA, 18 nt, Human
uaauuuugugaagcaaaa

SEQ ID NO: 1430439 - RNA, 22 nt, Human
uaauuagugccacuuaauguau

SEQ ID NO: 1430440 - RNA, 21 nt, Human
uaauuagugccacuuaaugua

SEQ ID NO: 1430441 - RNA, 19 nt, Human
uaauuagugccacuuaaug

SEQ ID NO: 1430442 - RNA, 14 nt, Human
uaauuagugccacu

SEQ ID NO: 1430443 - RNA, 14 nt, Human
uaauuccuucagca

SEQ ID NO: 1430444 - RNA, 20 nt, Human
uaauuagugcuaagugugaa

SEQ ID NO: 1430445 - RNA, 12 nt, Human
uaauuagugcua

SEQ ID NO: 1430446 - RNA, 14 nt, Human
uaauuagugcuaag

SEQ ID NO: 1430447 - RNA, 15 nt, Human
uaauuagugcuaagu

SEQ ID NO: 1430448 - RNA, 16 nt, Human
uaauuagugcuaagug

SEQ ID NO: 1430449 - RNA, 23 nt, Human
uaauucuauuaaagugcuaaggu

SEQ ID NO: 1430450 - RNA, 15 nt, Human
uaauucuaugccugu

SEQ ID NO: 1430451 - RNA, 15 nt, Human
uaauucuaugagaua

SEQ ID NO: 1430452 - RNA, 18 nt, Human
uaauucuaaaugaauguu

SEQ ID NO: 1430453 - RNA, 11 nt, Human
uaauucuaaau

SEQ ID NO: 1430454 - RNA, 21 nt, Human
uaauuccuucagcacuuuaga

SEQ ID NO: 1430455 - RNA, 20 nt, Human
uaauuccuucagcacuuuag

SEQ ID NO: 1430456 - RNA, 15 nt, Human
uacacucugcuguuu

SEQ ID NO: 1430457 - RNA, 16 nt, Human
uacacucuuuguaaga

SEQ ID NO: 1430458 - RNA, 23 nt, Human
uacacucugcuguuugacaccuc

SEQ ID NO: 1430459 - RNA, 14 nt, Human
uacacucugcuguu

SEQ ID NO: 1430460 - RNA, 13 nt, Human
uacacucugcugu

SEQ ID NO: 1430461 - RNA, 19 nt, Human
uacacucguaugauacuuc

SEQ ID NO: 1430462 - RNA, 21 nt, Human
uacacucucaaagcaaauaau

SEQ ID NO: 1430463 - RNA, 21 nt, Human
uacacauguaucuaugcauuu

SEQ ID NO: 1430464 - RNA, 19 nt, Human
uacacauuuuauuuuauua

SEQ ID NO: 1430465 - RNA, 13 nt, Human
uacacagucagcu

SEQ ID NO: 1430466 - RNA, 16 nt, Human
uacacacggugccuuu

SEQ ID NO: 1430467 - RNA, 17 nt, Human
uacacacggugccuuua

SEQ ID NO: 1430468 - RNA, 17 nt, Human
uacacacugcauguuug

SEQ ID NO: 1430469 - RNA, 15 nt, Human
uacacacugcauguu

SEQ ID NO: 1430470 - RNA, 15 nt, Human
uacaagaagcauuuu

SEQ ID NO: 1430471 - RNA, 14 nt, Human
uacaagaagcauuu

SEQ ID NO: 1430472 - RNA, 23 nt, Human
uacaacugccucgaaacacagaa

SEQ ID NO: 1430473 - RNA, 17 nt, Human
uacaacucauacacucg

SEQ ID NO: 1430474 - RNA, 15 nt, Human
uacaacggagucaaa

SEQ ID NO: 1430475 - RNA, 22 nt, Human
uacaacggagucaaaaauuaaa

SEQ ID NO: 1430476 - RNA, 21 nt, Human
uacaaauguuaaaauguguug

SEQ ID NO: 1430477 - RNA, 23 nt, Human
uacaaauguuaaaauguguuguu

SEQ ID NO: 1430478 - RNA, 18 nt, Human
uacaaauguuaaaaugug

SEQ ID NO: 1430479 - RNA, 17 nt, Human
uacaaauguuaaaaugu

SEQ ID NO: 1430480 - RNA, 13 nt, Human
uacaaauggauuu

SEQ ID NO: 1430481 - RNA, 16 nt, Human
uacaaccaauggaaug

SEQ ID NO: 1430482 - RNA, 15 nt, Human
uacaaccuccgccuc

SEQ ID NO: 1430483 - RNA, 21 nt, Human
uacagcucagaaguuucuucu

SEQ ID NO: 1430484 - RNA, 17 nt, Human
uacagcuggggugcagg

SEQ ID NO: 1430485 - RNA, 13 nt, Human
uacagcuggcucu

SEQ ID NO: 1430486 - RNA, 18 nt, Human
uacagcuguauugucuga

SEQ ID NO: 1430487 - RNA, 19 nt, Human
uacagcuguauugucugaa

SEQ ID NO: 1430488 - RNA, 14 nt, Human
uacagcuguauugu

SEQ ID NO: 1430489 - RNA, 15 nt, Human
uacagcuggggugca

SEQ ID NO: 1430490 - RNA, 17 nt, Human
uacacuguguaaauacc

SEQ ID NO: 1430491 - RNA, 20 nt, Human
uacacuguuucaaacuuuac

SEQ ID NO: 1430492 - RNA, 22 nt, Human
uacacuguuucaaacuuuacua

SEQ ID NO: 1430493 - RNA, 21 nt, Human
uacaguucugugguuucaugu

SEQ ID NO: 1430494 - RNA, 15 nt, Human
uacaguucugugguu

SEQ ID NO: 1430495 - RNA, 14 nt, Human
uacaguucuguggu

SEQ ID NO: 1430496 - RNA, 20 nt, Human
uacaguucugcucugguugu

SEQ ID NO: 1430497 - RNA, 13 nt, Human
uacaguucugcuc

SEQ ID NO: 1430498 - RNA, 18 nt, Human
uacaguuuguuaguauga

SEQ ID NO: 1430499 - RNA, 14 nt, Human
uacaggauuugaaa

SEQ ID NO: 1430500 - RNA, 20 nt, Human
uacaggaugaugacuaugga

SEQ ID NO: 1430501 - RNA, 23 nt, Human
uacaguucggugagcuacaaaug

SEQ ID NO: 1430502 - RNA, 20 nt, Human
uacaguuuuaacuguggaua

SEQ ID NO: 1430503 - RNA, 21 nt, Human
uacaguuuuaacuguggauau

SEQ ID NO: 1430504 - RNA, 19 nt, Human
uacaguuuuaacuguggau

SEQ ID NO: 1430505 - RNA, 17 nt, Human
uacaguuuuaacugugg

SEQ ID NO: 1430506 - RNA, 15 nt, Human
uacaguuuuaacugu

SEQ ID NO: 1430507 - RNA, 14 nt, Human
uacaguuuuaacug

SEQ ID NO: 1430508 - RNA, 19 nt, Human
uacaguuuguuaguaugag

SEQ ID NO: 1430509 - RNA, 21 nt, Human
uacaguuuguuaguaugaggc

SEQ ID NO: 1430510 - RNA, 21 nt, Human
uacauaacugaaaaugugcua

SEQ ID NO: 1430511 - RNA, 17 nt, Human
uacauaacugaaaaugu

SEQ ID NO: 1430512 - RNA, 15 nt, Human
uacauaacugaaaau

SEQ ID NO: 1430513 - RNA, 13 nt, Human
uacauaacugaaa

SEQ ID NO: 1430514 - RNA, 18 nt, Human
uacaguuuugaguagagu

SEQ ID NO: 1430515 - RNA, 16 nt, Human
uacaugaaaacacauu

SEQ ID NO: 1430516 - RNA, 17 nt, Human
uacaugaaaacacauuu

SEQ ID NO: 1430517 - RNA, 18 nt, Human
uacaugaaaacacauuuu

SEQ ID NO: 1430518 - RNA, 19 nt, Human
uacaugaaaacacauuuuu

SEQ ID NO: 1430519 - RNA, 23 nt, Human
uacaugaaaacacauuuuucuua

SEQ ID NO: 1430520 - RNA, 23 nt, Human
uacaugcuuauuccaugacugcu

SEQ ID NO: 1430521 - RNA, 21 nt, Human
uacaugcuuauuccaugacug

SEQ ID NO: 1430522 - RNA, 20 nt, Human
uacaugcuuauuccaugacu

SEQ ID NO: 1430523 - RNA, 17 nt, Human
uacaugcuuauuccaug

SEQ ID NO: 1430524 - RNA, 16 nt, Human
uacaugcuuauuccau

SEQ ID NO: 1430525 - RNA, 15 nt, Human
uacaugcuuauucca

SEQ ID NO: 1430526 - RNA, 12 nt, Human
uacaugcuuauu

SEQ ID NO: 1430527 - RNA, 19 nt, Human
uacaugcuaagagaaguag

SEQ ID NO: 1430528 - RNA, 18 nt, Human
uacaugcuaagagaagua

SEQ ID NO: 1430529 - RNA, 17 nt, Human
uacaugcuaagagaagu

SEQ ID NO: 1430530 - RNA, 22 nt, Human
uacaugcauugagcucucucau

SEQ ID NO: 1430531 - RNA, 20 nt, Human
uacaugcauuacugcaugca

SEQ ID NO: 1430532 - RNA, 21 nt, Human
uacaugcauacacucucaaag

SEQ ID NO: 1430533 - RNA, 20 nt, Human
uacaugcauacacucucaaa

SEQ ID NO: 1430534 - RNA, 14 nt, Human
uacaugcauacacu

SEQ ID NO: 1430535 - RNA, 21 nt, Human
uacaugcacuuggcugcauaa

SEQ ID NO: 1430536 - RNA, 21 nt, Human
uacaugaaacagaaacaaaaa

SEQ ID NO: 1430537 - RNA, 15 nt, Human
uacaugaaacagaaa

SEQ ID NO: 1430538 - RNA, 14 nt, Human
uacaugaaacagaa

SEQ ID NO: 1430539 - RNA, 13 nt, Human
uacaugaaacaga

SEQ ID NO: 1430540 - RNA, 12 nt, Human
uacaugaaacag

SEQ ID NO: 1430541 - RNA, 21 nt, Human
uacauggcuggagcuagaauu

SEQ ID NO: 1430542 - RNA, 14 nt, Human
uacauuuuuaagug

SEQ ID NO: 1430543 - RNA, 19 nt, Human
uacauuuuuaagugcugca

SEQ ID NO: 1430544 - RNA, 22 nt, Human
uacauuuuuaagugcugcauuu

SEQ ID NO: 1430545 - RNA, 15 nt, Human
uagagugucuuucca

SEQ ID NO: 1430546 - RNA, 17 nt, Human
uagagucugaacagcug

SEQ ID NO: 1430547 - RNA, 17 nt, Human
uagaggugagaaauuua

SEQ ID NO: 1430548 - RNA, 16 nt, Human
uagaggugagaaauuu

SEQ ID NO: 1430549 - RNA, 22 nt, Human
uagagucccagguuggcucugc

SEQ ID NO: 1430550 - RNA, 14 nt, Human
uagaguugauacua

SEQ ID NO: 1430551 - RNA, 17 nt, Human
uagaguugauacuacag

SEQ ID NO: 1430552 - RNA, 13 nt, Human
uagaguuagacug

SEQ ID NO: 1430553 - RNA, 14 nt, Human
uagaguuagacugu

SEQ ID NO: 1430554 - RNA, 19 nt, Human
uagagaaguauacauaagu

SEQ ID NO: 1430555 - RNA, 18 nt, Human
uagagaagacaggcugga

SEQ ID NO: 1430556 - RNA, 15 nt, Human
uagagaagacaggcu

SEQ ID NO: 1430557 - RNA, 13 nt, Human
uagagaagcaagu

SEQ ID NO: 1430558 - RNA, 16 nt, Human
uagagaagcaaguaaa

SEQ ID NO: 1430559 - RNA, 14 nt, Human
uagagguucaaaga

SEQ ID NO: 1430560 - RNA, 15 nt, Human
uagagguucaaagau

SEQ ID NO: 1430561 - RNA, 22 nt, Human
uagaccagcagacagagccagg

SEQ ID NO: 1430562 - RNA, 19 nt, Human
uagaccagcagacagagcc

SEQ ID NO: 1430563 - RNA, 10 nt, Human
uagaccaaua

SEQ ID NO: 1430564 - RNA, 12 nt, Human
uagaccaauaaa

SEQ ID NO: 1430565 - RNA, 23 nt, Human
uagacuaaggccauuauuguacu

SEQ ID NO: 1430566 - RNA, 19 nt, Human
uagaccuuguuacuucuga

SEQ ID NO: 1430567 - RNA, 17 nt, Human
uagaccuuguuacuucu

SEQ ID NO: 1430568 - RNA, 23 nt, Human
uagacggagcccuggcaugucaa

SEQ ID NO: 1430569 - RNA, 22 nt, Human
uagacuucaagcauggcuauuu

SEQ ID NO: 1430570 - RNA, 18 nt, Human
uagacugugauucagaaa

SEQ ID NO: 1430571 - RNA, 23 nt, Human
uagacuguugggguggguauaaa

SEQ ID NO: 1430572 - RNA, 17 nt, Human
uagacugugauucagaa

SEQ ID NO: 1430573 - RNA, 21 nt, Human
uagaaugauuucaugcuaucu

SEQ ID NO: 1430574 - RNA, 12 nt, Human
uagaaugacagu

SEQ ID NO: 1430575 - RNA, 22 nt, Human
uagaaucugcaauucaaaaguu

SEQ ID NO: 1430576 - RNA, 18 nt, Human
uagaaucugcaauucaaa

SEQ ID NO: 1430577 - RNA, 21 nt, Human
uagaaucccagcccccugacc

SEQ ID NO: 1430578 - RNA, 22 nt, Human
uagaaucccagcccccugacca

SEQ ID NO: 1430579 - RNA, 18 nt, Human
uagaaucccagcccccug

SEQ ID NO: 1430580 - RNA, 16 nt, Human
uagaaugauuucaugc

SEQ ID NO: 1430581 - RNA, 17 nt, Human
uagaauguaaagcuugu

SEQ ID NO: 1430582 - RNA, 15 nt, Human
uagaauguaaagcuu

SEQ ID NO: 1430583 - RNA, 18 nt, Human
uagaauguaaagcuuguc

SEQ ID NO: 1430584 - RNA, 21 nt, Human
uagaauuauaacuggaaagaa

SEQ ID NO: 1430585 - RNA, 16 nt, Human
uagaauuauuuaaaca

SEQ ID NO: 1430586 - RNA, 15 nt, Human
uagaauuauuuaaac

SEQ ID NO: 1430587 - RNA, 12 nt, Human
uagaauuauuua

SEQ ID NO: 1430588 - RNA, 23 nt, Human
uagaauuaucuaauuuauaaaaa

SEQ ID NO: 1430589 - RNA, 22 nt, Human
uagaauuaucuaauuuauaaaa

SEQ ID NO: 1430590 - RNA, 21 nt, Human
uagaauuaucuaauuuauaaa

SEQ ID NO: 1430591 - RNA, 19 nt, Human
uagaauuaucuaauuuaua

SEQ ID NO: 1430592 - RNA, 16 nt, Human
uagaauuaucuaauuu

SEQ ID NO: 1430593 - RNA, 15 nt, Human
uagaauuaucuaauu

SEQ ID NO: 1430594 - RNA, 22 nt, Human
uagaauuauaacuguaaagaug

SEQ ID NO: 1430595 - RNA, 15 nt, Human
uacuuguuucagagu

SEQ ID NO: 1430596 - RNA, 14 nt, Human
uacuuguuucagag

SEQ ID NO: 1430597 - RNA, 20 nt, Human
uacuuguggacuaaaagaua

SEQ ID NO: 1430598 - RNA, 22 nt, Human
uacuuguggacuaaaagauaua

SEQ ID NO: 1430599 - RNA, 23 nt, Human
uacuuguggacuaaaagauauaa

SEQ ID NO: 1430600 - RNA, 15 nt, Human
uacuuguggacuaaa

SEQ ID NO: 1430601 - RNA, 16 nt, Human
uacuuguggacuaaaa

SEQ ID NO: 1430602 - RNA, 19 nt, Human
uacuuguggacuaaaagau

SEQ ID NO: 1430603 - RNA, 22 nt, Human
uagaauaaaggcaguuuucuaa

SEQ ID NO: 1430604 - RNA, 21 nt, Human
uagaauaaaggcaguuuucua

SEQ ID NO: 1430605 - RNA, 19 nt, Human
uagaauaaaggcaguuuuc

SEQ ID NO: 1430606 - RNA, 23 nt, Human
uagaauaccacaggaaccacaag

SEQ ID NO: 1430607 - RNA, 23 nt, Human
uagaauacaguuuugaguagagu

SEQ ID NO: 1430608 - RNA, 22 nt, Human
uagaaucaaacauuuugaaagu

SEQ ID NO: 1430609 - RNA, 21 nt, Human
uagaaucaaacauuuugaaag

SEQ ID NO: 1430610 - RNA, 13 nt, Human
uagaauaugccuu

SEQ ID NO: 1430611 - RNA, 20 nt, Human
uagccuguccugucaucauc

SEQ ID NO: 1430612 - RNA, 16 nt, Human
uagccuguccugucau

SEQ ID NO: 1430613 - RNA, 14 nt, Human
uagccuguccuguc

SEQ ID NO: 1430614 - RNA, 13 nt, Human
uagccuguccugu

SEQ ID NO: 1430615 - RNA, 12 nt, Human
uagccuguccug

SEQ ID NO: 1430616 - RNA, 11 nt, Human
uagccuguccu

SEQ ID NO: 1430617 - RNA, 12 nt, Human
uagcucauucuc

SEQ ID NO: 1430618 - RNA, 11 nt, Human
uagccuggcua

SEQ ID NO: 1430619 - RNA, 14 nt, Human
uagccuggcuuggg

SEQ ID NO: 1430620 - RNA, 22 nt, Human
uagccuggaccucugacagcag

SEQ ID NO: 1430621 - RNA, 23 nt, Human
uagccuggaccucugacagcagc

SEQ ID NO: 1430622 - RNA, 21 nt, Human
uagccuggaccucugacagca

SEQ ID NO: 1430623 - RNA, 17 nt, Human
uagccuggaccucugac

SEQ ID NO: 1430624 - RNA, 11 nt, Human
uagccuggacc

SEQ ID NO: 1430625 - RNA, 21 nt, Human
uagccuaaggcuccuguuuug

SEQ ID NO: 1430626 - RNA, 20 nt, Human
uagccuaaggcuccuguuuu

SEQ ID NO: 1430627 - RNA, 12 nt, Human
uagcugagcuca

SEQ ID NO: 1430628 - RNA, 14 nt, Human
uagcugaucaguuu

SEQ ID NO: 1430629 - RNA, 21 nt, Human
uagcugagcucacaaggcagc

SEQ ID NO: 1430630 - RNA, 11 nt, Human
uagcugagcuc

SEQ ID NO: 1430631 - RNA, 19 nt, Human
uagcugaauguuuuucuaa

SEQ ID NO: 1430632 - RNA, 18 nt, Human
uagcugaauguuuuucua

SEQ ID NO: 1430633 - RNA, 15 nt, Human
uagcugaauguuuuu

SEQ ID NO: 1430634 - RNA, 19 nt, Human
uagcucuuugucagggagu

SEQ ID NO: 1430635 - RNA, 18 nt, Human
uagcucuuugucagggag

SEQ ID NO: 1430636 - RNA, 23 nt, Human
uagcaugcuuguugcaauugccu

SEQ ID NO: 1430637 - RNA, 18 nt, Human
uagcaugcuuguugcaau

SEQ ID NO: 1430638 - RNA, 17 nt, Human
uagcaugcuuguugcaa

SEQ ID NO: 1430639 - RNA, 16 nt, Human
uagcaugaagacagag

SEQ ID NO: 1430640 - RNA, 23 nt, Human
uagccagccggggcgaguggcac

SEQ ID NO: 1430641 - RNA, 23 nt, Human
uagccauauuuguaaaaugacaa

SEQ ID NO: 1430642 - RNA, 20 nt, Human
uagccauauuuguaaaauga

SEQ ID NO: 1430643 - RNA, 19 nt, Human
uagccauauuuguaaaaug

SEQ ID NO: 1430644 - RNA, 17 nt, Human
uagccauauuuguaaaa

SEQ ID NO: 1430645 - RNA, 15 nt, Human
uagccauauuuguaa

SEQ ID NO: 1430646 - RNA, 21 nt, Human
uagcccccugguaauagcugu

SEQ ID NO: 1430647 - RNA, 22 nt, Human
uagccauauuuguaaaaugaca

SEQ ID NO: 1430648 - RNA, 22 nt, Human
uagccccugggguggccaccag

SEQ ID NO: 1430649 - RNA, 14 nt, Human
uagccccugaaagc

SEQ ID NO: 1430650 - RNA, 22 nt, Human
uagcccccugguaauagcugua

SEQ ID NO: 1430651 - RNA, 16 nt, Human
uagccccucuccugga

SEQ ID NO: 1430652 - RNA, 23 nt, Human
uagauacccuacgcuguccagaa

SEQ ID NO: 1430653 - RNA, 17 nt, Human
uagaguuagacuguugg

SEQ ID NO: 1430654 - RNA, 15 nt, Human
uagaguuagacuguu

SEQ ID NO: 1430655 - RNA, 16 nt, Human
uagaguuagacuguug

SEQ ID NO: 1430656 - RNA, 16 nt, Human
uagauacuguaucaug

SEQ ID NO: 1430657 - RNA, 17 nt, Human
uagauagcccuguccug

SEQ ID NO: 1430658 - RNA, 15 nt, Human
uagauagcccugucc

SEQ ID NO: 1430659 - RNA, 14 nt, Human
uagauaggccaugg

SEQ ID NO: 1430660 - RNA, 23 nt, Human
uagauagcccuguccugguggua

SEQ ID NO: 1430661 - RNA, 19 nt, Human
uagauagcccuguccuggu

SEQ ID NO: 1430662 - RNA, 16 nt, Human
uagauuuuaaucaaau

SEQ ID NO: 1430663 - RNA, 20 nt, Human
uagauuugugugcaucaggc

SEQ ID NO: 1430664 - RNA, 22 nt, Human
uagauuugugugcaucaggcuu

SEQ ID NO: 1430665 - RNA, 19 nt, Human
uagauuugugugcaucagg

SEQ ID NO: 1430666 - RNA, 24 nt, Human
uagauuuggcuccucugcuucuca

SEQ ID NO: 1430667 - RNA, 20 nt, Human
uagauuuggcuccucugcuu

SEQ ID NO: 1430668 - RNA, 23 nt, Human
uagauuucauaguucagaauuua

SEQ ID NO: 1430669 - RNA, 22 nt, Human
uagauuucauaguucagaauuu

SEQ ID NO: 1430670 - RNA, 20 nt, Human
uagauuucauaguucagaau

SEQ ID NO: 1430671 - RNA, 19 nt, Human
uagauuucauaguucagaa

SEQ ID NO: 1430672 - RNA, 18 nt, Human
uagauuucauaguucaga

SEQ ID NO: 1430673 - RNA, 16 nt, Human
uagauuucauaguuca

SEQ ID NO: 1430674 - RNA, 11 nt, Human
uagauuuaugg

SEQ ID NO: 1430675 - RNA, 14 nt, Human
uagauucuaaagau

SEQ ID NO: 1430676 - RNA, 13 nt, Human
uagauucuaaaga

SEQ ID NO: 1430677 - RNA, 12 nt, Human
uagauucuaaag

SEQ ID NO: 1430678 - RNA, 11 nt, Human
uagauucuaaa

SEQ ID NO: 1430679 - RNA, 21 nt, Human
uagauuccauugguccaagau

SEQ ID NO: 1430680 - RNA, 20 nt, Human
uagauuccauugguccaaga

SEQ ID NO: 1430681 - RNA, 19 nt, Human
uagauucagguaauacaaa

SEQ ID NO: 1430682 - RNA, 17 nt, Human
uagauucagguaauaca

SEQ ID NO: 1430683 - RNA, 18 nt, Human
uagauucaaagguucuag

SEQ ID NO: 1430684 - RNA, 17 nt, Human
uagauucaaagguucua

SEQ ID NO: 1430685 - RNA, 16 nt, Human
uagauucaaagguucu

SEQ ID NO: 1430686 - RNA, 15 nt, Human
uagauucaaagguuc

SEQ ID NO: 1430687 - RNA, 13 nt, Human
uagauucaaaggu

SEQ ID NO: 1430688 - RNA, 20 nt, Human
uagauaggaagaaagaagac

SEQ ID NO: 1430689 - RNA, 22 nt, Human
uagcagcggaacaaggagucag

SEQ ID NO: 1430690 - RNA, 16 nt, Human
uagcagccuuucucuc

SEQ ID NO: 1430691 - RNA, 13 nt, Human
uagcagccuuucu

SEQ ID NO: 1430692 - RNA, 12 nt, Human
uagcagccuuuc

SEQ ID NO: 1430693 - RNA, 18 nt, Human
uagauuuuacaugaagua

SEQ ID NO: 1430694 - RNA, 17 nt, Human
uagauuuuacaugaagu

SEQ ID NO: 1430695 - RNA, 16 nt, Human
uagauuuuacaugaag

SEQ ID NO: 1430696 - RNA, 20 nt, Human
uagauuuuacaugaaguauu

SEQ ID NO: 1430697 - RNA, 15 nt, Human
uagauuuuacaugaa

SEQ ID NO: 1430698 - RNA, 14 nt, Human
uagauuuuacauga

SEQ ID NO: 1430699 - RNA, 18 nt, Human
uagauuuuaaucaaauuu

SEQ ID NO: 1430700 - RNA, 17 nt, Human
uagauuuuaaucaaauu

SEQ ID NO: 1430701 - RNA, 15 nt, Human
uagcagcuuccagau

SEQ ID NO: 1430702 - RNA, 14 nt, Human
uagcagcuuccaga

SEQ ID NO: 1430703 - RNA, 17 nt, Human
uagcauacguacacauu

SEQ ID NO: 1430704 - RNA, 18 nt, Human
uagcauacguacacauuu

SEQ ID NO: 1430705 - RNA, 19 nt, Human
uagcauacguacacauuuu

SEQ ID NO: 1430706 - RNA, 18 nt, Human
uagcauccuggaauaucu

SEQ ID NO: 1430707 - RNA, 16 nt, Human
uagcauccuggaauau

SEQ ID NO: 1430708 - RNA, 15 nt, Human
uagcauccuggaaua

SEQ ID NO: 1430709 - RNA, 13 nt, Human
uagcauccuggaa

SEQ ID NO: 1430710 - RNA, 14 nt, Human
uagcauaucugccu

SEQ ID NO: 1430711 - RNA, 16 nt, Human
uagcauaucugccuuu

SEQ ID NO: 1430712 - RNA, 17 nt, Human
uagcauaucugccuuua

SEQ ID NO: 1430713 - RNA, 18 nt, Human
uagcauaucugccuuuau

SEQ ID NO: 1430714 - RNA, 21 nt, Human
uagcauaucugccuuuauugu

SEQ ID NO: 1430715 - RNA, 22 nt, Human
uagcauaucugccuuuauugug

SEQ ID NO: 1430716 - RNA, 23 nt, Human
uagcauaucugccuuuauugugu

SEQ ID NO: 1430717 - RNA, 19 nt, Human
uaggugcuauuugucaucu

SEQ ID NO: 1430718 - RNA, 22 nt, Human
uaggucugaaauuuuucuucuu

SEQ ID NO: 1430719 - RNA, 18 nt, Human
uaggucugaaauuuuucu

SEQ ID NO: 1430720 - RNA, 14 nt, Human
uaggucugaaauuu

SEQ ID NO: 1430721 - RNA, 12 nt, Human
uaggucugaaau

SEQ ID NO: 1430722 - RNA, 18 nt, Human
uaggcuuaguuugugugu

SEQ ID NO: 1430723 - RNA, 21 nt, Human
uaggcuguaacuacuuuauaa

SEQ ID NO: 1430724 - RNA, 19 nt, Human
uaggcuguaacuacuuuau

SEQ ID NO: 1430725 - RNA, 20 nt, Human
uaggcuggaguuagggacug

SEQ ID NO: 1430726 - RNA, 23 nt, Human
uaggcugacaccuaacucuucuu

SEQ ID NO: 1430727 - RNA, 21 nt, Human
uaggcugacaccuaacucuuc

SEQ ID NO: 1430728 - RNA, 19 nt, Human
uaggcugacaccuaacucu

SEQ ID NO: 1430729 - RNA, 16 nt, Human
uagcugugaccucucc

SEQ ID NO: 1430730 - RNA, 21 nt, Human
uagcugucugcucagacagaa

SEQ ID NO: 1430731 - RNA, 22 nt, Human
uagcuguccuuuuuccucucca

SEQ ID NO: 1430732 - RNA, 14 nt, Human
uagcugggacuaca

SEQ ID NO: 1430733 - RNA, 19 nt, Human
uaggucugaaauuuuucuu

SEQ ID NO: 1430734 - RNA, 19 nt, Human
uaggugugacugaauuucu

SEQ ID NO: 1430735 - RNA, 21 nt, Human
uaggugugacugaauuucuuu

SEQ ID NO: 1430736 - RNA, 23 nt, Human
uaggugugacugaauuucuuuug

SEQ ID NO: 1430737 - RNA, 21 nt, Human
uagguguuuuguucaccauua

SEQ ID NO: 1430738 - RNA, 20 nt, Human
uagguggguugaaagccaag

SEQ ID NO: 1430739 - RNA, 14 nt, Human
uagguucagccaag

SEQ ID NO: 1430740 - RNA, 22 nt, Human
uagguuauuuugauguaaagau

SEQ ID NO: 1430741 - RNA, 18 nt, Human
uagguugcacacuuuggu

SEQ ID NO: 1430742 - RNA, 17 nt, Human
uagguugcacacuuugg

SEQ ID NO: 1430743 - RNA, 16 nt, Human
uagguugcacacuuug

SEQ ID NO: 1430744 - RNA, 13 nt, Human
uagguugcacacu

SEQ ID NO: 1430745 - RNA, 12 nt, Human
uagguugcacac

SEQ ID NO: 1430746 - RNA, 18 nt, Human
uagguucuuugcugcauu

SEQ ID NO: 1430747 - RNA, 22 nt, Human
uagguucuaaaguucuaagauu

SEQ ID NO: 1430748 - RNA, 21 nt, Human
uagguucuaaaguucuaagau

SEQ ID NO: 1430749 - RNA, 20 nt, Human
uagguucuaaaguucuaaga

SEQ ID NO: 1430750 - RNA, 18 nt, Human
uagguucuaaaguucuaa

SEQ ID NO: 1430751 - RNA, 17 nt, Human
uagguucuaaaguucua

SEQ ID NO: 1430752 - RNA, 16 nt, Human
uagguucuaaaguucu

SEQ ID NO: 1430753 - RNA, 15 nt, Human
uagguucuaaaguuc

SEQ ID NO: 1430754 - RNA, 15 nt, Human
uagguucagccaagg

SEQ ID NO: 1430755 - RNA, 12 nt, Human
uagguucuaaaa

SEQ ID NO: 1430756 - RNA, 13 nt, Human
uagguucuaaagu

SEQ ID NO: 1430757 - RNA, 20 nt, Human
uaguagcagugauugucuua

SEQ ID NO: 1430758 - RNA, 19 nt, Human
uaguagcguuuuuuaaaug

SEQ ID NO: 1430759 - RNA, 21 nt, Human
uaguagcguuuuuuaaaugua

SEQ ID NO: 1430760 - RNA, 23 nt, Human
uaguagcguuuuuuaaauguaua

SEQ ID NO: 1430761 - RNA, 17 nt, Human
uaguaugaggcauuugu

SEQ ID NO: 1430762 - RNA, 18 nt, Human
uaguaugaggcauuuguu

SEQ ID NO: 1430763 - RNA, 12 nt, Human
uaguugaauuuu

SEQ ID NO: 1430764 - RNA, 23 nt, Human
uaguugaauuuuuuuuaacauuc

SEQ ID NO: 1430765 - RNA, 17 nt, Human
uaguugaaaauaaagug

SEQ ID NO: 1430766 - RNA, 17 nt, Human
uaguucuuacugcuuaa

SEQ ID NO: 1430767 - RNA, 21 nt, Human
uaguauuguuguccuuuucau

SEQ ID NO: 1430768 - RNA, 17 nt, Human
uaguauuguuguccuuu

SEQ ID NO: 1430769 - RNA, 16 nt, Human
uaguauuguuguccuu

SEQ ID NO: 1430770 - RNA, 13 nt, Human
uaguauuguuguc

SEQ ID NO: 1430771 - RNA, 22 nt, Human
uaguauuguuguccuuuucaua

SEQ ID NO: 1430772 - RNA, 16 nt, Human
uaguauuucuaugaaa

SEQ ID NO: 1430773 - RNA, 16 nt, Human
uaguauggccuguguc

SEQ ID NO: 1430774 - RNA, 16 nt, Human
uaguaggcauuuuuac

SEQ ID NO: 1430775 - RNA, 19 nt, Human
uaguauggccugugucacu

SEQ ID NO: 1430776 - RNA, 17 nt, Human
uaguauggccuguguca

SEQ ID NO: 1430777 - RNA, 17 nt, Human
uaguauuguccaggucu

SEQ ID NO: 1430778 - RNA, 22 nt, Human
uauaaacaagaaaaauaaagaa

SEQ ID NO: 1430779 - RNA, 20 nt, Human
uauaaacaagaaaaauaaag

SEQ ID NO: 1430780 - RNA, 19 nt, Human
uauaaacaagaaaaauaaa

SEQ ID NO: 1430781 - RNA, 15 nt, Human
uauaaacaagaaaaa

SEQ ID NO: 1430782 - RNA, 13 nt, Human
uauaaacaagaaa

SEQ ID NO: 1430783 - RNA, 21 nt, Human
uauaaacaagaaaaauaaaga

SEQ ID NO: 1430784 - RNA, 22 nt, Human
uaguugaauuuuuuuuaacauu

SEQ ID NO: 1430785 - RNA, 15 nt, Human
uaguuugauuaaauu

SEQ ID NO: 1430786 - RNA, 16 nt, Human
uaguuugauuaaauuc

SEQ ID NO: 1430787 - RNA, 21 nt, Human
uaguuugauuaaauucuugca

SEQ ID NO: 1430788 - RNA, 18 nt, Human
uauaaaccgaacugaugu

SEQ ID NO: 1430789 - RNA, 11 nt, Human
uauaaacuuua

SEQ ID NO: 1430790 - RNA, 13 nt, Human
uauaaacuuuacc

SEQ ID NO: 1430791 - RNA, 14 nt, Human
uauaaacuuuaccu

SEQ ID NO: 1430792 - RNA, 15 nt, Human
uauaaacuuuaccuu

SEQ ID NO: 1430793 - RNA, 16 nt, Human
uauaaacuuuaccuuu

SEQ ID NO: 1430794 - RNA, 17 nt, Human
uauaaacuuuaccuuuu

SEQ ID NO: 1430795 - RNA, 18 nt, Human
uauaaacuuuaccuuuuu

SEQ ID NO: 1430796 - RNA, 16 nt, Human
uaucaugagugaauaa

SEQ ID NO: 1430797 - RNA, 18 nt, Human
uaucaucagauagcaucu

SEQ ID NO: 1430798 - RNA, 21 nt, Human
uaucauauauauacauacaug

SEQ ID NO: 1430799 - RNA, 18 nt, Human
uaucauagaaauguaacu

SEQ ID NO: 1430800 - RNA, 23 nt, Human
uaucauagaaauguaacuuuugu

SEQ ID NO: 1430801 - RNA, 14 nt, Human
uaucaugcccugug

SEQ ID NO: 1430802 - RNA, 19 nt, Human
uaucaugcauguccuguaa

SEQ ID NO: 1430803 - RNA, 17 nt, Human
uaucaugcauguccugu

SEQ ID NO: 1430804 - RNA, 14 nt, Human
uaucauucaagugu

SEQ ID NO: 1430805 - RNA, 13 nt, Human
uaucauucaagug

SEQ ID NO: 1430806 - RNA, 15 nt, Human
uaucauagaaaugua

SEQ ID NO: 1430807 - RNA, 14 nt, Human
uaucauagaaaugu

SEQ ID NO: 1430808 - RNA, 22 nt, Human
uaucagucauaacuaaauaaag

SEQ ID NO: 1430809 - RNA, 21 nt, Human
uaucagucaauauuuuuagau

SEQ ID NO: 1430810 - RNA, 20 nt, Human
uaucagucaauauuuuuaga

SEQ ID NO: 1430811 - RNA, 9 nt, Human
uaucaguag

SEQ ID NO: 1430812 - RNA, 15 nt, Human
uaucaguaaauaacu

SEQ ID NO: 1430813 - RNA, 22 nt, Human
uaucaaacccuagccuugcuug

SEQ ID NO: 1430814 - RNA, 17 nt, Human
uaucaaacccuagccuu

SEQ ID NO: 1430815 - RNA, 23 nt, Human
uaucaaacaccaacauaaaaaug

SEQ ID NO: 1430816 - RNA, 19 nt, Human
uaucaaacaccaacauaaa

SEQ ID NO: 1430817 - RNA, 23 nt, Human
uaucaaacccuagccuugcuugu

SEQ ID NO: 1430818 - RNA, 21 nt, Human
uaucaaacccuagccuugcuu

SEQ ID NO: 1430819 - RNA, 20 nt, Human
uaucaaacccuagccuugcu

SEQ ID NO: 1430820 - RNA, 19 nt, Human
uaucaaacccuagccuugc

SEQ ID NO: 1430821 - RNA, 18 nt, Human
uaucaaacccuagccuug

SEQ ID NO: 1430822 - RNA, 18 nt, Human
uauauggacaaaacaaga

SEQ ID NO: 1430823 - RNA, 22 nt, Human
uauauggaaauauauauuauac

SEQ ID NO: 1430824 - RNA, 22 nt, Human
uauauuugggccugcuccagac

SEQ ID NO: 1430825 - RNA, 17 nt, Human
uauauggaaauucugcu

SEQ ID NO: 1430826 - RNA, 19 nt, Human
uauauggaaauauauauua

SEQ ID NO: 1430827 - RNA, 18 nt, Human
uauauggaaauauauauu

SEQ ID NO: 1430828 - RNA, 14 nt, Human
uauauggaaauaua

SEQ ID NO: 1430829 - RNA, 19 nt, Human
uauaugaagaaaaucacuu

SEQ ID NO: 1430830 - RNA, 16 nt, Human
uauaugcuucuguuuu

SEQ ID NO: 1430831 - RNA, 18 nt, Human
uauaugaagaaaaucacu

SEQ ID NO: 1430832 - RNA, 14 nt, Human
uauaugcuucuguu

SEQ ID NO: 1430833 - RNA, 19 nt, Human
uaucaaaacuuucuuuucu

SEQ ID NO: 1430834 - RNA, 21 nt, Human
uauauuuuuuuuuaagcucug

SEQ ID NO: 1430835 - RNA, 20 nt, Human
uauauuuuuuucugaaauuu

SEQ ID NO: 1430836 - RNA, 19 nt, Human
uauauuuuuuucugaaauu

SEQ ID NO: 1430837 - RNA, 16 nt, Human
uauauuuuuuucugaa

SEQ ID NO: 1430838 - RNA, 17 nt, Human
uauauuuuguuuacaaa

SEQ ID NO: 1430839 - RNA, 15 nt, Human
uauauuuucuuucuc

SEQ ID NO: 1430840 - RNA, 14 nt, Human
uauauuuucuguuu

SEQ ID NO: 1430841 - RNA, 14 nt, Human
uauauuuuccuaua

SEQ ID NO: 1430842 - RNA, 23 nt, Human
uauauaaagaaaaugauacagca

SEQ ID NO: 1430843 - RNA, 19 nt, Human
uauauaacaaugcuguauu

SEQ ID NO: 1430844 - RNA, 17 nt, Human
uauauaacaaugcugua

SEQ ID NO: 1430845 - RNA, 13 nt, Human
uauaucuggccuc

SEQ ID NO: 1430846 - RNA, 12 nt, Human
uauauaaagaaa

SEQ ID NO: 1430847 - RNA, 23 nt, Human
uauaguuuuacuuuuaaacugug

SEQ ID NO: 1430848 - RNA, 22 nt, Human
uauaguuuuacuuuuaaacugu

SEQ ID NO: 1430849 - RNA, 18 nt, Human
uauagugauguaaucuug

SEQ ID NO: 1430850 - RNA, 13 nt, Human
uauagugauguaa

SEQ ID NO: 1430851 - RNA, 12 nt, Human
uauaguacauga

SEQ ID NO: 1430852 - RNA, 13 nt, Human
uauaguacaugau

SEQ ID NO: 1430853 - RNA, 14 nt, Human
uauaguacaugaua

SEQ ID NO: 1430854 - RNA, 16 nt, Human
uauaguacaugauaaa

SEQ ID NO: 1430855 - RNA, 16 nt, Human
uauaaaguaguccugu

SEQ ID NO: 1430856 - RNA, 18 nt, Human
uauaaaguaguccuguga

SEQ ID NO: 1430857 - RNA, 21 nt, Human
uauaaaguuuuauauauuaua

SEQ ID NO: 1430858 - RNA, 22 nt, Human
uauaaaguuuuauauauuauau

SEQ ID NO: 1430859 - RNA, 18 nt, Human
uauaaaguuuuauauauu

SEQ ID NO: 1430860 - RNA, 17 nt, Human
uauaaaguuuuauauau

SEQ ID NO: 1430861 - RNA, 18 nt, Human
uauaaauacugcaaauca

SEQ ID NO: 1430862 - RNA, 11 nt, Human
uauacuuuuuu

SEQ ID NO: 1430863 - RNA, 20 nt, Human
uauacuuucccuacccucua

SEQ ID NO: 1430864 - RNA, 17 nt, Human
uauacuuucccuacccu

SEQ ID NO: 1430865 - RNA, 16 nt, Human
uauacuuucccuaccc

SEQ ID NO: 1430866 - RNA, 12 nt, Human
uauacuuucccu

SEQ ID NO: 1430867 - RNA, 13 nt, Human
uauacuuuuacaa

SEQ ID NO: 1430868 - RNA, 13 nt, Human
uauagaaagcuau

SEQ ID NO: 1430869 - RNA, 24 nt, Human
uauagaaagcuauauaagacaaga

SEQ ID NO: 1430870 - RNA, 13 nt, Human
uauagaaguuuag

SEQ ID NO: 1430871 - RNA, 22 nt, Human
uauagaaguauaaagaauugug

SEQ ID NO: 1430872 - RNA, 19 nt, Human
uauagaaguauaaagaauu

SEQ ID NO: 1430873 - RNA, 18 nt, Human
uauagaacugaaugagaa

SEQ ID NO: 1430874 - RNA, 17 nt, Human
uauagaacugaaugaga

SEQ ID NO: 1430875 - RNA, 23 nt, Human
ucaggugcuggggccugguuccc

SEQ ID NO: 1430876 - RNA, 15 nt, Human
ucaggugcuggggcc

SEQ ID NO: 1430877 - RNA, 12 nt, Human
ucaguccaggau

SEQ ID NO: 1430878 - RNA, 18 nt, Human
ucaguccccacagauaac

SEQ ID NO: 1430879 - RNA, 20 nt, Human
ucagucucugagcagugaau

SEQ ID NO: 1430880 - RNA, 17 nt, Human
ucagucucugagcagug

SEQ ID NO: 1430881 - RNA, 15 nt, Human
ucagucucugagcag

SEQ ID NO: 1430882 - RNA, 13 nt, Human
ucagucucugagc

SEQ ID NO: 1430883 - RNA, 22 nt, Human
ucagucucuauaccaauaaagu

SEQ ID NO: 1430884 - RNA, 20 nt, Human
ucagucucucuucucuccag

SEQ ID NO: 1430885 - RNA, 23 nt, Human
ucagucucuauaccaauaaagug

SEQ ID NO: 1430886 - RNA, 21 nt, Human
ucaguguuaaaugugaugaau

SEQ ID NO: 1430887 - RNA, 17 nt, Human
ucaguguuaaaugugau

SEQ ID NO: 1430888 - RNA, 15 nt, Human
ucaguguuaaaugug

SEQ ID NO: 1430889 - RNA, 13 nt, Human
ucaguuaagaaau

SEQ ID NO: 1430890 - RNA, 16 nt, Human
ucaguuaacuauugca

SEQ ID NO: 1430891 - RNA, 20 nt, Human
ucaguuaacuauugcauuua

SEQ ID NO: 1430892 - RNA, 19 nt, Human
ucaucaagagaauuugggg

SEQ ID NO: 1430893 - RNA, 21 nt, Human
ucaucaagagaauuuggggcu

SEQ ID NO: 1430894 - RNA, 13 nt, Human
ucaucaagagaau

SEQ ID NO: 1430895 - RNA, 22 nt, Human
ucaucaacugaaugaggucagc

SEQ ID NO: 1430896 - RNA, 15 nt, Human
ucaucaacugaauga

SEQ ID NO: 1430897 - RNA, 13 nt, Human
ucaucaacugaau

SEQ ID NO: 1430898 - RNA, 16 nt, Human
ucaucaucauggccag

SEQ ID NO: 1430899 - RNA, 17 nt, Human
ucauccaaguuaaaugu

SEQ ID NO: 1430900 - RNA, 22 nt, Human
ucaucauucucugucucaucca

SEQ ID NO: 1430901 - RNA, 20 nt, Human
ucaucauucucugucucauc

SEQ ID NO: 1430902 - RNA, 17 nt, Human
ucaucaucauggccagc

SEQ ID NO: 1430903 - RNA, 16 nt, Human
ucaguucuaggaaaau

SEQ ID NO: 1430904 - RNA, 15 nt, Human
ucaguucuaggaaaa

SEQ ID NO: 1430905 - RNA, 13 nt, Human
ucaguucuaggaa

SEQ ID NO: 1430906 - RNA, 22 nt, Human
ucauacuugaacguuuucuaau

SEQ ID NO: 1430907 - RNA, 21 nt, Human
ucauacuugaacguuuucuaa

SEQ ID NO: 1430908 - RNA, 19 nt, Human
ucauacuugaacguuuucu

SEQ ID NO: 1430909 - RNA, 15 nt, Human
ucauacuugaacguu

SEQ ID NO: 1430910 - RNA, 14 nt, Human
ucauacuugaacgu

SEQ ID NO: 1430911 - RNA, 12 nt, Human
ucauacuugaac

SEQ ID NO: 1430912 - RNA, 23 nt, Human
ucauagaaauguaacuuuuguaa

SEQ ID NO: 1430913 - RNA, 22 nt, Human
ucauagaaauguaacuuuugua

SEQ ID NO: 1430914 - RNA, 13 nt, Human
ucauagaaaugua

SEQ ID NO: 1430915 - RNA, 23 nt, Human
ucauacuugaacguuuucuaauu

SEQ ID NO: 1430916 - RNA, 22 nt, Human
ucauauuuuucauagcuaaaaa

SEQ ID NO: 1430917 - RNA, 17 nt, Human
ucaucuuucuuccaaac

SEQ ID NO: 1430918 - RNA, 14 nt, Human
ucaucuuucuucca

SEQ ID NO: 1430919 - RNA, 23 nt, Human
ucaucuggcaacaucuuuauccg

SEQ ID NO: 1430920 - RNA, 19 nt, Human
ucaucuggcaacaucuuua

SEQ ID NO: 1430921 - RNA, 13 nt, Human
ucaucuggaacca

SEQ ID NO: 1430922 - RNA, 17 nt, Human
ucaucuggauuccagag

SEQ ID NO: 1430923 - RNA, 12 nt, Human
ucauccacccca

SEQ ID NO: 1430924 - RNA, 19 nt, Human
ucauccacauacccugacc

SEQ ID NO: 1430925 - RNA, 19 nt, Human
ucauccaaguuaaauguag

SEQ ID NO: 1430926 - RNA, 14 nt, Human
ucaucugcuggucc

SEQ ID NO: 1430927 - RNA, 13 nt, Human
ucaucugcugguc

SEQ ID NO: 1430928 - RNA, 16 nt, Human
ucauccaccccauccc

SEQ ID NO: 1430929 - RNA, 14 nt, Human
ucauccaccccauc

SEQ ID NO: 1430930 - RNA, 19 nt, Human
ucaucugcugguccguggg

SEQ ID NO: 1430931 - RNA, 12 nt, Human
ucaucuggaacc

SEQ ID NO: 1430932 - RNA, 18 nt, Human
ucaucuggaaccaucaga

SEQ ID NO: 1430933 - RNA, 19 nt, Human
ucauggaauuggagcucgu

SEQ ID NO: 1430934 - RNA, 13 nt, Human
ucaugaaagauuc

SEQ ID NO: 1430935 - RNA, 15 nt, Human
ucaugaaagauucaa

SEQ ID NO: 1430936 - RNA, 21 nt, Human
ucauggaauuggagcucgugg

SEQ ID NO: 1430937 - RNA, 16 nt, Human
ucauggccagcuggag

SEQ ID NO: 1430938 - RNA, 18 nt, Human
ucauggccccucugaccu

SEQ ID NO: 1430939 - RNA, 14 nt, Human
ucauggccccucug

SEQ ID NO: 1430940 - RNA, 13 nt, Human
ucauggccccucu

SEQ ID NO: 1430941 - RNA, 22 nt, Human
ucauggcagauguaggagggac

SEQ ID NO: 1430942 - RNA, 21 nt, Human
ucauggcagauguaggaggga

SEQ ID NO: 1430943 - RNA, 18 nt, Human
ucauggcagauguaggag

SEQ ID NO: 1430944 - RNA, 22 nt, Human
ucauggcagaaggcaaacccau

SEQ ID NO: 1430945 - RNA, 23 nt, Human
ucauggaugggggaacucagauc

SEQ ID NO: 1430946 - RNA, 24 nt, Human
ucauggacuucugccagcauaaua

SEQ ID NO: 1430947 - RNA, 20 nt, Human
ucagccucccaaguagcugg

SEQ ID NO: 1430948 - RNA, 23 nt, Human
ucagccuccauccuacccccugu

SEQ ID NO: 1430949 - RNA, 19 nt, Human
ucagccugaaccccagggc

SEQ ID NO: 1430950 - RNA, 17 nt, Human
ucagccugaaccccagg

SEQ ID NO: 1430951 - RNA, 17 nt, Human
ucagcuccuuccuggag

SEQ ID NO: 1430952 - RNA, 16 nt, Human
ucagcuccuuccugga

SEQ ID NO: 1430953 - RNA, 15 nt, Human
ucagcuccuuccugg

SEQ ID NO: 1430954 - RNA, 14 nt, Human
ucagcuccuuccug

SEQ ID NO: 1430955 - RNA, 18 nt, Human
ucagcuccugaccaguug

SEQ ID NO: 1430956 - RNA, 17 nt, Human
ucagcuccugaccaguu

SEQ ID NO: 1430957 - RNA, 12 nt, Human
ucagcuccugac

SEQ ID NO: 1430958 - RNA, 11 nt, Human
ucagcuccuga

SEQ ID NO: 1430959 - RNA, 17 nt, Human
ucaggaggcaggaccuu

SEQ ID NO: 1430960 - RNA, 19 nt, Human
ucaggaggaauacugaaca

SEQ ID NO: 1430961 - RNA, 17 nt, Human
ucaggaggaauacugaa

SEQ ID NO: 1430962 - RNA, 23 nt, Human
ucaggaggaaggcuuacacccac

SEQ ID NO: 1430963 - RNA, 16 nt, Human
ucaggaggaaggcuua

SEQ ID NO: 1430964 - RNA, 20 nt, Human
ucaggagagaguugaaccua

SEQ ID NO: 1430965 - RNA, 17 nt, Human
ucaggacuugaaagaaa

SEQ ID NO: 1430966 - RNA, 16 nt, Human
ucaggacuugaaagaa

SEQ ID NO: 1430967 - RNA, 23 nt, Human
ucaggacugggagcccccagccu

SEQ ID NO: 1430968 - RNA, 22 nt, Human
ucaggacugggagcccccagcc

SEQ ID NO: 1430969 - RNA, 21 nt, Human
ucaggacugggagcccccagc

SEQ ID NO: 1430970 - RNA, 15 nt, Human
ucaggacugggagcc

SEQ ID NO: 1430971 - RNA, 14 nt, Human
ucaggacugggagc

SEQ ID NO: 1430972 - RNA, 13 nt, Human
ucaggacugggag

SEQ ID NO: 1430973 - RNA, 12 nt, Human
ucaggacuggga

SEQ ID NO: 1430974 - RNA, 19 nt, Human
ucaggacccagaggaaggg

SEQ ID NO: 1430975 - RNA, 16 nt, Human
ucaggacccagaggaa

SEQ ID NO: 1430976 - RNA, 15 nt, Human
ucaggacccagagga

SEQ ID NO: 1430977 - RNA, 20 nt, Human
ucaggaccaaagcuuucaug

SEQ ID NO: 1430978 - RNA, 15 nt, Human
ucaggacagaugcca

SEQ ID NO: 1430979 - RNA, 14 nt, Human
ucaggacagaugcc

SEQ ID NO: 1430980 - RNA, 19 nt, Human
ucagcucucaguugcagcc

SEQ ID NO: 1430981 - RNA, 22 nt, Human
ucagcagggacuguaaacacag

SEQ ID NO: 1430982 - RNA, 18 nt, Human
ucagcagggacuguaaac

SEQ ID NO: 1430983 - RNA, 17 nt, Human
ucagcagggacuguaaa

SEQ ID NO: 1430984 - RNA, 17 nt, Human
ucagcacgauuucuguu

SEQ ID NO: 1430985 - RNA, 18 nt, Human
ucagcacgauuucuguuu

SEQ ID NO: 1430986 - RNA, 15 nt, Human
ucagcacgauuucug

SEQ ID NO: 1430987 - RNA, 16 nt, Human
ucagcacgauuucugu

SEQ ID NO: 1430988 - RNA, 23 nt, Human
ucagaucaguguaccauuugccu

SEQ ID NO: 1430989 - RNA, 16 nt, Human
ucagauccagggacag

SEQ ID NO: 1430990 - RNA, 15 nt, Human
ucagauccagggaca

SEQ ID NO: 1430991 - RNA, 14 nt, Human
ucagauccagggac

SEQ ID NO: 1430992 - RNA, 18 nt, Human
ucagauccaggagcucca

SEQ ID NO: 1430993 - RNA, 16 nt, Human
ucagauccaggagcuc

SEQ ID NO: 1430994 - RNA, 15 nt, Human
ucagauccaggagcu

SEQ ID NO: 1430995 - RNA, 14 nt, Human
ucagauccaggagc

SEQ ID NO: 1430996 - RNA, 20 nt, Human
ucagcacaucucaacaggcc

SEQ ID NO: 1430997 - RNA, 16 nt, Human
ucagcacaucucaaca

SEQ ID NO: 1430998 - RNA, 14 nt, Human
ucagcacaucucaa

SEQ ID NO: 1430999 - RNA, 14 nt, Human
ucagauccuccuca

SEQ ID NO: 1431000 - RNA, 15 nt, Human
ucagauccuccucau

SEQ ID NO: 1431001 - RNA, 13 nt, Human
ucagauccuccuc

SEQ ID NO: 1431002 - RNA, 15 nt, Human
ucagaucucuaacuu

SEQ ID NO: 1431003 - RNA, 22 nt, Human
ucagauaagguaaaaugccaug

SEQ ID NO: 1431004 - RNA, 18 nt, Human
ucagauaugauucaaaug

SEQ ID NO: 1431005 - RNA, 17 nt, Human
ucagauaugauucaaau

SEQ ID NO: 1431006 - RNA, 17 nt, Human
ucagauagaaugacagu

SEQ ID NO: 1431007 - RNA, 20 nt, Human
ucagauaagguaaaaugcca

SEQ ID NO: 1431008 - RNA, 16 nt, Human
uaucauuuaauaauau

SEQ ID NO: 1431009 - RNA, 19 nt, Human
uaucauugcuuccuccucc

SEQ ID NO: 1431010 - RNA, 14 nt, Human
uaucauuccaaagg

SEQ ID NO: 1431011 - RNA, 22 nt, Human
uaucauucaaguguaaaauauu

SEQ ID NO: 1431012 - RNA, 23 nt, Human
ucagauaagguaaaaugccauga

SEQ ID NO: 1431013 - RNA, 14 nt, Human
uaucauuuaauaau

SEQ ID NO: 1431014 - RNA, 23 nt, Human
uccaagccccaucuucuaaaugg

SEQ ID NO: 1431015 - RNA, 19 nt, Human
uccaagccccaucuucuaa

SEQ ID NO: 1431016 - RNA, 15 nt, Human
uccaagccccaucuu

SEQ ID NO: 1431017 - RNA, 21 nt, Human
uccaagcccagcccauggaga

SEQ ID NO: 1431018 - RNA, 19 nt, Human
uccaagcccagcccaugga

SEQ ID NO: 1431019 - RNA, 19 nt, Human
uccaagcagcuuagaguug

SEQ ID NO: 1431020 - RNA, 15 nt, Human
uccaagcagcuuaga

SEQ ID NO: 1431021 - RNA, 14 nt, Human
uccaagcagcuuag

SEQ ID NO: 1431022 - RNA, 23 nt, Human
uccaagcagccugagcaacucuu

SEQ ID NO: 1431023 - RNA, 22 nt, Human
uccaagcagcuuagaguuggcc

SEQ ID NO: 1431024 - RNA, 22 nt, Human
uccaagcuaagcacugccacug

SEQ ID NO: 1431025 - RNA, 14 nt, Human
uccaagcuaagcac

SEQ ID NO: 1431026 - RNA, 21 nt, Human
uccacaccuuuuauugacaca

SEQ ID NO: 1431027 - RNA, 15 nt, Human
uccacaccuuuuauu

SEQ ID NO: 1431028 - RNA, 15 nt, Human
uccacaccugcggcc

SEQ ID NO: 1431029 - RNA, 18 nt, Human
uccacaccugcggcccaa

SEQ ID NO: 1431030 - RNA, 14 nt, Human
uccacaccugcggc

SEQ ID NO: 1431031 - RNA, 13 nt, Human
uccacaccugcgg

SEQ ID NO: 1431032 - RNA, 13 nt, Human
uccacacaugaau

SEQ ID NO: 1431033 - RNA, 17 nt, Human
uccacacaugaaucugc

SEQ ID NO: 1431034 - RNA, 19 nt, Human
uccacacagugcucaaggc

SEQ ID NO: 1431035 - RNA, 20 nt, Human
uccacagcaaccccaggcug

SEQ ID NO: 1431036 - RNA, 19 nt, Human
uccacagcaaccccaggcu

SEQ ID NO: 1431037 - RNA, 18 nt, Human
uccacagccugcaaguca

SEQ ID NO: 1431038 - RNA, 15 nt, Human
uccacagccugcaag

SEQ ID NO: 1431039 - RNA, 23 nt, Human
uccacagcugccucuucccucuu

SEQ ID NO: 1431040 - RNA, 18 nt, Human
ucauguacaagaugaagg

SEQ ID NO: 1431041 - RNA, 17 nt, Human
ucauguacaagaugaag

SEQ ID NO: 1431042 - RNA, 16 nt, Human
ucauguacaagaugaa

SEQ ID NO: 1431043 - RNA, 23 nt, Human
ucaugucaaauauuuagauguaa

SEQ ID NO: 1431044 - RNA, 16 nt, Human
uccaagacucuagagu

SEQ ID NO: 1431045 - RNA, 15 nt, Human
uccaagacucuagag

SEQ ID NO: 1431046 - RNA, 14 nt, Human
uccaagacucuaga

SEQ ID NO: 1431047 - RNA, 13 nt, Human
uccaagacucuag

SEQ ID NO: 1431048 - RNA, 21 nt, Human
uccaagagcuacauaauuuag

SEQ ID NO: 1431049 - RNA, 15 nt, Human
uccaagagucuaaag

SEQ ID NO: 1431050 - RNA, 23 nt, Human
uccaagacucuagaguccaaggu

SEQ ID NO: 1431051 - RNA, 20 nt, Human
uccaagacucuagaguccaa

SEQ ID NO: 1431052 - RNA, 17 nt, Human
uccaagcaaaugugaau

SEQ ID NO: 1431053 - RNA, 17 nt, Human
uccagggcccccaucuc

SEQ ID NO: 1431054 - RNA, 23 nt, Human
uccaggagaaggccaauuccuau

SEQ ID NO: 1431055 - RNA, 20 nt, Human
uccaggagaaggccaauucc

SEQ ID NO: 1431056 - RNA, 16 nt, Human
uccaggagaaggccaa

SEQ ID NO: 1431057 - RNA, 23 nt, Human
uccaggacuauauuugggccugc

SEQ ID NO: 1431058 - RNA, 20 nt, Human
uccaggacuauauuugggcc

SEQ ID NO: 1431059 - RNA, 22 nt, Human
uccaggaaaguggccaagaagc

SEQ ID NO: 1431060 - RNA, 19 nt, Human
uccagcugggcucugcaau

SEQ ID NO: 1431061 - RNA, 15 nt, Human
uccagaugccacaau

SEQ ID NO: 1431062 - RNA, 19 nt, Human
uccagaugcagggcaguca

SEQ ID NO: 1431063 - RNA, 18 nt, Human
uccagaugcagggcaguc

SEQ ID NO: 1431064 - RNA, 17 nt, Human
uccagaugcagggcagu

SEQ ID NO: 1431065 - RNA, 16 nt, Human
uccagaugcagggcag

SEQ ID NO: 1431066 - RNA, 17 nt, Human
uccagauugacgacaag

SEQ ID NO: 1431067 - RNA, 17 nt, Human
uccagauuagagccugu

SEQ ID NO: 1431068 - RNA, 22 nt, Human
uccacccuggccgaguccaagc

SEQ ID NO: 1431069 - RNA, 16 nt, Human
uccacaggcuucugag

SEQ ID NO: 1431070 - RNA, 15 nt, Human
uccacuuuaucuuga

SEQ ID NO: 1431071 - RNA, 18 nt, Human
uccacuuucagcugucuu

SEQ ID NO: 1431072 - RNA, 17 nt, Human
uccacuuucagcugucu

SEQ ID NO: 1431073 - RNA, 16 nt, Human
uccacuuucagcuguc

SEQ ID NO: 1431074 - RNA, 15 nt, Human
uccacuuucagcugu

SEQ ID NO: 1431075 - RNA, 14 nt, Human
uccacuuucagcug

SEQ ID NO: 1431076 - RNA, 13 nt, Human
uccacuuucagcu

SEQ ID NO: 1431077 - RNA, 12 nt, Human
uccacuuucagc

SEQ ID NO: 1431078 - RNA, 15 nt, Human
uccacuucugacagc

SEQ ID NO: 1431079 - RNA, 14 nt, Human
uccacuucugacag

SEQ ID NO: 1431080 - RNA, 23 nt, Human
uccacuuauagccucugucuggc

SEQ ID NO: 1431081 - RNA, 22 nt, Human
uccacuuauagccucugucugg

SEQ ID NO: 1431082 - RNA, 20 nt, Human
uccacuuauagccucugucu

SEQ ID NO: 1431083 - RNA, 16 nt, Human
uccacuuauagccucu

SEQ ID NO: 1431084 - RNA, 17 nt, Human
uccacuuuaucuugaau

SEQ ID NO: 1431085 - RNA, 12 nt, Human
uccagagggcac

SEQ ID NO: 1431086 - RNA, 20 nt, Human
uccagaggcuauuauuuuca

SEQ ID NO: 1431087 - RNA, 15 nt, Human
uccagaugcagggca

SEQ ID NO: 1431088 - RNA, 17 nt, Human
uccagagggcacucugc

SEQ ID NO: 1431089 - RNA, 15 nt, Human
uccagagucccugcc

SEQ ID NO: 1431090 - RNA, 17 nt, Human
uccagagcacugcucca

SEQ ID NO: 1431091 - RNA, 16 nt, Human
ucccagggccugucuc

SEQ ID NO: 1431092 - RNA, 16 nt, Human
ucccagggacaccugg

SEQ ID NO: 1431093 - RNA, 21 nt, Human
ucccagggagcaugagaggag

SEQ ID NO: 1431094 - RNA, 22 nt, Human
ucccagggagcaugagaggagg

SEQ ID NO: 1431095 - RNA, 20 nt, Human
ucccaggcaaggcuguggac

SEQ ID NO: 1431096 - RNA, 19 nt, Human
ucccaggcaaggcugugga

SEQ ID NO: 1431097 - RNA, 17 nt, Human
ucccaggcaaggcugug

SEQ ID NO: 1431098 - RNA, 16 nt, Human
ucccaggcaaggcugu

SEQ ID NO: 1431099 - RNA, 15 nt, Human
ucccaggcaaggcug

SEQ ID NO: 1431100 - RNA, 18 nt, Human
ucccacuuaaaaauuaaa

SEQ ID NO: 1431101 - RNA, 13 nt, Human
ucccacucuccua

SEQ ID NO: 1431102 - RNA, 16 nt, Human
ucccacucuccuaggc

SEQ ID NO: 1431103 - RNA, 17 nt, Human
ucccacuccaagcccag

SEQ ID NO: 1431104 - RNA, 22 nt, Human
ucccacuccaagcccagcccau

SEQ ID NO: 1431105 - RNA, 13 nt, Human
ucccacuccaagc

SEQ ID NO: 1431106 - RNA, 14 nt, Human
ucccacuccaagcc

SEQ ID NO: 1431107 - RNA, 13 nt, Human
ucccaggcaaggc

SEQ ID NO: 1431108 - RNA, 21 nt, Human
ucccacuucagccucccaagc

SEQ ID NO: 1431109 - RNA, 17 nt, Human
ucccacggccuuucuag

SEQ ID NO: 1431110 - RNA, 15 nt, Human
ucccacggccuuucu

SEQ ID NO: 1431111 - RNA, 20 nt, Human
ucccaccuuucgggccaugu

SEQ ID NO: 1431112 - RNA, 22 nt, Human
ucccacucacaacagcugccug

SEQ ID NO: 1431113 - RNA, 17 nt, Human
ucccacucacaacagcu

SEQ ID NO: 1431114 - RNA, 21 nt, Human
ucccaccuccugacacccuuc

SEQ ID NO: 1431115 - RNA, 20 nt, Human
ucccaccuccugacacccuu

SEQ ID NO: 1431116 - RNA, 18 nt, Human
ucccaccuccccuugggc

SEQ ID NO: 1431117 - RNA, 17 nt, Human
ucccaagcggugucucu

SEQ ID NO: 1431118 - RNA, 13 nt, Human
ucccaagagcuac

SEQ ID NO: 1431119 - RNA, 22 nt, Human
ucccaagagcaucaugccucug

SEQ ID NO: 1431120 - RNA, 21 nt, Human
ucccaagcaccugggauuaca

SEQ ID NO: 1431121 - RNA, 17 nt, Human
ucccaccuccccuuggg

SEQ ID NO: 1431122 - RNA, 15 nt, Human
ucccaccuccccuug

SEQ ID NO: 1431123 - RNA, 17 nt, Human
ucccaccuccaucccag

SEQ ID NO: 1431124 - RNA, 15 nt, Human
ucccaccuccauccc

SEQ ID NO: 1431125 - RNA, 16 nt, Human
ucccaagcggugucuc

SEQ ID NO: 1431126 - RNA, 20 nt, Human
ucccaagcaccugggauuac

SEQ ID NO: 1431127 - RNA, 21 nt, Human
uccaugcacccucauacacag

SEQ ID NO: 1431128 - RNA, 12 nt, Human
uccaugauucua

SEQ ID NO: 1431129 - RNA, 19 nt, Human
uccaugcguguuucugacu

SEQ ID NO: 1431130 - RNA, 18 nt, Human
uccaugcguguuucugac

SEQ ID NO: 1431131 - RNA, 16 nt, Human
uccaugcgcucagggc

SEQ ID NO: 1431132 - RNA, 15 nt, Human
uccaugcgcucaggg

SEQ ID NO: 1431133 - RNA, 20 nt, Human
uccaugcguguuucugacuc

SEQ ID NO: 1431134 - RNA, 16 nt, Human
uccaugugcccaguua

SEQ ID NO: 1431135 - RNA, 14 nt, Human
uccaugugcccagu

SEQ ID NO: 1431136 - RNA, 15 nt, Human
ucccaacacugccag

SEQ ID NO: 1431137 - RNA, 14 nt, Human
ucccaacacugcca

SEQ ID NO: 1431138 - RNA, 16 nt, Human
ucccaacacugccagc

SEQ ID NO: 1431139 - RNA, 13 nt, Human
uccauaucacaca

SEQ ID NO: 1431140 - RNA, 15 nt, Human
uccauaucacacaca

SEQ ID NO: 1431141 - RNA, 14 nt, Human
uccagggcuaguga

SEQ ID NO: 1431142 - RNA, 18 nt, Human
uccauaaugcauucuucu

SEQ ID NO: 1431143 - RNA, 22 nt, Human
uccauaaugcauucuucucugu

SEQ ID NO: 1431144 - RNA, 12 nt, Human
uccauacauuug

SEQ ID NO: 1431145 - RNA, 23 nt, Human
uccucgagaucccaacacugcca

SEQ ID NO: 1431146 - RNA, 16 nt, Human
uccucgagaucccaac

SEQ ID NO: 1431147 - RNA, 11 nt, Human
uccuccuggaa

SEQ ID NO: 1431148 - RNA, 12 nt, Human
uccuccugcuca

SEQ ID NO: 1431149 - RNA, 14 nt, Human
uccuccuuuuucca

SEQ ID NO: 1431150 - RNA, 16 nt, Human
uccuccugggcccucu

SEQ ID NO: 1431151 - RNA, 15 nt, Human
uccuccugggcccuc

SEQ ID NO: 1431152 - RNA, 14 nt, Human
uccuccugggcccu

SEQ ID NO: 1431153 - RNA, 15 nt, Human
uccucuggcuuggcc

SEQ ID NO: 1431154 - RNA, 17 nt, Human
uccucuggagccagccg

SEQ ID NO: 1431155 - RNA, 13 nt, Human
uccucuggagcca

SEQ ID NO: 1431156 - RNA, 22 nt, Human
uccucuggcuuggccacagcca

SEQ ID NO: 1431157 - RNA, 19 nt, Human
uccucugucagucacagcc

SEQ ID NO: 1431158 - RNA, 23 nt, Human
uccucuggcuuggccacagccag

SEQ ID NO: 1431159 - RNA, 22 nt, Human
uccucugucagucacagccacc

SEQ ID NO: 1431160 - RNA, 21 nt, Human
uccucugucagucacagccac

SEQ ID NO: 1431161 - RNA, 17 nt, Human
uccuccgucaccucaga

SEQ ID NO: 1431162 - RNA, 20 nt, Human
uccuccugcagaccacgccc

SEQ ID NO: 1431163 - RNA, 15 nt, Human
uccuccugcagacca

SEQ ID NO: 1431164 - RNA, 12 nt, Human
uccuccugcaga

SEQ ID NO: 1431165 - RNA, 12 nt, Human
uccuccucaggc

SEQ ID NO: 1431166 - RNA, 14 nt, Human
uccuaagccuaaaa

SEQ ID NO: 1431167 - RNA, 16 nt, Human
uccggauccuaagcau

SEQ ID NO: 1431168 - RNA, 14 nt, Human
uccuaagcaucuaa

SEQ ID NO: 1431169 - RNA, 13 nt, Human
uccuaagcaucua

SEQ ID NO: 1431170 - RNA, 21 nt, Human
uccuaagcaacuaggccuuca

SEQ ID NO: 1431171 - RNA, 19 nt, Human
uccuaagagugcugggcau

SEQ ID NO: 1431172 - RNA, 17 nt, Human
uccuaagagugcugggc

SEQ ID NO: 1431173 - RNA, 21 nt, Human
uccuauugugcaauguaaaua

SEQ ID NO: 1431174 - RNA, 20 nt, Human
uccuaugcuuugaaacagaa

SEQ ID NO: 1431175 - RNA, 14 nt, Human
uccuaugcuuugaa

SEQ ID NO: 1431176 - RNA, 13 nt, Human
uccuaugcuuuga

SEQ ID NO: 1431177 - RNA, 22 nt, Human
uccuaugcaugguuucagcacu

SEQ ID NO: 1431178 - RNA, 21 nt, Human
uccuaugcaugguuucagcac

SEQ ID NO: 1431179 - RNA, 20 nt, Human
uccuaugcaugguuucagca

SEQ ID NO: 1431180 - RNA, 12 nt, Human
uccuaugcaugg

SEQ ID NO: 1431181 - RNA, 20 nt, Human
uccuaucugggcuuccugga

SEQ ID NO: 1431182 - RNA, 19 nt, Human
uccuaucugggcuuccugg

SEQ ID NO: 1431183 - RNA, 18 nt, Human
uccuaucugggcuuccug

SEQ ID NO: 1431184 - RNA, 16 nt, Human
uccuaucugggcuucc

SEQ ID NO: 1431185 - RNA, 13 nt, Human
uccuaucugggcu

SEQ ID NO: 1431186 - RNA, 23 nt, Human
uccuaucuccagcggcccuguca

SEQ ID NO: 1431187 - RNA, 19 nt, Human
uccuaucuccagcggcccu

SEQ ID NO: 1431188 - RNA, 17 nt, Human
uccuaucuccagcggcc

SEQ ID NO: 1431189 - RNA, 17 nt, Human
uccuaagcaucuaaguu

SEQ ID NO: 1431190 - RNA, 13 nt, Human
uccuauccuccua

SEQ ID NO: 1431191 - RNA, 16 nt, Human
uccuaagcaucuaagu

SEQ ID NO: 1431192 - RNA, 15 nt, Human
uccuaagcaucuaag

SEQ ID NO: 1431193 - RNA, 15 nt, Human
uccgcccccagguag

SEQ ID NO: 1431194 - RNA, 16 nt, Human
uccgcccccagguagg

SEQ ID NO: 1431195 - RNA, 14 nt, Human
uccgcccccaggua

SEQ ID NO: 1431196 - RNA, 21 nt, Human
uccgcccacaggaagccugca

SEQ ID NO: 1431197 - RNA, 21 nt, Human
uccgaggacccaggaaaggca

SEQ ID NO: 1431198 - RNA, 16 nt, Human
uccgagaggugggcca

SEQ ID NO: 1431199 - RNA, 16 nt, Human
uccgcccugccacuca

SEQ ID NO: 1431200 - RNA, 15 nt, Human
uccgcccugccacuc

SEQ ID NO: 1431201 - RNA, 14 nt, Human
uccgcccugccacu

SEQ ID NO: 1431202 - RNA, 13 nt, Human
uccgcccugccac

SEQ ID NO: 1431203 - RNA, 12 nt, Human
uccggaaagaag

SEQ ID NO: 1431204 - RNA, 15 nt, Human
uccgacugcuuugga

SEQ ID NO: 1431205 - RNA, 12 nt, Human
uccgacugcuuu

SEQ ID NO: 1431206 - RNA, 16 nt, Human
uccgacucacaccacu

SEQ ID NO: 1431207 - RNA, 17 nt, Human
uccgacucuucugagca

SEQ ID NO: 1431208 - RNA, 23 nt, Human
ucccugggagggacaugcuuagc

SEQ ID NO: 1431209 - RNA, 22 nt, Human
ucccugcauggcauccuccagc

SEQ ID NO: 1431210 - RNA, 23 nt, Human
ucccugcauggcauccuccagcc

SEQ ID NO: 1431211 - RNA, 20 nt, Human
ucccuggggcuagggggagc

SEQ ID NO: 1431212 - RNA, 16 nt, Human
ucccugggccuugggc

SEQ ID NO: 1431213 - RNA, 15 nt, Human
ucccugggccuuggg

SEQ ID NO: 1431214 - RNA, 14 nt, Human
ucccugggccuugg

SEQ ID NO: 1431215 - RNA, 13 nt, Human
ucccugggccuug

SEQ ID NO: 1431216 - RNA, 21 nt, Human
ucccugggccugcugcugaga

SEQ ID NO: 1431217 - RNA, 20 nt, Human
ucccugggccugcugcugag

SEQ ID NO: 1431218 - RNA, 19 nt, Human
ucccugggccugcugcuga

SEQ ID NO: 1431219 - RNA, 18 nt, Human
ucccugggccugcugcug

SEQ ID NO: 1431220 - RNA, 17 nt, Human
ucccugggccugcugcu

SEQ ID NO: 1431221 - RNA, 16 nt, Human
ucccugggccugcugc

SEQ ID NO: 1431222 - RNA, 15 nt, Human
ucccugggccugcug

SEQ ID NO: 1431223 - RNA, 14 nt, Human
ucccugggccugcu

SEQ ID NO: 1431224 - RNA, 13 nt, Human
ucccugggccugc

SEQ ID NO: 1431225 - RNA, 12 nt, Human
ucccugggccug

SEQ ID NO: 1431226 - RNA, 19 nt, Human
ucccugggccuugggcucc

SEQ ID NO: 1431227 - RNA, 21 nt, Human
ucccugcauggcauccuccag

SEQ ID NO: 1431228 - RNA, 20 nt, Human
ucccugcauggcauccucca

SEQ ID NO: 1431229 - RNA, 13 nt, Human
ucccugcauggca

SEQ ID NO: 1431230 - RNA, 21 nt, Human
ucccucuuagucuagguccuu

SEQ ID NO: 1431231 - RNA, 16 nt, Human
ucccucucccaggccc

SEQ ID NO: 1431232 - RNA, 15 nt, Human
ucccucucccaggcc

SEQ ID NO: 1431233 - RNA, 14 nt, Human
ucccucucccaggc

SEQ ID NO: 1431234 - RNA, 13 nt, Human
ucccucucccagg

SEQ ID NO: 1431235 - RNA, 12 nt, Human
ucccucucccag

SEQ ID NO: 1431236 - RNA, 21 nt, Human
ucccucucauuuagccugucc

SEQ ID NO: 1431237 - RNA, 22 nt, Human
ucccucucauuuagccuguccu

SEQ ID NO: 1431238 - RNA, 10 nt, Human
ucccucucau

SEQ ID NO: 1431239 - RNA, 16 nt, Human
ucccucucaggaucca

SEQ ID NO: 1431240 - RNA, 17 nt, Human
ucccucucaacacccag

SEQ ID NO: 1431241 - RNA, 14 nt, Human
ucccucucuggaga

SEQ ID NO: 1431242 - RNA, 15 nt, Human
ucccucucuggagaa

SEQ ID NO: 1431243 - RNA, 13 nt, Human
ucccucucuggag

SEQ ID NO: 1431244 - RNA, 22 nt, Human
ucccucugcagucucuauacca

SEQ ID NO: 1431245 - RNA, 16 nt, Human
ucccucugcagucucu

SEQ ID NO: 1431246 - RNA, 14 nt, Human
ucccuccgccccca

SEQ ID NO: 1431247 - RNA, 15 nt, Human
ucccuccgggaccug

SEQ ID NO: 1431248 - RNA, 14 nt, Human
ucccuccgggaccu

SEQ ID NO: 1431249 - RNA, 19 nt, Human
ucccuccgcccccagguag

SEQ ID NO: 1431250 - RNA, 18 nt, Human
ucccuagaaacuuccaaa

SEQ ID NO: 1431251 - RNA, 19 nt, Human
ucccuagaaacuuccaaau

SEQ ID NO: 1431252 - RNA, 18 nt, Human
ucccuagcugugaccucu

SEQ ID NO: 1431253 - RNA, 19 nt, Human
ucccaugaucccuguguug

SEQ ID NO: 1431254 - RNA, 16 nt, Human
ucccaugaucccugug

SEQ ID NO: 1431255 - RNA, 15 nt, Human
ucccaugaucccugu

SEQ ID NO: 1431256 - RNA, 23 nt, Human
ucccaugagcuccuuaaggcucu

SEQ ID NO: 1431257 - RNA, 16 nt, Human
ucccuacccucuagag

SEQ ID NO: 1431258 - RNA, 19 nt, Human
ucccuacccuaaccaaguu

SEQ ID NO: 1431259 - RNA, 13 nt, Human
ucucaaauuucua

SEQ ID NO: 1431260 - RNA, 14 nt, Human
ucucaaauuucuaa

SEQ ID NO: 1431261 - RNA, 16 nt, Human
ucucaaauuucuaaau

SEQ ID NO: 1431262 - RNA, 14 nt, Human
ucuauccucuguaa

SEQ ID NO: 1431263 - RNA, 23 nt, Human
ucucaauuccaacaguuuaauga

SEQ ID NO: 1431264 - RNA, 22 nt, Human
ucucaauuccaacaguuuaaug

SEQ ID NO: 1431265 - RNA, 16 nt, Human
ucucaauuccaacagu

SEQ ID NO: 1431266 - RNA, 15 nt, Human
ucucaauuccaacag

SEQ ID NO: 1431267 - RNA, 13 nt, Human
ucuaugaaauauu

SEQ ID NO: 1431268 - RNA, 18 nt, Human
ucucaaauuucuaaaucu

SEQ ID NO: 1431269 - RNA, 14 nt, Human
ucucagauuucuga

SEQ ID NO: 1431270 - RNA, 18 nt, Human
ucucagaaugucauuuug

SEQ ID NO: 1431271 - RNA, 16 nt, Human
ucucaguuuucauaag

SEQ ID NO: 1431272 - RNA, 15 nt, Human
ucucaguuuucauaa

SEQ ID NO: 1431273 - RNA, 19 nt, Human
ucucaguuugugugucuua

SEQ ID NO: 1431274 - RNA, 18 nt, Human
ucucaguuugugugucuu

SEQ ID NO: 1431275 - RNA, 17 nt, Human
ucucaguuugugugucu

SEQ ID NO: 1431276 - RNA, 16 nt, Human
ucucaguuuguguguc

SEQ ID NO: 1431277 - RNA, 21 nt, Human
ucucaguugcagcccugcugc

SEQ ID NO: 1431278 - RNA, 17 nt, Human
ucucagauuucugagga

SEQ ID NO: 1431279 - RNA, 18 nt, Human
ucucagauuucugaggaa

SEQ ID NO: 1431280 - RNA, 21 nt, Human
ucuaauucuauuaaagugcua

SEQ ID NO: 1431281 - RNA, 20 nt, Human
ucuaaucuagauaucgacuu

SEQ ID NO: 1431282 - RNA, 19 nt, Human
ucuaaucuagauaucgacu

SEQ ID NO: 1431283 - RNA, 18 nt, Human
ucuaaucaugaaacuccc

SEQ ID NO: 1431284 - RNA, 23 nt, Human
ucgucucuuuuacccuggccccu

SEQ ID NO: 1431285 - RNA, 21 nt, Human
ucgucucggccuucacaaucu

SEQ ID NO: 1431286 - RNA, 16 nt, Human
ucguccuuacuccugu

SEQ ID NO: 1431287 - RNA, 19 nt, Human
ucguccuuacuccuguggg

SEQ ID NO: 1431288 - RNA, 15 nt, Human
ucguccuuacuccug

SEQ ID NO: 1431289 - RNA, 19 nt, Human
ucguccucguuuguguucu

SEQ ID NO: 1431290 - RNA, 14 nt, Human
ucguccccaaguga

SEQ ID NO: 1431291 - RNA, 14 nt, Human
ucuaauuuauaaaa

SEQ ID NO: 1431292 - RNA, 13 nt, Human
ucuaauuuauaaa

SEQ ID NO: 1431293 - RNA, 15 nt, Human
ucuaauugcuuauuu

SEQ ID NO: 1431294 - RNA, 18 nt, Human
ucuaauugcuuauuuauu

SEQ ID NO: 1431295 - RNA, 14 nt, Human
ucuaauugcuuauu

SEQ ID NO: 1431296 - RNA, 13 nt, Human
ucuaauugcuuau

SEQ ID NO: 1431297 - RNA, 12 nt, Human
ucuaauugcuua

SEQ ID NO: 1431298 - RNA, 14 nt, Human
ucuaauugccaugu

SEQ ID NO: 1431299 - RNA, 15 nt, Human
ucuaauugccaugua

SEQ ID NO: 1431300 - RNA, 13 nt, Human
ucuaauugccaug

SEQ ID NO: 1431301 - RNA, 15 nt, Human
ucuaauuuuuaagaa

SEQ ID NO: 1431302 - RNA, 15 nt, Human
ucuacuaauuccaca

SEQ ID NO: 1431303 - RNA, 19 nt, Human
ucuacuaaugccucuucau

SEQ ID NO: 1431304 - RNA, 14 nt, Human
ucuaauuuuuaaga

SEQ ID NO: 1431305 - RNA, 21 nt, Human
ucuacucacuuuucccacucc

SEQ ID NO: 1431306 - RNA, 20 nt, Human
ucuacucacuuuucccacuc

SEQ ID NO: 1431307 - RNA, 18 nt, Human
ucuacuaauuccacaccu

SEQ ID NO: 1431308 - RNA, 24 nt, Human
ucuaggcacuguaguucuaagacu

SEQ ID NO: 1431309 - RNA, 22 nt, Human
ucuaggcacuguaguucuaaga

SEQ ID NO: 1431310 - RNA, 21 nt, Human
ucuaggcacuguaguucuaag

SEQ ID NO: 1431311 - RNA, 15 nt, Human
ucuaggcacuguagu

SEQ ID NO: 1431312 - RNA, 21 nt, Human
ucuaggcaguucaaagcagga

SEQ ID NO: 1431313 - RNA, 15 nt, Human
ucuagguccccauac

SEQ ID NO: 1431314 - RNA, 17 nt, Human
ucuagguaggaaaugug

SEQ ID NO: 1431315 - RNA, 21 nt, Human
ucuagguacgaugacaguguu

SEQ ID NO: 1431316 - RNA, 15 nt, Human
ucuagguaaauuaca

SEQ ID NO: 1431317 - RNA, 14 nt, Human
ucuagguucuaaaa

SEQ ID NO: 1431318 - RNA, 17 nt, Human
ucuagguccccauacuc

SEQ ID NO: 1431319 - RNA, 23 nt, Human
ucuagguucuaaaaauugugauc

SEQ ID NO: 1431320 - RNA, 13 nt, Human
ucuauauuuuaca

SEQ ID NO: 1431321 - RNA, 13 nt, Human
ucggaggaagccc

SEQ ID NO: 1431322 - RNA, 12 nt, Human
ucggaggaagcc

SEQ ID NO: 1431323 - RNA, 19 nt, Human
ucggaaaaauaaucaaaag

SEQ ID NO: 1431324 - RNA, 13 nt, Human
ucggaaaaauaau

SEQ ID NO: 1431325 - RNA, 19 nt, Human
ucgcuuuauuggcugagau

SEQ ID NO: 1431326 - RNA, 14 nt, Human
ucggagcccugucu

SEQ ID NO: 1431327 - RNA, 15 nt, Human
ucggagcccugucuc

SEQ ID NO: 1431328 - RNA, 21 nt, Human
ucgcuucuugccucugugcug

SEQ ID NO: 1431329 - RNA, 16 nt, Human
ucgcccauccccuuga

SEQ ID NO: 1431330 - RNA, 15 nt, Human
ucggaaaacaugcua

SEQ ID NO: 1431331 - RNA, 18 nt, Human
ucggaaaacaugcuacac

SEQ ID NO: 1431332 - RNA, 16 nt, Human
ucgccacacaguauuu

SEQ ID NO: 1431333 - RNA, 20 nt, Human
ucgcauggucacacacugau

SEQ ID NO: 1431334 - RNA, 19 nt, Human
ucgcauggucacacacuga

SEQ ID NO: 1431335 - RNA, 16 nt, Human
ucgcagccacccugag

SEQ ID NO: 1431336 - RNA, 14 nt, Human
ucgcagccacccug

SEQ ID NO: 1431337 - RNA, 13 nt, Human
ucgcagccacccu

SEQ ID NO: 1431338 - RNA, 12 nt, Human
ucgcagccaccc

SEQ ID NO: 1431339 - RNA, 21 nt, Human
ucgauuagacuggacagcuug

SEQ ID NO: 1431340 - RNA, 22 nt, Human
ucgauuagacuggacagcuugu

SEQ ID NO: 1431341 - RNA, 18 nt, Human
ucgauuagacuggacagc

SEQ ID NO: 1431342 - RNA, 14 nt, Human
ucgauuagacugga

SEQ ID NO: 1431343 - RNA, 13 nt, Human
ucgauuagacugg

SEQ ID NO: 1431344 - RNA, 12 nt, Human
ucgauuagacug

SEQ ID NO: 1431345 - RNA, 21 nt, Human
ucgcagccacccugaggaguc

SEQ ID NO: 1431346 - RNA, 23 nt, Human
ucgcagccacccugaggagucug

SEQ ID NO: 1431347 - RNA, 20 nt, Human
ucgcagccacccugaggagu

SEQ ID NO: 1431348 - RNA, 19 nt, Human
ucgcagccacccugaggag

SEQ ID NO: 1431349 - RNA, 18 nt, Human
ucgcagccacccugagga

SEQ ID NO: 1431350 - RNA, 17 nt, Human
ucgcagccacccugagg

SEQ ID NO: 1431351 - RNA, 14 nt, Human
ucgaugcaaugaac

SEQ ID NO: 1431352 - RNA, 23 nt, Human
ucgauacugcgacuuucugccug

SEQ ID NO: 1431353 - RNA, 22 nt, Human
ucgauacugcgacuuucugccu

SEQ ID NO: 1431354 - RNA, 20 nt, Human
ucgauacugcgacuuucugc

SEQ ID NO: 1431355 - RNA, 19 nt, Human
ucgauacugcgacuuucug

SEQ ID NO: 1431356 - RNA, 22 nt, Human
uccuuuugacacugcucuaaca

SEQ ID NO: 1431357 - RNA, 20 nt, Human
uccuuuugacacugcucuaa

SEQ ID NO: 1431358 - RNA, 18 nt, Human
uccuuuugacacugcucu

SEQ ID NO: 1431359 - RNA, 16 nt, Human
uccuuuugacacugcu

SEQ ID NO: 1431360 - RNA, 14 nt, Human
uccuuuugacacug

SEQ ID NO: 1431361 - RNA, 13 nt, Human
uccuuuugacacu

SEQ ID NO: 1431362 - RNA, 17 nt, Human
uccuuugugcuuaguua

SEQ ID NO: 1431363 - RNA, 23 nt, Human
uccuuugggcuucagcugccagu

SEQ ID NO: 1431364 - RNA, 21 nt, Human
uccuuugaauccucucucugu

SEQ ID NO: 1431365 - RNA, 20 nt, Human
uccuuugaauccucucucug

SEQ ID NO: 1431366 - RNA, 19 nt, Human
uccuugaagaacugcaggc

SEQ ID NO: 1431367 - RNA, 18 nt, Human
uccuugaagaacugcagg

SEQ ID NO: 1431368 - RNA, 22 nt, Human
uccuugcuuaugacaucacuug

SEQ ID NO: 1431369 - RNA, 16 nt, Human
uccuguccagcuccaa

SEQ ID NO: 1431370 - RNA, 15 nt, Human
uccuguccagcucca

SEQ ID NO: 1431371 - RNA, 14 nt, Human
uccuguccagcucc

SEQ ID NO: 1431372 - RNA, 13 nt, Human
uccuguccagcuc

SEQ ID NO: 1431373 - RNA, 18 nt, Human
uccugaggcuuuggauuu

SEQ ID NO: 1431374 - RNA, 17 nt, Human
uccugaggcuuuggauu

SEQ ID NO: 1431375 - RNA, 16 nt, Human
uccugaggcuuuggau

SEQ ID NO: 1431376 - RNA, 17 nt, Human
uccuguccccugcuaca

SEQ ID NO: 1431377 - RNA, 16 nt, Human
uccuguccccugcuac

SEQ ID NO: 1431378 - RNA, 17 nt, Human
uccuguccagcuccaac

SEQ ID NO: 1431379 - RNA, 17 nt, Human
uccuuaucgaaacucau

SEQ ID NO: 1431380 - RNA, 20 nt, Human
uccuuacuuuuuauauauau

SEQ ID NO: 1431381 - RNA, 18 nt, Human
uccuuacuuuuuauauau

SEQ ID NO: 1431382 - RNA, 17 nt, Human
uccuuacuuuuuauaua

SEQ ID NO: 1431383 - RNA, 23 nt, Human
uccuuacuccugugggagccucg

SEQ ID NO: 1431384 - RNA, 22 nt, Human
uccuuacuccugugggagccuc

SEQ ID NO: 1431385 - RNA, 20 nt, Human
uccuuacuccugugggagcc

SEQ ID NO: 1431386 - RNA, 17 nt, Human
uccuuacuccuguggga

SEQ ID NO: 1431387 - RNA, 16 nt, Human
uccuuacuccuguggg

SEQ ID NO: 1431388 - RNA, 14 nt, Human
uccuuacuccugug

SEQ ID NO: 1431389 - RNA, 16 nt, Human
uccuuacucccaggca

SEQ ID NO: 1431390 - RNA, 20 nt, Human
uccuuaccuuuuuauuugca

SEQ ID NO: 1431391 - RNA, 15 nt, Human
uccuuaccuuuuuau

SEQ ID NO: 1431392 - RNA, 21 nt, Human
ucugcaauucaaaaguuccaa

SEQ ID NO: 1431393 - RNA, 19 nt, Human
ucugcaauucaaaaguucc

SEQ ID NO: 1431394 - RNA, 16 nt, Human
ucugcaauucaaaagu

SEQ ID NO: 1431395 - RNA, 14 nt, Human
ucugcaauucaaaa

SEQ ID NO: 1431396 - RNA, 22 nt, Human
ucugcaaguauacuagggagcc

SEQ ID NO: 1431397 - RNA, 23 nt, Human
ucugcaaguauacuagggagcca

SEQ ID NO: 1431398 - RNA, 17 nt, Human
ucugcaaggucuuuggu

SEQ ID NO: 1431399 - RNA, 20 nt, Human
ucugcacuacugacaugugg

SEQ ID NO: 1431400 - RNA, 18 nt, Human
ucugcacuacugacaugu

SEQ ID NO: 1431401 - RNA, 16 nt, Human
ucugcaguaaaucuuu

SEQ ID NO: 1431402 - RNA, 21 nt, Human
ucugcacucccaccugacaca

SEQ ID NO: 1431403 - RNA, 18 nt, Human
ucugcacucccaccugac

SEQ ID NO: 1431404 - RNA, 21 nt, Human
ucugcacuacugacauguggg

SEQ ID NO: 1431405 - RNA, 24 nt, Human
ucugcaaacaccaacauguuggga

SEQ ID NO: 1431406 - RNA, 22 nt, Human
ucugauuuuaggagcuaaggcu

SEQ ID NO: 1431407 - RNA, 13 nt, Human
ucugauuuuagga

SEQ ID NO: 1431408 - RNA, 22 nt, Human
ucugauuuguaacccacugaga

SEQ ID NO: 1431409 - RNA, 17 nt, Human
ucugauuuguaacccac

SEQ ID NO: 1431410 - RNA, 13 nt, Human
ucugagcuccagc

SEQ ID NO: 1431411 - RNA, 22 nt, Human
ucugagcuauuucaucuauuuu

SEQ ID NO: 1431412 - RNA, 20 nt, Human
ucugagcuauuucaucuauu

SEQ ID NO: 1431413 - RNA, 17 nt, Human
ucugagcuauuucaucu

SEQ ID NO: 1431414 - RNA, 14 nt, Human
ucugagcgccucca

SEQ ID NO: 1431415 - RNA, 21 nt, Human
ucugagcgccuccauccaagg

SEQ ID NO: 1431416 - RNA, 23 nt, Human
ucugagcccgguaagagcaaaag

SEQ ID NO: 1431417 - RNA, 21 nt, Human
ucugagcccgguaagagcaaa

SEQ ID NO: 1431418 - RNA, 22 nt, Human
ucugagagucuagauucucugg

SEQ ID NO: 1431419 - RNA, 21 nt, Human
ucugagagucuagauucucug

SEQ ID NO: 1431420 - RNA, 19 nt, Human
ucugagagucuagauucuc

SEQ ID NO: 1431421 - RNA, 18 nt, Human
ucugagagucuagauucu

SEQ ID NO: 1431422 - RNA, 17 nt, Human
ucugagagucuagauuc

SEQ ID NO: 1431423 - RNA, 16 nt, Human
ucugagagucuagauu

SEQ ID NO: 1431424 - RNA, 15 nt, Human
ucugagagucuagau

SEQ ID NO: 1431425 - RNA, 14 nt, Human
ucugagagucuaga

SEQ ID NO: 1431426 - RNA, 18 nt, Human
ucugagaggcccuggauc

SEQ ID NO: 1431427 - RNA, 17 nt, Human
ucugagaggcccuggau

SEQ ID NO: 1431428 - RNA, 16 nt, Human
ucugagaggcccugga

SEQ ID NO: 1431429 - RNA, 14 nt, Human
ucugagaggcccug

SEQ ID NO: 1431430 - RNA, 13 nt, Human
ucugagaggcccu

SEQ ID NO: 1431431 - RNA, 14 nt, Human
ucucauccaucauc

SEQ ID NO: 1431432 - RNA, 13 nt, Human
ucucauccaucau

SEQ ID NO: 1431433 - RNA, 12 nt, Human
ucucauccacau

SEQ ID NO: 1431434 - RNA, 17 nt, Human
ucucaucaacugaauga

SEQ ID NO: 1431435 - RNA, 15 nt, Human
ucucaucaacugaau

SEQ ID NO: 1431436 - RNA, 17 nt, Human
ucugccugccagcugca

SEQ ID NO: 1431437 - RNA, 16 nt, Human
ucugccugccagcugc

SEQ ID NO: 1431438 - RNA, 19 nt, Human
ucugccucuucugggaggg

SEQ ID NO: 1431439 - RNA, 18 nt, Human
ucugccucuucugggagg

SEQ ID NO: 1431440 - RNA, 17 nt, Human
ucugccucuucugggag

SEQ ID NO: 1431441 - RNA, 15 nt, Human
ucugccucuucuggg

SEQ ID NO: 1431442 - RNA, 14 nt, Human
ucugccucuucugg

SEQ ID NO: 1431443 - RNA, 22 nt, Human
ucugccuccccuuaaaggggag

SEQ ID NO: 1431444 - RNA, 21 nt, Human
ucugccuacagaacuucagaa

SEQ ID NO: 1431445 - RNA, 15 nt, Human
ucugccucucuagga

SEQ ID NO: 1431446 - RNA, 12 nt, Human
ucugcccaaccc

SEQ ID NO: 1431447 - RNA, 21 nt, Human
ucugcauauguugaauacuuu

SEQ ID NO: 1431448 - RNA, 19 nt, Human
ucugcauauguugaauacu

SEQ ID NO: 1431449 - RNA, 18 nt, Human
ucugcauauguugaauac

SEQ ID NO: 1431450 - RNA, 16 nt, Human
ucugcauauguugaau

SEQ ID NO: 1431451 - RNA, 15 nt, Human
ucugcauauguugaa

SEQ ID NO: 1431452 - RNA, 14 nt, Human
ucugcagucucuau

SEQ ID NO: 1431453 - RNA, 18 nt, Human
ucugcagucucuauacca

SEQ ID NO: 1431454 - RNA, 20 nt, Human
ucugcagucucuauaccaau

SEQ ID NO: 1431455 - RNA, 21 nt, Human
ucugcagucucuauaccaaua

SEQ ID NO: 1431456 - RNA, 22 nt, Human
ucugcccaccucagccucccaa

SEQ ID NO: 1431457 - RNA, 12 nt, Human
ucugcuccuucc

SEQ ID NO: 1431458 - RNA, 15 nt, Human
ucugcuccuucccca

SEQ ID NO: 1431459 - RNA, 12 nt, Human
ucugcuccugga

SEQ ID NO: 1431460 - RNA, 22 nt, Human
ucugccugccagcugcacugau

SEQ ID NO: 1431461 - RNA, 21 nt, Human
ucugccugccagcugcacuga

SEQ ID NO: 1431462 - RNA, 18 nt, Human
ucugccugccagcugcac

SEQ ID NO: 1431463 - RNA, 21 nt, Human
ucugcucugguuguuucuguu

SEQ ID NO: 1431464 - RNA, 18 nt, Human
ucugcucugguuguuucu

SEQ ID NO: 1431465 - RNA, 21 nt, Human
ucugcucugcgugucaccugu

SEQ ID NO: 1431466 - RNA, 16 nt, Human
ucugcucugcguguca

SEQ ID NO: 1431467 - RNA, 13 nt, Human
ucugcucugaugc

SEQ ID NO: 1431468 - RNA, 14 nt, Human
ucugcucugaugca

SEQ ID NO: 1431469 - RNA, 11 nt, Human
ucugcucugau

SEQ ID NO: 1431470 - RNA, 17 nt, Human
ucugcucuuucucugcc

SEQ ID NO: 1431471 - RNA, 16 nt, Human
ucugcucuuucucugc

SEQ ID NO: 1431472 - RNA, 15 nt, Human
ucugcucuuucucug

SEQ ID NO: 1431473 - RNA, 14 nt, Human
ucugcucuuucucu

SEQ ID NO: 1431474 - RNA, 19 nt, Human
ucugcucuuucucugccag

SEQ ID NO: 1431475 - RNA, 18 nt, Human
ucugcucuuucucugcca

SEQ ID NO: 1431476 - RNA, 20 nt, Human
ucugcucuuucucugccagu

SEQ ID NO: 1431477 - RNA, 21 nt, Human
ucuggagaaagggcccugggc

SEQ ID NO: 1431478 - RNA, 15 nt, Human
ucuggaccucugggu

SEQ ID NO: 1431479 - RNA, 14 nt, Human
ucuggaccucuggg

SEQ ID NO: 1431480 - RNA, 19 nt, Human
ucuggacaggauguguuug

SEQ ID NO: 1431481 - RNA, 20 nt, Human
ucuggacagccccacccugg

SEQ ID NO: 1431482 - RNA, 13 nt, Human
ucugcuggaguuu

SEQ ID NO: 1431483 - RNA, 18 nt, Human
ucugcugcugucccuccc

SEQ ID NO: 1431484 - RNA, 19 nt, Human
ucugcugccucccucugcu

SEQ ID NO: 1431485 - RNA, 22 nt, Human
ucuggaauguaaucaauguuuc

SEQ ID NO: 1431486 - RNA, 18 nt, Human
ucuggaauguaaucaaug

SEQ ID NO: 1431487 - RNA, 16 nt, Human
ucuggaauguaaucaa

SEQ ID NO: 1431488 - RNA, 15 nt, Human
ucuggaauguaauca

SEQ ID NO: 1431489 - RNA, 19 nt, Human
ucugcuggaguuucaugua

SEQ ID NO: 1431490 - RNA, 23 nt, Human
ucugcuggaguuucauguacaag

SEQ ID NO: 1431491 - RNA, 19 nt, Human
ucuggacagccccacccug

SEQ ID NO: 1431492 - RNA, 18 nt, Human
ucuggacagccccacccu

SEQ ID NO: 1431493 - RNA, 14 nt, Human
ucuggaauuugaaa

SEQ ID NO: 1431494 - RNA, 17 nt, Human
ucugucucauccaucau

SEQ ID NO: 1431495 - RNA, 21 nt, Human
ucugucucauccaucaucaug

SEQ ID NO: 1431496 - RNA, 13 nt, Human
ucugucucaucca

SEQ ID NO: 1431497 - RNA, 23 nt, Human
ucugucuacuugcucagguacuu

SEQ ID NO: 1431498 - RNA, 18 nt, Human
ucugucuacuugcucagg

SEQ ID NO: 1431499 - RNA, 15 nt, Human
ucugucuacuugcuc

SEQ ID NO: 1431500 - RNA, 18 nt, Human
ucuguccugaaggccuga

SEQ ID NO: 1431501 - RNA, 17 nt, Human
ucugucgcccaugcugg

SEQ ID NO: 1431502 - RNA, 23 nt, Human
ucuguccucagccuugccagaga

SEQ ID NO: 1431503 - RNA, 21 nt, Human
ucuguccucagccuugccaga

SEQ ID NO: 1431504 - RNA, 19 nt, Human
ucuguccucagccuugcca

SEQ ID NO: 1431505 - RNA, 15 nt, Human
ucuguccucagccuu

SEQ ID NO: 1431506 - RNA, 14 nt, Human
ucuguccucagccu

SEQ ID NO: 1431507 - RNA, 13 nt, Human
ucuguccucagcc

SEQ ID NO: 1431508 - RNA, 13 nt, Human
ucuguaauugugu

SEQ ID NO: 1431509 - RNA, 17 nt, Human
ucuguaauuguguguga

SEQ ID NO: 1431510 - RNA, 14 nt, Human
ucuguaauugcaaa

SEQ ID NO: 1431511 - RNA, 13 nt, Human
ucuguaauugcaa

SEQ ID NO: 1431512 - RNA, 12 nt, Human
ucuguaauugca

SEQ ID NO: 1431513 - RNA, 20 nt, Human
ucuguaauucagguuuuucc

SEQ ID NO: 1431514 - RNA, 17 nt, Human
ucuggugaagcucacuu

SEQ ID NO: 1431515 - RNA, 20 nt, Human
ucuggcuucuggccaggaag

SEQ ID NO: 1431516 - RNA, 16 nt, Human
ucuguaaacuguguau

SEQ ID NO: 1431517 - RNA, 15 nt, Human
ucuguaaacugugua

SEQ ID NO: 1431518 - RNA, 14 nt, Human
ucuguaaacugugu

SEQ ID NO: 1431519 - RNA, 13 nt, Human
ucuguaaacugug

SEQ ID NO: 1431520 - RNA, 12 nt, Human
ucuguaaacugu

SEQ ID NO: 1431521 - RNA, 22 nt, Human
ucuguaaaaucuuucuuucuua

SEQ ID NO: 1431522 - RNA, 23 nt, Human
ucuguaaaaucuuucuuucuuag

SEQ ID NO: 1431523 - RNA, 13 nt, Human
ucuguaaagcuaa

SEQ ID NO: 1431524 - RNA, 19 nt, Human
ucuguaaagcuaaaauaaa

SEQ ID NO: 1431525 - RNA, 22 nt, Human
ucuguaaacuguguauuccaag

SEQ ID NO: 1431526 - RNA, 19 nt, Human
ucuguaaacuguguauucc

SEQ ID NO: 1431527 - RNA, 16 nt, Human
ucuguaaaucuacaca

SEQ ID NO: 1431528 - RNA, 20 nt, Human
ucuguaagaaaccuacugcc

SEQ ID NO: 1431529 - RNA, 14 nt, Human
ucuguaagaaaccu

SEQ ID NO: 1431530 - RNA, 22 nt, Human
ucuguaagaaaccuacugccca

SEQ ID NO: 1431531 - RNA, 16 nt, Human
ucuguaauucagguuu

SEQ ID NO: 1431532 - RNA, 19 nt, Human
ucuggcuucuggccaggaa

SEQ ID NO: 1431533 - RNA, 18 nt, Human
ucuggcuucuggccagga

SEQ ID NO: 1431534 - RNA, 15 nt, Human
ucuggcuucuggcca

SEQ ID NO: 1431535 - RNA, 21 nt, Human
ucuggcuguaaggcucuagau

SEQ ID NO: 1431536 - RNA, 18 nt, Human
ucuggcuguaaggcucua

SEQ ID NO: 1431537 - RNA, 16 nt, Human
ucuggcuguaaggcuc

SEQ ID NO: 1431538 - RNA, 22 nt, Human
ucuggcuguaaggcucuagauc

SEQ ID NO: 1431539 - RNA, 20 nt, Human
ucuggcugguguuaacagaa

SEQ ID NO: 1431540 - RNA, 18 nt, Human
ucuggcugguguuaacag

SEQ ID NO: 1431541 - RNA, 17 nt, Human
ucuggcugguguuaaca

SEQ ID NO: 1431542 - RNA, 13 nt, Human
ucuggcugguguu

SEQ ID NO: 1431543 - RNA, 12 nt, Human
ucuggcuggugu

SEQ ID NO: 1431544 - RNA, 18 nt, Human
ucuggcugguagagcagg

SEQ ID NO: 1431545 - RNA, 22 nt, Human
ucuggagccagccgagcaggag

SEQ ID NO: 1431546 - RNA, 14 nt, Human
ucuggagccagccg

SEQ ID NO: 1431547 - RNA, 15 nt, Human
ucuggagcauuucuc

SEQ ID NO: 1431548 - RNA, 12 nt, Human
ucuggagcccac

SEQ ID NO: 1431549 - RNA, 16 nt, Human
ucuggagcccacugua

SEQ ID NO: 1431550 - RNA, 22 nt, Human
ucuggagcccacuguacuugcu

SEQ ID NO: 1431551 - RNA, 14 nt, Human
ugaaaacagaaugu

SEQ ID NO: 1431552 - RNA, 18 nt, Human
ugaaaacacugugcacau

SEQ ID NO: 1431553 - RNA, 16 nt, Human
ugaaaacacugugcac

SEQ ID NO: 1431554 - RNA, 24 nt, Human
ucuuuucccccuuugugcacauuu

SEQ ID NO: 1431555 - RNA, 19 nt, Human
ucuuuucccccauuaauca

SEQ ID NO: 1431556 - RNA, 21 nt, Human
ucuuuucccauuuaucuaaau

SEQ ID NO: 1431557 - RNA, 20 nt, Human
ucuuuucccauuuaucuaaa

SEQ ID NO: 1431558 - RNA, 19 nt, Human
ucuuuucccauuuaucuaa

SEQ ID NO: 1431559 - RNA, 16 nt, Human
ucuuuucccauuuauc

SEQ ID NO: 1431560 - RNA, 19 nt, Human
ucuuuucccacuguuuaag

SEQ ID NO: 1431561 - RNA, 14 nt, Human
ucuuuucauacauu

SEQ ID NO: 1431562 - RNA, 12 nt, Human
ucuuuuguauua

SEQ ID NO: 1431563 - RNA, 20 nt, Human
ucuuuuguucgcauggucac

SEQ ID NO: 1431564 - RNA, 19 nt, Human
ucuuuuuaccuuucauaca

SEQ ID NO: 1431565 - RNA, 21 nt, Human
ugaaaacacauuuuucuuagg

SEQ ID NO: 1431566 - RNA, 14 nt, Human
ugaaaauuauuuaa

SEQ ID NO: 1431567 - RNA, 17 nt, Human
ugaaaauuauuuaaacc

SEQ ID NO: 1431568 - RNA, 13 nt, Human
ugaaaauuauuua

SEQ ID NO: 1431569 - RNA, 18 nt, Human
ugaaaaccacauuggaga

SEQ ID NO: 1431570 - RNA, 15 nt, Human
ugaaacacuuugcau

SEQ ID NO: 1431571 - RNA, 12 nt, Human
ugaaaauuuuga

SEQ ID NO: 1431572 - RNA, 23 nt, Human
ucuuuucauacauuuucuaagaa

SEQ ID NO: 1431573 - RNA, 13 nt, Human
ucuuuucauacau

SEQ ID NO: 1431574 - RNA, 12 nt, Human
ucuuugccucaa

SEQ ID NO: 1431575 - RNA, 12 nt, Human
ucuuugagaggg

SEQ ID NO: 1431576 - RNA, 21 nt, Human
ucuuugccacccucaugcugu

SEQ ID NO: 1431577 - RNA, 22 nt, Human
ucuuugccacccucaugcugug

SEQ ID NO: 1431578 - RNA, 14 nt, Human
ucuugugcacuggc

SEQ ID NO: 1431579 - RNA, 23 nt, Human
ucuuuccaaaguacacuguuuca

SEQ ID NO: 1431580 - RNA, 22 nt, Human
ucuugugcacuggcaccaagug

SEQ ID NO: 1431581 - RNA, 13 nt, Human
ucuugugaggaaa

SEQ ID NO: 1431582 - RNA, 23 nt, Human
ucuugugaggaaagucauuggcu

SEQ ID NO: 1431583 - RNA, 15 nt, Human
ucuugucuauaaagc

SEQ ID NO: 1431584 - RNA, 21 nt, Human
ucuugucucaaugcucauaac

SEQ ID NO: 1431585 - RNA, 18 nt, Human
ucuugucucaaugcucau

SEQ ID NO: 1431586 - RNA, 20 nt, Human
ucuugucucaaugcucauaa

SEQ ID NO: 1431587 - RNA, 20 nt, Human
ucuuugaauaaaugucacuu

SEQ ID NO: 1431588 - RNA, 21 nt, Human
ucuuugaauaaaugucacuuu

SEQ ID NO: 1431589 - RNA, 17 nt, Human
ucuuugaauaaauguca

SEQ ID NO: 1431590 - RNA, 16 nt, Human
ucuuugaauaaauguc

SEQ ID NO: 1431591 - RNA, 18 nt, Human
ucuuucccauggggaggg

SEQ ID NO: 1431592 - RNA, 22 nt, Human
ucuuuccauuugcauuuguuua

SEQ ID NO: 1431593 - RNA, 17 nt, Human
ucuuuccauuugcauuu

SEQ ID NO: 1431594 - RNA, 16 nt, Human
ucuuuccauuugcauu

SEQ ID NO: 1431595 - RNA, 14 nt, Human
ucuuuccauuugca

SEQ ID NO: 1431596 - RNA, 19 nt, Human
ucuuuccaaccggcuuugu

SEQ ID NO: 1431597 - RNA, 13 nt, Human
ucuuuccauuugc

SEQ ID NO: 1431598 - RNA, 22 nt, Human
ucuuguguguaugcacaugaac

SEQ ID NO: 1431599 - RNA, 19 nt, Human
ucuuuccacagaagcucca

SEQ ID NO: 1431600 - RNA, 21 nt, Human
ucuuguguguaugcacaugaa

SEQ ID NO: 1431601 - RNA, 15 nt, Human
ucuuguguguaugca

SEQ ID NO: 1431602 - RNA, 17 nt, Human
ucuuuccacagaagcuc

SEQ ID NO: 1431603 - RNA, 23 nt, Human
ucuuccuugaagaacugcaggcc

SEQ ID NO: 1431604 - RNA, 14 nt, Human
ucuuccuuuuauca

SEQ ID NO: 1431605 - RNA, 22 nt, Human
ucuucuuuuaaaccauuuucuu

SEQ ID NO: 1431606 - RNA, 21 nt, Human
ucuucuuuuaaaccauuuucu

SEQ ID NO: 1431607 - RNA, 20 nt, Human
ucuugaaauuaagaaggcaa

SEQ ID NO: 1431608 - RNA, 14 nt, Human
ucuugaaauuaaga

SEQ ID NO: 1431609 - RNA, 22 nt, Human
ucuugaaauuaagaaggcaaaa

SEQ ID NO: 1431610 - RNA, 20 nt, Human
ucuugaaauauaggaacuua

SEQ ID NO: 1431611 - RNA, 21 nt, Human
ucuugaaauauaggaacuuaa

SEQ ID NO: 1431612 - RNA, 21 nt, Human
ucuugaaauuaagaaggcaaa

SEQ ID NO: 1431613 - RNA, 16 nt, Human
ucuugucuauaaagca

SEQ ID NO: 1431614 - RNA, 14 nt, Human
ucuugucucaaugc

SEQ ID NO: 1431615 - RNA, 13 nt, Human
ucuugucuauaaa

SEQ ID NO: 1431616 - RNA, 12 nt, Human
ucuugucuauaa

SEQ ID NO: 1431617 - RNA, 15 nt, Human
ucuugucucaaugcu

SEQ ID NO: 1431618 - RNA, 17 nt, Human
ucuugucucaaugcuca

SEQ ID NO: 1431619 - RNA, 20 nt, Human
ucuuguauaagauccuagau

SEQ ID NO: 1431620 - RNA, 21 nt, Human
ucuuguauaagauccuagauc

SEQ ID NO: 1431621 - RNA, 15 nt, Human
ucuuguaauuuuaca

SEQ ID NO: 1431622 - RNA, 19 nt, Human
ucuuguaauuuuacacgcu

SEQ ID NO: 1431623 - RNA, 11 nt, Human
ucuuguaauuu

SEQ ID NO: 1431624 - RNA, 13 nt, Human
ucuuguaauuuua

SEQ ID NO: 1431625 - RNA, 17 nt, Human
ucuugcccgcucaggcu

SEQ ID NO: 1431626 - RNA, 17 nt, Human
ucuugcauuaugcaauu

SEQ ID NO: 1431627 - RNA, 15 nt, Human
ucuugcauuaugcaa

SEQ ID NO: 1431628 - RNA, 12 nt, Human
ucuugcauguaa

SEQ ID NO: 1431629 - RNA, 19 nt, Human
ucuugccaaauauaaauaa

SEQ ID NO: 1431630 - RNA, 20 nt, Human
ucuucauaacaauuuuagga

SEQ ID NO: 1431631 - RNA, 16 nt, Human
ucuucauguuucagga

SEQ ID NO: 1431632 - RNA, 17 nt, Human
ucuucaguugucucuga

SEQ ID NO: 1431633 - RNA, 16 nt, Human
ucuucaguugucucug

SEQ ID NO: 1431634 - RNA, 21 nt, Human
ucuucaguugucucugaugca

SEQ ID NO: 1431635 - RNA, 15 nt, Human
ucuucaguugucucu

SEQ ID NO: 1431636 - RNA, 15 nt, Human
ucuucagaggcccuc

SEQ ID NO: 1431637 - RNA, 14 nt, Human
ucuucagaggcccu

SEQ ID NO: 1431638 - RNA, 15 nt, Human
ucuucagaucucuaa

SEQ ID NO: 1431639 - RNA, 14 nt, Human
ucuuaugcaauuuc

SEQ ID NO: 1431640 - RNA, 14 nt, Human
ucuucagaucucua

SEQ ID NO: 1431641 - RNA, 16 nt, Human
ucuuauccuccaccgu

SEQ ID NO: 1431642 - RNA, 17 nt, Human
ucuuagucuagguccuu

SEQ ID NO: 1431643 - RNA, 22 nt, Human
ucuuagcucaaugagcauguuu

SEQ ID NO: 1431644 - RNA, 16 nt, Human
ucuuagcagcuuccag

SEQ ID NO: 1431645 - RNA, 21 nt, Human
ucuuagauucucugugucuaa

SEQ ID NO: 1431646 - RNA, 12 nt, Human
ucuuagauucuc

SEQ ID NO: 1431647 - RNA, 21 nt, Human
ucugugugcacaaauauuuau

SEQ ID NO: 1431648 - RNA, 14 nt, Human
ucugugugcacaaa

SEQ ID NO: 1431649 - RNA, 19 nt, Human
ucugugugaaacuuucauu

SEQ ID NO: 1431650 - RNA, 21 nt, Human
ucugugugaaacuuucauucc

SEQ ID NO: 1431651 - RNA, 16 nt, Human
ucugugugaaacuuuc

SEQ ID NO: 1431652 - RNA, 21 nt, Human
ucuuagcucaaugagcauguu

SEQ ID NO: 1431653 - RNA, 19 nt, Human
ucuuagcucaaugagcaug

SEQ ID NO: 1431654 - RNA, 18 nt, Human
ucuuagcucaaugagcau

SEQ ID NO: 1431655 - RNA, 16 nt, Human
ucuuagcucaaugagc

SEQ ID NO: 1431656 - RNA, 15 nt, Human
ucuuagcucaaugag

SEQ ID NO: 1431657 - RNA, 21 nt, Human
ucuuagcuaucauugcuuccu

SEQ ID NO: 1431658 - RNA, 20 nt, Human
ucuuagcuaucauugcuucc

SEQ ID NO: 1431659 - RNA, 13 nt, Human
ucuuauaauuuaa

SEQ ID NO: 1431660 - RNA, 14 nt, Human
ucuuauaauuuaaa

SEQ ID NO: 1431661 - RNA, 14 nt, Human
ugagcugaggcagc

SEQ ID NO: 1431662 - RNA, 14 nt, Human
ugagcugagcaggc

SEQ ID NO: 1431663 - RNA, 24 nt, Human
ugagcugaccagccgugagcaugu

SEQ ID NO: 1431664 - RNA, 15 nt, Human
ugagcugaccagccg

SEQ ID NO: 1431665 - RNA, 14 nt, Human
ugagcucagcgugg

SEQ ID NO: 1431666 - RNA, 23 nt, Human
ugagcucacaaggcagcaaggcc

SEQ ID NO: 1431667 - RNA, 23 nt, Human
ugagcucagaaaauaucccuccu

SEQ ID NO: 1431668 - RNA, 22 nt, Human
ugagcucacaaggcagcaaggc

SEQ ID NO: 1431669 - RNA, 20 nt, Human
ugagcucacaaggcagcaag

SEQ ID NO: 1431670 - RNA, 19 nt, Human
ugagcucacaaggcagcaa

SEQ ID NO: 1431671 - RNA, 18 nt, Human
ugagcucacaaggcagca

SEQ ID NO: 1431672 - RNA, 17 nt, Human
ugagcucacaaggcagc

SEQ ID NO: 1431673 - RNA, 15 nt, Human
ugagcuauuucaucu

SEQ ID NO: 1431674 - RNA, 16 nt, Human
ugagcuauugcuguuc

SEQ ID NO: 1431675 - RNA, 15 nt, Human
ugagcagucaggaaa

SEQ ID NO: 1431676 - RNA, 21 nt, Human
ugaggagucugagguccugag

SEQ ID NO: 1431677 - RNA, 22 nt, Human
ugaggagucugagguccugagc

SEQ ID NO: 1431678 - RNA, 17 nt, Human
ugaggagucugaggucc

SEQ ID NO: 1431679 - RNA, 16 nt, Human
ugaggagucugagguc

SEQ ID NO: 1431680 - RNA, 15 nt, Human
ugaggagucugaggu

SEQ ID NO: 1431681 - RNA, 14 nt, Human
ugaggagucugagg

SEQ ID NO: 1431682 - RNA, 13 nt, Human
ugaggagucugag

SEQ ID NO: 1431683 - RNA, 20 nt, Human
ugagcuuaaaauacaagacu

SEQ ID NO: 1431684 - RNA, 19 nt, Human
ugagcuuaaaauacaagac

SEQ ID NO: 1431685 - RNA, 17 nt, Human
ugagcuuaaaauacaag

SEQ ID NO: 1431686 - RNA, 16 nt, Human
ugagcuuaaaauacaa

SEQ ID NO: 1431687 - RNA, 22 nt, Human
ugagcuuaaaauacaagacugc

SEQ ID NO: 1431688 - RNA, 21 nt, Human
ugagcuuaaaauacaagacug

SEQ ID NO: 1431689 - RNA, 17 nt, Human
ugagcugcccacagcag

SEQ ID NO: 1431690 - RNA, 16 nt, Human
ugagcugucaacgaga

SEQ ID NO: 1431691 - RNA, 14 nt, Human
ugaggcaaaagaag

SEQ ID NO: 1431692 - RNA, 22 nt, Human
ugaggauguaaagaucaauaaa

SEQ ID NO: 1431693 - RNA, 20 nt, Human
ugaggauacgacaguacacu

SEQ ID NO: 1431694 - RNA, 19 nt, Human
ugaggaucagaguaaucca

SEQ ID NO: 1431695 - RNA, 13 nt, Human
ugaggaucagagu

SEQ ID NO: 1431696 - RNA, 17 nt, Human
ugaggaucagaguaauc

SEQ ID NO: 1431697 - RNA, 19 nt, Human
ugaggugcacugggaggcu

SEQ ID NO: 1431698 - RNA, 15 nt, Human
ugaggugcacuggga

SEQ ID NO: 1431699 - RNA, 22 nt, Human
ugaggucagcacaucucaacag

SEQ ID NO: 1431700 - RNA, 14 nt, Human
ugaggcuguccugu

SEQ ID NO: 1431701 - RNA, 13 nt, Human
ugaggcuguccug

SEQ ID NO: 1431702 - RNA, 12 nt, Human
ugaggcuguccu

SEQ ID NO: 1431703 - RNA, 15 nt, Human
ugagguguccaacug

SEQ ID NO: 1431704 - RNA, 22 nt, Human
ugaguccccauugaggcuuggu

SEQ ID NO: 1431705 - RNA, 20 nt, Human
ugaguccccauugaggcuug

SEQ ID NO: 1431706 - RNA, 15 nt, Human
ugaggugccuguccc

SEQ ID NO: 1431707 - RNA, 14 nt, Human
ugaggugccugucc

SEQ ID NO: 1431708 - RNA, 18 nt, Human
ugaggugcccaggagaag

SEQ ID NO: 1431709 - RNA, 17 nt, Human
ugaggugcccaggagaa

SEQ ID NO: 1431710 - RNA, 16 nt, Human
ugaggugcccaggaga

SEQ ID NO: 1431711 - RNA, 15 nt, Human
ugaggugcccaggag

SEQ ID NO: 1431712 - RNA, 14 nt, Human
ugaggugcccagga

SEQ ID NO: 1431713 - RNA, 13 nt, Human
ugaggugcccagg

SEQ ID NO: 1431714 - RNA, 12 nt, Human
ugaggugcccag

SEQ ID NO: 1431715 - RNA, 16 nt, Human
ugaggugcacugggag

SEQ ID NO: 1431716 - RNA, 16 nt, Human
ugaggugccuguccca

SEQ ID NO: 1431717 - RNA, 21 nt, Human
ugaggcgagaagggcugcuuc

SEQ ID NO: 1431718 - RNA, 20 nt, Human
ugaggcgagaagggcugcuu

SEQ ID NO: 1431719 - RNA, 22 nt, Human
ugaggccugggccgcugccacg

SEQ ID NO: 1431720 - RNA, 13 nt, Human
ugaggccugggcc

SEQ ID NO: 1431721 - RNA, 12 nt, Human
ugaggccugggc

SEQ ID NO: 1431722 - RNA, 23 nt, Human
ugaggcgccccaacccguggagg

SEQ ID NO: 1431723 - RNA, 23 nt, Human
ugaggccuggacuuuccugcaac

SEQ ID NO: 1431724 - RNA, 20 nt, Human
ugaggccuggacuuuccugc

SEQ ID NO: 1431725 - RNA, 19 nt, Human
ugaggccuggacuuuccug

SEQ ID NO: 1431726 - RNA, 17 nt, Human
ugaggccuggacuuucc

SEQ ID NO: 1431727 - RNA, 14 nt, Human
ugaggccuggacuu

SEQ ID NO: 1431728 - RNA, 12 nt, Human
ugaggccuggac

SEQ ID NO: 1431729 - RNA, 11 nt, Human
ugaggccugga

SEQ ID NO: 1431730 - RNA, 21 nt, Human
ugaggcagcagugugaggcca

SEQ ID NO: 1431731 - RNA, 20 nt, Human
ugaggcacaugucagcaagu

SEQ ID NO: 1431732 - RNA, 17 nt, Human
ugaggcacaugucagca

SEQ ID NO: 1431733 - RNA, 12 nt, Human
ugaggcaaaaga

SEQ ID NO: 1431734 - RNA, 15 nt, Human
ugaggcacuggcgag

SEQ ID NO: 1431735 - RNA, 15 nt, Human
ugagauaguuuucau

SEQ ID NO: 1431736 - RNA, 21 nt, Human
ugagauacauacagaauuacu

SEQ ID NO: 1431737 - RNA, 20 nt, Human
ugagauaccagcgaggaggc

SEQ ID NO: 1431738 - RNA, 21 nt, Human
ugagauaccagcgaggaggcu

SEQ ID NO: 1431739 - RNA, 15 nt, Human
ugagauacauacaga

SEQ ID NO: 1431740 - RNA, 14 nt, Human
ugagauacauacag

SEQ ID NO: 1431741 - RNA, 22 nt, Human
ugagagggcucgaggggugggc

SEQ ID NO: 1431742 - RNA, 22 nt, Human
ugagaguuuuggaugcagugcu

SEQ ID NO: 1431743 - RNA, 17 nt, Human
ugagcagcgagccugcu

SEQ ID NO: 1431744 - RNA, 16 nt, Human
ugagcagccuggagcc

SEQ ID NO: 1431745 - RNA, 18 nt, Human
ugagcagccuggagcccu

SEQ ID NO: 1431746 - RNA, 21 nt, Human
ugagcagccuggagcccugga

SEQ ID NO: 1431747 - RNA, 12 nt, Human
ugagcagggccg

SEQ ID NO: 1431748 - RNA, 22 nt, Human
ugagcaggccacacuucaaacu

SEQ ID NO: 1431749 - RNA, 16 nt, Human
ugagcagggccgggga

SEQ ID NO: 1431750 - RNA, 14 nt, Human
ugagcagggccggg

SEQ ID NO: 1431751 - RNA, 20 nt, Human
ugagcagggccggggaacug

SEQ ID NO: 1431752 - RNA, 19 nt, Human
ugagaggcugucuguugua

SEQ ID NO: 1431753 - RNA, 19 nt, Human
ugagaggcugggaauggag

SEQ ID NO: 1431754 - RNA, 13 nt, Human
ugagacauccagc

SEQ ID NO: 1431755 - RNA, 18 nt, Human
ugagaaacuuaaauguua

SEQ ID NO: 1431756 - RNA, 19 nt, Human
ugagaaaggguagaauucu

SEQ ID NO: 1431757 - RNA, 16 nt, Human
ugagaaagccuucuuu

SEQ ID NO: 1431758 - RNA, 14 nt, Human
ugagaaagccuucu

SEQ ID NO: 1431759 - RNA, 19 nt, Human
ugagaaacuuaaauguuau

SEQ ID NO: 1431760 - RNA, 17 nt, Human
ugagaaauauggacacu

SEQ ID NO: 1431761 - RNA, 15 nt, Human
ugagaaauauggaca

SEQ ID NO: 1431762 - RNA, 22 nt, Human
ugagaaauagcuuaugaaaaga

SEQ ID NO: 1431763 - RNA, 21 nt, Human
ugagaaauauggacacuuaau

SEQ ID NO: 1431764 - RNA, 13 nt, Human
ugagaaaucuaaa

SEQ ID NO: 1431765 - RNA, 10 nt, Human
ugagacaucc

SEQ ID NO: 1431766 - RNA, 12 nt, Human
ugagacauccag

SEQ ID NO: 1431767 - RNA, 14 nt, Human
ugacuuuuugcauu

SEQ ID NO: 1431768 - RNA, 14 nt, Human
ugacuuuugugaaa

SEQ ID NO: 1431769 - RNA, 22 nt, Human
ugacuuuucuguaauucagguu

SEQ ID NO: 1431770 - RNA, 19 nt, Human
ugacuuuucuguaauucag

SEQ ID NO: 1431771 - RNA, 13 nt, Human
ugacuuuucugua

SEQ ID NO: 1431772 - RNA, 17 nt, Human
ugacuuugcuugcuuug

SEQ ID NO: 1431773 - RNA, 20 nt, Human
ugagaaacaacaauuucuac

SEQ ID NO: 1431774 - RNA, 19 nt, Human
ugagaaaagcuuugaaccc

SEQ ID NO: 1431775 - RNA, 12 nt, Human
ugagaaaacaug

SEQ ID NO: 1431776 - RNA, 23 nt, Human
ugacuuuuugcauuuaaaacaga

SEQ ID NO: 1431777 - RNA, 17 nt, Human
ugacuuuuugcauuuaa

SEQ ID NO: 1431778 - RNA, 18 nt, Human
ugagaaaaauauauacua

SEQ ID NO: 1431779 - RNA, 16 nt, Human
ugacuaauggcaugag

SEQ ID NO: 1431780 - RNA, 14 nt, Human
ugacuaauggcaug

SEQ ID NO: 1431781 - RNA, 23 nt, Human
ugacuaacuagacaccaaaguuc

SEQ ID NO: 1431782 - RNA, 20 nt, Human
ugacuaacuagacaccaaag

SEQ ID NO: 1431783 - RNA, 21 nt, Human
ugacuaacaggccaaagaguc

SEQ ID NO: 1431784 - RNA, 17 nt, Human
ugacuaacaggccaaag

SEQ ID NO: 1431785 - RNA, 21 nt, Human
ugacuaaacuuuuuuucugua

SEQ ID NO: 1431786 - RNA, 19 nt, Human
ugacuaaacuuuuuuucug

SEQ ID NO: 1431787 - RNA, 18 nt, Human
ugacuaaacuuuuuuucu

SEQ ID NO: 1431788 - RNA, 12 nt, Human
ugacuaaacuuu

SEQ ID NO: 1431789 - RNA, 14 nt, Human
ugacuaaaauauuu

SEQ ID NO: 1431790 - RNA, 17 nt, Human
ugaccagccgugagcau

SEQ ID NO: 1431791 - RNA, 19 nt, Human
ugaccaugcucaucugcug

SEQ ID NO: 1431792 - RNA, 18 nt, Human
ugaccaugcucaucugcu

SEQ ID NO: 1431793 - RNA, 16 nt, Human
ugaccaugcucaucug

SEQ ID NO: 1431794 - RNA, 12 nt, Human
ugaccaugcuca

SEQ ID NO: 1431795 - RNA, 17 nt, Human
ugacuacagucaggaaa

SEQ ID NO: 1431796 - RNA, 16 nt, Human
ugacuacagucaggaa

SEQ ID NO: 1431797 - RNA, 15 nt, Human
ugacuaauggcauga

SEQ ID NO: 1431798 - RNA, 18 nt, Human
ugacuacagucaggaaag

SEQ ID NO: 1431799 - RNA, 16 nt, Human
ugacucuuaagaagac

SEQ ID NO: 1431800 - RNA, 15 nt, Human
ugacucuuaagaaga

SEQ ID NO: 1431801 - RNA, 14 nt, Human
ugacucuuaagaag

SEQ ID NO: 1431802 - RNA, 16 nt, Human
ugacugcuugcccuaa

SEQ ID NO: 1431803 - RNA, 14 nt, Human
ugacugcuugcccu

SEQ ID NO: 1431804 - RNA, 19 nt, Human
ugacucuuuccaaccggcu

SEQ ID NO: 1431805 - RNA, 13 nt, Human
ugacucuuuccaa

SEQ ID NO: 1431806 - RNA, 14 nt, Human
ugacucuuggcaca

SEQ ID NO: 1431807 - RNA, 19 nt, Human
ugacucuuggcacagcaug

SEQ ID NO: 1431808 - RNA, 16 nt, Human
ugacucuuuccaaccg

SEQ ID NO: 1431809 - RNA, 14 nt, Human
ugacucuuuccaac

SEQ ID NO: 1431810 - RNA, 21 nt, Human
ugacuuuccccaccagaugcu

SEQ ID NO: 1431811 - RNA, 12 nt, Human
ugacuuucccca

SEQ ID NO: 1431812 - RNA, 16 nt, Human
ugacugggaccaggca

SEQ ID NO: 1431813 - RNA, 15 nt, Human
ugacuggcuaaagcu

SEQ ID NO: 1431814 - RNA, 13 nt, Human
ugacuuugcuugc

SEQ ID NO: 1431815 - RNA, 13 nt, Human
ugacuuucuuuuu

SEQ ID NO: 1431816 - RNA, 23 nt, Human
ugacuuuccccaccagaugcuga

SEQ ID NO: 1431817 - RNA, 22 nt, Human
ugacuuuccccaccagaugcug

SEQ ID NO: 1431818 - RNA, 16 nt, Human
ugacuuugcuugcuuu

SEQ ID NO: 1431819 - RNA, 15 nt, Human
ugacuuugcuugcuu

SEQ ID NO: 1431820 - RNA, 16 nt, Human
ugacuuuggcugcaug

SEQ ID NO: 1431821 - RNA, 19 nt, Human
ugacaucggaaaaauaauc

SEQ ID NO: 1431822 - RNA, 21 nt, Human
ugacaucggaaaaauaaucaa

SEQ ID NO: 1431823 - RNA, 18 nt, Human
ugacaucagguuuuuccc

SEQ ID NO: 1431824 - RNA, 23 nt, Human
ugacaucacuuguacaaaauaaa

SEQ ID NO: 1431825 - RNA, 22 nt, Human
ugacaucacuuguacaaaauaa

SEQ ID NO: 1431826 - RNA, 21 nt, Human
ugacaucacuuguacaaaaua

SEQ ID NO: 1431827 - RNA, 20 nt, Human
ugacaucacuuguacaaaau

SEQ ID NO: 1431828 - RNA, 19 nt, Human
ugacaucacuuguacaaaa

SEQ ID NO: 1431829 - RNA, 18 nt, Human
ugacaucacuuguacaaa

SEQ ID NO: 1431830 - RNA, 17 nt, Human
ugacaucacuuguacaa

SEQ ID NO: 1431831 - RNA, 16 nt, Human
ugacaucacuuguaca

SEQ ID NO: 1431832 - RNA, 13 nt, Human
ugacaucacuugu

SEQ ID NO: 1431833 - RNA, 14 nt, Human
ugacaucaaaaaag

SEQ ID NO: 1431834 - RNA, 17 nt, Human
ugacaugcaucaucuca

SEQ ID NO: 1431835 - RNA, 22 nt, Human
ugacaugaauuuuagcuuuugu

SEQ ID NO: 1431836 - RNA, 21 nt, Human
ugacaugaauuuuagcuuuug

SEQ ID NO: 1431837 - RNA, 17 nt, Human
ugacaugaauuuuagcu

SEQ ID NO: 1431838 - RNA, 15 nt, Human
ugacaugaagcuguu

SEQ ID NO: 1431839 - RNA, 18 nt, Human
ugacauguggggccaggu

SEQ ID NO: 1431840 - RNA, 17 nt, Human
ugacauguggggccagg

SEQ ID NO: 1431841 - RNA, 20 nt, Human
ugacauguggggccagguca

SEQ ID NO: 1431842 - RNA, 19 nt, Human
ugacauguggggccagguc

SEQ ID NO: 1431843 - RNA, 16 nt, Human
ugacaugggacauuug

SEQ ID NO: 1431844 - RNA, 17 nt, Human
ugacaacuggcaggcag

SEQ ID NO: 1431845 - RNA, 18 nt, Human
ugacaacuggcaggcagg

SEQ ID NO: 1431846 - RNA, 15 nt, Human
ugacaacuggcaggc

SEQ ID NO: 1431847 - RNA, 14 nt, Human
ugacaacuggcagg

SEQ ID NO: 1431848 - RNA, 13 nt, Human
ugacaacuggcag

SEQ ID NO: 1431849 - RNA, 21 nt, Human
ugacaacguuucagcgacucc

SEQ ID NO: 1431850 - RNA, 17 nt, Human
ugacaaccacuggucug

SEQ ID NO: 1431851 - RNA, 19 nt, Human
ugacaaccaugagaccacu

SEQ ID NO: 1431852 - RNA, 16 nt, Human
ugacaaccacuggucu

SEQ ID NO: 1431853 - RNA, 16 nt, Human
ugacaauaaaacauua

SEQ ID NO: 1431854 - RNA, 14 nt, Human
ugacaauaaaacau

SEQ ID NO: 1431855 - RNA, 13 nt, Human
ugacaauaaaaca

SEQ ID NO: 1431856 - RNA, 12 nt, Human
ugacaauaaaac

SEQ ID NO: 1431857 - RNA, 19 nt, Human
ugaauuguaacuguucuug

SEQ ID NO: 1431858 - RNA, 14 nt, Human
ugaauuacauuugu

SEQ ID NO: 1431859 - RNA, 23 nt, Human
ugaauuaauaucccuacauguau

SEQ ID NO: 1431860 - RNA, 22 nt, Human
ugaauuaauaucccuacaugua

SEQ ID NO: 1431861 - RNA, 19 nt, Human
ugaauuaauaucccuacau

SEQ ID NO: 1431862 - RNA, 16 nt, Human
ugaauuaauaucccua

SEQ ID NO: 1431863 - RNA, 13 nt, Human
ugaauuacauuug

SEQ ID NO: 1431864 - RNA, 18 nt, Human
ugaauuaagcccaauuaa

SEQ ID NO: 1431865 - RNA, 17 nt, Human
ugaauuaaauaaacccu

SEQ ID NO: 1431866 - RNA, 14 nt, Human
ugaauuaaguuuuu

SEQ ID NO: 1431867 - RNA, 16 nt, Human
ugacaacauuucuaua

SEQ ID NO: 1431868 - RNA, 23 nt, Human
ugacaacauuucuauagccaaaa

SEQ ID NO: 1431869 - RNA, 16 nt, Human
ugaauuuaaauagcuu

SEQ ID NO: 1431870 - RNA, 22 nt, Human
ugaaugaagcaaaugucaugcu

SEQ ID NO: 1431871 - RNA, 11 nt, Human
ugaaugaagca

SEQ ID NO: 1431872 - RNA, 15 nt, Human
ugaaugaacacucuu

SEQ ID NO: 1431873 - RNA, 12 nt, Human
ugaaugaacacu

SEQ ID NO: 1431874 - RNA, 24 nt, Human
ugaaucuugucucaaugcucauaa

SEQ ID NO: 1431875 - RNA, 21 nt, Human
ugaaucuugucucaaugcuca

SEQ ID NO: 1431876 - RNA, 23 nt, Human
ugaaucuugucucaaugcucaua

SEQ ID NO: 1431877 - RNA, 13 nt, Human
ugaaucuugucuc

SEQ ID NO: 1431878 - RNA, 15 nt, Human
ugaaucuugucucaa

SEQ ID NO: 1431879 - RNA, 16 nt, Human
ugaaucuugucucaau

SEQ ID NO: 1431880 - RNA, 19 nt, Human
ugaaucuugucucaaugcu

SEQ ID NO: 1431881 - RNA, 20 nt, Human
ugaaucuugucucaaugcuc

SEQ ID NO: 1431882 - RNA, 20 nt, Human
ugaauguuuuucuaaaggag

SEQ ID NO: 1431883 - RNA, 18 nt, Human
ugaauguuuuucuaaagg

SEQ ID NO: 1431884 - RNA, 17 nt, Human
ugaauguuuuucuaaag

SEQ ID NO: 1431885 - RNA, 16 nt, Human
ugaauguuuuucuaaa

SEQ ID NO: 1431886 - RNA, 15 nt, Human
ugaauguuuuucuaa

SEQ ID NO: 1431887 - RNA, 13 nt, Human
ugaauguuuuucu

SEQ ID NO: 1431888 - RNA, 22 nt, Human
ugaauguuuacacucuuuguaa

SEQ ID NO: 1431889 - RNA, 19 nt, Human
ugaauguuuacacucuuug

SEQ ID NO: 1431890 - RNA, 19 nt, Human
ugaaugcaaaccauagcac

SEQ ID NO: 1431891 - RNA, 15 nt, Human
ugaaugcaaaccaua

SEQ ID NO: 1431892 - RNA, 20 nt, Human
ugaaugauuuuucuuuacaa

SEQ ID NO: 1431893 - RNA, 19 nt, Human
ugaaugauuuuucuuuaca

SEQ ID NO: 1431894 - RNA, 16 nt, Human
ugaaugauuuuucuuu

SEQ ID NO: 1431895 - RNA, 15 nt, Human
ugaaugauuuuucuu

SEQ ID NO: 1431896 - RNA, 24 nt, Human
ugaaugaagcaaaugucaugcugc

SEQ ID NO: 1431897 - RNA, 16 nt, Human
ugaaugauucaguguu

SEQ ID NO: 1431898 - RNA, 21 nt, Human
ugaauccucucucuguguuac

SEQ ID NO: 1431899 - RNA, 16 nt, Human
ugaauccucucucugu

SEQ ID NO: 1431900 - RNA, 14 nt, Human
ugaauccucucucu

SEQ ID NO: 1431901 - RNA, 14 nt, Human
ugaaucacaugaau

SEQ ID NO: 1431902 - RNA, 17 nt, Human
ugaaguuuuacauuguu

SEQ ID NO: 1431903 - RNA, 16 nt, Human
ugaaguuuuacauugu

SEQ ID NO: 1431904 - RNA, 15 nt, Human
ugaaguuuuacauug

SEQ ID NO: 1431905 - RNA, 14 nt, Human
ugaaguuuuacauu

SEQ ID NO: 1431906 - RNA, 16 nt, Human
ugaaguuugaauguua

SEQ ID NO: 1431907 - RNA, 17 nt, Human
ugaaguuugaauguuaa

SEQ ID NO: 1431908 - RNA, 18 nt, Human
ugaaguuugaauguuaaa

SEQ ID NO: 1431909 - RNA, 20 nt, Human
ugaaguuugaauguuaaaua

SEQ ID NO: 1431910 - RNA, 21 nt, Human
ugaaguuugaauguuaaauaa

SEQ ID NO: 1431911 - RNA, 14 nt, Human
ugaaguuugaaugu

SEQ ID NO: 1431912 - RNA, 15 nt, Human
ugaaguuugaauguu

SEQ ID NO: 1431913 - RNA, 12 nt, Human
ugaaguuugaau

SEQ ID NO: 1431914 - RNA, 13 nt, Human
ugaaguuugaaug

SEQ ID NO: 1431915 - RNA, 19 nt, Human
ugaaggcuucucucugugg

SEQ ID NO: 1431916 - RNA, 16 nt, Human
ugaaggcuucucucug

SEQ ID NO: 1431917 - RNA, 15 nt, Human
ugaaggcuucucucu

SEQ ID NO: 1431918 - RNA, 13 nt, Human
ugaaggcuucucu

SEQ ID NO: 1431919 - RNA, 14 nt, Human
ugaaggcuguacac

SEQ ID NO: 1431920 - RNA, 21 nt, Human
ugaacuugaggacacaugucc

SEQ ID NO: 1431921 - RNA, 22 nt, Human
ugaacuugaggacacaugucca

SEQ ID NO: 1431922 - RNA, 17 nt, Human
ugaacuugaggacacau

SEQ ID NO: 1431923 - RNA, 18 nt, Human
ugaacuugaggacacaug

SEQ ID NO: 1431924 - RNA, 19 nt, Human
ugaacuugaggacacaugu

SEQ ID NO: 1431925 - RNA, 20 nt, Human
ugaacuugaggacacauguc

SEQ ID NO: 1431926 - RNA, 21 nt, Human
ugaacuuagauuuuacaugaa

SEQ ID NO: 1431927 - RNA, 20 nt, Human
ugaacuuagauuuuacauga

SEQ ID NO: 1431928 - RNA, 19 nt, Human
ugaacuuagauuuuacaug

SEQ ID NO: 1431929 - RNA, 18 nt, Human
ugaacuuagauuuuacau

SEQ ID NO: 1431930 - RNA, 17 nt, Human
ugaacuuagauuuuaca

SEQ ID NO: 1431931 - RNA, 21 nt, Human
ugaacuugaaauauccugcuu

SEQ ID NO: 1431932 - RNA, 16 nt, Human
ugaacuugaggacaca

SEQ ID NO: 1431933 - RNA, 23 nt, Human
ugaaacagaaaaauauguaccaa

SEQ ID NO: 1431934 - RNA, 16 nt, Human
ugaaacagaaacaaaa

SEQ ID NO: 1431935 - RNA, 14 nt, Human
ugaaacagaaacaa

SEQ ID NO: 1431936 - RNA, 13 nt, Human
ugaaacagaaaca

SEQ ID NO: 1431937 - RNA, 15 nt, Human
ugaaacagaaaaaua

SEQ ID NO: 1431938 - RNA, 12 nt, Human
ugaaacagaaaa

SEQ ID NO: 1431939 - RNA, 16 nt, Human
ugaaacacuuugcaua

SEQ ID NO: 1431940 - RNA, 13 nt, Human
ugaaacauguuuc

SEQ ID NO: 1431941 - RNA, 14 nt, Human
ugaaggccugaggu

SEQ ID NO: 1431942 - RNA, 12 nt, Human
ugaaggccugag

SEQ ID NO: 1431943 - RNA, 23 nt, Human
ugaagaguguuauuuucauucaa

SEQ ID NO: 1431944 - RNA, 21 nt, Human
ugaagcuuuuaugugaaacau

SEQ ID NO: 1431945 - RNA, 17 nt, Human
ugaagagccacugccau

SEQ ID NO: 1431946 - RNA, 17 nt, Human
ugaagacuggaagcuaa

SEQ ID NO: 1431947 - RNA, 15 nt, Human
ugaagacuggaagcu

SEQ ID NO: 1431948 - RNA, 17 nt, Human
ugaagacuaugaaaaug

SEQ ID NO: 1431949 - RNA, 16 nt, Human
ugaagacuaugaaaau

SEQ ID NO: 1431950 - RNA, 23 nt, Human
ugaagaguaaucaaucuacucaa

SEQ ID NO: 1431951 - RNA, 23 nt, Human
ugaagaguaagucaaccugccug

SEQ ID NO: 1431952 - RNA, 21 nt, Human
ugaagagguuuuaaagcuucc

SEQ ID NO: 1431953 - RNA, 20 nt, Human
ugaagagguuuuaaagcuuc

SEQ ID NO: 1431954 - RNA, 21 nt, Human
ugccugacuagggagccaugu

SEQ ID NO: 1431955 - RNA, 23 nt, Human
ugccugacccuacuucuuuugcu

SEQ ID NO: 1431956 - RNA, 18 nt, Human
ugccugacauuuggagug

SEQ ID NO: 1431957 - RNA, 21 nt, Human
ugccuguagccccagugacag

SEQ ID NO: 1431958 - RNA, 22 nt, Human
ugccuguagccccagugacagc

SEQ ID NO: 1431959 - RNA, 20 nt, Human
ugccuguagccccagugaca

SEQ ID NO: 1431960 - RNA, 23 nt, Human
ugccucuacugggaaggcuacuu

SEQ ID NO: 1431961 - RNA, 23 nt, Human
ugccucgaaacacagaaaccuuu

SEQ ID NO: 1431962 - RNA, 21 nt, Human
ugccccuuccgccacuggggc

SEQ ID NO: 1431963 - RNA, 20 nt, Human
ugccccuuccgccacugggg

SEQ ID NO: 1431964 - RNA, 23 nt, Human
ugccccuuccgccacuggggcuc

SEQ ID NO: 1431965 - RNA, 19 nt, Human
ugccccuuccgccacuggg

SEQ ID NO: 1431966 - RNA, 18 nt, Human
ugccccuuccgccacugg

SEQ ID NO: 1431967 - RNA, 17 nt, Human
ugccccuuccgccacug

SEQ ID NO: 1431968 - RNA, 14 nt, Human
ugccccuuccgcca

SEQ ID NO: 1431969 - RNA, 13 nt, Human
ugccccuggcugg

SEQ ID NO: 1431970 - RNA, 21 nt, Human
ugccucuucugggagggcagc

SEQ ID NO: 1431971 - RNA, 20 nt, Human
ugccucuucugggagggcag

SEQ ID NO: 1431972 - RNA, 19 nt, Human
ugccucuucugggagggca

SEQ ID NO: 1431973 - RNA, 16 nt, Human
ugccucuucugggagg

SEQ ID NO: 1431974 - RNA, 16 nt, Human
ugccugacacacuaac

SEQ ID NO: 1431975 - RNA, 16 nt, Human
ugccucucccaggcag

SEQ ID NO: 1431976 - RNA, 17 nt, Human
ugccucucccaggcagg

SEQ ID NO: 1431977 - RNA, 13 nt, Human
ugccucucccagg

SEQ ID NO: 1431978 - RNA, 21 nt, Human
ugccucucaucaacugaauga

SEQ ID NO: 1431979 - RNA, 18 nt, Human
ugccucucaucaacugaa

SEQ ID NO: 1431980 - RNA, 15 nt, Human
ugccucuucugggag

SEQ ID NO: 1431981 - RNA, 20 nt, Human
ugccucucgcuccucaaccc

SEQ ID NO: 1431982 - RNA, 9 nt, Human
ugccucucu

SEQ ID NO: 1431983 - RNA, 17 nt, Human
ugcgugacaauaaaaca

SEQ ID NO: 1431984 - RNA, 15 nt, Human
ugcgugacaauaaaa

SEQ ID NO: 1431985 - RNA, 14 nt, Human
ugcgugacaauaaa

SEQ ID NO: 1431986 - RNA, 22 nt, Human
ugcgugacaauaaaacauuaau

SEQ ID NO: 1431987 - RNA, 13 nt, Human
ugcuaacaucuaa

SEQ ID NO: 1431988 - RNA, 22 nt, Human
ugcuaagagaaguagaaaucau

SEQ ID NO: 1431989 - RNA, 13 nt, Human
ugcuaagagaagu

SEQ ID NO: 1431990 - RNA, 16 nt, Human
ugcuaacaucuaaaaa

SEQ ID NO: 1431991 - RNA, 23 nt, Human
ugcuaaauaaaauuuguugcaua

SEQ ID NO: 1431992 - RNA, 22 nt, Human
ugcuaaauaaaauuuguugcau

SEQ ID NO: 1431993 - RNA, 21 nt, Human
ugcuaaauaaaauuuguugca

SEQ ID NO: 1431994 - RNA, 17 nt, Human
ugcuaaauaaaauuugu

SEQ ID NO: 1431995 - RNA, 12 nt, Human
ugcuaaagacau

SEQ ID NO: 1431996 - RNA, 16 nt, Human
ugcgauagagucucac

SEQ ID NO: 1431997 - RNA, 14 nt, Human
ugcgauagagucuc

SEQ ID NO: 1431998 - RNA, 13 nt, Human
ugcgauagagucu

SEQ ID NO: 1431999 - RNA, 16 nt, Human
ugccuugaaaaagaca

SEQ ID NO: 1432000 - RNA, 20 nt, Human
ugcgagugcucauuucagga

SEQ ID NO: 1432001 - RNA, 16 nt, Human
ugccuucuacuuuuaa

SEQ ID NO: 1432002 - RNA, 20 nt, Human
ugccuucgucuuucccaugg

SEQ ID NO: 1432003 - RNA, 23 nt, Human
ugccuucgcuucuugccucugug

SEQ ID NO: 1432004 - RNA, 22 nt, Human
ugccuucgcuucuugccucugu

SEQ ID NO: 1432005 - RNA, 21 nt, Human
ugccuucgcuucuugccucug

SEQ ID NO: 1432006 - RNA, 17 nt, Human
ugccuucucaacuccaa

SEQ ID NO: 1432007 - RNA, 15 nt, Human
ugccuucucaacucc

SEQ ID NO: 1432008 - RNA, 16 nt, Human
ugcuggaauucuaaca

SEQ ID NO: 1432009 - RNA, 17 nt, Human
ugcuggaauaaguucaa

SEQ ID NO: 1432010 - RNA, 22 nt, Human
ugcuggaagacgcaagggccug

SEQ ID NO: 1432011 - RNA, 18 nt, Human
ugcuggaaaauaauacug

SEQ ID NO: 1432012 - RNA, 14 nt, Human
ugcugcugugugcu

SEQ ID NO: 1432013 - RNA, 17 nt, Human
ugcugcugucugggugc

SEQ ID NO: 1432014 - RNA, 23 nt, Human
ugcugcuggggaagacaguggcc

SEQ ID NO: 1432015 - RNA, 13 nt, Human
ugcugcugucccu

SEQ ID NO: 1432016 - RNA, 24 nt, Human
ugcugcuggggaagacaguggccc

SEQ ID NO: 1432017 - RNA, 22 nt, Human
ugcugcuggggaagacaguggc

SEQ ID NO: 1432018 - RNA, 21 nt, Human
ugcugcuggggaagacagugg

SEQ ID NO: 1432019 - RNA, 20 nt, Human
ugcugcuggggaagacagug

SEQ ID NO: 1432020 - RNA, 19 nt, Human
ugcugcuggggaagacagu

SEQ ID NO: 1432021 - RNA, 15 nt, Human
ugcugcuggggaaga

SEQ ID NO: 1432022 - RNA, 14 nt, Human
ugcugcuggggaag

SEQ ID NO: 1432023 - RNA, 17 nt, Human
ugcugcugggcucagug

SEQ ID NO: 1432024 - RNA, 14 nt, Human
ugcugcugggcuca

SEQ ID NO: 1432025 - RNA, 13 nt, Human
ugcugcugggcuc

SEQ ID NO: 1432026 - RNA, 15 nt, Human
ugcugcuacuuauau

SEQ ID NO: 1432027 - RNA, 19 nt, Human
ugcugcuaauauuuuccuc

SEQ ID NO: 1432028 - RNA, 23 nt, Human
ugcugcauggcagggggcugcug

SEQ ID NO: 1432029 - RNA, 22 nt, Human
ugcugcauggcagggggcugcu

SEQ ID NO: 1432030 - RNA, 21 nt, Human
ugcugcauggcagggggcugc

SEQ ID NO: 1432031 - RNA, 16 nt, Human
ugcugcauggcagggg

SEQ ID NO: 1432032 - RNA, 14 nt, Human
ugcugcauuuaaaa

SEQ ID NO: 1432033 - RNA, 14 nt, Human
ugcugcauggcagg

SEQ ID NO: 1432034 - RNA, 19 nt, Human
ugcugcaagcacagcccuu

SEQ ID NO: 1432035 - RNA, 20 nt, Human
ugcugcaaaccugaccccug

SEQ ID NO: 1432036 - RNA, 14 nt, Human
ugcugcaaaccuga

SEQ ID NO: 1432037 - RNA, 13 nt, Human
ugcugcaaaccug

SEQ ID NO: 1432038 - RNA, 14 nt, Human
ugcugaacagugga

SEQ ID NO: 1432039 - RNA, 17 nt, Human
ugcugaaauuuuauaug

SEQ ID NO: 1432040 - RNA, 21 nt, Human
ugcucuccauucugcuccuuc

SEQ ID NO: 1432041 - RNA, 20 nt, Human
ugcucuccauucugcuccuu

SEQ ID NO: 1432042 - RNA, 19 nt, Human
ugcucuccauucugcuccu

SEQ ID NO: 1432043 - RNA, 14 nt, Human
ugcucgcccugcgg

SEQ ID NO: 1432044 - RNA, 13 nt, Human
ugcucgcccugcg

SEQ ID NO: 1432045 - RNA, 13 nt, Human
ugcucgcuguugc

SEQ ID NO: 1432046 - RNA, 14 nt, Human
ugcucgcuguugcu

SEQ ID NO: 1432047 - RNA, 15 nt, Human
ugcucgcuguugcug

SEQ ID NO: 1432048 - RNA, 17 nt, Human
ugcucgcuguugcugaa

SEQ ID NO: 1432049 - RNA, 18 nt, Human
ugcucgcuguugcugaau

SEQ ID NO: 1432050 - RNA, 16 nt, Human
ugcucgccccagcagg

SEQ ID NO: 1432051 - RNA, 14 nt, Human
ugcucgccccagca

SEQ ID NO: 1432052 - RNA, 14 nt, Human
ugcucaggggcccu

SEQ ID NO: 1432053 - RNA, 17 nt, Human
ugcucaggggcccugga

SEQ ID NO: 1432054 - RNA, 18 nt, Human
ugcucaggggcccuggag

SEQ ID NO: 1432055 - RNA, 20 nt, Human
ugcucaggggcccuggagca

SEQ ID NO: 1432056 - RNA, 17 nt, Human
ugcucagcucugggcca

SEQ ID NO: 1432057 - RNA, 13 nt, Human
ugcucagcccugc

SEQ ID NO: 1432058 - RNA, 19 nt, Human
ugcucagcccugaggacag

SEQ ID NO: 1432059 - RNA, 17 nt, Human
ugcucagcccugaggac

SEQ ID NO: 1432060 - RNA, 16 nt, Human
ugcucagcccugagga

SEQ ID NO: 1432061 - RNA, 17 nt, Human
ugcucaguaauuugagg

SEQ ID NO: 1432062 - RNA, 16 nt, Human
ugcucaguagucagac

SEQ ID NO: 1432063 - RNA, 17 nt, Human
ugcucaggugcuggggc

SEQ ID NO: 1432064 - RNA, 17 nt, Human
ugcucagguacuuguaa

SEQ ID NO: 1432065 - RNA, 13 nt, Human
ugcucagguacuu

SEQ ID NO: 1432066 - RNA, 21 nt, Human
ugcucagggggcgccuguggu

SEQ ID NO: 1432067 - RNA, 17 nt, Human
ugcucagagcaguguuu

SEQ ID NO: 1432068 - RNA, 21 nt, Human
ugcucaauaaaugauucuuag

SEQ ID NO: 1432069 - RNA, 16 nt, Human
ugcucaaggccagcuu

SEQ ID NO: 1432070 - RNA, 13 nt, Human
ugcucaaggccag

SEQ ID NO: 1432071 - RNA, 16 nt, Human
ugcuaagagaaguaga

SEQ ID NO: 1432072 - RNA, 15 nt, Human
ugcuaagccccagca

SEQ ID NO: 1432073 - RNA, 18 nt, Human
ugcuaagccccagcaagc

SEQ ID NO: 1432074 - RNA, 19 nt, Human
ugcuaagcauuccaacuau

SEQ ID NO: 1432075 - RNA, 15 nt, Human
ugcuaagcauuccaa

SEQ ID NO: 1432076 - RNA, 20 nt, Human
ugcaggcccuggccuccccu

SEQ ID NO: 1432077 - RNA, 16 nt, Human
ugcaggcccuggccuc

SEQ ID NO: 1432078 - RNA, 15 nt, Human
ugcaggcccuggccu

SEQ ID NO: 1432079 - RNA, 12 nt, Human
ugcaggcccugg

SEQ ID NO: 1432080 - RNA, 19 nt, Human
ugcaggcccuggccucccc

SEQ ID NO: 1432081 - RNA, 17 nt, Human
ugcaggcccuggccucc

SEQ ID NO: 1432082 - RNA, 17 nt, Human
ugcagugcucgcuguug

SEQ ID NO: 1432083 - RNA, 19 nt, Human
ugcagugcucgcuguugcu

SEQ ID NO: 1432084 - RNA, 20 nt, Human
ugcagugcucgcuguugcug

SEQ ID NO: 1432085 - RNA, 22 nt, Human
ugcaguucugaagaagauggua

SEQ ID NO: 1432086 - RNA, 19 nt, Human
ugcaguucugaagaagaug

SEQ ID NO: 1432087 - RNA, 22 nt, Human
ugcaguggcaucaucucagcuc

SEQ ID NO: 1432088 - RNA, 23 nt, Human
ugcagugcucgcuguugcugaau

SEQ ID NO: 1432089 - RNA, 21 nt, Human
ugcagugcucgcuguugcuga

SEQ ID NO: 1432090 - RNA, 22 nt, Human
ugcagugcucgcuguugcugaa

SEQ ID NO: 1432091 - RNA, 22 nt, Human
ugcaguggcgcgaucucagcuc

SEQ ID NO: 1432092 - RNA, 22 nt, Human
ugcaguggcgugaucucagcuc

SEQ ID NO: 1432093 - RNA, 18 nt, Human
ugcaguucugaagaagau

SEQ ID NO: 1432094 - RNA, 17 nt, Human
ugcaguucugaagaaga

SEQ ID NO: 1432095 - RNA, 16 nt, Human
ugcaguucugaagaag

SEQ ID NO: 1432096 - RNA, 15 nt, Human
ugcaguucugaagaa

SEQ ID NO: 1432097 - RNA, 21 nt, Human
ugcacuuugcuuuaauauaaa

SEQ ID NO: 1432098 - RNA, 17 nt, Human
ugcagaggccagaggcc

SEQ ID NO: 1432099 - RNA, 15 nt, Human
ugcagaggccagagg

SEQ ID NO: 1432100 - RNA, 14 nt, Human
ugcagaggccagag

SEQ ID NO: 1432101 - RNA, 23 nt, Human
ugcagcacagcugagaggcuguc

SEQ ID NO: 1432102 - RNA, 23 nt, Human
ugcagcaauaaagcagcguuucu

SEQ ID NO: 1432103 - RNA, 22 nt, Human
ugcacuuugcuuuaauauaaau

SEQ ID NO: 1432104 - RNA, 20 nt, Human
ugcacuuugcuuuaauauaa

SEQ ID NO: 1432105 - RNA, 17 nt, Human
ugcacuuugcuuuaaua

SEQ ID NO: 1432106 - RNA, 16 nt, Human
ugcacuuugcuuuaau

SEQ ID NO: 1432107 - RNA, 12 nt, Human
ugcacuuugcuu

SEQ ID NO: 1432108 - RNA, 20 nt, Human
ugcacuuucuauccucugua

SEQ ID NO: 1432109 - RNA, 15 nt, Human
ugcacuguaaaaugu

SEQ ID NO: 1432110 - RNA, 17 nt, Human
ugcacuguaaaaugugg

SEQ ID NO: 1432111 - RNA, 14 nt, Human
ugcacuguaaaaug

SEQ ID NO: 1432112 - RNA, 13 nt, Human
ugcacuguaaaau

SEQ ID NO: 1432113 - RNA, 12 nt, Human
ugcacuguaaaa

SEQ ID NO: 1432114 - RNA, 21 nt, Human
ugcacugggaggcuccccuuc

SEQ ID NO: 1432115 - RNA, 20 nt, Human
ugcacuggggagcccgucuc

SEQ ID NO: 1432116 - RNA, 16 nt, Human
ugcacuggggagcccg

SEQ ID NO: 1432117 - RNA, 15 nt, Human
ugcacuggccccacc

SEQ ID NO: 1432118 - RNA, 16 nt, Human
ugcacuggccccaccc

SEQ ID NO: 1432119 - RNA, 20 nt, Human
ugcacugggaggcuccccuu

SEQ ID NO: 1432120 - RNA, 17 nt, Human
ugcacugggaggcuccc

SEQ ID NO: 1432121 - RNA, 12 nt, Human
ugcacugggagg

SEQ ID NO: 1432122 - RNA, 17 nt, Human
ugcacuggccccacccu

SEQ ID NO: 1432123 - RNA, 22 nt, Human
ugcaccggggccugggcaggag

SEQ ID NO: 1432124 - RNA, 16 nt, Human
ugcaccggggccuggg

SEQ ID NO: 1432125 - RNA, 12 nt, Human
ugcaccggggcc

SEQ ID NO: 1432126 - RNA, 21 nt, Human
ugcacugcccauggacaggcu

SEQ ID NO: 1432127 - RNA, 19 nt, Human
ugcacugcccauggacagg

SEQ ID NO: 1432128 - RNA, 21 nt, Human
ugcacugauguuguguuuuua

SEQ ID NO: 1432129 - RNA, 15 nt, Human
ugcacugauguugug

SEQ ID NO: 1432130 - RNA, 14 nt, Human
ugcacugauguugu

SEQ ID NO: 1432131 - RNA, 13 nt, Human
ugcacugauguug

SEQ ID NO: 1432132 - RNA, 22 nt, Human
ugcacugaugcugccccucauc

SEQ ID NO: 1432133 - RNA, 21 nt, Human
ugcacugaugcugccccucau

SEQ ID NO: 1432134 - RNA, 17 nt, Human
ugcacugaugcugcccc

SEQ ID NO: 1432135 - RNA, 16 nt, Human
ugcacugaugcugccc

SEQ ID NO: 1432136 - RNA, 14 nt, Human
ugcacugaugcugc

SEQ ID NO: 1432137 - RNA, 22 nt, Human
ugcacugauauaucaugaguga

SEQ ID NO: 1432138 - RNA, 19 nt, Human
ugcacgcacacugucugcc

SEQ ID NO: 1432139 - RNA, 22 nt, Human
ugcccaccucagccucccaaag

SEQ ID NO: 1432140 - RNA, 22 nt, Human
ugcccacccucuggagaaggug

SEQ ID NO: 1432141 - RNA, 13 nt, Human
ugccccaggacca

SEQ ID NO: 1432142 - RNA, 16 nt, Human
ugcccaugggagcugg

SEQ ID NO: 1432143 - RNA, 24 nt, Human
ugcccauggacaggcuggcuccag

SEQ ID NO: 1432144 - RNA, 20 nt, Human
ugcccaugcugggagcccac

SEQ ID NO: 1432145 - RNA, 22 nt, Human
ugcccaguuaaucuugcuuucu

SEQ ID NO: 1432146 - RNA, 23 nt, Human
ugcccaguuaaucuugcuuucuu

SEQ ID NO: 1432147 - RNA, 20 nt, Human
ugcccaguuaaucuugcuuu

SEQ ID NO: 1432148 - RNA, 14 nt, Human
ugcccaguuaaucu

SEQ ID NO: 1432149 - RNA, 17 nt, Human
ugccccaucccaugcug

SEQ ID NO: 1432150 - RNA, 20 nt, Human
ugccccaggaccagcucagg

SEQ ID NO: 1432151 - RNA, 19 nt, Human
ugccccaggaccagcucag

SEQ ID NO: 1432152 - RNA, 18 nt, Human
ugccccaggaccagcuca

SEQ ID NO: 1432153 - RNA, 14 nt, Human
ugccccaggaccag

SEQ ID NO: 1432154 - RNA, 14 nt, Human
ugccccaggccuga

SEQ ID NO: 1432155 - RNA, 21 nt, Human
ugccccaucagugcucccuca

SEQ ID NO: 1432156 - RNA, 20 nt, Human
ugccccaucagugcucccuc

SEQ ID NO: 1432157 - RNA, 18 nt, Human
ugccccaucagugcuccc

SEQ ID NO: 1432158 - RNA, 16 nt, Human
ugccccaucagugcuc

SEQ ID NO: 1432159 - RNA, 13 nt, Human
ugccaccaggcca

SEQ ID NO: 1432160 - RNA, 16 nt, Human
ugccaaauauguccug

SEQ ID NO: 1432161 - RNA, 19 nt, Human
ugccaaauauaaauaaaaa

SEQ ID NO: 1432162 - RNA, 22 nt, Human
ugccaaauauaaauaaaaauaa

SEQ ID NO: 1432163 - RNA, 17 nt, Human
ugccaaauauaaauaaa

SEQ ID NO: 1432164 - RNA, 18 nt, Human
ugccaaauauaaauaaaa

SEQ ID NO: 1432165 - RNA, 13 nt, Human
ugcauauguugaa

SEQ ID NO: 1432166 - RNA, 20 nt, Human
ugcauauuuauaaaaauaaa

SEQ ID NO: 1432167 - RNA, 15 nt, Human
ugcauauuuguuuau

SEQ ID NO: 1432168 - RNA, 17 nt, Human
ugcauauguugaauacu

SEQ ID NO: 1432169 - RNA, 15 nt, Human
ugcauauguugaaua

SEQ ID NO: 1432170 - RNA, 21 nt, Human
ugcauauuuauaaaaauaaaa

SEQ ID NO: 1432171 - RNA, 22 nt, Human
ugccaggagggacaaaggagcc

SEQ ID NO: 1432172 - RNA, 21 nt, Human
ugccaggagggacaaaggagc

SEQ ID NO: 1432173 - RNA, 13 nt, Human
ugccaggagggac

SEQ ID NO: 1432174 - RNA, 23 nt, Human
ugccaggaggacccagggcucug

SEQ ID NO: 1432175 - RNA, 22 nt, Human
ugccaggaggacccagggcucu

SEQ ID NO: 1432176 - RNA, 21 nt, Human
ugccaggaggacccagggcuc

SEQ ID NO: 1432177 - RNA, 20 nt, Human
ugccaggaggacccagggcu

SEQ ID NO: 1432178 - RNA, 24 nt, Human
ugccaggagggacaaaggagccug

SEQ ID NO: 1432179 - RNA, 23 nt, Human
ugccaggagggacaaaggagccu

SEQ ID NO: 1432180 - RNA, 18 nt, Human
ugccaccaggccaccucc

SEQ ID NO: 1432181 - RNA, 17 nt, Human
ugccaccaggccaccuc

SEQ ID NO: 1432182 - RNA, 14 nt, Human
ugccaccaggccac

SEQ ID NO: 1432183 - RNA, 16 nt, Human
ugccacccucaugcug

SEQ ID NO: 1432184 - RNA, 17 nt, Human
ugccacccucaugcugu

SEQ ID NO: 1432185 - RNA, 20 nt, Human
uggcaacagaucuggaaccu

SEQ ID NO: 1432186 - RNA, 18 nt, Human
uggcaacagaucuggaac

SEQ ID NO: 1432187 - RNA, 17 nt, Human
uggcaacagaucuggaa

SEQ ID NO: 1432188 - RNA, 16 nt, Human
uggcaacagaucugga

SEQ ID NO: 1432189 - RNA, 15 nt, Human
uggcaacagaucugg

SEQ ID NO: 1432190 - RNA, 13 nt, Human
uggcaacagaucu

SEQ ID NO: 1432191 - RNA, 13 nt, Human
uggcaacacagag

SEQ ID NO: 1432192 - RNA, 15 nt, Human
uggauuuuucuuuaa

SEQ ID NO: 1432193 - RNA, 14 nt, Human
uggauuugacauug

SEQ ID NO: 1432194 - RNA, 13 nt, Human
uggauuugacauu

SEQ ID NO: 1432195 - RNA, 18 nt, Human
uggauuucuuugaaaaaa

SEQ ID NO: 1432196 - RNA, 18 nt, Human
uggaucucauuggacccu

SEQ ID NO: 1432197 - RNA, 20 nt, Human
uggaucuauuucauguuuuu

SEQ ID NO: 1432198 - RNA, 18 nt, Human
uggaucuauuucauguuu

SEQ ID NO: 1432199 - RNA, 14 nt, Human
uggaucuauuucau

SEQ ID NO: 1432200 - RNA, 17 nt, Human
uggauccuguguggaga

SEQ ID NO: 1432201 - RNA, 16 nt, Human
uggauccuguguggag

SEQ ID NO: 1432202 - RNA, 17 nt, Human
uggaucagcguggccuu

SEQ ID NO: 1432203 - RNA, 18 nt, Human
uggaucagcguggccuug

SEQ ID NO: 1432204 - RNA, 17 nt, Human
uggaucacucaccauuc

SEQ ID NO: 1432205 - RNA, 15 nt, Human
uggaucacucaccau

SEQ ID NO: 1432206 - RNA, 19 nt, Human
uggauuucuuugaaaaaaa

SEQ ID NO: 1432207 - RNA, 15 nt, Human
uggauuucuuugaaa

SEQ ID NO: 1432208 - RNA, 21 nt, Human
uggauuuccuaauacugucau

SEQ ID NO: 1432209 - RNA, 15 nt, Human
uggauuuccuaauac

SEQ ID NO: 1432210 - RNA, 15 nt, Human
uggauuuaguuucag

SEQ ID NO: 1432211 - RNA, 16 nt, Human
uggauuuaguuucagu

SEQ ID NO: 1432212 - RNA, 20 nt, Human
uggauuuaacagaaauguac

SEQ ID NO: 1432213 - RNA, 24 nt, Human
uggauuuaacagaaauguacagca

SEQ ID NO: 1432214 - RNA, 22 nt, Human
uggacucucagucucugagcag

SEQ ID NO: 1432215 - RNA, 20 nt, Human
uggacucucagucucugagc

SEQ ID NO: 1432216 - RNA, 15 nt, Human
uggacucucagucuc

SEQ ID NO: 1432217 - RNA, 14 nt, Human
uggacucuaaaguc

SEQ ID NO: 1432218 - RNA, 16 nt, Human
uggacucgccuguaau

SEQ ID NO: 1432219 - RNA, 16 nt, Human
uggaggaccugagccu

SEQ ID NO: 1432220 - RNA, 18 nt, Human
uggaggaagagggacaga

SEQ ID NO: 1432221 - RNA, 23 nt, Human
uggaggagcccaggccaggacuc

SEQ ID NO: 1432222 - RNA, 22 nt, Human
uggaggagcccaggccaggacu

SEQ ID NO: 1432223 - RNA, 19 nt, Human
uggaggagcccaggccagg

SEQ ID NO: 1432224 - RNA, 14 nt, Human
uggaggagcccagg

SEQ ID NO: 1432225 - RNA, 13 nt, Human
uggaggagcccag

SEQ ID NO: 1432226 - RNA, 12 nt, Human
uggaggagccca

SEQ ID NO: 1432227 - RNA, 19 nt, Human
uggaggaccugagccugcc

SEQ ID NO: 1432228 - RNA, 20 nt, Human
uggaggaccugagccugccg

SEQ ID NO: 1432229 - RNA, 18 nt, Human
uggaggaccugagccugc

SEQ ID NO: 1432230 - RNA, 17 nt, Human
uggaggaccugagccug

SEQ ID NO: 1432231 - RNA, 22 nt, Human
uggagggacaaguggacucagg

SEQ ID NO: 1432232 - RNA, 11 nt, Human
uggagggaagc

SEQ ID NO: 1432233 - RNA, 22 nt, Human
uggccaggccgggaaaaagccc

SEQ ID NO: 1432234 - RNA, 15 nt, Human
uggccaggccgggaa

SEQ ID NO: 1432235 - RNA, 13 nt, Human
uggccaggccggg

SEQ ID NO: 1432236 - RNA, 12 nt, Human
uggccaggaggu

SEQ ID NO: 1432237 - RNA, 16 nt, Human
uggccaggaggugcca

SEQ ID NO: 1432238 - RNA, 11 nt, Human
uggccaggagg

SEQ ID NO: 1432239 - RNA, 23 nt, Human
uggcagugggaaaaauguaggag

SEQ ID NO: 1432240 - RNA, 22 nt, Human
uggcagugggaaaaauguagga

SEQ ID NO: 1432241 - RNA, 19 nt, Human
uggcagugggaaaaaugua

SEQ ID NO: 1432242 - RNA, 20 nt, Human
uggccagcagcaccugcccu

SEQ ID NO: 1432243 - RNA, 21 nt, Human
uggccagcagcaccugcccua

SEQ ID NO: 1432244 - RNA, 18 nt, Human
uggccagcagcaccugcc

SEQ ID NO: 1432245 - RNA, 16 nt, Human
uggccagcagcaccug

SEQ ID NO: 1432246 - RNA, 15 nt, Human
uggccagcagcaccu

SEQ ID NO: 1432247 - RNA, 13 nt, Human
uggccagcagcac

SEQ ID NO: 1432248 - RNA, 20 nt, Human
uggcaccuaauccaggcaga

SEQ ID NO: 1432249 - RNA, 24 nt, Human
uggcaccgaagcccagagggucug

SEQ ID NO: 1432250 - RNA, 18 nt, Human
uggcaccgaagcccagag

SEQ ID NO: 1432251 - RNA, 17 nt, Human
uggcaccgaagcccaga

SEQ ID NO: 1432252 - RNA, 16 nt, Human
uggcaccgaagcccag

SEQ ID NO: 1432253 - RNA, 22 nt, Human
uggcaacagaucuggaaccuca

SEQ ID NO: 1432254 - RNA, 15 nt, Human
uggcaggaaggcuug

SEQ ID NO: 1432255 - RNA, 17 nt, Human
uggcaggaaggcuuguu

SEQ ID NO: 1432256 - RNA, 12 nt, Human
uggcaggaaggc

SEQ ID NO: 1432257 - RNA, 18 nt, Human
uggcagcuuuuaaaagau

SEQ ID NO: 1432258 - RNA, 11 nt, Human
uggcagcuuuu

SEQ ID NO: 1432259 - RNA, 23 nt, Human
uggcagggggcugcugcugggcu

SEQ ID NO: 1432260 - RNA, 21 nt, Human
uggcagggggcugcugcuggg

SEQ ID NO: 1432261 - RNA, 19 nt, Human
uggcagggggcugcugcug

SEQ ID NO: 1432262 - RNA, 18 nt, Human
uggcagggggcugcugcu

SEQ ID NO: 1432263 - RNA, 17 nt, Human
uggcagggggcugcugc

SEQ ID NO: 1432264 - RNA, 16 nt, Human
uggcagggggcugcug

SEQ ID NO: 1432265 - RNA, 15 nt, Human
uggcagggggcugcu

SEQ ID NO: 1432266 - RNA, 13 nt, Human
uggcagggggcug

SEQ ID NO: 1432267 - RNA, 18 nt, Human
uggcaggggacaggaguc

SEQ ID NO: 1432268 - RNA, 15 nt, Human
uggcaggggacagga

SEQ ID NO: 1432269 - RNA, 22 nt, Human
uggcagucugaauuuuuaaaac

SEQ ID NO: 1432270 - RNA, 16 nt, Human
uggcagucugaauuuu

SEQ ID NO: 1432271 - RNA, 18 nt, Human
uggcaguccuggaagcca

SEQ ID NO: 1432272 - RNA, 18 nt, Human
uggcaguccgugggacgg

SEQ ID NO: 1432273 - RNA, 15 nt, Human
uggcaggugcagccc

SEQ ID NO: 1432274 - RNA, 21 nt, Human
ugcuuuaauauaaaugcaaau

SEQ ID NO: 1432275 - RNA, 22 nt, Human
ugcuuuaauauaaaugcaaaua

SEQ ID NO: 1432276 - RNA, 20 nt, Human
ugcuuuaauauaaaugcaaa

SEQ ID NO: 1432277 - RNA, 18 nt, Human
ugcuuuaauauaaaugca

SEQ ID NO: 1432278 - RNA, 14 nt, Human
ugcuuuaauauaaa

SEQ ID NO: 1432279 - RNA, 13 nt, Human
ugcuuuaauauaa

SEQ ID NO: 1432280 - RNA, 21 nt, Human
ugcuuuaaccaccccaucugc

SEQ ID NO: 1432281 - RNA, 22 nt, Human
ugcuggagaggccccagccgcu

SEQ ID NO: 1432282 - RNA, 20 nt, Human
ugcuggagaggccccagccg

SEQ ID NO: 1432283 - RNA, 19 nt, Human
ugcuggacugucauagaaa

SEQ ID NO: 1432284 - RNA, 15 nt, Human
ugcuggacugucaua

SEQ ID NO: 1432285 - RNA, 14 nt, Human
ugcuggacugucau

SEQ ID NO: 1432286 - RNA, 17 nt, Human
ugcuggaauucuaacaa

SEQ ID NO: 1432287 - RNA, 16 nt, Human
ugcuuugaaacagaaa

SEQ ID NO: 1432288 - RNA, 21 nt, Human
ugcuuugaaacagaaaaauau

SEQ ID NO: 1432289 - RNA, 18 nt, Human
ugcuuucuuuguuuggcu

SEQ ID NO: 1432290 - RNA, 22 nt, Human
ugcuuucuguuccaaauucagu

SEQ ID NO: 1432291 - RNA, 17 nt, Human
ugcuuucuguuccaaau

SEQ ID NO: 1432292 - RNA, 16 nt, Human
ugcuuucuguuccaaa

SEQ ID NO: 1432293 - RNA, 15 nt, Human
ugcuuucuguuccaa

SEQ ID NO: 1432294 - RNA, 14 nt, Human
ugcuuucuguucca

SEQ ID NO: 1432295 - RNA, 20 nt, Human
ugcuuugaaguagcucuuuu

SEQ ID NO: 1432296 - RNA, 16 nt, Human
ugcuuugaaguagcuc

SEQ ID NO: 1432297 - RNA, 23 nt, Human
ugcuuugaaauugaaccuuugug

SEQ ID NO: 1432298 - RNA, 12 nt, Human
uggaaccagacu

SEQ ID NO: 1432299 - RNA, 20 nt, Human
uggaacauuggaauguucuc

SEQ ID NO: 1432300 - RNA, 17 nt, Human
uggaacauuggaauguu

SEQ ID NO: 1432301 - RNA, 13 nt, Human
uggaacauuggaa

SEQ ID NO: 1432302 - RNA, 14 nt, Human
uggaacauccuugg

SEQ ID NO: 1432303 - RNA, 12 nt, Human
uggaaagcaggu

SEQ ID NO: 1432304 - RNA, 23 nt, Human
uggaaagauaacuaggaaaucca

SEQ ID NO: 1432305 - RNA, 18 nt, Human
uggaaagauaacuaggaa

SEQ ID NO: 1432306 - RNA, 22 nt, Human
uggaaacuuuucuuaaaaaguu

SEQ ID NO: 1432307 - RNA, 23 nt, Human
uggaaagacagcuucucauccug

SEQ ID NO: 1432308 - RNA, 14 nt, Human
uggaaagaguacuc

SEQ ID NO: 1432309 - RNA, 19 nt, Human
uggaaagacagcuucucau

SEQ ID NO: 1432310 - RNA, 14 nt, Human
uggaaacuuuucuu

SEQ ID NO: 1432311 - RNA, 23 nt, Human
uggaaacuucagcgguuuauaua

SEQ ID NO: 1432312 - RNA, 20 nt, Human
uggaaaacagaacacuuaug

SEQ ID NO: 1432313 - RNA, 18 nt, Human
uggaaaacagaacacuua

SEQ ID NO: 1432314 - RNA, 17 nt, Human
uggaaaacagaacacuu

SEQ ID NO: 1432315 - RNA, 16 nt, Human
uggaaaacagaacacu

SEQ ID NO: 1432316 - RNA, 17 nt, Human
uggaaaacaaggaaguc

SEQ ID NO: 1432317 - RNA, 15 nt, Human
uggaaaauucauuuu

SEQ ID NO: 1432318 - RNA, 19 nt, Human
uggaaaacagaacacuuau

SEQ ID NO: 1432319 - RNA, 17 nt, Human
uggaaacaagucaguca

SEQ ID NO: 1432320 - RNA, 17 nt, Human
uggaaugcccuucacug

SEQ ID NO: 1432321 - RNA, 18 nt, Human
uggaaugaauuaaauaaa

SEQ ID NO: 1432322 - RNA, 17 nt, Human
uggaaugaauuaaauaa

SEQ ID NO: 1432323 - RNA, 22 nt, Human
uggaauauaauuguuuuaucug

SEQ ID NO: 1432324 - RNA, 15 nt, Human
uggaauggauuuuuc

SEQ ID NO: 1432325 - RNA, 20 nt, Human
uggacuaucugucugguggc

SEQ ID NO: 1432326 - RNA, 17 nt, Human
uggacuaucugucuggu

SEQ ID NO: 1432327 - RNA, 15 nt, Human
uggacuaucugucug

SEQ ID NO: 1432328 - RNA, 14 nt, Human
uggacuaucugucu

SEQ ID NO: 1432329 - RNA, 22 nt, Human
uggacuauggagugcaccaaag

SEQ ID NO: 1432330 - RNA, 23 nt, Human
uggacuaucugucugguggcccc

SEQ ID NO: 1432331 - RNA, 22 nt, Human
uggacuaucugucugguggccc

SEQ ID NO: 1432332 - RNA, 22 nt, Human
uggacaugaagauucuuuccca

SEQ ID NO: 1432333 - RNA, 21 nt, Human
uggacaugaagauucuuuccc

SEQ ID NO: 1432334 - RNA, 18 nt, Human
uggacaugaagauucuuu

SEQ ID NO: 1432335 - RNA, 23 nt, Human
uggacauccuccucccacccggc

SEQ ID NO: 1432336 - RNA, 20 nt, Human
uggacauccuccucccaccc

SEQ ID NO: 1432337 - RNA, 14 nt, Human
uggacagccccacc

SEQ ID NO: 1432338 - RNA, 12 nt, Human
uggacagcccca

SEQ ID NO: 1432339 - RNA, 15 nt, Human
uggaauaaguucaaa

SEQ ID NO: 1432340 - RNA, 22 nt, Human
uggaauaauccuaaacauauga

SEQ ID NO: 1432341 - RNA, 14 nt, Human
uggaauauaauugu

SEQ ID NO: 1432342 - RNA, 16 nt, Human
uggaauaucuccguca

SEQ ID NO: 1432343 - RNA, 16 nt, Human
uggaauauauaaccag

SEQ ID NO: 1432344 - RNA, 15 nt, Human
uggaauauauaacca

SEQ ID NO: 1432345 - RNA, 20 nt, Human
uggaacuagguuuuaauaau

SEQ ID NO: 1432346 - RNA, 18 nt, Human
uggaacuagguuuuaaua

SEQ ID NO: 1432347 - RNA, 23 nt, Human
uggaacuacauuaguacacagca

SEQ ID NO: 1432348 - RNA, 17 nt, Human
uggaacuacauuacugu

SEQ ID NO: 1432349 - RNA, 13 nt, Human
uggaaccagacuc

SEQ ID NO: 1432350 - RNA, 18 nt, Human
uggaacucgugucuggca

SEQ ID NO: 1432351 - RNA, 19 nt, Human
uggaaccagacucuugccu

SEQ ID NO: 1432352 - RNA, 15 nt, Human
ugggagucacacagu

SEQ ID NO: 1432353 - RNA, 23 nt, Human
ugggagucacacaguguuggagg

SEQ ID NO: 1432354 - RNA, 21 nt, Human
ugggauuaugggucacaggaa

SEQ ID NO: 1432355 - RNA, 19 nt, Human
ugggauuaugggucacagg

SEQ ID NO: 1432356 - RNA, 18 nt, Human
ugggauuaugggucacag

SEQ ID NO: 1432357 - RNA, 15 nt, Human
ugggauuauggguca

SEQ ID NO: 1432358 - RNA, 20 nt, Human
ugggcagagcuggcucugag

SEQ ID NO: 1432359 - RNA, 18 nt, Human
ugggcagagcuggcucug

SEQ ID NO: 1432360 - RNA, 21 nt, Human
ugggauucaggaaaaggccug

SEQ ID NO: 1432361 - RNA, 20 nt, Human
ugggauucaggaaaaggccu

SEQ ID NO: 1432362 - RNA, 20 nt, Human
ugggauuaugggucacagga

SEQ ID NO: 1432363 - RNA, 21 nt, Human
ugggacaccccgacuuuuguu

SEQ ID NO: 1432364 - RNA, 15 nt, Human
ugggacaacugcucc

SEQ ID NO: 1432365 - RNA, 20 nt, Human
uggcuuuugcgguucaggaa

SEQ ID NO: 1432366 - RNA, 14 nt, Human
uggcuuuggucucu

SEQ ID NO: 1432367 - RNA, 15 nt, Human
uggcuuuugugcauu

SEQ ID NO: 1432368 - RNA, 15 nt, Human
ugggacguggcucag

SEQ ID NO: 1432369 - RNA, 23 nt, Human
ugggacggugcccaagccagagg

SEQ ID NO: 1432370 - RNA, 14 nt, Human
ugggacggugccca

SEQ ID NO: 1432371 - RNA, 23 nt, Human
ugggacgggaugguucuggcugu

SEQ ID NO: 1432372 - RNA, 23 nt, Human
ugggaccucaguuuuaucauuuu

SEQ ID NO: 1432373 - RNA, 22 nt, Human
ugggaccgcuacaccacucugg

SEQ ID NO: 1432374 - RNA, 16 nt, Human
ugggaccuagggaggc

SEQ ID NO: 1432375 - RNA, 21 nt, Human
ugggaccgcuacaccacucug

SEQ ID NO: 1432376 - RNA, 20 nt, Human
ugggaccgcuacaccacucu

SEQ ID NO: 1432377 - RNA, 15 nt, Human
ugggaccgcuacacc

SEQ ID NO: 1432378 - RNA, 20 nt, Human
ugggagagggcgcaggccgu

SEQ ID NO: 1432379 - RNA, 15 nt, Human
ugggagagggcgcag

SEQ ID NO: 1432380 - RNA, 14 nt, Human
ugggagagggcgca

SEQ ID NO: 1432381 - RNA, 13 nt, Human
ugggagagggcgc

SEQ ID NO: 1432382 - RNA, 12 nt, Human
ugggagagggcg

SEQ ID NO: 1432383 - RNA, 22 nt, Human
ugggagaggcagcccaggaagu

SEQ ID NO: 1432384 - RNA, 18 nt, Human
ugggagaggcagcccagg

SEQ ID NO: 1432385 - RNA, 15 nt, Human
ugggagaggcagccc

SEQ ID NO: 1432386 - RNA, 14 nt, Human
ugggagaggcagcc

SEQ ID NO: 1432387 - RNA, 20 nt, Human
ugggacguggcucagccagc

SEQ ID NO: 1432388 - RNA, 16 nt, Human
ugggacguggcucagc

SEQ ID NO: 1432389 - RNA, 22 nt, Human
ugggagcugaggccacacucag

SEQ ID NO: 1432390 - RNA, 20 nt, Human
ugggagcugaggccacacuc

SEQ ID NO: 1432391 - RNA, 18 nt, Human
ugggagcaaacugcaugc

SEQ ID NO: 1432392 - RNA, 23 nt, Human
ugggagauucaagggacccauga

SEQ ID NO: 1432393 - RNA, 21 nt, Human
uggcuuuggucucuugcuugu

SEQ ID NO: 1432394 - RNA, 13 nt, Human
uggcuuuggaagc

SEQ ID NO: 1432395 - RNA, 16 nt, Human
uggcuuugaugauaaa

SEQ ID NO: 1432396 - RNA, 14 nt, Human
uggcuuuugugcau

SEQ ID NO: 1432397 - RNA, 21 nt, Human
uggcuuucauuuucucucagg

SEQ ID NO: 1432398 - RNA, 14 nt, Human
uggcuuucagggag

SEQ ID NO: 1432399 - RNA, 11 nt, Human
uggcuuucagg

SEQ ID NO: 1432400 - RNA, 17 nt, Human
uggcuuucagagccucc

SEQ ID NO: 1432401 - RNA, 15 nt, Human
uggcuuucagagccu

SEQ ID NO: 1432402 - RNA, 21 nt, Human
uggcuuuauccucuuuagagu

SEQ ID NO: 1432403 - RNA, 20 nt, Human
uggcuuuaggagcaguggga

SEQ ID NO: 1432404 - RNA, 17 nt, Human
uggcuuuaggagcagug

SEQ ID NO: 1432405 - RNA, 16 nt, Human
uggcuuuauccucuuu

SEQ ID NO: 1432406 - RNA, 20 nt, Human
uggcuuuauccucuuuagag

SEQ ID NO: 1432407 - RNA, 21 nt, Human
uggcuugaguuuaaauuguaa

SEQ ID NO: 1432408 - RNA, 15 nt, Human
uggcuugagaaauau

SEQ ID NO: 1432409 - RNA, 21 nt, Human
uggcuucuggccaggaagcuu

SEQ ID NO: 1432410 - RNA, 19 nt, Human
uggcuucuggccaggaagc

SEQ ID NO: 1432411 - RNA, 18 nt, Human
uggcuucuggccaggaag

SEQ ID NO: 1432412 - RNA, 17 nt, Human
uggcuucuggccaggaa

SEQ ID NO: 1432413 - RNA, 16 nt, Human
uggcuucuggccagga

SEQ ID NO: 1432414 - RNA, 15 nt, Human
uggcuucuggccagg

SEQ ID NO: 1432415 - RNA, 13 nt, Human
uggcuucuggcca

SEQ ID NO: 1432416 - RNA, 16 nt, Human
uggcugguguuaacag

SEQ ID NO: 1432417 - RNA, 15 nt, Human
uggcugguguuaaca

SEQ ID NO: 1432418 - RNA, 12 nt, Human
uggcugguguua

SEQ ID NO: 1432419 - RNA, 23 nt, Human
uggcuggugugguacagagaagc

SEQ ID NO: 1432420 - RNA, 22 nt, Human
uggcuggugugguacagagaag

SEQ ID NO: 1432421 - RNA, 21 nt, Human
uggcuggugugguacagagaa

SEQ ID NO: 1432422 - RNA, 20 nt, Human
uggcuggugugguacagaga

SEQ ID NO: 1432423 - RNA, 19 nt, Human
uggcuggugugguacagag

SEQ ID NO: 1432424 - RNA, 17 nt, Human
uggcuggugugguacag

SEQ ID NO: 1432425 - RNA, 13 nt, Human
uggcugguguggu

SEQ ID NO: 1432426 - RNA, 11 nt, Human
uggcuggugug

SEQ ID NO: 1432427 - RNA, 22 nt, Human
uggcuggucaacuugagcaugu

SEQ ID NO: 1432428 - RNA, 18 nt, Human
uggcugguguuaacagaa

SEQ ID NO: 1432429 - RNA, 16 nt, Human
uggcuuccuggcaaua

SEQ ID NO: 1432430 - RNA, 19 nt, Human
uggcucugccaguccuguc

SEQ ID NO: 1432431 - RNA, 17 nt, Human
uggcucugccaguccug

SEQ ID NO: 1432432 - RNA, 13 nt, Human
uggcucugccagu

SEQ ID NO: 1432433 - RNA, 12 nt, Human
uggcucugccag

SEQ ID NO: 1432434 - RNA, 22 nt, Human
uggcucugaggugccuguccca

SEQ ID NO: 1432435 - RNA, 21 nt, Human
uggcuggaagauccugcgggu

SEQ ID NO: 1432436 - RNA, 20 nt, Human
uggcuggaagauccugcggg

SEQ ID NO: 1432437 - RNA, 19 nt, Human
uggcuggaagauccugcgg

SEQ ID NO: 1432438 - RNA, 16 nt, Human
uggcugguccagggcu

SEQ ID NO: 1432439 - RNA, 15 nt, Human
uggcugguccagggc

SEQ ID NO: 1432440 - RNA, 13 nt, Human
uggcugguccagg

SEQ ID NO: 1432441 - RNA, 14 nt, Human
uggcuggucaacuu

SEQ ID NO: 1432442 - RNA, 23 nt, Human
uggcuggacccagccaggcccag

SEQ ID NO: 1432443 - RNA, 22 nt, Human
uggcuggacccagccaggccca

SEQ ID NO: 1432444 - RNA, 21 nt, Human
uggcuggacccagccaggccc

SEQ ID NO: 1432445 - RNA, 16 nt, Human
uggcuggacccagcca

SEQ ID NO: 1432446 - RNA, 15 nt, Human
uggcuggacccagcc

SEQ ID NO: 1432447 - RNA, 14 nt, Human
uggcuggacccagc

SEQ ID NO: 1432448 - RNA, 13 nt, Human
uggcuggacccag

SEQ ID NO: 1432449 - RNA, 21 nt, Human
uggcucugaggugccuguccc

SEQ ID NO: 1432450 - RNA, 20 nt, Human
uggcucugaggugccugucc

SEQ ID NO: 1432451 - RNA, 19 nt, Human
uggcucugagcgccuccau

SEQ ID NO: 1432452 - RNA, 14 nt, Human
uggcucuccuggcc

SEQ ID NO: 1432453 - RNA, 17 nt, Human
uggcucuccuggcccug

SEQ ID NO: 1432454 - RNA, 13 nt, Human
uggcucuccuggc

SEQ ID NO: 1432455 - RNA, 12 nt, Human
uggccccagcac

SEQ ID NO: 1432456 - RNA, 22 nt, Human
uggccccacccugggcccuggg

SEQ ID NO: 1432457 - RNA, 16 nt, Human
uggcccagggcccaga

SEQ ID NO: 1432458 - RNA, 15 nt, Human
uggcccagggcccag

SEQ ID NO: 1432459 - RNA, 14 nt, Human
uggcccagggccca

SEQ ID NO: 1432460 - RNA, 18 nt, Human
uggccccacccugggccc

SEQ ID NO: 1432461 - RNA, 16 nt, Human
uggccccacccugggc

SEQ ID NO: 1432462 - RNA, 15 nt, Human
uggccccacccuggg

SEQ ID NO: 1432463 - RNA, 13 nt, Human
uggccccacccug

SEQ ID NO: 1432464 - RNA, 22 nt, Human
uggccccacccucguggacacc

SEQ ID NO: 1432465 - RNA, 19 nt, Human
ugguauauccaaaagcuuu

SEQ ID NO: 1432466 - RNA, 16 nt, Human
ugguauauccaaaagc

SEQ ID NO: 1432467 - RNA, 18 nt, Human
ugguaguuuuuucaucuu

SEQ ID NO: 1432468 - RNA, 17 nt, Human
ugguaguuuuuucaucu

SEQ ID NO: 1432469 - RNA, 16 nt, Human
ugguaguuuuuucauc

SEQ ID NO: 1432470 - RNA, 15 nt, Human
ugguaguuuuuucau

SEQ ID NO: 1432471 - RNA, 17 nt, Human
uggguuugguguauggu

SEQ ID NO: 1432472 - RNA, 19 nt, Human
uggguucugccugccagcu

SEQ ID NO: 1432473 - RNA, 16 nt, Human
uggguucugccugcca

SEQ ID NO: 1432474 - RNA, 16 nt, Human
ugguaucucagaaagu

SEQ ID NO: 1432475 - RNA, 22 nt, Human
ugguaucucagaaagugccuga

SEQ ID NO: 1432476 - RNA, 13 nt, Human
ugguaucucagaa

SEQ ID NO: 1432477 - RNA, 22 nt, Human
ugguauauccaaaagcuuuuua

SEQ ID NO: 1432478 - RNA, 19 nt, Human
ugguaugaacuugaggaca

SEQ ID NO: 1432479 - RNA, 21 nt, Human
ugguaugaacuugaggacaca

SEQ ID NO: 1432480 - RNA, 22 nt, Human
ugguaugaacuugaggacacau

SEQ ID NO: 1432481 - RNA, 23 nt, Human
ugguaugaacuugaggacacaug

SEQ ID NO: 1432482 - RNA, 23 nt, Human
ugguauuggcuagagguucaaag

SEQ ID NO: 1432483 - RNA, 12 nt, Human
ugguauuguauu

SEQ ID NO: 1432484 - RNA, 13 nt, Human
ugguauuguauuu

SEQ ID NO: 1432485 - RNA, 14 nt, Human
ugguauuguauuua

SEQ ID NO: 1432486 - RNA, 18 nt, Human
ugguauuguauuuauuca

SEQ ID NO: 1432487 - RNA, 22 nt, Human
ugggugguacccucuggagggg

SEQ ID NO: 1432488 - RNA, 18 nt, Human
ugggugguacccucugga

SEQ ID NO: 1432489 - RNA, 14 nt, Human
ugggugguacccuc

SEQ ID NO: 1432490 - RNA, 13 nt, Human
ugggugguacccu

SEQ ID NO: 1432491 - RNA, 16 nt, Human
uggguaaaauacuuuu

SEQ ID NO: 1432492 - RNA, 15 nt, Human
uggguaaaauacuuu

SEQ ID NO: 1432493 - RNA, 23 nt, Human
uggguaaaauacuuuuacucugc

SEQ ID NO: 1432494 - RNA, 14 nt, Human
ugggggugccagga

SEQ ID NO: 1432495 - RNA, 15 nt, Human
ugggggugagggucc

SEQ ID NO: 1432496 - RNA, 14 nt, Human
uggguucugccugc

SEQ ID NO: 1432497 - RNA, 14 nt, Human
uggguguuaauuuu

SEQ ID NO: 1432498 - RNA, 22 nt, Human
uggguguuaucaccuagcugaa

SEQ ID NO: 1432499 - RNA, 15 nt, Human
uggguuagaccuaca

SEQ ID NO: 1432500 - RNA, 14 nt, Human
uggguuaaguauua

SEQ ID NO: 1432501 - RNA, 16 nt, Human
uggguuagggaaaaca

SEQ ID NO: 1432502 - RNA, 18 nt, Human
uggguuagggaaaacauu

SEQ ID NO: 1432503 - RNA, 19 nt, Human
uggguuagggaaaacauuc

SEQ ID NO: 1432504 - RNA, 21 nt, Human
uggguuagggaaaacauucca

SEQ ID NO: 1432505 - RNA, 18 nt, Human
uggggaaacuggccaugg

SEQ ID NO: 1432506 - RNA, 16 nt, Human
uggggaaacuggccau

SEQ ID NO: 1432507 - RNA, 18 nt, Human
uggggaaacagcaucucc

SEQ ID NO: 1432508 - RNA, 16 nt, Human
uggggaaacagcaucu

SEQ ID NO: 1432509 - RNA, 22 nt, Human
ugggcuuguggggccugggagg

SEQ ID NO: 1432510 - RNA, 20 nt, Human
ugggcuuguggggccuggga

SEQ ID NO: 1432511 - RNA, 19 nt, Human
ugggcuuguggggccuggg

SEQ ID NO: 1432512 - RNA, 18 nt, Human
ugggcuuguggggccugg

SEQ ID NO: 1432513 - RNA, 17 nt, Human
ugggcuucagcugccag

SEQ ID NO: 1432514 - RNA, 18 nt, Human
ugggcuucagcugccagu

SEQ ID NO: 1432515 - RNA, 14 nt, Human
ugggcuucagcugc

SEQ ID NO: 1432516 - RNA, 23 nt, Human
ugggcugguaucucagaaagugc

SEQ ID NO: 1432517 - RNA, 21 nt, Human
ugggcugguaucucagaaagu

SEQ ID NO: 1432518 - RNA, 20 nt, Human
ugggcugguaucucagaaag

SEQ ID NO: 1432519 - RNA, 18 nt, Human
ugggcugguaucucagaa

SEQ ID NO: 1432520 - RNA, 14 nt, Human
ugggcugguaucuc

SEQ ID NO: 1432521 - RNA, 22 nt, Human
ugggcuuauaucuggccucugc

SEQ ID NO: 1432522 - RNA, 21 nt, Human
ugggcuuauaucuggccucug

SEQ ID NO: 1432523 - RNA, 20 nt, Human
ugggcuuauaucuggccucu

SEQ ID NO: 1432524 - RNA, 13 nt, Human
ugggcuuauaucu

SEQ ID NO: 1432525 - RNA, 15 nt, Human
ugggcagauuuucag

SEQ ID NO: 1432526 - RNA, 23 nt, Human
ugggcagaggaccaggcuguagg

SEQ ID NO: 1432527 - RNA, 17 nt, Human
ugggcagauuuucagca

SEQ ID NO: 1432528 - RNA, 12 nt, Human
ugggcagcaauu

SEQ ID NO: 1432529 - RNA, 17 nt, Human
ugggggcugaggagcag

SEQ ID NO: 1432530 - RNA, 13 nt, Human
ugggggcugcagu

SEQ ID NO: 1432531 - RNA, 12 nt, Human
ugggggugcauu

SEQ ID NO: 1432532 - RNA, 15 nt, Human
ugggggugcauuuga

SEQ ID NO: 1432533 - RNA, 17 nt, Human
uggggaagacaguggcc

SEQ ID NO: 1432534 - RNA, 14 nt, Human
uggggaagacagug

SEQ ID NO: 1432535 - RNA, 13 nt, Human
uggggaagacagu

SEQ ID NO: 1432536 - RNA, 23 nt, Human
uggggaaaggggucggcugacca

SEQ ID NO: 1432537 - RNA, 22 nt, Human
uggggaaaggggucggcugacc

SEQ ID NO: 1432538 - RNA, 21 nt, Human
uggggaaaggggucggcugac

SEQ ID NO: 1432539 - RNA, 20 nt, Human
ugucauuuaguucagcaucc

SEQ ID NO: 1432540 - RNA, 14 nt, Human
ugucauguguauaa

SEQ ID NO: 1432541 - RNA, 13 nt, Human
ugucauguguaua

SEQ ID NO: 1432542 - RNA, 11 nt, Human
ugucaugugua

SEQ ID NO: 1432543 - RNA, 15 nt, Human
ugucauguguauaaa

SEQ ID NO: 1432544 - RNA, 20 nt, Human
ugucaugcugggauuuccaa

SEQ ID NO: 1432545 - RNA, 16 nt, Human
ugucaugcugggauuu

SEQ ID NO: 1432546 - RNA, 15 nt, Human
ugucaugcugccuua

SEQ ID NO: 1432547 - RNA, 14 nt, Human
ugucaugcugccuu

SEQ ID NO: 1432548 - RNA, 13 nt, Human
ugucaugcugccu

SEQ ID NO: 1432549 - RNA, 14 nt, Human
ugucaccugugcuu

SEQ ID NO: 1432550 - RNA, 13 nt, Human
ugucaucugugca

SEQ ID NO: 1432551 - RNA, 14 nt, Human
ugucacgccagacu

SEQ ID NO: 1432552 - RNA, 20 nt, Human
uguccaugcgcucagggcca

SEQ ID NO: 1432553 - RNA, 17 nt, Human
ugucauuucauuuccua

SEQ ID NO: 1432554 - RNA, 16 nt, Human
ugucauuucauuuccu

SEQ ID NO: 1432555 - RNA, 14 nt, Human
ugucauuucauuuc

SEQ ID NO: 1432556 - RNA, 16 nt, Human
ugucauuucagaaguu

SEQ ID NO: 1432557 - RNA, 15 nt, Human
ugucauuucagaagu

SEQ ID NO: 1432558 - RNA, 23 nt, Human
ugucauuguuauauaaucauuau

SEQ ID NO: 1432559 - RNA, 16 nt, Human
uguccucagccuugcc

SEQ ID NO: 1432560 - RNA, 13 nt, Human
uguccucagccuu

SEQ ID NO: 1432561 - RNA, 12 nt, Human
uguccucagccu

SEQ ID NO: 1432562 - RNA, 15 nt, Human
uguccuagcacagau

SEQ ID NO: 1432563 - RNA, 14 nt, Human
uguccuagcacaga

SEQ ID NO: 1432564 - RNA, 22 nt, Human
ugucccccuuuagaucucugaa

SEQ ID NO: 1432565 - RNA, 21 nt, Human
ugucccccuuuagaucucuga

SEQ ID NO: 1432566 - RNA, 21 nt, Human
uguccucagccccgcguggaa

SEQ ID NO: 1432567 - RNA, 18 nt, Human
ugucccccucuguccagg

SEQ ID NO: 1432568 - RNA, 19 nt, Human
uguccccccacucccucac

SEQ ID NO: 1432569 - RNA, 15 nt, Human
uguccccccacuccc

SEQ ID NO: 1432570 - RNA, 14 nt, Human
uguccccccacucc

SEQ ID NO: 1432571 - RNA, 12 nt, Human
uguccccagcag

SEQ ID NO: 1432572 - RNA, 22 nt, Human
ugucccacccccacccccagcu

SEQ ID NO: 1432573 - RNA, 18 nt, Human
ugucccacccccaccccc

SEQ ID NO: 1432574 - RNA, 17 nt, Human
ugucccacccccacccc

SEQ ID NO: 1432575 - RNA, 18 nt, Human
uguccaugcgcucagggc

SEQ ID NO: 1432576 - RNA, 23 nt, Human
ugucccacccccacccccagcuc

SEQ ID NO: 1432577 - RNA, 21 nt, Human
uguauucucugagcugugcag

SEQ ID NO: 1432578 - RNA, 20 nt, Human
uguauucucugagcugugca

SEQ ID NO: 1432579 - RNA, 19 nt, Human
uguauucucugagcugugc

SEQ ID NO: 1432580 - RNA, 14 nt, Human
uguauucucugagc

SEQ ID NO: 1432581 - RNA, 13 nt, Human
uguauucucugag

SEQ ID NO: 1432582 - RNA, 22 nt, Human
uguaugauuacuggccuuuuuc

SEQ ID NO: 1432583 - RNA, 16 nt, Human
uguaugauucccagcc

SEQ ID NO: 1432584 - RNA, 22 nt, Human
uguauucucuccuguaccucuu

SEQ ID NO: 1432585 - RNA, 20 nt, Human
uguauuguugaaaaaguuug

SEQ ID NO: 1432586 - RNA, 18 nt, Human
uguauuguugaaaaaguu

SEQ ID NO: 1432587 - RNA, 20 nt, Human
uguauugugcaauguguaua

SEQ ID NO: 1432588 - RNA, 19 nt, Human
uguauugugcaauguguau

SEQ ID NO: 1432589 - RNA, 18 nt, Human
uguauugugcaaugugua

SEQ ID NO: 1432590 - RNA, 21 nt, Human
uguauuguauauuacaaugau

SEQ ID NO: 1432591 - RNA, 15 nt, Human
uguauugugcaaugu

SEQ ID NO: 1432592 - RNA, 22 nt, Human
uguauaaaaauaaaaaagaucc

SEQ ID NO: 1432593 - RNA, 14 nt, Human
uguauaaaaauaaa

SEQ ID NO: 1432594 - RNA, 20 nt, Human
uguaguuuuuauauguugua

SEQ ID NO: 1432595 - RNA, 19 nt, Human
uguaguuuuuauauguugu

SEQ ID NO: 1432596 - RNA, 20 nt, Human
uguaguucugcuccagacag

SEQ ID NO: 1432597 - RNA, 15 nt, Human
uguaguucuaagacu

SEQ ID NO: 1432598 - RNA, 13 nt, Human
uguaguucuaaga

SEQ ID NO: 1432599 - RNA, 13 nt, Human
uguaugauuacug

SEQ ID NO: 1432600 - RNA, 12 nt, Human
uguaugauuacu

SEQ ID NO: 1432601 - RNA, 15 nt, Human
uguaugauucccagc

SEQ ID NO: 1432602 - RNA, 22 nt, Human
uguauaaaagggacugagaaau

SEQ ID NO: 1432603 - RNA, 17 nt, Human
uguauuuuauguuauau

SEQ ID NO: 1432604 - RNA, 14 nt, Human
uguauuuuauguua

SEQ ID NO: 1432605 - RNA, 13 nt, Human
uguauuuuauguu

SEQ ID NO: 1432606 - RNA, 12 nt, Human
uguauuuuaugu

SEQ ID NO: 1432607 - RNA, 16 nt, Human
uguauuuuagcagaga

SEQ ID NO: 1432608 - RNA, 22 nt, Human
uguauuguugaaaaaguuuguu

SEQ ID NO: 1432609 - RNA, 23 nt, Human
uguauuguugaaaaaguuuguuu

SEQ ID NO: 1432610 - RNA, 13 nt, Human
uguauuuauucaa

SEQ ID NO: 1432611 - RNA, 14 nt, Human
uguauuuauucaau

SEQ ID NO: 1432612 - RNA, 17 nt, Human
uguauuuauucaauaaa

SEQ ID NO: 1432613 - RNA, 19 nt, Human
uguauuuauucaauaaagu

SEQ ID NO: 1432614 - RNA, 22 nt, Human
uguauuuauugguuuugcagaa

SEQ ID NO: 1432615 - RNA, 22 nt, Human
uguauuuauucaauaaaguauu

SEQ ID NO: 1432616 - RNA, 14 nt, Human
uguauuuuguauug

SEQ ID NO: 1432617 - RNA, 22 nt, Human
ugucaccacccugcucauccac

SEQ ID NO: 1432618 - RNA, 18 nt, Human
ugucaccacccugcucau

SEQ ID NO: 1432619 - RNA, 23 nt, Human
ugucaccaauguacccaccgggc

SEQ ID NO: 1432620 - RNA, 15 nt, Human
ugucaccagaucuga

SEQ ID NO: 1432621 - RNA, 22 nt, Human
ugucacccagguuggagugcag

SEQ ID NO: 1432622 - RNA, 12 nt, Human
uguacacaguca

SEQ ID NO: 1432623 - RNA, 21 nt, Human
uguacacaacucacuccuuuu

SEQ ID NO: 1432624 - RNA, 15 nt, Human
uguacacaacucacu

SEQ ID NO: 1432625 - RNA, 19 nt, Human
uguaauuaaaagcaaauca

SEQ ID NO: 1432626 - RNA, 20 nt, Human
uguaauuaaaagcaaaucau

SEQ ID NO: 1432627 - RNA, 16 nt, Human
uguaauuaaaagcaaa

SEQ ID NO: 1432628 - RNA, 14 nt, Human
uguaauuaaaagca

SEQ ID NO: 1432629 - RNA, 18 nt, Human
uguacaguuaucuaaguu

SEQ ID NO: 1432630 - RNA, 17 nt, Human
uguacaguuaucuaagu

SEQ ID NO: 1432631 - RNA, 14 nt, Human
uguacaguguuacc

SEQ ID NO: 1432632 - RNA, 13 nt, Human
uguacaguguuac

SEQ ID NO: 1432633 - RNA, 12 nt, Human
uguacaguguua

SEQ ID NO: 1432634 - RNA, 23 nt, Human
uguacagugucuuuuuuuguaua

SEQ ID NO: 1432635 - RNA, 22 nt, Human
uguacagugucuuuuuuuguau

SEQ ID NO: 1432636 - RNA, 15 nt, Human
uguacagugucuuuu

SEQ ID NO: 1432637 - RNA, 14 nt, Human
uguacagugucuuu

SEQ ID NO: 1432638 - RNA, 22 nt, Human
uguacaguuaucuaaguuaauu

SEQ ID NO: 1432639 - RNA, 21 nt, Human
uguacaguuaucuaaguuaau

SEQ ID NO: 1432640 - RNA, 17 nt, Human
uguacaguuauuuaugc

SEQ ID NO: 1432641 - RNA, 21 nt, Human
uguaccgcgucuacccuggga

SEQ ID NO: 1432642 - RNA, 20 nt, Human
uguaccgcgucuacccuggg

SEQ ID NO: 1432643 - RNA, 19 nt, Human
uguaccgcgucuacccugg

SEQ ID NO: 1432644 - RNA, 18 nt, Human
uguaccgcgucuacccug

SEQ ID NO: 1432645 - RNA, 22 nt, Human
uguaccguaggcuuuguauuca

SEQ ID NO: 1432646 - RNA, 18 nt, Human
uguaauagauguuugaua

SEQ ID NO: 1432647 - RNA, 17 nt, Human
uguaauaaacuuuaaua

SEQ ID NO: 1432648 - RNA, 18 nt, Human
uguaauacuucuugugug

SEQ ID NO: 1432649 - RNA, 15 nt, Human
uguaauaaacuuuaa

SEQ ID NO: 1432650 - RNA, 13 nt, Human
uguaauaaacuuu

SEQ ID NO: 1432651 - RNA, 14 nt, Human
uggucacagcugua

SEQ ID NO: 1432652 - RNA, 13 nt, Human
uggucacagcugu

SEQ ID NO: 1432653 - RNA, 20 nt, Human
uguaauaaacucauuucuag

SEQ ID NO: 1432654 - RNA, 16 nt, Human
uggucacacacugaug

SEQ ID NO: 1432655 - RNA, 15 nt, Human
uggucacacacugau

SEQ ID NO: 1432656 - RNA, 14 nt, Human
uggucacacacuga

SEQ ID NO: 1432657 - RNA, 19 nt, Human
ugguauuguauuuauucaa

SEQ ID NO: 1432658 - RNA, 22 nt, Human
ugguauuguauuuauucaauaa

SEQ ID NO: 1432659 - RNA, 21 nt, Human
uggucacagcggaggugugga

SEQ ID NO: 1432660 - RNA, 15 nt, Human
uggucacagcggagg

SEQ ID NO: 1432661 - RNA, 14 nt, Human
uguaaucaauguuu

SEQ ID NO: 1432662 - RNA, 17 nt, Human
uguaauauuucuucaaa

SEQ ID NO: 1432663 - RNA, 16 nt, Human
uguaauccgaaucucu

SEQ ID NO: 1432664 - RNA, 20 nt, Human
uguaaucaauguuucuucua

SEQ ID NO: 1432665 - RNA, 15 nt, Human
uguaaucuugaauug

SEQ ID NO: 1432666 - RNA, 20 nt, Human
uguaaucuuauuuaggaagu

SEQ ID NO: 1432667 - RNA, 17 nt, Human
uguaauguuaauauuga

SEQ ID NO: 1432668 - RNA, 18 nt, Human
uguaauguuaauauugau

SEQ ID NO: 1432669 - RNA, 15 nt, Human
uguaauguuaauauu

SEQ ID NO: 1432670 - RNA, 14 nt, Human
uguaauguuaauau

SEQ ID NO: 1432671 - RNA, 19 nt, Human
uguaaugucuugagcucua

SEQ ID NO: 1432672 - RNA, 15 nt, Human
uguaaugucuugagc

SEQ ID NO: 1432673 - RNA, 20 nt, Human
uguaaugucuugagcucuau

SEQ ID NO: 1432674 - RNA, 21 nt, Human
uguaaucuugaauuguaacug

SEQ ID NO: 1432675 - RNA, 21 nt, Human
uguaccuuuugaggagcccca

SEQ ID NO: 1432676 - RNA, 22 nt, Human
uguaccgcgucuacccugggau

SEQ ID NO: 1432677 - RNA, 22 nt, Human
uguaccuuuugaggagccccag

SEQ ID NO: 1432678 - RNA, 15 nt, Human
uguacuguucugugu

SEQ ID NO: 1432679 - RNA, 14 nt, Human
uguacugccugcuu

SEQ ID NO: 1432680 - RNA, 15 nt, Human
uguacugccugcuug

SEQ ID NO: 1432681 - RNA, 13 nt, Human
uguacugccugcu

SEQ ID NO: 1432682 - RNA, 12 nt, Human
uguacugccugc

SEQ ID NO: 1432683 - RNA, 18 nt, Human
uguacggauuuucaguua

SEQ ID NO: 1432684 - RNA, 21 nt, Human
uguacggauuuucaguuacuu

SEQ ID NO: 1432685 - RNA, 14 nt, Human
uguagauugauugu

SEQ ID NO: 1432686 - RNA, 16 nt, Human
uguagauucagguaau

SEQ ID NO: 1432687 - RNA, 19 nt, Human
uguacuguucugugucuuu

SEQ ID NO: 1432688 - RNA, 16 nt, Human
uguacuguucuguguc

SEQ ID NO: 1432689 - RNA, 13 nt, Human
uguagccacacca

SEQ ID NO: 1432690 - RNA, 18 nt, Human
uguagcauccuggaauau

SEQ ID NO: 1432691 - RNA, 17 nt, Human
uguagcauccuggaaua

SEQ ID NO: 1432692 - RNA, 22 nt, Human
uguagauugauuguauuguuga

SEQ ID NO: 1432693 - RNA, 18 nt, Human
uguagauugauuguauug

SEQ ID NO: 1432694 - RNA, 16 nt, Human
uguagcauccuggaau

SEQ ID NO: 1432695 - RNA, 14 nt, Human
uguagcauccugga

SEQ ID NO: 1432696 - RNA, 22 nt, Human
uguaguuccacuuauagccucu

SEQ ID NO: 1432697 - RNA, 20 nt, Human
uguaguucauguaaauaaua

SEQ ID NO: 1432698 - RNA, 14 nt, Human
uguaguucauguaa

SEQ ID NO: 1432699 - RNA, 13 nt, Human
uguaguucaugua

SEQ ID NO: 1432700 - RNA, 21 nt, Human
uguagcugugaccugcugagc

SEQ ID NO: 1432701 - RNA, 20 nt, Human
uguagcugugaccugcugag

SEQ ID NO: 1432702 - RNA, 19 nt, Human
uguagcugugaccugcuga

SEQ ID NO: 1432703 - RNA, 18 nt, Human
uguagcugugaccugcug

SEQ ID NO: 1432704 - RNA, 17 nt, Human
uguagcugugaccugcu

SEQ ID NO: 1432705 - RNA, 16 nt, Human
uguagcugugaccugc

SEQ ID NO: 1432706 - RNA, 15 nt, Human
uguagcugugaccug

SEQ ID NO: 1432707 - RNA, 14 nt, Human
uguagcugugaccu

SEQ ID NO: 1432708 - RNA, 13 nt, Human
uguagcugugacc

SEQ ID NO: 1432709 - RNA, 11 nt, Human
uguagcuguga

SEQ ID NO: 1432710 - RNA, 15 nt, Human
uguagcugaggaggc

SEQ ID NO: 1432711 - RNA, 20 nt, Human
uguagcucuuugucagggag

SEQ ID NO: 1432712 - RNA, 18 nt, Human
uguagcuccuccccugga

SEQ ID NO: 1432713 - RNA, 17 nt, Human
uguagcuccuccccugg

SEQ ID NO: 1432714 - RNA, 11 nt, Human
uguagcuccuc

SEQ ID NO: 1432715 - RNA, 23 nt, Human
uguagcuacagagaaaccagcuu

SEQ ID NO: 1432716 - RNA, 22 nt, Human
uguagcuacagagaaaccagcu

SEQ ID NO: 1432717 - RNA, 21 nt, Human
uguagcuacagagaaaccagc

SEQ ID NO: 1432718 - RNA, 19 nt, Human
uguagcuacagagaaacca

SEQ ID NO: 1432719 - RNA, 18 nt, Human
uguagcuacagagaaacc

SEQ ID NO: 1432720 - RNA, 17 nt, Human
uguagcuacagagaaac

SEQ ID NO: 1432721 - RNA, 16 nt, Human
uguagcuacagagaaa

SEQ ID NO: 1432722 - RNA, 15 nt, Human
uguagcuacagagaa

SEQ ID NO: 1432723 - RNA, 14 nt, Human
uguagcuacagaga

SEQ ID NO: 1432724 - RNA, 13 nt, Human
uguagcuacagag

SEQ ID NO: 1432725 - RNA, 15 nt, Human
uguagcgucuuucuu

SEQ ID NO: 1432726 - RNA, 16 nt, Human
uguagcgucuuucuuu

SEQ ID NO: 1432727 - RNA, 13 nt, Human
uguagccuuuuug

SEQ ID NO: 1432728 - RNA, 12 nt, Human
uguagccuuuuu

SEQ ID NO: 1432729 - RNA, 21 nt, Human
uguagccccagugacagcuag

SEQ ID NO: 1432730 - RNA, 16 nt, Human
uguagccccagugaca

SEQ ID NO: 1432731 - RNA, 14 nt, Human
uguagccagccggg

SEQ ID NO: 1432732 - RNA, 12 nt, Human
uguagccagccg

SEQ ID NO: 1432733 - RNA, 15 nt, Human
uguagccagccgggg

SEQ ID NO: 1432734 - RNA, 18 nt, Human
uguagccacaccaggaua

SEQ ID NO: 1432735 - RNA, 17 nt, Human
uguagccacaccaggau

SEQ ID NO: 1432736 - RNA, 16 nt, Human
uguagccacaccagga

SEQ ID NO: 1432737 - RNA, 23 nt, Human
uguagccucaaucgagugagaca

SEQ ID NO: 1432738 - RNA, 19 nt, Human
uguagcccuuuccaagcuu

SEQ ID NO: 1432739 - RNA, 18 nt, Human
uguagccccucuccugga

SEQ ID NO: 1432740 - RNA, 18 nt, Human
ugucugaacuugcauugu

SEQ ID NO: 1432741 - RNA, 13 nt, Human
ugucugaacuugc

SEQ ID NO: 1432742 - RNA, 15 nt, Human
uguccugaaggccug

SEQ ID NO: 1432743 - RNA, 18 nt, Human
uguccugaaggccugagg

SEQ ID NO: 1432744 - RNA, 12 nt, Human
uguccugaaggc

SEQ ID NO: 1432745 - RNA, 21 nt, Human
uguccucuuucagcuccugac

SEQ ID NO: 1432746 - RNA, 19 nt, Human
uguccucuuucagcuccug

SEQ ID NO: 1432747 - RNA, 18 nt, Human
uguccucuuucagcuccu

SEQ ID NO: 1432748 - RNA, 17 nt, Human
uguccucuuucagcucc

SEQ ID NO: 1432749 - RNA, 16 nt, Human
uguccucuuucagcuc

SEQ ID NO: 1432750 - RNA, 15 nt, Human
uguccucuuucagcu

SEQ ID NO: 1432751 - RNA, 14 nt, Human
uguccucuuucagc

SEQ ID NO: 1432752 - RNA, 13 nt, Human
uguccucuucccu

SEQ ID NO: 1432753 - RNA, 16 nt, Human
uguccucuucccucuc

SEQ ID NO: 1432754 - RNA, 23 nt, Human
uguccucccgagcuccucuucca

SEQ ID NO: 1432755 - RNA, 22 nt, Human
uguccucagccuugccagagau

SEQ ID NO: 1432756 - RNA, 21 nt, Human
uguccucagccuugccagaga

SEQ ID NO: 1432757 - RNA, 20 nt, Human
uguccucagccuugccagag

SEQ ID NO: 1432758 - RNA, 17 nt, Human
uguccucagccuugcca

SEQ ID NO: 1432759 - RNA, 16 nt, Human
ugucugaacuugcauu

SEQ ID NO: 1432760 - RNA, 14 nt, Human
ugucuggcaaggac

SEQ ID NO: 1432761 - RNA, 21 nt, Human
ugucuggagaccaccagggca

SEQ ID NO: 1432762 - RNA, 20 nt, Human
ugucuggagaccaccagggc

SEQ ID NO: 1432763 - RNA, 18 nt, Human
ugucuggagaccaccagg

SEQ ID NO: 1432764 - RNA, 17 nt, Human
ugucuggagaccaccag

SEQ ID NO: 1432765 - RNA, 13 nt, Human
ugucuggagacca

SEQ ID NO: 1432766 - RNA, 12 nt, Human
ugucuggagacc

SEQ ID NO: 1432767 - RNA, 11 nt, Human
ugucuggagac

SEQ ID NO: 1432768 - RNA, 17 nt, Human
ugucuggaagaugggga

SEQ ID NO: 1432769 - RNA, 15 nt, Human
ugucuggaagauggg

SEQ ID NO: 1432770 - RNA, 22 nt, Human
ugucuggcaaugccacagcccu

SEQ ID NO: 1432771 - RNA, 19 nt, Human
ugucuggcaaugccacagc

SEQ ID NO: 1432772 - RNA, 16 nt, Human
ugucuggcaaugccac

SEQ ID NO: 1432773 - RNA, 15 nt, Human
ugucuggcaaugcca

SEQ ID NO: 1432774 - RNA, 20 nt, Human
ugucuggcaaggacuuugua

SEQ ID NO: 1432775 - RNA, 23 nt, Human
ugucugguucucaauuccaacag

SEQ ID NO: 1432776 - RNA, 17 nt, Human
ugucuggcacagccugg

SEQ ID NO: 1432777 - RNA, 14 nt, Human
ugucuguccuuuau

SEQ ID NO: 1432778 - RNA, 13 nt, Human
ugucuuuuggagg

SEQ ID NO: 1432779 - RNA, 14 nt, Human
ugugaaggacccuu

SEQ ID NO: 1432780 - RNA, 13 nt, Human
ugugaaggacccu

SEQ ID NO: 1432781 - RNA, 12 nt, Human
ugugaagccuuc

SEQ ID NO: 1432782 - RNA, 13 nt, Human
ugugaagccuucc

SEQ ID NO: 1432783 - RNA, 22 nt, Human
ugugaaaaugguccaggagaag

SEQ ID NO: 1432784 - RNA, 18 nt, Human
ugugaaaaugguccagga

SEQ ID NO: 1432785 - RNA, 18 nt, Human
ugugacauuuauauauug

SEQ ID NO: 1432786 - RNA, 17 nt, Human
ugugacauuuauauauu

SEQ ID NO: 1432787 - RNA, 24 nt, Human
ugugaauuaggcuguaacuacuuu

SEQ ID NO: 1432788 - RNA, 23 nt, Human
ugugaauuaggcuguaacuacuu

SEQ ID NO: 1432789 - RNA, 22 nt, Human
ugugaauuaggcuguaacuacu

SEQ ID NO: 1432790 - RNA, 19 nt, Human
ugugaauuaggcuguaacu

SEQ ID NO: 1432791 - RNA, 16 nt, Human
ugugaauuaagcccaa

SEQ ID NO: 1432792 - RNA, 23 nt, Human
ugugaaggugauuuaagggccca

SEQ ID NO: 1432793 - RNA, 17 nt, Human
ugugaaggugauuuaag

SEQ ID NO: 1432794 - RNA, 13 nt, Human
ugugaggccaggg

SEQ ID NO: 1432795 - RNA, 16 nt, Human
ugugaccaaugucuug

SEQ ID NO: 1432796 - RNA, 15 nt, Human
ugugaccaaugucuu

SEQ ID NO: 1432797 - RNA, 17 nt, Human
ugugaccaaaaguuaca

SEQ ID NO: 1432798 - RNA, 18 nt, Human
ugugaccaaaaguuacau

SEQ ID NO: 1432799 - RNA, 15 nt, Human
ugugacauuuuacau

SEQ ID NO: 1432800 - RNA, 17 nt, Human
ugugacauuuuacauua

SEQ ID NO: 1432801 - RNA, 18 nt, Human
ugugacauuuuacauuaa

SEQ ID NO: 1432802 - RNA, 22 nt, Human
ugugagucuuugguucuaagga

SEQ ID NO: 1432803 - RNA, 21 nt, Human
ugugagucuuugguucuaagg

SEQ ID NO: 1432804 - RNA, 20 nt, Human
ugugagucuuugguucuaag

SEQ ID NO: 1432805 - RNA, 18 nt, Human
ugugagucuuugguucua

SEQ ID NO: 1432806 - RNA, 14 nt, Human
ugugaggcuguccu

SEQ ID NO: 1432807 - RNA, 22 nt, Human
ugugaggccagggcagagugag

SEQ ID NO: 1432808 - RNA, 17 nt, Human
ugugaggccagggcaga

SEQ ID NO: 1432809 - RNA, 16 nt, Human
ugugaggccagggcag

SEQ ID NO: 1432810 - RNA, 15 nt, Human
ugugaggccagggca

SEQ ID NO: 1432811 - RNA, 14 nt, Human
ugugaggccagggc

SEQ ID NO: 1432812 - RNA, 20 nt, Human
ugugcacaucugugucuugu

SEQ ID NO: 1432813 - RNA, 17 nt, Human
ugugcacaucugugucu

SEQ ID NO: 1432814 - RNA, 15 nt, Human
ugugaucagaccaua

SEQ ID NO: 1432815 - RNA, 19 nt, Human
ugugauauucuaagacuua

SEQ ID NO: 1432816 - RNA, 15 nt, Human
ugugauauucuaaga

SEQ ID NO: 1432817 - RNA, 14 nt, Human
ugugauauucuaag

SEQ ID NO: 1432818 - RNA, 22 nt, Human
ugugaguguuuuuaucuuuuua

SEQ ID NO: 1432819 - RNA, 21 nt, Human
ugugauaugcacaauguagau

SEQ ID NO: 1432820 - RNA, 16 nt, Human
ugugauauauaagugu

SEQ ID NO: 1432821 - RNA, 15 nt, Human
ugugauauauaagug

SEQ ID NO: 1432822 - RNA, 14 nt, Human
ugugauauauaagu

SEQ ID NO: 1432823 - RNA, 13 nt, Human
ugugauauauaag

SEQ ID NO: 1432824 - RNA, 19 nt, Human
ugugaguuuaccuuguaua

SEQ ID NO: 1432825 - RNA, 21 nt, Human
ugugaguuuaccuuguauacu

SEQ ID NO: 1432826 - RNA, 16 nt, Human
ugugaguucucccugu

SEQ ID NO: 1432827 - RNA, 17 nt, Human
ugugaguguuuuuaucu

SEQ ID NO: 1432828 - RNA, 16 nt, Human
ugugauauaagugugu

SEQ ID NO: 1432829 - RNA, 15 nt, Human
ugugccuuguuuuuu

SEQ ID NO: 1432830 - RNA, 18 nt, Human
ugugccuuguuuuuuguu

SEQ ID NO: 1432831 - RNA, 13 nt, Human
ugugccuuguuuu

SEQ ID NO: 1432832 - RNA, 21 nt, Human
ugugccuucucucucccuuuu

SEQ ID NO: 1432833 - RNA, 20 nt, Human
ugugccuugucacgccagac

SEQ ID NO: 1432834 - RNA, 19 nt, Human
ugugccuugucacgccaga

SEQ ID NO: 1432835 - RNA, 17 nt, Human
ugugccuugucacgcca

SEQ ID NO: 1432836 - RNA, 23 nt, Human
ugugccuucgucuuucccauggg

SEQ ID NO: 1432837 - RNA, 14 nt, Human
ugugccuucgucuu

SEQ ID NO: 1432838 - RNA, 23 nt, Human
ugugcauuuggugguuucagaaa

SEQ ID NO: 1432839 - RNA, 15 nt, Human
ugugcauucuggauu

SEQ ID NO: 1432840 - RNA, 23 nt, Human
ugugcauuaucuagauacuguau

SEQ ID NO: 1432841 - RNA, 20 nt, Human
ugugcauuaucuagauacug

SEQ ID NO: 1432842 - RNA, 21 nt, Human
ugugcauuaucuagauacugu

SEQ ID NO: 1432843 - RNA, 21 nt, Human
ugugcacaucugugucuuguu

SEQ ID NO: 1432844 - RNA, 17 nt, Human
ugugcacuuauuuauga

SEQ ID NO: 1432845 - RNA, 20 nt, Human
ugugcacuggcaccaagugc

SEQ ID NO: 1432846 - RNA, 21 nt, Human
ugugcacugcccauggacagg

SEQ ID NO: 1432847 - RNA, 13 nt, Human
ugugcacugccca

SEQ ID NO: 1432848 - RNA, 14 nt, Human
ugugcauuaucuag

SEQ ID NO: 1432849 - RNA, 16 nt, Human
ugugcauuaucuagau

SEQ ID NO: 1432850 - RNA, 19 nt, Human
ugugcauuaucuagauacu

SEQ ID NO: 1432851 - RNA, 15 nt, Human
ugugcucagcccuga

SEQ ID NO: 1432852 - RNA, 12 nt, Human
ugugcucagccc

SEQ ID NO: 1432853 - RNA, 18 nt, Human
ugugcuauggugcucugu

SEQ ID NO: 1432854 - RNA, 21 nt, Human
ugugcuauacugcauacuuuu

SEQ ID NO: 1432855 - RNA, 20 nt, Human
ugugcuauacugcauacuuu

SEQ ID NO: 1432856 - RNA, 18 nt, Human
ugugcuauacugcauacu

SEQ ID NO: 1432857 - RNA, 13 nt, Human
ugugcuauacugc

SEQ ID NO: 1432858 - RNA, 19 nt, Human
ugugcuaguaauuggaaag

SEQ ID NO: 1432859 - RNA, 20 nt, Human
ugugcucaggagcccuggga

SEQ ID NO: 1432860 - RNA, 17 nt, Human
ugugcucaggagcccug

SEQ ID NO: 1432861 - RNA, 15 nt, Human
ugugcucaggagccc

SEQ ID NO: 1432862 - RNA, 16 nt, Human
ugugcucaggagcccu

SEQ ID NO: 1432863 - RNA, 14 nt, Human
ugugcuuugagaag

SEQ ID NO: 1432864 - RNA, 16 nt, Human
uguggaacauaaaaag

SEQ ID NO: 1432865 - RNA, 23 nt, Human
ugugggauuaugggucacaggaa

SEQ ID NO: 1432866 - RNA, 18 nt, Human
ugugggauuaugggucac

SEQ ID NO: 1432867 - RNA, 16 nt, Human
ugugggauuauggguc

SEQ ID NO: 1432868 - RNA, 13 nt, Human
ugugggauuaugg

SEQ ID NO: 1432869 - RNA, 22 nt, Human
ugugggauguucagcacugucc

SEQ ID NO: 1432870 - RNA, 19 nt, Human
ugugggauguucagcacug

SEQ ID NO: 1432871 - RNA, 14 nt, Human
ugugggagccucgc

SEQ ID NO: 1432872 - RNA, 19 nt, Human
ugugggccugggcuccugg

SEQ ID NO: 1432873 - RNA, 17 nt, Human
ugugggccugggcuccu

SEQ ID NO: 1432874 - RNA, 15 nt, Human
ugugggccugggcuc

SEQ ID NO: 1432875 - RNA, 14 nt, Human
ugugggccugggcu

SEQ ID NO: 1432876 - RNA, 13 nt, Human
ugugggccugggc

SEQ ID NO: 1432877 - RNA, 11 nt, Human
ugugggccugg

SEQ ID NO: 1432878 - RNA, 21 nt, Human
uguguaauuagugccacuuaa

SEQ ID NO: 1432879 - RNA, 20 nt, Human
ugugggccugggcuccugga

SEQ ID NO: 1432880 - RNA, 19 nt, Human
uguguagcugugaccugcu

SEQ ID NO: 1432881 - RNA, 16 nt, Human
uguguagcugugaccu

SEQ ID NO: 1432882 - RNA, 20 nt, Human
uguguagccuuuuuguauaa

SEQ ID NO: 1432883 - RNA, 14 nt, Human
uguguagccuuuuu

SEQ ID NO: 1432884 - RNA, 13 nt, Human
uguguagccuuuu

SEQ ID NO: 1432885 - RNA, 12 nt, Human
uguguagccuuu

SEQ ID NO: 1432886 - RNA, 17 nt, Human
uguguacauaacugaaa

SEQ ID NO: 1432887 - RNA, 15 nt, Human
uguguacauaacuga

SEQ ID NO: 1432888 - RNA, 17 nt, Human
uguguagcuuugcucuu

SEQ ID NO: 1432889 - RNA, 14 nt, Human
uguguagcuuugcu

SEQ ID NO: 1432890 - RNA, 23 nt, Human
uguggcgccgucuccaggggcug

SEQ ID NO: 1432891 - RNA, 19 nt, Human
uguggcgccgucuccaggg

SEQ ID NO: 1432892 - RNA, 12 nt, Human
ugugggagccuc

SEQ ID NO: 1432893 - RNA, 17 nt, Human
ugugggagaccggccug

SEQ ID NO: 1432894 - RNA, 23 nt, Human
ugugggagaccggccugccagga

SEQ ID NO: 1432895 - RNA, 19 nt, Human
uguggccuaagaggcugcc

SEQ ID NO: 1432896 - RNA, 23 nt, Human
uguggccucagcucccacaagcc

SEQ ID NO: 1432897 - RNA, 18 nt, Human
uguggcgccgucuccagg

SEQ ID NO: 1432898 - RNA, 17 nt, Human
uguggccuuugcgcucc

SEQ ID NO: 1432899 - RNA, 23 nt, Human
uguggccuaagaggcugcccucc

SEQ ID NO: 1432900 - RNA, 17 nt, Human
uguggccuaagaggcug

SEQ ID NO: 1432901 - RNA, 21 nt, Human
uguggaccauggaguggcagc

SEQ ID NO: 1432902 - RNA, 19 nt, Human
uguggacuaaaagauauaa

SEQ ID NO: 1432903 - RNA, 22 nt, Human
uguggaccauggaguggcagcc

SEQ ID NO: 1432904 - RNA, 15 nt, Human
uguggacuaaaagau

SEQ ID NO: 1432905 - RNA, 16 nt, Human
uguggacuaaaagaua

SEQ ID NO: 1432906 - RNA, 15 nt, Human
uguggccuaaccugc

SEQ ID NO: 1432907 - RNA, 14 nt, Human
uguggacaggacua

SEQ ID NO: 1432908 - RNA, 18 nt, Human
uguggaacugcugccacu

SEQ ID NO: 1432909 - RNA, 22 nt, Human
uguggaacugcugccacugagg

SEQ ID NO: 1432910 - RNA, 21 nt, Human
uguggaacauaaaaaggacau

SEQ ID NO: 1432911 - RNA, 17 nt, Human
uguggaacugcugccac

SEQ ID NO: 1432912 - RNA, 15 nt, Human
uguggaacugcugcc

SEQ ID NO: 1432913 - RNA, 19 nt, Human
uguggaacauaaaaaggac

SEQ ID NO: 1432914 - RNA, 15 nt, Human
uuacacucuuuguaa

SEQ ID NO: 1432915 - RNA, 14 nt, Human
uuacacucuuugua

SEQ ID NO: 1432916 - RNA, 22 nt, Human
uuacacuacacacuguguacug

SEQ ID NO: 1432917 - RNA, 14 nt, Human
uuacacgcuuuugu

SEQ ID NO: 1432918 - RNA, 17 nt, Human
uuacacgcuuuugugau

SEQ ID NO: 1432919 - RNA, 16 nt, Human
uuacacuuuuuggaag

SEQ ID NO: 1432920 - RNA, 19 nt, Human
uuacagacgcugcugucac

SEQ ID NO: 1432921 - RNA, 23 nt, Human
uuacagaauugcuuguuugcuuc

SEQ ID NO: 1432922 - RNA, 20 nt, Human
uuacauuuacaaacugaaga

SEQ ID NO: 1432923 - RNA, 19 nt, Human
uuacauuuacaaacugaag

SEQ ID NO: 1432924 - RNA, 18 nt, Human
uuacauuuacaaacugaa

SEQ ID NO: 1432925 - RNA, 17 nt, Human
uuacauuuacaaacuga

SEQ ID NO: 1432926 - RNA, 14 nt, Human
uuacauuuccuaaa

SEQ ID NO: 1432927 - RNA, 12 nt, Human
uuacauuuuuaa

SEQ ID NO: 1432928 - RNA, 17 nt, Human
uuacauuuuuaagugcu

SEQ ID NO: 1432929 - RNA, 16 nt, Human
uuaauagcagccuuuc

SEQ ID NO: 1432930 - RNA, 23 nt, Human
uuaaugaaguuugaauguuaaau

SEQ ID NO: 1432931 - RNA, 18 nt, Human
uuaaugaaguuugaaugu

SEQ ID NO: 1432932 - RNA, 22 nt, Human
uuaaugaaguuugaauguuaaa

SEQ ID NO: 1432933 - RNA, 16 nt, Human
uuaaugaaguuugaau

SEQ ID NO: 1432934 - RNA, 17 nt, Human
uuaaugaaguuugaaug

SEQ ID NO: 1432935 - RNA, 21 nt, Human
uuacaaauguuaaaauguguu

SEQ ID NO: 1432936 - RNA, 18 nt, Human
uuacaaauguuaaaaugu

SEQ ID NO: 1432937 - RNA, 13 nt, Human
uuaauuagugcua

SEQ ID NO: 1432938 - RNA, 14 nt, Human
uuaauuagugcuaa

SEQ ID NO: 1432939 - RNA, 19 nt, Human
uuaauuagccagugaaaaa

SEQ ID NO: 1432940 - RNA, 16 nt, Human
uuaauuaccaaccugu

SEQ ID NO: 1432941 - RNA, 19 nt, Human
uuacaaauguuaaaaugug

SEQ ID NO: 1432942 - RNA, 16 nt, Human
uuacaacggagucaaa

SEQ ID NO: 1432943 - RNA, 23 nt, Human
uuacaacugccucgaaacacaga

SEQ ID NO: 1432944 - RNA, 22 nt, Human
uuacaacugccucgaaacacag

SEQ ID NO: 1432945 - RNA, 19 nt, Human
uuacaacggagucaaaaau

SEQ ID NO: 1432946 - RNA, 23 nt, Human
uuacaacggagucaaaaauuaaa

SEQ ID NO: 1432947 - RNA, 20 nt, Human
uuaaaugcaaccauuugaaa

SEQ ID NO: 1432948 - RNA, 12 nt, Human
uuaaauguauac

SEQ ID NO: 1432949 - RNA, 14 nt, Human
uuaaauguauacua

SEQ ID NO: 1432950 - RNA, 19 nt, Human
uuaaauguauacuauagua

SEQ ID NO: 1432951 - RNA, 13 nt, Human
uuaaauguuauua

SEQ ID NO: 1432952 - RNA, 16 nt, Human
uuaaauguuaugacua

SEQ ID NO: 1432953 - RNA, 20 nt, Human
uuaaauguuaugacuaugua

SEQ ID NO: 1432954 - RNA, 12 nt, Human
uuaacuuuuaua

SEQ ID NO: 1432955 - RNA, 13 nt, Human
uuaacuuuuauaa

SEQ ID NO: 1432956 - RNA, 18 nt, Human
uuaagaucacagugaacu

SEQ ID NO: 1432957 - RNA, 14 nt, Human
uuaagauaauuaua

SEQ ID NO: 1432958 - RNA, 16 nt, Human
uuaagauaauuauaau

SEQ ID NO: 1432959 - RNA, 11 nt, Human
uuaacuuuguu

SEQ ID NO: 1432960 - RNA, 14 nt, Human
uuaacuuuaauguu

SEQ ID NO: 1432961 - RNA, 14 nt, Human
uuaacuuuuauaaa

SEQ ID NO: 1432962 - RNA, 19 nt, Human
uuaagaguccaagaaucca

SEQ ID NO: 1432963 - RNA, 14 nt, Human
uuaagaguccaaga

SEQ ID NO: 1432964 - RNA, 13 nt, Human
uuaagaguccaag

SEQ ID NO: 1432965 - RNA, 14 nt, Human
uuaacuuuguuuua

SEQ ID NO: 1432966 - RNA, 12 nt, Human
uuaagaguaaaa

SEQ ID NO: 1432967 - RNA, 20 nt, Human
uuaagcccagugcacugaaa

SEQ ID NO: 1432968 - RNA, 21 nt, Human
uuaagccacuuaaaauguuca

SEQ ID NO: 1432969 - RNA, 16 nt, Human
uuaagccaaaacaaug

SEQ ID NO: 1432970 - RNA, 22 nt, Human
uuaagcaucuggcucuaauuca

SEQ ID NO: 1432971 - RNA, 21 nt, Human
uuaauacucaaaugaguaaca

SEQ ID NO: 1432972 - RNA, 22 nt, Human
uuaauacucaaaugaguaacau

SEQ ID NO: 1432973 - RNA, 17 nt, Human
uuaauacuaccuugaaa

SEQ ID NO: 1432974 - RNA, 15 nt, Human
uuaauacuaccuuga

SEQ ID NO: 1432975 - RNA, 16 nt, Human
uuaauaauguuucaaa

SEQ ID NO: 1432976 - RNA, 21 nt, Human
uuaauaauauacuuguggacu

SEQ ID NO: 1432977 - RNA, 14 nt, Human
uuaauaauauacuu

SEQ ID NO: 1432978 - RNA, 16 nt, Human
uuaauaauauacuugu

SEQ ID NO: 1432979 - RNA, 18 nt, Human
uuaauaauauacuugugg

SEQ ID NO: 1432980 - RNA, 20 nt, Human
uuaauagcaaagaauugacu

SEQ ID NO: 1432981 - RNA, 18 nt, Human
uuaauagcaaagaauuga

SEQ ID NO: 1432982 - RNA, 16 nt, Human
uuaauagcaaagaauu

SEQ ID NO: 1432983 - RNA, 15 nt, Human
uuaauagcaaagaau

SEQ ID NO: 1432984 - RNA, 22 nt, Human
uuaauagcagccuuucucucuu

SEQ ID NO: 1432985 - RNA, 15 nt, Human
uuaauagcagccuuu

SEQ ID NO: 1432986 - RNA, 14 nt, Human
uuaauagcagccuu

SEQ ID NO: 1432987 - RNA, 20 nt, Human
uuaaagaaaaaaauguauuu

SEQ ID NO: 1432988 - RNA, 19 nt, Human
uuaaagaaaaaaauguauu

SEQ ID NO: 1432989 - RNA, 18 nt, Human
uuaaagaaaaaaauguau

SEQ ID NO: 1432990 - RNA, 18 nt, Human
uuaaacuuuuaauucauu

SEQ ID NO: 1432991 - RNA, 17 nt, Human
uuaaacuuuuaauucau

SEQ ID NO: 1432992 - RNA, 17 nt, Human
uuaaacuugcaucacuu

SEQ ID NO: 1432993 - RNA, 22 nt, Human
uuaaacuaggagaaccaaaucu

SEQ ID NO: 1432994 - RNA, 21 nt, Human
uuaaacuagcauaucugccuu

SEQ ID NO: 1432995 - RNA, 22 nt, Human
uuaaacuagcauaucugccuuu

SEQ ID NO: 1432996 - RNA, 23 nt, Human
uuaaacuagcauaucugccuuua

SEQ ID NO: 1432997 - RNA, 14 nt, Human
uuaaacuaaaugug

SEQ ID NO: 1432998 - RNA, 20 nt, Human
uuaaacuaaggcccucuuga

SEQ ID NO: 1432999 - RNA, 17 nt, Human
uuaaacuagcauaucug

SEQ ID NO: 1433000 - RNA, 19 nt, Human
uuaaacuagcauaucugcc

SEQ ID NO: 1433001 - RNA, 15 nt, Human
uuaaaauacaagacu

SEQ ID NO: 1433002 - RNA, 13 nt, Human
uuaaaauacaaga

SEQ ID NO: 1433003 - RNA, 11 nt, Human
uuaaaauacaa

SEQ ID NO: 1433004 - RNA, 15 nt, Human
uuaaaauaauuauau

SEQ ID NO: 1433005 - RNA, 17 nt, Human
uuaaaauacaagacugc

SEQ ID NO: 1433006 - RNA, 15 nt, Human
uuaaaacuuugaagu

SEQ ID NO: 1433007 - RNA, 15 nt, Human
uuaaaacuuguaauu

SEQ ID NO: 1433008 - RNA, 12 nt, Human
uuaaaacuccug

SEQ ID NO: 1433009 - RNA, 18 nt, Human
uuaaaaaaaaagaucugu

SEQ ID NO: 1433010 - RNA, 22 nt, Human
uuaaaugaacaagagaagcauu

SEQ ID NO: 1433011 - RNA, 20 nt, Human
uuaaaugaacaagagaagca

SEQ ID NO: 1433012 - RNA, 22 nt, Human
uuaaaugacacucauauaauua

SEQ ID NO: 1433013 - RNA, 18 nt, Human
uuaaaugaacaagagaag

SEQ ID NO: 1433014 - RNA, 17 nt, Human
uuaaaugaacaagagaa

SEQ ID NO: 1433015 - RNA, 14 nt, Human
uuaaaugaacaaga

SEQ ID NO: 1433016 - RNA, 18 nt, Human
uuaaaucuguuuuucuaa

SEQ ID NO: 1433017 - RNA, 16 nt, Human
uuaaaucucauugcuu

SEQ ID NO: 1433018 - RNA, 21 nt, Human
uuaaaugacacucauauaauu

SEQ ID NO: 1433019 - RNA, 11 nt, Human
uuaaaugcacc

SEQ ID NO: 1433020 - RNA, 22 nt, Human
uuaaagaaaaaaauugaaaugu

SEQ ID NO: 1433021 - RNA, 20 nt, Human
uuaaagaaaaaaauugaaau

SEQ ID NO: 1433022 - RNA, 17 nt, Human
uuaaagaaaaaaauuga

SEQ ID NO: 1433023 - RNA, 21 nt, Human
uuaaagaaaaaaauguauuuu

SEQ ID NO: 1433024 - RNA, 20 nt, Human
uuaaagcagguucuuguugg

SEQ ID NO: 1433025 - RNA, 13 nt, Human
uuaaagccuccuc

SEQ ID NO: 1433026 - RNA, 23 nt, Human
uguuuuuaaacuguacagugucu

SEQ ID NO: 1433027 - RNA, 19 nt, Human
uguuuuuaacaugucaauc

SEQ ID NO: 1433028 - RNA, 19 nt, Human
uguuuuuaaacuguacagu

SEQ ID NO: 1433029 - RNA, 18 nt, Human
uguuuuuaaacuguacag

SEQ ID NO: 1433030 - RNA, 16 nt, Human
uguuuuuaaacuguac

SEQ ID NO: 1433031 - RNA, 15 nt, Human
uguuuuuaaacugua

SEQ ID NO: 1433032 - RNA, 14 nt, Human
uguuuuuaaacugu

SEQ ID NO: 1433033 - RNA, 23 nt, Human
uguuuuaauuuaaacaccuccuc

SEQ ID NO: 1433034 - RNA, 22 nt, Human
uguuuuaauuuaaacaccuccu

SEQ ID NO: 1433035 - RNA, 13 nt, Human
uguuuuaauugua

SEQ ID NO: 1433036 - RNA, 16 nt, Human
uguuuuaauaacuuau

SEQ ID NO: 1433037 - RNA, 22 nt, Human
uguuuuaaggaugcuuguacau

SEQ ID NO: 1433038 - RNA, 23 nt, Human
uguuuuaaggaugcuuguacaua

SEQ ID NO: 1433039 - RNA, 16 nt, Human
uguuuuugcacauguu

SEQ ID NO: 1433040 - RNA, 20 nt, Human
uguuuuuaaugcuuugauau

SEQ ID NO: 1433041 - RNA, 18 nt, Human
uguuuuuacaaauguuaa

SEQ ID NO: 1433042 - RNA, 16 nt, Human
uguuuuuggucuuuua

SEQ ID NO: 1433043 - RNA, 10 nt, Human
uguuuuuggg

SEQ ID NO: 1433044 - RNA, 23 nt, Human
uguuuuugcgugggagugugugc

SEQ ID NO: 1433045 - RNA, 13 nt, Human
uuaaaaaaaaaga

SEQ ID NO: 1433046 - RNA, 15 nt, Human
uguuuacugcaaggu

SEQ ID NO: 1433047 - RNA, 19 nt, Human
uguuuacuagggaucccuc

SEQ ID NO: 1433048 - RNA, 13 nt, Human
uguuuacuaggga

SEQ ID NO: 1433049 - RNA, 18 nt, Human
uguuuccagcauucccag

SEQ ID NO: 1433050 - RNA, 22 nt, Human
uguuucccaggcccacugugcc

SEQ ID NO: 1433051 - RNA, 20 nt, Human
uguuuccagcauucccaggu

SEQ ID NO: 1433052 - RNA, 15 nt, Human
uguuuccagcauucc

SEQ ID NO: 1433053 - RNA, 17 nt, Human
uguuucuggauuucaua

SEQ ID NO: 1433054 - RNA, 19 nt, Human
uguuucugacucugagcua

SEQ ID NO: 1433055 - RNA, 12 nt, Human
uguuucugacuc

SEQ ID NO: 1433056 - RNA, 14 nt, Human
uguuuccucuaguu

SEQ ID NO: 1433057 - RNA, 16 nt, Human
uguuuccuagcugugu

SEQ ID NO: 1433058 - RNA, 20 nt, Human
uguuucccuuucacuggcau

SEQ ID NO: 1433059 - RNA, 14 nt, Human
uguuuccucuguuc

SEQ ID NO: 1433060 - RNA, 15 nt, Human
uguuuguuguagauu

SEQ ID NO: 1433061 - RNA, 11 nt, Human
uguuuguuggu

SEQ ID NO: 1433062 - RNA, 14 nt, Human
uguuuguguauuua

SEQ ID NO: 1433063 - RNA, 12 nt, Human
uguuuguguauu

SEQ ID NO: 1433064 - RNA, 15 nt, Human
uguuugugcuguggu

SEQ ID NO: 1433065 - RNA, 16 nt, Human
uguuucuguaagaaac

SEQ ID NO: 1433066 - RNA, 11 nt, Human
uguuucuguaa

SEQ ID NO: 1433067 - RNA, 12 nt, Human
uguuggcaggcu

SEQ ID NO: 1433068 - RNA, 21 nt, Human
uguuggacaccuuuagguucu

SEQ ID NO: 1433069 - RNA, 22 nt, Human
uguuggacaagcuucugagacg

SEQ ID NO: 1433070 - RNA, 21 nt, Human
uguuggacaagcuucugagac

SEQ ID NO: 1433071 - RNA, 20 nt, Human
uguuggagaagaacugaaau

SEQ ID NO: 1433072 - RNA, 19 nt, Human
uguuggagaagaacugaaa

SEQ ID NO: 1433073 - RNA, 16 nt, Human
uguugauuaaagauga

SEQ ID NO: 1433074 - RNA, 15 nt, Human
uguugauuaaagaug

SEQ ID NO: 1433075 - RNA, 23 nt, Human
uguugauacuguugcacgugugu

SEQ ID NO: 1433076 - RNA, 17 nt, Human
uguuggagaagaacuga

SEQ ID NO: 1433077 - RNA, 16 nt, Human
uguuggagaagaacug

SEQ ID NO: 1433078 - RNA, 12 nt, Human
uguuggaaugaa

SEQ ID NO: 1433079 - RNA, 14 nt, Human
uguuggagaagaac

SEQ ID NO: 1433080 - RNA, 19 nt, Human
uguugggacugcuaaauaa

SEQ ID NO: 1433081 - RNA, 14 nt, Human
uguugggacugcua

SEQ ID NO: 1433082 - RNA, 19 nt, Human
uguugggaaacuuggcucg

SEQ ID NO: 1433083 - RNA, 14 nt, Human
uguuggcuagccuc

SEQ ID NO: 1433084 - RNA, 18 nt, Human
uguuggcguaggcuacag

SEQ ID NO: 1433085 - RNA, 23 nt, Human
uguuggccaggcuggucuaaaac

SEQ ID NO: 1433086 - RNA, 17 nt, Human
uguuggcauagcucugg

SEQ ID NO: 1433087 - RNA, 21 nt, Human
uguuggcaggcuggccagucc

SEQ ID NO: 1433088 - RNA, 18 nt, Human
uguuggcaggcuggccag

SEQ ID NO: 1433089 - RNA, 24 nt, Human
uguuggcguaggcuacagagaagc

SEQ ID NO: 1433090 - RNA, 23 nt, Human
uguuggcguggggccuuugucag

SEQ ID NO: 1433091 - RNA, 23 nt, Human
uguuggcguaggcuacagagaag

SEQ ID NO: 1433092 - RNA, 22 nt, Human
uguuggcguaggcuacagagaa

SEQ ID NO: 1433093 - RNA, 21 nt, Human
uguuggcguaggcuacagaga

SEQ ID NO: 1433094 - RNA, 20 nt, Human
uguuggcguaggcuacagag

SEQ ID NO: 1433095 - RNA, 22 nt, Human
uguuuacaugcuuauuccauga

SEQ ID NO: 1433096 - RNA, 21 nt, Human
uguuuacaugcuuauuccaug

SEQ ID NO: 1433097 - RNA, 16 nt, Human
uguuuacaugcuuauu

SEQ ID NO: 1433098 - RNA, 13 nt, Human
uguuuacaugcuu

SEQ ID NO: 1433099 - RNA, 23 nt, Human
uguuuaaaguucaacauguuauu

SEQ ID NO: 1433100 - RNA, 12 nt, Human
uguuuaaaguuc

SEQ ID NO: 1433101 - RNA, 14 nt, Human
uguuuaaaccuuuu

SEQ ID NO: 1433102 - RNA, 13 nt, Human
uguuuaaaguuca

SEQ ID NO: 1433103 - RNA, 12 nt, Human
uguuuaagagac

SEQ ID NO: 1433104 - RNA, 23 nt, Human
uguucuccugcugcucccucaga

SEQ ID NO: 1433105 - RNA, 21 nt, Human
uguucuccuuuuccucucucc

SEQ ID NO: 1433106 - RNA, 20 nt, Human
uguucaugaaagauucaaug

SEQ ID NO: 1433107 - RNA, 22 nt, Human
uguucuccugcugcucccucag

SEQ ID NO: 1433108 - RNA, 15 nt, Human
uguucucuaucauuu

SEQ ID NO: 1433109 - RNA, 18 nt, Human
uguucucuaucauuuaau

SEQ ID NO: 1433110 - RNA, 20 nt, Human
uguucucuaucauuuaauaa

SEQ ID NO: 1433111 - RNA, 20 nt, Human
uguucauagcccaguagacc

SEQ ID NO: 1433112 - RNA, 19 nt, Human
uguucauagcccaguagac

SEQ ID NO: 1433113 - RNA, 23 nt, Human
uguucauagcccaguagaccuug

SEQ ID NO: 1433114 - RNA, 14 nt, Human
uguucaugaaagau

SEQ ID NO: 1433115 - RNA, 13 nt, Human
uguucaugaaaga

SEQ ID NO: 1433116 - RNA, 20 nt, Human
uguucuuuggaaauacacag

SEQ ID NO: 1433117 - RNA, 18 nt, Human
uguucuuuggaaaguaca

SEQ ID NO: 1433118 - RNA, 23 nt, Human
uguucuuucuggcuaugcauuug

SEQ ID NO: 1433119 - RNA, 18 nt, Human
uguugaaaaaguuuguuu

SEQ ID NO: 1433120 - RNA, 13 nt, Human
uguucuuuuuaga

SEQ ID NO: 1433121 - RNA, 22 nt, Human
uguucuuuggaaaguacacucu

SEQ ID NO: 1433122 - RNA, 20 nt, Human
uguucuuuuaaaugauugaa

SEQ ID NO: 1433123 - RNA, 21 nt, Human
uguugauacuguugcacgugu

SEQ ID NO: 1433124 - RNA, 23 nt, Human
uguugagaaucccaaauuugauu

SEQ ID NO: 1433125 - RNA, 22 nt, Human
uguugagaaucccaaauuugau

SEQ ID NO: 1433126 - RNA, 18 nt, Human
uguugacauucugaaugc

SEQ ID NO: 1433127 - RNA, 23 nt, Human
uguugacauucugaaugcuucua

SEQ ID NO: 1433128 - RNA, 17 nt, Human
uguugacauucugaaug

SEQ ID NO: 1433129 - RNA, 16 nt, Human
uguugacauucugaau

SEQ ID NO: 1433130 - RNA, 15 nt, Human
uguugacauucugaa

SEQ ID NO: 1433131 - RNA, 14 nt, Human
uguugacauucuga

SEQ ID NO: 1433132 - RNA, 14 nt, Human
uguugacauuaguc

SEQ ID NO: 1433133 - RNA, 12 nt, Human
uguugacauuag

SEQ ID NO: 1433134 - RNA, 18 nt, Human
uguugaauacuuuuuaca

SEQ ID NO: 1433135 - RNA, 13 nt, Human
uguugaauacuuu

SEQ ID NO: 1433136 - RNA, 17 nt, Human
uguugacaguucauaug

SEQ ID NO: 1433137 - RNA, 20 nt, Human
uguugacaugggacauuugc

SEQ ID NO: 1433138 - RNA, 21 nt, Human
uguuagcaugcuggugagcca

SEQ ID NO: 1433139 - RNA, 14 nt, Human
uguuagcagacagg

SEQ ID NO: 1433140 - RNA, 14 nt, Human
uguuacuguaauuc

SEQ ID NO: 1433141 - RNA, 12 nt, Human
uguuacuguaau

SEQ ID NO: 1433142 - RNA, 21 nt, Human
uguuagccuuuuuuccccaga

SEQ ID NO: 1433143 - RNA, 20 nt, Human
uguuagccuuuuuuccccag

SEQ ID NO: 1433144 - RNA, 19 nt, Human
uguuagccuuuuuucccca

SEQ ID NO: 1433145 - RNA, 19 nt, Human
uguuagccucaauuucuga

SEQ ID NO: 1433146 - RNA, 20 nt, Human
uguuacuaaaaaaaagauga

SEQ ID NO: 1433147 - RNA, 16 nt, Human
uguuacguagccuaag

SEQ ID NO: 1433148 - RNA, 23 nt, Human
uguuaccugaaaacacugugcac

SEQ ID NO: 1433149 - RNA, 14 nt, Human
uguuacuaaguuuu

SEQ ID NO: 1433150 - RNA, 14 nt, Human
uguuaaaaauguca

SEQ ID NO: 1433151 - RNA, 23 nt, Human
uguuaaaaaaauaagaagaaugc

SEQ ID NO: 1433152 - RNA, 22 nt, Human
uguuaaaaaaauaagaagaaug

SEQ ID NO: 1433153 - RNA, 20 nt, Human
uguuaaaaaaauaagaagaa

SEQ ID NO: 1433154 - RNA, 19 nt, Human
uguuaaaaaaauaagaaga

SEQ ID NO: 1433155 - RNA, 22 nt, Human
uguguuuuucuauuaaaagacu

SEQ ID NO: 1433156 - RNA, 21 nt, Human
uguguuuuucuauuaaaagac

SEQ ID NO: 1433157 - RNA, 19 nt, Human
uguguuuuucuauuaaaag

SEQ ID NO: 1433158 - RNA, 17 nt, Human
uguguuuuucuauuaaa

SEQ ID NO: 1433159 - RNA, 16 nt, Human
uguguuuuucuauuaa

SEQ ID NO: 1433160 - RNA, 15 nt, Human
uguguuuuucuauua

SEQ ID NO: 1433161 - RNA, 14 nt, Human
uguuaccuguagau

SEQ ID NO: 1433162 - RNA, 22 nt, Human
uguuaccugaaaacacugugca

SEQ ID NO: 1433163 - RNA, 16 nt, Human
uguuaccugaaaacac

SEQ ID NO: 1433164 - RNA, 15 nt, Human
uguuaccugaaaaca

SEQ ID NO: 1433165 - RNA, 16 nt, Human
uguuaccuacuuugac

SEQ ID NO: 1433166 - RNA, 21 nt, Human
uguuacccaguaacucaucug

SEQ ID NO: 1433167 - RNA, 17 nt, Human
uguuaguaugaggcauu

SEQ ID NO: 1433168 - RNA, 19 nt, Human
uguuaguaugaggcauuug

SEQ ID NO: 1433169 - RNA, 20 nt, Human
uguuaguaugaggcauuugu

SEQ ID NO: 1433170 - RNA, 14 nt, Human
uguucagcacuguc

SEQ ID NO: 1433171 - RNA, 13 nt, Human
uguucagcacugu

SEQ ID NO: 1433172 - RNA, 22 nt, Human
uguucagaagguugcucuagau

SEQ ID NO: 1433173 - RNA, 18 nt, Human
uguucagaagguugcucu

SEQ ID NO: 1433174 - RNA, 17 nt, Human
uguucacuuuugacaaa

SEQ ID NO: 1433175 - RNA, 19 nt, Human
uguucacuuuuccucccuc

SEQ ID NO: 1433176 - RNA, 16 nt, Human
uguucacuuuuccucc

SEQ ID NO: 1433177 - RNA, 15 nt, Human
uguuagucauuugcu

SEQ ID NO: 1433178 - RNA, 14 nt, Human
uguuagugcaaauu

SEQ ID NO: 1433179 - RNA, 18 nt, Human
uguucagcacugucccuu

SEQ ID NO: 1433180 - RNA, 17 nt, Human
uguucagcacugucccu

SEQ ID NO: 1433181 - RNA, 15 nt, Human
uguucagcacugucc

SEQ ID NO: 1433182 - RNA, 15 nt, Human
uguucauagcccagu

SEQ ID NO: 1433183 - RNA, 14 nt, Human
uguucauagcccag

SEQ ID NO: 1433184 - RNA, 17 nt, Human
uguucauaaauaaaguu

SEQ ID NO: 1433185 - RNA, 16 nt, Human
ugugugucuuaauuau

SEQ ID NO: 1433186 - RNA, 20 nt, Human
ugugugugaaugaacacucu

SEQ ID NO: 1433187 - RNA, 16 nt, Human
ugugugugaaugaaca

SEQ ID NO: 1433188 - RNA, 17 nt, Human
uguguggcuuucagagc

SEQ ID NO: 1433189 - RNA, 22 nt, Human
ugugugugcccucugggcucug

SEQ ID NO: 1433190 - RNA, 14 nt, Human
ugugugugcccucu

SEQ ID NO: 1433191 - RNA, 12 nt, Human
uguguuuccaca

SEQ ID NO: 1433192 - RNA, 23 nt, Human
uguguuucacaguuugaaauaag

SEQ ID NO: 1433193 - RNA, 19 nt, Human
uguguuucacaguuugaaa

SEQ ID NO: 1433194 - RNA, 18 nt, Human
uguguuucacaguuugaa

SEQ ID NO: 1433195 - RNA, 21 nt, Human
uguguuucacaguuugaaaua

SEQ ID NO: 1433196 - RNA, 13 nt, Human
uguguuugaagca

SEQ ID NO: 1433197 - RNA, 19 nt, Human
uguguuuugcaagccagau

SEQ ID NO: 1433198 - RNA, 13 nt, Human
uguguuuugcaag

SEQ ID NO: 1433199 - RNA, 15 nt, Human
uguguuuuuaacaug

SEQ ID NO: 1433200 - RNA, 19 nt, Human
uguguuuugcuaaaggaaa

SEQ ID NO: 1433201 - RNA, 16 nt, Human
uguguuuugaaagaau

SEQ ID NO: 1433202 - RNA, 17 nt, Human
uguguuucuugccucau

SEQ ID NO: 1433203 - RNA, 15 nt, Human
uguguuuuucauaaa

SEQ ID NO: 1433204 - RNA, 14 nt, Human
uguguuuuucuauu

SEQ ID NO: 1433205 - RNA, 18 nt, Human
uguguuuuucauaaagca

SEQ ID NO: 1433206 - RNA, 14 nt, Human
uguguggauucuuu

SEQ ID NO: 1433207 - RNA, 22 nt, Human
uguguggagagggaaugugaaa

SEQ ID NO: 1433208 - RNA, 14 nt, Human
uguguggacaggac

SEQ ID NO: 1433209 - RNA, 20 nt, Human
ugugugcuuuuuuugugugu

SEQ ID NO: 1433210 - RNA, 20 nt, Human
uguguggcuuucagagccuc

SEQ ID NO: 1433211 - RNA, 21 nt, Human
uguguggagagggaaugugaa

SEQ ID NO: 1433212 - RNA, 21 nt, Human
ugugugcguguuuggguuuuu

SEQ ID NO: 1433213 - RNA, 22 nt, Human
ugugugcaacaggguauggacu

SEQ ID NO: 1433214 - RNA, 23 nt, Human
uguguaugcacaugaacuuagau

SEQ ID NO: 1433215 - RNA, 22 nt, Human
uguguagcugugaccugcugag

SEQ ID NO: 1433216 - RNA, 19 nt, Human
uguguaugcacaugaacuu

SEQ ID NO: 1433217 - RNA, 22 nt, Human
ugugugaaagguacuucaaauc

SEQ ID NO: 1433218 - RNA, 21 nt, Human
ugugugaaagguacuucaaau

SEQ ID NO: 1433219 - RNA, 12 nt, Human
uuuuuuguuauu

SEQ ID NO: 1433220 - RNA, 22 nt, Human
gccugccuuuccauccauggcc

SEQ ID NO: 1433221 - RNA, 21 nt, Human
gccugcgccaccgcccagaga

SEQ ID NO: 1433222 - RNA, 23 nt, Human
gccugccuuuccauccauggcca

SEQ ID NO: 1433223 - RNA, 14 nt, Human
gccugccuuuccau

SEQ ID NO: 1433224 - RNA, 22 nt, Human
gccugccuccccugccucacca

SEQ ID NO: 1433225 - RNA, 23 nt, Human
gccuguguccaugcgcucagggc

SEQ ID NO: 1433226 - RNA, 21 nt, Human
gccuguguccaugcgcucagg

SEQ ID NO: 1433227 - RNA, 20 nt, Human
gccuguguccaugcgcucag

SEQ ID NO: 1433228 - RNA, 10 nt, Human
gccugggagg

SEQ ID NO: 1433229 - RNA, 19 nt, Human
gccugggacaacugcuccc

SEQ ID NO: 1433230 - RNA, 22 nt, Human
gccugggacaacugcucccacc

SEQ ID NO: 1433231 - RNA, 16 nt, Human
gccugggacaacugcu

SEQ ID NO: 1433232 - RNA, 18 nt, Human
gccugggaaagccccugc

SEQ ID NO: 1433233 - RNA, 16 nt, Human
gccugggaaagccccu

SEQ ID NO: 1433234 - RNA, 22 nt, Human
gccuggccuccugccucuacug

SEQ ID NO: 1433235 - RNA, 19 nt, Human
gccuggccuccugccucua

SEQ ID NO: 1433236 - RNA, 16 nt, Human
gccuggccuccugccu

SEQ ID NO: 1433237 - RNA, 15 nt, Human
gccuggccuccugcc

SEQ ID NO: 1433238 - RNA, 14 nt, Human
gccuggccuccugc

SEQ ID NO: 1433239 - RNA, 17 nt, Human
gccuacuccaaaauguu

SEQ ID NO: 1433240 - RNA, 21 nt, Human
gccuaccccgcagacaccuug

SEQ ID NO: 1433241 - RNA, 17 nt, Human
gccuaccccgcagacac

SEQ ID NO: 1433242 - RNA, 14 nt, Human
gccuaccccgcaga

SEQ ID NO: 1433243 - RNA, 12 nt, Human
gccggccccagg

SEQ ID NO: 1433244 - RNA, 14 nt, Human
gccggccccaggcu

SEQ ID NO: 1433245 - RNA, 13 nt, Human
gccuccugccucu

SEQ ID NO: 1433246 - RNA, 12 nt, Human
gccuccugccuc

SEQ ID NO: 1433247 - RNA, 20 nt, Human
gccuccugccggcuccuugg

SEQ ID NO: 1433248 - RNA, 17 nt, Human
gccuccugccggcuccu

SEQ ID NO: 1433249 - RNA, 13 nt, Human
gccuccugccggc

SEQ ID NO: 1433250 - RNA, 21 nt, Human
gccuccucccucccucuccga

SEQ ID NO: 1433251 - RNA, 20 nt, Human
gccuccucccucccucuccg

SEQ ID NO: 1433252 - RNA, 19 nt, Human
gccuccucccucccucucc

SEQ ID NO: 1433253 - RNA, 17 nt, Human
gccuccucccucccucu

SEQ ID NO: 1433254 - RNA, 16 nt, Human
gccuccucccucccuc

SEQ ID NO: 1433255 - RNA, 14 nt, Human
gccuccucccuccc

SEQ ID NO: 1433256 - RNA, 13 nt, Human
gccuccucccucc

SEQ ID NO: 1433257 - RNA, 12 nt, Human
gccuccucccuc

SEQ ID NO: 1433258 - RNA, 11 nt, Human
gccuccucccu

SEQ ID NO: 1433259 - RNA, 22 nt, Human
gccuccucaucccguguucucc

SEQ ID NO: 1433260 - RNA, 17 nt, Human
gccuccucaucccgugu

SEQ ID NO: 1433261 - RNA, 15 nt, Human
gccuccucaucccgu

SEQ ID NO: 1433262 - RNA, 12 nt, Human
gccuccucaucc

SEQ ID NO: 1433263 - RNA, 19 nt, Human
gccucugucuucuggacug

SEQ ID NO: 1433264 - RNA, 23 nt, Human
gccucugucuggcaaugccacag

SEQ ID NO: 1433265 - RNA, 20 nt, Human
gccucugucuggcaaugcca

SEQ ID NO: 1433266 - RNA, 21 nt, Human
gccuccuggcugucugaggcu

SEQ ID NO: 1433267 - RNA, 12 nt, Human
gccugccucacc

SEQ ID NO: 1433268 - RNA, 19 nt, Human
gccugccgagcaaccgugg

SEQ ID NO: 1433269 - RNA, 20 nt, Human
gccugccgagcaaccguggc

SEQ ID NO: 1433270 - RNA, 16 nt, Human
gccugccgagcaaccg

SEQ ID NO: 1433271 - RNA, 14 nt, Human
gccugccgagcaac

SEQ ID NO: 1433272 - RNA, 12 nt, Human
gccugccgagca

SEQ ID NO: 1433273 - RNA, 22 nt, Human
gccucuugaccaggcugccucc

SEQ ID NO: 1433274 - RNA, 21 nt, Human
gccucuugagcaguggcuggu

SEQ ID NO: 1433275 - RNA, 20 nt, Human
gccucuugagcaguggcugg

SEQ ID NO: 1433276 - RNA, 19 nt, Human
gccucuugagcaguggcug

SEQ ID NO: 1433277 - RNA, 18 nt, Human
gccucuugagcaguggcu

SEQ ID NO: 1433278 - RNA, 20 nt, Human
gccucuugaccaggcugccu

SEQ ID NO: 1433279 - RNA, 17 nt, Human
gccucuugaccaggcug

SEQ ID NO: 1433280 - RNA, 16 nt, Human
gccucuugaccaggcu

SEQ ID NO: 1433281 - RNA, 15 nt, Human
gccucuugaccaggc

SEQ ID NO: 1433282 - RNA, 14 nt, Human
gccucuugaccagg

SEQ ID NO: 1433283 - RNA, 13 nt, Human
gccucuugaccag

SEQ ID NO: 1433284 - RNA, 18 nt, Human
gccucugucuucuggacu

SEQ ID NO: 1433285 - RNA, 18 nt, Human
gccucugugcugugugug

SEQ ID NO: 1433286 - RNA, 17 nt, Human
gccucugugcugugugu

SEQ ID NO: 1433287 - RNA, 14 nt, Human
gccucugugcugug

SEQ ID NO: 1433288 - RNA, 12 nt, Human
gccucugugcug

SEQ ID NO: 1433289 - RNA, 11 nt, Human
gccucugugcu

SEQ ID NO: 1433290 - RNA, 18 nt, Human
gccucuucugggagggca

SEQ ID NO: 1433291 - RNA, 15 nt, Human
gccucuucugggagg

SEQ ID NO: 1433292 - RNA, 14 nt, Human
gccucuucugggag

SEQ ID NO: 1433293 - RNA, 14 nt, Human
gccggccagccccu

SEQ ID NO: 1433294 - RNA, 12 nt, Human
gccggccagccc

SEQ ID NO: 1433295 - RNA, 19 nt, Human
gccgcuuggcgaugccagc

SEQ ID NO: 1433296 - RNA, 12 nt, Human
gccgcugccacg

SEQ ID NO: 1433297 - RNA, 16 nt, Human
gccgcugaguggcagg

SEQ ID NO: 1433298 - RNA, 17 nt, Human
gccgcugagcgaggaga

SEQ ID NO: 1433299 - RNA, 15 nt, Human
gccgcugagcgagga

SEQ ID NO: 1433300 - RNA, 18 nt, Human
gcccugcugcugccugcc

SEQ ID NO: 1433301 - RNA, 12 nt, Human
gcccuacuggga

SEQ ID NO: 1433302 - RNA, 18 nt, Human
gcccuaccugccccacuu

SEQ ID NO: 1433303 - RNA, 16 nt, Human
gcccuaccugccccac

SEQ ID NO: 1433304 - RNA, 21 nt, Human
gcccuaccugccccacuuguc

SEQ ID NO: 1433305 - RNA, 15 nt, Human
gcccuacagcacccu

SEQ ID NO: 1433306 - RNA, 23 nt, Human
gccccuggcagagaugccucccu

SEQ ID NO: 1433307 - RNA, 22 nt, Human
gccccuggcagagaugccuccc

SEQ ID NO: 1433308 - RNA, 21 nt, Human
gccccuggcagagaugccucc

SEQ ID NO: 1433309 - RNA, 17 nt, Human
gccccuggcagagaugc

SEQ ID NO: 1433310 - RNA, 13 nt, Human
gccccuggcagag

SEQ ID NO: 1433311 - RNA, 22 nt, Human
gcccuaaaguguauuuuuuuac

SEQ ID NO: 1433312 - RNA, 19 nt, Human
gcccccaucauccucuggc

SEQ ID NO: 1433313 - RNA, 21 nt, Human
gcccccuccucuagcuguggg

SEQ ID NO: 1433314 - RNA, 20 nt, Human
gcccccuccucuagcugugg

SEQ ID NO: 1433315 - RNA, 19 nt, Human
gcccccuccucuagcugug

SEQ ID NO: 1433316 - RNA, 16 nt, Human
gcccccuccucuagcu

SEQ ID NO: 1433317 - RNA, 22 nt, Human
gcccccuccgcccugccacuca

SEQ ID NO: 1433318 - RNA, 20 nt, Human
gcccccuccgcccugccacu

SEQ ID NO: 1433319 - RNA, 18 nt, Human
gcccccuccgcccugcca

SEQ ID NO: 1433320 - RNA, 18 nt, Human
gcccccaucucaugcccc

SEQ ID NO: 1433321 - RNA, 13 nt, Human
gcccccaucucau

SEQ ID NO: 1433322 - RNA, 18 nt, Human
gcccccaucauccucugg

SEQ ID NO: 1433323 - RNA, 17 nt, Human
gcccccaucauccucug

SEQ ID NO: 1433324 - RNA, 14 nt, Human
gcccccagguaggg

SEQ ID NO: 1433325 - RNA, 19 nt, Human
gcccccaggguccugggag

SEQ ID NO: 1433326 - RNA, 22 nt, Human
gcccccaguaucucuucagucu

SEQ ID NO: 1433327 - RNA, 19 nt, Human
gcccacuccaucugguaga

SEQ ID NO: 1433328 - RNA, 18 nt, Human
gcccacuccaucugguag

SEQ ID NO: 1433329 - RNA, 15 nt, Human
gcccacuccaucugg

SEQ ID NO: 1433330 - RNA, 20 nt, Human
gcccaugggagcugguuaga

SEQ ID NO: 1433331 - RNA, 23 nt, Human
gcccauggagauugaccuggaug

SEQ ID NO: 1433332 - RNA, 19 nt, Human
gccacauuuggaauacuuu

SEQ ID NO: 1433333 - RNA, 22 nt, Human
gccacauuuggaauacuuuuug

SEQ ID NO: 1433334 - RNA, 14 nt, Human
gccacauuuggaau

SEQ ID NO: 1433335 - RNA, 15 nt, Human
gccacaugggaggcu

SEQ ID NO: 1433336 - RNA, 13 nt, Human
gccaccaugcccg

SEQ ID NO: 1433337 - RNA, 19 nt, Human
gccaccaguucucaugggu

SEQ ID NO: 1433338 - RNA, 13 nt, Human
gccaccaguucuc

SEQ ID NO: 1433339 - RNA, 11 nt, Human
gccaccaguuc

SEQ ID NO: 1433340 - RNA, 20 nt, Human
gccaccaggccaccucccca

SEQ ID NO: 1433341 - RNA, 18 nt, Human
gccaccaggccaccuccc

SEQ ID NO: 1433342 - RNA, 15 nt, Human
gccaccaggccaccu

SEQ ID NO: 1433343 - RNA, 12 nt, Human
gccaccaggcca

SEQ ID NO: 1433344 - RNA, 22 nt, Human
gccaccaagagggacgccuggg

SEQ ID NO: 1433345 - RNA, 19 nt, Human
gccaccaagagggacgccu

SEQ ID NO: 1433346 - RNA, 14 nt, Human
gccaccaagaggga

SEQ ID NO: 1433347 - RNA, 16 nt, Human
gccacuguuguuuugg

SEQ ID NO: 1433348 - RNA, 19 nt, Human
gccacuuaauguauguuac

SEQ ID NO: 1433349 - RNA, 18 nt, Human
gccacuuaauguauguua

SEQ ID NO: 1433350 - RNA, 16 nt, Human
gccacuuaauguaugu

SEQ ID NO: 1433351 - RNA, 13 nt, Human
gccacuuaaugua

SEQ ID NO: 1433352 - RNA, 18 nt, Human
gccacuuaaaauguucac

SEQ ID NO: 1433353 - RNA, 20 nt, Human
gccacuguguuccuuccgcu

SEQ ID NO: 1433354 - RNA, 18 nt, Human
gccacuguguuccuuccg

SEQ ID NO: 1433355 - RNA, 23 nt, Human
gccacugcuuuucccuuugugag

SEQ ID NO: 1433356 - RNA, 22 nt, Human
gccacuggagugugcguggugg

SEQ ID NO: 1433357 - RNA, 22 nt, Human
gccacugccuucgcuucuugcc

SEQ ID NO: 1433358 - RNA, 23 nt, Human
gccacugccuucgcuucuugccu

SEQ ID NO: 1433359 - RNA, 18 nt, Human
gccacugccuucgcuucu

SEQ ID NO: 1433360 - RNA, 16 nt, Human
gccacuguguuccuuc

SEQ ID NO: 1433361 - RNA, 15 nt, Human
gccacuguguuccuu

SEQ ID NO: 1433362 - RNA, 19 nt, Human
gccacuggggcucagagcc

SEQ ID NO: 1433363 - RNA, 18 nt, Human
gccacuggggcucagagc

SEQ ID NO: 1433364 - RNA, 17 nt, Human
gccacuggggcucagag

SEQ ID NO: 1433365 - RNA, 16 nt, Human
gccacuggggcucaga

SEQ ID NO: 1433366 - RNA, 15 nt, Human
gccacuggggcucag

SEQ ID NO: 1433367 - RNA, 14 nt, Human
gccacuggggcuca

SEQ ID NO: 1433368 - RNA, 12 nt, Human
gccacuggggcu

SEQ ID NO: 1433369 - RNA, 19 nt, Human
gccacugccauuaaagaau

SEQ ID NO: 1433370 - RNA, 13 nt, Human
gccacccaggauc

SEQ ID NO: 1433371 - RNA, 12 nt, Human
gccacccaggau

SEQ ID NO: 1433372 - RNA, 23 nt, Human
gccacccagccccagccagggcu

SEQ ID NO: 1433373 - RNA, 15 nt, Human
gccacccagccccag

SEQ ID NO: 1433374 - RNA, 14 nt, Human
gccacccagcccca

SEQ ID NO: 1433375 - RNA, 13 nt, Human
gccacccucaugc

SEQ ID NO: 1433376 - RNA, 23 nt, Human
gccacccugaggagucugagguc

SEQ ID NO: 1433377 - RNA, 22 nt, Human
gccacccugaggagucugaggu

SEQ ID NO: 1433378 - RNA, 20 nt, Human
gccacccugaggagucugag

SEQ ID NO: 1433379 - RNA, 19 nt, Human
gccacccugaggagucuga

SEQ ID NO: 1433380 - RNA, 16 nt, Human
gccacccugaggaguc

SEQ ID NO: 1433381 - RNA, 14 nt, Human
gccacccugaggag

SEQ ID NO: 1433382 - RNA, 13 nt, Human
gccacccugagga

SEQ ID NO: 1433383 - RNA, 12 nt, Human
gccacccugagg

SEQ ID NO: 1433384 - RNA, 15 nt, Human
gccacccucaugcug

SEQ ID NO: 1433385 - RNA, 16 nt, Human
gccacccucaugcugu

SEQ ID NO: 1433386 - RNA, 21 nt, Human
gcacuuggggcaccuugcucc

SEQ ID NO: 1433387 - RNA, 17 nt, Human
gcacuuggggcaccuug

SEQ ID NO: 1433388 - RNA, 16 nt, Human
gcacuuggcagccuug

SEQ ID NO: 1433389 - RNA, 15 nt, Human
gcacuuggcugcaua

SEQ ID NO: 1433390 - RNA, 13 nt, Human
gcacuuggcccuu

SEQ ID NO: 1433391 - RNA, 13 nt, Human
gcacuuggcagcc

SEQ ID NO: 1433392 - RNA, 16 nt, Human
gccauucucaagcccu

SEQ ID NO: 1433393 - RNA, 18 nt, Human
gccauucucaagcccugc

SEQ ID NO: 1433394 - RNA, 21 nt, Human
gccaugucuucucccuggaau

SEQ ID NO: 1433395 - RNA, 22 nt, Human
gccauucacuucauaauccagu

SEQ ID NO: 1433396 - RNA, 21 nt, Human
gccauucacuucauaauccag

SEQ ID NO: 1433397 - RNA, 15 nt, Human
gcccacgacacugca

SEQ ID NO: 1433398 - RNA, 19 nt, Human
gcccacgacacugcagccc

SEQ ID NO: 1433399 - RNA, 17 nt, Human
gcccacgcucacccccu

SEQ ID NO: 1433400 - RNA, 17 nt, Human
gccauucuccacagcaa

SEQ ID NO: 1433401 - RNA, 20 nt, Human
gccauucuccugccucagcc

SEQ ID NO: 1433402 - RNA, 22 nt, Human
gccauguccaaagaggcugccc

SEQ ID NO: 1433403 - RNA, 19 nt, Human
gccauguccaaagaggcug

SEQ ID NO: 1433404 - RNA, 18 nt, Human
gccauguccaaagaggcu

SEQ ID NO: 1433405 - RNA, 15 nt, Human
gccauguccaaagag

SEQ ID NO: 1433406 - RNA, 14 nt, Human
gccauguccaaaga

SEQ ID NO: 1433407 - RNA, 17 nt, Human
gccaugucaaacaaaua

SEQ ID NO: 1433408 - RNA, 22 nt, Human
gccaugucuucucccuggaaug

SEQ ID NO: 1433409 - RNA, 14 nt, Human
gccaugucuucucc

SEQ ID NO: 1433410 - RNA, 23 nt, Human
gccauauuaaauuuuuuguugac

SEQ ID NO: 1433411 - RNA, 20 nt, Human
gccauauuaaauuuuuuguu

SEQ ID NO: 1433412 - RNA, 21 nt, Human
gccauauugcacaugucuuaa

SEQ ID NO: 1433413 - RNA, 22 nt, Human
gccauauugcacaugucuuaau

SEQ ID NO: 1433414 - RNA, 16 nt, Human
gccauauuaaauuuuu

SEQ ID NO: 1433415 - RNA, 14 nt, Human
gccauauuaaauuu

SEQ ID NO: 1433416 - RNA, 17 nt, Human
gccauaugauuuacauu

SEQ ID NO: 1433417 - RNA, 16 nt, Human
gccauaugauuuacau

SEQ ID NO: 1433418 - RNA, 14 nt, Human
gccagcaucugggc

SEQ ID NO: 1433419 - RNA, 15 nt, Human
gccagcaucugggcc

SEQ ID NO: 1433420 - RNA, 13 nt, Human
gccagcaucuggg

SEQ ID NO: 1433421 - RNA, 19 nt, Human
gccagcagcaccugcccua

SEQ ID NO: 1433422 - RNA, 16 nt, Human
gccagcagcaccugcc

SEQ ID NO: 1433423 - RNA, 14 nt, Human
gccagcagcaccug

SEQ ID NO: 1433424 - RNA, 13 nt, Human
gccagcagcaccu

SEQ ID NO: 1433425 - RNA, 20 nt, Human
gccagcacuuguccagcuga

SEQ ID NO: 1433426 - RNA, 19 nt, Human
gccagcacuuguccagcug

SEQ ID NO: 1433427 - RNA, 14 nt, Human
gccagcacuugucc

SEQ ID NO: 1433428 - RNA, 18 nt, Human
gccagcacucgcuagcag

SEQ ID NO: 1433429 - RNA, 23 nt, Human
gccagcacucgcuagcaguggca

SEQ ID NO: 1433430 - RNA, 14 nt, Human
gccagcaccuggca

SEQ ID NO: 1433431 - RNA, 22 nt, Human
gccagcaccggaccagccuggc

SEQ ID NO: 1433432 - RNA, 21 nt, Human
gccagcaccggaccagccugg

SEQ ID NO: 1433433 - RNA, 21 nt, Human
gccagaaguaccagacuagau

SEQ ID NO: 1433434 - RNA, 18 nt, Human
gccagaaguaccagacua

SEQ ID NO: 1433435 - RNA, 17 nt, Human
gccagaaguaccagacu

SEQ ID NO: 1433436 - RNA, 14 nt, Human
gccagaaguaccag

SEQ ID NO: 1433437 - RNA, 14 nt, Human
gccagaagcuacug

SEQ ID NO: 1433438 - RNA, 17 nt, Human
gccagacacaggcccuc

SEQ ID NO: 1433439 - RNA, 16 nt, Human
gccagacacaggcccu

SEQ ID NO: 1433440 - RNA, 18 nt, Human
gccagacaugccacaagg

SEQ ID NO: 1433441 - RNA, 20 nt, Human
gccagcaccggaccagccug

SEQ ID NO: 1433442 - RNA, 19 nt, Human
gccagcaccggaccagccu

SEQ ID NO: 1433443 - RNA, 18 nt, Human
gccagcaccggaccagcc

SEQ ID NO: 1433444 - RNA, 15 nt, Human
gccagcaccggacca

SEQ ID NO: 1433445 - RNA, 22 nt, Human
gccagcacacagggcagugagg

SEQ ID NO: 1433446 - RNA, 18 nt, Human
gccagcacacagggcagu

SEQ ID NO: 1433447 - RNA, 17 nt, Human
gccagcacacagggcag

SEQ ID NO: 1433448 - RNA, 16 nt, Human
gccagcacacagggca

SEQ ID NO: 1433449 - RNA, 15 nt, Human
gccagcacacagggc

SEQ ID NO: 1433450 - RNA, 13 nt, Human
gccagcacacagg

SEQ ID NO: 1433451 - RNA, 12 nt, Human
gccagcacacag

SEQ ID NO: 1433452 - RNA, 16 nt, Human
gccagauuuuuuaaaa

SEQ ID NO: 1433453 - RNA, 23 nt, Human
gccagauuuuuuaaaauuuauau

SEQ ID NO: 1433454 - RNA, 13 nt, Human
gccagauuuuuua

SEQ ID NO: 1433455 - RNA, 12 nt, Human
gccagauuuuuu

SEQ ID NO: 1433456 - RNA, 13 nt, Human
gccagaccaugga

SEQ ID NO: 1433457 - RNA, 16 nt, Human
gccagaccauggacac

SEQ ID NO: 1433458 - RNA, 17 nt, Human
gccagaccauggacacu

SEQ ID NO: 1433459 - RNA, 18 nt, Human
gccaggaggugccacugg

SEQ ID NO: 1433460 - RNA, 17 nt, Human
gccaggaggugccacug

SEQ ID NO: 1433461 - RNA, 23 nt, Human
gccaggagggacaaaggagccug

SEQ ID NO: 1433462 - RNA, 22 nt, Human
gccaggagggacaaaggagccu

SEQ ID NO: 1433463 - RNA, 21 nt, Human
gccaggagggacaaaggagcc

SEQ ID NO: 1433464 - RNA, 22 nt, Human
gccaggauggaacacggccaca

SEQ ID NO: 1433465 - RNA, 20 nt, Human
gccaggauggaacacggcca

SEQ ID NO: 1433466 - RNA, 19 nt, Human
gccaggagggacaaaggag

SEQ ID NO: 1433467 - RNA, 13 nt, Human
gccaggagggaca

SEQ ID NO: 1433468 - RNA, 22 nt, Human
gccaggaggacccagggcucug

SEQ ID NO: 1433469 - RNA, 19 nt, Human
gccaggaggacccagggcu

SEQ ID NO: 1433470 - RNA, 17 nt, Human
gccaggaggacccaggg

SEQ ID NO: 1433471 - RNA, 16 nt, Human
gccaggaggacccagg

SEQ ID NO: 1433472 - RNA, 15 nt, Human
gccaggaggacccag

SEQ ID NO: 1433473 - RNA, 13 nt, Human
gccaggagcuggg

SEQ ID NO: 1433474 - RNA, 22 nt, Human
gccaggagcugggcagaaggcc

SEQ ID NO: 1433475 - RNA, 23 nt, Human
gccaggagcugggcagaaggcca

SEQ ID NO: 1433476 - RNA, 19 nt, Human
gccagccaagcucugcagu

SEQ ID NO: 1433477 - RNA, 16 nt, Human
gccagccaagcucugc

SEQ ID NO: 1433478 - RNA, 15 nt, Human
gccagccaagcucug

SEQ ID NO: 1433479 - RNA, 21 nt, Human
gccagccaagcucugcagucc

SEQ ID NO: 1433480 - RNA, 20 nt, Human
gccagccaagcucugcaguc

SEQ ID NO: 1433481 - RNA, 21 nt, Human
gccagccacggggacucagcc

SEQ ID NO: 1433482 - RNA, 23 nt, Human
gccaggccucucccuccuccagg

SEQ ID NO: 1433483 - RNA, 14 nt, Human
gccaggccucuccc

SEQ ID NO: 1433484 - RNA, 13 nt, Human
gccaggccgggaa

SEQ ID NO: 1433485 - RNA, 16 nt, Human
gcucugagaggcccug

SEQ ID NO: 1433486 - RNA, 15 nt, Human
gcucugagaggcccu

SEQ ID NO: 1433487 - RNA, 10 nt, Human
gcucugagaa

SEQ ID NO: 1433488 - RNA, 11 nt, Human
gcucugagaac

SEQ ID NO: 1433489 - RNA, 23 nt, Human
gcucugcaauuccccucugcugc

SEQ ID NO: 1433490 - RNA, 18 nt, Human
gcucugcaauuccccucu

SEQ ID NO: 1433491 - RNA, 21 nt, Human
gcucugagagucuagauucuc

SEQ ID NO: 1433492 - RNA, 20 nt, Human
gcucugagagucuagauucu

SEQ ID NO: 1433493 - RNA, 18 nt, Human
gcucugagagucuagauu

SEQ ID NO: 1433494 - RNA, 14 nt, Human
gcucugagagucua

SEQ ID NO: 1433495 - RNA, 13 nt, Human
gcucugagagucu

SEQ ID NO: 1433496 - RNA, 23 nt, Human
gcucugagaggcccuggaucagc

SEQ ID NO: 1433497 - RNA, 20 nt, Human
gcucugagaggcccuggauc

SEQ ID NO: 1433498 - RNA, 18 nt, Human
gcucugagaggcccugga

SEQ ID NO: 1433499 - RNA, 17 nt, Human
gcucugagaggcccugg

SEQ ID NO: 1433500 - RNA, 16 nt, Human
gcucuggaggggaggg

SEQ ID NO: 1433501 - RNA, 15 nt, Human
gcucuggaggggagg

SEQ ID NO: 1433502 - RNA, 13 nt, Human
gcucuggagggga

SEQ ID NO: 1433503 - RNA, 23 nt, Human
gcucuggagcccacuguacuugc

SEQ ID NO: 1433504 - RNA, 18 nt, Human
gcugagcucugagaggcc

SEQ ID NO: 1433505 - RNA, 17 nt, Human
gcugagcucugagaggc

SEQ ID NO: 1433506 - RNA, 16 nt, Human
gcugagcucugagagg

SEQ ID NO: 1433507 - RNA, 15 nt, Human
gcugagcucugagag

SEQ ID NO: 1433508 - RNA, 14 nt, Human
gcugagcucugaga

SEQ ID NO: 1433509 - RNA, 13 nt, Human
gcugagcucugag

SEQ ID NO: 1433510 - RNA, 14 nt, Human
gcugagcucucugu

SEQ ID NO: 1433511 - RNA, 23 nt, Human
gcugagcucacaaggcagcaagg

SEQ ID NO: 1433512 - RNA, 22 nt, Human
gcugagcucacaaggcagcaag

SEQ ID NO: 1433513 - RNA, 21 nt, Human
gcugagcucacaaggcagcaa

SEQ ID NO: 1433514 - RNA, 20 nt, Human
gcugagcucacaaggcagca

SEQ ID NO: 1433515 - RNA, 19 nt, Human
gcugagcucacaaggcagc

SEQ ID NO: 1433516 - RNA, 16 nt, Human
gcugagcucacaaggc

SEQ ID NO: 1433517 - RNA, 14 nt, Human
gcugagcgccagga

SEQ ID NO: 1433518 - RNA, 15 nt, Human
gcugaauguuuuucu

SEQ ID NO: 1433519 - RNA, 17 nt, Human
gcugaauguuuuucuaa

SEQ ID NO: 1433520 - RNA, 13 nt, Human
gcugaauguuuuu

SEQ ID NO: 1433521 - RNA, 23 nt, Human
gcugaauguugggacugcuaaau

SEQ ID NO: 1433522 - RNA, 20 nt, Human
gcugaauguugggacugcua

SEQ ID NO: 1433523 - RNA, 17 nt, Human
gcugaauguugggacug

SEQ ID NO: 1433524 - RNA, 16 nt, Human
gcugaauagcuucucc

SEQ ID NO: 1433525 - RNA, 19 nt, Human
gcugaauaggcgaucacaa

SEQ ID NO: 1433526 - RNA, 17 nt, Human
gcugaaauuuuauaugc

SEQ ID NO: 1433527 - RNA, 15 nt, Human
gcugaaauuuuauau

SEQ ID NO: 1433528 - RNA, 18 nt, Human
gcugaaauucuccuggag

SEQ ID NO: 1433529 - RNA, 17 nt, Human
gcugaaauucuccugga

SEQ ID NO: 1433530 - RNA, 16 nt, Human
gcugaaauucuccugg

SEQ ID NO: 1433531 - RNA, 15 nt, Human
gcugaaauucuccug

SEQ ID NO: 1433532 - RNA, 14 nt, Human
gcugaaauucuccu

SEQ ID NO: 1433533 - RNA, 14 nt, Human
gcucuucauguuuc

SEQ ID NO: 1433534 - RNA, 16 nt, Human
gcucuuagcagcuucc

SEQ ID NO: 1433535 - RNA, 13 nt, Human
gcucuuaauugcc

SEQ ID NO: 1433536 - RNA, 14 nt, Human
gcucuuaauugcca

SEQ ID NO: 1433537 - RNA, 18 nt, Human
gcucuuagcagcuuccag

SEQ ID NO: 1433538 - RNA, 17 nt, Human
gcucuuagcagcuucca

SEQ ID NO: 1433539 - RNA, 19 nt, Human
gcucuuagcagcuuccaga

SEQ ID NO: 1433540 - RNA, 18 nt, Human
gcucuggauaacaagacu

SEQ ID NO: 1433541 - RNA, 23 nt, Human
gcucuguucuuccucagccagcc

SEQ ID NO: 1433542 - RNA, 22 nt, Human
gcucuguucuuccucagccagc

SEQ ID NO: 1433543 - RNA, 21 nt, Human
gcucuguucuuccucagccag

SEQ ID NO: 1433544 - RNA, 20 nt, Human
gcucuguucuuccucagcca

SEQ ID NO: 1433545 - RNA, 19 nt, Human
gcucuguucuuccucagcc

SEQ ID NO: 1433546 - RNA, 18 nt, Human
gcucuguucuuccucagc

SEQ ID NO: 1433547 - RNA, 14 nt, Human
gcucuguucuuccu

SEQ ID NO: 1433548 - RNA, 15 nt, Human
gcucggaggaagccc

SEQ ID NO: 1433549 - RNA, 21 nt, Human
gcucgcuguugcugaauaggc

SEQ ID NO: 1433550 - RNA, 14 nt, Human
gcucgcuguugcug

SEQ ID NO: 1433551 - RNA, 16 nt, Human
gcucgcuguugcugaa

SEQ ID NO: 1433552 - RNA, 13 nt, Human
gcucgcucccugc

SEQ ID NO: 1433553 - RNA, 13 nt, Human
gcucgcuguugcu

SEQ ID NO: 1433554 - RNA, 23 nt, Human
gcuccugcuaacggugcucaggg

SEQ ID NO: 1433555 - RNA, 22 nt, Human
gcuccugcuaacggugcucagg

SEQ ID NO: 1433556 - RNA, 21 nt, Human
gcucggccugcccccacccca

SEQ ID NO: 1433557 - RNA, 17 nt, Human
gcucggccugcccccac

SEQ ID NO: 1433558 - RNA, 15 nt, Human
gcucggccugccccc

SEQ ID NO: 1433559 - RNA, 14 nt, Human
gcucggccugcccc

SEQ ID NO: 1433560 - RNA, 21 nt, Human
gcucuaacgccugagcccagg

SEQ ID NO: 1433561 - RNA, 20 nt, Human
gcucuaacgccugagcccag

SEQ ID NO: 1433562 - RNA, 16 nt, Human
gcucggggugcacagg

SEQ ID NO: 1433563 - RNA, 18 nt, Human
gcucuaacgccugagccc

SEQ ID NO: 1433564 - RNA, 12 nt, Human
gcucuaauacau

SEQ ID NO: 1433565 - RNA, 22 nt, Human
gcucuaacgccugagcccaggg

SEQ ID NO: 1433566 - RNA, 23 nt, Human
gcucuaacgccugagcccaggga

SEQ ID NO: 1433567 - RNA, 17 nt, Human
gcuccucugucucgagc

SEQ ID NO: 1433568 - RNA, 13 nt, Human
gcuccucugucuc

SEQ ID NO: 1433569 - RNA, 12 nt, Human
gcuccucugcuu

SEQ ID NO: 1433570 - RNA, 21 nt, Human
gcuccccuccccaacugacca

SEQ ID NO: 1433571 - RNA, 20 nt, Human
gcuccugaccaguugcaguc

SEQ ID NO: 1433572 - RNA, 19 nt, Human
gcuccugaccaguugcagu

SEQ ID NO: 1433573 - RNA, 15 nt, Human
gcuccugaccaguug

SEQ ID NO: 1433574 - RNA, 19 nt, Human
gcuccugacacugcuggag

SEQ ID NO: 1433575 - RNA, 18 nt, Human
gcuccugacacugcugga

SEQ ID NO: 1433576 - RNA, 17 nt, Human
gcuccugacacugcugg

SEQ ID NO: 1433577 - RNA, 16 nt, Human
gcuccugacacugcug

SEQ ID NO: 1433578 - RNA, 23 nt, Human
gcuccucuuccccagacgccugg

SEQ ID NO: 1433579 - RNA, 16 nt, Human
gcuccucuuccccaga

SEQ ID NO: 1433580 - RNA, 15 nt, Human
gcuccucuuccccag

SEQ ID NO: 1433581 - RNA, 14 nt, Human
gcuccucuucccca

SEQ ID NO: 1433582 - RNA, 22 nt, Human
gcuccucuuccaugcugugcgc

SEQ ID NO: 1433583 - RNA, 23 nt, Human
gcuccucugucucgagcgcccug

SEQ ID NO: 1433584 - RNA, 22 nt, Human
gcuccucugucucgagcgcccu

SEQ ID NO: 1433585 - RNA, 21 nt, Human
gcuccucugucucgagcgccc

SEQ ID NO: 1433586 - RNA, 12 nt, Human
gcuccugcccac

SEQ ID NO: 1433587 - RNA, 21 nt, Human
gcuccugaccaguugcaguca

SEQ ID NO: 1433588 - RNA, 24 nt, Human
gcuccugaccaguugcagucacuc

SEQ ID NO: 1433589 - RNA, 14 nt, Human
gcuccccuccccaa

SEQ ID NO: 1433590 - RNA, 19 nt, Human
gcuccccuaaagccucaaa

SEQ ID NO: 1433591 - RNA, 20 nt, Human
gcuccccacucugcucugau

SEQ ID NO: 1433592 - RNA, 22 nt, Human
gcuccccacucugcucugaugc

SEQ ID NO: 1433593 - RNA, 19 nt, Human
gcuccccacucugcucuga

SEQ ID NO: 1433594 - RNA, 18 nt, Human
gcuccccacucugcucug

SEQ ID NO: 1433595 - RNA, 17 nt, Human
gcuccccacucugcucu

SEQ ID NO: 1433596 - RNA, 16 nt, Human
gcuccccacucugcuc

SEQ ID NO: 1433597 - RNA, 14 nt, Human
gcuccccacucugc

SEQ ID NO: 1433598 - RNA, 17 nt, Human
gcucuacaucuucugcc

SEQ ID NO: 1433599 - RNA, 16 nt, Human
gcucuacaucuucugc

SEQ ID NO: 1433600 - RNA, 19 nt, Human
gcucuaauucacagugcuc

SEQ ID NO: 1433601 - RNA, 18 nt, Human
gcucuaauucacagugcu

SEQ ID NO: 1433602 - RNA, 16 nt, Human
gcucuaauucacagug

SEQ ID NO: 1433603 - RNA, 15 nt, Human
gcucuaauucacagu

SEQ ID NO: 1433604 - RNA, 17 nt, Human
gcucaggugcuggggcc

SEQ ID NO: 1433605 - RNA, 21 nt, Human
gcucaggucacauaaaacuuu

SEQ ID NO: 1433606 - RNA, 19 nt, Human
gcucaggucccuggggcua

SEQ ID NO: 1433607 - RNA, 21 nt, Human
gcucaggugcuggggccuggu

SEQ ID NO: 1433608 - RNA, 20 nt, Human
gcucacguccugagaaagcu

SEQ ID NO: 1433609 - RNA, 18 nt, Human
gcucaccuugugcugggg

SEQ ID NO: 1433610 - RNA, 14 nt, Human
gcucaggagcccug

SEQ ID NO: 1433611 - RNA, 15 nt, Human
gcucaggucccuggg

SEQ ID NO: 1433612 - RNA, 16 nt, Human
gcucagguacuuguaa

SEQ ID NO: 1433613 - RNA, 17 nt, Human
gcucagggggcgccugu

SEQ ID NO: 1433614 - RNA, 23 nt, Human
gcucagggccaugcugaggccug

SEQ ID NO: 1433615 - RNA, 21 nt, Human
gcucaggagcccugggaggcu

SEQ ID NO: 1433616 - RNA, 15 nt, Human
gcucaggagcccugg

SEQ ID NO: 1433617 - RNA, 18 nt, Human
gcucaggagcccugggag

SEQ ID NO: 1433618 - RNA, 15 nt, Human
gcuauuucaucuauu

SEQ ID NO: 1433619 - RNA, 14 nt, Human
gcuauuucaucuau

SEQ ID NO: 1433620 - RNA, 13 nt, Human
gcuauuuaaaacu

SEQ ID NO: 1433621 - RNA, 14 nt, Human
gcuauuuaaaacuu

SEQ ID NO: 1433622 - RNA, 13 nt, Human
gcuaugguuuucu

SEQ ID NO: 1433623 - RNA, 18 nt, Human
gcuauggugcucugucua

SEQ ID NO: 1433624 - RNA, 18 nt, Human
gcuaugucccaggaauca

SEQ ID NO: 1433625 - RNA, 19 nt, Human
gcuaggccagagcccacuc

SEQ ID NO: 1433626 - RNA, 17 nt, Human
gcuaggccagagcccac

SEQ ID NO: 1433627 - RNA, 16 nt, Human
gcuaggccagagccca

SEQ ID NO: 1433628 - RNA, 19 nt, Human
gcuaggagcaaagccuguu

SEQ ID NO: 1433629 - RNA, 18 nt, Human
gcuaggagcaaagccugu

SEQ ID NO: 1433630 - RNA, 17 nt, Human
gcuaggagcaaagccug

SEQ ID NO: 1433631 - RNA, 16 nt, Human
gcuaggagcaaagccu

SEQ ID NO: 1433632 - RNA, 15 nt, Human
gcuaggagcaaagcc

SEQ ID NO: 1433633 - RNA, 12 nt, Human
gcuaggaagagg

SEQ ID NO: 1433634 - RNA, 17 nt, Human
gcuaggaagaggagugg

SEQ ID NO: 1433635 - RNA, 20 nt, Human
gcuaggaagagcaggacucc

SEQ ID NO: 1433636 - RNA, 16 nt, Human
gccuguucauggcaga

SEQ ID NO: 1433637 - RNA, 15 nt, Human
gccuguucauggcag

SEQ ID NO: 1433638 - RNA, 21 nt, Human
gccuguuagcaugcuggugag

SEQ ID NO: 1433639 - RNA, 20 nt, Human
gccuguguucuuccuggccg

SEQ ID NO: 1433640 - RNA, 18 nt, Human
gccuguguucuuccuggc

SEQ ID NO: 1433641 - RNA, 17 nt, Human
gccuguguucuuccugg

SEQ ID NO: 1433642 - RNA, 14 nt, Human
gcugagggagccug

SEQ ID NO: 1433643 - RNA, 18 nt, Human
gcugaggcuggcacagga

SEQ ID NO: 1433644 - RNA, 16 nt, Human
gcugaggcuggcacag

SEQ ID NO: 1433645 - RNA, 15 nt, Human
gcugaggcuggcaca

SEQ ID NO: 1433646 - RNA, 18 nt, Human
gcugaggaggcaccuaca

SEQ ID NO: 1433647 - RNA, 16 nt, Human
gcugaggagcagcagg

SEQ ID NO: 1433648 - RNA, 12 nt, Human
gcugaggagcag

SEQ ID NO: 1433649 - RNA, 23 nt, Human
gcugagcucugagaggcccugga

SEQ ID NO: 1433650 - RNA, 22 nt, Human
gcugagcugcccacagcaggcc

SEQ ID NO: 1433651 - RNA, 22 nt, Human
gcugagcucugagaggcccugg

SEQ ID NO: 1433652 - RNA, 21 nt, Human
gcugagcucugagaggcccug

SEQ ID NO: 1433653 - RNA, 20 nt, Human
gcugagcucugagaggcccu

SEQ ID NO: 1433654 - RNA, 19 nt, Human
gcugagcucugagaggccc

SEQ ID NO: 1433655 - RNA, 20 nt, Human
gcugagggcaguucgcagcc

SEQ ID NO: 1433656 - RNA, 12 nt, Human
gcugagggcagu

SEQ ID NO: 1433657 - RNA, 22 nt, Human
gcugagggcaguucgcagccac

SEQ ID NO: 1433658 - RNA, 21 nt, Human
gcugagggcaguucgcagcca

SEQ ID NO: 1433659 - RNA, 13 nt, Human
gcugccaggagca

SEQ ID NO: 1433660 - RNA, 18 nt, Human
gcugccagcucuguauca

SEQ ID NO: 1433661 - RNA, 17 nt, Human
gcugccagcucuguauc

SEQ ID NO: 1433662 - RNA, 12 nt, Human
gcugccacugag

SEQ ID NO: 1433663 - RNA, 13 nt, Human
gcugccacugagg

SEQ ID NO: 1433664 - RNA, 22 nt, Human
gcugccguggggccgccgccuc

SEQ ID NO: 1433665 - RNA, 13 nt, Human
gcugccguggggc

SEQ ID NO: 1433666 - RNA, 19 nt, Human
gcugccggggcagcccccu

SEQ ID NO: 1433667 - RNA, 19 nt, Human
gcugccggucgcccuuugc

SEQ ID NO: 1433668 - RNA, 17 nt, Human
gcugccggggcagcccc

SEQ ID NO: 1433669 - RNA, 16 nt, Human
gcugccgcgcagugug

SEQ ID NO: 1433670 - RNA, 18 nt, Human
gcugccccaucagugcuc

SEQ ID NO: 1433671 - RNA, 17 nt, Human
gcugcccacagcaggcc

SEQ ID NO: 1433672 - RNA, 20 nt, Human
gcugccuagauucagggaaa

SEQ ID NO: 1433673 - RNA, 14 nt, Human
gcugccuggacccg

SEQ ID NO: 1433674 - RNA, 12 nt, Human
gcugccuggacc

SEQ ID NO: 1433675 - RNA, 20 nt, Human
gcugccuggaagagcagccc

SEQ ID NO: 1433676 - RNA, 17 nt, Human
gcugcugaucgccuucc

SEQ ID NO: 1433677 - RNA, 22 nt, Human
gcugcucggggugcacaggagg

SEQ ID NO: 1433678 - RNA, 21 nt, Human
gcugcucggggugcacaggag

SEQ ID NO: 1433679 - RNA, 20 nt, Human
gcugcucggggugcacagga

SEQ ID NO: 1433680 - RNA, 19 nt, Human
gcugcucggggugcacagg

SEQ ID NO: 1433681 - RNA, 18 nt, Human
gcugcucggggugcacag

SEQ ID NO: 1433682 - RNA, 13 nt, Human
gcugccuggaccc

SEQ ID NO: 1433683 - RNA, 18 nt, Human
gcugcugcccauguuuca

SEQ ID NO: 1433684 - RNA, 20 nt, Human
gcugcugaucgccuucccca

SEQ ID NO: 1433685 - RNA, 12 nt, Human
gcugcugccugc

SEQ ID NO: 1433686 - RNA, 22 nt, Human
gcugcugcucuuggcuggaccc

SEQ ID NO: 1433687 - RNA, 16 nt, Human
gcugcugccugccugg

SEQ ID NO: 1433688 - RNA, 13 nt, Human
gcugggcagaagg

SEQ ID NO: 1433689 - RNA, 19 nt, Human
gcugggcagaaggccaaga

SEQ ID NO: 1433690 - RNA, 14 nt, Human
gcuggagugcagug

SEQ ID NO: 1433691 - RNA, 16 nt, Human
gcugggucgcccugga

SEQ ID NO: 1433692 - RNA, 17 nt, Human
gcugggucgcccuggac

SEQ ID NO: 1433693 - RNA, 18 nt, Human
gcugggucgcccuggacu

SEQ ID NO: 1433694 - RNA, 16 nt, Human
gcuggguucauuugug

SEQ ID NO: 1433695 - RNA, 17 nt, Human
gcugggugguacccucu

SEQ ID NO: 1433696 - RNA, 19 nt, Human
gcugggucgcccuggacug

SEQ ID NO: 1433697 - RNA, 22 nt, Human
gcuggacucucagucucugagc

SEQ ID NO: 1433698 - RNA, 21 nt, Human
gcuggacucucagucucugag

SEQ ID NO: 1433699 - RNA, 14 nt, Human
gcuggaggagccca

SEQ ID NO: 1433700 - RNA, 13 nt, Human
gcuggaggagccc

SEQ ID NO: 1433701 - RNA, 21 nt, Human
gcuggaggagcccaggccagg

SEQ ID NO: 1433702 - RNA, 22 nt, Human
gcuggaggagcccaggccagga

SEQ ID NO: 1433703 - RNA, 20 nt, Human
gcuggaggagcccaggccag

SEQ ID NO: 1433704 - RNA, 17 nt, Human
gcuggaggagcccaggc

SEQ ID NO: 1433705 - RNA, 16 nt, Human
gcuggaggagcccagg

SEQ ID NO: 1433706 - RNA, 15 nt, Human
gcuggaggagcccag

SEQ ID NO: 1433707 - RNA, 12 nt, Human
gcuggagugcag

SEQ ID NO: 1433708 - RNA, 14 nt, Human
gcuuggggggugau

SEQ ID NO: 1433709 - RNA, 22 nt, Human
gcuuggggggugaugagggcag

SEQ ID NO: 1433710 - RNA, 17 nt, Human
gcuuggggcuggagagg

SEQ ID NO: 1433711 - RNA, 14 nt, Human
gcuuguacauaaug

SEQ ID NO: 1433712 - RNA, 16 nt, Human
gcuuguacauaaugcg

SEQ ID NO: 1433713 - RNA, 15 nt, Human
gcuugggauuugcug

SEQ ID NO: 1433714 - RNA, 17 nt, Human
gcuugggcagcaucccc

SEQ ID NO: 1433715 - RNA, 17 nt, Human
gcuugggauuugcugug

SEQ ID NO: 1433716 - RNA, 14 nt, Human
gcuugggauuugcu

SEQ ID NO: 1433717 - RNA, 15 nt, Human
gcuugggaauuuuau

SEQ ID NO: 1433718 - RNA, 20 nt, Human
gcuuggggcucacacaccug

SEQ ID NO: 1433719 - RNA, 16 nt, Human
gcuuggggcucacaca

SEQ ID NO: 1433720 - RNA, 19 nt, Human
gcuugggccuaggcugcau

SEQ ID NO: 1433721 - RNA, 21 nt, Human
gcuugggccuaggcugcauug

SEQ ID NO: 1433722 - RNA, 18 nt, Human
gcuugggccuaggcugca

SEQ ID NO: 1433723 - RNA, 14 nt, Human
gcuugggccuaggc

SEQ ID NO: 1433724 - RNA, 20 nt, Human
gcuucuugccucugugcugu

SEQ ID NO: 1433725 - RNA, 21 nt, Human
gcuucuugccucugugcugug

SEQ ID NO: 1433726 - RNA, 20 nt, Human
gcuucgggcccuucccacag

SEQ ID NO: 1433727 - RNA, 18 nt, Human
gcuucgggcccuucccac

SEQ ID NO: 1433728 - RNA, 19 nt, Human
gcuucuugccucugugcug

SEQ ID NO: 1433729 - RNA, 21 nt, Human
gcuucuuucuagaaagagaaa

SEQ ID NO: 1433730 - RNA, 15 nt, Human
gcuucuuucuagaaa

SEQ ID NO: 1433731 - RNA, 12 nt, Human
gcuucuuucuag

SEQ ID NO: 1433732 - RNA, 12 nt, Human
gcuucuuucuuu

SEQ ID NO: 1433733 - RNA, 18 nt, Human
gcuucuuucuuugggaau

SEQ ID NO: 1433734 - RNA, 23 nt, Human
gcuucuuucuuugggaauauuug

SEQ ID NO: 1433735 - RNA, 21 nt, Human
gcuugggaagacuccuagcug

SEQ ID NO: 1433736 - RNA, 22 nt, Human
gcuugggaaaggugguguuucu

SEQ ID NO: 1433737 - RNA, 18 nt, Human
gcuuggcgaugccagcca

SEQ ID NO: 1433738 - RNA, 19 nt, Human
gcuuggcgaugccagccaa

SEQ ID NO: 1433739 - RNA, 19 nt, Human
gcuugaaacccguggcgcu

SEQ ID NO: 1433740 - RNA, 17 nt, Human
gcuucccauccccagcg

SEQ ID NO: 1433741 - RNA, 18 nt, Human
gcuucccauccccagcga

SEQ ID NO: 1433742 - RNA, 16 nt, Human
gcuucccauccccagc

SEQ ID NO: 1433743 - RNA, 13 nt, Human
gcuucccaucccc

SEQ ID NO: 1433744 - RNA, 18 nt, Human
gcuucccaagggcugccg

SEQ ID NO: 1433745 - RNA, 14 nt, Human
gcuucccuaaucua

SEQ ID NO: 1433746 - RNA, 13 nt, Human
gcuucccuaaucu

SEQ ID NO: 1433747 - RNA, 17 nt, Human
gcuuccuucauuuccuc

SEQ ID NO: 1433748 - RNA, 14 nt, Human
gcuuccuucauuuc

SEQ ID NO: 1433749 - RNA, 16 nt, Human
gcuucccugaagcucc

SEQ ID NO: 1433750 - RNA, 15 nt, Human
gcuucccugaagcuc

SEQ ID NO: 1433751 - RNA, 13 nt, Human
gcuucccugaagc

SEQ ID NO: 1433752 - RNA, 18 nt, Human
gcuucccugacucauucu

SEQ ID NO: 1433753 - RNA, 14 nt, Human
gcuucccugacuca

SEQ ID NO: 1433754 - RNA, 14 nt, Human
gcuucccuuuccug

SEQ ID NO: 1433755 - RNA, 14 nt, Human
gcuuaacuucacau

SEQ ID NO: 1433756 - RNA, 18 nt, Human
gcuuaaaauacaagacug

SEQ ID NO: 1433757 - RNA, 14 nt, Human
gcuuaaaauacaag

SEQ ID NO: 1433758 - RNA, 13 nt, Human
gcuuaaaauacaa

SEQ ID NO: 1433759 - RNA, 12 nt, Human
gcuuaaaauaca

SEQ ID NO: 1433760 - RNA, 21 nt, Human
gcuuaaaauaagcagguggau

SEQ ID NO: 1433761 - RNA, 17 nt, Human
gcuuaaaauaagcaggu

SEQ ID NO: 1433762 - RNA, 22 nt, Human
gcuuaaacccauauuguaaaac

SEQ ID NO: 1433763 - RNA, 14 nt, Human
gcuucagccaggag

SEQ ID NO: 1433764 - RNA, 18 nt, Human
gcuuaaaacuuugaaguu

SEQ ID NO: 1433765 - RNA, 13 nt, Human
gcuuaaaacuuug

SEQ ID NO: 1433766 - RNA, 12 nt, Human
gcuuaaaacuuu

SEQ ID NO: 1433767 - RNA, 14 nt, Human
gcuguggccaggag

SEQ ID NO: 1433768 - RNA, 13 nt, Human
gcuguggccagga

SEQ ID NO: 1433769 - RNA, 12 nt, Human
gcuguggccagg

SEQ ID NO: 1433770 - RNA, 21 nt, Human
gcuguggcaugggugaagagg

SEQ ID NO: 1433771 - RNA, 23 nt, Human
gcuguggcaggccagcugugguu

SEQ ID NO: 1433772 - RNA, 14 nt, Human
gcuguggcaggcca

SEQ ID NO: 1433773 - RNA, 22 nt, Human
gcuguggaccauggaguggcag

SEQ ID NO: 1433774 - RNA, 17 nt, Human
gcugugcuuaugguacc

SEQ ID NO: 1433775 - RNA, 22 nt, Human
gcugugaccugcugagcucuga

SEQ ID NO: 1433776 - RNA, 23 nt, Human
gcugugaccugcugagcucugag

SEQ ID NO: 1433777 - RNA, 20 nt, Human
gcugugaccugcugagcucu

SEQ ID NO: 1433778 - RNA, 19 nt, Human
gcugugaccugcugagcuc

SEQ ID NO: 1433779 - RNA, 18 nt, Human
gcugugaccugcugagcu

SEQ ID NO: 1433780 - RNA, 17 nt, Human
gcugugaccugcugagc

SEQ ID NO: 1433781 - RNA, 16 nt, Human
gcugugaccugcugag

SEQ ID NO: 1433782 - RNA, 15 nt, Human
gcugugaccugcuga

SEQ ID NO: 1433783 - RNA, 14 nt, Human
gcugugaccugcug

SEQ ID NO: 1433784 - RNA, 13 nt, Human
gcugugaccugcu

SEQ ID NO: 1433785 - RNA, 12 nt, Human
gcugugaccugc

SEQ ID NO: 1433786 - RNA, 15 nt, Human
gcuguaacugccagg

SEQ ID NO: 1433787 - RNA, 21 nt, Human
gcuguaacuacuuuauaacua

SEQ ID NO: 1433788 - RNA, 12 nt, Human
gcuguacacugc

SEQ ID NO: 1433789 - RNA, 16 nt, Human
gcuguacacugcacga

SEQ ID NO: 1433790 - RNA, 19 nt, Human
gcuguaauguuaauauuga

SEQ ID NO: 1433791 - RNA, 22 nt, Human
gcuguaaucuaugaauucuaag

SEQ ID NO: 1433792 - RNA, 23 nt, Human
gcuguaaggcucuagaucauaag

SEQ ID NO: 1433793 - RNA, 17 nt, Human
gcuguaaggcucuagau

SEQ ID NO: 1433794 - RNA, 16 nt, Human
gcuguaaggcucuaga

SEQ ID NO: 1433795 - RNA, 15 nt, Human
gcuguaaggcucuag

SEQ ID NO: 1433796 - RNA, 13 nt, Human
gcuguaaggcucu

SEQ ID NO: 1433797 - RNA, 23 nt, Human
gcuguaaggauccggaaagaaga

SEQ ID NO: 1433798 - RNA, 17 nt, Human
gcuguauuaagccacuu

SEQ ID NO: 1433799 - RNA, 13 nt, Human
ggcaggcugggcc

SEQ ID NO: 1433800 - RNA, 12 nt, Human
ggcaggcugggc

SEQ ID NO: 1433801 - RNA, 20 nt, Human
ggcaggcuggccaguccagg

SEQ ID NO: 1433802 - RNA, 17 nt, Human
ggcaggcuggccagucc

SEQ ID NO: 1433803 - RNA, 13 nt, Human
ggcaggcuggcca

SEQ ID NO: 1433804 - RNA, 12 nt, Human
ggcaggcuggcc

SEQ ID NO: 1433805 - RNA, 11 nt, Human
ggcaggcuggc

SEQ ID NO: 1433806 - RNA, 10 nt, Human
ggcaggcugg

SEQ ID NO: 1433807 - RNA, 15 nt, Human
ggcaggccagcugug

SEQ ID NO: 1433808 - RNA, 19 nt, Human
ggcaggccaccuggcucuc

SEQ ID NO: 1433809 - RNA, 18 nt, Human
ggcaggccaccuggcucu

SEQ ID NO: 1433810 - RNA, 15 nt, Human
ggcaggccaccuggc

SEQ ID NO: 1433811 - RNA, 22 nt, Human
ggcaggcagggcucuccuggcu

SEQ ID NO: 1433812 - RNA, 23 nt, Human
ggcaggcagggcucuccuggcuu

SEQ ID NO: 1433813 - RNA, 12 nt, Human
ggcagccucugg

SEQ ID NO: 1433814 - RNA, 22 nt, Human
ggcagccucccauccagggccc

SEQ ID NO: 1433815 - RNA, 21 nt, Human
ggcagccucccauccagggcc

SEQ ID NO: 1433816 - RNA, 14 nt, Human
ggcagccucccauc

SEQ ID NO: 1433817 - RNA, 22 nt, Human
ggcagccgugggccccacccuc

SEQ ID NO: 1433818 - RNA, 17 nt, Human
ggcaggcagaggcccag

SEQ ID NO: 1433819 - RNA, 23 nt, Human
ggcaggaccuucgggcugugccc

SEQ ID NO: 1433820 - RNA, 21 nt, Human
ggcaggaccuucgggcugugc

SEQ ID NO: 1433821 - RNA, 18 nt, Human
ggcaggcaggcucccagg

SEQ ID NO: 1433822 - RNA, 20 nt, Human
ggcaggcagaggcccaggcu

SEQ ID NO: 1433823 - RNA, 23 nt, Human
ggcaggcagaggcccaggcugcc

SEQ ID NO: 1433824 - RNA, 19 nt, Human
ggcaggcagggcucuccug

SEQ ID NO: 1433825 - RNA, 15 nt, Human
ggcaggcagggcucu

SEQ ID NO: 1433826 - RNA, 14 nt, Human
ggcaggcagggcuc

SEQ ID NO: 1433827 - RNA, 13 nt, Human
ggcaggcagggcu

SEQ ID NO: 1433828 - RNA, 23 nt, Human
ggcaggcaucggggagccgggag

SEQ ID NO: 1433829 - RNA, 13 nt, Human
ggcagccagggag

SEQ ID NO: 1433830 - RNA, 12 nt, Human
ggcagccaggga

SEQ ID NO: 1433831 - RNA, 18 nt, Human
ggcagagaugccucccug

SEQ ID NO: 1433832 - RNA, 22 nt, Human
ggcagagaugccucccugagcu

SEQ ID NO: 1433833 - RNA, 16 nt, Human
ggcagagaugccuccc

SEQ ID NO: 1433834 - RNA, 20 nt, Human
ggcagccagggagagcccag

SEQ ID NO: 1433835 - RNA, 19 nt, Human
ggcagccagggagagccca

SEQ ID NO: 1433836 - RNA, 18 nt, Human
ggcagccagggagagccc

SEQ ID NO: 1433837 - RNA, 17 nt, Human
ggcagccagggagagcc

SEQ ID NO: 1433838 - RNA, 17 nt, Human
ggcagaaguguuuuuua

SEQ ID NO: 1433839 - RNA, 16 nt, Human
ggcagaaggccaagag

SEQ ID NO: 1433840 - RNA, 17 nt, Human
ggcagaaggcaaaccca

SEQ ID NO: 1433841 - RNA, 22 nt, Human
ggcagacucuuuaugcuugcaa

SEQ ID NO: 1433842 - RNA, 20 nt, Human
ggcagacucuuuaugcuugc

SEQ ID NO: 1433843 - RNA, 19 nt, Human
ggcagacucuuuaugcuug

SEQ ID NO: 1433844 - RNA, 20 nt, Human
ggcagagaagaaagaacgga

SEQ ID NO: 1433845 - RNA, 14 nt, Human
ggcaacacagaggc

SEQ ID NO: 1433846 - RNA, 19 nt, Human
ggcaacaaaagaagcccgg

SEQ ID NO: 1433847 - RNA, 16 nt, Human
ggcaaauaucuugaaa

SEQ ID NO: 1433848 - RNA, 12 nt, Human
ggcaaauaaaag

SEQ ID NO: 1433849 - RNA, 19 nt, Human
ggcaaaggaagguggaugg

SEQ ID NO: 1433850 - RNA, 17 nt, Human
ggcaaaggaagguggau

SEQ ID NO: 1433851 - RNA, 16 nt, Human
ggcaaaggaaggugga

SEQ ID NO: 1433852 - RNA, 11 nt, Human
ggcaaagccag

SEQ ID NO: 1433853 - RNA, 14 nt, Human
ggcaaagccagguc

SEQ ID NO: 1433854 - RNA, 22 nt, Human
ggcaaagcacgaaauguuauuu

SEQ ID NO: 1433855 - RNA, 13 nt, Human
ggcaaacccauca

SEQ ID NO: 1433856 - RNA, 13 nt, Human
ggcaaaauugcaa

SEQ ID NO: 1433857 - RNA, 16 nt, Human
ggcaaaauccuugcuu

SEQ ID NO: 1433858 - RNA, 12 nt, Human
ggauuuucagcc

SEQ ID NO: 1433859 - RNA, 18 nt, Human
ggauuaaccucugcacua

SEQ ID NO: 1433860 - RNA, 17 nt, Human
ggauuaaccucugcacu

SEQ ID NO: 1433861 - RNA, 16 nt, Human
ggauuaaccucugcac

SEQ ID NO: 1433862 - RNA, 15 nt, Human
ggauuaaccucugca

SEQ ID NO: 1433863 - RNA, 20 nt, Human
ggauuaacccacuagcucuu

SEQ ID NO: 1433864 - RNA, 23 nt, Human
ggauuaaacuuaaucuaaaugga

SEQ ID NO: 1433865 - RNA, 23 nt, Human
ggaugagaauuugagugcucuga

SEQ ID NO: 1433866 - RNA, 21 nt, Human
ggaugagaauuugagugcucu

SEQ ID NO: 1433867 - RNA, 15 nt, Human
ggauguguccugaca

SEQ ID NO: 1433868 - RNA, 14 nt, Human
ggauguguccugac

SEQ ID NO: 1433869 - RNA, 19 nt, Human
ggauguggguuccacagac

SEQ ID NO: 1433870 - RNA, 16 nt, Human
ggaugugacaguggcg

SEQ ID NO: 1433871 - RNA, 18 nt, Human
ggaugugauuguggaaug

SEQ ID NO: 1433872 - RNA, 15 nt, Human
ggaugugacaguggc

SEQ ID NO: 1433873 - RNA, 23 nt, Human
ggauguucagcacugucccuugc

SEQ ID NO: 1433874 - RNA, 20 nt, Human
ggauguucagcacugucccu

SEQ ID NO: 1433875 - RNA, 16 nt, Human
ggauguguccugacac

SEQ ID NO: 1433876 - RNA, 23 nt, Human
ggaugguucccuugaugaagaag

SEQ ID NO: 1433877 - RNA, 22 nt, Human
ggaugguucccuugaugaagaa

SEQ ID NO: 1433878 - RNA, 20 nt, Human
ggcaacagaucaguaaagaa

SEQ ID NO: 1433879 - RNA, 14 nt, Human
ggcaacaucuuuau

SEQ ID NO: 1433880 - RNA, 19 nt, Human
ggcaacagaucuggaaccu

SEQ ID NO: 1433881 - RNA, 15 nt, Human
ggcaacagaucugga

SEQ ID NO: 1433882 - RNA, 14 nt, Human
ggcaacagaucugg

SEQ ID NO: 1433883 - RNA, 18 nt, Human
ggcaacagaucaguaaag

SEQ ID NO: 1433884 - RNA, 22 nt, Human
ggccccaggcauugccaagggc

SEQ ID NO: 1433885 - RNA, 21 nt, Human
ggccccaggaccuggcugcca

SEQ ID NO: 1433886 - RNA, 16 nt, Human
ggccccaggaccuggc

SEQ ID NO: 1433887 - RNA, 18 nt, Human
ggccccaggaaaggccca

SEQ ID NO: 1433888 - RNA, 18 nt, Human
ggccccaacccuguccuc

SEQ ID NO: 1433889 - RNA, 19 nt, Human
ggccccaacccuguccucc

SEQ ID NO: 1433890 - RNA, 21 nt, Human
ggcccaucaggguaggcugga

SEQ ID NO: 1433891 - RNA, 15 nt, Human
ggcccagggcccaga

SEQ ID NO: 1433892 - RNA, 22 nt, Human
ggcccucccuguuccccagaga

SEQ ID NO: 1433893 - RNA, 21 nt, Human
ggcccucccuguuccccagag

SEQ ID NO: 1433894 - RNA, 20 nt, Human
ggcccucccuguuccccaga

SEQ ID NO: 1433895 - RNA, 19 nt, Human
ggcccucccuguuccccag

SEQ ID NO: 1433896 - RNA, 19 nt, Human
ggcccuccacaccugcggc

SEQ ID NO: 1433897 - RNA, 21 nt, Human
ggcccuccacaccugcggccc

SEQ ID NO: 1433898 - RNA, 17 nt, Human
ggcccuccacaccugcg

SEQ ID NO: 1433899 - RNA, 16 nt, Human
ggcccuccacaccugc

SEQ ID NO: 1433900 - RNA, 15 nt, Human
ggcccuccacaccug

SEQ ID NO: 1433901 - RNA, 14 nt, Human
ggcccuccacaccu

SEQ ID NO: 1433902 - RNA, 21 nt, Human
ggcccucaguagucccugcac

SEQ ID NO: 1433903 - RNA, 23 nt, Human
ggcccgcgauguggaacugcugc

SEQ ID NO: 1433904 - RNA, 22 nt, Human
ggcccgagcagcugagcagggc

SEQ ID NO: 1433905 - RNA, 23 nt, Human
ggcccgagcagcugagcagggcc

SEQ ID NO: 1433906 - RNA, 20 nt, Human
ggcccgagcagcugagcagg

SEQ ID NO: 1433907 - RNA, 18 nt, Human
ggcccgagcagcugagca

SEQ ID NO: 1433908 - RNA, 16 nt, Human
ggcccgagcagcugag

SEQ ID NO: 1433909 - RNA, 15 nt, Human
ggcccgagcagcuga

SEQ ID NO: 1433910 - RNA, 14 nt, Human
ggcccgagcagcug

SEQ ID NO: 1433911 - RNA, 13 nt, Human
ggcccgagcagcu

SEQ ID NO: 1433912 - RNA, 18 nt, Human
ggccccaugaccuccagc

SEQ ID NO: 1433913 - RNA, 16 nt, Human
ggccccaugaccucca

SEQ ID NO: 1433914 - RNA, 14 nt, Human
ggccccaugaccuc

SEQ ID NO: 1433915 - RNA, 14 nt, Human
ggcccagggcccag

SEQ ID NO: 1433916 - RNA, 15 nt, Human
ggcccaggcugccgu

SEQ ID NO: 1433917 - RNA, 14 nt, Human
ggcccaggcuggga

SEQ ID NO: 1433918 - RNA, 13 nt, Human
ggcccaggcugcc

SEQ ID NO: 1433919 - RNA, 11 nt, Human
ggcccaggcug

SEQ ID NO: 1433920 - RNA, 19 nt, Human
ggcccagccuuuguucccc

SEQ ID NO: 1433921 - RNA, 23 nt, Human
ggcccagccuuuguuccccacug

SEQ ID NO: 1433922 - RNA, 12 nt, Human
ggcccagccuuu

SEQ ID NO: 1433923 - RNA, 11 nt, Human
ggcccagccuu

SEQ ID NO: 1433924 - RNA, 19 nt, Human
ggcccagccgacccccucu

SEQ ID NO: 1433925 - RNA, 18 nt, Human
ggcccagccgacccccuc

SEQ ID NO: 1433926 - RNA, 16 nt, Human
ggcccagccgaccccc

SEQ ID NO: 1433927 - RNA, 21 nt, Human
ggccuccguccaggagccugg

SEQ ID NO: 1433928 - RNA, 15 nt, Human
ggccucccccacuuu

SEQ ID NO: 1433929 - RNA, 22 nt, Human
ggccuccccugccaccaggcca

SEQ ID NO: 1433930 - RNA, 19 nt, Human
ggccuccccugccaccagg

SEQ ID NO: 1433931 - RNA, 17 nt, Human
ggccuccccugccacca

SEQ ID NO: 1433932 - RNA, 15 nt, Human
ggccuccccugccac

SEQ ID NO: 1433933 - RNA, 14 nt, Human
ggccucccccacuu

SEQ ID NO: 1433934 - RNA, 13 nt, Human
ggccucccccacu

SEQ ID NO: 1433935 - RNA, 12 nt, Human
ggccucccccac

SEQ ID NO: 1433936 - RNA, 11 nt, Human
ggccuccccca

SEQ ID NO: 1433937 - RNA, 18 nt, Human
ggccuccaugggccccag

SEQ ID NO: 1433938 - RNA, 23 nt, Human
ggcccuuccuggacagcugugcc

SEQ ID NO: 1433939 - RNA, 22 nt, Human
ggcccuuccuggacagcugugc

SEQ ID NO: 1433940 - RNA, 21 nt, Human
ggcccuuccuggacagcugug

SEQ ID NO: 1433941 - RNA, 20 nt, Human
ggcccuuccuggacagcugu

SEQ ID NO: 1433942 - RNA, 19 nt, Human
ggcccuuccuggacagcug

SEQ ID NO: 1433943 - RNA, 17 nt, Human
ggcccuuccuggacagc

SEQ ID NO: 1433944 - RNA, 16 nt, Human
ggcccuuccuggacag

SEQ ID NO: 1433945 - RNA, 15 nt, Human
ggcccuuccuggaca

SEQ ID NO: 1433946 - RNA, 14 nt, Human
ggcccuuccuggac

SEQ ID NO: 1433947 - RNA, 13 nt, Human
ggcccuuccugga

SEQ ID NO: 1433948 - RNA, 12 nt, Human
ggcccuuccugg

SEQ ID NO: 1433949 - RNA, 23 nt, Human
ggcccucccuguuccccagagaa

SEQ ID NO: 1433950 - RNA, 16 nt, Human
ggccucccaaagugcu

SEQ ID NO: 1433951 - RNA, 19 nt, Human
ggccuccaugggccccagg

SEQ ID NO: 1433952 - RNA, 19 nt, Human
ggcauucuggaccucuggg

SEQ ID NO: 1433953 - RNA, 20 nt, Human
ggcauucuggaccucugggu

SEQ ID NO: 1433954 - RNA, 18 nt, Human
ggcauucuggaccucugg

SEQ ID NO: 1433955 - RNA, 21 nt, Human
ggccaaaggggaccuggaagg

SEQ ID NO: 1433956 - RNA, 20 nt, Human
ggccaaaggggaccuggaag

SEQ ID NO: 1433957 - RNA, 19 nt, Human
ggccaaaggggaccuggaa

SEQ ID NO: 1433958 - RNA, 16 nt, Human
ggccaaagagucucca

SEQ ID NO: 1433959 - RNA, 17 nt, Human
ggccaaagaaccaaaga

SEQ ID NO: 1433960 - RNA, 22 nt, Human
ggccaaagaaccaaagaagaaa

SEQ ID NO: 1433961 - RNA, 11 nt, Human
ggccaaagaac

SEQ ID NO: 1433962 - RNA, 22 nt, Human
ggccagccgcgcaucagacugu

SEQ ID NO: 1433963 - RNA, 21 nt, Human
ggccagccccuuagacagagg

SEQ ID NO: 1433964 - RNA, 23 nt, Human
ggccagccccuuagacagaggcc

SEQ ID NO: 1433965 - RNA, 20 nt, Human
ggccagccccuuagacagag

SEQ ID NO: 1433966 - RNA, 19 nt, Human
ggccagccccuuagacaga

SEQ ID NO: 1433967 - RNA, 15 nt, Human
ggccagccccuuaga

SEQ ID NO: 1433968 - RNA, 16 nt, Human
ggccagauccagccug

SEQ ID NO: 1433969 - RNA, 13 nt, Human
ggccagauccagc

SEQ ID NO: 1433970 - RNA, 12 nt, Human
ggccagauccag

SEQ ID NO: 1433971 - RNA, 19 nt, Human
ggccaagguguccuacaga

SEQ ID NO: 1433972 - RNA, 15 nt, Human
ggccaagguguccua

SEQ ID NO: 1433973 - RNA, 14 nt, Human
ggccaacaaagaac

SEQ ID NO: 1433974 - RNA, 21 nt, Human
ggccaguccaggcugccgugg

SEQ ID NO: 1433975 - RNA, 21 nt, Human
ggccagccgcgcaucagacug

SEQ ID NO: 1433976 - RNA, 16 nt, Human
ggccaguccaggcugc

SEQ ID NO: 1433977 - RNA, 15 nt, Human
ggccaguccaggcug

SEQ ID NO: 1433978 - RNA, 14 nt, Human
ggccaguccaggcu

SEQ ID NO: 1433979 - RNA, 11 nt, Human
ggaggaagccc

SEQ ID NO: 1433980 - RNA, 16 nt, Human
ggaggcaucagugucc

SEQ ID NO: 1433981 - RNA, 21 nt, Human
ggaggcaggggcuuccuggug

SEQ ID NO: 1433982 - RNA, 19 nt, Human
ggaggcaggggcuuccugg

SEQ ID NO: 1433983 - RNA, 20 nt, Human
ggagcuuugacucaggagcc

SEQ ID NO: 1433984 - RNA, 22 nt, Human
ggagcuuugacucaggagccug

SEQ ID NO: 1433985 - RNA, 19 nt, Human
ggaggaaccagagugcuga

SEQ ID NO: 1433986 - RNA, 13 nt, Human
ggaggcccaguuc

SEQ ID NO: 1433987 - RNA, 20 nt, Human
ggaggcccaggcugggaacu

SEQ ID NO: 1433988 - RNA, 16 nt, Human
ggaggcccaggcuggg

SEQ ID NO: 1433989 - RNA, 14 nt, Human
ggaggcccaggcug

SEQ ID NO: 1433990 - RNA, 17 nt, Human
ggaggccauugugugag

SEQ ID NO: 1433991 - RNA, 17 nt, Human
ggaggcucuggagccca

SEQ ID NO: 1433992 - RNA, 20 nt, Human
ggaggcucuggagcccacug

SEQ ID NO: 1433993 - RNA, 19 nt, Human
ggagcuuugacucaggagc

SEQ ID NO: 1433994 - RNA, 16 nt, Human
ggagcuuugacucagg

SEQ ID NO: 1433995 - RNA, 15 nt, Human
ggagcuugggaaugg

SEQ ID NO: 1433996 - RNA, 17 nt, Human
ggagcuccccuccccaa

SEQ ID NO: 1433997 - RNA, 16 nt, Human
ggagcuccccucccca

SEQ ID NO: 1433998 - RNA, 13 nt, Human
ggagcuccccucc

SEQ ID NO: 1433999 - RNA, 20 nt, Human
ggagcuccaguguccugagc

SEQ ID NO: 1434000 - RNA, 19 nt, Human
ggagcuccaguguccugag

SEQ ID NO: 1434001 - RNA, 17 nt, Human
ggagcuccaguguccug

SEQ ID NO: 1434002 - RNA, 18 nt, Human
ggagcuccagccugacau

SEQ ID NO: 1434003 - RNA, 16 nt, Human
ggagcuccagccugac

SEQ ID NO: 1434004 - RNA, 15 nt, Human
ggagcuccagccuga

SEQ ID NO: 1434005 - RNA, 13 nt, Human
ggagcuccagccu

SEQ ID NO: 1434006 - RNA, 15 nt, Human
ggagcccccacccug

SEQ ID NO: 1434007 - RNA, 20 nt, Human
ggagcuccacucugcuucuc

SEQ ID NO: 1434008 - RNA, 14 nt, Human
ggagcccccacccu

SEQ ID NO: 1434009 - RNA, 17 nt, Human
ggagccccauuccuggg

SEQ ID NO: 1434010 - RNA, 16 nt, Human
ggagccccauuccugg

SEQ ID NO: 1434011 - RNA, 18 nt, Human
ggagccccagcuacccuu

SEQ ID NO: 1434012 - RNA, 17 nt, Human
ggagccccagcuacccu

SEQ ID NO: 1434013 - RNA, 20 nt, Human
ggagcccacgcucacccccu

SEQ ID NO: 1434014 - RNA, 12 nt, Human
ggagcccacugu

SEQ ID NO: 1434015 - RNA, 18 nt, Human
ggagcccacuguacuugc

SEQ ID NO: 1434016 - RNA, 21 nt, Human
ggagcccacgacacugcagcc

SEQ ID NO: 1434017 - RNA, 17 nt, Human
ggagcccacgacacugc

SEQ ID NO: 1434018 - RNA, 14 nt, Human
ggagccauuugaga

SEQ ID NO: 1434019 - RNA, 22 nt, Human
ggagcccacuguacuugcucuu

SEQ ID NO: 1434020 - RNA, 18 nt, Human
ggagguguggagccgagg

SEQ ID NO: 1434021 - RNA, 22 nt, Human
ggaggugucucaggcugccuga

SEQ ID NO: 1434022 - RNA, 20 nt, Human
ggaggugucucaggcugccu

SEQ ID NO: 1434023 - RNA, 18 nt, Human
ggaggugucucaggcugc

SEQ ID NO: 1434024 - RNA, 23 nt, Human
ggagguucuaaggccuaggauuc

SEQ ID NO: 1434025 - RNA, 12 nt, Human
ggagguucuaag

SEQ ID NO: 1434026 - RNA, 17 nt, Human
ggaggugucucaggcug

SEQ ID NO: 1434027 - RNA, 16 nt, Human
ggaggugucucaggcu

SEQ ID NO: 1434028 - RNA, 13 nt, Human
ggaggugucucag

SEQ ID NO: 1434029 - RNA, 18 nt, Human
ggaggucgguagguucag

SEQ ID NO: 1434030 - RNA, 22 nt, Human
ggaggcccaggcugggaacuca

SEQ ID NO: 1434031 - RNA, 19 nt, Human
ggaggcccaguucacccug

SEQ ID NO: 1434032 - RNA, 21 nt, Human
ggaggcucuggagcccacugu

SEQ ID NO: 1434033 - RNA, 21 nt, Human
ggagcagcaggaggggggagg

SEQ ID NO: 1434034 - RNA, 19 nt, Human
ggagcagcaggagggggga

SEQ ID NO: 1434035 - RNA, 12 nt, Human
ggagcagcagga

SEQ ID NO: 1434036 - RNA, 21 nt, Human
ggagcagaggggcagaggccc

SEQ ID NO: 1434037 - RNA, 19 nt, Human
ggagcagaggggcagaggc

SEQ ID NO: 1434038 - RNA, 12 nt, Human
ggagcagagggg

SEQ ID NO: 1434039 - RNA, 23 nt, Human
ggagcagagcugauggagaagga

SEQ ID NO: 1434040 - RNA, 13 nt, Human
ggagcaggcagcc

SEQ ID NO: 1434041 - RNA, 16 nt, Human
ggagcaggcagccagc

SEQ ID NO: 1434042 - RNA, 23 nt, Human
ggagccaugcgcccccuccgccc

SEQ ID NO: 1434043 - RNA, 22 nt, Human
ggagccaugcgcccccuccgcc

SEQ ID NO: 1434044 - RNA, 13 nt, Human
ggagccagggcug

SEQ ID NO: 1434045 - RNA, 15 nt, Human
ggagcccacuguacu

SEQ ID NO: 1434046 - RNA, 14 nt, Human
ggagcagaagcagc

SEQ ID NO: 1434047 - RNA, 23 nt, Human
ggagcagaaaacccuugggccag

SEQ ID NO: 1434048 - RNA, 15 nt, Human
ggagcagaccacccc

SEQ ID NO: 1434049 - RNA, 19 nt, Human
ggagcagagcugauggaga

SEQ ID NO: 1434050 - RNA, 22 nt, Human
ggagagccaccaagagggacgc

SEQ ID NO: 1434051 - RNA, 20 nt, Human
ggagagaguugaaccuaaac

SEQ ID NO: 1434052 - RNA, 17 nt, Human
ggagagaguugaaccua

SEQ ID NO: 1434053 - RNA, 12 nt, Human
ggagagacuugu

SEQ ID NO: 1434054 - RNA, 22 nt, Human
ggagacuuagggcaccaggggu

SEQ ID NO: 1434055 - RNA, 17 nt, Human
ggagagacgggcccugg

SEQ ID NO: 1434056 - RNA, 15 nt, Human
ggagagacgggcccu

SEQ ID NO: 1434057 - RNA, 13 nt, Human
ggagagcccuggg

SEQ ID NO: 1434058 - RNA, 14 nt, Human
ggagagcccuggga

SEQ ID NO: 1434059 - RNA, 12 nt, Human
ggagagcccugg

SEQ ID NO: 1434060 - RNA, 11 nt, Human
ggagagcccug

SEQ ID NO: 1434061 - RNA, 22 nt, Human
ggagagcccaggagcuccccuc

SEQ ID NO: 1434062 - RNA, 21 nt, Human
ggagagcccaggagcuccccu

SEQ ID NO: 1434063 - RNA, 20 nt, Human
ggagagcccaggagcucccc

SEQ ID NO: 1434064 - RNA, 15 nt, Human
ggagagcccaggagc

SEQ ID NO: 1434065 - RNA, 13 nt, Human
ggagagcccagga

SEQ ID NO: 1434066 - RNA, 12 nt, Human
ggagagcccagg

SEQ ID NO: 1434067 - RNA, 21 nt, Human
ggagagccagcuaaggggugg

SEQ ID NO: 1434068 - RNA, 13 nt, Human
ggaccucaccaag

SEQ ID NO: 1434069 - RNA, 23 nt, Human
ggaccuagggaggcauggucugc

SEQ ID NO: 1434070 - RNA, 22 nt, Human
ggaccuagggaggcauggucug

SEQ ID NO: 1434071 - RNA, 17 nt, Human
ggaccuagggaggcaug

SEQ ID NO: 1434072 - RNA, 18 nt, Human
ggaccggagagugggggu

SEQ ID NO: 1434073 - RNA, 20 nt, Human
ggacuauauuugggccugcu

SEQ ID NO: 1434074 - RNA, 21 nt, Human
ggacuuccuguccagcuccaa

SEQ ID NO: 1434075 - RNA, 20 nt, Human
ggacuuccuguccagcucca

SEQ ID NO: 1434076 - RNA, 19 nt, Human
ggacuuccuguccagcucc

SEQ ID NO: 1434077 - RNA, 18 nt, Human
ggacuuccuguccagcuc

SEQ ID NO: 1434078 - RNA, 11 nt, Human
ggacuuccugu

SEQ ID NO: 1434079 - RNA, 22 nt, Human
ggacuuagaaaaccagcucagc

SEQ ID NO: 1434080 - RNA, 19 nt, Human
ggacuuagaaaaccagcuc

SEQ ID NO: 1434081 - RNA, 23 nt, Human
ggacuuaagcaucuggcucuaau

SEQ ID NO: 1434082 - RNA, 23 nt, Human
ggacuuagaaaaccagcucagca

SEQ ID NO: 1434083 - RNA, 22 nt, Human
ggacugugugcucaggagcccu

SEQ ID NO: 1434084 - RNA, 15 nt, Human
ggacucagccuucag

SEQ ID NO: 1434085 - RNA, 23 nt, Human
ggacugugugcucaggagcccug

SEQ ID NO: 1434086 - RNA, 21 nt, Human
ggagacugugugugcccucug

SEQ ID NO: 1434087 - RNA, 20 nt, Human
ggagacugugugugcccucu

SEQ ID NO: 1434088 - RNA, 19 nt, Human
ggagacugugugugcccuc

SEQ ID NO: 1434089 - RNA, 18 nt, Human
ggagacugugugugcccu

SEQ ID NO: 1434090 - RNA, 20 nt, Human
ggagacugucuggccccccu

SEQ ID NO: 1434091 - RNA, 19 nt, Human
ggagacugucuggcccccc

SEQ ID NO: 1434092 - RNA, 23 nt, Human
ggagacugggcugagggagccug

SEQ ID NO: 1434093 - RNA, 20 nt, Human
ggagacugggcugagggagc

SEQ ID NO: 1434094 - RNA, 17 nt, Human
ggagacugggcugaggg

SEQ ID NO: 1434095 - RNA, 13 nt, Human
ggagacugggcug

SEQ ID NO: 1434096 - RNA, 20 nt, Human
ggagaaccaaaucuggaagc

SEQ ID NO: 1434097 - RNA, 13 nt, Human
ggacuuuucugca

SEQ ID NO: 1434098 - RNA, 12 nt, Human
ggacuuuguaca

SEQ ID NO: 1434099 - RNA, 16 nt, Human
ggacuugugucucugu

SEQ ID NO: 1434100 - RNA, 15 nt, Human
ggacuuggccucucu

SEQ ID NO: 1434101 - RNA, 17 nt, Human
ggacuuggccucucucu

SEQ ID NO: 1434102 - RNA, 13 nt, Human
ggacuuggccucu

SEQ ID NO: 1434103 - RNA, 22 nt, Human
ggacuucugggguaaguggucu

SEQ ID NO: 1434104 - RNA, 14 nt, Human
ggacuucuggggua

SEQ ID NO: 1434105 - RNA, 23 nt, Human
ggacuuccuguccagcuccaacc

SEQ ID NO: 1434106 - RNA, 22 nt, Human
ggaccuaaauggccucaugugg

SEQ ID NO: 1434107 - RNA, 17 nt, Human
ggaccuaaauggccuca

SEQ ID NO: 1434108 - RNA, 19 nt, Human
ggaccggagagugggggug

SEQ ID NO: 1434109 - RNA, 17 nt, Human
ggaccggagaguggggg

SEQ ID NO: 1434110 - RNA, 22 nt, Human
ggaccgcuacaccacucuggca

SEQ ID NO: 1434111 - RNA, 21 nt, Human
ggaccgcuacaccacucuggc

SEQ ID NO: 1434112 - RNA, 20 nt, Human
ggaccgcuacaccacucugg

SEQ ID NO: 1434113 - RNA, 19 nt, Human
ggaccgcuacaccacucug

SEQ ID NO: 1434114 - RNA, 18 nt, Human
ggaccgcccccugucucu

SEQ ID NO: 1434115 - RNA, 19 nt, Human
ggacccguucaugggggag

SEQ ID NO: 1434116 - RNA, 17 nt, Human
ggacccguucauggggg

SEQ ID NO: 1434117 - RNA, 21 nt, Human
ggaccccccuuucacaggcag

SEQ ID NO: 1434118 - RNA, 18 nt, Human
ggaccccccuuucacagg

SEQ ID NO: 1434119 - RNA, 12 nt, Human
ggaccccugcau

SEQ ID NO: 1434120 - RNA, 11 nt, Human
ggaccccugca

SEQ ID NO: 1434121 - RNA, 23 nt, Human
ggaccccugcauuggaacuggag

SEQ ID NO: 1434122 - RNA, 17 nt, Human
ggaccccagccauccag

SEQ ID NO: 1434123 - RNA, 13 nt, Human
gcuuguagccagc

SEQ ID NO: 1434124 - RNA, 19 nt, Human
gcuuguacauaaugcgugc

SEQ ID NO: 1434125 - RNA, 13 nt, Human
aaaggaaaagaca

SEQ ID NO: 1434126 - RNA, 16 nt, Human
aaagcuuuugucuaca

SEQ ID NO: 1434127 - RNA, 15 nt, Human
aaaggaaagaaaaca

SEQ ID NO: 1434128 - RNA, 17 nt, Human
aaaggaaucauuucuau

SEQ ID NO: 1434129 - RNA, 16 nt, Human
aaaggaaagaaaacau

SEQ ID NO: 1434130 - RNA, 13 nt, Human
aaaggaauuuaaa

SEQ ID NO: 1434131 - RNA, 12 nt, Human
aaaggaaaagac

SEQ ID NO: 1434132 - RNA, 14 nt, Human
aaaggacaucagca

SEQ ID NO: 1434133 - RNA, 16 nt, Human
aaaggacaucagcaaa

SEQ ID NO: 1434134 - RNA, 15 nt, Human
aaaggacgcacugag

SEQ ID NO: 1434135 - RNA, 15 nt, Human
aaaggacaucagcaa

SEQ ID NO: 1434136 - RNA, 19 nt, Human
aaagcuugcaacaaaauuc

SEQ ID NO: 1434137 - RNA, 15 nt, Human
aaaggaaaaacaaac

SEQ ID NO: 1434138 - RNA, 19 nt, Human
aaagcuuuuuauuccuccu

SEQ ID NO: 1434139 - RNA, 20 nt, Human
aaagcuuccaugauucuauu

SEQ ID NO: 1434140 - RNA, 18 nt, Human
aaagcuuccaugauucua

SEQ ID NO: 1434141 - RNA, 17 nt, Human
aaagcuuccaugauucu

SEQ ID NO: 1434142 - RNA, 20 nt, Human
aaagcuucagugcugccgau

SEQ ID NO: 1434143 - RNA, 17 nt, Human
aaagcuucagugcugcc

SEQ ID NO: 1434144 - RNA, 16 nt, Human
aaagcuucacaguacc

SEQ ID NO: 1434145 - RNA, 20 nt, Human
aaagcuauaaagcaguauuu

SEQ ID NO: 1434146 - RNA, 17 nt, Human
aaagcuauauaagacaa

SEQ ID NO: 1434147 - RNA, 23 nt, Human
ggugcccaagccagaggcugggu

SEQ ID NO: 1434148 - RNA, 22 nt, Human
ggugcccaagccagaggcuggg

SEQ ID NO: 1434149 - RNA, 21 nt, Human
ggugcccaagccagaggcugg

SEQ ID NO: 1434150 - RNA, 18 nt, Human
ggugcccaagccagaggc

SEQ ID NO: 1434151 - RNA, 17 nt, Human
ggugcccaagccagagg

SEQ ID NO: 1434152 - RNA, 14 nt, Human
ggugcccaagccag

SEQ ID NO: 1434153 - RNA, 23 nt, Human
ggugcccacagugucaggcacug

SEQ ID NO: 1434154 - RNA, 14 nt, Human
ggugcccacaggcc

SEQ ID NO: 1434155 - RNA, 13 nt, Human
ggugcccacaggc

SEQ ID NO: 1434156 - RNA, 23 nt, Human
ggugcccagaauaaguuauugca

SEQ ID NO: 1434157 - RNA, 22 nt, Human
aaagcgugagcuuaaaauacaa

SEQ ID NO: 1434158 - RNA, 21 nt, Human
aaagcgugagcuuaaaauaca

SEQ ID NO: 1434159 - RNA, 21 nt, Human
aaagcuaaaauaaagaaauag

SEQ ID NO: 1434160 - RNA, 16 nt, Human
aaagcuaaaauaaaga

SEQ ID NO: 1434161 - RNA, 14 nt, Human
aaagcuaaaauaaa

SEQ ID NO: 1434162 - RNA, 14 nt, Human
aaagcguuugcaca

SEQ ID NO: 1434163 - RNA, 23 nt, Human
aaagcgugagcuuaaaauacaag

SEQ ID NO: 1434164 - RNA, 17 nt, Human
aaagcuacuuauuguag

SEQ ID NO: 1434165 - RNA, 16 nt, Human
aaagcuacuuauugua

SEQ ID NO: 1434166 - RNA, 20 nt, Human
ggucuguagguugcacacuu

SEQ ID NO: 1434167 - RNA, 19 nt, Human
ggucuguagguugcacacu

SEQ ID NO: 1434168 - RNA, 18 nt, Human
ggucuguagguugcacac

SEQ ID NO: 1434169 - RNA, 15 nt, Human
ggucuguagguugca

SEQ ID NO: 1434170 - RNA, 14 nt, Human
ggucuguagggauu

SEQ ID NO: 1434171 - RNA, 20 nt, Human
ggucugggggcacaagacug

SEQ ID NO: 1434172 - RNA, 21 nt, Human
ggucugggggcacaagacuga

SEQ ID NO: 1434173 - RNA, 12 nt, Human
ggucuguaaaau

SEQ ID NO: 1434174 - RNA, 14 nt, Human
ggucuguaaaaucu

SEQ ID NO: 1434175 - RNA, 20 nt, Human
ggucugggagucacacagug

SEQ ID NO: 1434176 - RNA, 19 nt, Human
ggucugggagucacacagu

SEQ ID NO: 1434177 - RNA, 23 nt, Human
ggucuggcugguguuaacagaag

SEQ ID NO: 1434178 - RNA, 20 nt, Human
ggucuggcugguguuaacag

SEQ ID NO: 1434179 - RNA, 15 nt, Human
ggucuggcugguguu

SEQ ID NO: 1434180 - RNA, 14 nt, Human
ggucuggcuggugu

SEQ ID NO: 1434181 - RNA, 13 nt, Human
ggucuggcuggug

SEQ ID NO: 1434182 - RNA, 12 nt, Human
ggucuggcuggu

SEQ ID NO: 1434183 - RNA, 22 nt, Human
ggucuggcagccucccauccag

SEQ ID NO: 1434184 - RNA, 15 nt, Human
ggucuggcagccucc

SEQ ID NO: 1434185 - RNA, 16 nt, Human
aaagcaaaaaagaaaa

SEQ ID NO: 1434186 - RNA, 21 nt, Human
aaagcaaaaaagaaaaccuuu

SEQ ID NO: 1434187 - RNA, 15 nt, Human
aaagcaaaaaagaaa

SEQ ID NO: 1434188 - RNA, 14 nt, Human
aaagcaaaaaagaa

SEQ ID NO: 1434189 - RNA, 23 nt, Human
aaagauuuuuuuuuuuucucuca

SEQ ID NO: 1434190 - RNA, 21 nt, Human
aaagauuuuuuaauaauuuag

SEQ ID NO: 1434191 - RNA, 22 nt, Human
aaagauuuuuuaauaauuuaga

SEQ ID NO: 1434192 - RNA, 20 nt, Human
aaagauuuuuuaauaauuua

SEQ ID NO: 1434193 - RNA, 19 nt, Human
aaagauuuuuuaauaauuu

SEQ ID NO: 1434194 - RNA, 14 nt, Human
aaagauuuuuuaau

SEQ ID NO: 1434195 - RNA, 13 nt, Human
aaagauuuuuuaa

SEQ ID NO: 1434196 - RNA, 17 nt, Human
ggucuguucuguuucaa

SEQ ID NO: 1434197 - RNA, 12 nt, Human
ggucuguucuuu

SEQ ID NO: 1434198 - RNA, 17 nt, Human
ggucuguucuuuccaaa

SEQ ID NO: 1434199 - RNA, 19 nt, Human
ggucuguucuuuccaaagu

SEQ ID NO: 1434200 - RNA, 16 nt, Human
ggucuuuuauaauucu

SEQ ID NO: 1434201 - RNA, 17 nt, Human
ggugaugagggcagcag

SEQ ID NO: 1434202 - RNA, 16 nt, Human
ggugaugagggcagca

SEQ ID NO: 1434203 - RNA, 15 nt, Human
ggugaugagggcagc

SEQ ID NO: 1434204 - RNA, 13 nt, Human
ggugaugagggca

SEQ ID NO: 1434205 - RNA, 17 nt, Human
ggugaucugggauuagg

SEQ ID NO: 1434206 - RNA, 20 nt, Human
ggugauccauguaacugccu

SEQ ID NO: 1434207 - RNA, 21 nt, Human
ggugauccauguaacugccua

SEQ ID NO: 1434208 - RNA, 17 nt, Human
ggucuuggaacuugccu

SEQ ID NO: 1434209 - RNA, 23 nt, Human
ggucuuggaacuugccugccuuu

SEQ ID NO: 1434210 - RNA, 18 nt, Human
ggucuguuggcaggcugg

SEQ ID NO: 1434211 - RNA, 16 nt, Human
ggucuguuggcaggcu

SEQ ID NO: 1434212 - RNA, 18 nt, Human
ggugauuuaagggcccag

SEQ ID NO: 1434213 - RNA, 20 nt, Human
ggugauuuagcaggaagcug

SEQ ID NO: 1434214 - RNA, 19 nt, Human
ggugaugagggcagcagcc

SEQ ID NO: 1434215 - RNA, 22 nt, Human
ggugaugagggcagcagccagc

SEQ ID NO: 1434216 - RNA, 14 nt, Human
ggugcacugggagg

SEQ ID NO: 1434217 - RNA, 13 nt, Human
ggugcacugggag

SEQ ID NO: 1434218 - RNA, 22 nt, Human
ggugcacagcacaaauuaguua

SEQ ID NO: 1434219 - RNA, 15 nt, Human
ggugcacaggagggg

SEQ ID NO: 1434220 - RNA, 13 nt, Human
ggugcacaggagg

SEQ ID NO: 1434221 - RNA, 12 nt, Human
ggugcacaggag

SEQ ID NO: 1434222 - RNA, 14 nt, Human
ggugcacaggaggg

SEQ ID NO: 1434223 - RNA, 17 nt, Human
ggugcacuggccccacc

SEQ ID NO: 1434224 - RNA, 21 nt, Human
gguaguaccuuuuauauccca

SEQ ID NO: 1434225 - RNA, 18 nt, Human
aaacuguacagugucuuu

SEQ ID NO: 1434226 - RNA, 16 nt, Human
aaacuguacagugucu

SEQ ID NO: 1434227 - RNA, 13 nt, Human
aaacuguacagug

SEQ ID NO: 1434228 - RNA, 22 nt, Human
gguauaaaacuuuccucgccug

SEQ ID NO: 1434229 - RNA, 21 nt, Human
gguauaaaacuuuccucgccu

SEQ ID NO: 1434230 - RNA, 12 nt, Human
gguauaaaagau

SEQ ID NO: 1434231 - RNA, 13 nt, Human
gguauaaaagaug

SEQ ID NO: 1434232 - RNA, 23 nt, Human
gguauggcguaaguacagagaag

SEQ ID NO: 1434233 - RNA, 20 nt, Human
gguauggcguaaguacagag

SEQ ID NO: 1434234 - RNA, 20 nt, Human
gguaguuuuuucaucuucag

SEQ ID NO: 1434235 - RNA, 16 nt, Human
gguauaaaagaugggg

SEQ ID NO: 1434236 - RNA, 21 nt, Human
gguccaaugcucaggugcugg

SEQ ID NO: 1434237 - RNA, 18 nt, Human
gguccaaugagcuuucug

SEQ ID NO: 1434238 - RNA, 17 nt, Human
gguccaaugagcuuucu

SEQ ID NO: 1434239 - RNA, 16 nt, Human
gguccaaugagcuuuc

SEQ ID NO: 1434240 - RNA, 16 nt, Human
ggucaugggccacugc

SEQ ID NO: 1434241 - RNA, 22 nt, Human
gguauggcguaaguacagagaa

SEQ ID NO: 1434242 - RNA, 21 nt, Human
gguauggcguaaguacagaga

SEQ ID NO: 1434243 - RNA, 23 nt, Human
gguauuggcuagagguucaaaga

SEQ ID NO: 1434244 - RNA, 17 nt, Human
gguauucguuaucuaau

SEQ ID NO: 1434245 - RNA, 12 nt, Human
gguauuguauuu

SEQ ID NO: 1434246 - RNA, 17 nt, Human
gguauuguauuuauuca

SEQ ID NO: 1434247 - RNA, 19 nt, Human
gguauuguauuuauucaau

SEQ ID NO: 1434248 - RNA, 18 nt, Human
gguccaugggcagagccc

SEQ ID NO: 1434249 - RNA, 17 nt, Human
gguccaugggcagagcc

SEQ ID NO: 1434250 - RNA, 22 nt, Human
gguccaaugagcuuucugaaca

SEQ ID NO: 1434251 - RNA, 19 nt, Human
gguccaaugagcuuucuga

SEQ ID NO: 1434252 - RNA, 14 nt, Human
ggucccacagccac

SEQ ID NO: 1434253 - RNA, 20 nt, Human
ggucccacaucccugggccu

SEQ ID NO: 1434254 - RNA, 19 nt, Human
ggucccacaucccugggcc

SEQ ID NO: 1434255 - RNA, 17 nt, Human
ggucccacaucccuggg

SEQ ID NO: 1434256 - RNA, 16 nt, Human
ggucccacaucccugg

SEQ ID NO: 1434257 - RNA, 22 nt, Human
ggucccacaucccugggccugc

SEQ ID NO: 1434258 - RNA, 21 nt, Human
ggucccacaucccugggccug

SEQ ID NO: 1434259 - RNA, 23 nt, Human
ggucccacaucccugggccugcu

SEQ ID NO: 1434260 - RNA, 13 nt, Human
aaacuuuaauaua

SEQ ID NO: 1434261 - RNA, 17 nt, Human
aaacuuuaccuuuuuua

SEQ ID NO: 1434262 - RNA, 14 nt, Human
aaacuuuaccuuuu

SEQ ID NO: 1434263 - RNA, 22 nt, Human
aaacuuuuuuucuguaccaguu

SEQ ID NO: 1434264 - RNA, 19 nt, Human
aaacuuuuuuucuguacca

SEQ ID NO: 1434265 - RNA, 15 nt, Human
aaacuuuuuuucugu

SEQ ID NO: 1434266 - RNA, 19 nt, Human
aaacuuuuuuauuuaaaaa

SEQ ID NO: 1434267 - RNA, 17 nt, Human
aaacuuuuuuauuuaaa

SEQ ID NO: 1434268 - RNA, 12 nt, Human
aaacuuuuuuau

SEQ ID NO: 1434269 - RNA, 20 nt, Human
aaacuuuucuuaaaaaguua

SEQ ID NO: 1434270 - RNA, 22 nt, Human
aaacuuuaaagcguuugcacag

SEQ ID NO: 1434271 - RNA, 20 nt, Human
aaagauucuauaguucuaga

SEQ ID NO: 1434272 - RNA, 19 nt, Human
aaagauucuauaguucuag

SEQ ID NO: 1434273 - RNA, 18 nt, Human
aaagauucuauaguucua

SEQ ID NO: 1434274 - RNA, 12 nt, Human
aaagauucuaua

SEQ ID NO: 1434275 - RNA, 16 nt, Human
aaagauguucuggaua

SEQ ID NO: 1434276 - RNA, 22 nt, Human
aaagauuacuuuuucuuuaugu

SEQ ID NO: 1434277 - RNA, 20 nt, Human
aaagaugagcuuugucuacu

SEQ ID NO: 1434278 - RNA, 17 nt, Human
aaagaugcacuuugcuu

SEQ ID NO: 1434279 - RNA, 12 nt, Human
aaagaugcacuu

SEQ ID NO: 1434280 - RNA, 14 nt, Human
aaagaugccacauu

SEQ ID NO: 1434281 - RNA, 22 nt, Human
aaagaugcacuuugcuuuaaua

SEQ ID NO: 1434282 - RNA, 23 nt, Human
aaagaugcacuuugcuuuaauau

SEQ ID NO: 1434283 - RNA, 21 nt, Human
aaagaugcacuuugcuuuaau

SEQ ID NO: 1434284 - RNA, 19 nt, Human
aaagaugcacuuugcuuua

SEQ ID NO: 1434285 - RNA, 23 nt, Human
aaagauggggucuguaaaaucuu

SEQ ID NO: 1434286 - RNA, 15 nt, Human
aaagaugagugagca

SEQ ID NO: 1434287 - RNA, 20 nt, Human
aaagaauuguuggggguuuu

SEQ ID NO: 1434288 - RNA, 22 nt, Human
aaagaauuguuggggguuuuuu

SEQ ID NO: 1434289 - RNA, 15 nt, Human
aaagaauuauuuugu

SEQ ID NO: 1434290 - RNA, 19 nt, Human
aaagaauugugguuuauau

SEQ ID NO: 1434291 - RNA, 17 nt, Human
aaagaauggcagaaaag

SEQ ID NO: 1434292 - RNA, 15 nt, Human
aaagacucauccguc

SEQ ID NO: 1434293 - RNA, 14 nt, Human
aaagacucauccgu

SEQ ID NO: 1434294 - RNA, 10 nt, Human
aaagacucau

SEQ ID NO: 1434295 - RNA, 22 nt, Human
aaagagaaacaguugguaacuu

SEQ ID NO: 1434296 - RNA, 19 nt, Human
aaagagaaacaguugguaa

SEQ ID NO: 1434297 - RNA, 12 nt, Human
aaagagaaacac

SEQ ID NO: 1434298 - RNA, 20 nt, Human
aaagacuugguugguagggu

SEQ ID NO: 1434299 - RNA, 18 nt, Human
aaagacuugguugguagg

SEQ ID NO: 1434300 - RNA, 12 nt, Human
aaagacuuaagc

SEQ ID NO: 1434301 - RNA, 21 nt, Human
aaagagacagugauauuggaa

SEQ ID NO: 1434302 - RNA, 15 nt, Human
aaagagacagugaua

SEQ ID NO: 1434303 - RNA, 13 nt, Human
aaagagacaguga

SEQ ID NO: 1434304 - RNA, 13 nt, Human
aaagagaaacacg

SEQ ID NO: 1434305 - RNA, 18 nt, Human
aaagagaacuuccagauc

SEQ ID NO: 1434306 - RNA, 20 nt, Human
aaacuacuuugcugcuaaua

SEQ ID NO: 1434307 - RNA, 16 nt, Human
aaacucauuucuagca

SEQ ID NO: 1434308 - RNA, 19 nt, Human
aaacuagcauaucugccuu

SEQ ID NO: 1434309 - RNA, 20 nt, Human
aaacuagcauaucugccuuu

SEQ ID NO: 1434310 - RNA, 21 nt, Human
aaacuagcauaucugccuuua

SEQ ID NO: 1434311 - RNA, 22 nt, Human
aaacuagcauaucugccuuuau

SEQ ID NO: 1434312 - RNA, 14 nt, Human
aaacuagcauaucu

SEQ ID NO: 1434313 - RNA, 22 nt, Human
aaacuagaggugagaaauuuaa

SEQ ID NO: 1434314 - RNA, 16 nt, Human
aaacuacuuugcugcu

SEQ ID NO: 1434315 - RNA, 23 nt, Human
aaacucccacuugucaugugaca

SEQ ID NO: 1434316 - RNA, 22 nt, Human
aaacuccagaugccacaaugga

SEQ ID NO: 1434317 - RNA, 15 nt, Human
aaacuccagaugcca

SEQ ID NO: 1434318 - RNA, 15 nt, Human
aaacuccaccuuccc

SEQ ID NO: 1434319 - RNA, 14 nt, Human
aaacuccugugacc

SEQ ID NO: 1434320 - RNA, 12 nt, Human
aaacuguacagu

SEQ ID NO: 1434321 - RNA, 11 nt, Human
aaacuguacag

SEQ ID NO: 1434322 - RNA, 17 nt, Human
aaacuguaauacaauga

SEQ ID NO: 1434323 - RNA, 16 nt, Human
aaacuggggccucccu

SEQ ID NO: 1434324 - RNA, 18 nt, Human
aaacugggaaccccuuuc

SEQ ID NO: 1434325 - RNA, 18 nt, Human
aaacuggccauggccugc

SEQ ID NO: 1434326 - RNA, 12 nt, Human
aaacuggagacu

SEQ ID NO: 1434327 - RNA, 21 nt, Human
aaacuggagacugugugugcc

SEQ ID NO: 1434328 - RNA, 11 nt, Human
aaacuggagac

SEQ ID NO: 1434329 - RNA, 10 nt, Human
aaacuggaga

SEQ ID NO: 1434330 - RNA, 16 nt, Human
aaacuggauuaaacuu

SEQ ID NO: 1434331 - RNA, 11 nt, Human
aaacuaaucca

SEQ ID NO: 1434332 - RNA, 15 nt, Human
aaacuaauaauugca

SEQ ID NO: 1434333 - RNA, 18 nt, Human
aaacuaaggcccucuuga

SEQ ID NO: 1434334 - RNA, 21 nt, Human
aaacuacaaccaauggaaugu

SEQ ID NO: 1434335 - RNA, 15 nt, Human
aaacuacauauugua

SEQ ID NO: 1434336 - RNA, 21 nt, Human
aaaccacauuggagauguuua

SEQ ID NO: 1434337 - RNA, 18 nt, Human
gggucguggagagcuagg

SEQ ID NO: 1434338 - RNA, 13 nt, Human
gggucguggagag

SEQ ID NO: 1434339 - RNA, 19 nt, Human
gggucaggccuuugagcuc

SEQ ID NO: 1434340 - RNA, 12 nt, Human
gggucaggccuu

SEQ ID NO: 1434341 - RNA, 21 nt, Human
aaacauguuuauuuuucuugu

SEQ ID NO: 1434342 - RNA, 20 nt, Human
aaacauguuuauuuuucuug

SEQ ID NO: 1434343 - RNA, 12 nt, Human
aaacauguuucc

SEQ ID NO: 1434344 - RNA, 19 nt, Human
aaacauguuuccacuauug

SEQ ID NO: 1434345 - RNA, 19 nt, Human
aaacauguuucuuuguaau

SEQ ID NO: 1434346 - RNA, 22 nt, Human
aaacauguuucuuuguaaugaa

SEQ ID NO: 1434347 - RNA, 23 nt, Human
aaacauguuucuuuguaaugaaa

SEQ ID NO: 1434348 - RNA, 18 nt, Human
aaacauuuauuuugacau

SEQ ID NO: 1434349 - RNA, 17 nt, Human
aaacauuuauuuugaca

SEQ ID NO: 1434350 - RNA, 14 nt, Human
aaacauuuauuuug

SEQ ID NO: 1434351 - RNA, 14 nt, Human
aaacauuaaaauau

SEQ ID NO: 1434352 - RNA, 20 nt, Human
aaacauuuauuuugacauaa

SEQ ID NO: 1434353 - RNA, 21 nt, Human
aaacauuuauuuugacauaaa

SEQ ID NO: 1434354 - RNA, 18 nt, Human
aaaccaaaucacugaacu

SEQ ID NO: 1434355 - RNA, 19 nt, Human
gggucagacgccugaggaa

SEQ ID NO: 1434356 - RNA, 23 nt, Human
ggguauaaaacuuuccucgccug

SEQ ID NO: 1434357 - RNA, 20 nt, Human
ggguaggcaggauuggggaa

SEQ ID NO: 1434358 - RNA, 19 nt, Human
ggguaggagggugggaagg

SEQ ID NO: 1434359 - RNA, 15 nt, Human
ggggucuguaaaauc

SEQ ID NO: 1434360 - RNA, 22 nt, Human
ggguaggguaaaucaguaagag

SEQ ID NO: 1434361 - RNA, 15 nt, Human
ggguaggguaaauca

SEQ ID NO: 1434362 - RNA, 18 nt, Human
ggguagggggcuggagga

SEQ ID NO: 1434363 - RNA, 14 nt, Human
ggguaggcuggagu

SEQ ID NO: 1434364 - RNA, 13 nt, Human
ggguaggcaggau

SEQ ID NO: 1434365 - RNA, 12 nt, Human
ggguaggcagga

SEQ ID NO: 1434366 - RNA, 19 nt, Human
ggggccuguacugccugcu

SEQ ID NO: 1434367 - RNA, 18 nt, Human
ggggccuguacugccugc

SEQ ID NO: 1434368 - RNA, 17 nt, Human
ggggccuguacugccug

SEQ ID NO: 1434369 - RNA, 15 nt, Human
ggggccuguacugcc

SEQ ID NO: 1434370 - RNA, 14 nt, Human
ggggccuguacugc

SEQ ID NO: 1434371 - RNA, 12 nt, Human
ggggccugggag

SEQ ID NO: 1434372 - RNA, 19 nt, Human
ggggccuggcuggcugagg

SEQ ID NO: 1434373 - RNA, 15 nt, Human
ggggccugggcagga

SEQ ID NO: 1434374 - RNA, 16 nt, Human
ggggaagacaguggcc

SEQ ID NO: 1434375 - RNA, 12 nt, Human
ggggaagacagu

SEQ ID NO: 1434376 - RNA, 16 nt, Human
ggggcccuggagcagc

SEQ ID NO: 1434377 - RNA, 18 nt, Human
ggggcccuggagcagcca

SEQ ID NO: 1434378 - RNA, 13 nt, Human
ggggaacuggcca

SEQ ID NO: 1434379 - RNA, 21 nt, Human
ggggaacuggccaagcugagg

SEQ ID NO: 1434380 - RNA, 22 nt, Human
ggggccuggcuggcugagggca

SEQ ID NO: 1434381 - RNA, 11 nt, Human
ggggccuggcu

SEQ ID NO: 1434382 - RNA, 12 nt, Human
ggggccugggca

SEQ ID NO: 1434383 - RNA, 19 nt, Human
ggggucguggagagcuagg

SEQ ID NO: 1434384 - RNA, 18 nt, Human
ggggucguggagagcuag

SEQ ID NO: 1434385 - RNA, 21 nt, Human
ggggucuggcugguguuaaca

SEQ ID NO: 1434386 - RNA, 16 nt, Human
ggggucuggcuggugu

SEQ ID NO: 1434387 - RNA, 13 nt, Human
ggggucuggcugg

SEQ ID NO: 1434388 - RNA, 21 nt, Human
ggggucuggaguugaucugga

SEQ ID NO: 1434389 - RNA, 20 nt, Human
ggggucuggaguugaucugg

SEQ ID NO: 1434390 - RNA, 23 nt, Human
ggggucucuucugaauaaagcaa

SEQ ID NO: 1434391 - RNA, 21 nt, Human
ggggaacucagauccagggac

SEQ ID NO: 1434392 - RNA, 18 nt, Human
ggggaacucagauccagg

SEQ ID NO: 1434393 - RNA, 22 nt, Human
ggggaaaggcaagguccggccc

SEQ ID NO: 1434394 - RNA, 17 nt, Human
ggggaaaggcaaggucc

SEQ ID NO: 1434395 - RNA, 21 nt, Human
ggggaaagcaaagcacagaga

SEQ ID NO: 1434396 - RNA, 18 nt, Human
ggggaaagcaaagcacag

SEQ ID NO: 1434397 - RNA, 16 nt, Human
ggggccaggcuggguc

SEQ ID NO: 1434398 - RNA, 14 nt, Human
ggggccaggcuggg

SEQ ID NO: 1434399 - RNA, 21 nt, Human
aaacauauauaacaaugcugu

SEQ ID NO: 1434400 - RNA, 22 nt, Human
aaacaugcuacacacugcaugu

SEQ ID NO: 1434401 - RNA, 19 nt, Human
aaacauauauaacaaugcu

SEQ ID NO: 1434402 - RNA, 16 nt, Human
aaacauauauaacaau

SEQ ID NO: 1434403 - RNA, 20 nt, Human
aaacauaaucuucugccuuc

SEQ ID NO: 1434404 - RNA, 13 nt, Human
aaacauauauaac

SEQ ID NO: 1434405 - RNA, 22 nt, Human
aaacaguugguaacuuuuguga

SEQ ID NO: 1434406 - RNA, 24 nt, Human
aaacaguugcauguaguaacacua

SEQ ID NO: 1434407 - RNA, 19 nt, Human
aaacaguugguaacuuuug

SEQ ID NO: 1434408 - RNA, 18 nt, Human
aaacaguugguaacuuuu

SEQ ID NO: 1434409 - RNA, 16 nt, Human
aaacaguugguaacuu

SEQ ID NO: 1434410 - RNA, 15 nt, Human
aaacacaagauuggu

SEQ ID NO: 1434411 - RNA, 21 nt, Human
aaacacaagauugguguuuuu

SEQ ID NO: 1434412 - RNA, 22 nt, Human
aaacaaguauuuguuaauuuag

SEQ ID NO: 1434413 - RNA, 13 nt, Human
aaacaaguauuug

SEQ ID NO: 1434414 - RNA, 12 nt, Human
aaacaaguauuu

SEQ ID NO: 1434415 - RNA, 16 nt, Human
aaacaagguuuucagu

SEQ ID NO: 1434416 - RNA, 19 nt, Human
aaacaagucagucauucag

SEQ ID NO: 1434417 - RNA, 23 nt, Human
aaacaaguauuuguuaauuuaga

SEQ ID NO: 1434418 - RNA, 14 nt, Human
aaacacaacuauau

SEQ ID NO: 1434419 - RNA, 15 nt, Human
gggcuggaugagcuc

SEQ ID NO: 1434420 - RNA, 18 nt, Human
gggcuggaugagcuccca

SEQ ID NO: 1434421 - RNA, 19 nt, Human
gggcuggaggcccaggcug

SEQ ID NO: 1434422 - RNA, 16 nt, Human
gggcuggaggcccagg

SEQ ID NO: 1434423 - RNA, 15 nt, Human
gggcuggaggcccag

SEQ ID NO: 1434424 - RNA, 14 nt, Human
gggcuggaggccca

SEQ ID NO: 1434425 - RNA, 23 nt, Human
gggcuggaggagcccaggccagg

SEQ ID NO: 1434426 - RNA, 22 nt, Human
gggcuggaggagcccaggccag

SEQ ID NO: 1434427 - RNA, 18 nt, Human
gggcuggaggagcccagg

SEQ ID NO: 1434428 - RNA, 17 nt, Human
gggcuggaggagcccag

SEQ ID NO: 1434429 - RNA, 16 nt, Human
gggcuggaggagccca

SEQ ID NO: 1434430 - RNA, 15 nt, Human
gggcuggaggagccc

SEQ ID NO: 1434431 - RNA, 14 nt, Human
gggcuggaggagcc

SEQ ID NO: 1434432 - RNA, 13 nt, Human
gggcuggaggagc

SEQ ID NO: 1434433 - RNA, 20 nt, Human
gggcugcuuccuccuggaaa

SEQ ID NO: 1434434 - RNA, 19 nt, Human
gggcugcuuccuccuggaa

SEQ ID NO: 1434435 - RNA, 18 nt, Human
gggcugcuuccuccugga

SEQ ID NO: 1434436 - RNA, 14 nt, Human
aaaauguauaugca

SEQ ID NO: 1434437 - RNA, 21 nt, Human
aaaauguaggcuuaguuugug

SEQ ID NO: 1434438 - RNA, 17 nt, Human
aaaauguaggagacugu

SEQ ID NO: 1434439 - RNA, 12 nt, Human
aaaauguaggag

SEQ ID NO: 1434440 - RNA, 19 nt, Human
aaaauggccauuugcuuuu

SEQ ID NO: 1434441 - RNA, 23 nt, Human
aaaauguaagauuauagauucua

SEQ ID NO: 1434442 - RNA, 21 nt, Human
aaaauggcaggggguggaauu

SEQ ID NO: 1434443 - RNA, 22 nt, Human
aaaauggaggccauugugugag

SEQ ID NO: 1434444 - RNA, 12 nt, Human
aaaauggaauac

SEQ ID NO: 1434445 - RNA, 20 nt, Human
aaacaagaaaaauaaagaaa

SEQ ID NO: 1434446 - RNA, 19 nt, Human
aaacaagaaaaauaaagaa

SEQ ID NO: 1434447 - RNA, 18 nt, Human
aaacaagaaaaauaaaga

SEQ ID NO: 1434448 - RNA, 17 nt, Human
aaacaagaaaaauaaag

SEQ ID NO: 1434449 - RNA, 13 nt, Human
aaacaagaaaaau

SEQ ID NO: 1434450 - RNA, 17 nt, Human
aaacaaccaugucauuu

SEQ ID NO: 1434451 - RNA, 17 nt, Human
aaacaacucuuugagaa

SEQ ID NO: 1434452 - RNA, 15 nt, Human
aaacaaccaugucau

SEQ ID NO: 1434453 - RNA, 17 nt, Human
aaacaaggaugaauuaa

SEQ ID NO: 1434454 - RNA, 18 nt, Human
aaacaagaccacguuucu

SEQ ID NO: 1434455 - RNA, 12 nt, Human
aaacaacacugu

SEQ ID NO: 1434456 - RNA, 12 nt, Human
aaacaaagaugu

SEQ ID NO: 1434457 - RNA, 18 nt, Human
aaacaaagaguucaagaa

SEQ ID NO: 1434458 - RNA, 20 nt, Human
aaacaaacucguuuuuuaca

SEQ ID NO: 1434459 - RNA, 13 nt, Human
aaacaaagaaauu

SEQ ID NO: 1434460 - RNA, 17 nt, Human
aaaauguauaugcacuu

SEQ ID NO: 1434461 - RNA, 13 nt, Human
aaaauugugauca

SEQ ID NO: 1434462 - RNA, 20 nt, Human
aaaauuguuaauuuuuccua

SEQ ID NO: 1434463 - RNA, 16 nt, Human
aaaauuuuuaaucuuu

SEQ ID NO: 1434464 - RNA, 22 nt, Human
aaaauuuuuucucuaggaaaua

SEQ ID NO: 1434465 - RNA, 19 nt, Human
aaaauuuuuucucuaggaa

SEQ ID NO: 1434466 - RNA, 19 nt, Human
aaaauuuuuaaucuuuaau

SEQ ID NO: 1434467 - RNA, 21 nt, Human
aaaacuacaaaucaaguauuu

SEQ ID NO: 1434468 - RNA, 22 nt, Human
aaaacuacaaccaauggaaugu

SEQ ID NO: 1434469 - RNA, 16 nt, Human
aaaacuaaaaacuaga

SEQ ID NO: 1434470 - RNA, 13 nt, Human
aaaacuaaaaacu

SEQ ID NO: 1434471 - RNA, 14 nt, Human
aaaacugcauuuca

SEQ ID NO: 1434472 - RNA, 17 nt, Human
aaaacuacuucuuuuuu

SEQ ID NO: 1434473 - RNA, 19 nt, Human
aaaacugcucauaugaugu

SEQ ID NO: 1434474 - RNA, 19 nt, Human
aaaaauuaucuauagcuaa

SEQ ID NO: 1434475 - RNA, 15 nt, Human
gggaacacuggggac

SEQ ID NO: 1434476 - RNA, 19 nt, Human
aaaaaucucaaauuucuaa

SEQ ID NO: 1434477 - RNA, 20 nt, Human
aaaaaucucaaauuucuaaa

SEQ ID NO: 1434478 - RNA, 22 nt, Human
gggaaaucaaaagggccaaaga

SEQ ID NO: 1434479 - RNA, 16 nt, Human
gggaaagccccugccc

SEQ ID NO: 1434480 - RNA, 20 nt, Human
gggaaagcaaagcacagaga

SEQ ID NO: 1434481 - RNA, 22 nt, Human
gggaacacuggggacuuggccu

SEQ ID NO: 1434482 - RNA, 21 nt, Human
gggaacaauuuggcaauuuug

SEQ ID NO: 1434483 - RNA, 14 nt, Human
gggaacaauuuggc

SEQ ID NO: 1434484 - RNA, 21 nt, Human
gggaaaugguacuguacagcu

SEQ ID NO: 1434485 - RNA, 16 nt, Human
aaaaaugauuucagua

SEQ ID NO: 1434486 - RNA, 20 nt, Human
aaaaaugauuucaguagcac

SEQ ID NO: 1434487 - RNA, 14 nt, Human
aaaaaugaucuaaa

SEQ ID NO: 1434488 - RNA, 17 nt, Human
aaaaauguauuuuaugu

SEQ ID NO: 1434489 - RNA, 16 nt, Human
aaaaauguauuuuaug

SEQ ID NO: 1434490 - RNA, 20 nt, Human
aaaaauguucuauuuuaauu

SEQ ID NO: 1434491 - RNA, 23 nt, Human
aaaaauguuuuuggucuuuuaua

SEQ ID NO: 1434492 - RNA, 12 nt, Human
aaaaauuaaaau

SEQ ID NO: 1434493 - RNA, 21 nt, Human
aaaaauuaaaccggaccaucu

SEQ ID NO: 1434494 - RNA, 13 nt, Human
gggagggcagcag

SEQ ID NO: 1434495 - RNA, 11 nt, Human
gggagggcagc

SEQ ID NO: 1434496 - RNA, 20 nt, Human
gggagggcagagcuggugcg

SEQ ID NO: 1434497 - RNA, 18 nt, Human
gggagggcagagcuggug

SEQ ID NO: 1434498 - RNA, 15 nt, Human
gggagggcagagcug

SEQ ID NO: 1434499 - RNA, 22 nt, Human
gggagggcggcaggggccugga

SEQ ID NO: 1434500 - RNA, 21 nt, Human
gggagggcggcaggggccugg

SEQ ID NO: 1434501 - RNA, 20 nt, Human
gggagacugggcugagggag

SEQ ID NO: 1434502 - RNA, 19 nt, Human
gggagacugggcugaggga

SEQ ID NO: 1434503 - RNA, 16 nt, Human
gggagacugggcugag

SEQ ID NO: 1434504 - RNA, 14 nt, Human
gggagacugggcug

SEQ ID NO: 1434505 - RNA, 17 nt, Human
gggacugucgcugcuuc

SEQ ID NO: 1434506 - RNA, 15 nt, Human
gggacugucgcugcu

SEQ ID NO: 1434507 - RNA, 13 nt, Human
gggacuguaaguu

SEQ ID NO: 1434508 - RNA, 15 nt, Human
gggacugcuaaauaa

SEQ ID NO: 1434509 - RNA, 16 nt, Human
gggacugcuaaauaaa

SEQ ID NO: 1434510 - RNA, 17 nt, Human
gggacugcggaggaagg

SEQ ID NO: 1434511 - RNA, 14 nt, Human
aaaagcuuccauga

SEQ ID NO: 1434512 - RNA, 23 nt, Human
aaaagcuuagcuuuagaaacagu

SEQ ID NO: 1434513 - RNA, 21 nt, Human
aaaagcuuagcuuuagaaaca

SEQ ID NO: 1434514 - RNA, 15 nt, Human
aaaagcuuacaaaua

SEQ ID NO: 1434515 - RNA, 20 nt, Human
aaaagcuauuuaaagcaucu

SEQ ID NO: 1434516 - RNA, 21 nt, Human
aaaagcuauaaagcaguauuu

SEQ ID NO: 1434517 - RNA, 17 nt, Human
aaaagcuauaaagcagu

SEQ ID NO: 1434518 - RNA, 14 nt, Human
aaaagcuagaauug

SEQ ID NO: 1434519 - RNA, 16 nt, Human
aaaagcuaauaccagu

SEQ ID NO: 1434520 - RNA, 22 nt, Human
aaaagcuccauuuuuagugaaa

SEQ ID NO: 1434521 - RNA, 20 nt, Human
aaaacuuuccucgccugaca

SEQ ID NO: 1434522 - RNA, 16 nt, Human
aaaacuuuccucgccu

SEQ ID NO: 1434523 - RNA, 14 nt, Human
aaaacuuuccucgc

SEQ ID NO: 1434524 - RNA, 13 nt, Human
aaaacuuuaaagc

SEQ ID NO: 1434525 - RNA, 22 nt, Human
aaaacugcuccuccuccuguau

SEQ ID NO: 1434526 - RNA, 11 nt, Human
aaaacugcucc

SEQ ID NO: 1434527 - RNA, 23 nt, Human
aaaagcgugagcuuaaaauacaa

SEQ ID NO: 1434528 - RNA, 21 nt, Human
aaaagcgugagcuuaaaauac

SEQ ID NO: 1434529 - RNA, 19 nt, Human
aaaagcgugagcuuaaaau

SEQ ID NO: 1434530 - RNA, 17 nt, Human
aaaagcgugagcuuaaa

SEQ ID NO: 1434531 - RNA, 11 nt, Human
aaaagccugcu

SEQ ID NO: 1434532 - RNA, 16 nt, Human
aaaagccuguuuaaga

SEQ ID NO: 1434533 - RNA, 18 nt, Human
aaaagccuguuuaagaga

SEQ ID NO: 1434534 - RNA, 16 nt, Human
aaaauaaagaauggaa

SEQ ID NO: 1434535 - RNA, 15 nt, Human
aaaauaaagaaugga

SEQ ID NO: 1434536 - RNA, 13 nt, Human
aaaaguaauaaaa

SEQ ID NO: 1434537 - RNA, 23 nt, Human
aaaagguuuaugaaaaagaagaa

SEQ ID NO: 1434538 - RNA, 20 nt, Human
aaaagguuuaugaaaaagaa

SEQ ID NO: 1434539 - RNA, 19 nt, Human
aaaagguuuaugaaaaaga

SEQ ID NO: 1434540 - RNA, 14 nt, Human
aaaagguuuaugaa

SEQ ID NO: 1434541 - RNA, 18 nt, Human
aaaagguuuacagaauuu

SEQ ID NO: 1434542 - RNA, 17 nt, Human
aaaauaaauauaucuac

SEQ ID NO: 1434543 - RNA, 14 nt, Human
aaaauaaauauauc

SEQ ID NO: 1434544 - RNA, 17 nt, Human
aaaauagcaaaagaaga

SEQ ID NO: 1434545 - RNA, 16 nt, Human
aaaauacggugggggu

SEQ ID NO: 1434546 - RNA, 14 nt, Human
aaaauacaagacug

SEQ ID NO: 1434547 - RNA, 15 nt, Human
aaaauaccagccagu

SEQ ID NO: 1434548 - RNA, 23 nt, Human
aaaauaaaugucaccagguacuu

SEQ ID NO: 1434549 - RNA, 14 nt, Human
aaaauaccagccag

SEQ ID NO: 1434550 - RNA, 23 nt, Human
aaaauaauuuuuauauuugaaau

SEQ ID NO: 1434551 - RNA, 21 nt, Human
aaaauaauuuuuauauuugaa

SEQ ID NO: 1434552 - RNA, 10 nt, Human
aaaauauaac

SEQ ID NO: 1434553 - RNA, 13 nt, Human
aaaauauaaaaua

SEQ ID NO: 1434554 - RNA, 20 nt, Human
aaaauaguuuggauauguaa

SEQ ID NO: 1434555 - RNA, 22 nt, Human
aaaauaguuuggauauguaaaa

SEQ ID NO: 1434556 - RNA, 19 nt, Human
aaaauaguuuggauaugua

SEQ ID NO: 1434557 - RNA, 16 nt, Human
aaaauaguuuggauau

SEQ ID NO: 1434558 - RNA, 13 nt, Human
aaaauaguuugga

SEQ ID NO: 1434559 - RNA, 23 nt, Human
aaaauaguuaagacaugauuucc

SEQ ID NO: 1434560 - RNA, 18 nt, Human
aaaauaguggugugauuu

SEQ ID NO: 1434561 - RNA, 21 nt, Human
aaaauaggguauauuuuccua

SEQ ID NO: 1434562 - RNA, 20 nt, Human
aaaauaggguauauuuuccu

SEQ ID NO: 1434563 - RNA, 22 nt, Human
aaaauagggacuaucuaucuua

SEQ ID NO: 1434564 - RNA, 13 nt, Human
aaaauaggcagga

SEQ ID NO: 1434565 - RNA, 12 nt, Human
aaaauaggcagg

SEQ ID NO: 1434566 - RNA, 20 nt, Human
aaaauagcuaaauaccucaa

SEQ ID NO: 1434567 - RNA, 20 nt, Human
aaaauagcguucuuguaauu

SEQ ID NO: 1434568 - RNA, 19 nt, Human
aaaauagcguucuuguaau

SEQ ID NO: 1434569 - RNA, 18 nt, Human
aaaauagcguucuuguaa

SEQ ID NO: 1434570 - RNA, 17 nt, Human
aaaauagcguucuugua

SEQ ID NO: 1434571 - RNA, 16 nt, Human
aaaauagcguucuugu

SEQ ID NO: 1434572 - RNA, 15 nt, Human
aaaauagcguucuug

SEQ ID NO: 1434573 - RNA, 13 nt, Human
aaaauauagcuaa

SEQ ID NO: 1434574 - RNA, 13 nt, Human
aaaauauauacua

SEQ ID NO: 1434575 - RNA, 17 nt, Human
aaaauauauacuaaaca

SEQ ID NO: 1434576 - RNA, 18 nt, Human
aaaauauauaucaaauau

SEQ ID NO: 1434577 - RNA, 14 nt, Human
aaaauauguaccaa

SEQ ID NO: 1434578 - RNA, 14 nt, Human
aaaauauauacuaa

SEQ ID NO: 1434579 - RNA, 21 nt, Human
gggauuuucagcccucagaau

SEQ ID NO: 1434580 - RNA, 19 nt, Human
gggauucugguuccagggu

SEQ ID NO: 1434581 - RNA, 17 nt, Human
gggcagagcuggcucug

SEQ ID NO: 1434582 - RNA, 16 nt, Human
gggcagagcuggcucu

SEQ ID NO: 1434583 - RNA, 11 nt, Human
gggcagagcug

SEQ ID NO: 1434584 - RNA, 15 nt, Human
gggcagagcuggugc

SEQ ID NO: 1434585 - RNA, 13 nt, Human
gggcagagcuggu

SEQ ID NO: 1434586 - RNA, 19 nt, Human
gggcagagcuggcucugag

SEQ ID NO: 1434587 - RNA, 16 nt, Human
gggcagcaauuuaaau

SEQ ID NO: 1434588 - RNA, 14 nt, Human
gggcagagcccaag

SEQ ID NO: 1434589 - RNA, 12 nt, Human
gggcagagccca

SEQ ID NO: 1434590 - RNA, 13 nt, Human
gggcagagccagg

SEQ ID NO: 1434591 - RNA, 14 nt, Human
gggcagagccagga

SEQ ID NO: 1434592 - RNA, 16 nt, Human
gggcagagccaggaag

SEQ ID NO: 1434593 - RNA, 19 nt, Human
gggagggcucugaggcgcc

SEQ ID NO: 1434594 - RNA, 20 nt, Human
gggagggcucugaggcgccc

SEQ ID NO: 1434595 - RNA, 18 nt, Human
gggagggcucugaggcgc

SEQ ID NO: 1434596 - RNA, 16 nt, Human
gggagggcucugaggc

SEQ ID NO: 1434597 - RNA, 15 nt, Human
gggagggcucugagg

SEQ ID NO: 1434598 - RNA, 14 nt, Human
gggagggcucugag

SEQ ID NO: 1434599 - RNA, 12 nt, Human
gggagggcucug

SEQ ID NO: 1434600 - RNA, 14 nt, Human
gggagggggagagg

SEQ ID NO: 1434601 - RNA, 11 nt, Human
gggagggcaga

SEQ ID NO: 1434602 - RNA, 21 nt, Human
gggauucaggaaaaggccugg

SEQ ID NO: 1434603 - RNA, 22 nt, Human
gggauucaggaaaaggccuggg

SEQ ID NO: 1434604 - RNA, 23 nt, Human
gggauuauuagaaucaaacauuu

SEQ ID NO: 1434605 - RNA, 20 nt, Human
gggauuaugggucacaggaa

SEQ ID NO: 1434606 - RNA, 18 nt, Human
gggauuaugggucacagg

SEQ ID NO: 1434607 - RNA, 15 nt, Human
gggagggggauccga

SEQ ID NO: 1434608 - RNA, 15 nt, Human
gggaggggcuccuuu

SEQ ID NO: 1434609 - RNA, 14 nt, Human
gggaggggcuccuu

SEQ ID NO: 1434610 - RNA, 17 nt, Human
gggauugaaggaugcug

SEQ ID NO: 1434611 - RNA, 19 nt, Human
gggcagccagggagagccc

SEQ ID NO: 1434612 - RNA, 18 nt, Human
gggcagccagggagagcc

SEQ ID NO: 1434613 - RNA, 14 nt, Human
gggcagccagggag

SEQ ID NO: 1434614 - RNA, 11 nt, Human
gggcagccagg

SEQ ID NO: 1434615 - RNA, 14 nt, Human
gggcagcagggcua

SEQ ID NO: 1434616 - RNA, 23 nt, Human
gggcagcagccagcccugccugg

SEQ ID NO: 1434617 - RNA, 22 nt, Human
gggcagcagccagcccugccug

SEQ ID NO: 1434618 - RNA, 20 nt, Human
gggcagcagccagcccugcc

SEQ ID NO: 1434619 - RNA, 19 nt, Human
gggcagcagccagcccugc

SEQ ID NO: 1434620 - RNA, 18 nt, Human
gggcagcagccagcccug

SEQ ID NO: 1434621 - RNA, 17 nt, Human
gggcagcagccagcccu

SEQ ID NO: 1434622 - RNA, 15 nt, Human
gggcagcagccagcc

SEQ ID NO: 1434623 - RNA, 14 nt, Human
gggcagcagccagc

SEQ ID NO: 1434624 - RNA, 13 nt, Human
gggcagcagccag

SEQ ID NO: 1434625 - RNA, 12 nt, Human
gggcagcagcca

SEQ ID NO: 1434626 - RNA, 15 nt, Human
gggcagcacaggagg

SEQ ID NO: 1434627 - RNA, 16 nt, Human
gggcagagcuggugcg

SEQ ID NO: 1434628 - RNA, 13 nt, Human
aaaaggccugggg

SEQ ID NO: 1434629 - RNA, 14 nt, Human
aaaaggccuggggu

SEQ ID NO: 1434630 - RNA, 19 nt, Human
gggcaggaguagcugagcu

SEQ ID NO: 1434631 - RNA, 15 nt, Human
gggcaggaguagcug

SEQ ID NO: 1434632 - RNA, 14 nt, Human
gggcaggaguagcu

SEQ ID NO: 1434633 - RNA, 20 nt, Human
aaaaggcuagguacacagcu

SEQ ID NO: 1434634 - RNA, 16 nt, Human
aaaagggacugagaaa

SEQ ID NO: 1434635 - RNA, 16 nt, Human
aaaagguuuacagaau

SEQ ID NO: 1434636 - RNA, 14 nt, Human
aaaagguuuacaga

SEQ ID NO: 1434637 - RNA, 13 nt, Human
aaaagguuuacag

SEQ ID NO: 1434638 - RNA, 19 nt, Human
aaaagggacugagaaauuu

SEQ ID NO: 1434639 - RNA, 17 nt, Human
ggcugucaucugugcac

SEQ ID NO: 1434640 - RNA, 14 nt, Human
ggcugucaucugug

SEQ ID NO: 1434641 - RNA, 21 nt, Human
ggcugguguuaacagaaggga

SEQ ID NO: 1434642 - RNA, 16 nt, Human
ggcuucagcugccagu

SEQ ID NO: 1434643 - RNA, 22 nt, Human
aaaaaguugcagcuguuuuguu

SEQ ID NO: 1434644 - RNA, 20 nt, Human
aaaaaguugcagcuguuuug

SEQ ID NO: 1434645 - RNA, 15 nt, Human
aaaaaguugcagcug

SEQ ID NO: 1434646 - RNA, 23 nt, Human
aaaaaguggguuuuuuaguugaa

SEQ ID NO: 1434647 - RNA, 12 nt, Human
aaaaagugucaa

SEQ ID NO: 1434648 - RNA, 22 nt, Human
aaaaaguggguuuuuuaguuga

SEQ ID NO: 1434649 - RNA, 20 nt, Human
aaaaaguggguuuuuuaguu

SEQ ID NO: 1434650 - RNA, 14 nt, Human
aaaaagugaaauaa

SEQ ID NO: 1434651 - RNA, 17 nt, Human
ggcuggugugguacaga

SEQ ID NO: 1434652 - RNA, 16 nt, Human
ggcuggugugguacag

SEQ ID NO: 1434653 - RNA, 15 nt, Human
ggcuggugugguaca

SEQ ID NO: 1434654 - RNA, 23 nt, Human
ggcuggugggugccuaggccugg

SEQ ID NO: 1434655 - RNA, 17 nt, Human
ggcugguguuaacagaa

SEQ ID NO: 1434656 - RNA, 16 nt, Human
ggcugguguuaacaga

SEQ ID NO: 1434657 - RNA, 23 nt, Human
ggcuggugugguacagagaagcc

SEQ ID NO: 1434658 - RNA, 22 nt, Human
ggcuggugugguacagagaagc

SEQ ID NO: 1434659 - RNA, 21 nt, Human
ggcuggugugguacagagaag

SEQ ID NO: 1434660 - RNA, 20 nt, Human
ggcuggugugguacagagaa

SEQ ID NO: 1434661 - RNA, 19 nt, Human
ggcuggugugguacagaga

SEQ ID NO: 1434662 - RNA, 18 nt, Human
ggcuggugugguacagag

SEQ ID NO: 1434663 - RNA, 14 nt, Human
gggaaagcaaagca

SEQ ID NO: 1434664 - RNA, 14 nt, Human
gggaaacuuggcuc

SEQ ID NO: 1434665 - RNA, 21 nt, Human
gggaaacuggccauggccugc

SEQ ID NO: 1434666 - RNA, 14 nt, Human
gggaaacuggccau

SEQ ID NO: 1434667 - RNA, 22 nt, Human
gggaaacagcaucuccaagcag

SEQ ID NO: 1434668 - RNA, 18 nt, Human
gggaaaauuauuugcaua

SEQ ID NO: 1434669 - RNA, 17 nt, Human
gggaaaauuauuugcau

SEQ ID NO: 1434670 - RNA, 17 nt, Human
ggcuuccuggugcugga

SEQ ID NO: 1434671 - RNA, 20 nt, Human
gggaaaaacuuuggaaccag

SEQ ID NO: 1434672 - RNA, 18 nt, Human
ggcuuccuggugcuggag

SEQ ID NO: 1434673 - RNA, 14 nt, Human
ggcuuccuggugcu

SEQ ID NO: 1434674 - RNA, 13 nt, Human
ggcuuccuggugc

SEQ ID NO: 1434675 - RNA, 12 nt, Human
ggcuuccuggug

SEQ ID NO: 1434676 - RNA, 11 nt, Human
ggcuuccuggu

SEQ ID NO: 1434677 - RNA, 21 nt, Human
ggcuuccuggagcagaagcag

SEQ ID NO: 1434678 - RNA, 16 nt, Human
ggcuuccuggagcaga

SEQ ID NO: 1434679 - RNA, 15 nt, Human
ggcuuccuggagcag

SEQ ID NO: 1434680 - RNA, 14 nt, Human
ggcuuccuggagca

SEQ ID NO: 1434681 - RNA, 13 nt, Human
ggcuuccuggagc

SEQ ID NO: 1434682 - RNA, 12 nt, Human
ggcuuccuggag

SEQ ID NO: 1434683 - RNA, 20 nt, Human
ggcuucccaagggcugccgg

SEQ ID NO: 1434684 - RNA, 12 nt, Human
ggcuucccaagg

SEQ ID NO: 1434685 - RNA, 18 nt, Human
ggcuucccauccccagcg

SEQ ID NO: 1434686 - RNA, 17 nt, Human
ggcuucccauccccagc

SEQ ID NO: 1434687 - RNA, 13 nt, Human
ggcuucaggucca

SEQ ID NO: 1434688 - RNA, 16 nt, Human
ggcuucaugccagcua

SEQ ID NO: 1434689 - RNA, 16 nt, Human
ggcuucagguccaggc

SEQ ID NO: 1434690 - RNA, 15 nt, Human
ggcuucaugccagcu

SEQ ID NO: 1434691 - RNA, 12 nt, Human
aaaaaaaacagu

SEQ ID NO: 1434692 - RNA, 14 nt, Human
aaaaaaaaauguuc

SEQ ID NO: 1434693 - RNA, 17 nt, Human
aaaaagcuaauaccagu

SEQ ID NO: 1434694 - RNA, 20 nt, Human
aaaaaaguugcagcuguuuu

SEQ ID NO: 1434695 - RNA, 13 nt, Human
aaaaaaaauuacu

SEQ ID NO: 1434696 - RNA, 14 nt, Human
aaaaaaaaguugca

SEQ ID NO: 1434697 - RNA, 12 nt, Human
aaaaaaaauaca

SEQ ID NO: 1434698 - RNA, 13 nt, Human
aaaaaaaagcuuc

SEQ ID NO: 1434699 - RNA, 11 nt, Human
aaaaaagauga

SEQ ID NO: 1434700 - RNA, 17 nt, Human
aaaaagugaaauaaugu

SEQ ID NO: 1434701 - RNA, 18 nt, Human
aaaaagguuuacagaauu

SEQ ID NO: 1434702 - RNA, 13 nt, Human
aaaaagguuuaca

SEQ ID NO: 1434703 - RNA, 20 nt, Human
aaaaagcuuaaaacuuugaa

SEQ ID NO: 1434704 - RNA, 19 nt, Human
aaaaagcuuaaaacuuuga

SEQ ID NO: 1434705 - RNA, 17 nt, Human
aaaaagcuuaaaacuuu

SEQ ID NO: 1434706 - RNA, 15 nt, Human
aaaaagcuuaaaacu

SEQ ID NO: 1434707 - RNA, 12 nt, Human
aaaaagcuuaaa

SEQ ID NO: 1434708 - RNA, 18 nt, Human
aaaaagcgaaaaaaucag

SEQ ID NO: 1434709 - RNA, 19 nt, Human
aaaaagcuuccaugauucu

SEQ ID NO: 1434710 - RNA, 15 nt, Human
aaaaagggaggggga

SEQ ID NO: 1434711 - RNA, 16 nt, Human
aaaaaggacaucagca

SEQ ID NO: 1434712 - RNA, 22 nt, Human
ggcugaaauucuccuggagguc

SEQ ID NO: 1434713 - RNA, 21 nt, Human
ggcugaaauucuccuggaggu

SEQ ID NO: 1434714 - RNA, 19 nt, Human
ggcugaaauucuccuggag

SEQ ID NO: 1434715 - RNA, 18 nt, Human
ggcugaaauucuccugga

SEQ ID NO: 1434716 - RNA, 17 nt, Human
ggcugaaauucuccugg

SEQ ID NO: 1434717 - RNA, 16 nt, Human
ggcugaaauucuccug

SEQ ID NO: 1434718 - RNA, 14 nt, Human
ggcugaaauucucc

SEQ ID NO: 1434719 - RNA, 23 nt, Human
ggcugcaguucgacucugugcug

SEQ ID NO: 1434720 - RNA, 22 nt, Human
ggcugcaguucgacucugugcu

SEQ ID NO: 1434721 - RNA, 17 nt, Human
ggcucgaaucucugugc

SEQ ID NO: 1434722 - RNA, 15 nt, Human
ggcucgaaucucugu

SEQ ID NO: 1434723 - RNA, 13 nt, Human
ggcucgaaucucu

SEQ ID NO: 1434724 - RNA, 22 nt, Human
ggcuccuugugggccugggcuc

SEQ ID NO: 1434725 - RNA, 12 nt, Human
ggcuccuuucca

SEQ ID NO: 1434726 - RNA, 20 nt, Human
ggcuccuugugggccugggc

SEQ ID NO: 1434727 - RNA, 20 nt, Human
ggcucgaaucucugugccuu

SEQ ID NO: 1434728 - RNA, 19 nt, Human
ggcucgaaucucugugccu

SEQ ID NO: 1434729 - RNA, 18 nt, Human
ggcucgaaucucugugcc

SEQ ID NO: 1434730 - RNA, 16 nt, Human
ggcuccgugugggaga

SEQ ID NO: 1434731 - RNA, 15 nt, Human
ggcuccgugugggag

SEQ ID NO: 1434732 - RNA, 14 nt, Human
ggcuccguguggga

SEQ ID NO: 1434733 - RNA, 18 nt, Human
ggcuccgugugggagacc

SEQ ID NO: 1434734 - RNA, 17 nt, Human
ggcuccuauucaacaca

SEQ ID NO: 1434735 - RNA, 9 nt, Human
ggcuccugc

SEQ ID NO: 1434736 - RNA, 20 nt, Human
ggcuccucgagaucccaaca

SEQ ID NO: 1434737 - RNA, 17 nt, Human
ggcuccgugugggagac

SEQ ID NO: 1434738 - RNA, 23 nt, Human
ggcuccuccaggguggcagcaac

SEQ ID NO: 1434739 - RNA, 15 nt, Human
ggcuggcacaggaca

SEQ ID NO: 1434740 - RNA, 14 nt, Human
ggcuggcacaggac

SEQ ID NO: 1434741 - RNA, 13 nt, Human
ggcuggcacagga

SEQ ID NO: 1434742 - RNA, 19 nt, Human
ggcuggaugagcucccaca

SEQ ID NO: 1434743 - RNA, 23 nt, Human
ggcuggaugagcucccacaagcc

SEQ ID NO: 1434744 - RNA, 18 nt, Human
ggcuggaugagcucccac

SEQ ID NO: 1434745 - RNA, 16 nt, Human
ggcuggaugagcuccc

SEQ ID NO: 1434746 - RNA, 15 nt, Human
ggcuggaugagcucc

SEQ ID NO: 1434747 - RNA, 14 nt, Human
ggcuggaugagcuc

SEQ ID NO: 1434748 - RNA, 13 nt, Human
ggcuggaugagcu

SEQ ID NO: 1434749 - RNA, 13 nt, Human
ggcugccccucuc

SEQ ID NO: 1434750 - RNA, 15 nt, Human
ggcuggcuggccuca

SEQ ID NO: 1434751 - RNA, 13 nt, Human
ggcuggcuggccu

SEQ ID NO: 1434752 - RNA, 10 nt, Human
ggcuggcugg

SEQ ID NO: 1434753 - RNA, 15 nt, Human
ggcuggcugagggca

SEQ ID NO: 1434754 - RNA, 14 nt, Human
ggcuggcugagggc

SEQ ID NO: 1434755 - RNA, 12 nt, Human
ggcuggcugagg

SEQ ID NO: 1434756 - RNA, 22 nt, Human
ggcuggcuccagaugcagggca

SEQ ID NO: 1434757 - RNA, 24 nt, Human
ggcuggcuccagaugcagggcagu

SEQ ID NO: 1434758 - RNA, 23 nt, Human
ggcugggacguggcucagccagc

SEQ ID NO: 1434759 - RNA, 19 nt, Human
ggcugggacguggcucagc

SEQ ID NO: 1434760 - RNA, 18 nt, Human
ggcugggacguggcucag

SEQ ID NO: 1434761 - RNA, 17 nt, Human
ggcugggaacagugugc

SEQ ID NO: 1434762 - RNA, 21 nt, Human
ggcugggaauggaggggcaga

SEQ ID NO: 1434763 - RNA, 22 nt, Human
ggcugggaauggaggggcagag

SEQ ID NO: 1434764 - RNA, 20 nt, Human
gaacccuaaauaauaaaaau

SEQ ID NO: 1434765 - RNA, 16 nt, Human
gaacccugcccacucc

SEQ ID NO: 1434766 - RNA, 19 nt, Human
gaacccucuguuccuuccc

SEQ ID NO: 1434767 - RNA, 15 nt, Human
gaacuccuugauuuu

SEQ ID NO: 1434768 - RNA, 15 nt, Human
gaaccgaggcaggga

SEQ ID NO: 1434769 - RNA, 12 nt, Human
gaaccgaggcag

SEQ ID NO: 1434770 - RNA, 22 nt, Human
gaacuccuugauuuuagccuuc

SEQ ID NO: 1434771 - RNA, 14 nt, Human
gaacugaaaucaua

SEQ ID NO: 1434772 - RNA, 15 nt, Human
gaacugcugccacug

SEQ ID NO: 1434773 - RNA, 14 nt, Human
gaacugcugccacu

SEQ ID NO: 1434774 - RNA, 13 nt, Human
gaacugcugccac

SEQ ID NO: 1434775 - RNA, 22 nt, Human
gaacugcuagucaagugcgucc

SEQ ID NO: 1434776 - RNA, 21 nt, Human
gaacugccuuuggcagaguuc

SEQ ID NO: 1434777 - RNA, 19 nt, Human
gaacugaagggggcggccu

SEQ ID NO: 1434778 - RNA, 12 nt, Human
gaacugaacuca

SEQ ID NO: 1434779 - RNA, 23 nt, Human
gaacugaacaccauugaaggcuu

SEQ ID NO: 1434780 - RNA, 22 nt, Human
gaacugaacaccauugaaggcu

SEQ ID NO: 1434781 - RNA, 21 nt, Human
gaacugaacaccauugaaggc

SEQ ID NO: 1434782 - RNA, 12 nt, Human
gaacugaacacc

SEQ ID NO: 1434783 - RNA, 12 nt, Human
gaacucugaaau

SEQ ID NO: 1434784 - RNA, 15 nt, Human
gaacuggccaagcug

SEQ ID NO: 1434785 - RNA, 14 nt, Human
gaacuggccaagcu

SEQ ID NO: 1434786 - RNA, 16 nt, Human
gaacuggaggcaggga

SEQ ID NO: 1434787 - RNA, 11 nt, Human
gaacuggaggc

SEQ ID NO: 1434788 - RNA, 22 nt, Human
gaacuggacccuguugcuaagc

SEQ ID NO: 1434789 - RNA, 23 nt, Human
gaacuggacccuguugcuaagcc

SEQ ID NO: 1434790 - RNA, 17 nt, Human
gaacugcugccacugag

SEQ ID NO: 1434791 - RNA, 16 nt, Human
gaacugcugccacuga

SEQ ID NO: 1434792 - RNA, 18 nt, Human
gaacuggacccuguugcu

SEQ ID NO: 1434793 - RNA, 20 nt, Human
gaacuggacccuguugcuaa

SEQ ID NO: 1434794 - RNA, 13 nt, Human
gaagaauuauuuu

SEQ ID NO: 1434795 - RNA, 12 nt, Human
gaagaauuccag

SEQ ID NO: 1434796 - RNA, 22 nt, Human
gaagaauguuaagacuugacag

SEQ ID NO: 1434797 - RNA, 20 nt, Human
gaagaaugcacaagaaugga

SEQ ID NO: 1434798 - RNA, 24 nt, Human
gaagaaugcuuaaucagauagaua

SEQ ID NO: 1434799 - RNA, 23 nt, Human
gaagaaugcacaagaauggauca

SEQ ID NO: 1434800 - RNA, 21 nt, Human
gaagaaucucaucucagugaa

SEQ ID NO: 1434801 - RNA, 23 nt, Human
gaagaauacuucucauuuuuuaa

SEQ ID NO: 1434802 - RNA, 18 nt, Human
gaacuggccaagcugagg

SEQ ID NO: 1434803 - RNA, 16 nt, Human
gaacuggccaagcuga

SEQ ID NO: 1434804 - RNA, 16 nt, Human
gaagacaaugacuuac

SEQ ID NO: 1434805 - RNA, 22 nt, Human
gaagacaaugacuuacuguaca

SEQ ID NO: 1434806 - RNA, 21 nt, Human
gaagacacagacugcgauuug

SEQ ID NO: 1434807 - RNA, 12 nt, Human
gaagacacagac

SEQ ID NO: 1434808 - RNA, 18 nt, Human
gaagacaauugacaacag

SEQ ID NO: 1434809 - RNA, 14 nt, Human
gaagacaauugaca

SEQ ID NO: 1434810 - RNA, 12 nt, Human
gaagacaaacuu

SEQ ID NO: 1434811 - RNA, 14 nt, Human
gaagcaaaauuuuu

SEQ ID NO: 1434812 - RNA, 20 nt, Human
gaagcaaccucaguaauuua

SEQ ID NO: 1434813 - RNA, 23 nt, Human
gaagcaaaugucaugcugccuua

SEQ ID NO: 1434814 - RNA, 20 nt, Human
gaagcaaguaaaaaggcuaa

SEQ ID NO: 1434815 - RNA, 22 nt, Human
gaagcaaaugucaugcugccuu

SEQ ID NO: 1434816 - RNA, 21 nt, Human
gaagcaaaugucaugcugccu

SEQ ID NO: 1434817 - RNA, 17 nt, Human
gaagcaaaucgaaugaa

SEQ ID NO: 1434818 - RNA, 16 nt, Human
gaagcaagcuuaaugg

SEQ ID NO: 1434819 - RNA, 22 nt, Human
gaagcaaccucaguaauuuaga

SEQ ID NO: 1434820 - RNA, 20 nt, Human
gaagcaaugcuucaucccuu

SEQ ID NO: 1434821 - RNA, 22 nt, Human
gaagggcugcuucccugaagcu

SEQ ID NO: 1434822 - RNA, 21 nt, Human
gaagggcuuggacucaagcaa

SEQ ID NO: 1434823 - RNA, 22 nt, Human
gaagggccugcccaguugcacu

SEQ ID NO: 1434824 - RNA, 15 nt, Human
gaaggcuugggauuu

SEQ ID NO: 1434825 - RNA, 18 nt, Human
gaagggccagagccaggg

SEQ ID NO: 1434826 - RNA, 17 nt, Human
gaagggccagagccagg

SEQ ID NO: 1434827 - RNA, 16 nt, Human
gaagggccagagccag

SEQ ID NO: 1434828 - RNA, 15 nt, Human
gaagggccagagcca

SEQ ID NO: 1434829 - RNA, 14 nt, Human
gaagggccagagcc

SEQ ID NO: 1434830 - RNA, 16 nt, Human
gaaggcuucucucugu

SEQ ID NO: 1434831 - RNA, 20 nt, Human
gaagcucuuggagcugugag

SEQ ID NO: 1434832 - RNA, 23 nt, Human
gaagcuccucuccccagcccaga

SEQ ID NO: 1434833 - RNA, 22 nt, Human
gaagcuccucuccccagcccag

SEQ ID NO: 1434834 - RNA, 21 nt, Human
gaagcuccucuccccagccca

SEQ ID NO: 1434835 - RNA, 20 nt, Human
gaagcuccucuccccagccc

SEQ ID NO: 1434836 - RNA, 19 nt, Human
gaagcuccucuccccagcc

SEQ ID NO: 1434837 - RNA, 17 nt, Human
gaagcuccucuccccag

SEQ ID NO: 1434838 - RNA, 23 nt, Human
gaagcuagacacaugaagguaaa

SEQ ID NO: 1434839 - RNA, 21 nt, Human
gaagcuagacacaugaaggua

SEQ ID NO: 1434840 - RNA, 18 nt, Human
gaagcuagacacaugaag

SEQ ID NO: 1434841 - RNA, 20 nt, Human
gaagcuauuuuuuucaguuu

SEQ ID NO: 1434842 - RNA, 16 nt, Human
gaagcuagucuuuugc

SEQ ID NO: 1434843 - RNA, 14 nt, Human
gaagcuagucuuuu

SEQ ID NO: 1434844 - RNA, 22 nt, Human
gaagcuagacacaugaagguaa

SEQ ID NO: 1434845 - RNA, 20 nt, Human
gaagcuaucguaaaauuaag

SEQ ID NO: 1434846 - RNA, 13 nt, Human
gaauauuguccau

SEQ ID NO: 1434847 - RNA, 11 nt, Human
gaauauuugaa

SEQ ID NO: 1434848 - RNA, 12 nt, Human
gaauauuugaau

SEQ ID NO: 1434849 - RNA, 13 nt, Human
gaauauuugaauc

SEQ ID NO: 1434850 - RNA, 10 nt, Human
gaauauuuga

SEQ ID NO: 1434851 - RNA, 21 nt, Human
gaauaugucagugcugaugua

SEQ ID NO: 1434852 - RNA, 22 nt, Human
gaauauacagcaggugcucaau

SEQ ID NO: 1434853 - RNA, 20 nt, Human
gaauauaauuguuuuaucug

SEQ ID NO: 1434854 - RNA, 19 nt, Human
gaauauaauuguuuuaucu

SEQ ID NO: 1434855 - RNA, 15 nt, Human
gaaggggacccuccg

SEQ ID NO: 1434856 - RNA, 14 nt, Human
gaaguugcugcuuc

SEQ ID NO: 1434857 - RNA, 12 nt, Human
gaaguugcugcu

SEQ ID NO: 1434858 - RNA, 21 nt, Human
gaaguugcugcuucucccagg

SEQ ID NO: 1434859 - RNA, 17 nt, Human
gaaguuaguuuguauau

SEQ ID NO: 1434860 - RNA, 16 nt, Human
gaaguuaguuuguaua

SEQ ID NO: 1434861 - RNA, 15 nt, Human
gaaguuaguuuguau

SEQ ID NO: 1434862 - RNA, 17 nt, Human
gaaguuagcuuuaacuu

SEQ ID NO: 1434863 - RNA, 19 nt, Human
gaaguuagcuuuaacuuaa

SEQ ID NO: 1434864 - RNA, 21 nt, Human
gaaguugacuuauaguacaug

SEQ ID NO: 1434865 - RNA, 23 nt, Human
gaaguugacuuauaguacaugau

SEQ ID NO: 1434866 - RNA, 14 nt, Human
gacugucuggggag

SEQ ID NO: 1434867 - RNA, 15 nt, Human
gacugucuggggagc

SEQ ID NO: 1434868 - RNA, 19 nt, Human
gacugucuggccccccugg

SEQ ID NO: 1434869 - RNA, 23 nt, Human
gacuguagggagggcggcagggg

SEQ ID NO: 1434870 - RNA, 22 nt, Human
gacuguagggagggcggcaggg

SEQ ID NO: 1434871 - RNA, 13 nt, Human
gacuguagggagg

SEQ ID NO: 1434872 - RNA, 14 nt, Human
gacugaauuaugaa

SEQ ID NO: 1434873 - RNA, 14 nt, Human
gacugaauuucuuu

SEQ ID NO: 1434874 - RNA, 20 nt, Human
gacugaauuaugaaacuuuu

SEQ ID NO: 1434875 - RNA, 16 nt, Human
gacugaauuucuuuug

SEQ ID NO: 1434876 - RNA, 18 nt, Human
gacuuguuuuugcacaug

SEQ ID NO: 1434877 - RNA, 13 nt, Human
gacuguuuggaaa

SEQ ID NO: 1434878 - RNA, 18 nt, Human
gacuuuaacauaagcuau

SEQ ID NO: 1434879 - RNA, 14 nt, Human
gacuuuaacauaag

SEQ ID NO: 1434880 - RNA, 18 nt, Human
gacugugugugcccucug

SEQ ID NO: 1434881 - RNA, 21 nt, Human
gacugugugugcccucugggc

SEQ ID NO: 1434882 - RNA, 17 nt, Human
gacugugugugcccucu

SEQ ID NO: 1434883 - RNA, 15 nt, Human
gacugugugugcccu

SEQ ID NO: 1434884 - RNA, 21 nt, Human
gacuguugggguggguauaaa

SEQ ID NO: 1434885 - RNA, 15 nt, Human
gacugugauucagaa

SEQ ID NO: 1434886 - RNA, 22 nt, Human
gacugugugcucaggagcccug

SEQ ID NO: 1434887 - RNA, 18 nt, Human
gacucugcagccucagag

SEQ ID NO: 1434888 - RNA, 16 nt, Human
gacucugcagccucag

SEQ ID NO: 1434889 - RNA, 15 nt, Human
gacucugcagccuca

SEQ ID NO: 1434890 - RNA, 14 nt, Human
gacucugcagccuc

SEQ ID NO: 1434891 - RNA, 13 nt, Human
gacucugcagccu

SEQ ID NO: 1434892 - RNA, 19 nt, Human
gacugaaaauauuguuuua

SEQ ID NO: 1434893 - RNA, 21 nt, Human
gacucuugccuguuucccagg

SEQ ID NO: 1434894 - RNA, 11 nt, Human
gacucuugccu

SEQ ID NO: 1434895 - RNA, 17 nt, Human
gacucuucugagcaccu

SEQ ID NO: 1434896 - RNA, 21 nt, Human
gacucugugcuggccagcgag

SEQ ID NO: 1434897 - RNA, 21 nt, Human
gacucuuaagaagacugcauu

SEQ ID NO: 1434898 - RNA, 18 nt, Human
gacucugugcuggccagc

SEQ ID NO: 1434899 - RNA, 17 nt, Human
gacucugugcuggccag

SEQ ID NO: 1434900 - RNA, 16 nt, Human
gacucugugcuggcca

SEQ ID NO: 1434901 - RNA, 14 nt, Human
gacucugugcuggc

SEQ ID NO: 1434902 - RNA, 13 nt, Human
gacucugugcugg

SEQ ID NO: 1434903 - RNA, 15 nt, Human
gacucuuaagaagac

SEQ ID NO: 1434904 - RNA, 14 nt, Human
gacucuuaagaaga

SEQ ID NO: 1434905 - RNA, 17 nt, Human
gacuuuauguaguuuuu

SEQ ID NO: 1434906 - RNA, 19 nt, Human
gacuuuauagaucagccag

SEQ ID NO: 1434907 - RNA, 21 nt, Human
gacuuuacccauuuggguggg

SEQ ID NO: 1434908 - RNA, 19 nt, Human
gacuuuaacauaagcuauu

SEQ ID NO: 1434909 - RNA, 21 nt, Human
gacgccugggggugccaggac

SEQ ID NO: 1434910 - RNA, 19 nt, Human
gacgccugggggugccagg

SEQ ID NO: 1434911 - RNA, 18 nt, Human
gaccugagccugccgagc

SEQ ID NO: 1434912 - RNA, 17 nt, Human
gaccugagccugccgag

SEQ ID NO: 1434913 - RNA, 16 nt, Human
gaccugagccugccga

SEQ ID NO: 1434914 - RNA, 15 nt, Human
gaccugagccugccg

SEQ ID NO: 1434915 - RNA, 14 nt, Human
gaccugagccugcc

SEQ ID NO: 1434916 - RNA, 13 nt, Human
gaccugagccugc

SEQ ID NO: 1434917 - RNA, 12 nt, Human
gaccugagccug

SEQ ID NO: 1434918 - RNA, 11 nt, Human
gaccugagccu

SEQ ID NO: 1434919 - RNA, 16 nt, Human
gaccugagaccugaag

SEQ ID NO: 1434920 - RNA, 16 nt, Human
gaccugagaauguauc

SEQ ID NO: 1434921 - RNA, 23 nt, Human
gaccugaaauuccaaagucucua

SEQ ID NO: 1434922 - RNA, 24 nt, Human
gaccugaaggguugacuuuaccca

SEQ ID NO: 1434923 - RNA, 12 nt, Human
gaccugaagaau

SEQ ID NO: 1434924 - RNA, 19 nt, Human
gaccugaaauuccaaaguc

SEQ ID NO: 1434925 - RNA, 17 nt, Human
gaccugaaauuccaaag

SEQ ID NO: 1434926 - RNA, 15 nt, Human
gaccugaaauuccaa

SEQ ID NO: 1434927 - RNA, 15 nt, Human
gaccucuggguuggg

SEQ ID NO: 1434928 - RNA, 17 nt, Human
gaccucugacagcagca

SEQ ID NO: 1434929 - RNA, 16 nt, Human
gaccucugacagcagc

SEQ ID NO: 1434930 - RNA, 15 nt, Human
gaccucugacagcag

SEQ ID NO: 1434931 - RNA, 14 nt, Human
gaccucugacagca

SEQ ID NO: 1434932 - RNA, 22 nt, Human
gaccucuccccuggaacugucu

SEQ ID NO: 1434933 - RNA, 14 nt, Human
gaccucugcagcaa

SEQ ID NO: 1434934 - RNA, 16 nt, Human
gaccaucugauuaaaa

SEQ ID NO: 1434935 - RNA, 18 nt, Human
gacacagaaaauguugag

SEQ ID NO: 1434936 - RNA, 16 nt, Human
gacacagaaaauguug

SEQ ID NO: 1434937 - RNA, 11 nt, Human
gacacagaaaa

SEQ ID NO: 1434938 - RNA, 16 nt, Human
gacacacugaagaagc

SEQ ID NO: 1434939 - RNA, 15 nt, Human
gacacacugaagaag

SEQ ID NO: 1434940 - RNA, 20 nt, Human
gacagaaccccuacaugaaa

SEQ ID NO: 1434941 - RNA, 17 nt, Human
gacagaaccacagggcu

SEQ ID NO: 1434942 - RNA, 20 nt, Human
gaccauaauguuacauuauu

SEQ ID NO: 1434943 - RNA, 18 nt, Human
gaccagggcuccagcccc

SEQ ID NO: 1434944 - RNA, 11 nt, Human
gaccagggcuc

SEQ ID NO: 1434945 - RNA, 12 nt, Human
gaccagcucagg

SEQ ID NO: 1434946 - RNA, 15 nt, Human
gaccagccuggccca

SEQ ID NO: 1434947 - RNA, 16 nt, Human
gaccagccuggcccac

SEQ ID NO: 1434948 - RNA, 14 nt, Human
gaccagccuggccc

SEQ ID NO: 1434949 - RNA, 21 nt, Human
gaccagcugcuccgaggaccc

SEQ ID NO: 1434950 - RNA, 20 nt, Human
gaccagcugcuccgaggacc

SEQ ID NO: 1434951 - RNA, 19 nt, Human
gaccagcugcuccgaggac

SEQ ID NO: 1434952 - RNA, 15 nt, Human
gaccagcugcuccga

SEQ ID NO: 1434953 - RNA, 13 nt, Human
gaccagcugcucc

SEQ ID NO: 1434954 - RNA, 21 nt, Human
gaccagcucccccucccuccc

SEQ ID NO: 1434955 - RNA, 20 nt, Human
gaccagcucccccucccucc

SEQ ID NO: 1434956 - RNA, 19 nt, Human
gaccagcucccccucccuc

SEQ ID NO: 1434957 - RNA, 18 nt, Human
gaccagcucccccucccu

SEQ ID NO: 1434958 - RNA, 13 nt, Human
gaccagcuccccc

SEQ ID NO: 1434959 - RNA, 22 nt, Human
gaccagcucaggacagaugcca

SEQ ID NO: 1434960 - RNA, 14 nt, Human
gaccagcucaggac

SEQ ID NO: 1434961 - RNA, 13 nt, Human
gaccagcucagga

SEQ ID NO: 1434962 - RNA, 23 nt, Human
gaccagcugcuccgaggacccag

SEQ ID NO: 1434963 - RNA, 22 nt, Human
gaccagcuuuucccaaaagccc

SEQ ID NO: 1434964 - RNA, 21 nt, Human
gacauucaccugccccaacuc

SEQ ID NO: 1434965 - RNA, 18 nt, Human
gacauucaccugccccaa

SEQ ID NO: 1434966 - RNA, 19 nt, Human
gacagugauauuggaacuu

SEQ ID NO: 1434967 - RNA, 20 nt, Human
gacauucugaaugcuucuaa

SEQ ID NO: 1434968 - RNA, 19 nt, Human
gacauucugaaugcuucua

SEQ ID NO: 1434969 - RNA, 15 nt, Human
gacauucugaaugcu

SEQ ID NO: 1434970 - RNA, 14 nt, Human
gacauucugaaugc

SEQ ID NO: 1434971 - RNA, 12 nt, Human
gacauucugaau

SEQ ID NO: 1434972 - RNA, 22 nt, Human
gacauucugauucgaaugacac

SEQ ID NO: 1434973 - RNA, 23 nt, Human
gacauucugauucgaaugacacu

SEQ ID NO: 1434974 - RNA, 13 nt, Human
gacauucugauuc

SEQ ID NO: 1434975 - RNA, 22 nt, Human
gacauucugaaugcuucuaagu

SEQ ID NO: 1434976 - RNA, 23 nt, Human
gacauugaccuauuuccagaaau

SEQ ID NO: 1434977 - RNA, 16 nt, Human
gacauuucucuaagag

SEQ ID NO: 1434978 - RNA, 13 nt, Human
gacauuucucuaa

SEQ ID NO: 1434979 - RNA, 17 nt, Human
gacauuugcucauggaa

SEQ ID NO: 1434980 - RNA, 16 nt, Human
gacauuugcucaugga

SEQ ID NO: 1434981 - RNA, 18 nt, Human
gagggcuggcuggccuca

SEQ ID NO: 1434982 - RNA, 16 nt, Human
gagggcuggcuggccu

SEQ ID NO: 1434983 - RNA, 14 nt, Human
gagggcuggcuggc

SEQ ID NO: 1434984 - RNA, 13 nt, Human
gagggcuggcugg

SEQ ID NO: 1434985 - RNA, 10 nt, Human
gagggcuggc

SEQ ID NO: 1434986 - RNA, 23 nt, Human
gagggcuggaggcccaggcuggg

SEQ ID NO: 1434987 - RNA, 20 nt, Human
gagggcuggaggcccaggcu

SEQ ID NO: 1434988 - RNA, 19 nt, Human
gagggcuggaggcccaggc

SEQ ID NO: 1434989 - RNA, 17 nt, Human
gagggcuggaggcccag

SEQ ID NO: 1434990 - RNA, 16 nt, Human
gagggcuggaggccca

SEQ ID NO: 1434991 - RNA, 10 nt, Human
gagggcugga

SEQ ID NO: 1434992 - RNA, 12 nt, Human
gagggcucugag

SEQ ID NO: 1434993 - RNA, 19 nt, Human
gaggcugaggcuggcacag

SEQ ID NO: 1434994 - RNA, 16 nt, Human
gaggcugaggcuggca

SEQ ID NO: 1434995 - RNA, 15 nt, Human
gaggcugaggcuggc

SEQ ID NO: 1434996 - RNA, 20 nt, Human
gaggcugaggcuggcacagg

SEQ ID NO: 1434997 - RNA, 13 nt, Human
gagggcugcccug

SEQ ID NO: 1434998 - RNA, 16 nt, Human
gagggcugccuuugga

SEQ ID NO: 1434999 - RNA, 15 nt, Human
gagggcucugaggcg

SEQ ID NO: 1435000 - RNA, 14 nt, Human
gagggcucugaggc

SEQ ID NO: 1435001 - RNA, 13 nt, Human
gagggcucugagg

SEQ ID NO: 1435002 - RNA, 9 nt, Human
gagggcugc

SEQ ID NO: 1435003 - RNA, 19 nt, Human
gaggggccgaugcccagag

SEQ ID NO: 1435004 - RNA, 22 nt, Human
gaggaccugagccugccgagca

SEQ ID NO: 1435005 - RNA, 18 nt, Human
gaggaccugagccugccg

SEQ ID NO: 1435006 - RNA, 17 nt, Human
gaggaccugagccugcc

SEQ ID NO: 1435007 - RNA, 16 nt, Human
gaggaccugagccugc

SEQ ID NO: 1435008 - RNA, 15 nt, Human
gaggaccugagccug

SEQ ID NO: 1435009 - RNA, 14 nt, Human
gaggaccugagccu

SEQ ID NO: 1435010 - RNA, 13 nt, Human
gaggaccugagcc

SEQ ID NO: 1435011 - RNA, 12 nt, Human
gaggaccugagc

SEQ ID NO: 1435012 - RNA, 21 nt, Human
gaggaccugagccugccgagc

SEQ ID NO: 1435013 - RNA, 16 nt, Human
gaggcaggggcuuccu

SEQ ID NO: 1435014 - RNA, 21 nt, Human
gaggcaggggcuuccuggugc

SEQ ID NO: 1435015 - RNA, 20 nt, Human
gaggcaggggcuuccuggug

SEQ ID NO: 1435016 - RNA, 18 nt, Human
gaggcaggggcuuccugg

SEQ ID NO: 1435017 - RNA, 17 nt, Human
gaggcaggggcuuccug

SEQ ID NO: 1435018 - RNA, 23 nt, Human
gaggcaguaccugggcaagcugg

SEQ ID NO: 1435019 - RNA, 22 nt, Human
gaggcaguaccugggcaagcug

SEQ ID NO: 1435020 - RNA, 23 nt, Human
gaggcaggggcuuccuggugcug

SEQ ID NO: 1435021 - RNA, 10 nt, Human
gaggcucagg

SEQ ID NO: 1435022 - RNA, 14 nt, Human
gaggcucagauugu

SEQ ID NO: 1435023 - RNA, 20 nt, Human
gaggcuauuauuuucacugu

SEQ ID NO: 1435024 - RNA, 22 nt, Human
gaggcuagguggguugaaagcc

SEQ ID NO: 1435025 - RNA, 16 nt, Human
gaggcuaugcucaggg

SEQ ID NO: 1435026 - RNA, 17 nt, Human
gaggcuaugcucagggg

SEQ ID NO: 1435027 - RNA, 20 nt, Human
gaggcuaugcucaggggccc

SEQ ID NO: 1435028 - RNA, 19 nt, Human
gaggcugaggccuggacuu

SEQ ID NO: 1435029 - RNA, 18 nt, Human
gaggcugaggccuggacu

SEQ ID NO: 1435030 - RNA, 16 nt, Human
gaggcugaggccugga

SEQ ID NO: 1435031 - RNA, 14 nt, Human
gaggcugaggccug

SEQ ID NO: 1435032 - RNA, 14 nt, Human
gaggcuccagaggg

SEQ ID NO: 1435033 - RNA, 12 nt, Human
gaggcucagguc

SEQ ID NO: 1435034 - RNA, 21 nt, Human
gaggccacacucagcacaagg

SEQ ID NO: 1435035 - RNA, 18 nt, Human
gaggccacacucagcaca

SEQ ID NO: 1435036 - RNA, 12 nt, Human
gaggccagacca

SEQ ID NO: 1435037 - RNA, 18 nt, Human
gaggccagaccauggaca

SEQ ID NO: 1435038 - RNA, 23 nt, Human
gagcgccuccauccaaggccagg

SEQ ID NO: 1435039 - RNA, 19 nt, Human
gagcgccuccauccaaggc

SEQ ID NO: 1435040 - RNA, 22 nt, Human
gagcgcccugcagacccugccc

SEQ ID NO: 1435041 - RNA, 23 nt, Human
gagcgcccugcagacccugcccu

SEQ ID NO: 1435042 - RNA, 21 nt, Human
gagcgcccugcagacccugcc

SEQ ID NO: 1435043 - RNA, 20 nt, Human
gagcgcccugcagacccugc

SEQ ID NO: 1435044 - RNA, 19 nt, Human
gagcgcccugcagacccug

SEQ ID NO: 1435045 - RNA, 16 nt, Human
gagcgcccugcagacc

SEQ ID NO: 1435046 - RNA, 14 nt, Human
gagcgcccugcaga

SEQ ID NO: 1435047 - RNA, 13 nt, Human
gagcgcccugcag

SEQ ID NO: 1435048 - RNA, 12 nt, Human
gagcgcccugca

SEQ ID NO: 1435049 - RNA, 23 nt, Human
gagcgcccagcuccugacacugc

SEQ ID NO: 1435050 - RNA, 23 nt, Human
gagcgaguggagucugccaccca

SEQ ID NO: 1435051 - RNA, 20 nt, Human
gagcgaguggagucugccac

SEQ ID NO: 1435052 - RNA, 16 nt, Human
gagcgaguggagucug

SEQ ID NO: 1435053 - RNA, 19 nt, Human
gagccuugaacuuugaccu

SEQ ID NO: 1435054 - RNA, 13 nt, Human
gagccuugaacuu

SEQ ID NO: 1435055 - RNA, 17 nt, Human
gagcuggaccucaccaa

SEQ ID NO: 1435056 - RNA, 20 nt, Human
gagcuggagaugaggccaga

SEQ ID NO: 1435057 - RNA, 13 nt, Human
gaggucucagccc

SEQ ID NO: 1435058 - RNA, 21 nt, Human
gaggucucagccccuuucccu

SEQ ID NO: 1435059 - RNA, 16 nt, Human
gaggugaccccagggc

SEQ ID NO: 1435060 - RNA, 15 nt, Human
gaggugaccccaggg

SEQ ID NO: 1435061 - RNA, 13 nt, Human
gaggucuaaucua

SEQ ID NO: 1435062 - RNA, 23 nt, Human
gaggucgguagguucagccaagg

SEQ ID NO: 1435063 - RNA, 22 nt, Human
gaggucgguagguucagccaag

SEQ ID NO: 1435064 - RNA, 21 nt, Human
gaggucgguagguucagccaa

SEQ ID NO: 1435065 - RNA, 16 nt, Human
gaguugaucuggaacc

SEQ ID NO: 1435066 - RNA, 14 nt, Human
gaguugaucuggaa

SEQ ID NO: 1435067 - RNA, 23 nt, Human
gaguggcaggggacaggagucca

SEQ ID NO: 1435068 - RNA, 19 nt, Human
gaguggcaggggacaggag

SEQ ID NO: 1435069 - RNA, 16 nt, Human
gaguggcaggggacag

SEQ ID NO: 1435070 - RNA, 14 nt, Human
gaguggcaggggac

SEQ ID NO: 1435071 - RNA, 22 nt, Human
gaguggcagcccagccagcguc

SEQ ID NO: 1435072 - RNA, 21 nt, Human
gaguggcagcccagccagcgu

SEQ ID NO: 1435073 - RNA, 18 nt, Human
gaguggcagcccagccag

SEQ ID NO: 1435074 - RNA, 16 nt, Human
gaguggcagcccagcc

SEQ ID NO: 1435075 - RNA, 15 nt, Human
gaguggcagcccagc

SEQ ID NO: 1435076 - RNA, 14 nt, Human
gaguggcagcccag

SEQ ID NO: 1435077 - RNA, 20 nt, Human
gaguggagucugccacccag

SEQ ID NO: 1435078 - RNA, 19 nt, Human
gaguggagucugccaccca

SEQ ID NO: 1435079 - RNA, 21 nt, Human
gaguugaucuggaacccagac

SEQ ID NO: 1435080 - RNA, 20 nt, Human
gaguugaucuggaacccaga

SEQ ID NO: 1435081 - RNA, 19 nt, Human
gaguugaucuggaacccag

SEQ ID NO: 1435082 - RNA, 17 nt, Human
gaguugaucuggaaccc

SEQ ID NO: 1435083 - RNA, 21 nt, Human
gaguggagucugccacccagg

SEQ ID NO: 1435084 - RNA, 15 nt, Human
gagugcaccaaagag

SEQ ID NO: 1435085 - RNA, 17 nt, Human
gagugcaccaaagagaa

SEQ ID NO: 1435086 - RNA, 14 nt, Human
gagugcaccaaaga

SEQ ID NO: 1435087 - RNA, 23 nt, Human
gagugacucaagaagugaagaau

SEQ ID NO: 1435088 - RNA, 15 nt, Human
gagugacucaagaag

SEQ ID NO: 1435089 - RNA, 16 nt, Human
gagugacuacacacag

SEQ ID NO: 1435090 - RNA, 19 nt, Human
gagugauagucuuuugcuu

SEQ ID NO: 1435091 - RNA, 14 nt, Human
gagugaguggcccu

SEQ ID NO: 1435092 - RNA, 17 nt, Human
gaguccaucagccucca

SEQ ID NO: 1435093 - RNA, 23 nt, Human
gagucaggacuugaacccagguc

SEQ ID NO: 1435094 - RNA, 15 nt, Human
gagucagagccaugu

SEQ ID NO: 1435095 - RNA, 22 nt, Human
gagucagacauuuuaagauggu

SEQ ID NO: 1435096 - RNA, 17 nt, Human
gagucacuacgccuggc

SEQ ID NO: 1435097 - RNA, 23 nt, Human
gaggugcuucuaguucugccagg

SEQ ID NO: 1435098 - RNA, 22 nt, Human
gaggugcuucuaguucugccag

SEQ ID NO: 1435099 - RNA, 16 nt, Human
gaggugagaccaccuc

SEQ ID NO: 1435100 - RNA, 21 nt, Human
gaggugaccccagggcacagg

SEQ ID NO: 1435101 - RNA, 19 nt, Human
gaggugaccccagggcaca

SEQ ID NO: 1435102 - RNA, 18 nt, Human
gaggugaccccagggcac

SEQ ID NO: 1435103 - RNA, 17 nt, Human
gaggugaccccagggca

SEQ ID NO: 1435104 - RNA, 23 nt, Human
gaggugaccccagggcacaggag

SEQ ID NO: 1435105 - RNA, 22 nt, Human
gaggugaccccagggcacagga

SEQ ID NO: 1435106 - RNA, 15 nt, Human
gaggugagaccaccu

SEQ ID NO: 1435107 - RNA, 15 nt, Human
gaguuggaaucacug

SEQ ID NO: 1435108 - RNA, 22 nt, Human
gaguugcuuuucagcugagguu

SEQ ID NO: 1435109 - RNA, 18 nt, Human
gaguugcugcaaaccuga

SEQ ID NO: 1435110 - RNA, 20 nt, Human
gaguuuaaaaucaucagaaa

SEQ ID NO: 1435111 - RNA, 14 nt, Human
gaguuuaaaaucau

SEQ ID NO: 1435112 - RNA, 16 nt, Human
gaguuuaaauuguaau

SEQ ID NO: 1435113 - RNA, 14 nt, Human
gcaccuacuuacau

SEQ ID NO: 1435114 - RNA, 21 nt, Human
gcacaucucaacaggccucag

SEQ ID NO: 1435115 - RNA, 19 nt, Human
gcaccggggccugggcagg

SEQ ID NO: 1435116 - RNA, 16 nt, Human
gcaccggggccugggc

SEQ ID NO: 1435117 - RNA, 22 nt, Human
gcacaucucaacaggccucagg

SEQ ID NO: 1435118 - RNA, 19 nt, Human
gcacaucucaacaggccuc

SEQ ID NO: 1435119 - RNA, 18 nt, Human
gcacaucucaacaggccu

SEQ ID NO: 1435120 - RNA, 14 nt, Human
gcaccggggccugg

SEQ ID NO: 1435121 - RNA, 13 nt, Human
gcacaucccugga

SEQ ID NO: 1435122 - RNA, 22 nt, Human
gcacaucagcacgauuucuguu

SEQ ID NO: 1435123 - RNA, 23 nt, Human
gcacaucagcacgauuucuguuu

SEQ ID NO: 1435124 - RNA, 15 nt, Human
gcacuugcuggaaga

SEQ ID NO: 1435125 - RNA, 22 nt, Human
gcacuugcgguuccggcaugga

SEQ ID NO: 1435126 - RNA, 20 nt, Human
gcacucgcuagcaguggcag

SEQ ID NO: 1435127 - RNA, 17 nt, Human
gcacucgcuagcagugg

SEQ ID NO: 1435128 - RNA, 19 nt, Human
gcacaauaaauggcuguaa

SEQ ID NO: 1435129 - RNA, 18 nt, Human
gcacaauaaauggcugua

SEQ ID NO: 1435130 - RNA, 17 nt, Human
gcacaaguuauuuaaau

SEQ ID NO: 1435131 - RNA, 17 nt, Human
gcacaauaaaaauguuu

SEQ ID NO: 1435132 - RNA, 16 nt, Human
gcacaauaaaaauguu

SEQ ID NO: 1435133 - RNA, 22 nt, Human
gcacaauaacuccucccagggu

SEQ ID NO: 1435134 - RNA, 21 nt, Human
gcacaauaacuccucccaggg

SEQ ID NO: 1435135 - RNA, 20 nt, Human
gcacaauaacuccucccagg

SEQ ID NO: 1435136 - RNA, 19 nt, Human
gcacaauaacuccucccag

SEQ ID NO: 1435137 - RNA, 18 nt, Human
gcacaauaacuccuccca

SEQ ID NO: 1435138 - RNA, 23 nt, Human
gcacauauggaauuuugcaaaga

SEQ ID NO: 1435139 - RNA, 17 nt, Human
gcacauaguagaacgcu

SEQ ID NO: 1435140 - RNA, 14 nt, Human
gcacaccccacucc

SEQ ID NO: 1435141 - RNA, 20 nt, Human
gcaauauacuggaaagcuuu

SEQ ID NO: 1435142 - RNA, 13 nt, Human
gcaaguucccagu

SEQ ID NO: 1435143 - RNA, 15 nt, Human
gcaaguucccaguug

SEQ ID NO: 1435144 - RNA, 13 nt, Human
gcaagucaggguu

SEQ ID NO: 1435145 - RNA, 18 nt, Human
gcaagucagaauagaaau

SEQ ID NO: 1435146 - RNA, 20 nt, Human
gcaaguauuagaauaccaca

SEQ ID NO: 1435147 - RNA, 15 nt, Human
gauuuuuuuuucaua

SEQ ID NO: 1435148 - RNA, 21 nt, Human
gauuuuuuccuucaaaguuua

SEQ ID NO: 1435149 - RNA, 18 nt, Human
gauuuuuuccuucaaagu

SEQ ID NO: 1435150 - RNA, 14 nt, Human
gauuuuuuccaaaa

SEQ ID NO: 1435151 - RNA, 21 nt, Human
gauuuuuuucccaauugagaa

SEQ ID NO: 1435152 - RNA, 19 nt, Human
gaugauaaagagacaguga

SEQ ID NO: 1435153 - RNA, 16 nt, Human
gaugauaaacgacuuu

SEQ ID NO: 1435154 - RNA, 18 nt, Human
gaugagggcagcagccag

SEQ ID NO: 1435155 - RNA, 17 nt, Human
gaugagggcagcagcca

SEQ ID NO: 1435156 - RNA, 16 nt, Human
gaugagggcagcagcc

SEQ ID NO: 1435157 - RNA, 15 nt, Human
gaugagggcagcagc

SEQ ID NO: 1435158 - RNA, 14 nt, Human
gaugagggcagcag

SEQ ID NO: 1435159 - RNA, 13 nt, Human
gaugagggcagca

SEQ ID NO: 1435160 - RNA, 12 nt, Human
gaugagggcagc

SEQ ID NO: 1435161 - RNA, 20 nt, Human
gaugagggcagcagccagcc

SEQ ID NO: 1435162 - RNA, 21 nt, Human
gaugagggcagcagccagccc

SEQ ID NO: 1435163 - RNA, 16 nt, Human
gaugagugagcaugcc

SEQ ID NO: 1435164 - RNA, 20 nt, Human
gauguaaaaucuugucaugu

SEQ ID NO: 1435165 - RNA, 16 nt, Human
gauguaaaaucuuguc

SEQ ID NO: 1435166 - RNA, 15 nt, Human
gauguaaaaucuugu

SEQ ID NO: 1435167 - RNA, 14 nt, Human
gauguaaaaucuug

SEQ ID NO: 1435168 - RNA, 13 nt, Human
gauguaaaaucuu

SEQ ID NO: 1435169 - RNA, 20 nt, Human
gauggagccagcucugcauu

SEQ ID NO: 1435170 - RNA, 13 nt, Human
gauguaggaggga

SEQ ID NO: 1435171 - RNA, 12 nt, Human
gauguaaagaug

SEQ ID NO: 1435172 - RNA, 17 nt, Human
gauguaaaaucuuguca

SEQ ID NO: 1435173 - RNA, 13 nt, Human
gauguaaagaugu

SEQ ID NO: 1435174 - RNA, 13 nt, Human
gaugcugccccuc

SEQ ID NO: 1435175 - RNA, 12 nt, Human
gaugcugccccu

SEQ ID NO: 1435176 - RNA, 18 nt, Human
gaugauacauccaaagca

SEQ ID NO: 1435177 - RNA, 13 nt, Human
gauggacaucuug

SEQ ID NO: 1435178 - RNA, 12 nt, Human
gauggagaagga

SEQ ID NO: 1435179 - RNA, 13 nt, Human
gauggagaaggaa

SEQ ID NO: 1435180 - RNA, 14 nt, Human
gauggagaaggaag

SEQ ID NO: 1435181 - RNA, 16 nt, Human
gauggagaaggaaggc

SEQ ID NO: 1435182 - RNA, 15 nt, Human
gauggagaaggaagg

SEQ ID NO: 1435183 - RNA, 13 nt, Human
gauuaugggucac

SEQ ID NO: 1435184 - RNA, 15 nt, Human
gauuauucaguguca

SEQ ID NO: 1435185 - RNA, 14 nt, Human
gauuauucaguguc

SEQ ID NO: 1435186 - RNA, 13 nt, Human
gauuauucagugu

SEQ ID NO: 1435187 - RNA, 18 nt, Human
gaugucaauuucuguguu

SEQ ID NO: 1435188 - RNA, 15 nt, Human
gaugucaauuucugu

SEQ ID NO: 1435189 - RNA, 13 nt, Human
gauguaguauuuu

SEQ ID NO: 1435190 - RNA, 14 nt, Human
gauguaggagggac

SEQ ID NO: 1435191 - RNA, 16 nt, Human
gauguaggagggacug

SEQ ID NO: 1435192 - RNA, 20 nt, Human
gauuaucguuuucuuaaagu

SEQ ID NO: 1435193 - RNA, 21 nt, Human
gauuaucguuuucuuaaagug

SEQ ID NO: 1435194 - RNA, 13 nt, Human
gauuaucguuuuc

SEQ ID NO: 1435195 - RNA, 22 nt, Human
gauuauagauucuaaagauucu

SEQ ID NO: 1435196 - RNA, 18 nt, Human
gauuauagauucuaaaga

SEQ ID NO: 1435197 - RNA, 17 nt, Human
gauuauagauucuaaag

SEQ ID NO: 1435198 - RNA, 15 nt, Human
gauuauagauucuaa

SEQ ID NO: 1435199 - RNA, 14 nt, Human
gauuauagauucua

SEQ ID NO: 1435200 - RNA, 13 nt, Human
gauuauagauucu

SEQ ID NO: 1435201 - RNA, 14 nt, Human
gauuauauuaugaa

SEQ ID NO: 1435202 - RNA, 14 nt, Human
gauucuuccaucug

SEQ ID NO: 1435203 - RNA, 15 nt, Human
gauuuaccacuugug

SEQ ID NO: 1435204 - RNA, 22 nt, Human
gauucugcuggccucugcgagu

SEQ ID NO: 1435205 - RNA, 19 nt, Human
gauucugcuggccucugcg

SEQ ID NO: 1435206 - RNA, 17 nt, Human
gauucugcuggccucug

SEQ ID NO: 1435207 - RNA, 17 nt, Human
gauucugccuuugccag

SEQ ID NO: 1435208 - RNA, 15 nt, Human
gauucugccuuugcc

SEQ ID NO: 1435209 - RNA, 12 nt, Human
gauucugccuuu

SEQ ID NO: 1435210 - RNA, 21 nt, Human
gauucugcaguaaaucuuuua

SEQ ID NO: 1435211 - RNA, 19 nt, Human
gauucugcaguaaaucuuu

SEQ ID NO: 1435212 - RNA, 18 nt, Human
gauucugcaguaaaucuu

SEQ ID NO: 1435213 - RNA, 17 nt, Human
gauucugguuccagggu

SEQ ID NO: 1435214 - RNA, 22 nt, Human
gauucugguuccagggucccuc

SEQ ID NO: 1435215 - RNA, 14 nt, Human
gauuuauuaaagaa

SEQ ID NO: 1435216 - RNA, 13 nt, Human
gauuuauuaaaga

SEQ ID NO: 1435217 - RNA, 12 nt, Human
gauuuauuaaag

SEQ ID NO: 1435218 - RNA, 19 nt, Human
gauuuaucacacaaagcag

SEQ ID NO: 1435219 - RNA, 20 nt, Human
gauuuaucacacaaagcaga

SEQ ID NO: 1435220 - RNA, 17 nt, Human
gauuuaucacacaaagc

SEQ ID NO: 1435221 - RNA, 15 nt, Human
gauuuaucacacaaa

SEQ ID NO: 1435222 - RNA, 13 nt, Human
gauuuuuuccaaa

SEQ ID NO: 1435223 - RNA, 12 nt, Human
gauuuuuuccaa

SEQ ID NO: 1435224 - RNA, 11 nt, Human
gauuuuuucca

SEQ ID NO: 1435225 - RNA, 17 nt, Human
gauuuauuaaagaaaaa

SEQ ID NO: 1435226 - RNA, 19 nt, Human
gauuuuuuaauaauuuaga

SEQ ID NO: 1435227 - RNA, 19 nt, Human
gauuuauuaaagaaaaaaa

SEQ ID NO: 1435228 - RNA, 16 nt, Human
gauuuauuaaagaaaa

SEQ ID NO: 1435229 - RNA, 15 nt, Human
gauuuauuaaagaaa

SEQ ID NO: 1435230 - RNA, 16 nt, Human
gauuuaguuucaguag

SEQ ID NO: 1435231 - RNA, 15 nt, Human
gauuuaguuucagua

SEQ ID NO: 1435232 - RNA, 14 nt, Human
gauuuaguuucagu

SEQ ID NO: 1435233 - RNA, 13 nt, Human
gauuuaguuucag

SEQ ID NO: 1435234 - RNA, 20 nt, Human
gauuuaggagaagccaggaa

SEQ ID NO: 1435235 - RNA, 15 nt, Human
gauuuacgcucauug

SEQ ID NO: 1435236 - RNA, 16 nt, Human
gauuuaccacuugugu

SEQ ID NO: 1435237 - RNA, 16 nt, Human
gauucugcaguaaauc

SEQ ID NO: 1435238 - RNA, 15 nt, Human
gauucugcaguaaau

SEQ ID NO: 1435239 - RNA, 14 nt, Human
cugcauuuaaaaga

SEQ ID NO: 1435240 - RNA, 15 nt, Human
cugccccgcccucau

SEQ ID NO: 1435241 - RNA, 22 nt, Human
cugccccggccccucccccuga

SEQ ID NO: 1435242 - RNA, 14 nt, Human
cugccccgcccuca

SEQ ID NO: 1435243 - RNA, 12 nt, Human
cugccccccagc

SEQ ID NO: 1435244 - RNA, 21 nt, Human
cugccccccagccucuggcau

SEQ ID NO: 1435245 - RNA, 19 nt, Human
cugccccccagccucuggc

SEQ ID NO: 1435246 - RNA, 16 nt, Human
cugccccccagccucu

SEQ ID NO: 1435247 - RNA, 22 nt, Human
cugcccccaccccauucccgca

SEQ ID NO: 1435248 - RNA, 23 nt, Human
cugcccccaccccauucccgcag

SEQ ID NO: 1435249 - RNA, 14 nt, Human
cugccauauuaaau

SEQ ID NO: 1435250 - RNA, 18 nt, Human
cugccauaugauuuacau

SEQ ID NO: 1435251 - RNA, 23 nt, Human
cugccaguguccugagccccagg

SEQ ID NO: 1435252 - RNA, 17 nt, Human
cugccaguguccugagc

SEQ ID NO: 1435253 - RNA, 23 nt, Human
cugccagugacagacaggcucuu

SEQ ID NO: 1435254 - RNA, 21 nt, Human
cugccagugacagacaggcuc

SEQ ID NO: 1435255 - RNA, 19 nt, Human
cugccagugacagacaggc

SEQ ID NO: 1435256 - RNA, 16 nt, Human
cugccagugacagaca

SEQ ID NO: 1435257 - RNA, 12 nt, Human
cugccagugaca

SEQ ID NO: 1435258 - RNA, 16 nt, Human
cugccaguccuguccu

SEQ ID NO: 1435259 - RNA, 23 nt, Human
cugccagggccccucuccccagg

SEQ ID NO: 1435260 - RNA, 21 nt, Human
cugccagggccccucucccca

SEQ ID NO: 1435261 - RNA, 20 nt, Human
cugccagggccccucucccc

SEQ ID NO: 1435262 - RNA, 19 nt, Human
cugccagggccccucuccc

SEQ ID NO: 1435263 - RNA, 18 nt, Human
cugccagggccccucucc

SEQ ID NO: 1435264 - RNA, 17 nt, Human
cugccagggccccucuc

SEQ ID NO: 1435265 - RNA, 16 nt, Human
cugccagggccccucu

SEQ ID NO: 1435266 - RNA, 16 nt, Human
cugccagggcagggcc

SEQ ID NO: 1435267 - RNA, 15 nt, Human
cugccagggcagggc

SEQ ID NO: 1435268 - RNA, 13 nt, Human
cugccagggcagg

SEQ ID NO: 1435269 - RNA, 12 nt, Human
cugccagggcag

SEQ ID NO: 1435270 - RNA, 11 nt, Human
cugccagggca

SEQ ID NO: 1435271 - RNA, 17 nt, Human
cugcauuuaaaagauac

SEQ ID NO: 1435272 - RNA, 18 nt, Human
cugcauuuaaaagauaca

SEQ ID NO: 1435273 - RNA, 19 nt, Human
cugcaggcccuggccuccc

SEQ ID NO: 1435274 - RNA, 18 nt, Human
cugcaggcccuggccucc

SEQ ID NO: 1435275 - RNA, 17 nt, Human
cugcaggcccuggccuc

SEQ ID NO: 1435276 - RNA, 16 nt, Human
cugcaggcccuggccu

SEQ ID NO: 1435277 - RNA, 15 nt, Human
cugcaggcccuggcc

SEQ ID NO: 1435278 - RNA, 14 nt, Human
cugcaggcccuggc

SEQ ID NO: 1435279 - RNA, 13 nt, Human
cugcaggcccugg

SEQ ID NO: 1435280 - RNA, 21 nt, Human
cugcaggaucucaccaggcag

SEQ ID NO: 1435281 - RNA, 20 nt, Human
cugcaggaucucaccaggca

SEQ ID NO: 1435282 - RNA, 14 nt, Human
cugcaggaaucuuu

SEQ ID NO: 1435283 - RNA, 23 nt, Human
cugcaggaaggagcugccuggac

SEQ ID NO: 1435284 - RNA, 22 nt, Human
cugcaggaaggagcugccugga

SEQ ID NO: 1435285 - RNA, 21 nt, Human
cugcaggaaggagcugccugg

SEQ ID NO: 1435286 - RNA, 20 nt, Human
cugcaggaaggagcugccug

SEQ ID NO: 1435287 - RNA, 19 nt, Human
cugcaggaaggagcugccu

SEQ ID NO: 1435288 - RNA, 18 nt, Human
cugcaggaaggagcugcc

SEQ ID NO: 1435289 - RNA, 17 nt, Human
cugcaggaaggagcugc

SEQ ID NO: 1435290 - RNA, 16 nt, Human
cugcaggaaggagcug

SEQ ID NO: 1435291 - RNA, 15 nt, Human
cugcaggaaggagcu

SEQ ID NO: 1435292 - RNA, 14 nt, Human
cugcaggaaggagc

SEQ ID NO: 1435293 - RNA, 13 nt, Human
cugcaggaaggag

SEQ ID NO: 1435294 - RNA, 22 nt, Human
cugcagcuuguagccagccggg

SEQ ID NO: 1435295 - RNA, 21 nt, Human
cugcagcuuguagccagccgg

SEQ ID NO: 1435296 - RNA, 20 nt, Human
cugcagcuuguagccagccg

SEQ ID NO: 1435297 - RNA, 19 nt, Human
cugcagcuuguagccagcc

SEQ ID NO: 1435298 - RNA, 18 nt, Human
cugcagcuuguagccagc

SEQ ID NO: 1435299 - RNA, 17 nt, Human
cugcagcuuguagccag

SEQ ID NO: 1435300 - RNA, 16 nt, Human
cugcagcuuguagcca

SEQ ID NO: 1435301 - RNA, 11 nt, Human
cugcagcuugu

SEQ ID NO: 1435302 - RNA, 22 nt, Human
cugcagccucaggacugggagc

SEQ ID NO: 1435303 - RNA, 11 nt, Human
cugcagccucc

SEQ ID NO: 1435304 - RNA, 21 nt, Human
cugcagccucaggacugggag

SEQ ID NO: 1435305 - RNA, 20 nt, Human
cugcagccucaggacuggga

SEQ ID NO: 1435306 - RNA, 19 nt, Human
cugcagccucaggacuggg

SEQ ID NO: 1435307 - RNA, 18 nt, Human
cugcagccucaggacugg

SEQ ID NO: 1435308 - RNA, 17 nt, Human
cugcagccucaggacug

SEQ ID NO: 1435309 - RNA, 16 nt, Human
cugcagccucaggacu

SEQ ID NO: 1435310 - RNA, 14 nt, Human
cugcagccucagga

SEQ ID NO: 1435311 - RNA, 13 nt, Human
cugcagccucagg

SEQ ID NO: 1435312 - RNA, 14 nt, Human
cugcagccucagag

SEQ ID NO: 1435313 - RNA, 13 nt, Human
cugcagccucaga

SEQ ID NO: 1435314 - RNA, 12 nt, Human
cugcagccucag

SEQ ID NO: 1435315 - RNA, 17 nt, Human
cugcacucaaccuuaag

SEQ ID NO: 1435316 - RNA, 14 nt, Human
cugcacuacugaca

SEQ ID NO: 1435317 - RNA, 16 nt, Human
cugcacuacugacaug

SEQ ID NO: 1435318 - RNA, 17 nt, Human
cugcacuaacagagugg

SEQ ID NO: 1435319 - RNA, 15 nt, Human
cugcacgugcgggug

SEQ ID NO: 1435320 - RNA, 22 nt, Human
cugcacgaauggaagaggcacc

SEQ ID NO: 1435321 - RNA, 21 nt, Human
cugaugggguggaaggcaugg

SEQ ID NO: 1435322 - RNA, 23 nt, Human
cugaugggguggaaggcauggcg

SEQ ID NO: 1435323 - RNA, 13 nt, Human
cugauggagaagg

SEQ ID NO: 1435324 - RNA, 14 nt, Human
cugauggagaagga

SEQ ID NO: 1435325 - RNA, 15 nt, Human
cugauggagaaggaa

SEQ ID NO: 1435326 - RNA, 16 nt, Human
cugauggagaaggaag

SEQ ID NO: 1435327 - RNA, 17 nt, Human
cugauggagaaggaagg

SEQ ID NO: 1435328 - RNA, 23 nt, Human
cugaugcaucagaaagggagggc

SEQ ID NO: 1435329 - RNA, 22 nt, Human
cugaugcaucagaaagggaggg

SEQ ID NO: 1435330 - RNA, 21 nt, Human
cugaugcaucagaaagggagg

SEQ ID NO: 1435331 - RNA, 18 nt, Human
cugaugcaucagaaaggg

SEQ ID NO: 1435332 - RNA, 17 nt, Human
cugaugcaucagaaagg

SEQ ID NO: 1435333 - RNA, 14 nt, Human
cugaugcaucagaa

SEQ ID NO: 1435334 - RNA, 16 nt, Human
cugaugcagcuuauac

SEQ ID NO: 1435335 - RNA, 12 nt, Human
cugaugcagcuu

SEQ ID NO: 1435336 - RNA, 21 nt, Human
cugaugauuuagagugcuguc

SEQ ID NO: 1435337 - RNA, 14 nt, Human
cugaugcugccccu

SEQ ID NO: 1435338 - RNA, 12 nt, Human
cugaugcugaca

SEQ ID NO: 1435339 - RNA, 22 nt, Human
cucuuauggauguccccagcag

SEQ ID NO: 1435340 - RNA, 21 nt, Human
cucuuauggauguccccagca

SEQ ID NO: 1435341 - RNA, 19 nt, Human
cucuuauggauguccccag

SEQ ID NO: 1435342 - RNA, 20 nt, Human
cucuuaugcuguacccaguu

SEQ ID NO: 1435343 - RNA, 19 nt, Human
cucuuaugcuguacccagu

SEQ ID NO: 1435344 - RNA, 17 nt, Human
cucuuaugcuguaccca

SEQ ID NO: 1435345 - RNA, 13 nt, Human
cucuuaugcugua

SEQ ID NO: 1435346 - RNA, 18 nt, Human
cucuuauaucuauauuuu

SEQ ID NO: 1435347 - RNA, 15 nt, Human
cucuuauaucuauau

SEQ ID NO: 1435348 - RNA, 19 nt, Human
cugcaccggggccugggca

SEQ ID NO: 1435349 - RNA, 18 nt, Human
cugcaccggggccugggc

SEQ ID NO: 1435350 - RNA, 19 nt, Human
cugcaagucaguccaggau

SEQ ID NO: 1435351 - RNA, 16 nt, Human
cugcaccggggccugg

SEQ ID NO: 1435352 - RNA, 14 nt, Human
cugcaccggggccu

SEQ ID NO: 1435353 - RNA, 17 nt, Human
cugcaaggucuuugguu

SEQ ID NO: 1435354 - RNA, 19 nt, Human
cugcaagguacucugguga

SEQ ID NO: 1435355 - RNA, 18 nt, Human
cugcaagguacucuggug

SEQ ID NO: 1435356 - RNA, 17 nt, Human
cugcaagguacucuggu

SEQ ID NO: 1435357 - RNA, 16 nt, Human
cugcaagguacucugg

SEQ ID NO: 1435358 - RNA, 17 nt, Human
cugcaagcacagcccuu

SEQ ID NO: 1435359 - RNA, 14 nt, Human
cugcaagcacagcc

SEQ ID NO: 1435360 - RNA, 15 nt, Human
cugcaaaucaggcuu

SEQ ID NO: 1435361 - RNA, 19 nt, Human
cugcaaauacuguauauuc

SEQ ID NO: 1435362 - RNA, 13 nt, Human
cugcaaccuccac

SEQ ID NO: 1435363 - RNA, 20 nt, Human
cugcaaaucaggcuuuuguu

SEQ ID NO: 1435364 - RNA, 18 nt, Human
cugcaaaucaggcuuuug

SEQ ID NO: 1435365 - RNA, 23 nt, Human
cugcaacucaaggacuuugcagc

SEQ ID NO: 1435366 - RNA, 15 nt, Human
cugcaacucaaggac

SEQ ID NO: 1435367 - RNA, 17 nt, Human
cugcaaccuccaccucc

SEQ ID NO: 1435368 - RNA, 14 nt, Human
cugcaaccuccacc

SEQ ID NO: 1435369 - RNA, 16 nt, Human
cugcaaccuccaccuc

SEQ ID NO: 1435370 - RNA, 16 nt, Human
cuggccgaguccaagc

SEQ ID NO: 1435371 - RNA, 21 nt, Human
cuggcccuugcuuaccucuca

SEQ ID NO: 1435372 - RNA, 23 nt, Human
cuggcccugcuuccugcuugcca

SEQ ID NO: 1435373 - RNA, 21 nt, Human
cuggcccugggagaaucgcuc

SEQ ID NO: 1435374 - RNA, 22 nt, Human
cuggcccugcuuccugcuugcc

SEQ ID NO: 1435375 - RNA, 21 nt, Human
cuggcccugcuuccugcuugc

SEQ ID NO: 1435376 - RNA, 17 nt, Human
cuggcccugcuuccugc

SEQ ID NO: 1435377 - RNA, 13 nt, Human
cuggcccugcuuc

SEQ ID NO: 1435378 - RNA, 23 nt, Human
cuggcuauagaugucuuuuccca

SEQ ID NO: 1435379 - RNA, 19 nt, Human
cuggcuauagaugucuuuu

SEQ ID NO: 1435380 - RNA, 22 nt, Human
cuggcuaugcauuugaaaauuu

SEQ ID NO: 1435381 - RNA, 15 nt, Human
cuggcuaugcauuug

SEQ ID NO: 1435382 - RNA, 16 nt, Human
cuggcuaugcauuuga

SEQ ID NO: 1435383 - RNA, 18 nt, Human
cuggcuauagaugucuuu

SEQ ID NO: 1435384 - RNA, 13 nt, Human
cuggcuaugcauu

SEQ ID NO: 1435385 - RNA, 14 nt, Human
cuggcuaugcauuu

SEQ ID NO: 1435386 - RNA, 23 nt, Human
cuggcucuaauucacagugcucu

SEQ ID NO: 1435387 - RNA, 22 nt, Human
cuggcucuaauucacagugcuc

SEQ ID NO: 1435388 - RNA, 20 nt, Human
cuggcucuaauucacagugc

SEQ ID NO: 1435389 - RNA, 19 nt, Human
cuggcucuaauucacagug

SEQ ID NO: 1435390 - RNA, 15 nt, Human
cuggcucuaauucac

SEQ ID NO: 1435391 - RNA, 21 nt, Human
cuggcuccuugugccagagaa

SEQ ID NO: 1435392 - RNA, 18 nt, Human
cuggcuccuugugccaga

SEQ ID NO: 1435393 - RNA, 20 nt, Human
cuggcuccguccaggagccu

SEQ ID NO: 1435394 - RNA, 22 nt, Human
cuggcucucaccucuagguccc

SEQ ID NO: 1435395 - RNA, 19 nt, Human
cuggcucucaccucuaggu

SEQ ID NO: 1435396 - RNA, 16 nt, Human
cuggcucucaccucua

SEQ ID NO: 1435397 - RNA, 14 nt, Human
cuggcucucaccuc

SEQ ID NO: 1435398 - RNA, 13 nt, Human
cuggcucucaccu

SEQ ID NO: 1435399 - RNA, 20 nt, Human
cugggacguggcucagccag

SEQ ID NO: 1435400 - RNA, 17 nt, Human
cugggagaaaugaaaaa

SEQ ID NO: 1435401 - RNA, 23 nt, Human
cugggacguggcucagccagcac

SEQ ID NO: 1435402 - RNA, 21 nt, Human
cugggacguggcucagccagc

SEQ ID NO: 1435403 - RNA, 16 nt, Human
cugggagaaaugaaaa

SEQ ID NO: 1435404 - RNA, 21 nt, Human
cugggagaaaucuggcuucug

SEQ ID NO: 1435405 - RNA, 20 nt, Human
cugggagaaaucuggcuucu

SEQ ID NO: 1435406 - RNA, 19 nt, Human
cugggagaaaucuggcuuc

SEQ ID NO: 1435407 - RNA, 18 nt, Human
cugggagaaaucuggcuu

SEQ ID NO: 1435408 - RNA, 13 nt, Human
cugggagaaaucu

SEQ ID NO: 1435409 - RNA, 22 nt, Human
cugggccauucuccacagcaac

SEQ ID NO: 1435410 - RNA, 21 nt, Human
cugggccauucuccacagcaa

SEQ ID NO: 1435411 - RNA, 20 nt, Human
cugggccauucuccacagca

SEQ ID NO: 1435412 - RNA, 19 nt, Human
cugggccauucuccacagc

SEQ ID NO: 1435413 - RNA, 23 nt, Human
cugggccauguccaaagaggcug

SEQ ID NO: 1435414 - RNA, 22 nt, Human
cugggccauguccaaagaggcu

SEQ ID NO: 1435415 - RNA, 19 nt, Human
cugggccauguccaaagag

SEQ ID NO: 1435416 - RNA, 18 nt, Human
cugggccauguccaaaga

SEQ ID NO: 1435417 - RNA, 17 nt, Human
cugggccauguccaaag

SEQ ID NO: 1435418 - RNA, 22 nt, Human
cugggcaugagggguuccuccc

SEQ ID NO: 1435419 - RNA, 23 nt, Human
cugggcaugagggguuccucccc

SEQ ID NO: 1435420 - RNA, 13 nt, Human
cugggcaggaggg

SEQ ID NO: 1435421 - RNA, 14 nt, Human
cugggugacauuug

SEQ ID NO: 1435422 - RNA, 23 nt, Human
cuggggccuguacugccugcuug

SEQ ID NO: 1435423 - RNA, 22 nt, Human
cuggggccuguacugccugcuu

SEQ ID NO: 1435424 - RNA, 21 nt, Human
cuggggccuguacugccugcu

SEQ ID NO: 1435425 - RNA, 20 nt, Human
cuggggccuguacugccugc

SEQ ID NO: 1435426 - RNA, 19 nt, Human
cuggggccuguacugccug

SEQ ID NO: 1435427 - RNA, 18 nt, Human
cuggggccuguacugccu

SEQ ID NO: 1435428 - RNA, 21 nt, Human
cugggugcuacuggggaaacu

SEQ ID NO: 1435429 - RNA, 18 nt, Human
cugggugcuacuggggaa

SEQ ID NO: 1435430 - RNA, 17 nt, Human
cugggugcuacugggga

SEQ ID NO: 1435431 - RNA, 14 nt, Human
cugggugcuacugg

SEQ ID NO: 1435432 - RNA, 19 nt, Human
cuggggacuuggccucucu

SEQ ID NO: 1435433 - RNA, 18 nt, Human
cuggggacuuggccucuc

SEQ ID NO: 1435434 - RNA, 17 nt, Human
cuggggacuuggccucu

SEQ ID NO: 1435435 - RNA, 15 nt, Human
cuggggacuuggccu

SEQ ID NO: 1435436 - RNA, 14 nt, Human
cuggggacuuggcc

SEQ ID NO: 1435437 - RNA, 22 nt, Human
cuggggaccugguacccuccug

SEQ ID NO: 1435438 - RNA, 20 nt, Human
cuggggaccugguacccucc

SEQ ID NO: 1435439 - RNA, 12 nt, Human
cuggggacaggu

SEQ ID NO: 1435440 - RNA, 19 nt, Human
cuggggacagguccucagu

SEQ ID NO: 1435441 - RNA, 17 nt, Human
cuggggccuguacugcc

SEQ ID NO: 1435442 - RNA, 16 nt, Human
cuggggccuguacugc

SEQ ID NO: 1435443 - RNA, 14 nt, Human
cuggggccuguacu

SEQ ID NO: 1435444 - RNA, 16 nt, Human
cuggggccugggacaa

SEQ ID NO: 1435445 - RNA, 15 nt, Human
cuggggccugggaca

SEQ ID NO: 1435446 - RNA, 13 nt, Human
cuggggccuggga

SEQ ID NO: 1435447 - RNA, 12 nt, Human
cuggggccuggg

SEQ ID NO: 1435448 - RNA, 21 nt, Human
cuggugcggcuggccauggag

SEQ ID NO: 1435449 - RNA, 20 nt, Human
cuggugcggcuggccaugga

SEQ ID NO: 1435450 - RNA, 19 nt, Human
cuggugcggcuggccaugg

SEQ ID NO: 1435451 - RNA, 12 nt, Human
cuggugccaccu

SEQ ID NO: 1435452 - RNA, 18 nt, Human
cuggugcggcuggccaug

SEQ ID NO: 1435453 - RNA, 15 nt, Human
cuggugcggcuggcc

SEQ ID NO: 1435454 - RNA, 14 nt, Human
cuggugcggcuggc

SEQ ID NO: 1435455 - RNA, 15 nt, Human
cuggugccuccagag

SEQ ID NO: 1435456 - RNA, 16 nt, Human
cuggugccuccagagg

SEQ ID NO: 1435457 - RNA, 14 nt, Human
cuggugccuccaga

SEQ ID NO: 1435458 - RNA, 20 nt, Human
cuggugccaauuucaaguuc

SEQ ID NO: 1435459 - RNA, 18 nt, Human
cuggugccaauuucaagu

SEQ ID NO: 1435460 - RNA, 16 nt, Human
cuggugccaauuucaa

SEQ ID NO: 1435461 - RNA, 15 nt, Human
cuggugccaauuuca

SEQ ID NO: 1435462 - RNA, 14 nt, Human
cugggugguggccu

SEQ ID NO: 1435463 - RNA, 17 nt, Human
cugggugguggccuggu

SEQ ID NO: 1435464 - RNA, 19 nt, Human
cugggugguacccucugga

SEQ ID NO: 1435465 - RNA, 16 nt, Human
cugggugguacccucu

SEQ ID NO: 1435466 - RNA, 19 nt, Human
cugcugaucgccuucccca

SEQ ID NO: 1435467 - RNA, 18 nt, Human
cugcugaucgccuucccc

SEQ ID NO: 1435468 - RNA, 17 nt, Human
cugcugaucgccuuccc

SEQ ID NO: 1435469 - RNA, 16 nt, Human
cugcugaucgccuucc

SEQ ID NO: 1435470 - RNA, 19 nt, Human
cugcugauauuuucucuag

SEQ ID NO: 1435471 - RNA, 18 nt, Human
cugcugauauuuucucua

SEQ ID NO: 1435472 - RNA, 17 nt, Human
cugcugauauuuucucu

SEQ ID NO: 1435473 - RNA, 14 nt, Human
cugcugauauuuuc

SEQ ID NO: 1435474 - RNA, 18 nt, Human
cugcucacgucaaaugca

SEQ ID NO: 1435475 - RNA, 18 nt, Human
cugcuguggccaggaggu

SEQ ID NO: 1435476 - RNA, 21 nt, Human
cugcuguggccaggaggugcc

SEQ ID NO: 1435477 - RNA, 17 nt, Human
cugcuguggccaggagg

SEQ ID NO: 1435478 - RNA, 16 nt, Human
cugcuguggccaggag

SEQ ID NO: 1435479 - RNA, 15 nt, Human
cugcuguggccagga

SEQ ID NO: 1435480 - RNA, 14 nt, Human
cugcuguggccagg

SEQ ID NO: 1435481 - RNA, 12 nt, Human
cugcuguggcca

SEQ ID NO: 1435482 - RNA, 21 nt, Human
cugcugugauacgaugcuuca

SEQ ID NO: 1435483 - RNA, 21 nt, Human
cugcugucuggguggcucacu

SEQ ID NO: 1435484 - RNA, 19 nt, Human
cugcugucuggguggcuca

SEQ ID NO: 1435485 - RNA, 15 nt, Human
cugcugugaaagaag

SEQ ID NO: 1435486 - RNA, 21 nt, Human
cugcugucugggugcuacugg

SEQ ID NO: 1435487 - RNA, 16 nt, Human
cugcugucugggugcu

SEQ ID NO: 1435488 - RNA, 15 nt, Human
cugcugucugggugc

SEQ ID NO: 1435489 - RNA, 14 nt, Human
cugcugucugggug

SEQ ID NO: 1435490 - RNA, 13 nt, Human
cugcugucugggu

SEQ ID NO: 1435491 - RNA, 12 nt, Human
cugcugucuggg

SEQ ID NO: 1435492 - RNA, 18 nt, Human
cugcugucgcucucaguu

SEQ ID NO: 1435493 - RNA, 22 nt, Human
cuggaugauacuaauaaacuaa

SEQ ID NO: 1435494 - RNA, 23 nt, Human
cuggaugauacuaauaaacuaau

SEQ ID NO: 1435495 - RNA, 15 nt, Human
cuggaugauacuaau

SEQ ID NO: 1435496 - RNA, 14 nt, Human
cuggaugauacuaa

SEQ ID NO: 1435497 - RNA, 20 nt, Human
cuggaugagcucccacaagc

SEQ ID NO: 1435498 - RNA, 15 nt, Human
cuggaugagcuccca

SEQ ID NO: 1435499 - RNA, 14 nt, Human
cuggaugagcuccc

SEQ ID NO: 1435500 - RNA, 15 nt, Human
cuggaugacauuaaa

SEQ ID NO: 1435501 - RNA, 18 nt, Human
cuggaugauacuaauaaa

SEQ ID NO: 1435502 - RNA, 16 nt, Human
cuggaugauacuaaua

SEQ ID NO: 1435503 - RNA, 18 nt, Human
cuggaguugaucuggaac

SEQ ID NO: 1435504 - RNA, 17 nt, Human
cuggaguugaucuggaa

SEQ ID NO: 1435505 - RNA, 16 nt, Human
cuggaguugaucugga

SEQ ID NO: 1435506 - RNA, 15 nt, Human
cuggaguugaucugg

SEQ ID NO: 1435507 - RNA, 13 nt, Human
cuggaucucccug

SEQ ID NO: 1435508 - RNA, 12 nt, Human
cugcuuaauuca

SEQ ID NO: 1435509 - RNA, 13 nt, Human
cugcuuaauucaa

SEQ ID NO: 1435510 - RNA, 19 nt, Human
cuggacugugugcucagga

SEQ ID NO: 1435511 - RNA, 22 nt, Human
cuggacugugugcucaggagcc

SEQ ID NO: 1435512 - RNA, 23 nt, Human
cuggacuuaagcaucuggcucua

SEQ ID NO: 1435513 - RNA, 22 nt, Human
cuggacuuaagcaucuggcucu

SEQ ID NO: 1435514 - RNA, 18 nt, Human
cuggacuuaagcaucugg

SEQ ID NO: 1435515 - RNA, 20 nt, Human
cugcuuauccguuagccgug

SEQ ID NO: 1435516 - RNA, 23 nt, Human
cuggacugugugcucaggagccc

SEQ ID NO: 1435517 - RNA, 19 nt, Human
cuucuuaaaguauucuucu

SEQ ID NO: 1435518 - RNA, 14 nt, Human
cuucuuaaaguauu

SEQ ID NO: 1435519 - RNA, 12 nt, Human
cuucugagcucc

SEQ ID NO: 1435520 - RNA, 20 nt, Human
cuucugagcuauuucaucua

SEQ ID NO: 1435521 - RNA, 18 nt, Human
cuucugagcuauuucauc

SEQ ID NO: 1435522 - RNA, 17 nt, Human
cuucugagcuauuucau

SEQ ID NO: 1435523 - RNA, 16 nt, Human
cuucugagcuauuuca

SEQ ID NO: 1435524 - RNA, 22 nt, Human
cuucugagcccgguaagagcaa

SEQ ID NO: 1435525 - RNA, 22 nt, Human
cuucugagcagcgagccugcua

SEQ ID NO: 1435526 - RNA, 21 nt, Human
cuucugagcagcgagccugcu

SEQ ID NO: 1435527 - RNA, 20 nt, Human
cuucugagcagcgagccugc

SEQ ID NO: 1435528 - RNA, 18 nt, Human
cuucugagcagcgagccu

SEQ ID NO: 1435529 - RNA, 23 nt, Human
cuucugagcacuguuuauacacu

SEQ ID NO: 1435530 - RNA, 15 nt, Human
cuucugagcacuguu

SEQ ID NO: 1435531 - RNA, 11 nt, Human
cuucugagacg

SEQ ID NO: 1435532 - RNA, 22 nt, Human
cuucugagacgucaugaggaga

SEQ ID NO: 1435533 - RNA, 20 nt, Human
cuucuguuuuauaauuuugu

SEQ ID NO: 1435534 - RNA, 15 nt, Human
cuucuguuuuauaau

SEQ ID NO: 1435535 - RNA, 18 nt, Human
cuugccucuuccuugaag

SEQ ID NO: 1435536 - RNA, 16 nt, Human
cuugccucuuccuuga

SEQ ID NO: 1435537 - RNA, 13 nt, Human
cuugccucuuccu

SEQ ID NO: 1435538 - RNA, 12 nt, Human
cuugccucuucc

SEQ ID NO: 1435539 - RNA, 20 nt, Human
cuugccucugugcugugugu

SEQ ID NO: 1435540 - RNA, 19 nt, Human
cuugccucugugcugugug

SEQ ID NO: 1435541 - RNA, 16 nt, Human
cuugccucugugcugu

SEQ ID NO: 1435542 - RNA, 15 nt, Human
cuugccucugugcug

SEQ ID NO: 1435543 - RNA, 14 nt, Human
cuugccucugugcu

SEQ ID NO: 1435544 - RNA, 13 nt, Human
cuugccucugugc

SEQ ID NO: 1435545 - RNA, 15 nt, Human
cuugccucaaugcca

SEQ ID NO: 1435546 - RNA, 18 nt, Human
cuugccucaaccucccaa

SEQ ID NO: 1435547 - RNA, 17 nt, Human
cuugccucaaccuccca

SEQ ID NO: 1435548 - RNA, 18 nt, Human
cuugcuccuccuucugcu

SEQ ID NO: 1435549 - RNA, 15 nt, Human
cuugcuccuccuucu

SEQ ID NO: 1435550 - RNA, 12 nt, Human
cuugccugcagg

SEQ ID NO: 1435551 - RNA, 17 nt, Human
cuugccucaaugccagu

SEQ ID NO: 1435552 - RNA, 22 nt, Human
cuugacaccugcugagaaaaca

SEQ ID NO: 1435553 - RNA, 15 nt, Human
cuugacaccugcuga

SEQ ID NO: 1435554 - RNA, 13 nt, Human
cuugacaccugcu

SEQ ID NO: 1435555 - RNA, 16 nt, Human
cuugacaacuggcagg

SEQ ID NO: 1435556 - RNA, 20 nt, Human
cuugacaacuggcaggcagg

SEQ ID NO: 1435557 - RNA, 14 nt, Human
cuugacaacuggca

SEQ ID NO: 1435558 - RNA, 12 nt, Human
cuugaaugaaaa

SEQ ID NO: 1435559 - RNA, 18 nt, Human
cuuggccacagccagggg

SEQ ID NO: 1435560 - RNA, 16 nt, Human
cuuggccacagccagg

SEQ ID NO: 1435561 - RNA, 15 nt, Human
cuuggccaugcagaa

SEQ ID NO: 1435562 - RNA, 18 nt, Human
cuuggccaugcagaaagc

SEQ ID NO: 1435563 - RNA, 22 nt, Human
cuuuucaaauagggucuaacuc

SEQ ID NO: 1435564 - RNA, 19 nt, Human
cuuuggugagaaccugggu

SEQ ID NO: 1435565 - RNA, 17 nt, Human
cuuuggucucuugcuug

SEQ ID NO: 1435566 - RNA, 16 nt, Human
cuuuggucucuugcuu

SEQ ID NO: 1435567 - RNA, 15 nt, Human
cuuuggucucuugcu

SEQ ID NO: 1435568 - RNA, 14 nt, Human
cuuugguccuucaa

SEQ ID NO: 1435569 - RNA, 14 nt, Human
cuuugguagaaaag

SEQ ID NO: 1435570 - RNA, 18 nt, Human
cuuuggggcuaauuuaac

SEQ ID NO: 1435571 - RNA, 16 nt, Human
cuuugggcuugggccu

SEQ ID NO: 1435572 - RNA, 21 nt, Human
cuuugggcuucagcugccagu

SEQ ID NO: 1435573 - RNA, 18 nt, Human
cuuugggcuucagcugcc

SEQ ID NO: 1435574 - RNA, 20 nt, Human
cuuugguaccagauaacuuu

SEQ ID NO: 1435575 - RNA, 15 nt, Human
cuuugguaccagaua

SEQ ID NO: 1435576 - RNA, 15 nt, Human
cuuuuauaaacuuua

SEQ ID NO: 1435577 - RNA, 17 nt, Human
cuuuuaggacccuuccc

SEQ ID NO: 1435578 - RNA, 21 nt, Human
cuuuuaguaaagucaaggaga

SEQ ID NO: 1435579 - RNA, 19 nt, Human
cuuuuauaaacuuuaccuu

SEQ ID NO: 1435580 - RNA, 16 nt, Human
cuuuuauaaacuuuac

SEQ ID NO: 1435581 - RNA, 18 nt, Human
cuuuuauaaacuuuaccu

SEQ ID NO: 1435582 - RNA, 18 nt, Human
cuuucuccuuuaauugua

SEQ ID NO: 1435583 - RNA, 17 nt, Human
cuuucuauccucuguaa

SEQ ID NO: 1435584 - RNA, 16 nt, Human
cuuucuauccucugua

SEQ ID NO: 1435585 - RNA, 21 nt, Human
cuuucuaguugaaaauaaagu

SEQ ID NO: 1435586 - RNA, 18 nt, Human
cuuucuaguugaaaauaa

SEQ ID NO: 1435587 - RNA, 16 nt, Human
cuuucuaguugaaaau

SEQ ID NO: 1435588 - RNA, 14 nt, Human
cuuucuaguugaaa

SEQ ID NO: 1435589 - RNA, 20 nt, Human
cuuucgggccauguugcccc

SEQ ID NO: 1435590 - RNA, 14 nt, Human
cuuucgggccaugu

SEQ ID NO: 1435591 - RNA, 17 nt, Human
cuuucggauccagggag

SEQ ID NO: 1435592 - RNA, 21 nt, Human
cuuugauucauaguaacuucu

SEQ ID NO: 1435593 - RNA, 19 nt, Human
cuuugauucauaguaacuu

SEQ ID NO: 1435594 - RNA, 12 nt, Human
cuuugauucaua

SEQ ID NO: 1435595 - RNA, 16 nt, Human
cuuugauguuccuucc

SEQ ID NO: 1435596 - RNA, 20 nt, Human
cuuugauuaaagacuccagu

SEQ ID NO: 1435597 - RNA, 14 nt, Human
cuuugauguuccuu

SEQ ID NO: 1435598 - RNA, 21 nt, Human
cuuugagugcaguccugauca

SEQ ID NO: 1435599 - RNA, 22 nt, Human
cuuugagcuacugccgucagug

SEQ ID NO: 1435600 - RNA, 21 nt, Human
cuuugagcuuaaucuuugaaa

SEQ ID NO: 1435601 - RNA, 14 nt, Human
cuuucagagccucc

SEQ ID NO: 1435602 - RNA, 13 nt, Human
cuuucagagccuc

SEQ ID NO: 1435603 - RNA, 12 nt, Human
cuuucagagccu

SEQ ID NO: 1435604 - RNA, 11 nt, Human
cuuucagagcc

SEQ ID NO: 1435605 - RNA, 21 nt, Human
cuuucagaauaugucagugcu

SEQ ID NO: 1435606 - RNA, 16 nt, Human
cuuucagaauauguca

SEQ ID NO: 1435607 - RNA, 14 nt, Human
cuuucagaauaugu

SEQ ID NO: 1435608 - RNA, 19 nt, Human
cuuuaauauaaaugcaaau

SEQ ID NO: 1435609 - RNA, 18 nt, Human
cuuuaauauaaaugcaaa

SEQ ID NO: 1435610 - RNA, 20 nt, Human
cuuuaauauaaaugcaaaua

SEQ ID NO: 1435611 - RNA, 16 nt, Human
cuuuaauauaaaugca

SEQ ID NO: 1435612 - RNA, 15 nt, Human
cuuuaauauaaaugc

SEQ ID NO: 1435613 - RNA, 14 nt, Human
cuuuaauauaaaug

SEQ ID NO: 1435614 - RNA, 12 nt, Human
cuuuaauauaaa

SEQ ID NO: 1435615 - RNA, 18 nt, Human
cuuuaacugacaagccau

SEQ ID NO: 1435616 - RNA, 21 nt, Human
cuuuaacucccauuaccaugu

SEQ ID NO: 1435617 - RNA, 17 nt, Human
cuuuaacucccauuacc

SEQ ID NO: 1435618 - RNA, 22 nt, Human
cuuuaacucccauuaccaugua

SEQ ID NO: 1435619 - RNA, 20 nt, Human
cuuuaaggggaggaaccaga

SEQ ID NO: 1435620 - RNA, 20 nt, Human
cuuuacacaauagaauuaua

SEQ ID NO: 1435621 - RNA, 23 nt, Human
cuuuacaaaacaaacucauucau

SEQ ID NO: 1435622 - RNA, 18 nt, Human
cuuuacaaaacaaacuca

SEQ ID NO: 1435623 - RNA, 16 nt, Human
cuuuacaaaacaaacu

SEQ ID NO: 1435624 - RNA, 22 nt, Human
cuuuaacaacauguuuccagca

SEQ ID NO: 1435625 - RNA, 19 nt, Human
cuuuaacaacauguuucca

SEQ ID NO: 1435626 - RNA, 16 nt, Human
cuuuaacaacauguuu

SEQ ID NO: 1435627 - RNA, 15 nt, Human
cuuuaacaacauguu

SEQ ID NO: 1435628 - RNA, 13 nt, Human
cuuuaaauugugu

SEQ ID NO: 1435629 - RNA, 13 nt, Human
cuuuaaaguucuu

SEQ ID NO: 1435630 - RNA, 23 nt, Human
cuuuaaagugacuaauggcauga

SEQ ID NO: 1435631 - RNA, 24 nt, Human
cuugugaugucauacagagaaguc

SEQ ID NO: 1435632 - RNA, 22 nt, Human
cuugugaugucauacagagaag

SEQ ID NO: 1435633 - RNA, 21 nt, Human
cuugugaugucauacagagaa

SEQ ID NO: 1435634 - RNA, 20 nt, Human
cuugugaugucauacagaga

SEQ ID NO: 1435635 - RNA, 23 nt, Human
cuugugauccacucgccucagcc

SEQ ID NO: 1435636 - RNA, 23 nt, Human
cuugugaggaaagucauuggcuu

SEQ ID NO: 1435637 - RNA, 17 nt, Human
cuugugaggaaagucau

SEQ ID NO: 1435638 - RNA, 19 nt, Human
cuugugaggaaagucauug

SEQ ID NO: 1435639 - RNA, 13 nt, Human
cuugugaggaaag

SEQ ID NO: 1435640 - RNA, 16 nt, Human
cuugugaggaaaguca

SEQ ID NO: 1435641 - RNA, 20 nt, Human
cuuagauuuuacaugaagua

SEQ ID NO: 1435642 - RNA, 19 nt, Human
cuuagauuuuacaugaagu

SEQ ID NO: 1435643 - RNA, 16 nt, Human
cuuagauuuuacauga

SEQ ID NO: 1435644 - RNA, 15 nt, Human
cuuagauuuuacaug

SEQ ID NO: 1435645 - RNA, 13 nt, Human
cuuagauuuuaca

SEQ ID NO: 1435646 - RNA, 12 nt, Human
cuuagauuuuac

SEQ ID NO: 1435647 - RNA, 21 nt, Human
cuuagauuucauaguucagaa

SEQ ID NO: 1435648 - RNA, 14 nt, Human
cuuagauuucauag

SEQ ID NO: 1435649 - RNA, 13 nt, Human
cuuagauuucaua

SEQ ID NO: 1435650 - RNA, 24 nt, Human
cuuagauucucugugucuaagauu

SEQ ID NO: 1435651 - RNA, 22 nt, Human
cuuagauucucugugucuaaga

SEQ ID NO: 1435652 - RNA, 20 nt, Human
cuuagauucucugugucuaa

SEQ ID NO: 1435653 - RNA, 11 nt, Human
cuuagauucuc

SEQ ID NO: 1435654 - RNA, 18 nt, Human
cuuagauguucuaagucu

SEQ ID NO: 1435655 - RNA, 14 nt, Human
cuuagauguucuaa

SEQ ID NO: 1435656 - RNA, 20 nt, Human
cuuagauguuccaguaaucu

SEQ ID NO: 1435657 - RNA, 13 nt, Human
cuuacagcaggca

SEQ ID NO: 1435658 - RNA, 12 nt, Human
cuuacagcaggc

SEQ ID NO: 1435659 - RNA, 17 nt, Human
cuuacccucauguucuu

SEQ ID NO: 1435660 - RNA, 18 nt, Human
cuuacccucauguucuua

SEQ ID NO: 1435661 - RNA, 19 nt, Human
cuuacccucauguucuuaa

SEQ ID NO: 1435662 - RNA, 24 nt, Human
cuuaaaauguucacuuuugacaaa

SEQ ID NO: 1435663 - RNA, 22 nt, Human
cuguugggagagggcgcaggcc

SEQ ID NO: 1435664 - RNA, 20 nt, Human
cuguugggguggguauaaaa

SEQ ID NO: 1435665 - RNA, 20 nt, Human
cuguugggagagggcgcagg

SEQ ID NO: 1435666 - RNA, 17 nt, Human
cuguugggguggguaua

SEQ ID NO: 1435667 - RNA, 18 nt, Human
cuguugggguggguauaa

SEQ ID NO: 1435668 - RNA, 23 nt, Human
cuguuggaauggauuuuucuuua

SEQ ID NO: 1435669 - RNA, 22 nt, Human
cuuaaagugccaguauuuuaaa

SEQ ID NO: 1435670 - RNA, 16 nt, Human
cuuaaagugccaguau

SEQ ID NO: 1435671 - RNA, 13 nt, Human
cuuaaaggggaga

SEQ ID NO: 1435672 - RNA, 15 nt, Human
cuuaaagcuuucaga

SEQ ID NO: 1435673 - RNA, 19 nt, Human
cuuaaacaaaaauuaaaau

SEQ ID NO: 1435674 - RNA, 13 nt, Human
cuuaaacaaaaau

SEQ ID NO: 1435675 - RNA, 20 nt, Human
cuuacacccacaguggaaag

SEQ ID NO: 1435676 - RNA, 11 nt, Human
cuuacacccac

SEQ ID NO: 1435677 - RNA, 21 nt, Human
cugugucuaagauucuagauc

SEQ ID NO: 1435678 - RNA, 20 nt, Human
cugugucuaagauucuagau

SEQ ID NO: 1435679 - RNA, 19 nt, Human
cugugucuaagauucuaga

SEQ ID NO: 1435680 - RNA, 18 nt, Human
cugugucuaagauucuag

SEQ ID NO: 1435681 - RNA, 17 nt, Human
cugugucuaagauucua

SEQ ID NO: 1435682 - RNA, 16 nt, Human
cugugucuaagauucu

SEQ ID NO: 1435683 - RNA, 15 nt, Human
cuguguacugcaguu

SEQ ID NO: 1435684 - RNA, 22 nt, Human
cuguguacauaacugaaaaugu

SEQ ID NO: 1435685 - RNA, 20 nt, Human
cuguguacauaacugaaaau

SEQ ID NO: 1435686 - RNA, 19 nt, Human
cuguguacauaacugaaaa

SEQ ID NO: 1435687 - RNA, 17 nt, Human
cuguguacauaacugaa

SEQ ID NO: 1435688 - RNA, 18 nt, Human
cuguguaagauuuguuuu

SEQ ID NO: 1435689 - RNA, 18 nt, Human
cuguguaauuagugccac

SEQ ID NO: 1435690 - RNA, 23 nt, Human
cuguguaagggccagaaauaucu

SEQ ID NO: 1435691 - RNA, 13 nt, Human
cuguguaagauuu

SEQ ID NO: 1435692 - RNA, 16 nt, Human
cuguguaacugcccaa

SEQ ID NO: 1435693 - RNA, 15 nt, Human
cuguguaacugccca

SEQ ID NO: 1435694 - RNA, 13 nt, Human
cuguguaacugcc

SEQ ID NO: 1435695 - RNA, 11 nt, Human
cuguguaacug

SEQ ID NO: 1435696 - RNA, 16 nt, Human
cugugcucagcccuga

SEQ ID NO: 1435697 - RNA, 19 nt, Human
cugugcucagcccugagga

SEQ ID NO: 1435698 - RNA, 15 nt, Human
cugugcucagcccug

SEQ ID NO: 1435699 - RNA, 13 nt, Human
cugugcucagccc

SEQ ID NO: 1435700 - RNA, 21 nt, Human
cugugcuauggugcucugucu

SEQ ID NO: 1435701 - RNA, 19 nt, Human
cugugcuauggugcucugu

SEQ ID NO: 1435702 - RNA, 23 nt, Human
cugugaccugcugagcucugaga

SEQ ID NO: 1435703 - RNA, 17 nt, Human
cugugaccacaacauga

SEQ ID NO: 1435704 - RNA, 16 nt, Human
cugugaccacaacaug

SEQ ID NO: 1435705 - RNA, 14 nt, Human
cugugaccacaaca

SEQ ID NO: 1435706 - RNA, 17 nt, Human
cugugaccaaugucuug

SEQ ID NO: 1435707 - RNA, 16 nt, Human
cugugaccaaugucuu

SEQ ID NO: 1435708 - RNA, 15 nt, Human
cugugaccaaugucu

SEQ ID NO: 1435709 - RNA, 18 nt, Human
cuguucacuuuuccuccc

SEQ ID NO: 1435710 - RNA, 17 nt, Human
cuguucacuuuuccucc

SEQ ID NO: 1435711 - RNA, 16 nt, Human
cuguucacuuuuccuc

SEQ ID NO: 1435712 - RNA, 11 nt, Human
cuucagaaaga

SEQ ID NO: 1435713 - RNA, 19 nt, Human
cuucagacagagaggacug

SEQ ID NO: 1435714 - RNA, 12 nt, Human
cuucagaaagac

SEQ ID NO: 1435715 - RNA, 20 nt, Human
cuucagacagagaggacugu

SEQ ID NO: 1435716 - RNA, 19 nt, Human
cuuauugccucacuucagg

SEQ ID NO: 1435717 - RNA, 14 nt, Human
cuuauugccucacu

SEQ ID NO: 1435718 - RNA, 13 nt, Human
cuuauugccucac

SEQ ID NO: 1435719 - RNA, 17 nt, Human
cuucaccuucaccuuca

SEQ ID NO: 1435720 - RNA, 19 nt, Human
cuucaucccacuccaacuc

SEQ ID NO: 1435721 - RNA, 17 nt, Human
cuucaguuaugauuuuu

SEQ ID NO: 1435722 - RNA, 20 nt, Human
cuucaguguauggaaauaaa

SEQ ID NO: 1435723 - RNA, 17 nt, Human
cuucaguguauggaaau

SEQ ID NO: 1435724 - RNA, 20 nt, Human
cuucaucucccaccuagcag

SEQ ID NO: 1435725 - RNA, 19 nt, Human
cuucaucucccaccuagca

SEQ ID NO: 1435726 - RNA, 13 nt, Human
cuucaucucccac

SEQ ID NO: 1435727 - RNA, 17 nt, Human
cuucaucgaaucuacua

SEQ ID NO: 1435728 - RNA, 15 nt, Human
cuucaucgaaucuac

SEQ ID NO: 1435729 - RNA, 11 nt, Human
cuucauccucu

SEQ ID NO: 1435730 - RNA, 13 nt, Human
cuucauggauggg

SEQ ID NO: 1435731 - RNA, 23 nt, Human
cuucaugcugucuacacuaagag

SEQ ID NO: 1435732 - RNA, 16 nt, Human
cuucaugccagcuacu

SEQ ID NO: 1435733 - RNA, 15 nt, Human
cuucaugccagcuac

SEQ ID NO: 1435734 - RNA, 14 nt, Human
cuucaugccagcua

SEQ ID NO: 1435735 - RNA, 21 nt, Human
cuucaugcauggaaauucccu

SEQ ID NO: 1435736 - RNA, 23 nt, Human
cuucaugcauggaaauucccuuc

SEQ ID NO: 1435737 - RNA, 15 nt, Human
cuuccaugcugugcg

SEQ ID NO: 1435738 - RNA, 14 nt, Human
cuuccaugcugugc

SEQ ID NO: 1435739 - RNA, 17 nt, Human
cuuccaugauucuauuu

SEQ ID NO: 1435740 - RNA, 14 nt, Human
cuuccaugauucua

SEQ ID NO: 1435741 - RNA, 21 nt, Human
cuuauuaacaauuaggcagac

SEQ ID NO: 1435742 - RNA, 17 nt, Human
cuuauuagagugucuuu

SEQ ID NO: 1435743 - RNA, 13 nt, Human
cuuaugguaccag

SEQ ID NO: 1435744 - RNA, 19 nt, Human
cuuaugguaccagaugcag

SEQ ID NO: 1435745 - RNA, 20 nt, Human
cuuauggauguccccagcag

SEQ ID NO: 1435746 - RNA, 21 nt, Human
cuuauggauguccccagcaga

SEQ ID NO: 1435747 - RNA, 14 nt, Human
cuuauggaauugau

SEQ ID NO: 1435748 - RNA, 18 nt, Human
cuuauggauguccccagc

SEQ ID NO: 1435749 - RNA, 17 nt, Human
cuuauggauguccccag

SEQ ID NO: 1435750 - RNA, 16 nt, Human
cuuauggaugucccca

SEQ ID NO: 1435751 - RNA, 14 nt, Human
cuuauggauguccc

SEQ ID NO: 1435752 - RNA, 23 nt, Human
cuuauggaauugauuugcauuga

SEQ ID NO: 1435753 - RNA, 21 nt, Human
cuuauggaauugauuugcauu

SEQ ID NO: 1435754 - RNA, 20 nt, Human
cuuauggaauugauuugcau

SEQ ID NO: 1435755 - RNA, 19 nt, Human
cuuauggaauugauuugca

SEQ ID NO: 1435756 - RNA, 17 nt, Human
cuuauggaauugauuug

SEQ ID NO: 1435757 - RNA, 16 nt, Human
cuuauggaauugauuu

SEQ ID NO: 1435758 - RNA, 18 nt, Human
cuuagcagcuuccagauu

SEQ ID NO: 1435759 - RNA, 17 nt, Human
cuuagcagcuuccagau

SEQ ID NO: 1435760 - RNA, 16 nt, Human
cuuagcagcuuccaga

SEQ ID NO: 1435761 - RNA, 15 nt, Human
cuuagcagcuuccag

SEQ ID NO: 1435762 - RNA, 23 nt, Human
auuagagugucuuuccacggagc

SEQ ID NO: 1435763 - RNA, 17 nt, Human
auuagagugucuuucca

SEQ ID NO: 1435764 - RNA, 16 nt, Human
auuagagugucuuucc

SEQ ID NO: 1435765 - RNA, 21 nt, Human
auuagagggaggagaaugagc

SEQ ID NO: 1435766 - RNA, 13 nt, Human
auuagauguucuc

SEQ ID NO: 1435767 - RNA, 14 nt, Human
auuagauguucucu

SEQ ID NO: 1435768 - RNA, 16 nt, Human
auuagauguucucuau

SEQ ID NO: 1435769 - RNA, 16 nt, Human
auuauguagcucuuug

SEQ ID NO: 1435770 - RNA, 19 nt, Human
auuauguagcucuuuguca

SEQ ID NO: 1435771 - RNA, 15 nt, Human
auuauguagcucuuu

SEQ ID NO: 1435772 - RNA, 14 nt, Human
auuauguagcucuu

SEQ ID NO: 1435773 - RNA, 12 nt, Human
auuauguagcuc

SEQ ID NO: 1435774 - RNA, 12 nt, Human
auuauguaaauu

SEQ ID NO: 1435775 - RNA, 13 nt, Human
auuaugugacauu

SEQ ID NO: 1435776 - RNA, 19 nt, Human
auuaugugacauuuuacau

SEQ ID NO: 1435777 - RNA, 13 nt, Human
auuaugugccaga

SEQ ID NO: 1435778 - RNA, 21 nt, Human
auuaugugccagauuuaugca

SEQ ID NO: 1435779 - RNA, 23 nt, Human
auuaugugccagauuuaugcaua

SEQ ID NO: 1435780 - RNA, 22 nt, Human
auucaaggaauuucuuaacuuc

SEQ ID NO: 1435781 - RNA, 20 nt, Human
auuaugugacauuuuacauu

SEQ ID NO: 1435782 - RNA, 21 nt, Human
auucaaguguaaaauauuuug

SEQ ID NO: 1435783 - RNA, 20 nt, Human
auucaaguguaaaauauuuu

SEQ ID NO: 1435784 - RNA, 12 nt, Human
auucaauaaagc

SEQ ID NO: 1435785 - RNA, 13 nt, Human
auucaauaaagcu

SEQ ID NO: 1435786 - RNA, 12 nt, Human
auucaauaaagu

SEQ ID NO: 1435787 - RNA, 13 nt, Human
auucaauaaagua

SEQ ID NO: 1435788 - RNA, 14 nt, Human
auucaauaaaguau

SEQ ID NO: 1435789 - RNA, 17 nt, Human
auucaauaaaguauuua

SEQ ID NO: 1435790 - RNA, 19 nt, Human
auucauaguaacuucuuau

SEQ ID NO: 1435791 - RNA, 20 nt, Human
auucauagucuuuggagaaa

SEQ ID NO: 1435792 - RNA, 16 nt, Human
auucauuagucauguu

SEQ ID NO: 1435793 - RNA, 15 nt, Human
auucauuagucaugu

SEQ ID NO: 1435794 - RNA, 12 nt, Human
auucauuccauu

SEQ ID NO: 1435795 - RNA, 17 nt, Human
auucauuccauucugga

SEQ ID NO: 1435796 - RNA, 19 nt, Human
auucauuccauucuggaag

SEQ ID NO: 1435797 - RNA, 18 nt, Human
auucauuccauucuggaa

SEQ ID NO: 1435798 - RNA, 21 nt, Human
auucuuucaauacagauauau

SEQ ID NO: 1435799 - RNA, 22 nt, Human
auucuuucaauacagauauauu

SEQ ID NO: 1435800 - RNA, 20 nt, Human
auucuuucaauacagauaua

SEQ ID NO: 1435801 - RNA, 19 nt, Human
auucuuucaauacagauau

SEQ ID NO: 1435802 - RNA, 18 nt, Human
auucuuucaauacagaua

SEQ ID NO: 1435803 - RNA, 16 nt, Human
auucuuucaauacaga

SEQ ID NO: 1435804 - RNA, 13 nt, Human
auucuuucaauac

SEQ ID NO: 1435805 - RNA, 19 nt, Human
auucuuuccauuugcauuu

SEQ ID NO: 1435806 - RNA, 17 nt, Human
auucuuuccauuugcau

SEQ ID NO: 1435807 - RNA, 16 nt, Human
auucuuuccauuugca

SEQ ID NO: 1435808 - RNA, 15 nt, Human
auucuuuccauuugc

SEQ ID NO: 1435809 - RNA, 22 nt, Human
auucuuuccauuugcauuuguu

SEQ ID NO: 1435810 - RNA, 20 nt, Human
auucuuuccauuugcauuug

SEQ ID NO: 1435811 - RNA, 13 nt, Human
auucuuucccaac

SEQ ID NO: 1435812 - RNA, 18 nt, Human
auucucuuguauaagauc

SEQ ID NO: 1435813 - RNA, 15 nt, Human
auucucuuguauaag

SEQ ID NO: 1435814 - RNA, 23 nt, Human
auucucugugucuaagauucuag

SEQ ID NO: 1435815 - RNA, 22 nt, Human
auucucugugucuaagauucua

SEQ ID NO: 1435816 - RNA, 16 nt, Human
auucucuccuguaccu

SEQ ID NO: 1435817 - RNA, 21 nt, Human
auucgcuacuaugauuuaauu

SEQ ID NO: 1435818 - RNA, 19 nt, Human
auucgccacacaguauuuu

SEQ ID NO: 1435819 - RNA, 18 nt, Human
auucgccacacaguauuu

SEQ ID NO: 1435820 - RNA, 17 nt, Human
auucgccacacaguauu

SEQ ID NO: 1435821 - RNA, 16 nt, Human
auucgaaugacacugu

SEQ ID NO: 1435822 - RNA, 14 nt, Human
auucauuguguuac

SEQ ID NO: 1435823 - RNA, 16 nt, Human
auucguguguuuuuuu

SEQ ID NO: 1435824 - RNA, 19 nt, Human
auucgugaaaacacauuug

SEQ ID NO: 1435825 - RNA, 12 nt, Human
auucgugaaaac

SEQ ID NO: 1435826 - RNA, 22 nt, Human
auucguagauauuggacaaaga

SEQ ID NO: 1435827 - RNA, 21 nt, Human
auucggugugcaccaggguug

SEQ ID NO: 1435828 - RNA, 21 nt, Human
auucgguauccccccaucuug

SEQ ID NO: 1435829 - RNA, 13 nt, Human
auucguucugugg

SEQ ID NO: 1435830 - RNA, 20 nt, Human
auucucuaguuugauuaaau

SEQ ID NO: 1435831 - RNA, 17 nt, Human
auucguuaucuaauagg

SEQ ID NO: 1435832 - RNA, 23 nt, Human
auucucuaguuugauuaaauucu

SEQ ID NO: 1435833 - RNA, 21 nt, Human
auugagcuggaccucaccaag

SEQ ID NO: 1435834 - RNA, 22 nt, Human
auugaggacacugauauggguc

SEQ ID NO: 1435835 - RNA, 14 nt, Human
auuacacccaaaga

SEQ ID NO: 1435836 - RNA, 14 nt, Human
auuacaaguauuuu

SEQ ID NO: 1435837 - RNA, 19 nt, Human
auuacaaguauuuuuaauu

SEQ ID NO: 1435838 - RNA, 18 nt, Human
auuaauuuuaguuuuuca

SEQ ID NO: 1435839 - RNA, 15 nt, Human
auuacaggcuugagc

SEQ ID NO: 1435840 - RNA, 19 nt, Human
auuacacuugguaauugua

SEQ ID NO: 1435841 - RNA, 13 nt, Human
auuacagaaauuu

SEQ ID NO: 1435842 - RNA, 14 nt, Human
auuacacuugguaa

SEQ ID NO: 1435843 - RNA, 17 nt, Human
auuaauuuaugcagaau

SEQ ID NO: 1435844 - RNA, 14 nt, Human
auuaauuucuucac

SEQ ID NO: 1435845 - RNA, 16 nt, Human
auuaauuuaugcagaa

SEQ ID NO: 1435846 - RNA, 20 nt, Human
auuaauuguaaucugaauaa

SEQ ID NO: 1435847 - RNA, 13 nt, Human
auuaauuguaauc

SEQ ID NO: 1435848 - RNA, 22 nt, Human
auuaauugggccagcuuuucaa

SEQ ID NO: 1435849 - RNA, 19 nt, Human
auuaauugggccagcuuuu

SEQ ID NO: 1435850 - RNA, 16 nt, Human
auuaaugcacuuucua

SEQ ID NO: 1435851 - RNA, 15 nt, Human
auuaaugcacuuucu

SEQ ID NO: 1435852 - RNA, 14 nt, Human
auuaaugcacuuuc

SEQ ID NO: 1435853 - RNA, 13 nt, Human
auuaaugcacuuu

SEQ ID NO: 1435854 - RNA, 13 nt, Human
auuaaugcccaga

SEQ ID NO: 1435855 - RNA, 14 nt, Human
auuaaugcccagac

SEQ ID NO: 1435856 - RNA, 19 nt, Human
auuaacaauuaggcagacu

SEQ ID NO: 1435857 - RNA, 18 nt, Human
auuaacauaggugaaagu

SEQ ID NO: 1435858 - RNA, 24 nt, Human
auuaacauaccuaagaaguacauu

SEQ ID NO: 1435859 - RNA, 23 nt, Human
auuaacauaccuaagaaguacau

SEQ ID NO: 1435860 - RNA, 12 nt, Human
auuaacauaccu

SEQ ID NO: 1435861 - RNA, 21 nt, Human
auuaacaugaauauuuagugu

SEQ ID NO: 1435862 - RNA, 19 nt, Human
auuaaauuuuuuguugaca

SEQ ID NO: 1435863 - RNA, 18 nt, Human
auuaaauuuuuuguugac

SEQ ID NO: 1435864 - RNA, 17 nt, Human
auuaaauuuuuuguuga

SEQ ID NO: 1435865 - RNA, 20 nt, Human
auuaaauuuuuuaaaaagca

SEQ ID NO: 1435866 - RNA, 17 nt, Human
auuaaauuuuuuuuaca

SEQ ID NO: 1435867 - RNA, 18 nt, Human
auuaaauuuuuuuuacau

SEQ ID NO: 1435868 - RNA, 19 nt, Human
auuaaauuuuuuuuacauu

SEQ ID NO: 1435869 - RNA, 19 nt, Human
auuaacaaaauguaugucu

SEQ ID NO: 1435870 - RNA, 18 nt, Human
auuaacaaaauguauguc

SEQ ID NO: 1435871 - RNA, 20 nt, Human
auuaaauuuuuuuuacauuu

SEQ ID NO: 1435872 - RNA, 21 nt, Human
auuucugaggugcacugggag

SEQ ID NO: 1435873 - RNA, 20 nt, Human
auuucuguuuagauaauaca

SEQ ID NO: 1435874 - RNA, 14 nt, Human
auuucuuaaacacu

SEQ ID NO: 1435875 - RNA, 13 nt, Human
auuucugcauaug

SEQ ID NO: 1435876 - RNA, 21 nt, Human
auuucuguuuagauaauacac

SEQ ID NO: 1435877 - RNA, 19 nt, Human
auuucacaacagccugaca

SEQ ID NO: 1435878 - RNA, 15 nt, Human
auuuaucuaaauaug

SEQ ID NO: 1435879 - RNA, 15 nt, Human
auuuaucuauaauuu

SEQ ID NO: 1435880 - RNA, 11 nt, Human
auuuaucuaua

SEQ ID NO: 1435881 - RNA, 10 nt, Human
auuuaucuau

SEQ ID NO: 1435882 - RNA, 17 nt, Human
auuuaucuaaauaugga

SEQ ID NO: 1435883 - RNA, 21 nt, Human
auuuaucgcugggaaaugaga

SEQ ID NO: 1435884 - RNA, 19 nt, Human
auuuaucgcugggaaauga

SEQ ID NO: 1435885 - RNA, 17 nt, Human
auuuaucgcagaccuuu

SEQ ID NO: 1435886 - RNA, 21 nt, Human
auuuauccugaaauuucagau

SEQ ID NO: 1435887 - RNA, 20 nt, Human
auuuauccugaaauuucaga

SEQ ID NO: 1435888 - RNA, 19 nt, Human
auuuauccugaaauuucag

SEQ ID NO: 1435889 - RNA, 18 nt, Human
auuuauccugaaauuuca

SEQ ID NO: 1435890 - RNA, 19 nt, Human
auuucaggcauuggauauu

SEQ ID NO: 1435891 - RNA, 22 nt, Human
auuucaggaggaauacugaaca

SEQ ID NO: 1435892 - RNA, 20 nt, Human
auuucaggaggaauacugaa

SEQ ID NO: 1435893 - RNA, 19 nt, Human
auuucaggaggaauacuga

SEQ ID NO: 1435894 - RNA, 14 nt, Human
auuucaccuguaaa

SEQ ID NO: 1435895 - RNA, 19 nt, Human
auuucaccuguaaaccuga

SEQ ID NO: 1435896 - RNA, 18 nt, Human
auuucaccuguaaaccug

SEQ ID NO: 1435897 - RNA, 16 nt, Human
auuucaccuguaaacc

SEQ ID NO: 1435898 - RNA, 15 nt, Human
auuucaccuguaaac

SEQ ID NO: 1435899 - RNA, 14 nt, Human
auuuauauauugaa

SEQ ID NO: 1435900 - RNA, 15 nt, Human
auuuauauauguauu

SEQ ID NO: 1435901 - RNA, 14 nt, Human
auuuauauauguau

SEQ ID NO: 1435902 - RNA, 18 nt, Human
auuuaauuugaaauaugg

SEQ ID NO: 1435903 - RNA, 23 nt, Human
auuuaauauaaaguuuuauauau

SEQ ID NO: 1435904 - RNA, 12 nt, Human
auuuaauucaga

SEQ ID NO: 1435905 - RNA, 23 nt, Human
auuuaauuagugcuaagugugaa

SEQ ID NO: 1435906 - RNA, 20 nt, Human
auuuaauagcaaagaauuga

SEQ ID NO: 1435907 - RNA, 20 nt, Human
auuuaauuagugcuaagugu

SEQ ID NO: 1435908 - RNA, 21 nt, Human
auuuaauuagugcuaagugug

SEQ ID NO: 1435909 - RNA, 22 nt, Human
auuuaauuagugcuaaguguga

SEQ ID NO: 1435910 - RNA, 23 nt, Human
auuuaagggggaaaaagugucaa

SEQ ID NO: 1435911 - RNA, 21 nt, Human
auuuaacuuuuaguaaaguca

SEQ ID NO: 1435912 - RNA, 15 nt, Human
auuuaagauaauuau

SEQ ID NO: 1435913 - RNA, 18 nt, Human
auuuaauagcaaagaauu

SEQ ID NO: 1435914 - RNA, 17 nt, Human
auuuaauagcaaagaau

SEQ ID NO: 1435915 - RNA, 22 nt, Human
auuuaauagguuuggacaaaau

SEQ ID NO: 1435916 - RNA, 16 nt, Human
auuuaagacacugaaa

SEQ ID NO: 1435917 - RNA, 15 nt, Human
auuuaagacacugaa

SEQ ID NO: 1435918 - RNA, 23 nt, Human
auuuaacuuuuaguaaagucaag

SEQ ID NO: 1435919 - RNA, 17 nt, Human
auuuaacuuuuaguaaa

SEQ ID NO: 1435920 - RNA, 17 nt, Human
auugauaagaucuuuua

SEQ ID NO: 1435921 - RNA, 21 nt, Human
auugaggcuugguuccuuccc

SEQ ID NO: 1435922 - RNA, 14 nt, Human
auugagguaaguuu

SEQ ID NO: 1435923 - RNA, 16 nt, Human
auugagguaaguuuuu

SEQ ID NO: 1435924 - RNA, 19 nt, Human
auuuugaaagucuguccuu

SEQ ID NO: 1435925 - RNA, 15 nt, Human
auuuugaaagucugu

SEQ ID NO: 1435926 - RNA, 20 nt, Human
auuuugaaagucuguccuug

SEQ ID NO: 1435927 - RNA, 21 nt, Human
auuuguguuuuaauuuaaaca

SEQ ID NO: 1435928 - RNA, 20 nt, Human
auuuguguuuuaauuuaaac

SEQ ID NO: 1435929 - RNA, 13 nt, Human
auuuguguuuuaa

SEQ ID NO: 1435930 - RNA, 22 nt, Human
auuuguguugaagagguuuuaa

SEQ ID NO: 1435931 - RNA, 18 nt, Human
auuuguguugaagagguu

SEQ ID NO: 1435932 - RNA, 15 nt, Human
auuuguguugaagag

SEQ ID NO: 1435933 - RNA, 14 nt, Human
auuuguguugaaga

SEQ ID NO: 1435934 - RNA, 16 nt, Human
auuuguucuuguauuu

SEQ ID NO: 1435935 - RNA, 17 nt, Human
auuuguucuuguauuua

SEQ ID NO: 1435936 - RNA, 13 nt, Human
auuuguucuugua

SEQ ID NO: 1435937 - RNA, 17 nt, Human
auuuguucccaagagca

SEQ ID NO: 1435938 - RNA, 14 nt, Human
auuuguucccaaga

SEQ ID NO: 1435939 - RNA, 17 nt, Human
auuuguuauuuugcaac

SEQ ID NO: 1435940 - RNA, 19 nt, Human
auuuguuaauuuagaaaac

SEQ ID NO: 1435941 - RNA, 23 nt, Human
auuuguuaauuuagaaaacuuua

SEQ ID NO: 1435942 - RNA, 18 nt, Human
auuuguuaauaguuccug

SEQ ID NO: 1435943 - RNA, 16 nt, Human
auuuguuauuuugcaa

SEQ ID NO: 1435944 - RNA, 19 nt, Human
auuuguucuauagcuuuuc

SEQ ID NO: 1435945 - RNA, 17 nt, Human
auuuucuauaauuuaaa

SEQ ID NO: 1435946 - RNA, 18 nt, Human
auuuucuauaauuuaaau

SEQ ID NO: 1435947 - RNA, 20 nt, Human
auuuuaguuuuucauuaaau

SEQ ID NO: 1435948 - RNA, 19 nt, Human
auuuuaguuuuucauuaaa

SEQ ID NO: 1435949 - RNA, 23 nt, Human
auuuuaguuuuucauuaaauaaa

SEQ ID NO: 1435950 - RNA, 19 nt, Human
auuuucuauaauuuaaaua

SEQ ID NO: 1435951 - RNA, 17 nt, Human
auuuucucucaggugaa

SEQ ID NO: 1435952 - RNA, 16 nt, Human
auuuucucucagguga

SEQ ID NO: 1435953 - RNA, 15 nt, Human
auuuucugcuacuuu

SEQ ID NO: 1435954 - RNA, 18 nt, Human
auuuucuggccaguguuu

SEQ ID NO: 1435955 - RNA, 22 nt, Human
auuuucuggaauacaugaaaua

SEQ ID NO: 1435956 - RNA, 19 nt, Human
auuuucuggaauacaugaa

SEQ ID NO: 1435957 - RNA, 18 nt, Human
auuuucuggaauacauga

SEQ ID NO: 1435958 - RNA, 13 nt, Human
auuuugaaaaacu

SEQ ID NO: 1435959 - RNA, 22 nt, Human
auuuucuggauuccccaucuca

SEQ ID NO: 1435960 - RNA, 15 nt, Human
auuuugaaaaacugc

SEQ ID NO: 1435961 - RNA, 21 nt, Human
caaacaugacccuaaaucuug

SEQ ID NO: 1435962 - RNA, 20 nt, Human
caaaccacuuuuugcagcuu

SEQ ID NO: 1435963 - RNA, 17 nt, Human
caaaccaguaucgcuca

SEQ ID NO: 1435964 - RNA, 23 nt, Human
caaaccagauacggacagagacc

SEQ ID NO: 1435965 - RNA, 21 nt, Human
caaacauauauauacuauuaa

SEQ ID NO: 1435966 - RNA, 15 nt, Human
caaaagcccauucau

SEQ ID NO: 1435967 - RNA, 19 nt, Human
caaaagcccauucauucca

SEQ ID NO: 1435968 - RNA, 13 nt, Human
caaaagcauguga

SEQ ID NO: 1435969 - RNA, 16 nt, Human
auuuuuuuuucauaca

SEQ ID NO: 1435970 - RNA, 14 nt, Human
auuuuuuuuucaua

SEQ ID NO: 1435971 - RNA, 21 nt, Human
auuuuuuuuuaagcucugagc

SEQ ID NO: 1435972 - RNA, 20 nt, Human
auuuuuuuuuaagcucugag

SEQ ID NO: 1435973 - RNA, 19 nt, Human
auuuuuuuuuaagcucuga

SEQ ID NO: 1435974 - RNA, 15 nt, Human
auuuuuuuucuuuua

SEQ ID NO: 1435975 - RNA, 21 nt, Human
auuuuuuuucuuugaauaaau

SEQ ID NO: 1435976 - RNA, 20 nt, Human
auuuuuuuucuuugaauaaa

SEQ ID NO: 1435977 - RNA, 22 nt, Human
caaaagauugcugaaauuuuau

SEQ ID NO: 1435978 - RNA, 20 nt, Human
auuuuuuuuucauacacuua

SEQ ID NO: 1435979 - RNA, 19 nt, Human
auuuuuuuuucauacacuu

SEQ ID NO: 1435980 - RNA, 21 nt, Human
auuuuuuuuucauacacuuau

SEQ ID NO: 1435981 - RNA, 16 nt, Human
auuuuuuuucuuugaa

SEQ ID NO: 1435982 - RNA, 18 nt, Human
auuuuuuuuaacauuccu

SEQ ID NO: 1435983 - RNA, 18 nt, Human
auuuuuuuuaaguauuua

SEQ ID NO: 1435984 - RNA, 14 nt, Human
auuuuuuuuaacau

SEQ ID NO: 1435985 - RNA, 20 nt, Human
auuuuuuuuauuaguauugu

SEQ ID NO: 1435986 - RNA, 16 nt, Human
auuuuuuuuauuagua

SEQ ID NO: 1435987 - RNA, 14 nt, Human
auuuuuuuuacauu

SEQ ID NO: 1435988 - RNA, 17 nt, Human
auuuuuauuaauuuuag

SEQ ID NO: 1435989 - RNA, 22 nt, Human
auuuuuauuaauuuuaguuuuu

SEQ ID NO: 1435990 - RNA, 17 nt, Human
auuuuuauuucuuccua

SEQ ID NO: 1435991 - RNA, 13 nt, Human
auuuuuauuucuu

SEQ ID NO: 1435992 - RNA, 18 nt, Human
auuuuuauuuuugcugag

SEQ ID NO: 1435993 - RNA, 19 nt, Human
auuuuuuucccaauugaga

SEQ ID NO: 1435994 - RNA, 16 nt, Human
auuuuuuuccuugcaa

SEQ ID NO: 1435995 - RNA, 17 nt, Human
auuuuuuucugaaauuu

SEQ ID NO: 1435996 - RNA, 16 nt, Human
auuuuuuucugaaauu

SEQ ID NO: 1435997 - RNA, 15 nt, Human
auuuuuuucugaauu

SEQ ID NO: 1435998 - RNA, 14 nt, Human
auuuuuaaaaugua

SEQ ID NO: 1435999 - RNA, 17 nt, Human
auuuuuaaaacccauuu

SEQ ID NO: 1436000 - RNA, 16 nt, Human
auuuuuaaaacccauu

SEQ ID NO: 1436001 - RNA, 17 nt, Human
auuuuuaugccaccuga

SEQ ID NO: 1436002 - RNA, 14 nt, Human
auuuuuaaacaagu

SEQ ID NO: 1436003 - RNA, 13 nt, Human
auuuuuaaacaag

SEQ ID NO: 1436004 - RNA, 16 nt, Human
auuuuuaaaauguaca

SEQ ID NO: 1436005 - RNA, 15 nt, Human
auuuuuaaacaagua

SEQ ID NO: 1436006 - RNA, 19 nt, Human
auuuuuauauuugaaauau

SEQ ID NO: 1436007 - RNA, 14 nt, Human
caagcacagcccuu

SEQ ID NO: 1436008 - RNA, 17 nt, Human
caagcacagcagccugg

SEQ ID NO: 1436009 - RNA, 14 nt, Human
caagcacagcagcc

SEQ ID NO: 1436010 - RNA, 13 nt, Human
caagcacagcagc

SEQ ID NO: 1436011 - RNA, 12 nt, Human
caagcacagcag

SEQ ID NO: 1436012 - RNA, 22 nt, Human
caagcaccaccaaacacagugu

SEQ ID NO: 1436013 - RNA, 18 nt, Human
caagaugaaggagaggca

SEQ ID NO: 1436014 - RNA, 23 nt, Human
caagauauuuuaaaaucugucac

SEQ ID NO: 1436015 - RNA, 21 nt, Human
caagauauuuuaaaaucuguc

SEQ ID NO: 1436016 - RNA, 14 nt, Human
caagaccacguuuc

SEQ ID NO: 1436017 - RNA, 16 nt, Human
caagaccacguuucua

SEQ ID NO: 1436018 - RNA, 14 nt, Human
caagcaaguauuag

SEQ ID NO: 1436019 - RNA, 14 nt, Human
caagcaauccuccc

SEQ ID NO: 1436020 - RNA, 15 nt, Human
caagcaaaugugaau

SEQ ID NO: 1436021 - RNA, 17 nt, Human
caagcaaaugugaauca

SEQ ID NO: 1436022 - RNA, 19 nt, Human
caagcaaaugugaaucauu

SEQ ID NO: 1436023 - RNA, 17 nt, Human
caagacaugucuguucu

SEQ ID NO: 1436024 - RNA, 15 nt, Human
caagacaugucuguu

SEQ ID NO: 1436025 - RNA, 14 nt, Human
caagacaugucugu

SEQ ID NO: 1436026 - RNA, 22 nt, Human
caagaauccacauuucuaaaau

SEQ ID NO: 1436027 - RNA, 21 nt, Human
caagaauccacauuucuaaaa

SEQ ID NO: 1436028 - RNA, 19 nt, Human
caagaauccacauuucuaa

SEQ ID NO: 1436029 - RNA, 18 nt, Human
caagaauccacauuucua

SEQ ID NO: 1436030 - RNA, 14 nt, Human
caagaauccacauu

SEQ ID NO: 1436031 - RNA, 15 nt, Human
caagaaucagagaag

SEQ ID NO: 1436032 - RNA, 19 nt, Human
caagaauagcauuguaaaa

SEQ ID NO: 1436033 - RNA, 21 nt, Human
caagaauaaucacgcuuuccu

SEQ ID NO: 1436034 - RNA, 16 nt, Human
caagaaggcaaaaaua

SEQ ID NO: 1436035 - RNA, 12 nt, Human
caagaaggauuu

SEQ ID NO: 1436036 - RNA, 23 nt, Human
caagaauaaucacgcuuuccuga

SEQ ID NO: 1436037 - RNA, 22 nt, Human
caagaauaaucacgcuuuccug

SEQ ID NO: 1436038 - RNA, 17 nt, Human
caacuauuuucagaugu

SEQ ID NO: 1436039 - RNA, 21 nt, Human
caacuauuuucagaugugaac

SEQ ID NO: 1436040 - RNA, 12 nt, Human
caacuccagaaa

SEQ ID NO: 1436041 - RNA, 14 nt, Human
caacuauuuucaga

SEQ ID NO: 1436042 - RNA, 17 nt, Human
caacuauggaucagaau

SEQ ID NO: 1436043 - RNA, 16 nt, Human
caacuauggaucagaa

SEQ ID NO: 1436044 - RNA, 14 nt, Human
caacuauggccugu

SEQ ID NO: 1436045 - RNA, 13 nt, Human
caaccccaggcug

SEQ ID NO: 1436046 - RNA, 21 nt, Human
caacuaucagacuaagccagc

SEQ ID NO: 1436047 - RNA, 21 nt, Human
caacuaucucauuuccaagca

SEQ ID NO: 1436048 - RNA, 13 nt, Human
caacuauggccug

SEQ ID NO: 1436049 - RNA, 19 nt, Human
caacuaucucauuuccaag

SEQ ID NO: 1436050 - RNA, 19 nt, Human
caacuauauuguuugcuaa

SEQ ID NO: 1436051 - RNA, 15 nt, Human
caacuaggaucagaa

SEQ ID NO: 1436052 - RNA, 22 nt, Human
cacaaggcagcaaggcccgagc

SEQ ID NO: 1436053 - RNA, 18 nt, Human
cacaaggcagcaaggccc

SEQ ID NO: 1436054 - RNA, 17 nt, Human
cacaaggcagcaaggcc

SEQ ID NO: 1436055 - RNA, 16 nt, Human
cacaaggcagcaaggc

SEQ ID NO: 1436056 - RNA, 15 nt, Human
cacaaggcagcaagg

SEQ ID NO: 1436057 - RNA, 14 nt, Human
cacaaggcagcaag

SEQ ID NO: 1436058 - RNA, 11 nt, Human
cacaaggcagc

SEQ ID NO: 1436059 - RNA, 15 nt, Human
cacaaggccaucugg

SEQ ID NO: 1436060 - RNA, 22 nt, Human
cacaaggauagaugcuggccca

SEQ ID NO: 1436061 - RNA, 21 nt, Human
cacaaggauagaugcuggccc

SEQ ID NO: 1436062 - RNA, 18 nt, Human
cacaaggauagaugcugg

SEQ ID NO: 1436063 - RNA, 17 nt, Human
cacaaggauagaugcug

SEQ ID NO: 1436064 - RNA, 22 nt, Human
cacaaggacuuccuguccagcu

SEQ ID NO: 1436065 - RNA, 16 nt, Human
cacaaggacuuccugu

SEQ ID NO: 1436066 - RNA, 14 nt, Human
cacaaggacuuccu

SEQ ID NO: 1436067 - RNA, 12 nt, Human
cacaaggacuuc

SEQ ID NO: 1436068 - RNA, 14 nt, Human
caauuucagacucc

SEQ ID NO: 1436069 - RNA, 19 nt, Human
caauuucaagguucuaacc

SEQ ID NO: 1436070 - RNA, 11 nt, Human
caauuucaagu

SEQ ID NO: 1436071 - RNA, 16 nt, Human
caauuucaagguucua

SEQ ID NO: 1436072 - RNA, 15 nt, Human
caauuucaagguucu

SEQ ID NO: 1436073 - RNA, 23 nt, Human
caauuuauuugaaugauuuuucu

SEQ ID NO: 1436074 - RNA, 15 nt, Human
caauuuauuugaaug

SEQ ID NO: 1436075 - RNA, 13 nt, Human
caauuuauuugaa

SEQ ID NO: 1436076 - RNA, 20 nt, Human
caauuuauuauggcacauca

SEQ ID NO: 1436077 - RNA, 14 nt, Human
caauauuuuuagau

SEQ ID NO: 1436078 - RNA, 21 nt, Human
caauuggcaccgaagcccaga

SEQ ID NO: 1436079 - RNA, 20 nt, Human
caauuggcaccgaagcccag

SEQ ID NO: 1436080 - RNA, 19 nt, Human
caauuggcaccgaagccca

SEQ ID NO: 1436081 - RNA, 15 nt, Human
caauuggcaccgaag

SEQ ID NO: 1436082 - RNA, 16 nt, Human
caaucaaucuugcaug

SEQ ID NO: 1436083 - RNA, 19 nt, Human
caaucaaucuugcauguaa

SEQ ID NO: 1436084 - RNA, 18 nt, Human
caaucaagucuguuuacu

SEQ ID NO: 1436085 - RNA, 15 nt, Human
caaucaagucuguuu

SEQ ID NO: 1436086 - RNA, 17 nt, Human
caauauuuucuuuuccc

SEQ ID NO: 1436087 - RNA, 17 nt, Human
caaugcucaggugcugg

SEQ ID NO: 1436088 - RNA, 14 nt, Human
caaugccaucaucu

SEQ ID NO: 1436089 - RNA, 13 nt, Human
caaugccaucauc

SEQ ID NO: 1436090 - RNA, 22 nt, Human
caaugccacagcccugucagca

SEQ ID NO: 1436091 - RNA, 18 nt, Human
caaucagcuccuuccugg

SEQ ID NO: 1436092 - RNA, 16 nt, Human
caaucagcuccuuccu

SEQ ID NO: 1436093 - RNA, 15 nt, Human
caaucagcuccuucc

SEQ ID NO: 1436094 - RNA, 17 nt, Human
caaucagccuaguugau

SEQ ID NO: 1436095 - RNA, 13 nt, Human
caagcucuuccuu

SEQ ID NO: 1436096 - RNA, 19 nt, Human
caagcugauuaaaugacac

SEQ ID NO: 1436097 - RNA, 15 nt, Human
caagcugauuaaaug

SEQ ID NO: 1436098 - RNA, 23 nt, Human
caagcugaguuuccuaugggaac

SEQ ID NO: 1436099 - RNA, 22 nt, Human
caagcugaguuuccuaugggaa

SEQ ID NO: 1436100 - RNA, 16 nt, Human
caagcugaguuuccua

SEQ ID NO: 1436101 - RNA, 15 nt, Human
caagcugaguuuccu

SEQ ID NO: 1436102 - RNA, 14 nt, Human
caagcugaguuucc

SEQ ID NO: 1436103 - RNA, 20 nt, Human
caagcugaguauuaaaaugu

SEQ ID NO: 1436104 - RNA, 21 nt, Human
caagcugaggugcccaggaga

SEQ ID NO: 1436105 - RNA, 20 nt, Human
caagcugaggugcccaggag

SEQ ID NO: 1436106 - RNA, 19 nt, Human
caagcugaggugcccagga

SEQ ID NO: 1436107 - RNA, 18 nt, Human
caagcugaggugcccagg

SEQ ID NO: 1436108 - RNA, 17 nt, Human
caagcugaggugcccag

SEQ ID NO: 1436109 - RNA, 15 nt, Human
caagcugaggugccc

SEQ ID NO: 1436110 - RNA, 15 nt, Human
caaguaauacaaacu

SEQ ID NO: 1436111 - RNA, 17 nt, Human
caaguaacaaaaauaaa

SEQ ID NO: 1436112 - RNA, 14 nt, Human
caaguaacaaaaau

SEQ ID NO: 1436113 - RNA, 17 nt, Human
caaguauuauaccuuuu

SEQ ID NO: 1436114 - RNA, 22 nt, Human
caaguauuauaccuuuuuuaga

SEQ ID NO: 1436115 - RNA, 17 nt, Human
caaggccaucugggcuc

SEQ ID NO: 1436116 - RNA, 14 nt, Human
caaggccaucuggg

SEQ ID NO: 1436117 - RNA, 20 nt, Human
caagguuuuagguucuaaag

SEQ ID NO: 1436118 - RNA, 18 nt, Human
caagguuuuagguucuaa

SEQ ID NO: 1436119 - RNA, 13 nt, Human
caagguuuuaggu

SEQ ID NO: 1436120 - RNA, 19 nt, Human
caagguuuuauaaggcuga

SEQ ID NO: 1436121 - RNA, 23 nt, Human
caagguuuuagguucuaaaguuc

SEQ ID NO: 1436122 - RNA, 21 nt, Human
caagguuuuagguucuaaagu

SEQ ID NO: 1436123 - RNA, 10 nt, Human
caaguaaaaa

SEQ ID NO: 1436124 - RNA, 15 nt, Human
caaguaaaaaggcua

SEQ ID NO: 1436125 - RNA, 21 nt, Human
caaguuauuaauuucuucaca

SEQ ID NO: 1436126 - RNA, 15 nt, Human
caaguuauuaauuuc

SEQ ID NO: 1436127 - RNA, 19 nt, Human
caaguauuuguuaauuuag

SEQ ID NO: 1436128 - RNA, 16 nt, Human
caaguauuuguuaauu

SEQ ID NO: 1436129 - RNA, 22 nt, Human
caaguauuugggaagugaagac

SEQ ID NO: 1436130 - RNA, 19 nt, Human
caaguauuugggaagugaa

SEQ ID NO: 1436131 - RNA, 21 nt, Human
caaguuccucuaacuuggcuc

SEQ ID NO: 1436132 - RNA, 19 nt, Human
caaguucccaguuggagcu

SEQ ID NO: 1436133 - RNA, 18 nt, Human
caaguuccaaguugcuaa

SEQ ID NO: 1436134 - RNA, 17 nt, Human
caaguucaugcagcugu

SEQ ID NO: 1436135 - RNA, 20 nt, Human
caaguuauuuuuaauuuggu

SEQ ID NO: 1436136 - RNA, 15 nt, Human
caaguucuaagauuc

SEQ ID NO: 1436137 - RNA, 14 nt, Human
caaguucuaagauu

SEQ ID NO: 1436138 - RNA, 13 nt, Human
caaguucuaagau

SEQ ID NO: 1436139 - RNA, 12 nt, Human
caaguucuaaga

SEQ ID NO: 1436140 - RNA, 16 nt, Human
caaguucgucuguugu

SEQ ID NO: 1436141 - RNA, 15 nt, Human
caaguucgucuguug

SEQ ID NO: 1436142 - RNA, 20 nt, Human
caaguuccucuaacuuggcu

SEQ ID NO: 1436143 - RNA, 21 nt, Human
caaguuccuuggccaugcaga

SEQ ID NO: 1436144 - RNA, 18 nt, Human
cacccaucugucugccaa

SEQ ID NO: 1436145 - RNA, 11 nt, Human
cacccaucugu

SEQ ID NO: 1436146 - RNA, 22 nt, Human
cacccaguuuccuugggaguug

SEQ ID NO: 1436147 - RNA, 23 nt, Human
cacccagugcccucuccccucag

SEQ ID NO: 1436148 - RNA, 16 nt, Human
cacccagugcccucuc

SEQ ID NO: 1436149 - RNA, 17 nt, Human
cacccagucuguucccc

SEQ ID NO: 1436150 - RNA, 16 nt, Human
cacccagcaauagaga

SEQ ID NO: 1436151 - RNA, 20 nt, Human
cacccaggcuggagugcagu

SEQ ID NO: 1436152 - RNA, 12 nt, Human
cacccaggccag

SEQ ID NO: 1436153 - RNA, 20 nt, Human
cacccaggcuggacugcaau

SEQ ID NO: 1436154 - RNA, 16 nt, Human
cacccaggggcagccc

SEQ ID NO: 1436155 - RNA, 14 nt, Human
cacccaggggcagc

SEQ ID NO: 1436156 - RNA, 13 nt, Human
cacccaggggcag

SEQ ID NO: 1436157 - RNA, 20 nt, Human
cacccagguuggagugcagu

SEQ ID NO: 1436158 - RNA, 13 nt, Human
caccaggcagccu

SEQ ID NO: 1436159 - RNA, 22 nt, Human
caccaggauagagacuggaaca

SEQ ID NO: 1436160 - RNA, 15 nt, Human
cacccacuucugcac

SEQ ID NO: 1436161 - RNA, 16 nt, Human
cacccacuucugcacu

SEQ ID NO: 1436162 - RNA, 14 nt, Human
cacccacuucugca

SEQ ID NO: 1436163 - RNA, 23 nt, Human
cacccagacauaaaggaaaagac

SEQ ID NO: 1436164 - RNA, 21 nt, Human
cacccagacauaaaggaaaag

SEQ ID NO: 1436165 - RNA, 20 nt, Human
cacccagacauaaaggaaaa

SEQ ID NO: 1436166 - RNA, 15 nt, Human
cacccagacauaaag

SEQ ID NO: 1436167 - RNA, 20 nt, Human
cacccagaugccccuuucug

SEQ ID NO: 1436168 - RNA, 13 nt, Human
cacccagcaauag

SEQ ID NO: 1436169 - RNA, 13 nt, Human
caccaggaagccg

SEQ ID NO: 1436170 - RNA, 23 nt, Human
cacaugaacuuagauuuuacaug

SEQ ID NO: 1436171 - RNA, 21 nt, Human
cacaugaacuuagauuuuaca

SEQ ID NO: 1436172 - RNA, 15 nt, Human
cacaugaacuuagau

SEQ ID NO: 1436173 - RNA, 16 nt, Human
cacaugaaguccaagc

SEQ ID NO: 1436174 - RNA, 14 nt, Human
cacgcuuuccugaa

SEQ ID NO: 1436175 - RNA, 23 nt, Human
cacggagccacuccucugacuca

SEQ ID NO: 1436176 - RNA, 21 nt, Human
cacggagccacuccucugacu

SEQ ID NO: 1436177 - RNA, 19 nt, Human
cacggagccacuccucuga

SEQ ID NO: 1436178 - RNA, 18 nt, Human
cacggagccacuccucug

SEQ ID NO: 1436179 - RNA, 17 nt, Human
cacggagccacuccucu

SEQ ID NO: 1436180 - RNA, 16 nt, Human
cacggagccacuccuc

SEQ ID NO: 1436181 - RNA, 13 nt, Human
cacuacauucugu

SEQ ID NO: 1436182 - RNA, 14 nt, Human
cacuacauucuguu

SEQ ID NO: 1436183 - RNA, 15 nt, Human
cacggagccacuccu

SEQ ID NO: 1436184 - RNA, 23 nt, Human
cacggaccaaagggagucugcca

SEQ ID NO: 1436185 - RNA, 21 nt, Human
cacggaccaaagggagucugc

SEQ ID NO: 1436186 - RNA, 20 nt, Human
cacggaccaaagggagucug

SEQ ID NO: 1436187 - RNA, 13 nt, Human
cacgcuuuuguga

SEQ ID NO: 1436188 - RNA, 23 nt, Human
cacuagcccaaugaaaugaauua

SEQ ID NO: 1436189 - RNA, 16 nt, Human
cacuagcccaaugaaa

SEQ ID NO: 1436190 - RNA, 19 nt, Human
cacuagccaaaccucacca

SEQ ID NO: 1436191 - RNA, 22 nt, Human
cacuagccaaaccucaccaacu

SEQ ID NO: 1436192 - RNA, 16 nt, Human
cacuagccaaaccuca

SEQ ID NO: 1436193 - RNA, 14 nt, Human
cacuagccaaaccu

SEQ ID NO: 1436194 - RNA, 19 nt, Human
cacuagcccaaugaaauga

SEQ ID NO: 1436195 - RNA, 12 nt, Human
cacuagccaaac

SEQ ID NO: 1436196 - RNA, 21 nt, Human
cacuagacaagccagaacuug

SEQ ID NO: 1436197 - RNA, 19 nt, Human
cacuagacaagccagaacu

SEQ ID NO: 1436198 - RNA, 17 nt, Human
cacuagacaagccagaa

SEQ ID NO: 1436199 - RNA, 16 nt, Human
cacuagacaagccaga

SEQ ID NO: 1436200 - RNA, 14 nt, Human
cacuagacaagcca

SEQ ID NO: 1436201 - RNA, 15 nt, Human
cacuacauucauuua

SEQ ID NO: 1436202 - RNA, 15 nt, Human
cacuacauucuguua

SEQ ID NO: 1436203 - RNA, 17 nt, Human
cacugaagcuuuuuagu

SEQ ID NO: 1436204 - RNA, 17 nt, Human
cacucccacaugggccc

SEQ ID NO: 1436205 - RNA, 17 nt, Human
cacucccaccugacaca

SEQ ID NO: 1436206 - RNA, 23 nt, Human
cacugaagaagcaccaaucauga

SEQ ID NO: 1436207 - RNA, 20 nt, Human
caccugcccuaccugcccca

SEQ ID NO: 1436208 - RNA, 14 nt, Human
caccugcccugccc

SEQ ID NO: 1436209 - RNA, 16 nt, Human
caccugcccugcccug

SEQ ID NO: 1436210 - RNA, 21 nt, Human
cacccucggggauguguccug

SEQ ID NO: 1436211 - RNA, 11 nt, Human
cacccuggagg

SEQ ID NO: 1436212 - RNA, 21 nt, Human
cacccuggauugaucggagcc

SEQ ID NO: 1436213 - RNA, 22 nt, Human
cacccuggccgaguccaagcug

SEQ ID NO: 1436214 - RNA, 21 nt, Human
cacccuggccgaguccaagcu

SEQ ID NO: 1436215 - RNA, 23 nt, Human
cacccuggccuagaccagcagac

SEQ ID NO: 1436216 - RNA, 11 nt, Human
cacccuggccu

SEQ ID NO: 1436217 - RNA, 19 nt, Human
cacccugccuuaucuugca

SEQ ID NO: 1436218 - RNA, 18 nt, Human
cacccugccuuaucuugc

SEQ ID NO: 1436219 - RNA, 13 nt, Human
cacccugccuuau

SEQ ID NO: 1436220 - RNA, 12 nt, Human
cacccugccuua

SEQ ID NO: 1436221 - RNA, 22 nt, Human
cacccugauuuaggagaagcca

SEQ ID NO: 1436222 - RNA, 17 nt, Human
cacccugauaggaagag

SEQ ID NO: 1436223 - RNA, 22 nt, Human
cacccugaggagucugaggucc

SEQ ID NO: 1436224 - RNA, 21 nt, Human
cacccugaggagucugagguc

SEQ ID NO: 1436225 - RNA, 18 nt, Human
cacccugaggagucugag

SEQ ID NO: 1436226 - RNA, 16 nt, Human
cacccugaggagucug

SEQ ID NO: 1436227 - RNA, 15 nt, Human
cacccugaggagucu

SEQ ID NO: 1436228 - RNA, 14 nt, Human
cacccugagccggc

SEQ ID NO: 1436229 - RNA, 12 nt, Human
cacccugagccg

SEQ ID NO: 1436230 - RNA, 22 nt, Human
cacccucggggauguguccuga

SEQ ID NO: 1436231 - RNA, 17 nt, Human
cacccucguggacaccu

SEQ ID NO: 1436232 - RNA, 18 nt, Human
cacccucguggacaccug

SEQ ID NO: 1436233 - RNA, 19 nt, Human
cacccucguggacaccugc

SEQ ID NO: 1436234 - RNA, 20 nt, Human
cacccucguggacaccugcc

SEQ ID NO: 1436235 - RNA, 21 nt, Human
cacccuguacuguucuguguc

SEQ ID NO: 1436236 - RNA, 17 nt, Human
cacccuguacuguucug

SEQ ID NO: 1436237 - RNA, 16 nt, Human
cacccuguacuguucu

SEQ ID NO: 1436238 - RNA, 16 nt, Human
cacccuggugggccaa

SEQ ID NO: 1436239 - RNA, 15 nt, Human
cacccuggugggcca

SEQ ID NO: 1436240 - RNA, 19 nt, Human
cacccuggccuagaccagc

SEQ ID NO: 1436241 - RNA, 22 nt, Human
cacccugggcccugggcuggaa

SEQ ID NO: 1436242 - RNA, 21 nt, Human
cacccugggcccugggcugga

SEQ ID NO: 1436243 - RNA, 17 nt, Human
cacccugggcccugggc

SEQ ID NO: 1436244 - RNA, 14 nt, Human
cacccugggcccug

SEQ ID NO: 1436245 - RNA, 12 nt, Human
cacccugggccc

SEQ ID NO: 1436246 - RNA, 23 nt, Human
cacccuguacuguucugugucuu

SEQ ID NO: 1436247 - RNA, 20 nt, Human
cacccuguccaaacugccua

SEQ ID NO: 1436248 - RNA, 19 nt, Human
caccuaggcuagggugggg

SEQ ID NO: 1436249 - RNA, 18 nt, Human
caccuaggcuaggguggg

SEQ ID NO: 1436250 - RNA, 23 nt, Human
cacccuguccaaacugccuaagc

SEQ ID NO: 1436251 - RNA, 14 nt, Human
caccugcccuaccu

SEQ ID NO: 1436252 - RNA, 13 nt, Human
caccugcccuacc

SEQ ID NO: 1436253 - RNA, 12 nt, Human
caccugcccugc

SEQ ID NO: 1436254 - RNA, 13 nt, Human
caccugcccugcc

SEQ ID NO: 1436255 - RNA, 23 nt, Human
cagcgcuccugcuaacggugcuc

SEQ ID NO: 1436256 - RNA, 12 nt, Human
cagcuaaagcaa

SEQ ID NO: 1436257 - RNA, 21 nt, Human
cagcgcugucaggauugcgag

SEQ ID NO: 1436258 - RNA, 16 nt, Human
cagcgcuugaagccug

SEQ ID NO: 1436259 - RNA, 20 nt, Human
cagcgcugucaggauugcga

SEQ ID NO: 1436260 - RNA, 14 nt, Human
cagcggcaucaggc

SEQ ID NO: 1436261 - RNA, 22 nt, Human
cagcggagguguggagccgagg

SEQ ID NO: 1436262 - RNA, 19 nt, Human
cagcuaaagcaauaugcau

SEQ ID NO: 1436263 - RNA, 22 nt, Human
cagcugccggucgcccuuugcu

SEQ ID NO: 1436264 - RNA, 16 nt, Human
cagcugagcgccagga

SEQ ID NO: 1436265 - RNA, 14 nt, Human
cagcugagcgccag

SEQ ID NO: 1436266 - RNA, 16 nt, Human
cagcugagcagggccg

SEQ ID NO: 1436267 - RNA, 18 nt, Human
cagcugagcgccaggaug

SEQ ID NO: 1436268 - RNA, 20 nt, Human
cagcugagcagggccgggga

SEQ ID NO: 1436269 - RNA, 15 nt, Human
cagcugagcagggcc

SEQ ID NO: 1436270 - RNA, 14 nt, Human
cagcugagcagggc

SEQ ID NO: 1436271 - RNA, 13 nt, Human
cagcugagcaggg

SEQ ID NO: 1436272 - RNA, 14 nt, Human
cagcugagaggcug

SEQ ID NO: 1436273 - RNA, 20 nt, Human
caggaaagagaacuuccaga

SEQ ID NO: 1436274 - RNA, 16 nt, Human
caggaaagagaacuuc

SEQ ID NO: 1436275 - RNA, 21 nt, Human
caggaaacuccugugaccaca

SEQ ID NO: 1436276 - RNA, 19 nt, Human
caggaaacuccugugacca

SEQ ID NO: 1436277 - RNA, 18 nt, Human
caggaaacuccugugacc

SEQ ID NO: 1436278 - RNA, 23 nt, Human
caggaaacaguugcauguaguaa

SEQ ID NO: 1436279 - RNA, 20 nt, Human
cagcuuauugucuagugaaa

SEQ ID NO: 1436280 - RNA, 17 nt, Human
cagcuguccccccacuc

SEQ ID NO: 1436281 - RNA, 19 nt, Human
cagcuguccccccacuccc

SEQ ID NO: 1436282 - RNA, 14 nt, Human
cagcuuauugucua

SEQ ID NO: 1436283 - RNA, 16 nt, Human
cagcuguccccccacu

SEQ ID NO: 1436284 - RNA, 15 nt, Human
cagcuguccccccac

SEQ ID NO: 1436285 - RNA, 14 nt, Human
cagcugucccccca

SEQ ID NO: 1436286 - RNA, 18 nt, Human
cagcugucaucaauuaaa

SEQ ID NO: 1436287 - RNA, 16 nt, Human
cagcugucaaggcuca

SEQ ID NO: 1436288 - RNA, 20 nt, Human
cagcuguaugauucccagcc

SEQ ID NO: 1436289 - RNA, 14 nt, Human
caggaggccuagga

SEQ ID NO: 1436290 - RNA, 20 nt, Human
caggaggacccagggcucug

SEQ ID NO: 1436291 - RNA, 18 nt, Human
caggaggacccagggcuc

SEQ ID NO: 1436292 - RNA, 17 nt, Human
caggaggacccagggcu

SEQ ID NO: 1436293 - RNA, 16 nt, Human
caggaggacccagggc

SEQ ID NO: 1436294 - RNA, 15 nt, Human
caggaggacccaggg

SEQ ID NO: 1436295 - RNA, 16 nt, Human
caggaggaauacugaa

SEQ ID NO: 1436296 - RNA, 19 nt, Human
caggaggacccagggcucu

SEQ ID NO: 1436297 - RNA, 15 nt, Human
caggaggaauacuga

SEQ ID NO: 1436298 - RNA, 13 nt, Human
caggaccagaagc

SEQ ID NO: 1436299 - RNA, 15 nt, Human
caggaccagaagcuc

SEQ ID NO: 1436300 - RNA, 23 nt, Human
caggaccacaggcucaggcaggg

SEQ ID NO: 1436301 - RNA, 21 nt, Human
caggaccacaggcucaggcag

SEQ ID NO: 1436302 - RNA, 19 nt, Human
caggaccacaggcucaggc

SEQ ID NO: 1436303 - RNA, 18 nt, Human
caggaccacaggcucagg

SEQ ID NO: 1436304 - RNA, 17 nt, Human
caggaccacaggcucag

SEQ ID NO: 1436305 - RNA, 16 nt, Human
caggaccacaggcuca

SEQ ID NO: 1436306 - RNA, 15 nt, Human
caggaccacaggcuc

SEQ ID NO: 1436307 - RNA, 14 nt, Human
caggaccacaggcu

SEQ ID NO: 1436308 - RNA, 12 nt, Human
caggaccacagg

SEQ ID NO: 1436309 - RNA, 18 nt, Human
caggacauuucucuaaga

SEQ ID NO: 1436310 - RNA, 14 nt, Human
caggacauuucucu

SEQ ID NO: 1436311 - RNA, 12 nt, Human
caggacauuucu

SEQ ID NO: 1436312 - RNA, 16 nt, Human
caggacccagaggaag

SEQ ID NO: 1436313 - RNA, 15 nt, Human
caggacccagaggaa

SEQ ID NO: 1436314 - RNA, 14 nt, Human
caggacccagagga

SEQ ID NO: 1436315 - RNA, 13 nt, Human
caggacccagagg

SEQ ID NO: 1436316 - RNA, 20 nt, Human
caggaccagucccagagcag

SEQ ID NO: 1436317 - RNA, 19 nt, Human
caggaccagucccagagca

SEQ ID NO: 1436318 - RNA, 18 nt, Human
caggaccagucccagagc

SEQ ID NO: 1436319 - RNA, 21 nt, Human
caggaccagucaaccugggca

SEQ ID NO: 1436320 - RNA, 13 nt, Human
caggaccagcuca

SEQ ID NO: 1436321 - RNA, 14 nt, Human
caggaccagcucag

SEQ ID NO: 1436322 - RNA, 12 nt, Human
caggaccagcuc

SEQ ID NO: 1436323 - RNA, 12 nt, Human
caggccaggcau

SEQ ID NO: 1436324 - RNA, 16 nt, Human
caggagggacaaagga

SEQ ID NO: 1436325 - RNA, 23 nt, Human
caggccaggacucugcagccuca

SEQ ID NO: 1436326 - RNA, 21 nt, Human
caggccaggacucugcagccu

SEQ ID NO: 1436327 - RNA, 20 nt, Human
caggccaggacucugcagcc

SEQ ID NO: 1436328 - RNA, 19 nt, Human
caggccaggacucugcagc

SEQ ID NO: 1436329 - RNA, 18 nt, Human
caggccaggacucugcag

SEQ ID NO: 1436330 - RNA, 17 nt, Human
caggccaggacucugca

SEQ ID NO: 1436331 - RNA, 16 nt, Human
caggccaggacucugc

SEQ ID NO: 1436332 - RNA, 15 nt, Human
caggccaggacucug

SEQ ID NO: 1436333 - RNA, 14 nt, Human
caggccaggacucu

SEQ ID NO: 1436334 - RNA, 13 nt, Human
caggccaggacuc

SEQ ID NO: 1436335 - RNA, 13 nt, Human
caggccagcugug

SEQ ID NO: 1436336 - RNA, 12 nt, Human
caggccagcugu

SEQ ID NO: 1436337 - RNA, 22 nt, Human
caggcacugagauaccagcgag

SEQ ID NO: 1436338 - RNA, 20 nt, Human
caggccgugacgucugggug

SEQ ID NO: 1436339 - RNA, 19 nt, Human
caggccgugacgucugggu

SEQ ID NO: 1436340 - RNA, 18 nt, Human
caggccgugacgucuggg

SEQ ID NO: 1436341 - RNA, 17 nt, Human
caggccgugacgucugg

SEQ ID NO: 1436342 - RNA, 15 nt, Human
caggccuguccaaca

SEQ ID NO: 1436343 - RNA, 20 nt, Human
caggccugaaagaggcugag

SEQ ID NO: 1436344 - RNA, 15 nt, Human
caggccugaaagagg

SEQ ID NO: 1436345 - RNA, 22 nt, Human
caggccucucccuccuccagga

SEQ ID NO: 1436346 - RNA, 23 nt, Human
caggccuguguagcugugaccug

SEQ ID NO: 1436347 - RNA, 22 nt, Human
caggccuguguagcugugaccu

SEQ ID NO: 1436348 - RNA, 21 nt, Human
caggccuguguagcugugacc

SEQ ID NO: 1436349 - RNA, 20 nt, Human
caggccuguguagcugugac

SEQ ID NO: 1436350 - RNA, 19 nt, Human
caggccuguguagcuguga

SEQ ID NO: 1436351 - RNA, 18 nt, Human
caggccuguguagcugug

SEQ ID NO: 1436352 - RNA, 16 nt, Human
caggccuguguagcug

SEQ ID NO: 1436353 - RNA, 16 nt, Human
caggccuuugagcuca

SEQ ID NO: 1436354 - RNA, 17 nt, Human
caggccuuugagcucag

SEQ ID NO: 1436355 - RNA, 18 nt, Human
caggccuuugagaaaggg

SEQ ID NO: 1436356 - RNA, 18 nt, Human
caggcgugagccaccucg

SEQ ID NO: 1436357 - RNA, 22 nt, Human
caggcuaauuuuuuuguauuuu

SEQ ID NO: 1436358 - RNA, 13 nt, Human
caggcuaauuuuu

SEQ ID NO: 1436359 - RNA, 13 nt, Human
caggccgggaaaa

SEQ ID NO: 1436360 - RNA, 20 nt, Human
caggccggcuugccacaccc

SEQ ID NO: 1436361 - RNA, 22 nt, Human
cagggcuuuacuccguaacaga

SEQ ID NO: 1436362 - RNA, 18 nt, Human
cagggcucuccuggcuuc

SEQ ID NO: 1436363 - RNA, 19 nt, Human
cagggcucuccuggcuucc

SEQ ID NO: 1436364 - RNA, 17 nt, Human
cagggcucuccuggcuu

SEQ ID NO: 1436365 - RNA, 16 nt, Human
cagggcucuccuggcu

SEQ ID NO: 1436366 - RNA, 15 nt, Human
cagggcucuccuggc

SEQ ID NO: 1436367 - RNA, 14 nt, Human
cagggcucuccugg

SEQ ID NO: 1436368 - RNA, 23 nt, Human
cagggcuccuugugggccugggc

SEQ ID NO: 1436369 - RNA, 21 nt, Human
cagggcuccuugugggccugg

SEQ ID NO: 1436370 - RNA, 14 nt, Human
cagggcuccuugug

SEQ ID NO: 1436371 - RNA, 13 nt, Human
cagggcuccuggg

SEQ ID NO: 1436372 - RNA, 12 nt, Human
cagggcuccugg

SEQ ID NO: 1436373 - RNA, 14 nt, Human
cagggcuccugcac

SEQ ID NO: 1436374 - RNA, 12 nt, Human
cagggcuccugc

SEQ ID NO: 1436375 - RNA, 11 nt, Human
cagggcuccug

SEQ ID NO: 1436376 - RNA, 18 nt, Human
cagggcuagugacuugug

SEQ ID NO: 1436377 - RNA, 15 nt, Human
cagggcuagugacuu

SEQ ID NO: 1436378 - RNA, 14 nt, Human
cagggcuagugacu

SEQ ID NO: 1436379 - RNA, 24 nt, Human
cagggcuacccugagcugaggcag

SEQ ID NO: 1436380 - RNA, 23 nt, Human
cagggcuacccugagcugaggca

SEQ ID NO: 1436381 - RNA, 22 nt, Human
cagggcuacccugagcugaggc

SEQ ID NO: 1436382 - RNA, 19 nt, Human
cagggcuacccugagcuga

SEQ ID NO: 1436383 - RNA, 18 nt, Human
cagggcuacccugagcug

SEQ ID NO: 1436384 - RNA, 16 nt, Human
cagggcuacccugagc

SEQ ID NO: 1436385 - RNA, 14 nt, Human
cagggcuacccuga

SEQ ID NO: 1436386 - RNA, 18 nt, Human
cagggagcaugagaggag

SEQ ID NO: 1436387 - RNA, 21 nt, Human
cagggagcaugagaggaggca

SEQ ID NO: 1436388 - RNA, 22 nt, Human
cagggagcaugagaggaggcag

SEQ ID NO: 1436389 - RNA, 23 nt, Human
cagggagcaugagaggaggcagc

SEQ ID NO: 1436390 - RNA, 17 nt, Human
cagggagagggggcugg

SEQ ID NO: 1436391 - RNA, 19 nt, Human
cagggagagcccaggagcu

SEQ ID NO: 1436392 - RNA, 20 nt, Human
cagggagagcccaggagcuc

SEQ ID NO: 1436393 - RNA, 16 nt, Human
cagggagagcccagga

SEQ ID NO: 1436394 - RNA, 15 nt, Human
cagggagagcccagg

SEQ ID NO: 1436395 - RNA, 14 nt, Human
cagggagagcccag

SEQ ID NO: 1436396 - RNA, 13 nt, Human
cagggagagccca

SEQ ID NO: 1436397 - RNA, 10 nt, Human
caggcugggc

SEQ ID NO: 1436398 - RNA, 22 nt, Human
cagggagacuggguaggaaaga

SEQ ID NO: 1436399 - RNA, 18 nt, Human
cagacugcgauuuguccc

SEQ ID NO: 1436400 - RNA, 20 nt, Human
cagacugcuuccaauuuucu

SEQ ID NO: 1436401 - RNA, 14 nt, Human
cagacugcuuccaa

SEQ ID NO: 1436402 - RNA, 19 nt, Human
cagacuggauaguccgucu

SEQ ID NO: 1436403 - RNA, 23 nt, Human
cagacugacaguuuacagacgcu

SEQ ID NO: 1436404 - RNA, 18 nt, Human
cagacucuuuaugcuugc

SEQ ID NO: 1436405 - RNA, 19 nt, Human
cagacucuuuaugcuugca

SEQ ID NO: 1436406 - RNA, 15 nt, Human
cagacucuuuaugcu

SEQ ID NO: 1436407 - RNA, 18 nt, Human
cagacucuugccuguuuc

SEQ ID NO: 1436408 - RNA, 13 nt, Human
cagacucuugccu

SEQ ID NO: 1436409 - RNA, 18 nt, Human
cagacucuaagaaagaac

SEQ ID NO: 1436410 - RNA, 17 nt, Human
cagacucuaagaaagaa

SEQ ID NO: 1436411 - RNA, 14 nt, Human
cagacucuaagaaa

SEQ ID NO: 1436412 - RNA, 18 nt, Human
cagacuccuucaacaauu

SEQ ID NO: 1436413 - RNA, 20 nt, Human
cagacucccauuccugaaga

SEQ ID NO: 1436414 - RNA, 19 nt, Human
cagacucccauuccugaag

SEQ ID NO: 1436415 - RNA, 19 nt, Human
cagacaguguuuucuggga

SEQ ID NO: 1436416 - RNA, 16 nt, Human
cagacaggucccuccc

SEQ ID NO: 1436417 - RNA, 23 nt, Human
cagacuccuucaacaauucuaaa

SEQ ID NO: 1436418 - RNA, 22 nt, Human
cagacagggaauuaggccccca

SEQ ID NO: 1436419 - RNA, 22 nt, Human
cagacaggcucuuagcagcuuc

SEQ ID NO: 1436420 - RNA, 20 nt, Human
cagacaggcucuuagcagcu

SEQ ID NO: 1436421 - RNA, 18 nt, Human
cagacaggcucuuagcag

SEQ ID NO: 1436422 - RNA, 14 nt, Human
cagacaggcucuua

SEQ ID NO: 1436423 - RNA, 20 nt, Human
cagacaggccccgugaggca

SEQ ID NO: 1436424 - RNA, 15 nt, Human
cagacaggccccgug

SEQ ID NO: 1436425 - RNA, 18 nt, Human
cagacaggcaaauaaaag

SEQ ID NO: 1436426 - RNA, 21 nt, Human
cagacagcuccacccuggccg

SEQ ID NO: 1436427 - RNA, 18 nt, Human
cagacagaugaggcuuuc

SEQ ID NO: 1436428 - RNA, 17 nt, Human
cagacagaugaggcuuu

SEQ ID NO: 1436429 - RNA, 11 nt, Human
cagacagauga

SEQ ID NO: 1436430 - RNA, 21 nt, Human
cagacagauggaaaagggaga

SEQ ID NO: 1436431 - RNA, 23 nt, Human
cagacagagccaggagaagcuca

SEQ ID NO: 1436432 - RNA, 14 nt, Human
cagacagagcccug

SEQ ID NO: 1436433 - RNA, 20 nt, Human
cagacagagccaggagaagc

SEQ ID NO: 1436434 - RNA, 18 nt, Human
cagacagagccaggagaa

SEQ ID NO: 1436435 - RNA, 17 nt, Human
cagacagagccaggaga

SEQ ID NO: 1436436 - RNA, 16 nt, Human
cagacagagccaggag

SEQ ID NO: 1436437 - RNA, 15 nt, Human
cagacagagccagga

SEQ ID NO: 1436438 - RNA, 14 nt, Human
cagacagagccagg

SEQ ID NO: 1436439 - RNA, 13 nt, Human
cagacagagccag

SEQ ID NO: 1436440 - RNA, 16 nt, Human
cagagagaauggcuuu

SEQ ID NO: 1436441 - RNA, 12 nt, Human
cagagagaccga

SEQ ID NO: 1436442 - RNA, 14 nt, Human
cagagagaccgagg

SEQ ID NO: 1436443 - RNA, 20 nt, Human
cagagagaaauaagugcccu

SEQ ID NO: 1436444 - RNA, 17 nt, Human
cagagacuuuagggggu

SEQ ID NO: 1436445 - RNA, 20 nt, Human
cagagagguuugcaguccca

SEQ ID NO: 1436446 - RNA, 23 nt, Human
cagagagguuugcagucccaagc

SEQ ID NO: 1436447 - RNA, 18 nt, Human
cagagagguuugcagucc

SEQ ID NO: 1436448 - RNA, 20 nt, Human
cagagcugauggagaaggaa

SEQ ID NO: 1436449 - RNA, 21 nt, Human
cagagcugauggagaaggaag

SEQ ID NO: 1436450 - RNA, 19 nt, Human
cagagcugauggagaagga

SEQ ID NO: 1436451 - RNA, 23 nt, Human
cagaggggccugccaccuggacc

SEQ ID NO: 1436452 - RNA, 22 nt, Human
cagagcugauggagaaggaagg

SEQ ID NO: 1436453 - RNA, 15 nt, Human
cagauauauauucau

SEQ ID NO: 1436454 - RNA, 20 nt, Human
cagauaguguagcugaggag

SEQ ID NO: 1436455 - RNA, 18 nt, Human
cagauaguguagcugagg

SEQ ID NO: 1436456 - RNA, 22 nt, Human
cagaggggccugccaccuggac

SEQ ID NO: 1436457 - RNA, 20 nt, Human
cagauccaggagcuccagug

SEQ ID NO: 1436458 - RNA, 23 nt, Human
cagauccagggacagaggcccca

SEQ ID NO: 1436459 - RNA, 15 nt, Human
cagauccagggacag

SEQ ID NO: 1436460 - RNA, 14 nt, Human
cagauccagggaca

SEQ ID NO: 1436461 - RNA, 13 nt, Human
cagauccagggac

SEQ ID NO: 1436462 - RNA, 19 nt, Human
cagauccaggagcuccagu

SEQ ID NO: 1436463 - RNA, 18 nt, Human
cagauccaggagcuccag

SEQ ID NO: 1436464 - RNA, 17 nt, Human
cagauccaggagcucca

SEQ ID NO: 1436465 - RNA, 14 nt, Human
cagauccaggagcu

SEQ ID NO: 1436466 - RNA, 13 nt, Human
cagauccaggacu

SEQ ID NO: 1436467 - RNA, 12 nt, Human
cagauccaggac

SEQ ID NO: 1436468 - RNA, 20 nt, Human
cagauaucuuggacaaauca

SEQ ID NO: 1436469 - RNA, 18 nt, Human
cagauauauuuucuuucu

SEQ ID NO: 1436470 - RNA, 15 nt, Human
cagauaugauucaaa

SEQ ID NO: 1436471 - RNA, 14 nt, Human
cagauaugauucaa

SEQ ID NO: 1436472 - RNA, 17 nt, Human
cagccagcaucugggcc

SEQ ID NO: 1436473 - RNA, 16 nt, Human
cagccagcaucugggc

SEQ ID NO: 1436474 - RNA, 15 nt, Human
cagccagcaucuggg

SEQ ID NO: 1436475 - RNA, 14 nt, Human
cagccagcaucugg

SEQ ID NO: 1436476 - RNA, 13 nt, Human
cagccagcaucug

SEQ ID NO: 1436477 - RNA, 20 nt, Human
cagccagcccugccuggagg

SEQ ID NO: 1436478 - RNA, 19 nt, Human
cagccagcccugccuggag

SEQ ID NO: 1436479 - RNA, 18 nt, Human
cagccagcccugccugga

SEQ ID NO: 1436480 - RNA, 17 nt, Human
cagccagcccugccugg

SEQ ID NO: 1436481 - RNA, 16 nt, Human
cagccagcccugccug

SEQ ID NO: 1436482 - RNA, 15 nt, Human
cagccagcccugccu

SEQ ID NO: 1436483 - RNA, 14 nt, Human
cagccagcccugcc

SEQ ID NO: 1436484 - RNA, 13 nt, Human
cagccagcccugc

SEQ ID NO: 1436485 - RNA, 12 nt, Human
cagccagcccug

SEQ ID NO: 1436486 - RNA, 17 nt, Human
cagccaggcccagccga

SEQ ID NO: 1436487 - RNA, 15 nt, Human
cagccaggcccagcc

SEQ ID NO: 1436488 - RNA, 21 nt, Human
cagccaggcccagccgacccc

SEQ ID NO: 1436489 - RNA, 13 nt, Human
cagccaggcccag

SEQ ID NO: 1436490 - RNA, 21 nt, Human
cagccagcccugccuggagga

SEQ ID NO: 1436491 - RNA, 21 nt, Human
cagcacuagccaaaccucacc

SEQ ID NO: 1436492 - RNA, 17 nt, Human
cagcacuagccaaaccu

SEQ ID NO: 1436493 - RNA, 15 nt, Human
cagcacuagccaaac

SEQ ID NO: 1436494 - RNA, 12 nt, Human
cagcaccugccc

SEQ ID NO: 1436495 - RNA, 12 nt, Human
cagcaccuggca

SEQ ID NO: 1436496 - RNA, 14 nt, Human
cagcacgauuucug

SEQ ID NO: 1436497 - RNA, 15 nt, Human
cagcacgauuucugu

SEQ ID NO: 1436498 - RNA, 13 nt, Human
cagauuguuugca

SEQ ID NO: 1436499 - RNA, 14 nt, Human
cagauugucagcuc

SEQ ID NO: 1436500 - RNA, 13 nt, Human
cagauuuaugcau

SEQ ID NO: 1436501 - RNA, 13 nt, Human
cagcaccugcccu

SEQ ID NO: 1436502 - RNA, 19 nt, Human
cagcaccuccucagccuga

SEQ ID NO: 1436503 - RNA, 18 nt, Human
cagcaccuccucagccug

SEQ ID NO: 1436504 - RNA, 17 nt, Human
cagcaccuccucagccu

SEQ ID NO: 1436505 - RNA, 16 nt, Human
cagcaccuccucagcc

SEQ ID NO: 1436506 - RNA, 15 nt, Human
cagcaccuccucagc

SEQ ID NO: 1436507 - RNA, 14 nt, Human
cagcaccuccucag

SEQ ID NO: 1436508 - RNA, 12 nt, Human
cagcaccuccuc

SEQ ID NO: 1436509 - RNA, 14 nt, Human
cagcaccagaaugu

SEQ ID NO: 1436510 - RNA, 14 nt, Human
cagauuuccagccu

SEQ ID NO: 1436511 - RNA, 14 nt, Human
cagauuucugagga

SEQ ID NO: 1436512 - RNA, 15 nt, Human
cagauuucugaggaa

SEQ ID NO: 1436513 - RNA, 17 nt, Human
cagauuucugaggaaau

SEQ ID NO: 1436514 - RNA, 20 nt, Human
cauguccaaagaggcugccc

SEQ ID NO: 1436515 - RNA, 19 nt, Human
cauguccaaagaggcugcc

SEQ ID NO: 1436516 - RNA, 18 nt, Human
cauguccaaagaggcugc

SEQ ID NO: 1436517 - RNA, 17 nt, Human
cauguccaaagaggcug

SEQ ID NO: 1436518 - RNA, 16 nt, Human
cauguccaaagaggcu

SEQ ID NO: 1436519 - RNA, 15 nt, Human
cauguccaaagaggc

SEQ ID NO: 1436520 - RNA, 14 nt, Human
cauguccaaagagg

SEQ ID NO: 1436521 - RNA, 13 nt, Human
cauguccaaagag

SEQ ID NO: 1436522 - RNA, 12 nt, Human
cauguccaaaga

SEQ ID NO: 1436523 - RNA, 18 nt, Human
caugucauuucagaaguu

SEQ ID NO: 1436524 - RNA, 21 nt, Human
cauguauugcacauuguaaaa

SEQ ID NO: 1436525 - RNA, 18 nt, Human
cauguauugcacauugua

SEQ ID NO: 1436526 - RNA, 17 nt, Human
cauguauugcacauugu

SEQ ID NO: 1436527 - RNA, 21 nt, Human
cauguccaaagaggcugcccc

SEQ ID NO: 1436528 - RNA, 13 nt, Human
cauguucuuaauu

SEQ ID NO: 1436529 - RNA, 16 nt, Human
cauguucuuaauucuu

SEQ ID NO: 1436530 - RNA, 19 nt, Human
cauuauauuucuauuuuau

SEQ ID NO: 1436531 - RNA, 22 nt, Human
cauguugaagccacugccuuca

SEQ ID NO: 1436532 - RNA, 19 nt, Human
cauguugaagccacugccu

SEQ ID NO: 1436533 - RNA, 18 nt, Human
cauguucugucccuugcc

SEQ ID NO: 1436534 - RNA, 14 nt, Human
cauguucugucccu

SEQ ID NO: 1436535 - RNA, 18 nt, Human
cauguucuuaauucuuag

SEQ ID NO: 1436536 - RNA, 21 nt, Human
cauuaucgagcagcauuuuau

SEQ ID NO: 1436537 - RNA, 16 nt, Human
cauuauuacuuuugcu

SEQ ID NO: 1436538 - RNA, 12 nt, Human
cauuauuacuuu

SEQ ID NO: 1436539 - RNA, 13 nt, Human
cauuauuaucaac

SEQ ID NO: 1436540 - RNA, 23 nt, Human
cauuauuacuuuugcuguaaugu

SEQ ID NO: 1436541 - RNA, 16 nt, Human
cauucugaaggagccc

SEQ ID NO: 1436542 - RNA, 23 nt, Human
cauucucugucucauccaucauc

SEQ ID NO: 1436543 - RNA, 19 nt, Human
cauucucugucucauccau

SEQ ID NO: 1436544 - RNA, 14 nt, Human
cauucucugucuca

SEQ ID NO: 1436545 - RNA, 11 nt, Human
cauucugaaug

SEQ ID NO: 1436546 - RNA, 18 nt, Human
cauuauuacuuuugcugu

SEQ ID NO: 1436547 - RNA, 21 nt, Human
cauggccucuucagaucucua

SEQ ID NO: 1436548 - RNA, 22 nt, Human
cauggccucuucagaucucuaa

SEQ ID NO: 1436549 - RNA, 18 nt, Human
cauggccccucugaccug

SEQ ID NO: 1436550 - RNA, 17 nt, Human
cauggccccucugaccu

SEQ ID NO: 1436551 - RNA, 16 nt, Human
cauggccccucugacc

SEQ ID NO: 1436552 - RNA, 13 nt, Human
cauggccccucug

SEQ ID NO: 1436553 - RNA, 12 nt, Human
cauggccccucu

SEQ ID NO: 1436554 - RNA, 17 nt, Human
cauggcccugagcgagu

SEQ ID NO: 1436555 - RNA, 15 nt, Human
cauggcccugagcga

SEQ ID NO: 1436556 - RNA, 16 nt, Human
cauggcccugccaugc

SEQ ID NO: 1436557 - RNA, 19 nt, Human
caugauggcaacagaucug

SEQ ID NO: 1436558 - RNA, 15 nt, Human
caugauggcaacaga

SEQ ID NO: 1436559 - RNA, 20 nt, Human
caugaugccucugucuucug

SEQ ID NO: 1436560 - RNA, 17 nt, Human
caugaugccucugucuu

SEQ ID NO: 1436561 - RNA, 16 nt, Human
caugaugccucugucu

SEQ ID NO: 1436562 - RNA, 23 nt, Human
caugaugccucugucuucuggac

SEQ ID NO: 1436563 - RNA, 22 nt, Human
caugaugccucugucuucugga

SEQ ID NO: 1436564 - RNA, 20 nt, Human
caugauggcaacagaucugg

SEQ ID NO: 1436565 - RNA, 14 nt, Human
caugcaaacucuuu

SEQ ID NO: 1436566 - RNA, 12 nt, Human
caugcaagguca

SEQ ID NO: 1436567 - RNA, 15 nt, Human
caugcaaggucauuu

SEQ ID NO: 1436568 - RNA, 18 nt, Human
caugaauuuuagcuuuug

SEQ ID NO: 1436569 - RNA, 17 nt, Human
caugaauuuuagcuuuu

SEQ ID NO: 1436570 - RNA, 16 nt, Human
caugaauuuuagcuuu

SEQ ID NO: 1436571 - RNA, 15 nt, Human
caugaauuuuagcuu

SEQ ID NO: 1436572 - RNA, 19 nt, Human
caugaauguaaauuuguac

SEQ ID NO: 1436573 - RNA, 22 nt, Human
caugaauguaaauuuguacuau

SEQ ID NO: 1436574 - RNA, 17 nt, Human
caugaauguaaauuugu

SEQ ID NO: 1436575 - RNA, 16 nt, Human
caugaauguaaauuug

SEQ ID NO: 1436576 - RNA, 19 nt, Human
caugaauuuuagcuuuugu

SEQ ID NO: 1436577 - RNA, 16 nt, Human
caugacaacuucuaau

SEQ ID NO: 1436578 - RNA, 20 nt, Human
caugaauuuuagcuuuugug

SEQ ID NO: 1436579 - RNA, 13 nt, Human
caugacaaagacu

SEQ ID NO: 1436580 - RNA, 14 nt, Human
caugaauguaaauu

SEQ ID NO: 1436581 - RNA, 13 nt, Human
caugaauguaaau

SEQ ID NO: 1436582 - RNA, 19 nt, Human
caugaaucugcacaucugu

SEQ ID NO: 1436583 - RNA, 15 nt, Human
caucugucccccuuu

SEQ ID NO: 1436584 - RNA, 13 nt, Human
caucugucccccu

SEQ ID NO: 1436585 - RNA, 12 nt, Human
caucuguccccc

SEQ ID NO: 1436586 - RNA, 21 nt, Human
caugaauauuuaguguucaua

SEQ ID NO: 1436587 - RNA, 23 nt, Human
cauuuaugagcucuucauguuuc

SEQ ID NO: 1436588 - RNA, 20 nt, Human
cauuuaugagcucuucaugu

SEQ ID NO: 1436589 - RNA, 17 nt, Human
cauuuaugagcucuuca

SEQ ID NO: 1436590 - RNA, 16 nt, Human
cauuuaugaagcaagc

SEQ ID NO: 1436591 - RNA, 20 nt, Human
cauuuaucuaaauauggacu

SEQ ID NO: 1436592 - RNA, 22 nt, Human
cauuuaucuauaauuuaccuaa

SEQ ID NO: 1436593 - RNA, 21 nt, Human
cauuuaucuauaauuuaccua

SEQ ID NO: 1436594 - RNA, 16 nt, Human
cauuuaucuauaauuu

SEQ ID NO: 1436595 - RNA, 14 nt, Human
cauuuaucuauaau

SEQ ID NO: 1436596 - RNA, 23 nt, Human
cauuugggaguuuuuaugagaaa

SEQ ID NO: 1436597 - RNA, 18 nt, Human
cauuuggcaucccugggc

SEQ ID NO: 1436598 - RNA, 20 nt, Human
cauuugggagacaugugaca

SEQ ID NO: 1436599 - RNA, 18 nt, Human
cauuugggagacauguga

SEQ ID NO: 1436600 - RNA, 20 nt, Human
cauuuggcaucccugggccu

SEQ ID NO: 1436601 - RNA, 16 nt, Human
cauuuggcaucccugg

SEQ ID NO: 1436602 - RNA, 18 nt, Human
cauuuggguccaggagga

SEQ ID NO: 1436603 - RNA, 17 nt, Human
cauuuggguccaggagg

SEQ ID NO: 1436604 - RNA, 16 nt, Human
cauuuggguccaggag

SEQ ID NO: 1436605 - RNA, 15 nt, Human
cauuuggguccagga

SEQ ID NO: 1436606 - RNA, 14 nt, Human
cauuuggguccagg

SEQ ID NO: 1436607 - RNA, 21 nt, Human
cauuuggugguuucagaaaug

SEQ ID NO: 1436608 - RNA, 22 nt, Human
cauuuguuucuuucucugagga

SEQ ID NO: 1436609 - RNA, 21 nt, Human
cauuuguuucuuucucugagg

SEQ ID NO: 1436610 - RNA, 20 nt, Human
cauuuguuuauguaauuuca

SEQ ID NO: 1436611 - RNA, 19 nt, Human
cauuuguuuauguaauuuc

SEQ ID NO: 1436612 - RNA, 18 nt, Human
cauuuguuuauguaauuu

SEQ ID NO: 1436613 - RNA, 17 nt, Human
cauuuguuuauguaauu

SEQ ID NO: 1436614 - RNA, 16 nt, Human
cauuuguuggaaugaa

SEQ ID NO: 1436615 - RNA, 15 nt, Human
cauuuguuucuacuu

SEQ ID NO: 1436616 - RNA, 23 nt, Human
cauuuguuucuuucucugaggac

SEQ ID NO: 1436617 - RNA, 17 nt, Human
cauuuguuugaacugau

SEQ ID NO: 1436618 - RNA, 23 nt, Human
cauuuuuuuuaagaaaaaggaug

SEQ ID NO: 1436619 - RNA, 16 nt, Human
cauuuguauaaaauaa

SEQ ID NO: 1436620 - RNA, 14 nt, Human
cauuuguauaaaau

SEQ ID NO: 1436621 - RNA, 17 nt, Human
cauuuguauaaaauaau

SEQ ID NO: 1436622 - RNA, 19 nt, Human
ccaaaagguuuaagaaaua

SEQ ID NO: 1436623 - RNA, 15 nt, Human
ccaaaagcuuuuuau

SEQ ID NO: 1436624 - RNA, 23 nt, Human
ccaaaagguuuaagaaauagaau

SEQ ID NO: 1436625 - RNA, 17 nt, Human
ccaaaaguuacauguuu

SEQ ID NO: 1436626 - RNA, 19 nt, Human
ccaaaaaaaaauacaugcu

SEQ ID NO: 1436627 - RNA, 22 nt, Human
cauuuuuuuucuuugaauaaau

SEQ ID NO: 1436628 - RNA, 21 nt, Human
cauuuuuuuucuuugaauaaa

SEQ ID NO: 1436629 - RNA, 17 nt, Human
cauuuuuuuucuuugaa

SEQ ID NO: 1436630 - RNA, 15 nt, Human
cauuuuuuuucuuug

SEQ ID NO: 1436631 - RNA, 23 nt, Human
cauuuuuuuucuuugaauaaaug

SEQ ID NO: 1436632 - RNA, 12 nt, Human
ccaaaaaacuac

SEQ ID NO: 1436633 - RNA, 21 nt, Human
cauuuauauugauaagaucuu

SEQ ID NO: 1436634 - RNA, 20 nt, Human
cauuuauauugauaagaucu

SEQ ID NO: 1436635 - RNA, 14 nt, Human
cauuuauauugaua

SEQ ID NO: 1436636 - RNA, 17 nt, Human
cauuuaguuugauuauu

SEQ ID NO: 1436637 - RNA, 17 nt, Human
cauuuagucaugugacc

SEQ ID NO: 1436638 - RNA, 15 nt, Human
cauuuagucauguga

SEQ ID NO: 1436639 - RNA, 15 nt, Human
cauuuagguuucuga

SEQ ID NO: 1436640 - RNA, 23 nt, Human
cauugggguaguuguguuucaac

SEQ ID NO: 1436641 - RNA, 14 nt, Human
cauugguccaagau

SEQ ID NO: 1436642 - RNA, 13 nt, Human
cauugguccaaga

SEQ ID NO: 1436643 - RNA, 20 nt, Human
cauuggaagagcagcaccuc

SEQ ID NO: 1436644 - RNA, 11 nt, Human
cauuggauauu

SEQ ID NO: 1436645 - RNA, 18 nt, Human
cauuggauauuuuuuacu

SEQ ID NO: 1436646 - RNA, 18 nt, Human
cauuggaauguucucaga

SEQ ID NO: 1436647 - RNA, 17 nt, Human
cauuggacccuuccaug

SEQ ID NO: 1436648 - RNA, 16 nt, Human
cauuggacccuuccau

SEQ ID NO: 1436649 - RNA, 19 nt, Human
cauuggaauguucucagau

SEQ ID NO: 1436650 - RNA, 16 nt, Human
cauuggaauguucuca

SEQ ID NO: 1436651 - RNA, 19 nt, Human
cauuggaagagcagcaccu

SEQ ID NO: 1436652 - RNA, 16 nt, Human
cauuggagauguuuag

SEQ ID NO: 1436653 - RNA, 17 nt, Human
ccaaagucauaauugca

SEQ ID NO: 1436654 - RNA, 13 nt, Human
ccaaagucauaau

SEQ ID NO: 1436655 - RNA, 22 nt, Human
ccaaaguacacuguuucaaacu

SEQ ID NO: 1436656 - RNA, 18 nt, Human
ccaaagucucuaauucua

SEQ ID NO: 1436657 - RNA, 16 nt, Human
ccaaagucucuaauuc

SEQ ID NO: 1436658 - RNA, 15 nt, Human
ccaaagucucuaauu

SEQ ID NO: 1436659 - RNA, 14 nt, Human
ccaaagucucuaau

SEQ ID NO: 1436660 - RNA, 19 nt, Human
ccaaagucauaauugcauu

SEQ ID NO: 1436661 - RNA, 19 nt, Human
ccaaaguccugggauuaca

SEQ ID NO: 1436662 - RNA, 22 nt, Human
ccaaggagucacugagaccaag

SEQ ID NO: 1436663 - RNA, 19 nt, Human
ccaaggagucacugagacc

SEQ ID NO: 1436664 - RNA, 17 nt, Human
ccaaggagucacugaga

SEQ ID NO: 1436665 - RNA, 14 nt, Human
ccaaggaccugaga

SEQ ID NO: 1436666 - RNA, 14 nt, Human
ccaaggaaaggcac

SEQ ID NO: 1436667 - RNA, 16 nt, Human
ccaauucagacaggca

SEQ ID NO: 1436668 - RNA, 14 nt, Human
ccaauucagacagg

SEQ ID NO: 1436669 - RNA, 22 nt, Human
ccaauuauuuucauccuugucu

SEQ ID NO: 1436670 - RNA, 15 nt, Human
ccaauuauguuaaac

SEQ ID NO: 1436671 - RNA, 17 nt, Human
ccaauuauguuaaacua

SEQ ID NO: 1436672 - RNA, 22 nt, Human
ccaauggaaugugauguucaug

SEQ ID NO: 1436673 - RNA, 20 nt, Human
ccaauggaaugugauguuca

SEQ ID NO: 1436674 - RNA, 14 nt, Human
ccaauuauguuaaa

SEQ ID NO: 1436675 - RNA, 20 nt, Human
ccaaaucaaaaucucuccac

SEQ ID NO: 1436676 - RNA, 19 nt, Human
ccaaaucaaaaucucucca

SEQ ID NO: 1436677 - RNA, 16 nt, Human
ccaaaucaaaaucucu

SEQ ID NO: 1436678 - RNA, 15 nt, Human
ccaaagugcugagau

SEQ ID NO: 1436679 - RNA, 22 nt, Human
ccaaaucaaaagacuuuuuccu

SEQ ID NO: 1436680 - RNA, 16 nt, Human
ccaacuauggccugug

SEQ ID NO: 1436681 - RNA, 14 nt, Human
ccaacuauggccug

SEQ ID NO: 1436682 - RNA, 15 nt, Human
ccaacuauggccugu

SEQ ID NO: 1436683 - RNA, 14 nt, Human
ccaacucaccugag

SEQ ID NO: 1436684 - RNA, 20 nt, Human
ccaaaucacugaacuuugcu

SEQ ID NO: 1436685 - RNA, 21 nt, Human
ccaacuccagaaagugacaag

SEQ ID NO: 1436686 - RNA, 13 nt, Human
cagugguaagcua

SEQ ID NO: 1436687 - RNA, 15 nt, Human
cagugguaaaaaggc

SEQ ID NO: 1436688 - RNA, 15 nt, Human
cagugcaacacuggu

SEQ ID NO: 1436689 - RNA, 14 nt, Human
cagugcaacacugg

SEQ ID NO: 1436690 - RNA, 20 nt, Human
cagugauugucuuaauauug

SEQ ID NO: 1436691 - RNA, 16 nt, Human
cagugauugucuuaau

SEQ ID NO: 1436692 - RNA, 22 nt, Human
cagucucucuucucuccagcug

SEQ ID NO: 1436693 - RNA, 16 nt, Human
caguuaucuaaguuaa

SEQ ID NO: 1436694 - RNA, 18 nt, Human
caguuauauuuugcaguu

SEQ ID NO: 1436695 - RNA, 16 nt, Human
caguuauauuuugcag

SEQ ID NO: 1436696 - RNA, 15 nt, Human
caguuauauuuugca

SEQ ID NO: 1436697 - RNA, 21 nt, Human
caguuauaaguagcaggccaa

SEQ ID NO: 1436698 - RNA, 17 nt, Human
caguuauuauauuuaca

SEQ ID NO: 1436699 - RNA, 21 nt, Human
caguuauuauauuuacaaaug

SEQ ID NO: 1436700 - RNA, 20 nt, Human
caguuacucagaauucucua

SEQ ID NO: 1436701 - RNA, 22 nt, Human
cagucuaaagcugguuuaaugu

SEQ ID NO: 1436702 - RNA, 16 nt, Human
cagucguucccagugu

SEQ ID NO: 1436703 - RNA, 14 nt, Human
cagucguucccagu

SEQ ID NO: 1436704 - RNA, 17 nt, Human
cagucgugccugugucc

SEQ ID NO: 1436705 - RNA, 15 nt, Human
cagucgugccugugu

SEQ ID NO: 1436706 - RNA, 19 nt, Human
cagucucuauaccaauaaa

SEQ ID NO: 1436707 - RNA, 20 nt, Human
cagucucuauaccaauaaag

SEQ ID NO: 1436708 - RNA, 21 nt, Human
cagucucuauaccaauaaagu

SEQ ID NO: 1436709 - RNA, 22 nt, Human
cagucucuauaccaauaaagug

SEQ ID NO: 1436710 - RNA, 17 nt, Human
cagucucucuucucucc

SEQ ID NO: 1436711 - RNA, 14 nt, Human
cagucucucuucuc

SEQ ID NO: 1436712 - RNA, 23 nt, Human
cagucucuauaccaauaaaguga

SEQ ID NO: 1436713 - RNA, 17 nt, Human
cagucuauucacagaag

SEQ ID NO: 1436714 - RNA, 13 nt, Human
cagucucgucucu

SEQ ID NO: 1436715 - RNA, 17 nt, Human
cagucucuauaccaaua

SEQ ID NO: 1436716 - RNA, 19 nt, Human
caguucccacauuaaagaa

SEQ ID NO: 1436717 - RNA, 18 nt, Human
caguucccacauuaaaga

SEQ ID NO: 1436718 - RNA, 15 nt, Human
caguucauugcacuu

SEQ ID NO: 1436719 - RNA, 18 nt, Human
caguucauugcacuuuga

SEQ ID NO: 1436720 - RNA, 20 nt, Human
caguucauuagaaauauuuu

SEQ ID NO: 1436721 - RNA, 17 nt, Human
caguucauuagaaauau

SEQ ID NO: 1436722 - RNA, 23 nt, Human
caguucauauguaccauguacau

SEQ ID NO: 1436723 - RNA, 22 nt, Human
caguuaugauuuuuuuuucaua

SEQ ID NO: 1436724 - RNA, 22 nt, Human
caguuaucuaaguuaauuuaaa

SEQ ID NO: 1436725 - RNA, 22 nt, Human
caguuauuauauuuacaaaugg

SEQ ID NO: 1436726 - RNA, 13 nt, Human
caguucacccuga

SEQ ID NO: 1436727 - RNA, 14 nt, Human
caguucaagaaagc

SEQ ID NO: 1436728 - RNA, 15 nt, Human
caguucaaagcagga

SEQ ID NO: 1436729 - RNA, 20 nt, Human
caguuugaaauaagcuauuu

SEQ ID NO: 1436730 - RNA, 13 nt, Human
caguuugaaauaa

SEQ ID NO: 1436731 - RNA, 20 nt, Human
caguuucuaaacuggagacu

SEQ ID NO: 1436732 - RNA, 19 nt, Human
caguuucuaaacuggagac

SEQ ID NO: 1436733 - RNA, 18 nt, Human
caguuucuaaacuggaga

SEQ ID NO: 1436734 - RNA, 17 nt, Human
caguuucuaaacuggag

SEQ ID NO: 1436735 - RNA, 14 nt, Human
caguuuccuuggga

SEQ ID NO: 1436736 - RNA, 23 nt, Human
caguuucauaaaaggagaaccag

SEQ ID NO: 1436737 - RNA, 21 nt, Human
caguuucacagaaaauaaggc

SEQ ID NO: 1436738 - RNA, 17 nt, Human
caguuucacagaaaaua

SEQ ID NO: 1436739 - RNA, 15 nt, Human
caguuucacagaaaa

SEQ ID NO: 1436740 - RNA, 14 nt, Human
caguuucacagaaa

SEQ ID NO: 1436741 - RNA, 13 nt, Human
caguuuuaacugu

SEQ ID NO: 1436742 - RNA, 12 nt, Human
caguuuuaacug

SEQ ID NO: 1436743 - RNA, 23 nt, Human
caguuuguuaguaugaggcauuu

SEQ ID NO: 1436744 - RNA, 18 nt, Human
caguuuaucauucaagug

SEQ ID NO: 1436745 - RNA, 16 nt, Human
caguuuaucauucaag

SEQ ID NO: 1436746 - RNA, 15 nt, Human
caguuuaucauucaa

SEQ ID NO: 1436747 - RNA, 14 nt, Human
caguuuaucauuca

SEQ ID NO: 1436748 - RNA, 13 nt, Human
caguuguucuuuu

SEQ ID NO: 1436749 - RNA, 12 nt, Human
caguuguucuuu

SEQ ID NO: 1436750 - RNA, 19 nt, Human
caguuuaucauucaagugu

SEQ ID NO: 1436751 - RNA, 14 nt, Human
caguuuauuuguug

SEQ ID NO: 1436752 - RNA, 18 nt, Human
caguuuauuugaaccaau

SEQ ID NO: 1436753 - RNA, 19 nt, Human
caguuuauuugaaccaaua

SEQ ID NO: 1436754 - RNA, 17 nt, Human
cauaauguuacauuauu

SEQ ID NO: 1436755 - RNA, 23 nt, Human
cauaaugcgugcauaccacuuuu

SEQ ID NO: 1436756 - RNA, 19 nt, Human
caguuuuccuaugcuuuga

SEQ ID NO: 1436757 - RNA, 12 nt, Human
caguuuucauaa

SEQ ID NO: 1436758 - RNA, 15 nt, Human
caguuuuaucauuuu

SEQ ID NO: 1436759 - RNA, 23 nt, Human
caguuuuaacuguggauauuguu

SEQ ID NO: 1436760 - RNA, 22 nt, Human
caguuuuaacuguggauauugu

SEQ ID NO: 1436761 - RNA, 20 nt, Human
caguuuuaacuguggauauu

SEQ ID NO: 1436762 - RNA, 18 nt, Human
caguuuuaacuguggaua

SEQ ID NO: 1436763 - RNA, 17 nt, Human
caguuuuaacuguggau

SEQ ID NO: 1436764 - RNA, 16 nt, Human
caguuuuaacugugga

SEQ ID NO: 1436765 - RNA, 15 nt, Human
caguuuuaacugugg

SEQ ID NO: 1436766 - RNA, 14 nt, Human
caguuuuaacugug

SEQ ID NO: 1436767 - RNA, 22 nt, Human
cauacagagaagucacagggca

SEQ ID NO: 1436768 - RNA, 21 nt, Human
cauaauuauccaggaagggaa

SEQ ID NO: 1436769 - RNA, 23 nt, Human
cauaauguuucuggauuucauac

SEQ ID NO: 1436770 - RNA, 22 nt, Human
cauaauguuucuggauuucaua

SEQ ID NO: 1436771 - RNA, 21 nt, Human
cauaauguuucuggauuucau

SEQ ID NO: 1436772 - RNA, 18 nt, Human
cauaauguuucuggauuu

SEQ ID NO: 1436773 - RNA, 18 nt, Human
cauaauguuacauuauua

SEQ ID NO: 1436774 - RNA, 23 nt, Human
cauaauucacucugaguguuuua

SEQ ID NO: 1436775 - RNA, 21 nt, Human
cauaauucacucugaguguuu

SEQ ID NO: 1436776 - RNA, 17 nt, Human
cauaauucacucugagu

SEQ ID NO: 1436777 - RNA, 14 nt, Human
cauaauucacucug

SEQ ID NO: 1436778 - RNA, 18 nt, Human
cauaauuauuauuuggcc

SEQ ID NO: 1436779 - RNA, 23 nt, Human
cauagguagaauguaaagcuugu

SEQ ID NO: 1436780 - RNA, 17 nt, Human
cauagguagaauguaaa

SEQ ID NO: 1436781 - RNA, 21 nt, Human
cauaggugauccauguaacug

SEQ ID NO: 1436782 - RNA, 23 nt, Human
cauaggugauccauguaacugcc

SEQ ID NO: 1436783 - RNA, 20 nt, Human
cauaggugauccauguaacu

SEQ ID NO: 1436784 - RNA, 18 nt, Human
cauaggugauccauguaa

SEQ ID NO: 1436785 - RNA, 21 nt, Human
cauaggucugaaauuuuucuu

SEQ ID NO: 1436786 - RNA, 16 nt, Human
cauagguuuaauaauu

SEQ ID NO: 1436787 - RNA, 19 nt, Human
cauauguugaauacuuuuu

SEQ ID NO: 1436788 - RNA, 18 nt, Human
cauauguugaauacuuuu

SEQ ID NO: 1436789 - RNA, 17 nt, Human
cauauguugaauacuuu

SEQ ID NO: 1436790 - RNA, 16 nt, Human
cauauguugaauacuu

SEQ ID NO: 1436791 - RNA, 15 nt, Human
cauauguaccaugua

SEQ ID NO: 1436792 - RNA, 21 nt, Human
cauauguaccauguacaugaa

SEQ ID NO: 1436793 - RNA, 21 nt, Human
cauauuauuuuauguugcaua

SEQ ID NO: 1436794 - RNA, 23 nt, Human
caucagaaagggagggcucugag

SEQ ID NO: 1436795 - RNA, 24 nt, Human
caucagaaagggagggcucugagg

SEQ ID NO: 1436796 - RNA, 22 nt, Human
caucagaaagggagggcucuga

SEQ ID NO: 1436797 - RNA, 21 nt, Human
caucagaaagggagggcucug

SEQ ID NO: 1436798 - RNA, 21 nt, Human
caucagcacgauuucuguuua

SEQ ID NO: 1436799 - RNA, 21 nt, Human
cauccauucucacagguccca

SEQ ID NO: 1436800 - RNA, 16 nt, Human
cauccauucuccugag

SEQ ID NO: 1436801 - RNA, 14 nt, Human
caucagcuccagcu

SEQ ID NO: 1436802 - RNA, 13 nt, Human
caucccacugcca

SEQ ID NO: 1436803 - RNA, 23 nt, Human
caucccacucacaacagcugccu

SEQ ID NO: 1436804 - RNA, 19 nt, Human
cauccugaccagcugcucc

SEQ ID NO: 1436805 - RNA, 15 nt, Human
cauccucuuuuucca

SEQ ID NO: 1436806 - RNA, 23 nt, Human
caucccagacaggucccuccccu

SEQ ID NO: 1436807 - RNA, 21 nt, Human
caucccagacaggucccuccc

SEQ ID NO: 1436808 - RNA, 17 nt, Human
caucccagacagguccc

SEQ ID NO: 1436809 - RNA, 23 nt, Human
caucuaaaaauagacuuaaaucu

SEQ ID NO: 1436810 - RNA, 15 nt, Human
caucguugcccccau

SEQ ID NO: 1436811 - RNA, 15 nt, Human
caucuaaccucaucu

SEQ ID NO: 1436812 - RNA, 12 nt, Human
cauccugcaggc

SEQ ID NO: 1436813 - RNA, 21 nt, Human
caucuguauacccucuguuuc

SEQ ID NO: 1436814 - RNA, 20 nt, Human
caucuguauacccucuguuu

SEQ ID NO: 1436815 - RNA, 19 nt, Human
caucuguauacccucuguu

SEQ ID NO: 1436816 - RNA, 18 nt, Human
caucuguauacccucugu

SEQ ID NO: 1436817 - RNA, 22 nt, Human
caucugguugaacucugguggc

SEQ ID NO: 1436818 - RNA, 23 nt, Human
caucugguagaagggaaagccca

SEQ ID NO: 1436819 - RNA, 18 nt, Human
caucuggcucuaauucac

SEQ ID NO: 1436820 - RNA, 22 nt, Human
caucuguaaaucuacacacggu

SEQ ID NO: 1436821 - RNA, 20 nt, Human
caucugguagaagggaaagc

SEQ ID NO: 1436822 - RNA, 14 nt, Human
caucuggcucuaau

SEQ ID NO: 1436823 - RNA, 18 nt, Human
caucuggccuggccagug

SEQ ID NO: 1436824 - RNA, 17 nt, Human
caucuggccuggccagu

SEQ ID NO: 1436825 - RNA, 15 nt, Human
caucuggccuggcca

SEQ ID NO: 1436826 - RNA, 14 nt, Human
caucuggccuggcc

SEQ ID NO: 1436827 - RNA, 13 nt, Human
caucuggccuggc

SEQ ID NO: 1436828 - RNA, 12 nt, Human
caucuggccugg

SEQ ID NO: 1436829 - RNA, 19 nt, Human
caucuaaccucaucuucuu

SEQ ID NO: 1436830 - RNA, 18 nt, Human
caucuaaccucaucuucu

SEQ ID NO: 1436831 - RNA, 20 nt, Human
caucuggcaacaucuuuauc

SEQ ID NO: 1436832 - RNA, 16 nt, Human
caucuggauuccagag

SEQ ID NO: 1436833 - RNA, 15 nt, Human
caucacuuugaccua

SEQ ID NO: 1436834 - RNA, 19 nt, Human
caucacuuguacaaaauaa

SEQ ID NO: 1436835 - RNA, 20 nt, Human
caucagaaagggagggcucu

SEQ ID NO: 1436836 - RNA, 18 nt, Human
caucagaaagggagggcu

SEQ ID NO: 1436837 - RNA, 17 nt, Human
caucagaaagggagggc

SEQ ID NO: 1436838 - RNA, 16 nt, Human
caucagaaagggaggg

SEQ ID NO: 1436839 - RNA, 12 nt, Human
caucagaaaggg

SEQ ID NO: 1436840 - RNA, 18 nt, Human
caucagaaaggaaaaaca

SEQ ID NO: 1436841 - RNA, 20 nt, Human
caucagaaaggaaaaacaaa

SEQ ID NO: 1436842 - RNA, 19 nt, Human
caucagaaacacccucaca

SEQ ID NO: 1436843 - RNA, 17 nt, Human
caucagaaacacccuca

SEQ ID NO: 1436844 - RNA, 22 nt, Human
cccugugcaaccucuuggccug

SEQ ID NO: 1436845 - RNA, 17 nt, Human
cccuguccuuagccuag

SEQ ID NO: 1436846 - RNA, 14 nt, Human
cccuguccuggugg

SEQ ID NO: 1436847 - RNA, 13 nt, Human
cccuguccuggug

SEQ ID NO: 1436848 - RNA, 23 nt, Human
cccuguccuggugguauuuucaa

SEQ ID NO: 1436849 - RNA, 23 nt, Human
ccgcccagcggcuugccugccug

SEQ ID NO: 1436850 - RNA, 22 nt, Human
ccgcccagagacccaagcugcc

SEQ ID NO: 1436851 - RNA, 23 nt, Human
ccgcccacaggaagccugcaguc

SEQ ID NO: 1436852 - RNA, 15 nt, Human
ccgaaaaucauauaa

SEQ ID NO: 1436853 - RNA, 23 nt, Human
cccuuccuggacagcugugccuc

SEQ ID NO: 1436854 - RNA, 22 nt, Human
cccuuccuggacagcugugccu

SEQ ID NO: 1436855 - RNA, 20 nt, Human
cccuuccuggacagcugugc

SEQ ID NO: 1436856 - RNA, 19 nt, Human
cccuuccuggacagcugug

SEQ ID NO: 1436857 - RNA, 18 nt, Human
cccuuccuggacagcugu

SEQ ID NO: 1436858 - RNA, 17 nt, Human
cccuuccuggacagcug

SEQ ID NO: 1436859 - RNA, 16 nt, Human
cccuuccuggacagcu

SEQ ID NO: 1436860 - RNA, 14 nt, Human
cccuuccuggacag

SEQ ID NO: 1436861 - RNA, 13 nt, Human
cccuuccuggaca

SEQ ID NO: 1436862 - RNA, 22 nt, Human
cccugugcagccgcugagcgag

SEQ ID NO: 1436863 - RNA, 11 nt, Human
cccuuccugga

SEQ ID NO: 1436864 - RNA, 13 nt, Human
ccgaagucuuuug

SEQ ID NO: 1436865 - RNA, 23 nt, Human
ccgaaggugaggagcuugaaacc

SEQ ID NO: 1436866 - RNA, 22 nt, Human
ccggcauggacaauggaccgga

SEQ ID NO: 1436867 - RNA, 18 nt, Human
ccggcauggacaauggac

SEQ ID NO: 1436868 - RNA, 17 nt, Human
ccggcauggacaaugga

SEQ ID NO: 1436869 - RNA, 13 nt, Human
ccggcauggacaa

SEQ ID NO: 1436870 - RNA, 17 nt, Human
ccuaagaaucuuuagag

SEQ ID NO: 1436871 - RNA, 17 nt, Human
ccuaacucuucuuucau

SEQ ID NO: 1436872 - RNA, 15 nt, Human
ccuaacucuucuuuc

SEQ ID NO: 1436873 - RNA, 14 nt, Human
ccuaacucuucuuu

SEQ ID NO: 1436874 - RNA, 16 nt, Human
ccguccugccuguggc

SEQ ID NO: 1436875 - RNA, 20 nt, Human
ccuagcccucucacauuuau

SEQ ID NO: 1436876 - RNA, 21 nt, Human
ccuagcauacguacacauuuu

SEQ ID NO: 1436877 - RNA, 12 nt, Human
ccuagcagcacc

SEQ ID NO: 1436878 - RNA, 23 nt, Human
ccuagcagcaccguucugugcac

SEQ ID NO: 1436879 - RNA, 21 nt, Human
ccuagcagcaccguucugugc

SEQ ID NO: 1436880 - RNA, 20 nt, Human
ccuagcagcaccguucugug

SEQ ID NO: 1436881 - RNA, 19 nt, Human
ccuagcauacguacacauu

SEQ ID NO: 1436882 - RNA, 18 nt, Human
ccuaauccccuucucccc

SEQ ID NO: 1436883 - RNA, 21 nt, Human
ccuaauccaggcagauccagg

SEQ ID NO: 1436884 - RNA, 20 nt, Human
ccuaauccaggcagauccag

SEQ ID NO: 1436885 - RNA, 19 nt, Human
ccuaauccaggcagaucca

SEQ ID NO: 1436886 - RNA, 18 nt, Human
ccuaauccaggcagaucc

SEQ ID NO: 1436887 - RNA, 16 nt, Human
ccuaauccccuucucc

SEQ ID NO: 1436888 - RNA, 20 nt, Human
ccuaaucuauggucgggaga

SEQ ID NO: 1436889 - RNA, 15 nt, Human
ccuaagaggcugccc

SEQ ID NO: 1436890 - RNA, 14 nt, Human
ccuaagaggcugcc

SEQ ID NO: 1436891 - RNA, 13 nt, Human
ccuaagaggcugc

SEQ ID NO: 1436892 - RNA, 12 nt, Human
ccuaagaggcug

SEQ ID NO: 1436893 - RNA, 15 nt, Human
ccuaagagagcaccu

SEQ ID NO: 1436894 - RNA, 19 nt, Human
cccuccgcccugccacuca

SEQ ID NO: 1436895 - RNA, 16 nt, Human
cccuccgcccugccac

SEQ ID NO: 1436896 - RNA, 15 nt, Human
cccuccgcccugcca

SEQ ID NO: 1436897 - RNA, 14 nt, Human
cccuccgcccugcc

SEQ ID NO: 1436898 - RNA, 19 nt, Human
cccuccucuagcugugggg

SEQ ID NO: 1436899 - RNA, 18 nt, Human
cccuccucuagcuguggg

SEQ ID NO: 1436900 - RNA, 13 nt, Human
cccuccuaaccua

SEQ ID NO: 1436901 - RNA, 17 nt, Human
cccuccgcucuguagug

SEQ ID NO: 1436902 - RNA, 14 nt, Human
cccucgcugccagc

SEQ ID NO: 1436903 - RNA, 20 nt, Human
cccucggggauguguccuga

SEQ ID NO: 1436904 - RNA, 18 nt, Human
cccucggggauguguccu

SEQ ID NO: 1436905 - RNA, 17 nt, Human
cccucggggaugugucc

SEQ ID NO: 1436906 - RNA, 14 nt, Human
cccugaacaagaau

SEQ ID NO: 1436907 - RNA, 20 nt, Human
cccugaagugagcacagccu

SEQ ID NO: 1436908 - RNA, 17 nt, Human
cccugaaggggccauga

SEQ ID NO: 1436909 - RNA, 17 nt, Human
cccugaccacucagaga

SEQ ID NO: 1436910 - RNA, 16 nt, Human
cccugaccacucagag

SEQ ID NO: 1436911 - RNA, 15 nt, Human
cccugaccacucaga

SEQ ID NO: 1436912 - RNA, 14 nt, Human
cccugaccacucag

SEQ ID NO: 1436913 - RNA, 20 nt, Human
cccugaauuuaaauagcuuu

SEQ ID NO: 1436914 - RNA, 16 nt, Human
cccugaccugugagcc

SEQ ID NO: 1436915 - RNA, 19 nt, Human
cccugaccuggcccccuca

SEQ ID NO: 1436916 - RNA, 16 nt, Human
cccugaccuggccccc

SEQ ID NO: 1436917 - RNA, 16 nt, Human
cccugaccagcucccc

SEQ ID NO: 1436918 - RNA, 20 nt, Human
cccugaccagcucccccucc

SEQ ID NO: 1436919 - RNA, 15 nt, Human
cccugaccagcuccc

SEQ ID NO: 1436920 - RNA, 23 nt, Human
cccugaccacucagagacaugca

SEQ ID NO: 1436921 - RNA, 22 nt, Human
cccugaccacucagagacaugc

SEQ ID NO: 1436922 - RNA, 19 nt, Human
cccugaccacucagagaca

SEQ ID NO: 1436923 - RNA, 13 nt, Human
cccugacugggag

SEQ ID NO: 1436924 - RNA, 21 nt, Human
cccugacucauucugaaggag

SEQ ID NO: 1436925 - RNA, 19 nt, Human
cccugacucauucugaagg

SEQ ID NO: 1436926 - RNA, 15 nt, Human
cccugacucauucug

SEQ ID NO: 1436927 - RNA, 20 nt, Human
cccugaccugugagcccagc

SEQ ID NO: 1436928 - RNA, 20 nt, Human
cccugagacaaauggaggcc

SEQ ID NO: 1436929 - RNA, 23 nt, Human
cccugagacaaauggaggccugu

SEQ ID NO: 1436930 - RNA, 16 nt, Human
cccugagacaaaugga

SEQ ID NO: 1436931 - RNA, 17 nt, Human
cccugagacaaauggag

SEQ ID NO: 1436932 - RNA, 20 nt, Human
cccugagcuagaacccucug

SEQ ID NO: 1436933 - RNA, 19 nt, Human
cccugagcgaguggagucu

SEQ ID NO: 1436934 - RNA, 12 nt, Human
cccugagccggc

SEQ ID NO: 1436935 - RNA, 20 nt, Human
cccugagccagggucuccag

SEQ ID NO: 1436936 - RNA, 21 nt, Human
cccugagccagggucuccaga

SEQ ID NO: 1436937 - RNA, 19 nt, Human
cccugagccagggucucca

SEQ ID NO: 1436938 - RNA, 18 nt, Human
cccugagccagggucucc

SEQ ID NO: 1436939 - RNA, 21 nt, Human
cccugagcugaggcagcagug

SEQ ID NO: 1436940 - RNA, 19 nt, Human
cccugagcugaggcagcag

SEQ ID NO: 1436941 - RNA, 17 nt, Human
cccugagcugaggcagc

SEQ ID NO: 1436942 - RNA, 16 nt, Human
cccugagcugaggcag

SEQ ID NO: 1436943 - RNA, 14 nt, Human
cccugagcugaggc

SEQ ID NO: 1436944 - RNA, 13 nt, Human
cccugagcugagg

SEQ ID NO: 1436945 - RNA, 14 nt, Human
cccugagcugacca

SEQ ID NO: 1436946 - RNA, 11 nt, Human
cccugagcuga

SEQ ID NO: 1436947 - RNA, 19 nt, Human
cccugccccuccucucccu

SEQ ID NO: 1436948 - RNA, 18 nt, Human
cccugcccccugcaggaa

SEQ ID NO: 1436949 - RNA, 15 nt, Human
cccugcccccugcag

SEQ ID NO: 1436950 - RNA, 14 nt, Human
cccugcccccugca

SEQ ID NO: 1436951 - RNA, 21 nt, Human
cccugccccccagccucuggc

SEQ ID NO: 1436952 - RNA, 19 nt, Human
cccugccccccagccucug

SEQ ID NO: 1436953 - RNA, 16 nt, Human
cccugccccccagccu

SEQ ID NO: 1436954 - RNA, 19 nt, Human
cccugcccccugcaggaag

SEQ ID NO: 1436955 - RNA, 17 nt, Human
cccugcccccugcagga

SEQ ID NO: 1436956 - RNA, 16 nt, Human
cccugcccccugcagg

SEQ ID NO: 1436957 - RNA, 15 nt, Human
cccugccccccagcc

SEQ ID NO: 1436958 - RNA, 12 nt, Human
cccugcccccca

SEQ ID NO: 1436959 - RNA, 13 nt, Human
cccugcccaugcu

SEQ ID NO: 1436960 - RNA, 22 nt, Human
cccuggcuccuugugccagaga

SEQ ID NO: 1436961 - RNA, 15 nt, Human
cccuggccuccccca

SEQ ID NO: 1436962 - RNA, 20 nt, Human
cccuggccuccccugccacc

SEQ ID NO: 1436963 - RNA, 19 nt, Human
cccuggccuccccugccac

SEQ ID NO: 1436964 - RNA, 20 nt, Human
cccuggcuccuugugccaga

SEQ ID NO: 1436965 - RNA, 14 nt, Human
cccuggccuccccu

SEQ ID NO: 1436966 - RNA, 13 nt, Human
cccuggccucccc

SEQ ID NO: 1436967 - RNA, 11 nt, Human
cccuggccucc

SEQ ID NO: 1436968 - RNA, 16 nt, Human
cccuggccuagaccag

SEQ ID NO: 1436969 - RNA, 15 nt, Human
cccuggccgcccccu

SEQ ID NO: 1436970 - RNA, 20 nt, Human
cccuggccgaguccaagcug

SEQ ID NO: 1436971 - RNA, 21 nt, Human
cccuggaucagcguggccuug

SEQ ID NO: 1436972 - RNA, 20 nt, Human
cccuggaucagcguggccuu

SEQ ID NO: 1436973 - RNA, 19 nt, Human
cccuggaucagcguggccu

SEQ ID NO: 1436974 - RNA, 16 nt, Human
cccuggaucagcgugg

SEQ ID NO: 1436975 - RNA, 17 nt, Human
cccuggaucagaacagg

SEQ ID NO: 1436976 - RNA, 15 nt, Human
cccuggaucagaaca

SEQ ID NO: 1436977 - RNA, 15 nt, Human
cccugcccugccacc

SEQ ID NO: 1436978 - RNA, 17 nt, Human
cccugcccugccaccug

SEQ ID NO: 1436979 - RNA, 18 nt, Human
cccugcccugccaccugu

SEQ ID NO: 1436980 - RNA, 13 nt, Human
ccuaggaagccuc

SEQ ID NO: 1436981 - RNA, 22 nt, Human
ccuagcugugugaauaccugcu

SEQ ID NO: 1436982 - RNA, 16 nt, Human
ccuagcugugugaaua

SEQ ID NO: 1436983 - RNA, 22 nt, Human
ccuagcuguccuuuuuccucuc

SEQ ID NO: 1436984 - RNA, 21 nt, Human
ccuagcugugaccucuccccu

SEQ ID NO: 1436985 - RNA, 20 nt, Human
ccuagcuguccuuuuuccuc

SEQ ID NO: 1436986 - RNA, 19 nt, Human
ccuagcuguccuuuuuccu

SEQ ID NO: 1436987 - RNA, 18 nt, Human
ccuagcuguccuuuuucc

SEQ ID NO: 1436988 - RNA, 13 nt, Human
ccuagcuguccuu

SEQ ID NO: 1436989 - RNA, 22 nt, Human
ccuagcugaauguuuuucuaaa

SEQ ID NO: 1436990 - RNA, 21 nt, Human
ccuagcugaauguuuuucuaa

SEQ ID NO: 1436991 - RNA, 20 nt, Human
ccuagcugaauguuuuucua

SEQ ID NO: 1436992 - RNA, 19 nt, Human
ccuagcugaauguuuuucu

SEQ ID NO: 1436993 - RNA, 14 nt, Human
ccuagcugaauguu

SEQ ID NO: 1436994 - RNA, 20 nt, Human
ccuagcgggauggggcuccc

SEQ ID NO: 1436995 - RNA, 17 nt, Human
ccuagcgggauggggcu

SEQ ID NO: 1436996 - RNA, 21 nt, Human
ccuagcgcuaucucccugccu

SEQ ID NO: 1436997 - RNA, 15 nt, Human
ccuagccuugcuugu

SEQ ID NO: 1436998 - RNA, 14 nt, Human
ccuagccuugcuug

SEQ ID NO: 1436999 - RNA, 10 nt, Human
ccuagccuug

SEQ ID NO: 1437000 - RNA, 15 nt, Human
ccucaggcagcucaa

SEQ ID NO: 1437001 - RNA, 14 nt, Human
ccucaggcagcuca

SEQ ID NO: 1437002 - RNA, 13 nt, Human
ccucaggcagcuc

SEQ ID NO: 1437003 - RNA, 17 nt, Human
ccucaggcacacagcua

SEQ ID NO: 1437004 - RNA, 20 nt, Human
ccucaggcacacagcuacuc

SEQ ID NO: 1437005 - RNA, 16 nt, Human
ccucaggcacacagcu

SEQ ID NO: 1437006 - RNA, 15 nt, Human
ccucaggcacacagc

SEQ ID NO: 1437007 - RNA, 22 nt, Human
ccucaggcaaucugcccgccug

SEQ ID NO: 1437008 - RNA, 19 nt, Human
ccucagccuggccagacac

SEQ ID NO: 1437009 - RNA, 19 nt, Human
ccucaggaggcaggaccuu

SEQ ID NO: 1437010 - RNA, 18 nt, Human
ccucagccuggccagaca

SEQ ID NO: 1437011 - RNA, 17 nt, Human
ccucagccuggccagac

SEQ ID NO: 1437012 - RNA, 16 nt, Human
ccucagccuggccaga

SEQ ID NO: 1437013 - RNA, 15 nt, Human
ccucagccuggccag

SEQ ID NO: 1437014 - RNA, 14 nt, Human
ccucagccuggcca

SEQ ID NO: 1437015 - RNA, 13 nt, Human
ccucagccuggcc

SEQ ID NO: 1437016 - RNA, 12 nt, Human
ccucagccuggc

SEQ ID NO: 1437017 - RNA, 11 nt, Human
ccucagccugg

SEQ ID NO: 1437018 - RNA, 21 nt, Human
ccucagccugaaccccagggc

SEQ ID NO: 1437019 - RNA, 22 nt, Human
ccucagccugaaccccagggcu

SEQ ID NO: 1437020 - RNA, 19 nt, Human
ccucagccugaaccccagg

SEQ ID NO: 1437021 - RNA, 12 nt, Human
ccucagccucuc

SEQ ID NO: 1437022 - RNA, 22 nt, Human
ccuaggaagccucagauuccuu

SEQ ID NO: 1437023 - RNA, 17 nt, Human
ccuaggaagccucagau

SEQ ID NO: 1437024 - RNA, 15 nt, Human
ccuaggaagccucag

SEQ ID NO: 1437025 - RNA, 22 nt, Human
ccuccccagcauuccagccccu

SEQ ID NO: 1437026 - RNA, 20 nt, Human
ccucccagagcaccugcugu

SEQ ID NO: 1437027 - RNA, 23 nt, Human
ccucccagaggagccaccaguuc

SEQ ID NO: 1437028 - RNA, 21 nt, Human
ccucccagaggagccaccagu

SEQ ID NO: 1437029 - RNA, 20 nt, Human
ccucccagaggagccaccag

SEQ ID NO: 1437030 - RNA, 21 nt, Human
ccucccagagcaccugcuguc

SEQ ID NO: 1437031 - RNA, 17 nt, Human
ccucccagagcaccugc

SEQ ID NO: 1437032 - RNA, 16 nt, Human
ccucccagagcaccug

SEQ ID NO: 1437033 - RNA, 19 nt, Human
ccucccagaaagcaaaccu

SEQ ID NO: 1437034 - RNA, 11 nt, Human
ccucccagaaa

SEQ ID NO: 1437035 - RNA, 22 nt, Human
ccucaugaauguaaauuuguac

SEQ ID NO: 1437036 - RNA, 23 nt, Human
ccucaugaauguaaauuuguacu

SEQ ID NO: 1437037 - RNA, 20 nt, Human
ccucaugaauguaaauuugu

SEQ ID NO: 1437038 - RNA, 19 nt, Human
ccucaugaauguaaauuug

SEQ ID NO: 1437039 - RNA, 17 nt, Human
ccucaugaauguaaauu

SEQ ID NO: 1437040 - RNA, 16 nt, Human
ccucaugaauguaaau

SEQ ID NO: 1437041 - RNA, 15 nt, Human
ccucaugaauguaaa

SEQ ID NO: 1437042 - RNA, 20 nt, Human
ccucccuguuccccagagaa

SEQ ID NO: 1437043 - RNA, 19 nt, Human
ccucccuguuccccagaga

SEQ ID NO: 1437044 - RNA, 18 nt, Human
ccucccuguuccccagag

SEQ ID NO: 1437045 - RNA, 11 nt, Human
ccucccuguaa

SEQ ID NO: 1437046 - RNA, 14 nt, Human
ccucccuguaacuu

SEQ ID NO: 1437047 - RNA, 12 nt, Human
ccucccuggaug

SEQ ID NO: 1437048 - RNA, 15 nt, Human
ccuccuuucuggcuu

SEQ ID NO: 1437049 - RNA, 15 nt, Human
ccuccguccccugcc

SEQ ID NO: 1437050 - RNA, 18 nt, Human
ccuccguccaggagccug

SEQ ID NO: 1437051 - RNA, 18 nt, Human
ccuccgcccugccacuca

SEQ ID NO: 1437052 - RNA, 16 nt, Human
ccuccgcccugccacu

SEQ ID NO: 1437053 - RNA, 15 nt, Human
ccuccgcccugccac

SEQ ID NO: 1437054 - RNA, 14 nt, Human
ccuccgcccugcca

SEQ ID NO: 1437055 - RNA, 13 nt, Human
ccuccgcccugcc

SEQ ID NO: 1437056 - RNA, 12 nt, Human
ccuccgcccugc

SEQ ID NO: 1437057 - RNA, 15 nt, Human
ccuccgccauccacc

SEQ ID NO: 1437058 - RNA, 23 nt, Human
ccuccgccauucucaagcccugc

SEQ ID NO: 1437059 - RNA, 18 nt, Human
ccuccgggaccuggugcu

SEQ ID NO: 1437060 - RNA, 14 nt, Human
ccuccgccauccac

SEQ ID NO: 1437061 - RNA, 21 nt, Human
ccucucuauccucucuuccuc

SEQ ID NO: 1437062 - RNA, 20 nt, Human
ccucucuauccucucuuccu

SEQ ID NO: 1437063 - RNA, 22 nt, Human
ccucugcccgggagcucaggaa

SEQ ID NO: 1437064 - RNA, 21 nt, Human
ccucugcccgggagcucagga

SEQ ID NO: 1437065 - RNA, 20 nt, Human
ccucucugcaggucccuaau

SEQ ID NO: 1437066 - RNA, 18 nt, Human
ccucucugcaggucccua

SEQ ID NO: 1437067 - RNA, 19 nt, Human
ccucucugcaggucccuaa

SEQ ID NO: 1437068 - RNA, 19 nt, Human
ccucucuauccucucuucc

SEQ ID NO: 1437069 - RNA, 17 nt, Human
ccucucuauccucucuu

SEQ ID NO: 1437070 - RNA, 20 nt, Human
ccucucuacagucucgucuc

SEQ ID NO: 1437071 - RNA, 15 nt, Human
ccucucuacagucuc

SEQ ID NO: 1437072 - RNA, 22 nt, Human
ccucucguaagauuuccuucuu

SEQ ID NO: 1437073 - RNA, 19 nt, Human
ccucucguaagauuuccuu

SEQ ID NO: 1437074 - RNA, 22 nt, Human
ccucucgcuccucaaccccucc

SEQ ID NO: 1437075 - RNA, 23 nt, Human
ccucucguaagauuuccuucuuu

SEQ ID NO: 1437076 - RNA, 16 nt, Human
ccucucugcagguccc

SEQ ID NO: 1437077 - RNA, 17 nt, Human
ccucucugcaggucccu

SEQ ID NO: 1437078 - RNA, 23 nt, Human
ccucucgcuccucaaccccuccc

SEQ ID NO: 1437079 - RNA, 20 nt, Human
ccucucgcuccucaaccccu

SEQ ID NO: 1437080 - RNA, 14 nt, Human
ccucucgcggcccu

SEQ ID NO: 1437081 - RNA, 16 nt, Human
ccucucgagggcaggg

SEQ ID NO: 1437082 - RNA, 23 nt, Human
ccucuccuucaugacagccucca

SEQ ID NO: 1437083 - RNA, 15 nt, Human
ccucuccuuccugug

SEQ ID NO: 1437084 - RNA, 13 nt, Human
ccucuccuuccug

SEQ ID NO: 1437085 - RNA, 13 nt, Human
ccucgggccugcu

SEQ ID NO: 1437086 - RNA, 20 nt, Human
ccucgcugccagcucuguau

SEQ ID NO: 1437087 - RNA, 19 nt, Human
ccucgcugccagcucugua

SEQ ID NO: 1437088 - RNA, 14 nt, Human
ccucgcugccagcu

SEQ ID NO: 1437089 - RNA, 13 nt, Human
ccucgcugccagc

SEQ ID NO: 1437090 - RNA, 23 nt, Human
ccucgcuccccacucugcucuga

SEQ ID NO: 1437091 - RNA, 22 nt, Human
ccucgcuccccacucugcucug

SEQ ID NO: 1437092 - RNA, 21 nt, Human
ccucgcuccccacucugcucu

SEQ ID NO: 1437093 - RNA, 19 nt, Human
ccucgcuccccacucugcu

SEQ ID NO: 1437094 - RNA, 18 nt, Human
ccucgcuccccacucugc

SEQ ID NO: 1437095 - RNA, 17 nt, Human
ccucgcuccccacucug

SEQ ID NO: 1437096 - RNA, 18 nt, Human
ccucgccggaucugaggg

SEQ ID NO: 1437097 - RNA, 13 nt, Human
ccucgccugacaa

SEQ ID NO: 1437098 - RNA, 19 nt, Human
ccucgccggaucugaggga

SEQ ID NO: 1437099 - RNA, 21 nt, Human
ccucuucugggagggcagcag

SEQ ID NO: 1437100 - RNA, 18 nt, Human
ccucuucugggagggcag

SEQ ID NO: 1437101 - RNA, 17 nt, Human
ccucuucugggagggca

SEQ ID NO: 1437102 - RNA, 13 nt, Human
ccucuucugggag

SEQ ID NO: 1437103 - RNA, 14 nt, Human
ccucuugaccaggc

SEQ ID NO: 1437104 - RNA, 15 nt, Human
ccucuugaccaggcu

SEQ ID NO: 1437105 - RNA, 13 nt, Human
ccucuugaccagg

SEQ ID NO: 1437106 - RNA, 16 nt, Human
ccucuucugggccuga

SEQ ID NO: 1437107 - RNA, 13 nt, Human
ccucuuggccuga

SEQ ID NO: 1437108 - RNA, 22 nt, Human
ccucuuggagaagucucagcua

SEQ ID NO: 1437109 - RNA, 21 nt, Human
ccucuuggagaagucucagcu

SEQ ID NO: 1437110 - RNA, 20 nt, Human
ccucuuggagaagucucagc

SEQ ID NO: 1437111 - RNA, 19 nt, Human
ccucuuggagaagucucag

SEQ ID NO: 1437112 - RNA, 18 nt, Human
ccucuuggagaagucuca

SEQ ID NO: 1437113 - RNA, 14 nt, Human
ccucuuggagaagu

SEQ ID NO: 1437114 - RNA, 22 nt, Human
ccucuuggggaguuuagggugg

SEQ ID NO: 1437115 - RNA, 23 nt, Human
ccucuuggggaguuuaggguggg

SEQ ID NO: 1437116 - RNA, 18 nt, Human
ccucuuuggcuccccugu

SEQ ID NO: 1437117 - RNA, 14 nt, Human
ccucuuuggcuccc

SEQ ID NO: 1437118 - RNA, 16 nt, Human
ccugaguggugccaaa

SEQ ID NO: 1437119 - RNA, 16 nt, Human
ccugcagacucacugu

SEQ ID NO: 1437120 - RNA, 14 nt, Human
ccugaguggugcca

SEQ ID NO: 1437121 - RNA, 19 nt, Human
ccugagugcuugcuuuuca

SEQ ID NO: 1437122 - RNA, 17 nt, Human
ccugagugcuugcuuuu

SEQ ID NO: 1437123 - RNA, 15 nt, Human
ccugagugcuugcuu

SEQ ID NO: 1437124 - RNA, 14 nt, Human
ccugagugcuugcu

SEQ ID NO: 1437125 - RNA, 15 nt, Human
ccugaggcugugguc

SEQ ID NO: 1437126 - RNA, 14 nt, Human
ccugaggcuguggu

SEQ ID NO: 1437127 - RNA, 13 nt, Human
ccugacucauucu

SEQ ID NO: 1437128 - RNA, 19 nt, Human
ccugacuagggagccaugu

SEQ ID NO: 1437129 - RNA, 22 nt, Human
ccugaccugugagcccagcugg

SEQ ID NO: 1437130 - RNA, 21 nt, Human
ccugaccugugagcccagcug

SEQ ID NO: 1437131 - RNA, 20 nt, Human
ccugaccugugagcccagcu

SEQ ID NO: 1437132 - RNA, 19 nt, Human
ccugaccugugagcccagc

SEQ ID NO: 1437133 - RNA, 18 nt, Human
ccugaccugugagcccag

SEQ ID NO: 1437134 - RNA, 14 nt, Human
ccugaccugugagc

SEQ ID NO: 1437135 - RNA, 16 nt, Human
ccugaccugucucacc

SEQ ID NO: 1437136 - RNA, 20 nt, Human
ccucuuuggcuccccuguac

SEQ ID NO: 1437137 - RNA, 19 nt, Human
ccucuuuggcuccccugua

SEQ ID NO: 1437138 - RNA, 17 nt, Human
ccugccucucugcaggu

SEQ ID NO: 1437139 - RNA, 22 nt, Human
ccugcugccauguggacuggug

SEQ ID NO: 1437140 - RNA, 23 nt, Human
ccugccuccugccggcuccuugg

SEQ ID NO: 1437141 - RNA, 20 nt, Human
ccugccucucugcagguccc

SEQ ID NO: 1437142 - RNA, 21 nt, Human
ccugccucucugcaggucccu

SEQ ID NO: 1437143 - RNA, 16 nt, Human
ccugccugcccuggug

SEQ ID NO: 1437144 - RNA, 21 nt, Human
ccugccucuuaaauaaaccuu

SEQ ID NO: 1437145 - RNA, 14 nt, Human
ccugccucuuaaau

SEQ ID NO: 1437146 - RNA, 18 nt, Human
ccugccugcucgcucccu

SEQ ID NO: 1437147 - RNA, 12 nt, Human
ccugccuggacc

SEQ ID NO: 1437148 - RNA, 19 nt, Human
ccugccuggaccagccucu

SEQ ID NO: 1437149 - RNA, 11 nt, Human
ccugccuggag

SEQ ID NO: 1437150 - RNA, 23 nt, Human
ccugccuggacuuggccccugcc

SEQ ID NO: 1437151 - RNA, 20 nt, Human
ccauggggagggauucuggu

SEQ ID NO: 1437152 - RNA, 18 nt, Human
ccauggggagggauucug

SEQ ID NO: 1437153 - RNA, 12 nt, Human
ccauggggaggg

SEQ ID NO: 1437154 - RNA, 14 nt, Human
ccaugggcagagga

SEQ ID NO: 1437155 - RNA, 17 nt, Human
ccaugggcagagcccaa

SEQ ID NO: 1437156 - RNA, 13 nt, Human
ccaugucuuucuc

SEQ ID NO: 1437157 - RNA, 20 nt, Human
ccaugucuucucccuggaau

SEQ ID NO: 1437158 - RNA, 19 nt, Human
ccaugucuucucccuggaa

SEQ ID NO: 1437159 - RNA, 16 nt, Human
ccaugucuucucccug

SEQ ID NO: 1437160 - RNA, 15 nt, Human
ccaugucuucucccu

SEQ ID NO: 1437161 - RNA, 13 nt, Human
ccaugucuucucc

SEQ ID NO: 1437162 - RNA, 23 nt, Human
ccaugagaugauacauccaaagc

SEQ ID NO: 1437163 - RNA, 21 nt, Human
ccaugacugcuugcccuaagc

SEQ ID NO: 1437164 - RNA, 22 nt, Human
ccaugacugcuugcccuaagca

SEQ ID NO: 1437165 - RNA, 19 nt, Human
ccaugacugcuugcccuaa

SEQ ID NO: 1437166 - RNA, 13 nt, Human
ccaugacugcuug

SEQ ID NO: 1437167 - RNA, 12 nt, Human
ccaugacugcuu

SEQ ID NO: 1437168 - RNA, 21 nt, Human
ccaugaccuccagcuuuccug

SEQ ID NO: 1437169 - RNA, 22 nt, Human
ccaugaccuccagcuuuccugu

SEQ ID NO: 1437170 - RNA, 20 nt, Human
ccaugaccuccagcuuuccu

SEQ ID NO: 1437171 - RNA, 15 nt, Human
ccaugaccuccagcu

SEQ ID NO: 1437172 - RNA, 14 nt, Human
ccaugaccuccagc

SEQ ID NO: 1437173 - RNA, 23 nt, Human
ccaugacccugccucucccaggc

SEQ ID NO: 1437174 - RNA, 21 nt, Human
ccaugacccugccucucccag

SEQ ID NO: 1437175 - RNA, 21 nt, Human
ccaugagcuccuuaaggcucu

SEQ ID NO: 1437176 - RNA, 16 nt, Human
ccaugggcagagccca

SEQ ID NO: 1437177 - RNA, 14 nt, Human
ccaugggcagagcc

SEQ ID NO: 1437178 - RNA, 18 nt, Human
ccaugggcacugugggua

SEQ ID NO: 1437179 - RNA, 16 nt, Human
cccacuguccugggcc

SEQ ID NO: 1437180 - RNA, 15 nt, Human
cccacuguccugggc

SEQ ID NO: 1437181 - RNA, 22 nt, Human
cccacuguccugggccugcaga

SEQ ID NO: 1437182 - RNA, 17 nt, Human
cccacccuguuccugcu

SEQ ID NO: 1437183 - RNA, 16 nt, Human
cccacccuguuccugc

SEQ ID NO: 1437184 - RNA, 15 nt, Human
cccacccuguuccug

SEQ ID NO: 1437185 - RNA, 14 nt, Human
cccacccuguuccu

SEQ ID NO: 1437186 - RNA, 12 nt, Human
cccacccuguuc

SEQ ID NO: 1437187 - RNA, 18 nt, Human
cccacccuggugggccaa

SEQ ID NO: 1437188 - RNA, 14 nt, Human
cccacccugggccc

SEQ ID NO: 1437189 - RNA, 13 nt, Human
cccacccugggcc

SEQ ID NO: 1437190 - RNA, 13 nt, Human
cccaccccuagga

SEQ ID NO: 1437191 - RNA, 18 nt, Human
cccacuguacuugcucuu

SEQ ID NO: 1437192 - RNA, 19 nt, Human
cccacuguacuugcucuug

SEQ ID NO: 1437193 - RNA, 19 nt, Human
cccacuguaucuaggcaac

SEQ ID NO: 1437194 - RNA, 20 nt, Human
cccacccuguuccugcugcu

SEQ ID NO: 1437195 - RNA, 19 nt, Human
cccacccuguuccugcugc

SEQ ID NO: 1437196 - RNA, 18 nt, Human
cccacccuguuccugcug

SEQ ID NO: 1437197 - RNA, 23 nt, Human
cccacuguacuugcucuugaugc

SEQ ID NO: 1437198 - RNA, 20 nt, Human
cccaccauuuggcaucccug

SEQ ID NO: 1437199 - RNA, 23 nt, Human
cccaccauuuggcaucccugggc

SEQ ID NO: 1437200 - RNA, 18 nt, Human
cccaccauuuggcauccc

SEQ ID NO: 1437201 - RNA, 16 nt, Human
cccaagccagaggcug

SEQ ID NO: 1437202 - RNA, 15 nt, Human
cccaagccagaggcu

SEQ ID NO: 1437203 - RNA, 14 nt, Human
cccaagccagaggc

SEQ ID NO: 1437204 - RNA, 19 nt, Human
cccaagcuguuuucuucua

SEQ ID NO: 1437205 - RNA, 12 nt, Human
cccaagcucaga

SEQ ID NO: 1437206 - RNA, 17 nt, Human
cccaagcggugucucuc

SEQ ID NO: 1437207 - RNA, 16 nt, Human
cccaagcggugucucu

SEQ ID NO: 1437208 - RNA, 12 nt, Human
cccaacugacca

SEQ ID NO: 1437209 - RNA, 23 nt, Human
cccaacucuugcacagucacugc

SEQ ID NO: 1437210 - RNA, 12 nt, Human
cccaacgcucca

SEQ ID NO: 1437211 - RNA, 20 nt, Human
cccaacucuccccugaccug

SEQ ID NO: 1437212 - RNA, 21 nt, Human
cccaaccugcucuccucuucu

SEQ ID NO: 1437213 - RNA, 19 nt, Human
cccaaccugcucuccucuu

SEQ ID NO: 1437214 - RNA, 17 nt, Human
cccaaccugcucuccuc

SEQ ID NO: 1437215 - RNA, 16 nt, Human
cccaaccugcucuccu

SEQ ID NO: 1437216 - RNA, 14 nt, Human
cccaaccugcucuc

SEQ ID NO: 1437217 - RNA, 14 nt, Human
ccauugguccaaga

SEQ ID NO: 1437218 - RNA, 15 nt, Human
ccauugucucagagc

SEQ ID NO: 1437219 - RNA, 20 nt, Human
ccauuguagcgucuuucuuu

SEQ ID NO: 1437220 - RNA, 19 nt, Human
ccauuguccaauccuaugu

SEQ ID NO: 1437221 - RNA, 19 nt, Human
ccauuguagcgucuuucuu

SEQ ID NO: 1437222 - RNA, 20 nt, Human
ccauuguggccuaagaggcu

SEQ ID NO: 1437223 - RNA, 20 nt, Human
ccauugugccuaaguccagu

SEQ ID NO: 1437224 - RNA, 22 nt, Human
cccagcauuccagccccucugg

SEQ ID NO: 1437225 - RNA, 20 nt, Human
cccagcauuccagccccucu

SEQ ID NO: 1437226 - RNA, 19 nt, Human
cccagcauuccagccccuc

SEQ ID NO: 1437227 - RNA, 18 nt, Human
cccagcauuccagccccu

SEQ ID NO: 1437228 - RNA, 15 nt, Human
cccagcccauggaga

SEQ ID NO: 1437229 - RNA, 18 nt, Human
cccagcccagggcuccug

SEQ ID NO: 1437230 - RNA, 11 nt, Human
cccagcccagg

SEQ ID NO: 1437231 - RNA, 16 nt, Human
cccagcccagagacau

SEQ ID NO: 1437232 - RNA, 15 nt, Human
cccagcccagagaca

SEQ ID NO: 1437233 - RNA, 14 nt, Human
cccagcccagagac

SEQ ID NO: 1437234 - RNA, 13 nt, Human
cccagcccagaga

SEQ ID NO: 1437235 - RNA, 12 nt, Human
cccagcccagag

SEQ ID NO: 1437236 - RNA, 11 nt, Human
cccagcccaga

SEQ ID NO: 1437237 - RNA, 18 nt, Human
cccauccccagcgauucc

SEQ ID NO: 1437238 - RNA, 13 nt, Human
cccauccccagcg

SEQ ID NO: 1437239 - RNA, 14 nt, Human
cccaucccaugcug

SEQ ID NO: 1437240 - RNA, 14 nt, Human
cccauccccagcga

SEQ ID NO: 1437241 - RNA, 16 nt, Human
cccaucauccucuggc

SEQ ID NO: 1437242 - RNA, 14 nt, Human
cccaucauccucug

SEQ ID NO: 1437243 - RNA, 15 nt, Human
cccagggcagccagg

SEQ ID NO: 1437244 - RNA, 18 nt, Human
cccagggcagccagggag

SEQ ID NO: 1437245 - RNA, 13 nt, Human
cccagggcagcca

SEQ ID NO: 1437246 - RNA, 22 nt, Human
cccagggcacaggagcuaccug

SEQ ID NO: 1437247 - RNA, 18 nt, Human
cccagggcacaggagcua

SEQ ID NO: 1437248 - RNA, 17 nt, Human
cccagggcacaggagcu

SEQ ID NO: 1437249 - RNA, 16 nt, Human
cccagggcacaggagc

SEQ ID NO: 1437250 - RNA, 15 nt, Human
cccagggcacaggag

SEQ ID NO: 1437251 - RNA, 14 nt, Human
cccagggcacagga

SEQ ID NO: 1437252 - RNA, 13 nt, Human
cccagggcacagg

SEQ ID NO: 1437253 - RNA, 21 nt, Human
cccauccaguucaugagaauc

SEQ ID NO: 1437254 - RNA, 14 nt, Human
cccauccaguucau

SEQ ID NO: 1437255 - RNA, 13 nt, Human
cccauccagggcc

SEQ ID NO: 1437256 - RNA, 19 nt, Human
cccaucauccucuggcuug

SEQ ID NO: 1437257 - RNA, 18 nt, Human
cccagggaggccgaagcu

SEQ ID NO: 1437258 - RNA, 11 nt, Human
cccagggcaca

SEQ ID NO: 1437259 - RNA, 19 nt, Human
cccagcugggucaggcagg

SEQ ID NO: 1437260 - RNA, 17 nt, Human
cccagcugggucaggca

SEQ ID NO: 1437261 - RNA, 22 nt, Human
cccagcuggggccaggcugggu

SEQ ID NO: 1437262 - RNA, 23 nt, Human
cccagcuggggccaggcuggguc

SEQ ID NO: 1437263 - RNA, 21 nt, Human
cccauucuuccuaguuuucuc

SEQ ID NO: 1437264 - RNA, 12 nt, Human
cccauucuuccu

SEQ ID NO: 1437265 - RNA, 21 nt, Human
ccccgcguggaacucgugucu

SEQ ID NO: 1437266 - RNA, 18 nt, Human
ccccgccugcccucaugg

SEQ ID NO: 1437267 - RNA, 22 nt, Human
cccccugugccuugucacgcca

SEQ ID NO: 1437268 - RNA, 16 nt, Human
cccccuucaagccugu

SEQ ID NO: 1437269 - RNA, 19 nt, Human
ccccagcauuccagccccu

SEQ ID NO: 1437270 - RNA, 18 nt, Human
ccccagcaggugcugacu

SEQ ID NO: 1437271 - RNA, 11 nt, Human
ccccagcacuu

SEQ ID NO: 1437272 - RNA, 20 nt, Human
cccauucuuccuaguuuucu

SEQ ID NO: 1437273 - RNA, 23 nt, Human
ccccauucuuccuaguuuucucc

SEQ ID NO: 1437274 - RNA, 21 nt, Human
ccccauucuuccuaguuuucu

SEQ ID NO: 1437275 - RNA, 16 nt, Human
ccccauucuuccuagu

SEQ ID NO: 1437276 - RNA, 16 nt, Human
ccccagccagggcuca

SEQ ID NO: 1437277 - RNA, 17 nt, Human
ccccagccauccagggg

SEQ ID NO: 1437278 - RNA, 17 nt, Human
ccagcguccuccucugu

SEQ ID NO: 1437279 - RNA, 19 nt, Human
ccagcguccuccucuguga

SEQ ID NO: 1437280 - RNA, 13 nt, Human
ccagcguccuccu

SEQ ID NO: 1437281 - RNA, 15 nt, Human
ccagcggugggaccu

SEQ ID NO: 1437282 - RNA, 21 nt, Human
ccagcgcuugaagccugaacc

SEQ ID NO: 1437283 - RNA, 15 nt, Human
ccagcggcccuguca

SEQ ID NO: 1437284 - RNA, 14 nt, Human
ccagcggacacacg

SEQ ID NO: 1437285 - RNA, 13 nt, Human
ccagcggacacac

SEQ ID NO: 1437286 - RNA, 19 nt, Human
ccagcuuguuuacaugcuu

SEQ ID NO: 1437287 - RNA, 14 nt, Human
ccagcuuguuuaca

SEQ ID NO: 1437288 - RNA, 23 nt, Human
ccagcgauucccucucccaggcc

SEQ ID NO: 1437289 - RNA, 22 nt, Human
ccagcgauucccucucccaggc

SEQ ID NO: 1437290 - RNA, 21 nt, Human
ccagcgauucccucucccagg

SEQ ID NO: 1437291 - RNA, 19 nt, Human
ccagcgauucccucuccca

SEQ ID NO: 1437292 - RNA, 18 nt, Human
ccagcgauucccucuccc

SEQ ID NO: 1437293 - RNA, 17 nt, Human
ccagcgagggcgugucu

SEQ ID NO: 1437294 - RNA, 16 nt, Human
ccagcgaggaggcucc

SEQ ID NO: 1437295 - RNA, 22 nt, Human
ccagcgagcgcccagcuccuga

SEQ ID NO: 1437296 - RNA, 20 nt, Human
ccagcgagcgcccagcuccu

SEQ ID NO: 1437297 - RNA, 13 nt, Human
ccagcgagcgccc

SEQ ID NO: 1437298 - RNA, 22 nt, Human
ccagcccccugaccacucagag

SEQ ID NO: 1437299 - RNA, 23 nt, Human
ccagcccccugaccacucagaga

SEQ ID NO: 1437300 - RNA, 19 nt, Human
ccagcccccugaccacuca

SEQ ID NO: 1437301 - RNA, 14 nt, Human
ccagcccccugacc

SEQ ID NO: 1437302 - RNA, 22 nt, Human
ccagcccccuccuggugccacc

SEQ ID NO: 1437303 - RNA, 18 nt, Human
ccagcccccuccuggugc

SEQ ID NO: 1437304 - RNA, 15 nt, Human
ccagcccccuccugg

SEQ ID NO: 1437305 - RNA, 22 nt, Human
ccagcccccuaagagagcaccu

SEQ ID NO: 1437306 - RNA, 16 nt, Human
ccagcagacagagcca

SEQ ID NO: 1437307 - RNA, 21 nt, Human
ccagcagccccacaccagggc

SEQ ID NO: 1437308 - RNA, 13 nt, Human
ccagcagacagag

SEQ ID NO: 1437309 - RNA, 12 nt, Human
ccagcagacaga

SEQ ID NO: 1437310 - RNA, 16 nt, Human
ccagcagaaaugccuu

SEQ ID NO: 1437311 - RNA, 17 nt, Human
ccagcagaaaugccuua

SEQ ID NO: 1437312 - RNA, 22 nt, Human
ccagcagaaaugccuuacccuc

SEQ ID NO: 1437313 - RNA, 15 nt, Human
ccaggcugagguccu

SEQ ID NO: 1437314 - RNA, 23 nt, Human
ccaggcugaccacagcacagcca

SEQ ID NO: 1437315 - RNA, 21 nt, Human
ccaggcugaccacagcacagc

SEQ ID NO: 1437316 - RNA, 23 nt, Human
ccaggggcagccccaggccaaag

SEQ ID NO: 1437317 - RNA, 19 nt, Human
ccaggggcagccccaggcc

SEQ ID NO: 1437318 - RNA, 16 nt, Human
ccaggggcagccccag

SEQ ID NO: 1437319 - RNA, 15 nt, Human
ccaggggccaugaau

SEQ ID NO: 1437320 - RNA, 13 nt, Human
ccaguccuguccu

SEQ ID NO: 1437321 - RNA, 20 nt, Human
ccaggcugaccacagcacag

SEQ ID NO: 1437322 - RNA, 19 nt, Human
ccaggcugaccacagcaca

SEQ ID NO: 1437323 - RNA, 18 nt, Human
ccaggcugaccacagcac

SEQ ID NO: 1437324 - RNA, 17 nt, Human
ccaggcugaccacagca

SEQ ID NO: 1437325 - RNA, 16 nt, Human
ccaggcugaccacagc

SEQ ID NO: 1437326 - RNA, 15 nt, Human
ccaggcugaccacag

SEQ ID NO: 1437327 - RNA, 20 nt, Human
ccaggcugaagcagguuccc

SEQ ID NO: 1437328 - RNA, 13 nt, Human
ccaggcugaagca

SEQ ID NO: 1437329 - RNA, 20 nt, Human
ccaggcucucuuugcccagu

SEQ ID NO: 1437330 - RNA, 23 nt, Human
ccaggcucucgcacaccucugca

SEQ ID NO: 1437331 - RNA, 14 nt, Human
ccaggcagccucug

SEQ ID NO: 1437332 - RNA, 17 nt, Human
ccaggcagccucugggg

SEQ ID NO: 1437333 - RNA, 16 nt, Human
ccaggcagccucuggg

SEQ ID NO: 1437334 - RNA, 12 nt, Human
ccaggcagccuc

SEQ ID NO: 1437335 - RNA, 18 nt, Human
ccaggcaggagcccuucu

SEQ ID NO: 1437336 - RNA, 17 nt, Human
ccagacgccuggcugcu

SEQ ID NO: 1437337 - RNA, 23 nt, Human
ccagaccuguuagcagacaggcc

SEQ ID NO: 1437338 - RNA, 21 nt, Human
ccagaccuguuagcagacagg

SEQ ID NO: 1437339 - RNA, 20 nt, Human
ccagaccuguuagcagacag

SEQ ID NO: 1437340 - RNA, 14 nt, Human
ccagaccugaggcg

SEQ ID NO: 1437341 - RNA, 24 nt, Human
ccagaccugauccuggaggcccag

SEQ ID NO: 1437342 - RNA, 14 nt, Human
ccagacgccuggcu

SEQ ID NO: 1437343 - RNA, 22 nt, Human
ccagacuagauguaguauuuuu

SEQ ID NO: 1437344 - RNA, 18 nt, Human
ccagacuagauguaguau

SEQ ID NO: 1437345 - RNA, 16 nt, Human
ccagacuacuugggag

SEQ ID NO: 1437346 - RNA, 23 nt, Human
ccagaccugauccuggaggccca

SEQ ID NO: 1437347 - RNA, 21 nt, Human
ccagaccugauccuggaggcc

SEQ ID NO: 1437348 - RNA, 20 nt, Human
ccagaccugauccuggaggc

SEQ ID NO: 1437349 - RNA, 19 nt, Human
ccagaccugauccuggagg

SEQ ID NO: 1437350 - RNA, 18 nt, Human
ccagaccugauccuggag

SEQ ID NO: 1437351 - RNA, 17 nt, Human
ccagaccugauccugga

SEQ ID NO: 1437352 - RNA, 16 nt, Human
ccagaccugauccugg

SEQ ID NO: 1437353 - RNA, 15 nt, Human
ccagaccugauccug

SEQ ID NO: 1437354 - RNA, 13 nt, Human
ccagaccugaggc

SEQ ID NO: 1437355 - RNA, 14 nt, Human
ccacuuuuguucuu

SEQ ID NO: 1437356 - RNA, 15 nt, Human
ccacuuuuguucuug

SEQ ID NO: 1437357 - RNA, 21 nt, Human
ccacuuuuguucuugguuugu

SEQ ID NO: 1437358 - RNA, 22 nt, Human
ccacuuuuguucuugguuugua

SEQ ID NO: 1437359 - RNA, 22 nt, Human
ccacuuguccuuagccuggacc

SEQ ID NO: 1437360 - RNA, 21 nt, Human
ccacuuguccuuagccuggac

SEQ ID NO: 1437361 - RNA, 18 nt, Human
ccacuuguccuuagccug

SEQ ID NO: 1437362 - RNA, 21 nt, Human
ccacuuguccgcuggguggua

SEQ ID NO: 1437363 - RNA, 15 nt, Human
ccacuuguccgcugg

SEQ ID NO: 1437364 - RNA, 17 nt, Human
ccacuugggucuucccu

SEQ ID NO: 1437365 - RNA, 22 nt, Human
ccacuuuguuucguggggaggu

SEQ ID NO: 1437366 - RNA, 16 nt, Human
ccacuuucuuucuuuc

SEQ ID NO: 1437367 - RNA, 13 nt, Human
ccacuuucuuucu

SEQ ID NO: 1437368 - RNA, 20 nt, Human
ccacuuugcacagcucuccg

SEQ ID NO: 1437369 - RNA, 17 nt, Human
ccacuuucagcugucuu

SEQ ID NO: 1437370 - RNA, 16 nt, Human
ccacuuucagcugucu

SEQ ID NO: 1437371 - RNA, 15 nt, Human
ccacuuucagcuguc

SEQ ID NO: 1437372 - RNA, 20 nt, Human
ccacuuuaaaauaucuacau

SEQ ID NO: 1437373 - RNA, 14 nt, Human
ccacuuucagcugu

SEQ ID NO: 1437374 - RNA, 13 nt, Human
ccacuuucagcug

SEQ ID NO: 1437375 - RNA, 12 nt, Human
ccacuuucagcu

SEQ ID NO: 1437376 - RNA, 12 nt, Human
ccacuucugcac

SEQ ID NO: 1437377 - RNA, 13 nt, Human
ccacuucugcacu

SEQ ID NO: 1437378 - RNA, 19 nt, Human
ccacuucugacagccucag

SEQ ID NO: 1437379 - RNA, 18 nt, Human
ccacuucugacagccuca

SEQ ID NO: 1437380 - RNA, 16 nt, Human
ccacuucugacagccu

SEQ ID NO: 1437381 - RNA, 14 nt, Human
ccacuucugacagc

SEQ ID NO: 1437382 - RNA, 22 nt, Human
ccacuugccucuuccuugaaga

SEQ ID NO: 1437383 - RNA, 19 nt, Human
ccacuugccucuuccuuga

SEQ ID NO: 1437384 - RNA, 17 nt, Human
ccacuugccucuuccuu

SEQ ID NO: 1437385 - RNA, 16 nt, Human
ccacuugccucuuccu

SEQ ID NO: 1437386 - RNA, 13 nt, Human
ccacuugccucuu

SEQ ID NO: 1437387 - RNA, 12 nt, Human
ccacuugccucu

SEQ ID NO: 1437388 - RNA, 16 nt, Human
ccacuugggucuuccc

SEQ ID NO: 1437389 - RNA, 19 nt, Human
ccacucuggcagccacacu

SEQ ID NO: 1437390 - RNA, 18 nt, Human
ccacucuggcagccacac

SEQ ID NO: 1437391 - RNA, 17 nt, Human
ccacucuggcagccaca

SEQ ID NO: 1437392 - RNA, 16 nt, Human
ccacucuggcagccac

SEQ ID NO: 1437393 - RNA, 15 nt, Human
ccacucuggcagcca

SEQ ID NO: 1437394 - RNA, 14 nt, Human
ccacucuggcagcc

SEQ ID NO: 1437395 - RNA, 13 nt, Human
ccacucuggcagc

SEQ ID NO: 1437396 - RNA, 12 nt, Human
ccacucuggcag

SEQ ID NO: 1437397 - RNA, 13 nt, Human
ccacugagggcag

SEQ ID NO: 1437398 - RNA, 18 nt, Human
ccacugagaggacagaga

SEQ ID NO: 1437399 - RNA, 17 nt, Human
ccacugagaggacagag

SEQ ID NO: 1437400 - RNA, 13 nt, Human
ccacugaccagaa

SEQ ID NO: 1437401 - RNA, 19 nt, Human
ccacucuguaauugcaaaa

SEQ ID NO: 1437402 - RNA, 14 nt, Human
ccacucuguaauug

SEQ ID NO: 1437403 - RNA, 13 nt, Human
ccacucuguaauu

SEQ ID NO: 1437404 - RNA, 12 nt, Human
ccacucuguaau

SEQ ID NO: 1437405 - RNA, 11 nt, Human
ccacucuguaa

SEQ ID NO: 1437406 - RNA, 22 nt, Human
ccacucuggcagccacacuucu

SEQ ID NO: 1437407 - RNA, 21 nt, Human
ccacucuggcagccacacuuc

SEQ ID NO: 1437408 - RNA, 19 nt, Human
ccacugaaaaaauauaugu

SEQ ID NO: 1437409 - RNA, 17 nt, Human
ccacugaaaaaauauau

SEQ ID NO: 1437410 - RNA, 15 nt, Human
ccacugaaaaaauau

SEQ ID NO: 1437411 - RNA, 15 nt, Human
ccacucuuucuuuca

SEQ ID NO: 1437412 - RNA, 18 nt, Human
ccagagggucugggggca

SEQ ID NO: 1437413 - RNA, 17 nt, Human
ccagagggucugggggc

SEQ ID NO: 1437414 - RNA, 14 nt, Human
ccagagggucuggg

SEQ ID NO: 1437415 - RNA, 23 nt, Human
ccagaggggccugccaccuggac

SEQ ID NO: 1437416 - RNA, 22 nt, Human
ccagaggggccugccaccugga

SEQ ID NO: 1437417 - RNA, 20 nt, Human
ccagaggggccugccaccug

SEQ ID NO: 1437418 - RNA, 19 nt, Human
ccagagagcccgaggaggu

SEQ ID NO: 1437419 - RNA, 15 nt, Human
ccagagagcccgagg

SEQ ID NO: 1437420 - RNA, 20 nt, Human
ccagagagcccgaggaggug

SEQ ID NO: 1437421 - RNA, 13 nt, Human
ccagagagcccga

SEQ ID NO: 1437422 - RNA, 12 nt, Human
ccagagagcccg

SEQ ID NO: 1437423 - RNA, 18 nt, Human
ccagaggggccugccacc

SEQ ID NO: 1437424 - RNA, 17 nt, Human
ccagaggggccugccac

SEQ ID NO: 1437425 - RNA, 15 nt, Human
ccagaggggccugcc

SEQ ID NO: 1437426 - RNA, 13 nt, Human
ccagaggggccug

SEQ ID NO: 1437427 - RNA, 23 nt, Human
ccagaucugauuuguaacccacu

SEQ ID NO: 1437428 - RNA, 20 nt, Human
ccagauaguguagcugagga

SEQ ID NO: 1437429 - RNA, 18 nt, Human
ccagauaucaucuaccua

SEQ ID NO: 1437430 - RNA, 17 nt, Human
ccagauaguguagcuga

SEQ ID NO: 1437431 - RNA, 22 nt, Human
ccagauacggacagagaccaag

SEQ ID NO: 1437432 - RNA, 13 nt, Human
ccagauaacuuuu

SEQ ID NO: 1437433 - RNA, 18 nt, Human
ccagaugcacaucccugg

SEQ ID NO: 1437434 - RNA, 23 nt, Human
ccagagaacccagcccacccccg

SEQ ID NO: 1437435 - RNA, 13 nt, Human
ccagagaacccag

SEQ ID NO: 1437436 - RNA, 23 nt, Human
ccagagaaaggggagcccacugu

SEQ ID NO: 1437437 - RNA, 20 nt, Human
ccagagaaaggggagcccac

SEQ ID NO: 1437438 - RNA, 19 nt, Human
ccagagaaaggggagccca

SEQ ID NO: 1437439 - RNA, 16 nt, Human
ccagagaaaggggagc

SEQ ID NO: 1437440 - RNA, 22 nt, Human
ccagacuuguuggcguaggcua

SEQ ID NO: 1437441 - RNA, 18 nt, Human
ccagagaaaaagggaggg

SEQ ID NO: 1437442 - RNA, 15 nt, Human
ccagacucuugccug

SEQ ID NO: 1437443 - RNA, 22 nt, Human
ccagacugcuuccaauuuucug

SEQ ID NO: 1437444 - RNA, 18 nt, Human
ccagacucuugccuguuu

SEQ ID NO: 1437445 - RNA, 13 nt, Human
ccagacucuugcc

SEQ ID NO: 1437446 - RNA, 21 nt, Human
ccagacucguucuucugggaa

SEQ ID NO: 1437447 - RNA, 22 nt, Human
ccagacuagauggaccugccug

SEQ ID NO: 1437448 - RNA, 23 nt, Human
ccagacuucccacggcuccucga

SEQ ID NO: 1437449 - RNA, 18 nt, Human
ccagagacauacuugaag

SEQ ID NO: 1437450 - RNA, 17 nt, Human
ccagagacauacuugaa

SEQ ID NO: 1437451 - RNA, 19 nt, Human
ccagagacacagcccccac

SEQ ID NO: 1437452 - RNA, 16 nt, Human
ccagagacccagcgga

SEQ ID NO: 1437453 - RNA, 21 nt, Human
ccagagacccagcggacacac

SEQ ID NO: 1437454 - RNA, 14 nt, Human
ccagagacccagcg

SEQ ID NO: 1437455 - RNA, 13 nt, Human
ccagagacccagc

SEQ ID NO: 1437456 - RNA, 12 nt, Human
ccagagacccag

SEQ ID NO: 1437457 - RNA, 23 nt, Human
ccagagacauacuugaagggcca

SEQ ID NO: 1437458 - RNA, 22 nt, Human
ccagagacauacuugaagggcc

SEQ ID NO: 1437459 - RNA, 20 nt, Human
ccagagacauacuugaaggg

SEQ ID NO: 1437460 - RNA, 14 nt, Human
ccagagacuuuagg

SEQ ID NO: 1437461 - RNA, 21 nt, Human
ccuuauuagagugucuuucca

SEQ ID NO: 1437462 - RNA, 16 nt, Human
ccuuauuagagugucu

SEQ ID NO: 1437463 - RNA, 24 nt, Human
ccuucccagaggggccugccaccu

SEQ ID NO: 1437464 - RNA, 22 nt, Human
ccuucccagaggggccugccac

SEQ ID NO: 1437465 - RNA, 20 nt, Human
ccuucccagaggggccugcc

SEQ ID NO: 1437466 - RNA, 19 nt, Human
ccuucccagaggggccugc

SEQ ID NO: 1437467 - RNA, 17 nt, Human
ccuucccagaggggccu

SEQ ID NO: 1437468 - RNA, 12 nt, Human
ccuucccagagg

SEQ ID NO: 1437469 - RNA, 15 nt, Human
ccuucccaucgcugu

SEQ ID NO: 1437470 - RNA, 14 nt, Human
ccuucccaucgcug

SEQ ID NO: 1437471 - RNA, 17 nt, Human
ccuucccaauccagugg

SEQ ID NO: 1437472 - RNA, 23 nt, Human
ccuucccaagugagucucucugg

SEQ ID NO: 1437473 - RNA, 14 nt, Human
ccuuauucagggaa

SEQ ID NO: 1437474 - RNA, 20 nt, Human
ccuuagucucaguuugugug

SEQ ID NO: 1437475 - RNA, 14 nt, Human
ccuuagucucaguu

SEQ ID NO: 1437476 - RNA, 14 nt, Human
ccuuauaguuacug

SEQ ID NO: 1437477 - RNA, 21 nt, Human
ccuuauaguuacuguguaauu

SEQ ID NO: 1437478 - RNA, 15 nt, Human
ccuuaggaagagccu

SEQ ID NO: 1437479 - RNA, 23 nt, Human
ccuuaggaagagccuuccaccca

SEQ ID NO: 1437480 - RNA, 20 nt, Human
ccuuauccucccuguaacuu

SEQ ID NO: 1437481 - RNA, 17 nt, Human
ccuuauccucccuguaa

SEQ ID NO: 1437482 - RNA, 16 nt, Human
ccuuauccucccugua

SEQ ID NO: 1437483 - RNA, 13 nt, Human
ccuuauccucccu

SEQ ID NO: 1437484 - RNA, 14 nt, Human
ccuuauccccacuu

SEQ ID NO: 1437485 - RNA, 16 nt, Human
ccuuaucgaaacucau

SEQ ID NO: 1437486 - RNA, 19 nt, Human
ccuuauccucccuguaacu

SEQ ID NO: 1437487 - RNA, 17 nt, Human
ccuuaugacugccaaga

SEQ ID NO: 1437488 - RNA, 13 nt, Human
ccuuaucuugcac

SEQ ID NO: 1437489 - RNA, 22 nt, Human
ccuuagcuggcauuacagcugg

SEQ ID NO: 1437490 - RNA, 19 nt, Human
ccuuagcuggcauuacagc

SEQ ID NO: 1437491 - RNA, 21 nt, Human
ccuuagccuggaccucugaca

SEQ ID NO: 1437492 - RNA, 19 nt, Human
ccuuagccuggaccucuga

SEQ ID NO: 1437493 - RNA, 17 nt, Human
ccuuagccuggaccucu

SEQ ID NO: 1437494 - RNA, 15 nt, Human
ccuuagccuggaccu

SEQ ID NO: 1437495 - RNA, 14 nt, Human
ccuuagccuggacc

SEQ ID NO: 1437496 - RNA, 13 nt, Human
ccuuagccuggac

SEQ ID NO: 1437497 - RNA, 12 nt, Human
ccuguugggaga

SEQ ID NO: 1437498 - RNA, 17 nt, Human
ccuguugagcaucacag

SEQ ID NO: 1437499 - RNA, 12 nt, Human
ccuguugcuaag

SEQ ID NO: 1437500 - RNA, 13 nt, Human
ccuguugcuaagc

SEQ ID NO: 1437501 - RNA, 14 nt, Human
ccuguugcuaagcc

SEQ ID NO: 1437502 - RNA, 22 nt, Human
ccuguugcuaagccccagcaag

SEQ ID NO: 1437503 - RNA, 14 nt, Human
ccuguucacaccag

SEQ ID NO: 1437504 - RNA, 15 nt, Human
ccuguuccugcugcu

SEQ ID NO: 1437505 - RNA, 14 nt, Human
ccuguuccugcugc

SEQ ID NO: 1437506 - RNA, 23 nt, Human
ccuguuccccagagaaaggggag

SEQ ID NO: 1437507 - RNA, 16 nt, Human
ccuguuccccagagaa

SEQ ID NO: 1437508 - RNA, 15 nt, Human
ccuguuccccagaga

SEQ ID NO: 1437509 - RNA, 13 nt, Human
ccuguuccccaga

SEQ ID NO: 1437510 - RNA, 18 nt, Human
ccuguucauggcagaugu

SEQ ID NO: 1437511 - RNA, 22 nt, Human
ccuguucaugccgacgcuugca

SEQ ID NO: 1437512 - RNA, 19 nt, Human
ccuguuaccuacuuugacu

SEQ ID NO: 1437513 - RNA, 18 nt, Human
ccuguuaccuacuuugac

SEQ ID NO: 1437514 - RNA, 17 nt, Human
ccuguuaccuacuuuga

SEQ ID NO: 1437515 - RNA, 16 nt, Human
ccuguuagcagacagg

SEQ ID NO: 1437516 - RNA, 15 nt, Human
ccuguuagcagacag

SEQ ID NO: 1437517 - RNA, 20 nt, Human
ccugcugcugucugggugcu

SEQ ID NO: 1437518 - RNA, 24 nt, Human
ccugcugcugagaaccuggccuuc

SEQ ID NO: 1437519 - RNA, 15 nt, Human
ccugcugcugccugc

SEQ ID NO: 1437520 - RNA, 16 nt, Human
ccugcugcugccugcc

SEQ ID NO: 1437521 - RNA, 17 nt, Human
ccugcugcugccugccu

SEQ ID NO: 1437522 - RNA, 23 nt, Human
ccugcugcugucugggugcuacu

SEQ ID NO: 1437523 - RNA, 19 nt, Human
ccugcugcugucugggugc

SEQ ID NO: 1437524 - RNA, 17 nt, Human
ccugcugcugucugggu

SEQ ID NO: 1437525 - RNA, 18 nt, Human
ccugcugcugccugccug

SEQ ID NO: 1437526 - RNA, 18 nt, Human
ccuucucuguucauuucc

SEQ ID NO: 1437527 - RNA, 17 nt, Human
ccuucucuguucauuuc

SEQ ID NO: 1437528 - RNA, 13 nt, Human
ccuucucuguuca

SEQ ID NO: 1437529 - RNA, 21 nt, Human
ccuucucuguucauuuccuca

SEQ ID NO: 1437530 - RNA, 19 nt, Human
ccuucucuguucauuuccu

SEQ ID NO: 1437531 - RNA, 14 nt, Human
ccuucucucucccu

SEQ ID NO: 1437532 - RNA, 21 nt, Human
ccuuccucauccaccccaucc

SEQ ID NO: 1437533 - RNA, 20 nt, Human
ccuuccucauccaccccauc

SEQ ID NO: 1437534 - RNA, 19 nt, Human
ccuuccucauccaccccau

SEQ ID NO: 1437535 - RNA, 18 nt, Human
ccuuccucauccacccca

SEQ ID NO: 1437536 - RNA, 17 nt, Human
ccuuccucauccacccc

SEQ ID NO: 1437537 - RNA, 16 nt, Human
ccuuccucauccaccc

SEQ ID NO: 1437538 - RNA, 23 nt, Human
ccuuccuaaauuuuccuguccuc

SEQ ID NO: 1437539 - RNA, 13 nt, Human
ccuuccuccuggg

SEQ ID NO: 1437540 - RNA, 12 nt, Human
ccuuccuccugg

SEQ ID NO: 1437541 - RNA, 23 nt, Human
ccuucccucaccuuggcaccaga

SEQ ID NO: 1437542 - RNA, 20 nt, Human
ccuuccccuuauccucccug

SEQ ID NO: 1437543 - RNA, 21 nt, Human
ccuuccccuuauccucccugu

SEQ ID NO: 1437544 - RNA, 16 nt, Human
ccuucccauggaggga

SEQ ID NO: 1437545 - RNA, 13 nt, Human
ccuucccauggag

SEQ ID NO: 1437546 - RNA, 18 nt, Human
ccuuccgccacuggggcu

SEQ ID NO: 1437547 - RNA, 16 nt, Human
ccuuccgccacugggg

SEQ ID NO: 1437548 - RNA, 14 nt, Human
ccuuccgccacugg

SEQ ID NO: 1437549 - RNA, 13 nt, Human
ccuuccgccacug

SEQ ID NO: 1437550 - RNA, 18 nt, Human
ccuucccuuuucuguucu

SEQ ID NO: 1437551 - RNA, 22 nt, Human
ccuucccuuuucuguucuaguu

SEQ ID NO: 1437552 - RNA, 16 nt, Human
ccuucccuugagcccu

SEQ ID NO: 1437553 - RNA, 16 nt, Human
ccuuccgcuuggagcu

SEQ ID NO: 1437554 - RNA, 22 nt, Human
ccuuccgccacuggggcucaga

SEQ ID NO: 1437555 - RNA, 22 nt, Human
ccuucccuguuuuccccccaag

SEQ ID NO: 1437556 - RNA, 20 nt, Human
ccuucccugugccuccuccc

SEQ ID NO: 1437557 - RNA, 17 nt, Human
ccuucccugugccuccu

SEQ ID NO: 1437558 - RNA, 13 nt, Human
ccuucccugugcc

SEQ ID NO: 1437559 - RNA, 14 nt, Human
ccuucccucucugg

SEQ ID NO: 1437560 - RNA, 24 nt, Human
ccuucccucaccuuggcaccagac

SEQ ID NO: 1437561 - RNA, 13 nt, Human
ccuucccuccaag

SEQ ID NO: 1437562 - RNA, 15 nt, Human
ccuucccucucugga

SEQ ID NO: 1437563 - RNA, 18 nt, Human
ccuucccucucuggagaa

SEQ ID NO: 1437564 - RNA, 13 nt, Human
ccuucccugcugu

SEQ ID NO: 1437565 - RNA, 21 nt, Human
ccuugcuccuccuucugcugc

SEQ ID NO: 1437566 - RNA, 20 nt, Human
ccuugcggcuccucagggac

SEQ ID NO: 1437567 - RNA, 19 nt, Human
ccuugcggcuccucaggga

SEQ ID NO: 1437568 - RNA, 18 nt, Human
ccuugcggcuccucaggg

SEQ ID NO: 1437569 - RNA, 17 nt, Human
ccuugcggcuccucagg

SEQ ID NO: 1437570 - RNA, 16 nt, Human
ccuugcggcuccucag

SEQ ID NO: 1437571 - RNA, 15 nt, Human
ccuugcggcuccuca

SEQ ID NO: 1437572 - RNA, 17 nt, Human
ccuugccugguacagua

SEQ ID NO: 1437573 - RNA, 14 nt, Human
ccuugccugugcca

SEQ ID NO: 1437574 - RNA, 15 nt, Human
ccuugccugguacag

SEQ ID NO: 1437575 - RNA, 12 nt, Human
ccuugccuggua

SEQ ID NO: 1437576 - RNA, 11 nt, Human
ccuugccuggu

SEQ ID NO: 1437577 - RNA, 16 nt, Human
ccuugccagagaucca

SEQ ID NO: 1437578 - RNA, 13 nt, Human
ccuugccagagau

SEQ ID NO: 1437579 - RNA, 12 nt, Human
ccuugccagaga

SEQ ID NO: 1437580 - RNA, 19 nt, Human
ccuuucccuuguagcuccu

SEQ ID NO: 1437581 - RNA, 21 nt, Human
ccuuuauuuuuggcguggcug

SEQ ID NO: 1437582 - RNA, 19 nt, Human
ccuuuauuuccacugugca

SEQ ID NO: 1437583 - RNA, 12 nt, Human
ccuuuauugugu

SEQ ID NO: 1437584 - RNA, 15 nt, Human
ccuuuauuguguuug

SEQ ID NO: 1437585 - RNA, 20 nt, Human
ccuuuauuguguuugucauu

SEQ ID NO: 1437586 - RNA, 23 nt, Human
ccuuuauuuguuaauaguuccug

SEQ ID NO: 1437587 - RNA, 21 nt, Human
ccuuuauuguguuugucauua

SEQ ID NO: 1437588 - RNA, 14 nt, Human
ccuugcauaauggu

SEQ ID NO: 1437589 - RNA, 13 nt, Human
ccuugccacacuc

SEQ ID NO: 1437590 - RNA, 17 nt, Human
cggaggcggugggccug

SEQ ID NO: 1437591 - RNA, 14 nt, Human
cggaggcggugggc

SEQ ID NO: 1437592 - RNA, 14 nt, Human
cggagagugggggu

SEQ ID NO: 1437593 - RNA, 13 nt, Human
cggagagccagcu

SEQ ID NO: 1437594 - RNA, 15 nt, Human
cggagucguggggug

SEQ ID NO: 1437595 - RNA, 23 nt, Human
cggaguccuguguuugugagucg

SEQ ID NO: 1437596 - RNA, 15 nt, Human
cguaaguacagagaa

SEQ ID NO: 1437597 - RNA, 14 nt, Human
cguaaguacagaga

SEQ ID NO: 1437598 - RNA, 13 nt, Human
cguaaguacagag

SEQ ID NO: 1437599 - RNA, 14 nt, Human
cguaagauuuccuu

SEQ ID NO: 1437600 - RNA, 16 nt, Human
cguaaaguacuuguag

SEQ ID NO: 1437601 - RNA, 18 nt, Human
cguaaaguacuuguaguu

SEQ ID NO: 1437602 - RNA, 14 nt, Human
cguaaaguacuugu

SEQ ID NO: 1437603 - RNA, 12 nt, Human
cgggcugugccc

SEQ ID NO: 1437604 - RNA, 20 nt, Human
cgguggcucacgccuguaau

SEQ ID NO: 1437605 - RNA, 15 nt, Human
cguacugcagccucc

SEQ ID NO: 1437606 - RNA, 14 nt, Human
cguacugcagccuc

SEQ ID NO: 1437607 - RNA, 20 nt, Human
cguacguaauaagguuuuaa

SEQ ID NO: 1437608 - RNA, 17 nt, Human
cguacguaauaagguuu

SEQ ID NO: 1437609 - RNA, 20 nt, Human
cguaaguacagagaagccau

SEQ ID NO: 1437610 - RNA, 21 nt, Human
cguaaguacagagaagccauc

SEQ ID NO: 1437611 - RNA, 19 nt, Human
cguaaguacagagaagcca

SEQ ID NO: 1437612 - RNA, 18 nt, Human
cguaaguacagagaagcc

SEQ ID NO: 1437613 - RNA, 17 nt, Human
cguaaguacagagaagc

SEQ ID NO: 1437614 - RNA, 16 nt, Human
cguaaguacagagaag

SEQ ID NO: 1437615 - RNA, 22 nt, Human
cguacacauuuuauuuuauuau

SEQ ID NO: 1437616 - RNA, 21 nt, Human
cgggcccuucccacaggacau

SEQ ID NO: 1437617 - RNA, 21 nt, Human
cgggccacuccuuccugcccc

SEQ ID NO: 1437618 - RNA, 22 nt, Human
cgggccacuccuuccugcccca

SEQ ID NO: 1437619 - RNA, 20 nt, Human
cgggccacuccuuccugccc

SEQ ID NO: 1437620 - RNA, 19 nt, Human
cgggccacuccuuccugcc

SEQ ID NO: 1437621 - RNA, 19 nt, Human
cggcuaauuuuuauauuuu

SEQ ID NO: 1437622 - RNA, 18 nt, Human
cgggccacuccuuccugc

SEQ ID NO: 1437623 - RNA, 15 nt, Human
cgggccuguccacag

SEQ ID NO: 1437624 - RNA, 16 nt, Human
cgggccuguccacagg

SEQ ID NO: 1437625 - RNA, 23 nt, Human
ccuuuucccaaaauguugaaaua

SEQ ID NO: 1437626 - RNA, 12 nt, Human
ccuuuuccaugc

SEQ ID NO: 1437627 - RNA, 16 nt, Human
ccuuuucaugauuuua

SEQ ID NO: 1437628 - RNA, 22 nt, Human
ccuuuccuggacacucagaccu

SEQ ID NO: 1437629 - RNA, 20 nt, Human
ccuuucccuuguagcuccuc

SEQ ID NO: 1437630 - RNA, 22 nt, Human
ccuuuucauaggucugaaauuu

SEQ ID NO: 1437631 - RNA, 19 nt, Human
ccuuuucauaggucugaaa

SEQ ID NO: 1437632 - RNA, 18 nt, Human
ccuuuucauaggucugaa

SEQ ID NO: 1437633 - RNA, 11 nt, Human
ccuuuucauag

SEQ ID NO: 1437634 - RNA, 12 nt, Human
ccuuuucccaac

SEQ ID NO: 1437635 - RNA, 23 nt, Human
cgagggcuggcuggccucaccca

SEQ ID NO: 1437636 - RNA, 19 nt, Human
cgagggcuggcuggccuca

SEQ ID NO: 1437637 - RNA, 17 nt, Human
cgagggcuggcuggccu

SEQ ID NO: 1437638 - RNA, 15 nt, Human
cgagggcuggcuggc

SEQ ID NO: 1437639 - RNA, 14 nt, Human
cgagggcuggcugg

SEQ ID NO: 1437640 - RNA, 21 nt, Human
cgagggcagggaccacacccu

SEQ ID NO: 1437641 - RNA, 11 nt, Human
cgagggcuggc

SEQ ID NO: 1437642 - RNA, 19 nt, Human
cgaggggugucuugggcag

SEQ ID NO: 1437643 - RNA, 18 nt, Human
cgaggggugucuugggca

SEQ ID NO: 1437644 - RNA, 16 nt, Human
cgcaguguggaggcca

SEQ ID NO: 1437645 - RNA, 23 nt, Human
cgcagugggagcaaacugcaugc

SEQ ID NO: 1437646 - RNA, 22 nt, Human
cgcagugggagcaaacugcaug

SEQ ID NO: 1437647 - RNA, 22 nt, Human
cgcaguccacuucugacagccu

SEQ ID NO: 1437648 - RNA, 23 nt, Human
cgcaguccacuucugacagccuc

SEQ ID NO: 1437649 - RNA, 20 nt, Human
cgcaguccacuucugacagc

SEQ ID NO: 1437650 - RNA, 19 nt, Human
cgcaguccacuucugacag

SEQ ID NO: 1437651 - RNA, 20 nt, Human
cgcugaguggcaggggacag

SEQ ID NO: 1437652 - RNA, 22 nt, Human
cgccugcccucauggccccucu

SEQ ID NO: 1437653 - RNA, 20 nt, Human
cgccugcccucauggccccu

SEQ ID NO: 1437654 - RNA, 17 nt, Human
cgccugcccucauggcc

SEQ ID NO: 1437655 - RNA, 13 nt, Human
cgcucuuugagaa

SEQ ID NO: 1437656 - RNA, 13 nt, Human
cgcugaguggcag

SEQ ID NO: 1437657 - RNA, 16 nt, Human
cgcugaguggcagggg

SEQ ID NO: 1437658 - RNA, 14 nt, Human
cgcugaguggcagg

SEQ ID NO: 1437659 - RNA, 19 nt, Human
cuaagagaaguagaaauca

SEQ ID NO: 1437660 - RNA, 17 nt, Human
cuaagagaaguagaaau

SEQ ID NO: 1437661 - RNA, 15 nt, Human
cuaagagaaguagaa

SEQ ID NO: 1437662 - RNA, 13 nt, Human
cuaagagaaguag

SEQ ID NO: 1437663 - RNA, 23 nt, Human
cuaagacuuacucuaagaucuua

SEQ ID NO: 1437664 - RNA, 22 nt, Human
cuaagacuuacucuaagaucuu

SEQ ID NO: 1437665 - RNA, 19 nt, Human
cuaagacuuacucuaagau

SEQ ID NO: 1437666 - RNA, 18 nt, Human
cuaagacuuacucuaaga

SEQ ID NO: 1437667 - RNA, 17 nt, Human
cuaagacuuacucuaag

SEQ ID NO: 1437668 - RNA, 22 nt, Human
cuaagacucaaauguucuaagu

SEQ ID NO: 1437669 - RNA, 21 nt, Human
cuaagacucaaauguucuaag

SEQ ID NO: 1437670 - RNA, 20 nt, Human
cuaagacucaaauguucuaa

SEQ ID NO: 1437671 - RNA, 19 nt, Human
cuaagacucaaauguucua

SEQ ID NO: 1437672 - RNA, 17 nt, Human
cuaagacucaaauguuc

SEQ ID NO: 1437673 - RNA, 16 nt, Human
cuaagacucaaauguu

SEQ ID NO: 1437674 - RNA, 13 nt, Human
cuaagacucaaau

SEQ ID NO: 1437675 - RNA, 22 nt, Human
cuaagaaguacauuguuaccuc

SEQ ID NO: 1437676 - RNA, 12 nt, Human
cuaauuuuuaag

SEQ ID NO: 1437677 - RNA, 19 nt, Human
cuaauuuguuuuggauaua

SEQ ID NO: 1437678 - RNA, 22 nt, Human
cuaauuuguaggaaaaagcaag

SEQ ID NO: 1437679 - RNA, 22 nt, Human
cuaauuugcauuaaauucacaa

SEQ ID NO: 1437680 - RNA, 21 nt, Human
cuaauuugcauuaaauucaca

SEQ ID NO: 1437681 - RNA, 19 nt, Human
cuaauuugcauuaaauuca

SEQ ID NO: 1437682 - RNA, 14 nt, Human
cuaauuugcauuaa

SEQ ID NO: 1437683 - RNA, 13 nt, Human
cuaauuugcauua

SEQ ID NO: 1437684 - RNA, 12 nt, Human
cuaauuugcauu

SEQ ID NO: 1437685 - RNA, 23 nt, Human
cuaaguuucuaagauucuaaagg

SEQ ID NO: 1437686 - RNA, 22 nt, Human
cuaaguuucuaagauucuaaag

SEQ ID NO: 1437687 - RNA, 21 nt, Human
cuaaguuucuaagauucuaaa

SEQ ID NO: 1437688 - RNA, 19 nt, Human
cuaaguuucuaagauucua

SEQ ID NO: 1437689 - RNA, 20 nt, Human
cuaaguuuuuauggcuuuug

SEQ ID NO: 1437690 - RNA, 18 nt, Human
cuaaguuucuaagauucu

SEQ ID NO: 1437691 - RNA, 17 nt, Human
cuaaguuucuaagauuc

SEQ ID NO: 1437692 - RNA, 15 nt, Human
cuaaguuucuaagau

SEQ ID NO: 1437693 - RNA, 14 nt, Human
cuaaguuucuaaga

SEQ ID NO: 1437694 - RNA, 13 nt, Human
cuaaguuucuaag

SEQ ID NO: 1437695 - RNA, 12 nt, Human
cuaaguuucuaa

SEQ ID NO: 1437696 - RNA, 14 nt, Human
cuaaguuuuuaugg

SEQ ID NO: 1437697 - RNA, 23 nt, Human
cuaaguccaguccaguccuaucu

SEQ ID NO: 1437698 - RNA, 21 nt, Human
cuaaguccaguccaguccuau

SEQ ID NO: 1437699 - RNA, 19 nt, Human
cuaaguccaguguuucuuu

SEQ ID NO: 1437700 - RNA, 20 nt, Human
cuaaguacacaauaagcaaa

SEQ ID NO: 1437701 - RNA, 19 nt, Human
cuaaguacacaauaagcaa

SEQ ID NO: 1437702 - RNA, 22 nt, Human
cgugagcuuaaaauacaagacu

SEQ ID NO: 1437703 - RNA, 17 nt, Human
cgugagcugagcaggcc

SEQ ID NO: 1437704 - RNA, 14 nt, Human
cgugagcugagcag

SEQ ID NO: 1437705 - RNA, 15 nt, Human
cgugagcucuuguga

SEQ ID NO: 1437706 - RNA, 14 nt, Human
cgugagccaccucg

SEQ ID NO: 1437707 - RNA, 19 nt, Human
cgugacaauaaaacauuaa

SEQ ID NO: 1437708 - RNA, 17 nt, Human
cgugacaauaaaacauu

SEQ ID NO: 1437709 - RNA, 13 nt, Human
cgugacacaaaca

SEQ ID NO: 1437710 - RNA, 16 nt, Human
cuaagaaccuggaacu

SEQ ID NO: 1437711 - RNA, 15 nt, Human
cuaagaaccuggaac

SEQ ID NO: 1437712 - RNA, 14 nt, Human
cuaagaaccuggaa

SEQ ID NO: 1437713 - RNA, 21 nt, Human
cuaagaaauugaauacuuuga

SEQ ID NO: 1437714 - RNA, 16 nt, Human
cuaagaaauugaauac

SEQ ID NO: 1437715 - RNA, 20 nt, Human
cuaagaaauaugcacaauag

SEQ ID NO: 1437716 - RNA, 22 nt, Human
cuaagaaagcccuuaggaagaa

SEQ ID NO: 1437717 - RNA, 15 nt, Human
cuaacuuggcucaca

SEQ ID NO: 1437718 - RNA, 22 nt, Human
cuaacguugagccccuggaggc

SEQ ID NO: 1437719 - RNA, 17 nt, Human
cuaacggugcucagggg

SEQ ID NO: 1437720 - RNA, 17 nt, Human
cuaacguugagccccug

SEQ ID NO: 1437721 - RNA, 19 nt, Human
cuaacggugcucagggggc

SEQ ID NO: 1437722 - RNA, 16 nt, Human
cuaacggugcucaggg

SEQ ID NO: 1437723 - RNA, 22 nt, Human
cuaacggucuguucuguuucaa

SEQ ID NO: 1437724 - RNA, 22 nt, Human
cuaacgccugagcccagggagg

SEQ ID NO: 1437725 - RNA, 21 nt, Human
cuaacgccugagcccagggag

SEQ ID NO: 1437726 - RNA, 20 nt, Human
cuaacgccugagcccaggga

SEQ ID NO: 1437727 - RNA, 19 nt, Human
cuaacgccugagcccaggg

SEQ ID NO: 1437728 - RNA, 18 nt, Human
cuaacgccugagcccagg

SEQ ID NO: 1437729 - RNA, 17 nt, Human
cuaacgccugagcccag

SEQ ID NO: 1437730 - RNA, 15 nt, Human
cuaacgccugagccc

SEQ ID NO: 1437731 - RNA, 14 nt, Human
cuaacgccugagcc

SEQ ID NO: 1437732 - RNA, 13 nt, Human
cuaacgccugagc

SEQ ID NO: 1437733 - RNA, 12 nt, Human
cuaacgccugag

SEQ ID NO: 1437734 - RNA, 19 nt, Human
cuaaaguguauuuuuuuac

SEQ ID NO: 1437735 - RNA, 14 nt, Human
cuaaagcucugaca

SEQ ID NO: 1437736 - RNA, 23 nt, Human
cuaaagguccacaggucuagacu

SEQ ID NO: 1437737 - RNA, 12 nt, Human
cuaaagcucuga

SEQ ID NO: 1437738 - RNA, 14 nt, Human
cuaaagccuuuauu

SEQ ID NO: 1437739 - RNA, 12 nt, Human
cuaaagccuuua

SEQ ID NO: 1437740 - RNA, 16 nt, Human
cuaaagccucaaaaca

SEQ ID NO: 1437741 - RNA, 23 nt, Human
cuaaaguaaaaacaaagaaauua

SEQ ID NO: 1437742 - RNA, 16 nt, Human
cguguucuccuuuucc

SEQ ID NO: 1437743 - RNA, 15 nt, Human
cguguucaauauuuu

SEQ ID NO: 1437744 - RNA, 23 nt, Human
cguguguuuuucuauuaaaagac

SEQ ID NO: 1437745 - RNA, 21 nt, Human
cguguguuuuucuauuaaaag

SEQ ID NO: 1437746 - RNA, 18 nt, Human
cguguguuuuucuauuaa

SEQ ID NO: 1437747 - RNA, 17 nt, Human
cguguguuuuucuauua

SEQ ID NO: 1437748 - RNA, 20 nt, Human
cgugagcugagcaggccaca

SEQ ID NO: 1437749 - RNA, 18 nt, Human
cuaaagccaaacauauau

SEQ ID NO: 1437750 - RNA, 11 nt, Human
cuaaagccaaa

SEQ ID NO: 1437751 - RNA, 13 nt, Human
cuaaagcaggccu

SEQ ID NO: 1437752 - RNA, 23 nt, Human
cuaaagauucuauaguucuagac

SEQ ID NO: 1437753 - RNA, 22 nt, Human
cuaaagauucuauaguucuaga

SEQ ID NO: 1437754 - RNA, 20 nt, Human
cuaaagauucuauaguucua

SEQ ID NO: 1437755 - RNA, 17 nt, Human
cguuagcuccuguggcc

SEQ ID NO: 1437756 - RNA, 16 nt, Human
cguuagcuccuguggc

SEQ ID NO: 1437757 - RNA, 15 nt, Human
cguuagcuccugugg

SEQ ID NO: 1437758 - RNA, 14 nt, Human
cguuagcuccugug

SEQ ID NO: 1437759 - RNA, 13 nt, Human
cguuagcuccugu

SEQ ID NO: 1437760 - RNA, 20 nt, Human
cguguuucugacucugagcu

SEQ ID NO: 1437761 - RNA, 15 nt, Human
cguguuucugacucu

SEQ ID NO: 1437762 - RNA, 14 nt, Human
cguguuucugacuc

SEQ ID NO: 1437763 - RNA, 19 nt, Human
cguucaacuuuuccuuuga

SEQ ID NO: 1437764 - RNA, 23 nt, Human
cguuaucuaauagggcaauuaau

SEQ ID NO: 1437765 - RNA, 20 nt, Human
cguuagucgugagcucuugu

SEQ ID NO: 1437766 - RNA, 18 nt, Human
cuaucagacuaagccagc

SEQ ID NO: 1437767 - RNA, 19 nt, Human
cuaucagaguugcugcaaa

SEQ ID NO: 1437768 - RNA, 17 nt, Human
cuaucaccuauuuccau

SEQ ID NO: 1437769 - RNA, 16 nt, Human
cuaucaccuauuucca

SEQ ID NO: 1437770 - RNA, 20 nt, Human
cuauccucucuuccucuucc

SEQ ID NO: 1437771 - RNA, 13 nt, Human
cuauccucuguaa

SEQ ID NO: 1437772 - RNA, 12 nt, Human
cuauccucugua

SEQ ID NO: 1437773 - RNA, 16 nt, Human
cuauccucucuuccuc

SEQ ID NO: 1437774 - RNA, 15 nt, Human
cuauccucucuuccu

SEQ ID NO: 1437775 - RNA, 20 nt, Human
cuauccggacagagcacguu

SEQ ID NO: 1437776 - RNA, 18 nt, Human
cuaucccuaggcacuuaa

SEQ ID NO: 1437777 - RNA, 21 nt, Human
cuaucuccagcggcccuguca

SEQ ID NO: 1437778 - RNA, 15 nt, Human
cuaugucccaggaau

SEQ ID NO: 1437779 - RNA, 19 nt, Human
cuaucuccagcggcccugu

SEQ ID NO: 1437780 - RNA, 16 nt, Human
cuauguccuaauaaua

SEQ ID NO: 1437781 - RNA, 18 nt, Human
cuaucucauuuccaagca

SEQ ID NO: 1437782 - RNA, 17 nt, Human
cuaucguaaaauuaaga

SEQ ID NO: 1437783 - RNA, 15 nt, Human
cuauuaaaagacuca

SEQ ID NO: 1437784 - RNA, 14 nt, Human
cuauuaaaagacuc

SEQ ID NO: 1437785 - RNA, 13 nt, Human
cuauuaaaagacu

SEQ ID NO: 1437786 - RNA, 12 nt, Human
cuauuaaaagac

SEQ ID NO: 1437787 - RNA, 11 nt, Human
cuauuaaaaga

SEQ ID NO: 1437788 - RNA, 15 nt, Human
cuauguuuuuaaugu

SEQ ID NO: 1437789 - RNA, 22 nt, Human
cuauguuuuuguucaaagccag

SEQ ID NO: 1437790 - RNA, 20 nt, Human
cuauguuuuuguucaaagcc

SEQ ID NO: 1437791 - RNA, 14 nt, Human
cuauguuuuuaaug

SEQ ID NO: 1437792 - RNA, 16 nt, Human
cuauguuuuuaaugua

SEQ ID NO: 1437793 - RNA, 20 nt, Human
cucaaguucuaagauucuaa

SEQ ID NO: 1437794 - RNA, 19 nt, Human
cucaaguucuaagauucua

SEQ ID NO: 1437795 - RNA, 18 nt, Human
cucaaguucuaagauucu

SEQ ID NO: 1437796 - RNA, 15 nt, Human
cucaaguucuaagau

SEQ ID NO: 1437797 - RNA, 14 nt, Human
cucaaguucuaaga

SEQ ID NO: 1437798 - RNA, 13 nt, Human
cucaaguucuaag

SEQ ID NO: 1437799 - RNA, 17 nt, Human
cuauuaaaagacucauc

SEQ ID NO: 1437800 - RNA, 16 nt, Human
cuauuaaaagacucau

SEQ ID NO: 1437801 - RNA, 22 nt, Human
cucaaguugauuagaaagacca

SEQ ID NO: 1437802 - RNA, 20 nt, Human
cucaauggacuggaagggga

SEQ ID NO: 1437803 - RNA, 17 nt, Human
cucaauggacuggaagg

SEQ ID NO: 1437804 - RNA, 14 nt, Human
cucaauggacugga

SEQ ID NO: 1437805 - RNA, 15 nt, Human
cucaaugagcauguu

SEQ ID NO: 1437806 - RNA, 14 nt, Human
cucaaugagcaugu

SEQ ID NO: 1437807 - RNA, 13 nt, Human
cucaaugagcaug

SEQ ID NO: 1437808 - RNA, 12 nt, Human
cucaaugagcau

SEQ ID NO: 1437809 - RNA, 15 nt, Human
cucaaucccugagga

SEQ ID NO: 1437810 - RNA, 16 nt, Human
cucaaucagucucaga

SEQ ID NO: 1437811 - RNA, 19 nt, Human
cucaaugagcauguuuaga

SEQ ID NO: 1437812 - RNA, 21 nt, Human
cucaauuccaacaguuuaaug

SEQ ID NO: 1437813 - RNA, 16 nt, Human
cucaauuccaacaguu

SEQ ID NO: 1437814 - RNA, 12 nt, Human
cucaauuccaac

SEQ ID NO: 1437815 - RNA, 14 nt, Human
cucaauuagugugg

SEQ ID NO: 1437816 - RNA, 19 nt, Human
cucauggccccucugaccu

SEQ ID NO: 1437817 - RNA, 17 nt, Human
cucauggccccucugac

SEQ ID NO: 1437818 - RNA, 15 nt, Human
cucauggccccucug

SEQ ID NO: 1437819 - RNA, 14 nt, Human
cucauggccccucu

SEQ ID NO: 1437820 - RNA, 20 nt, Human
cucaugcaaaucaauuacug

SEQ ID NO: 1437821 - RNA, 19 nt, Human
cucaugcaaaucaauuacu

SEQ ID NO: 1437822 - RNA, 16 nt, Human
cucaugcaaaucaauu

SEQ ID NO: 1437823 - RNA, 21 nt, Human
cucaugaauguaaauuuguac

SEQ ID NO: 1437824 - RNA, 22 nt, Human
cucaugaauguaaauuuguacu

SEQ ID NO: 1437825 - RNA, 16 nt, Human
cucaugaauguaaauu

SEQ ID NO: 1437826 - RNA, 15 nt, Human
cucaugaauguaaau

SEQ ID NO: 1437827 - RNA, 19 nt, Human
cucagugacccuggcuccu

SEQ ID NO: 1437828 - RNA, 20 nt, Human
cucagugacccuggcuccuu

SEQ ID NO: 1437829 - RNA, 21 nt, Human
cucagugaaguugcugcuucu

SEQ ID NO: 1437830 - RNA, 20 nt, Human
cucagugaaguugcugcuuc

SEQ ID NO: 1437831 - RNA, 19 nt, Human
cucagugaaguugcugcuu

SEQ ID NO: 1437832 - RNA, 18 nt, Human
cucagugaaguugcugcu

SEQ ID NO: 1437833 - RNA, 16 nt, Human
cucagugaaguugcug

SEQ ID NO: 1437834 - RNA, 15 nt, Human
cucagugaaguugcu

SEQ ID NO: 1437835 - RNA, 14 nt, Human
cucagugaagacua

SEQ ID NO: 1437836 - RNA, 18 nt, Human
cucagugaagaauacuuc

SEQ ID NO: 1437837 - RNA, 15 nt, Human
cucagugaagaauac

SEQ ID NO: 1437838 - RNA, 17 nt, Human
cucaguaugaauuauuc

SEQ ID NO: 1437839 - RNA, 13 nt, Human
cucaguagucccu

SEQ ID NO: 1437840 - RNA, 16 nt, Human
cucaguagucccugca

SEQ ID NO: 1437841 - RNA, 15 nt, Human
cucagguguugccaa

SEQ ID NO: 1437842 - RNA, 14 nt, Human
cucagguguugcca

SEQ ID NO: 1437843 - RNA, 16 nt, Human
cucagcccugcaccau

SEQ ID NO: 1437844 - RNA, 20 nt, Human
cucagcccugcaccaugcug

SEQ ID NO: 1437845 - RNA, 15 nt, Human
cucagcccugcacca

SEQ ID NO: 1437846 - RNA, 16 nt, Human
cucagcccugaggaca

SEQ ID NO: 1437847 - RNA, 17 nt, Human
cucagcccugaggacag

SEQ ID NO: 1437848 - RNA, 13 nt, Human
cucagcccugagg

SEQ ID NO: 1437849 - RNA, 12 nt, Human
cucagcccugag

SEQ ID NO: 1437850 - RNA, 14 nt, Human
cucagacuggggca

SEQ ID NO: 1437851 - RNA, 18 nt, Human
cucagacucuaagaaaga

SEQ ID NO: 1437852 - RNA, 14 nt, Human
cucagacucuaaga

SEQ ID NO: 1437853 - RNA, 19 nt, Human
cucagacucuaagaaagaa

SEQ ID NO: 1437854 - RNA, 14 nt, Human
cucagacccuuucu

SEQ ID NO: 1437855 - RNA, 15 nt, Human
cucagacccuuucuu

SEQ ID NO: 1437856 - RNA, 23 nt, Human
cucagaagccugggggccuggcu

SEQ ID NO: 1437857 - RNA, 22 nt, Human
cucagaagccugggggccuggc

SEQ ID NO: 1437858 - RNA, 21 nt, Human
cucagaagccugggggccugg

SEQ ID NO: 1437859 - RNA, 20 nt, Human
cucagaagccugggggccug

SEQ ID NO: 1437860 - RNA, 17 nt, Human
cucagaagccugggggc

SEQ ID NO: 1437861 - RNA, 16 nt, Human
cucagaagccuggggg

SEQ ID NO: 1437862 - RNA, 15 nt, Human
cucagaagccugggg

SEQ ID NO: 1437863 - RNA, 18 nt, Human
cucagaccacaugcccca

SEQ ID NO: 1437864 - RNA, 14 nt, Human
cucagaagccuggg

SEQ ID NO: 1437865 - RNA, 13 nt, Human
cucagaagccugg

SEQ ID NO: 1437866 - RNA, 22 nt, Human
cucagaaagugccugacacacu

SEQ ID NO: 1437867 - RNA, 22 nt, Human
cucacuaggcccccacuugccu

SEQ ID NO: 1437868 - RNA, 18 nt, Human
cucacuaggcccccacuu

SEQ ID NO: 1437869 - RNA, 15 nt, Human
cucacuaggccccca

SEQ ID NO: 1437870 - RNA, 15 nt, Human
cucacuaauucauua

SEQ ID NO: 1437871 - RNA, 15 nt, Human
cucacguccugagaa

SEQ ID NO: 1437872 - RNA, 14 nt, Human
cucacguccugaga

SEQ ID NO: 1437873 - RNA, 14 nt, Human
cucacgucaaaugc

SEQ ID NO: 1437874 - RNA, 19 nt, Human
cucacggccacacagcugc

SEQ ID NO: 1437875 - RNA, 21 nt, Human
cucacggccacacagcugccg

SEQ ID NO: 1437876 - RNA, 18 nt, Human
cucacggccacacagcug

SEQ ID NO: 1437877 - RNA, 22 nt, Human
cucacgccuguaaucccagcau

SEQ ID NO: 1437878 - RNA, 22 nt, Human
cucaccuugugcuggggacagg

SEQ ID NO: 1437879 - RNA, 21 nt, Human
cucaccuugugcuggggacag

SEQ ID NO: 1437880 - RNA, 16 nt, Human
cucaggcugccugagu

SEQ ID NO: 1437881 - RNA, 21 nt, Human
cucaggcugccugagucguga

SEQ ID NO: 1437882 - RNA, 15 nt, Human
cucaggcugccugag

SEQ ID NO: 1437883 - RNA, 14 nt, Human
cucaggcugccuga

SEQ ID NO: 1437884 - RNA, 13 nt, Human
cucaggcugccug

SEQ ID NO: 1437885 - RNA, 12 nt, Human
cucaggcugccu

SEQ ID NO: 1437886 - RNA, 17 nt, Human
cucaggcugaccacuuu

SEQ ID NO: 1437887 - RNA, 22 nt, Human
cucaggcccccaccuggcucac

SEQ ID NO: 1437888 - RNA, 20 nt, Human
cucaggccaagaaacgucuu

SEQ ID NO: 1437889 - RNA, 21 nt, Human
cucagccugggcgcugguccu

SEQ ID NO: 1437890 - RNA, 16 nt, Human
cucagccugggcgcug

SEQ ID NO: 1437891 - RNA, 15 nt, Human
cucagccugggcgcu

SEQ ID NO: 1437892 - RNA, 14 nt, Human
cucagccugggcgc

SEQ ID NO: 1437893 - RNA, 12 nt, Human
cucagccugggc

SEQ ID NO: 1437894 - RNA, 11 nt, Human
cucagccuggg

SEQ ID NO: 1437895 - RNA, 16 nt, Human
cucagccugaacccca

SEQ ID NO: 1437896 - RNA, 20 nt, Human
cucagccuggccagacacag

SEQ ID NO: 1437897 - RNA, 19 nt, Human
cucagccuggccagacaca

SEQ ID NO: 1437898 - RNA, 17 nt, Human
cucagccuggccagaca

SEQ ID NO: 1437899 - RNA, 16 nt, Human
cucagccuggccagac

SEQ ID NO: 1437900 - RNA, 15 nt, Human
cucagccuggccaga

SEQ ID NO: 1437901 - RNA, 14 nt, Human
cucagccuggccag

SEQ ID NO: 1437902 - RNA, 13 nt, Human
cucagccuggcca

SEQ ID NO: 1437903 - RNA, 19 nt, Human
cucagccugaaccccaggg

SEQ ID NO: 1437904 - RNA, 21 nt, Human
cucagccucuccccugccugc

SEQ ID NO: 1437905 - RNA, 15 nt, Human
cucagccucuccccu

SEQ ID NO: 1437906 - RNA, 16 nt, Human
cucagccucucgaagu

SEQ ID NO: 1437907 - RNA, 17 nt, Human
cuccggaggacucacca

SEQ ID NO: 1437908 - RNA, 23 nt, Human
cuccggaggacucaccacugccc

SEQ ID NO: 1437909 - RNA, 14 nt, Human
cuccuaccucugcu

SEQ ID NO: 1437910 - RNA, 13 nt, Human
cuccucugcacuc

SEQ ID NO: 1437911 - RNA, 12 nt, Human
cuccucugcacu

SEQ ID NO: 1437912 - RNA, 22 nt, Human
cuccucugacucagggcuccug

SEQ ID NO: 1437913 - RNA, 20 nt, Human
cuccucugacucagggcucc

SEQ ID NO: 1437914 - RNA, 19 nt, Human
cuccucugacucagggcuc

SEQ ID NO: 1437915 - RNA, 18 nt, Human
cuccucugacucagggcu

SEQ ID NO: 1437916 - RNA, 13 nt, Human
cuccucugacuca

SEQ ID NO: 1437917 - RNA, 24 nt, Human
cuccucugcccgggagcucaggaa

SEQ ID NO: 1437918 - RNA, 22 nt, Human
cuccucugcccgggagcucagg

SEQ ID NO: 1437919 - RNA, 16 nt, Human
cuccugucucccuccu

SEQ ID NO: 1437920 - RNA, 16 nt, Human
cuccuugugggccugg

SEQ ID NO: 1437921 - RNA, 14 nt, Human
cuccuugugccaga

SEQ ID NO: 1437922 - RNA, 14 nt, Human
cuccuuguguuacu

SEQ ID NO: 1437923 - RNA, 21 nt, Human
cuccuugugggccugggcucc

SEQ ID NO: 1437924 - RNA, 19 nt, Human
cuccuugugggccugggcu

SEQ ID NO: 1437925 - RNA, 18 nt, Human
cuccuugugggccugggc

SEQ ID NO: 1437926 - RNA, 15 nt, Human
cuccuuuaauuguaa

SEQ ID NO: 1437927 - RNA, 15 nt, Human
cuccuggugccaccu

SEQ ID NO: 1437928 - RNA, 18 nt, Human
cuccuggucaccuaggaa

SEQ ID NO: 1437929 - RNA, 17 nt, Human
cuccuggucaccuagga

SEQ ID NO: 1437930 - RNA, 23 nt, Human
cuccuggguuuuguauucucuga

SEQ ID NO: 1437931 - RNA, 16 nt, Human
cuccuggcccagccuu

SEQ ID NO: 1437932 - RNA, 22 nt, Human
cuccugggcccucucugcucug

SEQ ID NO: 1437933 - RNA, 21 nt, Human
cuccugggcccucucugcucu

SEQ ID NO: 1437934 - RNA, 18 nt, Human
cuccuguccccugcuaca

SEQ ID NO: 1437935 - RNA, 21 nt, Human
cuccuguccccugcuacaccu

SEQ ID NO: 1437936 - RNA, 15 nt, Human
cuccuguccccugcu

SEQ ID NO: 1437937 - RNA, 14 nt, Human
cuccuguccccugc

SEQ ID NO: 1437938 - RNA, 13 nt, Human
cuccuguccccug

SEQ ID NO: 1437939 - RNA, 23 nt, Human
cuccuguaacauacuggccugga

SEQ ID NO: 1437940 - RNA, 22 nt, Human
cuccuguaacauacuggccugg

SEQ ID NO: 1437941 - RNA, 20 nt, Human
cuccuguaacauacuggccu

SEQ ID NO: 1437942 - RNA, 16 nt, Human
cuccuguaccucuuga

SEQ ID NO: 1437943 - RNA, 20 nt, Human
cuccugggcccucucugcuc

SEQ ID NO: 1437944 - RNA, 19 nt, Human
cuccugggcccucucugcu

SEQ ID NO: 1437945 - RNA, 17 nt, Human
cuccugggcccucucug

SEQ ID NO: 1437946 - RNA, 15 nt, Human
cuccugggcccucuc

SEQ ID NO: 1437947 - RNA, 22 nt, Human
cuccuggcucuugauacccccc

SEQ ID NO: 1437948 - RNA, 18 nt, Human
cuccuggcccagccuuug

SEQ ID NO: 1437949 - RNA, 23 nt, Human
cuccucuucuacucacuuuuccc

SEQ ID NO: 1437950 - RNA, 15 nt, Human
cuccuggcccagccu

SEQ ID NO: 1437951 - RNA, 14 nt, Human
cuccuggcccagcc

SEQ ID NO: 1437952 - RNA, 17 nt, Human
cuccucuucuacucacu

SEQ ID NO: 1437953 - RNA, 17 nt, Human
cuccucuuccccagacg

SEQ ID NO: 1437954 - RNA, 15 nt, Human
cuccucuuccccaga

SEQ ID NO: 1437955 - RNA, 14 nt, Human
cuccucuuccccag

SEQ ID NO: 1437956 - RNA, 13 nt, Human
cuccucuucccca

SEQ ID NO: 1437957 - RNA, 20 nt, Human
cuccucuuccaugcugugcg

SEQ ID NO: 1437958 - RNA, 18 nt, Human
cuccucuuccaugcugug

SEQ ID NO: 1437959 - RNA, 16 nt, Human
cuccucuuccaugcug

SEQ ID NO: 1437960 - RNA, 21 nt, Human
cuccucugcugaccugcugac

SEQ ID NO: 1437961 - RNA, 20 nt, Human
cuccucugcugaccugcuga

SEQ ID NO: 1437962 - RNA, 19 nt, Human
cuccucugcugaccugcug

SEQ ID NO: 1437963 - RNA, 16 nt, Human
cuccucugcugaccug

SEQ ID NO: 1437964 - RNA, 14 nt, Human
cuccucugcugacc

SEQ ID NO: 1437965 - RNA, 12 nt, Human
cuccucugcuga

SEQ ID NO: 1437966 - RNA, 11 nt, Human
cuccucugcug

SEQ ID NO: 1437967 - RNA, 23 nt, Human
cucauggguggcacucagucucu

SEQ ID NO: 1437968 - RNA, 19 nt, Human
cucauggguggcacucagu

SEQ ID NO: 1437969 - RNA, 15 nt, Human
cucauggguggcacu

SEQ ID NO: 1437970 - RNA, 14 nt, Human
cucauggguggcac

SEQ ID NO: 1437971 - RNA, 20 nt, Human
cucauggccccucugaccug

SEQ ID NO: 1437972 - RNA, 16 nt, Human
cucauguacauacccu

SEQ ID NO: 1437973 - RNA, 14 nt, Human
cucaugugacucuu

SEQ ID NO: 1437974 - RNA, 15 nt, Human
cucccagaggagcca

SEQ ID NO: 1437975 - RNA, 19 nt, Human
cucccagagcaccugcugu

SEQ ID NO: 1437976 - RNA, 20 nt, Human
cucccagagcaccugcuguc

SEQ ID NO: 1437977 - RNA, 18 nt, Human
cucccagagcaccugcug

SEQ ID NO: 1437978 - RNA, 15 nt, Human
cucccagagcaccug

SEQ ID NO: 1437979 - RNA, 21 nt, Human
cucccacucuccuaggcauuc

SEQ ID NO: 1437980 - RNA, 17 nt, Human
cucccacucuccuaggc

SEQ ID NO: 1437981 - RNA, 16 nt, Human
cucccacucuccuagg

SEQ ID NO: 1437982 - RNA, 20 nt, Human
cucccacagucccaucugcu

SEQ ID NO: 1437983 - RNA, 21 nt, Human
cucccacagucccaucugcuu

SEQ ID NO: 1437984 - RNA, 17 nt, Human
cuccagguggcucugag

SEQ ID NO: 1437985 - RNA, 14 nt, Human
cuccagguggcucu

SEQ ID NO: 1437986 - RNA, 18 nt, Human
cucccugaagccuuugca

SEQ ID NO: 1437987 - RNA, 11 nt, Human
cucccucuccg

SEQ ID NO: 1437988 - RNA, 19 nt, Human
cucccucucaacacccagu

SEQ ID NO: 1437989 - RNA, 18 nt, Human
cucccucucaacacccag

SEQ ID NO: 1437990 - RNA, 19 nt, Human
cucccucuccgacucacac

SEQ ID NO: 1437991 - RNA, 17 nt, Human
cucccucucaggaucca

SEQ ID NO: 1437992 - RNA, 23 nt, Human
cuccccuaaagccucaaaacaaa

SEQ ID NO: 1437993 - RNA, 16 nt, Human
cuccccuaaagccuca

SEQ ID NO: 1437994 - RNA, 21 nt, Human
cucccucccagagcaccugcu

SEQ ID NO: 1437995 - RNA, 20 nt, Human
cucccucccagagcaccugc

SEQ ID NO: 1437996 - RNA, 18 nt, Human
cucccucccagagcaccu

SEQ ID NO: 1437997 - RNA, 17 nt, Human
cuccccccgccugccac

SEQ ID NO: 1437998 - RNA, 17 nt, Human
cucccaggcacugucuu

SEQ ID NO: 1437999 - RNA, 21 nt, Human
cucccccccaugcacugugaa

SEQ ID NO: 1438000 - RNA, 20 nt, Human
cucccccccaugcacuguga

SEQ ID NO: 1438001 - RNA, 11 nt, Human
cucccccugcc

SEQ ID NO: 1438002 - RNA, 16 nt, Human
cucccaggagacaguu

SEQ ID NO: 1438003 - RNA, 21 nt, Human
cucccaggaccacaggcucag

SEQ ID NO: 1438004 - RNA, 18 nt, Human
cucccaggaacugggcca

SEQ ID NO: 1438005 - RNA, 15 nt, Human
cucccaggcaaggcu

SEQ ID NO: 1438006 - RNA, 15 nt, Human
cucccaggaccacag

SEQ ID NO: 1438007 - RNA, 19 nt, Human
cucccaggagacaguucaa

SEQ ID NO: 1438008 - RNA, 16 nt, Human
cucccaggcacugucu

SEQ ID NO: 1438009 - RNA, 22 nt, Human
cucccaggcaaggcuguggacc

SEQ ID NO: 1438010 - RNA, 18 nt, Human
cucccaggcaaggcugug

SEQ ID NO: 1438011 - RNA, 17 nt, Human
cucccaggcaaggcugu

SEQ ID NO: 1438012 - RNA, 18 nt, Human
cucccccccaugcacugu

SEQ ID NO: 1438013 - RNA, 13 nt, Human
cuccuuuaauugu

SEQ ID NO: 1438014 - RNA, 23 nt, Human
cucgucucuuuuacccuggcccc

SEQ ID NO: 1438015 - RNA, 19 nt, Human
cucguccucguuuguguuc

SEQ ID NO: 1438016 - RNA, 14 nt, Human
cucguccucguuug

SEQ ID NO: 1438017 - RNA, 17 nt, Human
cucgucucuuuuacccu

SEQ ID NO: 1438018 - RNA, 12 nt, Human
cucguggacacc

SEQ ID NO: 1438019 - RNA, 14 nt, Human
cucguggacaccug

SEQ ID NO: 1438020 - RNA, 19 nt, Human
cucuaugagucuagauguu

SEQ ID NO: 1438021 - RNA, 17 nt, Human
cucuaugagucuagaug

SEQ ID NO: 1438022 - RNA, 16 nt, Human
cucuaugagucuagau

SEQ ID NO: 1438023 - RNA, 15 nt, Human
cucuaugagucuaga

SEQ ID NO: 1438024 - RNA, 14 nt, Human
cucuaugagucuag

SEQ ID NO: 1438025 - RNA, 13 nt, Human
cucuaugagucua

SEQ ID NO: 1438026 - RNA, 15 nt, Human
cucguggacaccugc

SEQ ID NO: 1438027 - RNA, 16 nt, Human
cucguggacaccugcc

SEQ ID NO: 1438028 - RNA, 16 nt, Human
cucucuucucuccagc

SEQ ID NO: 1438029 - RNA, 23 nt, Human
cucucuuauugccucacuucagg

SEQ ID NO: 1438030 - RNA, 19 nt, Human
cucucuuagggacagucaa

SEQ ID NO: 1438031 - RNA, 19 nt, Human
cucucugugggcuggcagu

SEQ ID NO: 1438032 - RNA, 16 nt, Human
cucucuguaauaaacu

SEQ ID NO: 1438033 - RNA, 21 nt, Human
cucucuguaauaaacucauuu

SEQ ID NO: 1438034 - RNA, 14 nt, Human
cucucccugcaugg

SEQ ID NO: 1438035 - RNA, 19 nt, Human
cucuccccccgccugccac

SEQ ID NO: 1438036 - RNA, 19 nt, Human
cucuauggggcauccucuu

SEQ ID NO: 1438037 - RNA, 16 nt, Human
cucuccccaugauguu

SEQ ID NO: 1438038 - RNA, 18 nt, Human
cucuuagucuagguccuu

SEQ ID NO: 1438039 - RNA, 22 nt, Human
cucuuagggacagucaaaacca

SEQ ID NO: 1438040 - RNA, 13 nt, Human
cucuuagcugucu

SEQ ID NO: 1438041 - RNA, 22 nt, Human
cucuguccugaaggccugaggu

SEQ ID NO: 1438042 - RNA, 17 nt, Human
cucuguccugaaggccu

SEQ ID NO: 1438043 - RNA, 13 nt, Human
cucuguccugaag

SEQ ID NO: 1438044 - RNA, 12 nt, Human
cucuguccugaa

SEQ ID NO: 1438045 - RNA, 19 nt, Human
cucuguccugaaggccuga

SEQ ID NO: 1438046 - RNA, 17 nt, Human
cucuguccccagccugg

SEQ ID NO: 1438047 - RNA, 16 nt, Human
cucuguccccagccug

SEQ ID NO: 1438048 - RNA, 14 nt, Human
cucuguccccagcc

SEQ ID NO: 1438049 - RNA, 13 nt, Human
cucuguccccagc

SEQ ID NO: 1438050 - RNA, 12 nt, Human
cucuguccccag

SEQ ID NO: 1438051 - RNA, 22 nt, Human
cucugcugcugucccucccccu

SEQ ID NO: 1438052 - RNA, 21 nt, Human
cucugcugcugucccuccccc

SEQ ID NO: 1438053 - RNA, 16 nt, Human
cucugcugcugucccu

SEQ ID NO: 1438054 - RNA, 16 nt, Human
cucugcugaccugcug

SEQ ID NO: 1438055 - RNA, 17 nt, Human
cucugcugaccugcuga

SEQ ID NO: 1438056 - RNA, 13 nt, Human
cucugcugaccug

SEQ ID NO: 1438057 - RNA, 14 nt, Human
cucugcucugaugc

SEQ ID NO: 1438058 - RNA, 15 nt, Human
cucugcucugaugca

SEQ ID NO: 1438059 - RNA, 12 nt, Human
cucugcucugau

SEQ ID NO: 1438060 - RNA, 19 nt, Human
cucugcagccucagagaca

SEQ ID NO: 1438061 - RNA, 16 nt, Human
cucugcagccucagag

SEQ ID NO: 1438062 - RNA, 15 nt, Human
cucugcagccucaga

SEQ ID NO: 1438063 - RNA, 14 nt, Human
cucugcagccucag

SEQ ID NO: 1438064 - RNA, 13 nt, Human
cucugcagccuca

SEQ ID NO: 1438065 - RNA, 12 nt, Human
cucugcagccuc

SEQ ID NO: 1438066 - RNA, 13 nt, Human
cucugcagguccc

SEQ ID NO: 1438067 - RNA, 17 nt, Human
aacauaccuaagaagua

SEQ ID NO: 1438068 - RNA, 21 nt, Human
aacauaccccuuacaaaugaa

SEQ ID NO: 1438069 - RNA, 20 nt, Human
aacauaccccuuacaaauga

SEQ ID NO: 1438070 - RNA, 12 nt, Human
aacaguuuuccu

SEQ ID NO: 1438071 - RNA, 17 nt, Human
aacauuuauuuugacau

SEQ ID NO: 1438072 - RNA, 15 nt, Human
aacauuuauuuugac

SEQ ID NO: 1438073 - RNA, 23 nt, Human
aacauuguguucccauuucagcu

SEQ ID NO: 1438074 - RNA, 13 nt, Human
aacauuguguucc

SEQ ID NO: 1438075 - RNA, 16 nt, Human
aacauuguagccucaa

SEQ ID NO: 1438076 - RNA, 22 nt, Human
aacauuucuauagccaaaaaua

SEQ ID NO: 1438077 - RNA, 19 nt, Human
aacauuuauuuugacauaa

SEQ ID NO: 1438078 - RNA, 16 nt, Human
aacauuucucaauaau

SEQ ID NO: 1438079 - RNA, 18 nt, Human
aacauuugguaaggggaa

SEQ ID NO: 1438080 - RNA, 20 nt, Human
aacauuuguucuauagcuuu

SEQ ID NO: 1438081 - RNA, 13 nt, Human
guccuucaaaggc

SEQ ID NO: 1438082 - RNA, 23 nt, Human
guccuuagccuggaccucugaca

SEQ ID NO: 1438083 - RNA, 20 nt, Human
guccuuagccuggaccucug

SEQ ID NO: 1438084 - RNA, 19 nt, Human
guccuuagccuggaccucu

SEQ ID NO: 1438085 - RNA, 16 nt, Human
guccuuagccuggacc

SEQ ID NO: 1438086 - RNA, 15 nt, Human
guccugccuguggcg

SEQ ID NO: 1438087 - RNA, 14 nt, Human
guccugccuguggc

SEQ ID NO: 1438088 - RNA, 13 nt, Human
guccugccugugg

SEQ ID NO: 1438089 - RNA, 11 nt, Human
guccugccugu

SEQ ID NO: 1438090 - RNA, 20 nt, Human
guccugccacccagccccag

SEQ ID NO: 1438091 - RNA, 17 nt, Human
guccugccacccagccc

SEQ ID NO: 1438092 - RNA, 15 nt, Human
guccugaucagagcc

SEQ ID NO: 1438093 - RNA, 18 nt, Human
guccugagcucagcgugg

SEQ ID NO: 1438094 - RNA, 19 nt, Human
guccugagcucagcgugga

SEQ ID NO: 1438095 - RNA, 16 nt, Human
guccugagcucagcgu

SEQ ID NO: 1438096 - RNA, 15 nt, Human
guccugagcucagcg

SEQ ID NO: 1438097 - RNA, 14 nt, Human
guccugagcucagc

SEQ ID NO: 1438098 - RNA, 13 nt, Human
guccugagcucag

SEQ ID NO: 1438099 - RNA, 18 nt, Human
guccugagccccagggag

SEQ ID NO: 1438100 - RNA, 23 nt, Human
guccugagcacugccaggaggga

SEQ ID NO: 1438101 - RNA, 22 nt, Human
guccugagcacugccaggaggg

SEQ ID NO: 1438102 - RNA, 21 nt, Human
guccugagcacugccaggagg

SEQ ID NO: 1438103 - RNA, 20 nt, Human
guccugagcacugccaggag

SEQ ID NO: 1438104 - RNA, 19 nt, Human
guccugagcacugccagga

SEQ ID NO: 1438105 - RNA, 18 nt, Human
guccugagcacugccagg

SEQ ID NO: 1438106 - RNA, 17 nt, Human
guccugagcacugccag

SEQ ID NO: 1438107 - RNA, 16 nt, Human
guccugagcacugcca

SEQ ID NO: 1438108 - RNA, 14 nt, Human
guccugagcacugc

SEQ ID NO: 1438109 - RNA, 13 nt, Human
guccugagcacug

SEQ ID NO: 1438110 - RNA, 16 nt, Human
guccugagaaagcuca

SEQ ID NO: 1438111 - RNA, 13 nt, Human
guccucuucuggg

SEQ ID NO: 1438112 - RNA, 20 nt, Human
guccucuucccucucugcag

SEQ ID NO: 1438113 - RNA, 19 nt, Human
guccucuucccucucugca

SEQ ID NO: 1438114 - RNA, 18 nt, Human
guccucuucccucucugc

SEQ ID NO: 1438115 - RNA, 18 nt, Human
guccucuuccaccacaga

SEQ ID NO: 1438116 - RNA, 15 nt, Human
guccugaccugucuc

SEQ ID NO: 1438117 - RNA, 16 nt, Human
guccugaccugucuca

SEQ ID NO: 1438118 - RNA, 23 nt, Human
guccucugucagucacagccacc

SEQ ID NO: 1438119 - RNA, 20 nt, Human
guccucugucagucacagcc

SEQ ID NO: 1438120 - RNA, 19 nt, Human
guccucugucagucacagc

SEQ ID NO: 1438121 - RNA, 18 nt, Human
guccucugucagucacag

SEQ ID NO: 1438122 - RNA, 19 nt, Human
guccucugagacuccagac

SEQ ID NO: 1438123 - RNA, 15 nt, Human
guccucugagacucc

SEQ ID NO: 1438124 - RNA, 16 nt, Human
aacauuugcuguuuua

SEQ ID NO: 1438125 - RNA, 15 nt, Human
aacauuugcuguuuu

SEQ ID NO: 1438126 - RNA, 14 nt, Human
aacauuugcuguuu

SEQ ID NO: 1438127 - RNA, 22 nt, Human
aacauuuguucuauagcuuuuc

SEQ ID NO: 1438128 - RNA, 18 nt, Human
aacagaacauagacagaa

SEQ ID NO: 1438129 - RNA, 13 nt, Human
aacagaacacuua

SEQ ID NO: 1438130 - RNA, 12 nt, Human
aacagaacacuu

SEQ ID NO: 1438131 - RNA, 21 nt, Human
aacagaaauuguauauuguaa

SEQ ID NO: 1438132 - RNA, 19 nt, Human
aacagaaauuguauauugu

SEQ ID NO: 1438133 - RNA, 18 nt, Human
aacagaaauuguauauug

SEQ ID NO: 1438134 - RNA, 17 nt, Human
aacagaaauuguauauu

SEQ ID NO: 1438135 - RNA, 15 nt, Human
aacagaaauuguaua

SEQ ID NO: 1438136 - RNA, 22 nt, Human
aacagaaagccugggugacauu

SEQ ID NO: 1438137 - RNA, 16 nt, Human
aacagaaacaaaaaca

SEQ ID NO: 1438138 - RNA, 21 nt, Human
aacagaaauguacagcaagga

SEQ ID NO: 1438139 - RNA, 10 nt, Human
aacagaaaug

SEQ ID NO: 1438140 - RNA, 11 nt, Human
aacagaaaugu

SEQ ID NO: 1438141 - RNA, 15 nt, Human
guccgaucuuugacu

SEQ ID NO: 1438142 - RNA, 13 nt, Human
aacagaaacaaaa

SEQ ID NO: 1438143 - RNA, 23 nt, Human
aacagaaaaauauguaccaagaa

SEQ ID NO: 1438144 - RNA, 18 nt, Human
guccggcagcuucugccc

SEQ ID NO: 1438145 - RNA, 15 nt, Human
guccggcagcuucug

SEQ ID NO: 1438146 - RNA, 22 nt, Human
guccgcugggugguacccucug

SEQ ID NO: 1438147 - RNA, 23 nt, Human
aacaguaaaccacugaaaaaaua

SEQ ID NO: 1438148 - RNA, 17 nt, Human
aacaguaaaccacugaa

SEQ ID NO: 1438149 - RNA, 16 nt, Human
aacaguaaaccacuga

SEQ ID NO: 1438150 - RNA, 15 nt, Human
aacaguaaaccacug

SEQ ID NO: 1438151 - RNA, 13 nt, Human
aacaguaaaccac

SEQ ID NO: 1438152 - RNA, 18 nt, Human
aacagugugcaaggcagc

SEQ ID NO: 1438153 - RNA, 19 nt, Human
aacagugugcaaggcagcc

SEQ ID NO: 1438154 - RNA, 16 nt, Human
aacagugugcaaggca

SEQ ID NO: 1438155 - RNA, 14 nt, Human
aacaguggaucaca

SEQ ID NO: 1438156 - RNA, 19 nt, Human
aacaguaaaccacugaaaa

SEQ ID NO: 1438157 - RNA, 18 nt, Human
aacaguaaaccacugaaa

SEQ ID NO: 1438158 - RNA, 20 nt, Human
aacaguuuaaugaagaucua

SEQ ID NO: 1438159 - RNA, 21 nt, Human
aacaguuuaaugaagaucuaa

SEQ ID NO: 1438160 - RNA, 18 nt, Human
aacaguuuaaugaagauc

SEQ ID NO: 1438161 - RNA, 15 nt, Human
aacaguuuaaugaag

SEQ ID NO: 1438162 - RNA, 13 nt, Human
aacaguuuaauga

SEQ ID NO: 1438163 - RNA, 20 nt, Human
aacaguuguauuuaacagaa

SEQ ID NO: 1438164 - RNA, 23 nt, Human
aacaguuguauuuaacagaaauu

SEQ ID NO: 1438165 - RNA, 21 nt, Human
aacaguugguaacuuuuguga

SEQ ID NO: 1438166 - RNA, 13 nt, Human
aacaguguuuaaa

SEQ ID NO: 1438167 - RNA, 13 nt, Human
aacaguuguauuu

SEQ ID NO: 1438168 - RNA, 22 nt, Human
aacaguugguaacuuuugugaa

SEQ ID NO: 1438169 - RNA, 19 nt, Human
aacaguuguguuugaagca

SEQ ID NO: 1438170 - RNA, 13 nt, Human
gucacagggcagu

SEQ ID NO: 1438171 - RNA, 12 nt, Human
gucacagggcag

SEQ ID NO: 1438172 - RNA, 11 nt, Human
gucacagggca

SEQ ID NO: 1438173 - RNA, 17 nt, Human
aaauuuuucuucuugag

SEQ ID NO: 1438174 - RNA, 23 nt, Human
aaauuuuuaaucuuuaauuuuac

SEQ ID NO: 1438175 - RNA, 17 nt, Human
aaauuuuuguaguagcg

SEQ ID NO: 1438176 - RNA, 20 nt, Human
aacaagaccacguuucuaaa

SEQ ID NO: 1438177 - RNA, 19 nt, Human
aacaagaccacguuucuaa

SEQ ID NO: 1438178 - RNA, 16 nt, Human
aacaagaccacguuuc

SEQ ID NO: 1438179 - RNA, 17 nt, Human
aacaagaccacguuucu

SEQ ID NO: 1438180 - RNA, 21 nt, Human
aacaagccuccuuuuaaagua

SEQ ID NO: 1438181 - RNA, 14 nt, Human
aacaaggaagucaa

SEQ ID NO: 1438182 - RNA, 15 nt, Human
aacaaggaugaauua

SEQ ID NO: 1438183 - RNA, 16 nt, Human
aacaauacaaauggau

SEQ ID NO: 1438184 - RNA, 15 nt, Human
aacaauacaaaugga

SEQ ID NO: 1438185 - RNA, 14 nt, Human
aacaauacaaaugg

SEQ ID NO: 1438186 - RNA, 13 nt, Human
aacaauacaaaug

SEQ ID NO: 1438187 - RNA, 17 nt, Human
aacaauacaaauggauu

SEQ ID NO: 1438188 - RNA, 18 nt, Human
aacaagucagucauucag

SEQ ID NO: 1438189 - RNA, 23 nt, Human
aacaaguauuuguuaauuuagaa

SEQ ID NO: 1438190 - RNA, 20 nt, Human
aacaaguauuuguuaauuua

SEQ ID NO: 1438191 - RNA, 12 nt, Human
aacaaguauuug

SEQ ID NO: 1438192 - RNA, 15 nt, Human
aacaagucagucauu

SEQ ID NO: 1438193 - RNA, 23 nt, Human
aacaauuuuaggaggaccagagc

SEQ ID NO: 1438194 - RNA, 19 nt, Human
aacaauuuggcaauuuugu

SEQ ID NO: 1438195 - RNA, 18 nt, Human
aacaauuuggcaauuuug

SEQ ID NO: 1438196 - RNA, 14 nt, Human
aacaauuuggcaau

SEQ ID NO: 1438197 - RNA, 22 nt, Human
aacaauuguguagccuuuuugu

SEQ ID NO: 1438198 - RNA, 16 nt, Human
aacaauuuaugaauug

SEQ ID NO: 1438199 - RNA, 13 nt, Human
aacaauuuaugaa

SEQ ID NO: 1438200 - RNA, 23 nt, Human
aacaauuguguagccuuuuugua

SEQ ID NO: 1438201 - RNA, 20 nt, Human
aacaauuguguagccuuuuu

SEQ ID NO: 1438202 - RNA, 18 nt, Human
aacaauuguguagccuuu

SEQ ID NO: 1438203 - RNA, 14 nt, Human
aacaaucuuccugu

SEQ ID NO: 1438204 - RNA, 18 nt, Human
aacaaugaaaacucuuug

SEQ ID NO: 1438205 - RNA, 15 nt, Human
aacaaugacauuuau

SEQ ID NO: 1438206 - RNA, 18 nt, Human
aacaaugacaaagcagau

SEQ ID NO: 1438207 - RNA, 17 nt, Human
aacaaugacaaagcaga

SEQ ID NO: 1438208 - RNA, 24 nt, Human
aacaaugaauaaaaacucaaggag

SEQ ID NO: 1438209 - RNA, 22 nt, Human
aacaaugaauaaaaacucaagg

SEQ ID NO: 1438210 - RNA, 17 nt, Human
aacaaucuuccuguuua

SEQ ID NO: 1438211 - RNA, 14 nt, Human
aacaaugcuguauu

SEQ ID NO: 1438212 - RNA, 19 nt, Human
aacacuguaguaaauaaug

SEQ ID NO: 1438213 - RNA, 19 nt, Human
aacacucuuuugcuuuauu

SEQ ID NO: 1438214 - RNA, 16 nt, Human
aacacucuuuugcuuu

SEQ ID NO: 1438215 - RNA, 22 nt, Human
aacacugccagcauuucccuuc

SEQ ID NO: 1438216 - RNA, 12 nt, Human
aacacugccagc

SEQ ID NO: 1438217 - RNA, 22 nt, Human
aacacugugcacaucugugucu

SEQ ID NO: 1438218 - RNA, 20 nt, Human
aacacugugcacaucugugu

SEQ ID NO: 1438219 - RNA, 22 nt, Human
aacacuguaguaaauaaugcuu

SEQ ID NO: 1438220 - RNA, 12 nt, Human
aacacucuuuug

SEQ ID NO: 1438221 - RNA, 22 nt, Human
gucauuugcugagcauguacug

SEQ ID NO: 1438222 - RNA, 22 nt, Human
guccaagauuccggauccuaag

SEQ ID NO: 1438223 - RNA, 21 nt, Human
gucauuugcugagcauguacu

SEQ ID NO: 1438224 - RNA, 12 nt, Human
aacacuuguaau

SEQ ID NO: 1438225 - RNA, 16 nt, Human
guccauuuacacguau

SEQ ID NO: 1438226 - RNA, 21 nt, Human
guccauuguccaauccuaugu

SEQ ID NO: 1438227 - RNA, 16 nt, Human
guccauuguccaaucc

SEQ ID NO: 1438228 - RNA, 20 nt, Human
guccacaaaauaaccaaucc

SEQ ID NO: 1438229 - RNA, 17 nt, Human
guccaauuaguuuccuu

SEQ ID NO: 1438230 - RNA, 16 nt, Human
guccaauuaguuuccu

SEQ ID NO: 1438231 - RNA, 23 nt, Human
guccaaugagcuuucugaacagc

SEQ ID NO: 1438232 - RNA, 12 nt, Human
guccaauguggc

SEQ ID NO: 1438233 - RNA, 21 nt, Human
guccaaugagcuuucugaaca

SEQ ID NO: 1438234 - RNA, 19 nt, Human
guccaaugagcuuucugaa

SEQ ID NO: 1438235 - RNA, 18 nt, Human
guccaaugagcuuucuga

SEQ ID NO: 1438236 - RNA, 17 nt, Human
guccaaugagcuuucug

SEQ ID NO: 1438237 - RNA, 16 nt, Human
guccaaugagcuuucu

SEQ ID NO: 1438238 - RNA, 15 nt, Human
guccaaugagcuuuc

SEQ ID NO: 1438239 - RNA, 17 nt, Human
guccaauccuauguuuu

SEQ ID NO: 1438240 - RNA, 12 nt, Human
guccaauccuau

SEQ ID NO: 1438241 - RNA, 21 nt, Human
guccaagguuuaaagagucua

SEQ ID NO: 1438242 - RNA, 20 nt, Human
guccaagguuuaaagagucu

SEQ ID NO: 1438243 - RNA, 15 nt, Human
guccaagcugggaga

SEQ ID NO: 1438244 - RNA, 21 nt, Human
guccaagcauuuagauguaua

SEQ ID NO: 1438245 - RNA, 16 nt, Human
gucuuuucccauuuau

SEQ ID NO: 1438246 - RNA, 19 nt, Human
gucuuaauuauuauuugug

SEQ ID NO: 1438247 - RNA, 19 nt, Human
gucuuauauauuguagaua

SEQ ID NO: 1438248 - RNA, 12 nt, Human
gucuuccugagu

SEQ ID NO: 1438249 - RNA, 19 nt, Human
gucuuccugacacuuuaau

SEQ ID NO: 1438250 - RNA, 18 nt, Human
gucuuccugacacuuuaa

SEQ ID NO: 1438251 - RNA, 14 nt, Human
gucuuccugacacu

SEQ ID NO: 1438252 - RNA, 14 nt, Human
gucuuccucugucu

SEQ ID NO: 1438253 - RNA, 21 nt, Human
gucuuaauuauuauuuguguu

SEQ ID NO: 1438254 - RNA, 18 nt, Human
gucuuaauuauuauuugu

SEQ ID NO: 1438255 - RNA, 13 nt, Human
gucuuaauuauua

SEQ ID NO: 1438256 - RNA, 21 nt, Human
gucuggcugguguuaacagaa

SEQ ID NO: 1438257 - RNA, 16 nt, Human
gucuggcugguguuaa

SEQ ID NO: 1438258 - RNA, 15 nt, Human
gucuggcugguguua

SEQ ID NO: 1438259 - RNA, 14 nt, Human
gucuggcugguguu

SEQ ID NO: 1438260 - RNA, 13 nt, Human
gucuggcuggugu

SEQ ID NO: 1438261 - RNA, 14 nt, Human
gucugcuguagaaa

SEQ ID NO: 1438262 - RNA, 16 nt, Human
gucugcuguuccagug

SEQ ID NO: 1438263 - RNA, 13 nt, Human
gucugcuguagaa

SEQ ID NO: 1438264 - RNA, 22 nt, Human
gucugcucuuucucugccagug

SEQ ID NO: 1438265 - RNA, 20 nt, Human
gucugcucuuucucugccag

SEQ ID NO: 1438266 - RNA, 19 nt, Human
gucugcucuuucucugcca

SEQ ID NO: 1438267 - RNA, 17 nt, Human
gucugcucuuucucugc

SEQ ID NO: 1438268 - RNA, 15 nt, Human
gucugcucuuucucu

SEQ ID NO: 1438269 - RNA, 21 nt, Human
gucugcucccaaggggccuga

SEQ ID NO: 1438270 - RNA, 19 nt, Human
gucugcucccaaggggccu

SEQ ID NO: 1438271 - RNA, 18 nt, Human
aaccucuucagaggcccu

SEQ ID NO: 1438272 - RNA, 12 nt, Human
gucugcucccaa

SEQ ID NO: 1438273 - RNA, 13 nt, Human
aacuacaguggcu

SEQ ID NO: 1438274 - RNA, 22 nt, Human
aacuacaugagaacaaacagau

SEQ ID NO: 1438275 - RNA, 13 nt, Human
aacuacaugagaa

SEQ ID NO: 1438276 - RNA, 14 nt, Human
aacuacagucuaaa

SEQ ID NO: 1438277 - RNA, 20 nt, Human
aacuacaaccaauggaaugu

SEQ ID NO: 1438278 - RNA, 13 nt, Human
aacuacaaaucaa

SEQ ID NO: 1438279 - RNA, 21 nt, Human
aacuacaaagguuuaaaugaa

SEQ ID NO: 1438280 - RNA, 20 nt, Human
aacuacaaagguuuaaauga

SEQ ID NO: 1438281 - RNA, 18 nt, Human
aacuacaaagguuuaaau

SEQ ID NO: 1438282 - RNA, 17 nt, Human
aacuacaaagguuuaaa

SEQ ID NO: 1438283 - RNA, 16 nt, Human
aacuacaaagguuuaa

SEQ ID NO: 1438284 - RNA, 15 nt, Human
aacuaauuuaguaau

SEQ ID NO: 1438285 - RNA, 23 nt, Human
aacuaauuuuuauuuuugcugag

SEQ ID NO: 1438286 - RNA, 15 nt, Human
aacuaaugccuuacu

SEQ ID NO: 1438287 - RNA, 12 nt, Human
aacuaaugccuu

SEQ ID NO: 1438288 - RNA, 14 nt, Human
aacuaauaauugca

SEQ ID NO: 1438289 - RNA, 21 nt, Human
aacuaaaugugcaauagaagg

SEQ ID NO: 1438290 - RNA, 20 nt, Human
aacuaaagugcugcacucaa

SEQ ID NO: 1438291 - RNA, 23 nt, Human
aacuaaacucuuaccauauguuu

SEQ ID NO: 1438292 - RNA, 18 nt, Human
aacuaaacucuuaccaua

SEQ ID NO: 1438293 - RNA, 17 nt, Human
aaccugcucuccucuuc

SEQ ID NO: 1438294 - RNA, 16 nt, Human
aaccugcucuccucuu

SEQ ID NO: 1438295 - RNA, 14 nt, Human
aaccugcucuccuc

SEQ ID NO: 1438296 - RNA, 13 nt, Human
aaccugcucuccu

SEQ ID NO: 1438297 - RNA, 19 nt, Human
aaccugccugacauuugga

SEQ ID NO: 1438298 - RNA, 23 nt, Human
aacucuauauuguucagcaugca

SEQ ID NO: 1438299 - RNA, 22 nt, Human
aacucuauauuguucagcaugc

SEQ ID NO: 1438300 - RNA, 15 nt, Human
aacucguuuuuuaca

SEQ ID NO: 1438301 - RNA, 19 nt, Human
aacucgugucuggcacagc

SEQ ID NO: 1438302 - RNA, 18 nt, Human
aacucguuaauuuguagu

SEQ ID NO: 1438303 - RNA, 15 nt, Human
aacucccauuaccau

SEQ ID NO: 1438304 - RNA, 21 nt, Human
aacucccauuaccauguaaug

SEQ ID NO: 1438305 - RNA, 14 nt, Human
aacuaggaucagaa

SEQ ID NO: 1438306 - RNA, 23 nt, Human
aacuaggagcuuugacucaggag

SEQ ID NO: 1438307 - RNA, 22 nt, Human
aacuaggagcuuugacucagga

SEQ ID NO: 1438308 - RNA, 15 nt, Human
aacuaggaaguggcu

SEQ ID NO: 1438309 - RNA, 21 nt, Human
aacuccagaaagugacaagcu

SEQ ID NO: 1438310 - RNA, 15 nt, Human
aacuagcauuguaaa

SEQ ID NO: 1438311 - RNA, 19 nt, Human
aacuagcauaucugccuuu

SEQ ID NO: 1438312 - RNA, 14 nt, Human
aacuagcauaucug

SEQ ID NO: 1438313 - RNA, 17 nt, Human
aacuagcauaucugccu

SEQ ID NO: 1438314 - RNA, 18 nt, Human
aacuagcauaucugccuu

SEQ ID NO: 1438315 - RNA, 13 nt, Human
aacuagccccugg

SEQ ID NO: 1438316 - RNA, 16 nt, Human
aacuagccccuggggu

SEQ ID NO: 1438317 - RNA, 14 nt, Human
aacuccagaaagug

SEQ ID NO: 1438318 - RNA, 19 nt, Human
aaccccaacuacuguguua

SEQ ID NO: 1438319 - RNA, 20 nt, Human
aacccaucaacaaaaauugu

SEQ ID NO: 1438320 - RNA, 21 nt, Human
aacccauauuguaaaacaggu

SEQ ID NO: 1438321 - RNA, 17 nt, Human
aacccauauuguaaaac

SEQ ID NO: 1438322 - RNA, 15 nt, Human
aacccaguugccauc

SEQ ID NO: 1438323 - RNA, 20 nt, Human
aacccagguuggcgacugca

SEQ ID NO: 1438324 - RNA, 20 nt, Human
aacccagcucccuucuuccc

SEQ ID NO: 1438325 - RNA, 17 nt, Human
aaccaugucauuucaga

SEQ ID NO: 1438326 - RNA, 17 nt, Human
aaccauguagaaaauuu

SEQ ID NO: 1438327 - RNA, 14 nt, Human
aaccacauggcaca

SEQ ID NO: 1438328 - RNA, 16 nt, Human
aaccucagccuggcca

SEQ ID NO: 1438329 - RNA, 14 nt, Human
aaccucagccuggc

SEQ ID NO: 1438330 - RNA, 13 nt, Human
aaccucagccugg

SEQ ID NO: 1438331 - RNA, 12 nt, Human
aaccucagccug

SEQ ID NO: 1438332 - RNA, 11 nt, Human
aaccucagccu

SEQ ID NO: 1438333 - RNA, 17 nt, Human
aaccucaccaacuccua

SEQ ID NO: 1438334 - RNA, 20 nt, Human
aaccucaccaacuccuaguu

SEQ ID NO: 1438335 - RNA, 18 nt, Human
aaccucaacugccuacuc

SEQ ID NO: 1438336 - RNA, 17 nt, Human
aaccucaacugccuacu

SEQ ID NO: 1438337 - RNA, 16 nt, Human
aaccucaacugccuac

SEQ ID NO: 1438338 - RNA, 15 nt, Human
aaccccagacacugg

SEQ ID NO: 1438339 - RNA, 22 nt, Human
aaccuauuucuuaaacacuugc

SEQ ID NO: 1438340 - RNA, 14 nt, Human
aaccccccagauau

SEQ ID NO: 1438341 - RNA, 22 nt, Human
aaccuaugauauuuucugugcc

SEQ ID NO: 1438342 - RNA, 16 nt, Human
aaccccccagauauca

SEQ ID NO: 1438343 - RNA, 20 nt, Human
aaccuagggugauauuaacc

SEQ ID NO: 1438344 - RNA, 17 nt, Human
aaccacauggcacagag

SEQ ID NO: 1438345 - RNA, 20 nt, Human
aaccacauuggagauguuua

SEQ ID NO: 1438346 - RNA, 14 nt, Human
aaccaauuauuuuc

SEQ ID NO: 1438347 - RNA, 17 nt, Human
aaccacacccacacuca

SEQ ID NO: 1438348 - RNA, 13 nt, Human
aaccaauuauuuu

SEQ ID NO: 1438349 - RNA, 16 nt, Human
aaccaaagaagaaagu

SEQ ID NO: 1438350 - RNA, 20 nt, Human
aaccaauccuaugcaugguu

SEQ ID NO: 1438351 - RNA, 13 nt, Human
aaccaauccugga

SEQ ID NO: 1438352 - RNA, 19 nt, Human
aaccaauccuaugcauggu

SEQ ID NO: 1438353 - RNA, 10 nt, Human
aaccaaguuc

SEQ ID NO: 1438354 - RNA, 20 nt, Human
gucucccccaacagcuggac

SEQ ID NO: 1438355 - RNA, 23 nt, Human
gucucccccaacagcuggacccu

SEQ ID NO: 1438356 - RNA, 18 nt, Human
gucucccccaacagcugg

SEQ ID NO: 1438357 - RNA, 23 nt, Human
gucucaugccaguaacaggcuca

SEQ ID NO: 1438358 - RNA, 22 nt, Human
gucucaugccaguaacaggcuc

SEQ ID NO: 1438359 - RNA, 22 nt, Human
gucucaucuggggagcaggcag

SEQ ID NO: 1438360 - RNA, 15 nt, Human
gucucaucuggggag

SEQ ID NO: 1438361 - RNA, 13 nt, Human
gucucaucugggg

SEQ ID NO: 1438362 - RNA, 16 nt, Human
gucucauccaucauca

SEQ ID NO: 1438363 - RNA, 15 nt, Human
gucucauccaucauc

SEQ ID NO: 1438364 - RNA, 14 nt, Human
gucucaguuucuug

SEQ ID NO: 1438365 - RNA, 21 nt, Human
gucucaguuugugugucuuaa

SEQ ID NO: 1438366 - RNA, 19 nt, Human
gucucaguuugugugucuu

SEQ ID NO: 1438367 - RNA, 18 nt, Human
gucucaguuugugugucu

SEQ ID NO: 1438368 - RNA, 15 nt, Human
gucucagugaagacu

SEQ ID NO: 1438369 - RNA, 16 nt, Human
gucucagugaagacua

SEQ ID NO: 1438370 - RNA, 19 nt, Human
aacauuuuugauaaagccu

SEQ ID NO: 1438371 - RNA, 16 nt, Human
gucucccuccucugcc

SEQ ID NO: 1438372 - RNA, 12 nt, Human
gucucccuccuc

SEQ ID NO: 1438373 - RNA, 17 nt, Human
gucuccuaagcaccugu

SEQ ID NO: 1438374 - RNA, 16 nt, Human
gucuccuaagcaccug

SEQ ID NO: 1438375 - RNA, 20 nt, Human
gucuccuaagcuggagugca

SEQ ID NO: 1438376 - RNA, 19 nt, Human
gucaaaaagaaccacuugu

SEQ ID NO: 1438377 - RNA, 17 nt, Human
guauuuuuuuacuaaua

SEQ ID NO: 1438378 - RNA, 21 nt, Human
guauuuuuuuacuaauagaca

SEQ ID NO: 1438379 - RNA, 14 nt, Human
gucaaaaauuaaac

SEQ ID NO: 1438380 - RNA, 14 nt, Human
gucaaaaagaacca

SEQ ID NO: 1438381 - RNA, 13 nt, Human
gucaaaaauuaaa

SEQ ID NO: 1438382 - RNA, 23 nt, Human
gucaaaaauuaaaccggaccauc

SEQ ID NO: 1438383 - RNA, 13 nt, Human
gucacacacugau

SEQ ID NO: 1438384 - RNA, 20 nt, Human
gucacaaugagauugaauuu

SEQ ID NO: 1438385 - RNA, 14 nt, Human
gucacaaccaagaa

SEQ ID NO: 1438386 - RNA, 17 nt, Human
gucaacucuuuguuauu

SEQ ID NO: 1438387 - RNA, 19 nt, Human
gucaacucauauuuucaug

SEQ ID NO: 1438388 - RNA, 21 nt, Human
gucaacgagacguuuccuacc

SEQ ID NO: 1438389 - RNA, 19 nt, Human
gucaaccugggcaaagccu

SEQ ID NO: 1438390 - RNA, 14 nt, Human
gucaaccugggcaa

SEQ ID NO: 1438391 - RNA, 22 nt, Human
gucaacaguuuuccuaugcuuu

SEQ ID NO: 1438392 - RNA, 21 nt, Human
gucaacaguuuuccuaugcuu

SEQ ID NO: 1438393 - RNA, 14 nt, Human
gucaacaguuuucc

SEQ ID NO: 1438394 - RNA, 14 nt, Human
gucaacaguaaacc

SEQ ID NO: 1438395 - RNA, 22 nt, Human
gucaaaugguaggcauuuccua

SEQ ID NO: 1438396 - RNA, 22 nt, Human
gucaaaugcauacaaguuucau

SEQ ID NO: 1438397 - RNA, 16 nt, Human
gucaaauugugugaaa

SEQ ID NO: 1438398 - RNA, 12 nt, Human
aaauuucagauu

SEQ ID NO: 1438399 - RNA, 16 nt, Human
aaauuuauauuguaaa

SEQ ID NO: 1438400 - RNA, 10 nt, Human
aaauuuauaa

SEQ ID NO: 1438401 - RNA, 22 nt, Human
aaauuuagcauuguagugcuuu

SEQ ID NO: 1438402 - RNA, 21 nt, Human
aaauuuagcauuguagugcuu

SEQ ID NO: 1438403 - RNA, 22 nt, Human
aaauuuccugggagcuuuugua

SEQ ID NO: 1438404 - RNA, 12 nt, Human
aaauuucuaaau

SEQ ID NO: 1438405 - RNA, 14 nt, Human
guauuuuuuuacua

SEQ ID NO: 1438406 - RNA, 15 nt, Human
guauuuuuuuacuaa

SEQ ID NO: 1438407 - RNA, 17 nt, Human
aaauuuacaucauuucu

SEQ ID NO: 1438408 - RNA, 16 nt, Human
aaauuuagcauuguag

SEQ ID NO: 1438409 - RNA, 13 nt, Human
aaauuuagcauug

SEQ ID NO: 1438410 - RNA, 20 nt, Human
aaauuuaguauuuuguuuca

SEQ ID NO: 1438411 - RNA, 18 nt, Human
aaauucccuucaucugga

SEQ ID NO: 1438412 - RNA, 17 nt, Human
aaauuucagcagcugca

SEQ ID NO: 1438413 - RNA, 18 nt, Human
aaauuucagcagcugcag

SEQ ID NO: 1438414 - RNA, 20 nt, Human
aaauuagacugugauucaga

SEQ ID NO: 1438415 - RNA, 17 nt, Human
aaauuacuuugugaaua

SEQ ID NO: 1438416 - RNA, 14 nt, Human
aaauuacuuuguga

SEQ ID NO: 1438417 - RNA, 14 nt, Human
aaauuagaugaacu

SEQ ID NO: 1438418 - RNA, 22 nt, Human
aaauuaucaggcaaauuugcau

SEQ ID NO: 1438419 - RNA, 23 nt, Human
aaauuaucaggcaaauuugcauu

SEQ ID NO: 1438420 - RNA, 22 nt, Human
aaauucacccccuuuccuggac

SEQ ID NO: 1438421 - RNA, 15 nt, Human
aaauucagcauuuga

SEQ ID NO: 1438422 - RNA, 13 nt, Human
aaauucagcauuu

SEQ ID NO: 1438423 - RNA, 12 nt, Human
aaauucagcaaa

SEQ ID NO: 1438424 - RNA, 19 nt, Human
aaauucauuuuuuaaauuc

SEQ ID NO: 1438425 - RNA, 13 nt, Human
aaauucauuuuuu

SEQ ID NO: 1438426 - RNA, 14 nt, Human
aaauucaguuucau

SEQ ID NO: 1438427 - RNA, 13 nt, Human
aaauucaguuuca

SEQ ID NO: 1438428 - RNA, 17 nt, Human
aaauucccguuuuguca

SEQ ID NO: 1438429 - RNA, 16 nt, Human
aaauucccuucaucug

SEQ ID NO: 1438430 - RNA, 19 nt, Human
aaauucccuucaucuggaa

SEQ ID NO: 1438431 - RNA, 20 nt, Human
aaauguuauuuuuuaauuau

SEQ ID NO: 1438432 - RNA, 16 nt, Human
aaauguuauuaucugg

SEQ ID NO: 1438433 - RNA, 21 nt, Human
aaauuaacuuuuauaaacuuu

SEQ ID NO: 1438434 - RNA, 17 nt, Human
aaauguuaucuucucaa

SEQ ID NO: 1438435 - RNA, 23 nt, Human
aaauguuaucuucucaaguucua

SEQ ID NO: 1438436 - RNA, 18 nt, Human
aaauguuaucuucucaag

SEQ ID NO: 1438437 - RNA, 22 nt, Human
aaauguuaugacuauguaaacu

SEQ ID NO: 1438438 - RNA, 23 nt, Human
aaauuacuguuuauuaaaguaca

SEQ ID NO: 1438439 - RNA, 13 nt, Human
aaauuacuguuua

SEQ ID NO: 1438440 - RNA, 18 nt, Human
aaauuaccuguggauauu

SEQ ID NO: 1438441 - RNA, 15 nt, Human
aaauuaccuguggau

SEQ ID NO: 1438442 - RNA, 22 nt, Human
aaauuaacuuuuauaaacuuua

SEQ ID NO: 1438443 - RNA, 23 nt, Human
aaauuaacuuuuauaaacuuuac

SEQ ID NO: 1438444 - RNA, 20 nt, Human
guauuuaacagaaauuguau

SEQ ID NO: 1438445 - RNA, 21 nt, Human
guauuuaacagaaauuguaua

SEQ ID NO: 1438446 - RNA, 19 nt, Human
guauuuaacagaaauugua

SEQ ID NO: 1438447 - RNA, 20 nt, Human
guauugggguuauuuucugg

SEQ ID NO: 1438448 - RNA, 20 nt, Human
guauuuaauagguuuggaca

SEQ ID NO: 1438449 - RNA, 12 nt, Human
guauuuaauuag

SEQ ID NO: 1438450 - RNA, 22 nt, Human
guauuggcuagagguucaaaga

SEQ ID NO: 1438451 - RNA, 16 nt, Human
guauuuaauucauguu

SEQ ID NO: 1438452 - RNA, 18 nt, Human
guauuuaauuagugcuaa

SEQ ID NO: 1438453 - RNA, 19 nt, Human
guauuuaauuagugcuaag

SEQ ID NO: 1438454 - RNA, 20 nt, Human
guauuuaauuagugcuaagu

SEQ ID NO: 1438455 - RNA, 21 nt, Human
guauuuaauuagugcuaagug

SEQ ID NO: 1438456 - RNA, 14 nt, Human
aaauguuaaaaugu

SEQ ID NO: 1438457 - RNA, 22 nt, Human
aaauggggccagauccagccug

SEQ ID NO: 1438458 - RNA, 21 nt, Human
aaauggggccagauccagccu

SEQ ID NO: 1438459 - RNA, 17 nt, Human
aaauggggccagaucca

SEQ ID NO: 1438460 - RNA, 16 nt, Human
aaauggggccagaucc

SEQ ID NO: 1438461 - RNA, 13 nt, Human
aaauggggccaga

SEQ ID NO: 1438462 - RNA, 20 nt, Human
aaaugggcacuuaaagcuuu

SEQ ID NO: 1438463 - RNA, 15 nt, Human
aaaugggcacuuaaa

SEQ ID NO: 1438464 - RNA, 15 nt, Human
aaaugggggugcauu

SEQ ID NO: 1438465 - RNA, 16 nt, Human
aaaugggggugcauuu

SEQ ID NO: 1438466 - RNA, 17 nt, Human
aaaugggggugcauuug

SEQ ID NO: 1438467 - RNA, 18 nt, Human
aaaugggggugcauuuga

SEQ ID NO: 1438468 - RNA, 19 nt, Human
aaaugggggugcauuugag

SEQ ID NO: 1438469 - RNA, 19 nt, Human
aaauguagaguuuuuaaac

SEQ ID NO: 1438470 - RNA, 20 nt, Human
aaauguaggcuuaguuugug

SEQ ID NO: 1438471 - RNA, 20 nt, Human
guaguucugcuccagacagg

SEQ ID NO: 1438472 - RNA, 16 nt, Human
guaguucugcuccaga

SEQ ID NO: 1438473 - RNA, 13 nt, Human
guaguucuaagac

SEQ ID NO: 1438474 - RNA, 23 nt, Human
guaguuccacuuauagccucugu

SEQ ID NO: 1438475 - RNA, 22 nt, Human
guaguuccacuuauagccucug

SEQ ID NO: 1438476 - RNA, 15 nt, Human
guaguucauguaaau

SEQ ID NO: 1438477 - RNA, 17 nt, Human
guauaaaagccuguuua

SEQ ID NO: 1438478 - RNA, 12 nt, Human
guauaaaagaug

SEQ ID NO: 1438479 - RNA, 16 nt, Human
guauaaaugucuuuaa

SEQ ID NO: 1438480 - RNA, 17 nt, Human
guauaaagaauuguggu

SEQ ID NO: 1438481 - RNA, 16 nt, Human
guauaaacugauggau

SEQ ID NO: 1438482 - RNA, 23 nt, Human
guauaaacaagaaaaauaaagaa

SEQ ID NO: 1438483 - RNA, 22 nt, Human
guauaaacaagaaaaauaaaga

SEQ ID NO: 1438484 - RNA, 17 nt, Human
guauaaacaagaaaaau

SEQ ID NO: 1438485 - RNA, 16 nt, Human
guauaaacaagaaaaa

SEQ ID NO: 1438486 - RNA, 15 nt, Human
guauaaacaagaaaa

SEQ ID NO: 1438487 - RNA, 18 nt, Human
guauaaaagccuguuuaa

SEQ ID NO: 1438488 - RNA, 21 nt, Human
guauaaaagccuguuuaagag

SEQ ID NO: 1438489 - RNA, 18 nt, Human
guauaaaagggacugaga

SEQ ID NO: 1438490 - RNA, 13 nt, Human
guauaaaagaugg

SEQ ID NO: 1438491 - RNA, 23 nt, Human
guauaaaagauggggucuguaaa

SEQ ID NO: 1438492 - RNA, 15 nt, Human
guauaaaaucagcca

SEQ ID NO: 1438493 - RNA, 17 nt, Human
guauaaaaucagccaau

SEQ ID NO: 1438494 - RNA, 23 nt, Human
guauaaaaucagccaauuauguu

SEQ ID NO: 1438495 - RNA, 18 nt, Human
guauaaaugucuuuaaug

SEQ ID NO: 1438496 - RNA, 18 nt, Human
guauaagauccuagaucc

SEQ ID NO: 1438497 - RNA, 22 nt, Human
guauaagauccuagauccuaag

SEQ ID NO: 1438498 - RNA, 14 nt, Human
guauaagauccuag

SEQ ID NO: 1438499 - RNA, 17 nt, Human
guauauuacaaugauca

SEQ ID NO: 1438500 - RNA, 15 nt, Human
guauauuacaaugau

SEQ ID NO: 1438501 - RNA, 18 nt, Human
guauauuacaaugaucac

SEQ ID NO: 1438502 - RNA, 23 nt, Human
guauauucaggacuugaaagaaa

SEQ ID NO: 1438503 - RNA, 12 nt, Human
guauauucagga

SEQ ID NO: 1438504 - RNA, 12 nt, Human
guauauucacuu

SEQ ID NO: 1438505 - RNA, 22 nt, Human
guauauugauccagaaagaaaa

SEQ ID NO: 1438506 - RNA, 14 nt, Human
guauccccccaucu

SEQ ID NO: 1438507 - RNA, 22 nt, Human
guaucaggacccagaggaaggg

SEQ ID NO: 1438508 - RNA, 21 nt, Human
guaucaggacccagaggaagg

SEQ ID NO: 1438509 - RNA, 18 nt, Human
guaucaggacccagagga

SEQ ID NO: 1438510 - RNA, 14 nt, Human
guaucaggacccag

SEQ ID NO: 1438511 - RNA, 13 nt, Human
guauccccugcag

SEQ ID NO: 1438512 - RNA, 18 nt, Human
guauccccccaucuugcu

SEQ ID NO: 1438513 - RNA, 17 nt, Human
guauccccccaucuugc

SEQ ID NO: 1438514 - RNA, 15 nt, Human
guaucccuacuguaa

SEQ ID NO: 1438515 - RNA, 19 nt, Human
guauggcguaaguacagag

SEQ ID NO: 1438516 - RNA, 18 nt, Human
guauggcguaaguacaga

SEQ ID NO: 1438517 - RNA, 15 nt, Human
guauggccuguguca

SEQ ID NO: 1438518 - RNA, 14 nt, Human
guauggccuguguc

SEQ ID NO: 1438519 - RNA, 18 nt, Human
guauggacuaucugucug

SEQ ID NO: 1438520 - RNA, 24 nt, Human
guauggcguaaguacagagaagcc

SEQ ID NO: 1438521 - RNA, 23 nt, Human
guauggcguaaguacagagaagc

SEQ ID NO: 1438522 - RNA, 22 nt, Human
guauggcguaaguacagagaag

SEQ ID NO: 1438523 - RNA, 21 nt, Human
guauggcguaaguacagagaa

SEQ ID NO: 1438524 - RNA, 20 nt, Human
guauggcguaaguacagaga

SEQ ID NO: 1438525 - RNA, 13 nt, Human
guauggaaauaaa

SEQ ID NO: 1438526 - RNA, 19 nt, Human
guaugcacaugaacuuaga

SEQ ID NO: 1438527 - RNA, 15 nt, Human
guaugcagggagcug

SEQ ID NO: 1438528 - RNA, 21 nt, Human
guaugauuacuggccuuuuuc

SEQ ID NO: 1438529 - RNA, 19 nt, Human
guaugaucggcaggacacc

SEQ ID NO: 1438530 - RNA, 14 nt, Human
guaugauucccagc

SEQ ID NO: 1438531 - RNA, 21 nt, Human
guauugcacauuguaaaaagu

SEQ ID NO: 1438532 - RNA, 18 nt, Human
guauugcacauuguaaaa

SEQ ID NO: 1438533 - RNA, 16 nt, Human
guauugcacauuguaa

SEQ ID NO: 1438534 - RNA, 14 nt, Human
guauugcacauugu

SEQ ID NO: 1438535 - RNA, 13 nt, Human
guauugcacauug

SEQ ID NO: 1438536 - RNA, 16 nt, Human
guauucuucucuuccu

SEQ ID NO: 1438537 - RNA, 22 nt, Human
guauucuucucuuccuuuuauc

SEQ ID NO: 1438538 - RNA, 18 nt, Human
guauucugggguauggcg

SEQ ID NO: 1438539 - RNA, 19 nt, Human
guauucucugagcugugca

SEQ ID NO: 1438540 - RNA, 13 nt, Human
guauucucugagc

SEQ ID NO: 1438541 - RNA, 12 nt, Human
guauucucugag

SEQ ID NO: 1438542 - RNA, 11 nt, Human
guauucucuga

SEQ ID NO: 1438543 - RNA, 17 nt, Human
guaugucugguucucaa

SEQ ID NO: 1438544 - RNA, 22 nt, Human
guaugucugguucucaauucca

SEQ ID NO: 1438545 - RNA, 14 nt, Human
guaugucugguucu

SEQ ID NO: 1438546 - RNA, 15 nt, Human
guauggugcaaugug

SEQ ID NO: 1438547 - RNA, 19 nt, Human
guauggguaggguaaauca

SEQ ID NO: 1438548 - RNA, 21 nt, Human
guauggguuagggaaaacauu

SEQ ID NO: 1438549 - RNA, 22 nt, Human
aaaugccaaauuaaaaaagaua

SEQ ID NO: 1438550 - RNA, 17 nt, Human
aaaugccaaauuaaaaa

SEQ ID NO: 1438551 - RNA, 16 nt, Human
aaaugccaaauuaaaa

SEQ ID NO: 1438552 - RNA, 14 nt, Human
aaaugcauuucuaa

SEQ ID NO: 1438553 - RNA, 22 nt, Human
aaaugccaugaugccucugucu

SEQ ID NO: 1438554 - RNA, 18 nt, Human
aaaugccaaauuaaaaaa

SEQ ID NO: 1438555 - RNA, 19 nt, Human
aaauggcuuccuggcaaua

SEQ ID NO: 1438556 - RNA, 23 nt, Human
aaaugccuuacccucauguucuu

SEQ ID NO: 1438557 - RNA, 14 nt, Human
aaaugauuguagua

SEQ ID NO: 1438558 - RNA, 17 nt, Human
aaaugauuacuaaggaa

SEQ ID NO: 1438559 - RNA, 15 nt, Human
aaaugauucuuagug

SEQ ID NO: 1438560 - RNA, 13 nt, Human
aaaugaucuaaac

SEQ ID NO: 1438561 - RNA, 14 nt, Human
aaaugcaaauaaca

SEQ ID NO: 1438562 - RNA, 19 nt, Human
aaaugcaaaaacucuuuga

SEQ ID NO: 1438563 - RNA, 14 nt, Human
aaaugcaccuggaa

SEQ ID NO: 1438564 - RNA, 15 nt, Human
aaaugcauaaaugca

SEQ ID NO: 1438565 - RNA, 18 nt, Human
aaaugcaccuggaauaua

SEQ ID NO: 1438566 - RNA, 22 nt, Human
aaaugcaccuggaauauauaac

SEQ ID NO: 1438567 - RNA, 20 nt, Human
aaaugcauuauaggaucauu

SEQ ID NO: 1438568 - RNA, 13 nt, Human
aaaugcauguugc

SEQ ID NO: 1438569 - RNA, 15 nt, Human
aaaugaguaacauuu

SEQ ID NO: 1438570 - RNA, 18 nt, Human
aaaugaguaacauuugcu

SEQ ID NO: 1438571 - RNA, 14 nt, Human
aaaugaguaacauu

SEQ ID NO: 1438572 - RNA, 13 nt, Human
aaaugaguaacau

SEQ ID NO: 1438573 - RNA, 12 nt, Human
aaaugaguaaca

SEQ ID NO: 1438574 - RNA, 20 nt, Human
aaaugaggccauggacucug

SEQ ID NO: 1438575 - RNA, 19 nt, Human
aaaugaggccauggacucu

SEQ ID NO: 1438576 - RNA, 13 nt, Human
aaaugagccauga

SEQ ID NO: 1438577 - RNA, 13 nt, Human
aaaugagaaaucu

SEQ ID NO: 1438578 - RNA, 14 nt, Human
aaaugagaaaucua

SEQ ID NO: 1438579 - RNA, 16 nt, Human
aaaugagaaaucuaaa

SEQ ID NO: 1438580 - RNA, 11 nt, Human
aaaugaagaaa

SEQ ID NO: 1438581 - RNA, 13 nt, Human
aaaugaacaagag

SEQ ID NO: 1438582 - RNA, 21 nt, Human
aaaugaacaagagaagcauuc

SEQ ID NO: 1438583 - RNA, 14 nt, Human
aaaugaaagcuacu

SEQ ID NO: 1438584 - RNA, 13 nt, Human
aaaugaaagcuac

SEQ ID NO: 1438585 - RNA, 21 nt, Human
aaaugacaaucauguguguua

SEQ ID NO: 1438586 - RNA, 19 nt, Human
aaaugacaaucaugugugu

SEQ ID NO: 1438587 - RNA, 17 nt, Human
aaaugacaaucaugugu

SEQ ID NO: 1438588 - RNA, 16 nt, Human
aaaugacaaucaugug

SEQ ID NO: 1438589 - RNA, 23 nt, Human
aaaugaauggaggaacuuuccaa

SEQ ID NO: 1438590 - RNA, 23 nt, Human
aaaugacacucauauaauuauau

SEQ ID NO: 1438591 - RNA, 20 nt, Human
aaaugacacucauauaauua

SEQ ID NO: 1438592 - RNA, 11 nt, Human
aaaugagaaau

SEQ ID NO: 1438593 - RNA, 17 nt, Human
aaaucuaccacuguaug

SEQ ID NO: 1438594 - RNA, 14 nt, Human
aaaucuacaguaca

SEQ ID NO: 1438595 - RNA, 13 nt, Human
aaaucuaccacug

SEQ ID NO: 1438596 - RNA, 17 nt, Human
aaaugaaaaugucuugu

SEQ ID NO: 1438597 - RNA, 16 nt, Human
aaaugaaaaugucuug

SEQ ID NO: 1438598 - RNA, 15 nt, Human
aaaugaaaaugucuu

SEQ ID NO: 1438599 - RNA, 15 nt, Human
aaaucucaaauuucu

SEQ ID NO: 1438600 - RNA, 16 nt, Human
aaaucucaaauuucua

SEQ ID NO: 1438601 - RNA, 17 nt, Human
aaaucucaaauuucuaa

SEQ ID NO: 1438602 - RNA, 19 nt, Human
aaaucucaaauuucuaaau

SEQ ID NO: 1438603 - RNA, 21 nt, Human
aaauccuuagaucuggcaugu

SEQ ID NO: 1438604 - RNA, 22 nt, Human
guaggccaagguguccuacaga

SEQ ID NO: 1438605 - RNA, 20 nt, Human
aaaucgaaugaaauuaacug

SEQ ID NO: 1438606 - RNA, 13 nt, Human
aaaucgaaugaaa

SEQ ID NO: 1438607 - RNA, 19 nt, Human
aaauccuuagaucuggcau

SEQ ID NO: 1438608 - RNA, 16 nt, Human
aaauccuuuacuguua

SEQ ID NO: 1438609 - RNA, 14 nt, Human
aaauccuugaagau

SEQ ID NO: 1438610 - RNA, 17 nt, Human
guagcugggacuacagg

SEQ ID NO: 1438611 - RNA, 21 nt, Human
guagcugugaccugcugagcu

SEQ ID NO: 1438612 - RNA, 20 nt, Human
guagcugugaccugcugagc

SEQ ID NO: 1438613 - RNA, 19 nt, Human
guagcugugaccugcugag

SEQ ID NO: 1438614 - RNA, 18 nt, Human
guagcugugaccugcuga

SEQ ID NO: 1438615 - RNA, 17 nt, Human
guagcugugaccugcug

SEQ ID NO: 1438616 - RNA, 16 nt, Human
guagcugugaccugcu

SEQ ID NO: 1438617 - RNA, 15 nt, Human
guagcugugaccugc

SEQ ID NO: 1438618 - RNA, 14 nt, Human
guagcugugaccug

SEQ ID NO: 1438619 - RNA, 13 nt, Human
guagcugugaccu

SEQ ID NO: 1438620 - RNA, 23 nt, Human
guagcuggggcuuugauguuccu

SEQ ID NO: 1438621 - RNA, 12 nt, Human
guagcuggggcu

SEQ ID NO: 1438622 - RNA, 15 nt, Human
aaaggaguuuauguu

SEQ ID NO: 1438623 - RNA, 22 nt, Human
guagcugagcucacaaggcagc

SEQ ID NO: 1438624 - RNA, 21 nt, Human
guagcugagcucacaaggcag

SEQ ID NO: 1438625 - RNA, 13 nt, Human
guagcugagcuca

SEQ ID NO: 1438626 - RNA, 12 nt, Human
guagcugagcuc

SEQ ID NO: 1438627 - RNA, 11 nt, Human
guagcugagcu

SEQ ID NO: 1438628 - RNA, 21 nt, Human
guagcucuuugucagggagug

SEQ ID NO: 1438629 - RNA, 20 nt, Human
guagcucuuugucagggagu

SEQ ID NO: 1438630 - RNA, 19 nt, Human
guagcucuuugucagggag

SEQ ID NO: 1438631 - RNA, 14 nt, Human
aaaggaugcacaga

SEQ ID NO: 1438632 - RNA, 21 nt, Human
aaaggaguuuauguuccauua

SEQ ID NO: 1438633 - RNA, 11 nt, Human
aaaggaguuua

SEQ ID NO: 1438634 - RNA, 16 nt, Human
aaaggagucaaaacua

SEQ ID NO: 1438635 - RNA, 23 nt, Human
aaaggagccugugaacccaggac

SEQ ID NO: 1438636 - RNA, 21 nt, Human
aaaggacuccugaaaaaaaac

SEQ ID NO: 1438637 - RNA, 13 nt, Human
aaaggacuguaau

SEQ ID NO: 1438638 - RNA, 19 nt, Human
guaggaccaagcaucuugg

SEQ ID NO: 1438639 - RNA, 15 nt, Human
guaggaaguaggaag

SEQ ID NO: 1438640 - RNA, 13 nt, Human
guaggaaaugugg

SEQ ID NO: 1438641 - RNA, 12 nt, Human
guagcuuugcuc

SEQ ID NO: 1438642 - RNA, 16 nt, Human
guaggaaagaggaagc

SEQ ID NO: 1438643 - RNA, 17 nt, Human
guaggagggugggaagg

SEQ ID NO: 1438644 - RNA, 16 nt, Human
guaggagggugggaag

SEQ ID NO: 1438645 - RNA, 21 nt, Human
guaggagggacugucgcugcu

SEQ ID NO: 1438646 - RNA, 18 nt, Human
guaggagcccagcucuga

SEQ ID NO: 1438647 - RNA, 20 nt, Human
guaggagacuguuuggaaau

SEQ ID NO: 1438648 - RNA, 19 nt, Human
guaggagacuguuuggaaa

SEQ ID NO: 1438649 - RNA, 14 nt, Human
guaggauuuuuguu

SEQ ID NO: 1438650 - RNA, 23 nt, Human
guaggccaagguguccuacagaa

SEQ ID NO: 1438651 - RNA, 20 nt, Human
guaggccaagguguccuaca

SEQ ID NO: 1438652 - RNA, 18 nt, Human
guaggccaagguguccua

SEQ ID NO: 1438653 - RNA, 12 nt, Human
guaggccaaggu

SEQ ID NO: 1438654 - RNA, 14 nt, Human
guaggcauuuccua

SEQ ID NO: 1438655 - RNA, 18 nt, Human
guaggcaggauuggggaa

SEQ ID NO: 1438656 - RNA, 13 nt, Human
guaggcaggauug

SEQ ID NO: 1438657 - RNA, 17 nt, Human
aagaauggcagaaaagu

SEQ ID NO: 1438658 - RNA, 20 nt, Human
aagaauggcagaaaaguuua

SEQ ID NO: 1438659 - RNA, 17 nt, Human
aagaaugcuuaaucaga

SEQ ID NO: 1438660 - RNA, 13 nt, Human
aagaaugcuuaau

SEQ ID NO: 1438661 - RNA, 22 nt, Human
aagaaugcacaagaauggauca

SEQ ID NO: 1438662 - RNA, 21 nt, Human
aagaaugcacaagaauggauc

SEQ ID NO: 1438663 - RNA, 20 nt, Human
aagaaugcacaagaauggau

SEQ ID NO: 1438664 - RNA, 19 nt, Human
aagaaugcacaagaaugga

SEQ ID NO: 1438665 - RNA, 18 nt, Human
aagaaugcacaagaaugg

SEQ ID NO: 1438666 - RNA, 17 nt, Human
aagaaugcacaagaaug

SEQ ID NO: 1438667 - RNA, 18 nt, Human
aagaaugauuaugaauua

SEQ ID NO: 1438668 - RNA, 14 nt, Human
aagacccuggcuuu

SEQ ID NO: 1438669 - RNA, 18 nt, Human
aagacccuaaacauccau

SEQ ID NO: 1438670 - RNA, 13 nt, Human
aagacccuccccg

SEQ ID NO: 1438671 - RNA, 17 nt, Human
aagacaaagguuuuccu

SEQ ID NO: 1438672 - RNA, 18 nt, Human
aagacaaacuuugcaucu

SEQ ID NO: 1438673 - RNA, 15 nt, Human
aagacaaacuuugca

SEQ ID NO: 1438674 - RNA, 17 nt, Human
aagaauugaguaauggu

SEQ ID NO: 1438675 - RNA, 15 nt, Human
aagaauugaguaaug

SEQ ID NO: 1438676 - RNA, 23 nt, Human
aagaauugugguuuauauauuua

SEQ ID NO: 1438677 - RNA, 22 nt, Human
aagaauugugguuuauauauuu

SEQ ID NO: 1438678 - RNA, 20 nt, Human
aagaauugugguuuauauau

SEQ ID NO: 1438679 - RNA, 16 nt, Human
aagaauugaguaaugg

SEQ ID NO: 1438680 - RNA, 22 nt, Human
aagaauuguuggggguuuuuuu

SEQ ID NO: 1438681 - RNA, 21 nt, Human
aagaauuguuggggguuuuuu

SEQ ID NO: 1438682 - RNA, 12 nt, Human
aagaauuguugg

SEQ ID NO: 1438683 - RNA, 23 nt, Human
aagacaaaaagcuacuuauugua

SEQ ID NO: 1438684 - RNA, 20 nt, Human
aagacaaaaagcuacuuauu

SEQ ID NO: 1438685 - RNA, 22 nt, Human
guggcacucagucucucuucuc

SEQ ID NO: 1438686 - RNA, 19 nt, Human
guggauugcacguggccuc

SEQ ID NO: 1438687 - RNA, 18 nt, Human
guggcagcccagccagcg

SEQ ID NO: 1438688 - RNA, 17 nt, Human
guggcagcccagccagc

SEQ ID NO: 1438689 - RNA, 16 nt, Human
guggcagcccagccag

SEQ ID NO: 1438690 - RNA, 15 nt, Human
guggcagcccagcca

SEQ ID NO: 1438691 - RNA, 14 nt, Human
guggcagcccagcc

SEQ ID NO: 1438692 - RNA, 14 nt, Human
guggcacuggggca

SEQ ID NO: 1438693 - RNA, 13 nt, Human
guggauucuuuaa

SEQ ID NO: 1438694 - RNA, 20 nt, Human
guggauuuaacagaaaugua

SEQ ID NO: 1438695 - RNA, 18 nt, Human
guggauuuaacagaaaug

SEQ ID NO: 1438696 - RNA, 19 nt, Human
guggauuuaacagaaaugu

SEQ ID NO: 1438697 - RNA, 19 nt, Human
aagaauccacauuucuaaa

SEQ ID NO: 1438698 - RNA, 18 nt, Human
aagaauccacauuucuaa

SEQ ID NO: 1438699 - RNA, 17 nt, Human
aagaauccacauuucua

SEQ ID NO: 1438700 - RNA, 15 nt, Human
aagaaucuuuagaga

SEQ ID NO: 1438701 - RNA, 21 nt, Human
aagaaucuugguuugccuucc

SEQ ID NO: 1438702 - RNA, 20 nt, Human
aagaaucuugguuugccuuc

SEQ ID NO: 1438703 - RNA, 20 nt, Human
aagaaucucaucucagugaa

SEQ ID NO: 1438704 - RNA, 12 nt, Human
aagaaucucauc

SEQ ID NO: 1438705 - RNA, 21 nt, Human
aagaauccacauuucuaaaau

SEQ ID NO: 1438706 - RNA, 16 nt, Human
aagaaugauuaugaau

SEQ ID NO: 1438707 - RNA, 20 nt, Human
gugcugggauuacaggugua

SEQ ID NO: 1438708 - RNA, 12 nt, Human
guggacaggacu

SEQ ID NO: 1438709 - RNA, 21 nt, Human
guggaccauggaguggcagcc

SEQ ID NO: 1438710 - RNA, 14 nt, Human
guggacuaaaagau

SEQ ID NO: 1438711 - RNA, 16 nt, Human
guggaccauggagugg

SEQ ID NO: 1438712 - RNA, 22 nt, Human
guggauggccccagcacagcuu

SEQ ID NO: 1438713 - RNA, 19 nt, Human
guggauggccccagcacag

SEQ ID NO: 1438714 - RNA, 16 nt, Human
guggauggccccagca

SEQ ID NO: 1438715 - RNA, 15 nt, Human
guggauggccccagc

SEQ ID NO: 1438716 - RNA, 13 nt, Human
guggauggcccca

SEQ ID NO: 1438717 - RNA, 23 nt, Human
gugcugggagcuccacucugcuu

SEQ ID NO: 1438718 - RNA, 22 nt, Human
gugcugggagcuccacucugcu

SEQ ID NO: 1438719 - RNA, 16 nt, Human
gugcugggagcuccac

SEQ ID NO: 1438720 - RNA, 18 nt, Human
gugcugggagaggcagcc

SEQ ID NO: 1438721 - RNA, 17 nt, Human
gugcugggagaggcagc

SEQ ID NO: 1438722 - RNA, 16 nt, Human
gugcuauggugcucug

SEQ ID NO: 1438723 - RNA, 14 nt, Human
gugcuauggugcuc

SEQ ID NO: 1438724 - RNA, 14 nt, Human
gugcuaggaagagg

SEQ ID NO: 1438725 - RNA, 16 nt, Human
gugcucagcccugagg

SEQ ID NO: 1438726 - RNA, 12 nt, Human
gugcucagcccu

SEQ ID NO: 1438727 - RNA, 13 nt, Human
gugcucaaggcca

SEQ ID NO: 1438728 - RNA, 16 nt, Human
gugcuauuugucaucu

SEQ ID NO: 1438729 - RNA, 15 nt, Human
gugcucaggagcccu

SEQ ID NO: 1438730 - RNA, 18 nt, Human
gugcucagcccugaggac

SEQ ID NO: 1438731 - RNA, 15 nt, Human
gugcuggccagcgag

SEQ ID NO: 1438732 - RNA, 16 nt, Human
gugcucaggagcccug

SEQ ID NO: 1438733 - RNA, 14 nt, Human
gugccuaggccugg

SEQ ID NO: 1438734 - RNA, 18 nt, Human
gugccuaggccugggcag

SEQ ID NO: 1438735 - RNA, 15 nt, Human
gugccuaggccuggg

SEQ ID NO: 1438736 - RNA, 20 nt, Human
gugccuaggccugggcagug

SEQ ID NO: 1438737 - RNA, 21 nt, Human
gugccuauugcuagagcuccu

SEQ ID NO: 1438738 - RNA, 20 nt, Human
gugccuauugcuagagcucc

SEQ ID NO: 1438739 - RNA, 19 nt, Human
gugccuauugcuagagcuc

SEQ ID NO: 1438740 - RNA, 18 nt, Human
gugccuauugcuagagcu

SEQ ID NO: 1438741 - RNA, 20 nt, Human
gugccucagagaccagggcu

SEQ ID NO: 1438742 - RNA, 19 nt, Human
gugccucagagaccagggc

SEQ ID NO: 1438743 - RNA, 15 nt, Human
gugccucagagacca

SEQ ID NO: 1438744 - RNA, 13 nt, Human
gugccucagagac

SEQ ID NO: 1438745 - RNA, 19 nt, Human
aagaaaaaaauugaaaugu

SEQ ID NO: 1438746 - RNA, 18 nt, Human
aagaaaaaaauugaaaug

SEQ ID NO: 1438747 - RNA, 17 nt, Human
aagaaaaaaauugaaau

SEQ ID NO: 1438748 - RNA, 22 nt, Human
aagaaaaaaauguauuuuaugu

SEQ ID NO: 1438749 - RNA, 23 nt, Human
aagaaaaaaauguauuuuauguu

SEQ ID NO: 1438750 - RNA, 21 nt, Human
aagaaaaaaauguauuuuaug

SEQ ID NO: 1438751 - RNA, 17 nt, Human
aagaaaaaaauguauuu

SEQ ID NO: 1438752 - RNA, 16 nt, Human
aagaaaaaaauguauu

SEQ ID NO: 1438753 - RNA, 15 nt, Human
aagaaaaaaauguau

SEQ ID NO: 1438754 - RNA, 14 nt, Human
aacuuuaauguuuu

SEQ ID NO: 1438755 - RNA, 19 nt, Human
aacuuuaaagcguuugcac

SEQ ID NO: 1438756 - RNA, 19 nt, Human
aacuuuaauguuuuuugcc

SEQ ID NO: 1438757 - RNA, 13 nt, Human
aacuuuaccuuuu

SEQ ID NO: 1438758 - RNA, 23 nt, Human
aacuuggcucgaaucucugugcc

SEQ ID NO: 1438759 - RNA, 22 nt, Human
aacuuggcucgaaucucugugc

SEQ ID NO: 1438760 - RNA, 21 nt, Human
aacuuggcucgaaucucugug

SEQ ID NO: 1438761 - RNA, 22 nt, Human
aacuuggggaguuaagaccugg

SEQ ID NO: 1438762 - RNA, 21 nt, Human
aacuuggggaguuaagaccug

SEQ ID NO: 1438763 - RNA, 19 nt, Human
aacuuggcugcaggaaucu

SEQ ID NO: 1438764 - RNA, 18 nt, Human
aacuuggcugcaggaauc

SEQ ID NO: 1438765 - RNA, 11 nt, Human
aacuuggcuca

SEQ ID NO: 1438766 - RNA, 19 nt, Human
aacuuguccuagcacagau

SEQ ID NO: 1438767 - RNA, 23 nt, Human
aacuuggggaguuaagaccuggc

SEQ ID NO: 1438768 - RNA, 16 nt, Human
aacuuguauuaugugu

SEQ ID NO: 1438769 - RNA, 15 nt, Human
aagaaaaagaagcaa

SEQ ID NO: 1438770 - RNA, 20 nt, Human
aagaaaaaaauugaaaugua

SEQ ID NO: 1438771 - RNA, 21 nt, Human
aagaaaaaaauugaaauguaa

SEQ ID NO: 1438772 - RNA, 15 nt, Human
aagaaaaaggaugca

SEQ ID NO: 1438773 - RNA, 17 nt, Human
aagaaaaaggaugcaca

SEQ ID NO: 1438774 - RNA, 21 nt, Human
aagaaaccuacugcccaggca

SEQ ID NO: 1438775 - RNA, 16 nt, Human
aagaaaccuacugccc

SEQ ID NO: 1438776 - RNA, 19 nt, Human
aagaaaaaggaugcacaga

SEQ ID NO: 1438777 - RNA, 15 nt, Human
aagaaaccuacugcc

SEQ ID NO: 1438778 - RNA, 18 nt, Human
aagaaaaaggaugcacag

SEQ ID NO: 1438779 - RNA, 20 nt, Human
aagaaacugaggaauuuucu

SEQ ID NO: 1438780 - RNA, 19 nt, Human
aagaaacugaggaauuuuc

SEQ ID NO: 1438781 - RNA, 16 nt, Human
aagaaacugaggaauu

SEQ ID NO: 1438782 - RNA, 21 nt, Human
aagaaacugaggaauuuucuu

SEQ ID NO: 1438783 - RNA, 21 nt, Human
aagaaacuggggcuccuccag

SEQ ID NO: 1438784 - RNA, 11 nt, Human
aagaaacuuuc

SEQ ID NO: 1438785 - RNA, 17 nt, Human
aagaaacuuguccuucc

SEQ ID NO: 1438786 - RNA, 23 nt, Human
aagaaacuuucuuucucacuaaa

SEQ ID NO: 1438787 - RNA, 14 nt, Human
aagaaacuuuuuua

SEQ ID NO: 1438788 - RNA, 16 nt, Human
aagaaagaacggaaga

SEQ ID NO: 1438789 - RNA, 14 nt, Human
aagaaauagaacaa

SEQ ID NO: 1438790 - RNA, 20 nt, Human
aagaaagacgcacuuuggcu

SEQ ID NO: 1438791 - RNA, 16 nt, Human
aagaaagacgcacuuu

SEQ ID NO: 1438792 - RNA, 12 nt, Human
aagaaauagaau

SEQ ID NO: 1438793 - RNA, 20 nt, Human
aagaaauagaacaaggcuga

SEQ ID NO: 1438794 - RNA, 15 nt, Human
aagaaauagaacaag

SEQ ID NO: 1438795 - RNA, 13 nt, Human
aagaaauauaccu

SEQ ID NO: 1438796 - RNA, 19 nt, Human
aagaaggcaaaaauaguuu

SEQ ID NO: 1438797 - RNA, 15 nt, Human
aagaaggcaaaaaua

SEQ ID NO: 1438798 - RNA, 14 nt, Human
aagaaggcaaaaau

SEQ ID NO: 1438799 - RNA, 16 nt, Human
aagaaggcaaaaaugu

SEQ ID NO: 1438800 - RNA, 23 nt, Human
aagaauagcauuguaaaagcauu

SEQ ID NO: 1438801 - RNA, 18 nt, Human
aagaauagcauuguaaaa

SEQ ID NO: 1438802 - RNA, 17 nt, Human
aagaauagcauuguaaa

SEQ ID NO: 1438803 - RNA, 11 nt, Human
aagaauagaac

SEQ ID NO: 1438804 - RNA, 22 nt, Human
aagaauacuucucauuuuuuaa

SEQ ID NO: 1438805 - RNA, 17 nt, Human
aagaauacuucucauuu

SEQ ID NO: 1438806 - RNA, 16 nt, Human
aagaauacuucucauu

SEQ ID NO: 1438807 - RNA, 12 nt, Human
aagaauacuucu

SEQ ID NO: 1438808 - RNA, 17 nt, Human
aagaauagcuuuaauga

SEQ ID NO: 1438809 - RNA, 19 nt, Human
gugcuaggaagaggagugg

SEQ ID NO: 1438810 - RNA, 18 nt, Human
gugcuaguaauuggaaag

SEQ ID NO: 1438811 - RNA, 21 nt, Human
aagacucuagaguccaagguu

SEQ ID NO: 1438812 - RNA, 19 nt, Human
aagacucuagaguccaagg

SEQ ID NO: 1438813 - RNA, 15 nt, Human
aagacucuagagucc

SEQ ID NO: 1438814 - RNA, 13 nt, Human
aagacucuagagu

SEQ ID NO: 1438815 - RNA, 12 nt, Human
aagacucuagag

SEQ ID NO: 1438816 - RNA, 15 nt, Human
aagacuaugaaaaug

SEQ ID NO: 1438817 - RNA, 17 nt, Human
aagacugaguacguugu

SEQ ID NO: 1438818 - RNA, 17 nt, Human
aagacuaugaaaaugcu

SEQ ID NO: 1438819 - RNA, 22 nt, Human
aagacuaucuuacuauuucaca

SEQ ID NO: 1438820 - RNA, 21 nt, Human
aagacugaguacguugugcau

SEQ ID NO: 1438821 - RNA, 22 nt, Human
aagacugaguacguugugcauu

SEQ ID NO: 1438822 - RNA, 17 nt, Human
aagaccuggcagcucug

SEQ ID NO: 1438823 - RNA, 21 nt, Human
aagaccuacuguucuaaagcu

SEQ ID NO: 1438824 - RNA, 15 nt, Human
aagaccugagaaugu

SEQ ID NO: 1438825 - RNA, 22 nt, Human
aagaccuacuguucuaaagcuc

SEQ ID NO: 1438826 - RNA, 20 nt, Human
aagaccuacuguucuaaagc

SEQ ID NO: 1438827 - RNA, 18 nt, Human
aagaccuacuguucuaaa

SEQ ID NO: 1438828 - RNA, 17 nt, Human
aagaccuacuguucuaa

SEQ ID NO: 1438829 - RNA, 17 nt, Human
aagacccuuuuggguuu

SEQ ID NO: 1438830 - RNA, 20 nt, Human
aagacccuuuuggguuucug

SEQ ID NO: 1438831 - RNA, 17 nt, Human
aagagcagcaccuccuc

SEQ ID NO: 1438832 - RNA, 20 nt, Human
aagagcaaaagaauggcaga

SEQ ID NO: 1438833 - RNA, 15 nt, Human
aagagcaaaagaaug

SEQ ID NO: 1438834 - RNA, 20 nt, Human
aagacuuacucuaagaucuu

SEQ ID NO: 1438835 - RNA, 17 nt, Human
aagacuuacucuaagau

SEQ ID NO: 1438836 - RNA, 16 nt, Human
aagacuuacucuaaga

SEQ ID NO: 1438837 - RNA, 15 nt, Human
aagacuuacucuaag

SEQ ID NO: 1438838 - RNA, 14 nt, Human
aagacuuacucuaa

SEQ ID NO: 1438839 - RNA, 18 nt, Human
aagagcuacguauuuaau

SEQ ID NO: 1438840 - RNA, 21 nt, Human
aagagcgagagaucaaagaug

SEQ ID NO: 1438841 - RNA, 18 nt, Human
aagagcgagagaucaaag

SEQ ID NO: 1438842 - RNA, 18 nt, Human
aagagccuuccacccagg

SEQ ID NO: 1438843 - RNA, 16 nt, Human
aagagccuuccaccca

SEQ ID NO: 1438844 - RNA, 16 nt, Human
aagagcuacauaauuu

SEQ ID NO: 1438845 - RNA, 14 nt, Human
aagagcuacauaau

SEQ ID NO: 1438846 - RNA, 23 nt, Human
aagagcgagagaucaaagaugaa

SEQ ID NO: 1438847 - RNA, 19 nt, Human
guggcccucuccccugccc

SEQ ID NO: 1438848 - RNA, 18 nt, Human
guggcccucuccccugcc

SEQ ID NO: 1438849 - RNA, 17 nt, Human
guggcccucuccccugc

SEQ ID NO: 1438850 - RNA, 15 nt, Human
guggcccucuccccu

SEQ ID NO: 1438851 - RNA, 14 nt, Human
guggcccucucccc

SEQ ID NO: 1438852 - RNA, 13 nt, Human
aagaggaagcaaa

SEQ ID NO: 1438853 - RNA, 14 nt, Human
aagaggaagcaaau

SEQ ID NO: 1438854 - RNA, 23 nt, Human
guggggggggggcgcggcuggga

SEQ ID NO: 1438855 - RNA, 14 nt, Human
gugggagugugugc

SEQ ID NO: 1438856 - RNA, 17 nt, Human
gugggagugugugccug

SEQ ID NO: 1438857 - RNA, 19 nt, Human
guggggugugcugggagcu

SEQ ID NO: 1438858 - RNA, 16 nt, Human
guggggugugcuggga

SEQ ID NO: 1438859 - RNA, 13 nt, Human
guggggugugcug

SEQ ID NO: 1438860 - RNA, 16 nt, Human
gugggguggugucaga

SEQ ID NO: 1438861 - RNA, 19 nt, Human
gugggguggcugcagccuc

SEQ ID NO: 1438862 - RNA, 18 nt, Human
gugggguggcugcagccu

SEQ ID NO: 1438863 - RNA, 15 nt, Human
gugggguggcugcag

SEQ ID NO: 1438864 - RNA, 13 nt, Human
gugggguggcugc

SEQ ID NO: 1438865 - RNA, 20 nt, Human
guggguacccccaggaccag

SEQ ID NO: 1438866 - RNA, 16 nt, Human
gugguggucccugggu

SEQ ID NO: 1438867 - RNA, 15 nt, Human
gugguggucccuggg

SEQ ID NO: 1438868 - RNA, 14 nt, Human
gugguggcucggga

SEQ ID NO: 1438869 - RNA, 16 nt, Human
gugguuucagaaaugu

SEQ ID NO: 1438870 - RNA, 14 nt, Human
guggugguuuucug

SEQ ID NO: 1438871 - RNA, 13 nt, Human
gugggugccuagg

SEQ ID NO: 1438872 - RNA, 13 nt, Human
gugggucugggag

SEQ ID NO: 1438873 - RNA, 14 nt, Human
guggguagacacac

SEQ ID NO: 1438874 - RNA, 21 nt, Human
guggcgccgucuccaggggcu

SEQ ID NO: 1438875 - RNA, 17 nt, Human
guggcgccgucuccagg

SEQ ID NO: 1438876 - RNA, 22 nt, Human
guggcgccgucuccaggggcug

SEQ ID NO: 1438877 - RNA, 19 nt, Human
guggcgcgaucucagcuca

SEQ ID NO: 1438878 - RNA, 16 nt, Human
guggcguuuguaauga

SEQ ID NO: 1438879 - RNA, 21 nt, Human
gugggacagucaccucaugga

SEQ ID NO: 1438880 - RNA, 17 nt, Human
gugggaccuagggaggc

SEQ ID NO: 1438881 - RNA, 22 nt, Human
gugggacagcuuguaggggagg

SEQ ID NO: 1438882 - RNA, 19 nt, Human
guggcgugaucucagcuca

SEQ ID NO: 1438883 - RNA, 20 nt, Human
gugggacgggaugguucugg

SEQ ID NO: 1438884 - RNA, 20 nt, Human
gugggacggugcccaagcca

SEQ ID NO: 1438885 - RNA, 19 nt, Human
gugggacggugcccaagcc

SEQ ID NO: 1438886 - RNA, 20 nt, Human
gugggaggguaccagcagaa

SEQ ID NO: 1438887 - RNA, 16 nt, Human
gugggaggguaccagc

SEQ ID NO: 1438888 - RNA, 15 nt, Human
gugggaggguaccag

SEQ ID NO: 1438889 - RNA, 17 nt, Human
gugggaggugagaccac

SEQ ID NO: 1438890 - RNA, 19 nt, Human
aagcaaguucgucuguugu

SEQ ID NO: 1438891 - RNA, 22 nt, Human
aagcaagaggccguggcugcug

SEQ ID NO: 1438892 - RNA, 15 nt, Human
aagcaagauuucaga

SEQ ID NO: 1438893 - RNA, 17 nt, Human
aagcaagaaucagagaa

SEQ ID NO: 1438894 - RNA, 23 nt, Human
aagcaagaaucagagaaggaaca

SEQ ID NO: 1438895 - RNA, 19 nt, Human
aagcaacuaggccuucagu

SEQ ID NO: 1438896 - RNA, 22 nt, Human
aagcaaccucaguaauuuagaa

SEQ ID NO: 1438897 - RNA, 21 nt, Human
aagcaaccucaguaauuuaga

SEQ ID NO: 1438898 - RNA, 20 nt, Human
aagcaaccucaguaauuuag

SEQ ID NO: 1438899 - RNA, 19 nt, Human
aagcaaccucaguaauuua

SEQ ID NO: 1438900 - RNA, 18 nt, Human
aagcaaccucaguaauuu

SEQ ID NO: 1438901 - RNA, 16 nt, Human
aagcaaagcacagaga

SEQ ID NO: 1438902 - RNA, 22 nt, Human
aagaugccacauucaaaauagg

SEQ ID NO: 1438903 - RNA, 16 nt, Human
aagaugccacauucaa

SEQ ID NO: 1438904 - RNA, 15 nt, Human
aagaugccacauuca

SEQ ID NO: 1438905 - RNA, 23 nt, Human
aagaugcacuuugcuuuaauaua

SEQ ID NO: 1438906 - RNA, 18 nt, Human
aagaucuuuuauuuugcc

SEQ ID NO: 1438907 - RNA, 19 nt, Human
aagaugugauauucuaaga

SEQ ID NO: 1438908 - RNA, 18 nt, Human
aagaugugauauucuaag

SEQ ID NO: 1438909 - RNA, 17 nt, Human
aagaugugauauucuaa

SEQ ID NO: 1438910 - RNA, 16 nt, Human
aagaugugauauucua

SEQ ID NO: 1438911 - RNA, 14 nt, Human
aagaugugauauuc

SEQ ID NO: 1438912 - RNA, 17 nt, Human
aagcaaagcacagagag

SEQ ID NO: 1438913 - RNA, 15 nt, Human
aagcaaagcacagag

SEQ ID NO: 1438914 - RNA, 12 nt, Human
aagcaaagcaca

SEQ ID NO: 1438915 - RNA, 17 nt, Human
aagaucuuagauucucu

SEQ ID NO: 1438916 - RNA, 16 nt, Human
aagaucuuagauucuc

SEQ ID NO: 1438917 - RNA, 15 nt, Human
aagaucuuagauucu

SEQ ID NO: 1438918 - RNA, 14 nt, Human
aagaucuuagauuc

SEQ ID NO: 1438919 - RNA, 13 nt, Human
aagaucuuagauu

SEQ ID NO: 1438920 - RNA, 22 nt, Human
aagaucuguuuugaaggcaaaa

SEQ ID NO: 1438921 - RNA, 21 nt, Human
aagaucuguuuugaaggcaaa

SEQ ID NO: 1438922 - RNA, 20 nt, Human
aagaucuguuuugaaggcaa

SEQ ID NO: 1438923 - RNA, 17 nt, Human
aagaucuuuuauuuugc

SEQ ID NO: 1438924 - RNA, 15 nt, Human
aagaucuuuuauuuu

SEQ ID NO: 1438925 - RNA, 11 nt, Human
aagaucuuuua

SEQ ID NO: 1438926 - RNA, 23 nt, Human
aagaucuuagauucucugugucu

SEQ ID NO: 1438927 - RNA, 19 nt, Human
aagauauuuuaaaaucugu

SEQ ID NO: 1438928 - RNA, 20 nt, Human
aagaucuguccucagccuug

SEQ ID NO: 1438929 - RNA, 19 nt, Human
aagaucuguccucagccuu

SEQ ID NO: 1438930 - RNA, 15 nt, Human
aagauauuuugcuuu

SEQ ID NO: 1438931 - RNA, 17 nt, Human
aagagguguuauuugga

SEQ ID NO: 1438932 - RNA, 17 nt, Human
aagagguguuuuuucua

SEQ ID NO: 1438933 - RNA, 17 nt, Human
gugguuuucuguucuuu

SEQ ID NO: 1438934 - RNA, 23 nt, Human
gugguuuuagauuuucugguucu

SEQ ID NO: 1438935 - RNA, 14 nt, Human
gugguuucauguua

SEQ ID NO: 1438936 - RNA, 20 nt, Human
guggugguuuucuguucuuu

SEQ ID NO: 1438937 - RNA, 13 nt, Human
aagaguaaucaau

SEQ ID NO: 1438938 - RNA, 20 nt, Human
aagauauaagugcuguauaa

SEQ ID NO: 1438939 - RNA, 21 nt, Human
aagauauaagugcuguauaaa

SEQ ID NO: 1438940 - RNA, 19 nt, Human
aagauauaagugcuguaua

SEQ ID NO: 1438941 - RNA, 13 nt, Human
aagaguagaaacu

SEQ ID NO: 1438942 - RNA, 18 nt, Human
aagagguuuuaaagcuuc

SEQ ID NO: 1438943 - RNA, 14 nt, Human
aagagguuuuaaag

SEQ ID NO: 1438944 - RNA, 12 nt, Human
gugugagacugg

SEQ ID NO: 1438945 - RNA, 22 nt, Human
gugugagaagugaaugcuggga

SEQ ID NO: 1438946 - RNA, 21 nt, Human
gugugagaagugaaugcuggg

SEQ ID NO: 1438947 - RNA, 20 nt, Human
gugugaaacuuucauuccuu

SEQ ID NO: 1438948 - RNA, 16 nt, Human
gugucuuuuuuuguau

SEQ ID NO: 1438949 - RNA, 19 nt, Human
aagcaauaugcauuuaaau

SEQ ID NO: 1438950 - RNA, 13 nt, Human
aagcaauaugcau

SEQ ID NO: 1438951 - RNA, 18 nt, Human
aagaugcacuuugcuuua

SEQ ID NO: 1438952 - RNA, 15 nt, Human
aagcaauccuaggua

SEQ ID NO: 1438953 - RNA, 19 nt, Human
gugucuuuagauagcccug

SEQ ID NO: 1438954 - RNA, 18 nt, Human
gugucuuucacagcuccu

SEQ ID NO: 1438955 - RNA, 17 nt, Human
gugucuuuagauagccc

SEQ ID NO: 1438956 - RNA, 18 nt, Human
guguugccaagcuccaag

SEQ ID NO: 1438957 - RNA, 14 nt, Human
guguugccaagcuc

SEQ ID NO: 1438958 - RNA, 20 nt, Human
guguugccaaauauguccug

SEQ ID NO: 1438959 - RNA, 19 nt, Human
guguugccaaauauguccu

SEQ ID NO: 1438960 - RNA, 17 nt, Human
guguugccaaauauguc

SEQ ID NO: 1438961 - RNA, 23 nt, Human
guguugauacuguugcacgugug

SEQ ID NO: 1438962 - RNA, 21 nt, Human
guguugauacuguugcacgug

SEQ ID NO: 1438963 - RNA, 20 nt, Human
guguugauacuguugcacgu

SEQ ID NO: 1438964 - RNA, 18 nt, Human
guguugauacuguugcac

SEQ ID NO: 1438965 - RNA, 17 nt, Human
guguugauacuguugca

SEQ ID NO: 1438966 - RNA, 16 nt, Human
guguugauacuguugc

SEQ ID NO: 1438967 - RNA, 15 nt, Human
guguugauacuguug

SEQ ID NO: 1438968 - RNA, 21 nt, Human
gugugucuuaauuauuauuug

SEQ ID NO: 1438969 - RNA, 14 nt, Human
gugugucuuaauua

SEQ ID NO: 1438970 - RNA, 22 nt, Human
gugugucuguucacuuuuccuc

SEQ ID NO: 1438971 - RNA, 15 nt, Human
gugugucuguucacu

SEQ ID NO: 1438972 - RNA, 16 nt, Human
gugugucugcucagua

SEQ ID NO: 1438973 - RNA, 15 nt, Human
gugugucugcucagu

SEQ ID NO: 1438974 - RNA, 18 nt, Human
gugugucccccucugucc

SEQ ID NO: 1438975 - RNA, 17 nt, Human
gugugucccccucuguc

SEQ ID NO: 1438976 - RNA, 16 nt, Human
gugugucccccucugu

SEQ ID NO: 1438977 - RNA, 20 nt, Human
guguguccacgacugucucc

SEQ ID NO: 1438978 - RNA, 19 nt, Human
guguguccacgacugucuc

SEQ ID NO: 1438979 - RNA, 14 nt, Human
guguguauauggac

SEQ ID NO: 1438980 - RNA, 15 nt, Human
guguugucucuugag

SEQ ID NO: 1438981 - RNA, 12 nt, Human
guguugucucua

SEQ ID NO: 1438982 - RNA, 21 nt, Human
guguuucacaguuugaaauaa

SEQ ID NO: 1438983 - RNA, 13 nt, Human
guguuucacaguu

SEQ ID NO: 1438984 - RNA, 20 nt, Human
guguuggacaagcuucugag

SEQ ID NO: 1438985 - RNA, 16 nt, Human
aagcuuucagaauaug

SEQ ID NO: 1438986 - RNA, 12 nt, Human
aagcuuuccugc

SEQ ID NO: 1438987 - RNA, 23 nt, Human
aagcuuucauguaaacugugcac

SEQ ID NO: 1438988 - RNA, 22 nt, Human
aagcuuucauguaaacugugca

SEQ ID NO: 1438989 - RNA, 21 nt, Human
aagcuuucagaauaugucagu

SEQ ID NO: 1438990 - RNA, 16 nt, Human
aagcuuccaugauucu

SEQ ID NO: 1438991 - RNA, 20 nt, Human
guucccaguuggagcuccag

SEQ ID NO: 1438992 - RNA, 18 nt, Human
guucccacauuaaagaag

SEQ ID NO: 1438993 - RNA, 21 nt, Human
guucccacauuaaagaagacc

SEQ ID NO: 1438994 - RNA, 19 nt, Human
guucccaccaggcugcuca

SEQ ID NO: 1438995 - RNA, 17 nt, Human
guucccacauuaaagaa

SEQ ID NO: 1438996 - RNA, 23 nt, Human
guucccaagagcaucaugccucu

SEQ ID NO: 1438997 - RNA, 19 nt, Human
guucccaagcucagaggcg

SEQ ID NO: 1438998 - RNA, 21 nt, Human
guucccaagagcaucaugccu

SEQ ID NO: 1438999 - RNA, 17 nt, Human
guuccauuaaacgauuu

SEQ ID NO: 1439000 - RNA, 20 nt, Human
guuccauggccucuucagau

SEQ ID NO: 1439001 - RNA, 13 nt, Human
guucccucccaga

SEQ ID NO: 1439002 - RNA, 18 nt, Human
guucccguuucuccaccu

SEQ ID NO: 1439003 - RNA, 16 nt, Human
guucccguuucuccac

SEQ ID NO: 1439004 - RNA, 14 nt, Human
guucccguuucucc

SEQ ID NO: 1439005 - RNA, 19 nt, Human
guucccguuucuccaccua

SEQ ID NO: 1439006 - RNA, 16 nt, Human
guucccauuucagcug

SEQ ID NO: 1439007 - RNA, 17 nt, Human
guuccccuuugcuucau

SEQ ID NO: 1439008 - RNA, 22 nt, Human
guuccccuuccacugagggcag

SEQ ID NO: 1439009 - RNA, 15 nt, Human
guuccccuuccacug

SEQ ID NO: 1439010 - RNA, 20 nt, Human
aagcuuccaugauucuauuu

SEQ ID NO: 1439011 - RNA, 15 nt, Human
aagcuuccaugauuc

SEQ ID NO: 1439012 - RNA, 19 nt, Human
aagcuucagugcugccgau

SEQ ID NO: 1439013 - RNA, 18 nt, Human
aagcuucaaacugcauga

SEQ ID NO: 1439014 - RNA, 20 nt, Human
aagcugaggugcccaggaga

SEQ ID NO: 1439015 - RNA, 19 nt, Human
aagcugaggugcccaggag

SEQ ID NO: 1439016 - RNA, 18 nt, Human
aagcugaggugcccagga

SEQ ID NO: 1439017 - RNA, 17 nt, Human
aagcugaggugcccagg

SEQ ID NO: 1439018 - RNA, 13 nt, Human
aagcugaggugcc

SEQ ID NO: 1439019 - RNA, 19 nt, Human
aagcugacuuggcuggugu

SEQ ID NO: 1439020 - RNA, 20 nt, Human
aagcugacuuggcuggugug

SEQ ID NO: 1439021 - RNA, 18 nt, Human
aagcugacuuggcuggug

SEQ ID NO: 1439022 - RNA, 17 nt, Human
aagcugacuuggcuggu

SEQ ID NO: 1439023 - RNA, 16 nt, Human
aagcugacuuggcugg

SEQ ID NO: 1439024 - RNA, 15 nt, Human
aagcugacuuggcug

SEQ ID NO: 1439025 - RNA, 14 nt, Human
aagcugacuuggcu

SEQ ID NO: 1439026 - RNA, 23 nt, Human
aagcuccucuccccagcccagag

SEQ ID NO: 1439027 - RNA, 22 nt, Human
aagcuccucuccccagcccaga

SEQ ID NO: 1439028 - RNA, 21 nt, Human
aagcuccucuccccagcccag

SEQ ID NO: 1439029 - RNA, 20 nt, Human
aagcuccucuccccagccca

SEQ ID NO: 1439030 - RNA, 19 nt, Human
aagcuccucuccccagccc

SEQ ID NO: 1439031 - RNA, 23 nt, Human
aagcucgauguggucacagcugu

SEQ ID NO: 1439032 - RNA, 22 nt, Human
aagcucgauguggucacagcug

SEQ ID NO: 1439033 - RNA, 18 nt, Human
aagcuccucuccccagcc

SEQ ID NO: 1439034 - RNA, 17 nt, Human
aagcuaucguaaaauua

SEQ ID NO: 1439035 - RNA, 23 nt, Human
guucuccguuagcuccuguggcc

SEQ ID NO: 1439036 - RNA, 22 nt, Human
guucuccguuagcuccuguggc

SEQ ID NO: 1439037 - RNA, 23 nt, Human
guucuagacauggagguucuaag

SEQ ID NO: 1439038 - RNA, 22 nt, Human
guucuagacauggagguucuaa

SEQ ID NO: 1439039 - RNA, 21 nt, Human
guucuagacauggagguucua

SEQ ID NO: 1439040 - RNA, 20 nt, Human
guucuagacauggagguucu

SEQ ID NO: 1439041 - RNA, 21 nt, Human
guucuagaaaaacaggcacuu

SEQ ID NO: 1439042 - RNA, 18 nt, Human
guucuagaaaaacaggca

SEQ ID NO: 1439043 - RNA, 14 nt, Human
guucuagaaaaaca

SEQ ID NO: 1439044 - RNA, 13 nt, Human
guucuagaaaaac

SEQ ID NO: 1439045 - RNA, 12 nt, Human
guucuagaaaaa

SEQ ID NO: 1439046 - RNA, 21 nt, Human
guucuaccucaggcagcucaa

SEQ ID NO: 1439047 - RNA, 20 nt, Human
guucuaccucaggcagcuca

SEQ ID NO: 1439048 - RNA, 22 nt, Human
guucuccuuuuccucucucccg

SEQ ID NO: 1439049 - RNA, 18 nt, Human
guucuccuuuuccucucu

SEQ ID NO: 1439050 - RNA, 13 nt, Human
guucuccuuuucc

SEQ ID NO: 1439051 - RNA, 22 nt, Human
guucuccugcugcucccucaga

SEQ ID NO: 1439052 - RNA, 21 nt, Human
guucuccugcugcucccucag

SEQ ID NO: 1439053 - RNA, 18 nt, Human
guucuccugcugcucccu

SEQ ID NO: 1439054 - RNA, 17 nt, Human
guucuccugcugcuccc

SEQ ID NO: 1439055 - RNA, 17 nt, Human
guucucuaucauuuaau

SEQ ID NO: 1439056 - RNA, 18 nt, Human
guucucuaucauuuaaua

SEQ ID NO: 1439057 - RNA, 22 nt, Human
guucucuaucauuuaauaauau

SEQ ID NO: 1439058 - RNA, 22 nt, Human
guucuuaccuguaugucuccag

SEQ ID NO: 1439059 - RNA, 22 nt, Human
guucuguagaaaugguuguauu

SEQ ID NO: 1439060 - RNA, 14 nt, Human
guucuguagaaaug

SEQ ID NO: 1439061 - RNA, 17 nt, Human
guucugguccuuuuugg

SEQ ID NO: 1439062 - RNA, 23 nt, Human
guucugguaugaacuugaggaca

SEQ ID NO: 1439063 - RNA, 23 nt, Human
guucuuuaaaauguaaagccaug

SEQ ID NO: 1439064 - RNA, 15 nt, Human
guucuuguuggugca

SEQ ID NO: 1439065 - RNA, 14 nt, Human
guucuuguuggugc

SEQ ID NO: 1439066 - RNA, 13 nt, Human
guucuuguuggug

SEQ ID NO: 1439067 - RNA, 13 nt, Human
guucuuguaauuu

SEQ ID NO: 1439068 - RNA, 12 nt, Human
guucuuguauuu

SEQ ID NO: 1439069 - RNA, 18 nt, Human
guucuuguaauuuuacac

SEQ ID NO: 1439070 - RNA, 14 nt, Human
guucuucaucuaag

SEQ ID NO: 1439071 - RNA, 17 nt, Human
guucuuagcucaaugag

SEQ ID NO: 1439072 - RNA, 21 nt, Human
guucuugguuuguaaauuaac

SEQ ID NO: 1439073 - RNA, 19 nt, Human
guucuuagcucaaugagca

SEQ ID NO: 1439074 - RNA, 16 nt, Human
guucuuagcucaauga

SEQ ID NO: 1439075 - RNA, 14 nt, Human
guucuuacugcuug

SEQ ID NO: 1439076 - RNA, 16 nt, Human
guucuuacugcuuaau

SEQ ID NO: 1439077 - RNA, 19 nt, Human
guugaggccacuguguucc

SEQ ID NO: 1439078 - RNA, 21 nt, Human
guugaggccacuguguuccuu

SEQ ID NO: 1439079 - RNA, 14 nt, Human
guugaggccacugu

SEQ ID NO: 1439080 - RNA, 19 nt, Human
guugacauucugaaugcuu

SEQ ID NO: 1439081 - RNA, 18 nt, Human
guugacauucugaaugcu

SEQ ID NO: 1439082 - RNA, 17 nt, Human
guugacauucugaaugc

SEQ ID NO: 1439083 - RNA, 15 nt, Human
guugacauucugaau

SEQ ID NO: 1439084 - RNA, 14 nt, Human
guugacauucugaa

SEQ ID NO: 1439085 - RNA, 13 nt, Human
guugacauucuga

SEQ ID NO: 1439086 - RNA, 18 nt, Human
guugacaugggacauuug

SEQ ID NO: 1439087 - RNA, 14 nt, Human
guugacaugggaca

SEQ ID NO: 1439088 - RNA, 12 nt, Human
guuaagcucugc

SEQ ID NO: 1439089 - RNA, 21 nt, Human
guuaaucuugcuuucuuuguu

SEQ ID NO: 1439090 - RNA, 13 nt, Human
guuaaucuugcuu

SEQ ID NO: 1439091 - RNA, 23 nt, Human
guuaaguugagauaguuuucauc

SEQ ID NO: 1439092 - RNA, 16 nt, Human
guuaaucuugcuuucu

SEQ ID NO: 1439093 - RNA, 13 nt, Human
guguuuuaauuua

SEQ ID NO: 1439094 - RNA, 14 nt, Human
guguuuuaauugua

SEQ ID NO: 1439095 - RNA, 15 nt, Human
guuaagcucugcuau

SEQ ID NO: 1439096 - RNA, 16 nt, Human
guguuuuaauuguaaa

SEQ ID NO: 1439097 - RNA, 14 nt, Human
guguuuggcuuuca

SEQ ID NO: 1439098 - RNA, 14 nt, Human
guguuuccaucuca

SEQ ID NO: 1439099 - RNA, 18 nt, Human
guguuuccacagccugca

SEQ ID NO: 1439100 - RNA, 18 nt, Human
guguuuuaaaaugagaaa

SEQ ID NO: 1439101 - RNA, 12 nt, Human
guguuugucauu

SEQ ID NO: 1439102 - RNA, 13 nt, Human
guguuugucauua

SEQ ID NO: 1439103 - RNA, 15 nt, Human
guguuugucauuagc

SEQ ID NO: 1439104 - RNA, 23 nt, Human
guuaguuaccuuauaguuacugu

SEQ ID NO: 1439105 - RNA, 22 nt, Human
guuaguuaccuuauaguuacug

SEQ ID NO: 1439106 - RNA, 17 nt, Human
guuaguuaccuuauagu

SEQ ID NO: 1439107 - RNA, 18 nt, Human
guuaguaucuuuugauau

SEQ ID NO: 1439108 - RNA, 20 nt, Human
guuagucgugagcucuugug

SEQ ID NO: 1439109 - RNA, 22 nt, Human
guuagucgugagcucuugugag

SEQ ID NO: 1439110 - RNA, 22 nt, Human
guuagucauuugcugagcaugu

SEQ ID NO: 1439111 - RNA, 18 nt, Human
guuagucgugagcucuug

SEQ ID NO: 1439112 - RNA, 12 nt, Human
guuagucauuug

SEQ ID NO: 1439113 - RNA, 17 nt, Human
guuaguaucuuuugaua

SEQ ID NO: 1439114 - RNA, 14 nt, Human
guuaguaucuuuug

SEQ ID NO: 1439115 - RNA, 20 nt, Human
guuaguaugaggcauuuguu

SEQ ID NO: 1439116 - RNA, 23 nt, Human
guuagccuuuuuuccccagacuu

SEQ ID NO: 1439117 - RNA, 15 nt, Human
guuagcuccuguggc

SEQ ID NO: 1439118 - RNA, 14 nt, Human
guuagcuccugugg

SEQ ID NO: 1439119 - RNA, 17 nt, Human
guuaguaugaggcauuu

SEQ ID NO: 1439120 - RNA, 12 nt, Human
guuagcuccugu

SEQ ID NO: 1439121 - RNA, 18 nt, Human
guuagccuuuuuucccca

SEQ ID NO: 1439122 - RNA, 21 nt, Human
guuagcuaauaaaaagcuuuu

SEQ ID NO: 1439123 - RNA, 18 nt, Human
guuagcagacaggccccg

SEQ ID NO: 1439124 - RNA, 13 nt, Human
guuagcagacagg

SEQ ID NO: 1439125 - RNA, 16 nt, Human
guuagauuaagaaaua

SEQ ID NO: 1439126 - RNA, 13 nt, Human
guuagauuaagaa

SEQ ID NO: 1439127 - RNA, 11 nt, Human
guuauuuaaau

SEQ ID NO: 1439128 - RNA, 17 nt, Human
guuauuuguaauagaug

SEQ ID NO: 1439129 - RNA, 22 nt, Human
guuauuugaaaacauguuuauu

SEQ ID NO: 1439130 - RNA, 16 nt, Human
guuauuuguaauagau

SEQ ID NO: 1439131 - RNA, 21 nt, Human
aagccuggccuacaugguuga

SEQ ID NO: 1439132 - RNA, 19 nt, Human
aagccugggggccuggcug

SEQ ID NO: 1439133 - RNA, 18 nt, Human
aagccugggggccuggcu

SEQ ID NO: 1439134 - RNA, 17 nt, Human
aagccugggggccuggc

SEQ ID NO: 1439135 - RNA, 16 nt, Human
aagccugggggccugg

SEQ ID NO: 1439136 - RNA, 15 nt, Human
aagccugggggccug

SEQ ID NO: 1439137 - RNA, 22 nt, Human
aagccuggguuugguguauggu

SEQ ID NO: 1439138 - RNA, 23 nt, Human
aagccugggggccuggcuggcug

SEQ ID NO: 1439139 - RNA, 21 nt, Human
aagccugggggccuggcuggc

SEQ ID NO: 1439140 - RNA, 20 nt, Human
aagccugggggccuggcugg

SEQ ID NO: 1439141 - RNA, 19 nt, Human
guucauauguaccauguac

SEQ ID NO: 1439142 - RNA, 14 nt, Human
guucauagcccagu

SEQ ID NO: 1439143 - RNA, 13 nt, Human
guucauagcccag

SEQ ID NO: 1439144 - RNA, 15 nt, Human
aagccucugcccagg

SEQ ID NO: 1439145 - RNA, 22 nt, Human
guucauauguaccauguacaug

SEQ ID NO: 1439146 - RNA, 19 nt, Human
aagccuccuuagaaaaaaa

SEQ ID NO: 1439147 - RNA, 22 nt, Human
aagguaaaaugccaugaugccu

SEQ ID NO: 1439148 - RNA, 14 nt, Human
aagguaaaaugcca

SEQ ID NO: 1439149 - RNA, 15 nt, Human
aaggguaaacaauau

SEQ ID NO: 1439150 - RNA, 16 nt, Human
aaggguaaacaauaua

SEQ ID NO: 1439151 - RNA, 13 nt, Human
aaggguaaacaau

SEQ ID NO: 1439152 - RNA, 12 nt, Human
aaggguaaacaa

SEQ ID NO: 1439153 - RNA, 20 nt, Human
aagguuuuccucuucuauuu

SEQ ID NO: 1439154 - RNA, 19 nt, Human
aagguacaagaagcauuuu

SEQ ID NO: 1439155 - RNA, 18 nt, Human
aagguacaagaagcauuu

SEQ ID NO: 1439156 - RNA, 19 nt, Human
aagguaaauaaaaagaaag

SEQ ID NO: 1439157 - RNA, 16 nt, Human
aagguaaauaaaaaga

SEQ ID NO: 1439158 - RNA, 18 nt, Human
aagguaaaaugccaugau

SEQ ID NO: 1439159 - RNA, 13 nt, Human
aagguacuucaaa

SEQ ID NO: 1439160 - RNA, 14 nt, Human
aaguaauaaaauuc

SEQ ID NO: 1439161 - RNA, 17 nt, Human
aagguuuuuuuucaguu

SEQ ID NO: 1439162 - RNA, 17 nt, Human
aaguaauaugcacacau

SEQ ID NO: 1439163 - RNA, 19 nt, Human
guuucuaaaggcuaccuuu

SEQ ID NO: 1439164 - RNA, 15 nt, Human
aaguaauaugcacac

SEQ ID NO: 1439165 - RNA, 16 nt, Human
aaguaauaugcacaca

SEQ ID NO: 1439166 - RNA, 11 nt, Human
aagguuuuuuu

SEQ ID NO: 1439167 - RNA, 22 nt, Human
aaguaaaaacaaagaaauuaug

SEQ ID NO: 1439168 - RNA, 12 nt, Human
aaguaauaugca

SEQ ID NO: 1439169 - RNA, 13 nt, Human
aaguaaaaacaaa

SEQ ID NO: 1439170 - RNA, 20 nt, Human
aaguaaaaacaaagaaauua

SEQ ID NO: 1439171 - RNA, 18 nt, Human
aagggcuuuguuuugcac

SEQ ID NO: 1439172 - RNA, 16 nt, Human
aagggguuggauugca

SEQ ID NO: 1439173 - RNA, 17 nt, Human
aaggggaauugaggaca

SEQ ID NO: 1439174 - RNA, 14 nt, Human
aaggcuuucucuac

SEQ ID NO: 1439175 - RNA, 20 nt, Human
aaggcuuguugugcuuuuag

SEQ ID NO: 1439176 - RNA, 19 nt, Human
aaggcuuguugugcuuuua

SEQ ID NO: 1439177 - RNA, 17 nt, Human
aaggcuuguugugcuuu

SEQ ID NO: 1439178 - RNA, 19 nt, Human
aaggcuugggauuugcugu

SEQ ID NO: 1439179 - RNA, 14 nt, Human
aaggcuugggauuu

SEQ ID NO: 1439180 - RNA, 18 nt, Human
aaggcuucucucuguggg

SEQ ID NO: 1439181 - RNA, 17 nt, Human
aaggcuucucucugugg

SEQ ID NO: 1439182 - RNA, 21 nt, Human
guuucaaacauauauaacaau

SEQ ID NO: 1439183 - RNA, 22 nt, Human
guuugccuccguccccugccca

SEQ ID NO: 1439184 - RNA, 17 nt, Human
guuugcaccuuucuagu

SEQ ID NO: 1439185 - RNA, 18 nt, Human
guuugcaaaaaauguuuu

SEQ ID NO: 1439186 - RNA, 18 nt, Human
guuuggcuuucagggagg

SEQ ID NO: 1439187 - RNA, 13 nt, Human
guuuggcuuucag

SEQ ID NO: 1439188 - RNA, 14 nt, Human
guuucuguuccaaa

SEQ ID NO: 1439189 - RNA, 15 nt, Human
guuucuguuccaaau

SEQ ID NO: 1439190 - RNA, 13 nt, Human
guuucuguuccaa

SEQ ID NO: 1439191 - RNA, 12 nt, Human
guuucuguucca

SEQ ID NO: 1439192 - RNA, 22 nt, Human
guuucugucguuaaaaacagau

SEQ ID NO: 1439193 - RNA, 15 nt, Human
guuugauuucauuaa

SEQ ID NO: 1439194 - RNA, 17 nt, Human
guuucugucguuaaaaa

SEQ ID NO: 1439195 - RNA, 15 nt, Human
guuucuaagauucua

SEQ ID NO: 1439196 - RNA, 14 nt, Human
guuucuaagauucu

SEQ ID NO: 1439197 - RNA, 20 nt, Human
aaguaauaaaauucaacaaa

SEQ ID NO: 1439198 - RNA, 16 nt, Human
aaguaauacaaacuaa

SEQ ID NO: 1439199 - RNA, 22 nt, Human
guuucuaaaggcuaccuuugua

SEQ ID NO: 1439200 - RNA, 23 nt, Human
guuucuaaaggcuaccuuuguau

SEQ ID NO: 1439201 - RNA, 12 nt, Human
guuuuagguucu

SEQ ID NO: 1439202 - RNA, 21 nt, Human
guuuuagauuuucugguucua

SEQ ID NO: 1439203 - RNA, 20 nt, Human
guuuuagauuuucugguucu

SEQ ID NO: 1439204 - RNA, 21 nt, Human
guuuuacauuguugagcuauu

SEQ ID NO: 1439205 - RNA, 12 nt, Human
guuuuacauugu

SEQ ID NO: 1439206 - RNA, 20 nt, Human
guuuuacaaguuggagucac

SEQ ID NO: 1439207 - RNA, 16 nt, Human
guuuuacaaguuggag

SEQ ID NO: 1439208 - RNA, 11 nt, Human
guuuuacaaua

SEQ ID NO: 1439209 - RNA, 13 nt, Human
guuuuacaauagu

SEQ ID NO: 1439210 - RNA, 16 nt, Human
guuuuacaauaguucu

SEQ ID NO: 1439211 - RNA, 20 nt, Human
guuuuacaauaguucugugg

SEQ ID NO: 1439212 - RNA, 23 nt, Human
guuuuauaagcaucauuauuuau

SEQ ID NO: 1439213 - RNA, 21 nt, Human
guuuuagguucuaaaguucua

SEQ ID NO: 1439214 - RNA, 17 nt, Human
guuuuagguucuaaagu

SEQ ID NO: 1439215 - RNA, 16 nt, Human
guuuuagguucuaaag

SEQ ID NO: 1439216 - RNA, 15 nt, Human
guuuuagguucuaaa

SEQ ID NO: 1439217 - RNA, 13 nt, Human
guuuuagguucua

SEQ ID NO: 1439218 - RNA, 22 nt, Human
guuuuauaagcaucauuauuua

SEQ ID NO: 1439219 - RNA, 20 nt, Human
guuuuauaagcaucauuauu

SEQ ID NO: 1439220 - RNA, 12 nt, Human
guuuuauaagca

SEQ ID NO: 1439221 - RNA, 11 nt, Human
guuuucuguuc

SEQ ID NO: 1439222 - RNA, 20 nt, Human
guuuucuuaaccagaucauu

SEQ ID NO: 1439223 - RNA, 12 nt, Human
guuuucuguucu

SEQ ID NO: 1439224 - RNA, 13 nt, Human
guuuaaagaaagu

SEQ ID NO: 1439225 - RNA, 23 nt, Human
guuuaaaagacacacuuguccac

SEQ ID NO: 1439226 - RNA, 19 nt, Human
guuuaaaagacacacuugu

SEQ ID NO: 1439227 - RNA, 11 nt, Human
guuuaaaacuu

SEQ ID NO: 1439228 - RNA, 20 nt, Human
guuuaagccaaaacaauguu

SEQ ID NO: 1439229 - RNA, 17 nt, Human
guuuaagccaaaacaau

SEQ ID NO: 1439230 - RNA, 23 nt, Human
guuuaaaugaacaagagaagcau

SEQ ID NO: 1439231 - RNA, 15 nt, Human
guuuauguaauuuca

SEQ ID NO: 1439232 - RNA, 16 nt, Human
guuuacacucuuugua

SEQ ID NO: 1439233 - RNA, 20 nt, Human
guuuacaaaaauuucuguaa

SEQ ID NO: 1439234 - RNA, 19 nt, Human
guuuacaaaaucagguaac

SEQ ID NO: 1439235 - RNA, 20 nt, Human
guuuaauuuuuauuucuucc

SEQ ID NO: 1439236 - RNA, 18 nt, Human
guuuaauuuuuauuucuu

SEQ ID NO: 1439237 - RNA, 13 nt, Human
guuuaauguuuug

SEQ ID NO: 1439238 - RNA, 22 nt, Human
guuuauuaaucuuaguguauga

SEQ ID NO: 1439239 - RNA, 18 nt, Human
guuuauuaagcaucagaa

SEQ ID NO: 1439240 - RNA, 21 nt, Human
guuuauuaaucuuaguguaug

SEQ ID NO: 1439241 - RNA, 20 nt, Human
guuuauuaaucuuaguguau

SEQ ID NO: 1439242 - RNA, 18 nt, Human
guuuauuaaucuuagugu

SEQ ID NO: 1439243 - RNA, 14 nt, Human
guuuauuaaucuua

SEQ ID NO: 1439244 - RNA, 22 nt, Human
guuuauguuccauuaaacgauu

SEQ ID NO: 1439245 - RNA, 21 nt, Human
guuuauguuccauuaaacgau

SEQ ID NO: 1439246 - RNA, 17 nt, Human
guuggugcacagcacaa

SEQ ID NO: 1439247 - RNA, 18 nt, Human
guuguacuuuggaauucu

SEQ ID NO: 1439248 - RNA, 17 nt, Human
guuguaauauuucuuca

SEQ ID NO: 1439249 - RNA, 16 nt, Human
guuguauuuaacagaa

SEQ ID NO: 1439250 - RNA, 12 nt, Human
guuguauucauu

SEQ ID NO: 1439251 - RNA, 15 nt, Human
guuguauuagauguu

SEQ ID NO: 1439252 - RNA, 14 nt, Human
guuguauuagaugu

SEQ ID NO: 1439253 - RNA, 23 nt, Human
guugcugcuucucccaggcaagg

SEQ ID NO: 1439254 - RNA, 22 nt, Human
guugcugcuucucccaggcaag

SEQ ID NO: 1439255 - RNA, 18 nt, Human
guugcugcuucucccagg

SEQ ID NO: 1439256 - RNA, 19 nt, Human
aaggaugaagggcccgaga

SEQ ID NO: 1439257 - RNA, 22 nt, Human
aaggaugcacagaguuguuaca

SEQ ID NO: 1439258 - RNA, 18 nt, Human
aaggaugcacagaguugu

SEQ ID NO: 1439259 - RNA, 15 nt, Human
aaggaugcuuguaca

SEQ ID NO: 1439260 - RNA, 16 nt, Human
aaggaugcuuguacau

SEQ ID NO: 1439261 - RNA, 17 nt, Human
aaggaugcuuguacaua

SEQ ID NO: 1439262 - RNA, 19 nt, Human
aaggaugcuuguacauaau

SEQ ID NO: 1439263 - RNA, 20 nt, Human
aaggcuacuucggggcuggg

SEQ ID NO: 1439264 - RNA, 23 nt, Human
aaggcuacuucggggcugggaag

SEQ ID NO: 1439265 - RNA, 19 nt, Human
aaggcuaccuuuguauucu

SEQ ID NO: 1439266 - RNA, 21 nt, Human
aaggccaauuccuauacgcag

SEQ ID NO: 1439267 - RNA, 19 nt, Human
aaggccaagaggcuguucc

SEQ ID NO: 1439268 - RNA, 22 nt, Human
aaggaugugauuguggaaugga

SEQ ID NO: 1439269 - RNA, 17 nt, Human
aaggaugugauugugga

SEQ ID NO: 1439270 - RNA, 15 nt, Human
aaggaugugauugug

SEQ ID NO: 1439271 - RNA, 15 nt, Human
guugcccccauuucu

SEQ ID NO: 1439272 - RNA, 23 nt, Human
acaagauugguguuuuuuucuau

SEQ ID NO: 1439273 - RNA, 24 nt, Human
acaagauugguguuuuuuucuaug

SEQ ID NO: 1439274 - RNA, 22 nt, Human
acaagauugguguuuuuuucua

SEQ ID NO: 1439275 - RNA, 19 nt, Human
acaagauugguguuuuuuu

SEQ ID NO: 1439276 - RNA, 18 nt, Human
acaagauugguguuuuuu

SEQ ID NO: 1439277 - RNA, 17 nt, Human
acaagauugguguuuuu

SEQ ID NO: 1439278 - RNA, 22 nt, Human
acaagccugagggaaaggccag

SEQ ID NO: 1439279 - RNA, 12 nt, Human
acaagccugagg

SEQ ID NO: 1439280 - RNA, 23 nt, Human
acaagccucugcccaggcacugc

SEQ ID NO: 1439281 - RNA, 20 nt, Human
acaagccucugcccaggcac

SEQ ID NO: 1439282 - RNA, 18 nt, Human
acaagccucugcccaggc

SEQ ID NO: 1439283 - RNA, 13 nt, Human
acaagccucugcc

SEQ ID NO: 1439284 - RNA, 11 nt, Human
acaagccucug

SEQ ID NO: 1439285 - RNA, 18 nt, Human
acaagauggaauuuauca

SEQ ID NO: 1439286 - RNA, 16 nt, Human
acaagaccacguuucu

SEQ ID NO: 1439287 - RNA, 17 nt, Human
acaagaccacguuucua

SEQ ID NO: 1439288 - RNA, 18 nt, Human
acaagaccacguuucuaa

SEQ ID NO: 1439289 - RNA, 14 nt, Human
acaaauggccuuua

SEQ ID NO: 1439290 - RNA, 21 nt, Human
acaacaugaggccacuggaga

SEQ ID NO: 1439291 - RNA, 23 nt, Human
acaacaguuacauaauucacucu

SEQ ID NO: 1439292 - RNA, 14 nt, Human
acaacagcugccug

SEQ ID NO: 1439293 - RNA, 21 nt, Human
uagcaacuacagucuaaagcu

SEQ ID NO: 1439294 - RNA, 22 nt, Human
uagcaacuacagucuaaagcug

SEQ ID NO: 1439295 - RNA, 22 nt, Human
acaaaugccaaauuaaaaaaga

SEQ ID NO: 1439296 - RNA, 18 nt, Human
acaaaugccaaauuaaaa

SEQ ID NO: 1439297 - RNA, 21 nt, Human
acaaauucugucucuggauua

SEQ ID NO: 1439298 - RNA, 16 nt, Human
acaaauggaggccugu

SEQ ID NO: 1439299 - RNA, 16 nt, Human
acaauaaaacauuaau

SEQ ID NO: 1439300 - RNA, 12 nt, Human
acaauaaaacau

SEQ ID NO: 1439301 - RNA, 16 nt, Human
acaauaaaaauguuua

SEQ ID NO: 1439302 - RNA, 14 nt, Human
acaauaaaaauguu

SEQ ID NO: 1439303 - RNA, 18 nt, Human
acaaguuggagucacucu

SEQ ID NO: 1439304 - RNA, 17 nt, Human
acaaguuggagucacuc

SEQ ID NO: 1439305 - RNA, 16 nt, Human
acaaguuggagucacu

SEQ ID NO: 1439306 - RNA, 22 nt, Human
acaaguuauuuaaaucuguuuu

SEQ ID NO: 1439307 - RNA, 17 nt, Human
acaaguuauuuaaaucu

SEQ ID NO: 1439308 - RNA, 23 nt, Human
acaagccugagggaaaggccagc

SEQ ID NO: 1439309 - RNA, 15 nt, Human
uagcucaauuagugu

SEQ ID NO: 1439310 - RNA, 18 nt, Human
uagcucaaugagcauguu

SEQ ID NO: 1439311 - RNA, 17 nt, Human
uagcucaaugagcaugu

SEQ ID NO: 1439312 - RNA, 16 nt, Human
uagcucaaugagcaug

SEQ ID NO: 1439313 - RNA, 15 nt, Human
uagcucaaugagcau

SEQ ID NO: 1439314 - RNA, 13 nt, Human
uagcucaaugagc

SEQ ID NO: 1439315 - RNA, 12 nt, Human
uagcucaaugag

SEQ ID NO: 1439316 - RNA, 23 nt, Human
uagccuuuuuuccccagacuugu

SEQ ID NO: 1439317 - RNA, 22 nt, Human
uagccuuuuuuccccagacuug

SEQ ID NO: 1439318 - RNA, 20 nt, Human
uagccuuuuuuccccagacu

SEQ ID NO: 1439319 - RNA, 19 nt, Human
uagccuuuuuuccccagac

SEQ ID NO: 1439320 - RNA, 22 nt, Human
uagccuuuuuguauaaaauaga

SEQ ID NO: 1439321 - RNA, 17 nt, Human
uagccuuuuuguauaaa

SEQ ID NO: 1439322 - RNA, 15 nt, Human
uagccuuuuuguaua

SEQ ID NO: 1439323 - RNA, 15 nt, Human
uagccuucucuguuc

SEQ ID NO: 1439324 - RNA, 14 nt, Human
uagccuucucuguu

SEQ ID NO: 1439325 - RNA, 13 nt, Human
uagccuucucugu

SEQ ID NO: 1439326 - RNA, 15 nt, Human
acaaugacaaagcag

SEQ ID NO: 1439327 - RNA, 23 nt, Human
acaaugaauaaaaacucaaggag

SEQ ID NO: 1439328 - RNA, 18 nt, Human
acaaugaaaacucuuugc

SEQ ID NO: 1439329 - RNA, 21 nt, Human
acaaugaaaacucuuugcugc

SEQ ID NO: 1439330 - RNA, 24 nt, Human
acaaugaacaucccuuuuucaaug

SEQ ID NO: 1439331 - RNA, 14 nt, Human
uagccuugcuuguu

SEQ ID NO: 1439332 - RNA, 15 nt, Human
uagccuugcuuguua

SEQ ID NO: 1439333 - RNA, 13 nt, Human
uagccuugcuugu

SEQ ID NO: 1439334 - RNA, 12 nt, Human
uagccuugcuug

SEQ ID NO: 1439335 - RNA, 22 nt, Human
uagccuucucuguucauuuccu

SEQ ID NO: 1439336 - RNA, 20 nt, Human
uagccuucucuguucauuuc

SEQ ID NO: 1439337 - RNA, 16 nt, Human
uagccuucucuguuca

SEQ ID NO: 1439338 - RNA, 16 nt, Human
uagcuacuaauuuuaa

SEQ ID NO: 1439339 - RNA, 16 nt, Human
acaaaacuagagacuc

SEQ ID NO: 1439340 - RNA, 23 nt, Human
acaaaacuacaugagaacaaaca

SEQ ID NO: 1439341 - RNA, 17 nt, Human
acaaaacuacaugagaa

SEQ ID NO: 1439342 - RNA, 19 nt, Human
aauuuuuuuuuccuagccc

SEQ ID NO: 1439343 - RNA, 16 nt, Human
acaaaacugcauuuca

SEQ ID NO: 1439344 - RNA, 23 nt, Human
acaaaagaagcccggcuccuggu

SEQ ID NO: 1439345 - RNA, 20 nt, Human
acaaaagaagcccggcuccu

SEQ ID NO: 1439346 - RNA, 14 nt, Human
acaaaacugcauuu

SEQ ID NO: 1439347 - RNA, 16 nt, Human
acaaagcccuuuuaua

SEQ ID NO: 1439348 - RNA, 15 nt, Human
acaaagcccuuuuau

SEQ ID NO: 1439349 - RNA, 15 nt, Human
acaaaggagccugug

SEQ ID NO: 1439350 - RNA, 14 nt, Human
acaaaggagccugu

SEQ ID NO: 1439351 - RNA, 23 nt, Human
acaaaggagccugugaacccagg

SEQ ID NO: 1439352 - RNA, 13 nt, Human
acaaaggagccug

SEQ ID NO: 1439353 - RNA, 19 nt, Human
acaaaguuuaccagaaagc

SEQ ID NO: 1439354 - RNA, 16 nt, Human
acaaaggagccuguga

SEQ ID NO: 1439355 - RNA, 19 nt, Human
uagcaaagauaucucaucu

SEQ ID NO: 1439356 - RNA, 17 nt, Human
uagcaaagauaucucau

SEQ ID NO: 1439357 - RNA, 22 nt, Human
uagaugcauuuggguccaggag

SEQ ID NO: 1439358 - RNA, 23 nt, Human
uagaugcauuuggguccaggagg

SEQ ID NO: 1439359 - RNA, 21 nt, Human
uagaugcauuuggguccagga

SEQ ID NO: 1439360 - RNA, 20 nt, Human
uagaugcauuuggguccagg

SEQ ID NO: 1439361 - RNA, 19 nt, Human
uagaugcauuuggguccag

SEQ ID NO: 1439362 - RNA, 15 nt, Human
uagaugcauuugggu

SEQ ID NO: 1439363 - RNA, 21 nt, Human
uagaugcaguucugaagaaga

SEQ ID NO: 1439364 - RNA, 16 nt, Human
uagaugaaguuuuaca

SEQ ID NO: 1439365 - RNA, 15 nt, Human
uagaugaacucaacu

SEQ ID NO: 1439366 - RNA, 15 nt, Human
uagaucuggcauguu

SEQ ID NO: 1439367 - RNA, 13 nt, Human
uagaucucugaag

SEQ ID NO: 1439368 - RNA, 16 nt, Human
uagaucuggcauguua

SEQ ID NO: 1439369 - RNA, 23 nt, Human
acaaauauuuauuuucuuucugu

SEQ ID NO: 1439370 - RNA, 22 nt, Human
acaaauauuuauuuucuuucug

SEQ ID NO: 1439371 - RNA, 18 nt, Human
acaaauauuuauuuucuu

SEQ ID NO: 1439372 - RNA, 12 nt, Human
acaaauauuuau

SEQ ID NO: 1439373 - RNA, 21 nt, Human
acaaauagucggauuagaaau

SEQ ID NO: 1439374 - RNA, 17 nt, Human
uagauaguuagaaccug

SEQ ID NO: 1439375 - RNA, 17 nt, Human
uagauaggccaugggca

SEQ ID NO: 1439376 - RNA, 22 nt, Human
uagauaggucagugcaaauacu

SEQ ID NO: 1439377 - RNA, 14 nt, Human
aauuuuuuuuaaca

SEQ ID NO: 1439378 - RNA, 18 nt, Human
aauuuuuuuguauuuuag

SEQ ID NO: 1439379 - RNA, 22 nt, Human
aauuuuuuuaucgucacugcuu

SEQ ID NO: 1439380 - RNA, 18 nt, Human
aauuuuuuuagaaagcau

SEQ ID NO: 1439381 - RNA, 20 nt, Human
aauuuuuuuagaaagcauuu

SEQ ID NO: 1439382 - RNA, 23 nt, Human
aauuuuuuuuauuaguauuguug

SEQ ID NO: 1439383 - RNA, 22 nt, Human
aauuuuuuuuauuaguauuguu

SEQ ID NO: 1439384 - RNA, 20 nt, Human
aauuuuuuuuauuaguauug

SEQ ID NO: 1439385 - RNA, 19 nt, Human
aauuuuuuuuaacauuccu

SEQ ID NO: 1439386 - RNA, 18 nt, Human
aauuuuuuuuaacauucc

SEQ ID NO: 1439387 - RNA, 17 nt, Human
aauuuuuuuuaacauuc

SEQ ID NO: 1439388 - RNA, 15 nt, Human
aauuuuuuuuaacau

SEQ ID NO: 1439389 - RNA, 12 nt, Human
aauuuuuuuuac

SEQ ID NO: 1439390 - RNA, 16 nt, Human
aauuuuuuuuacauuu

SEQ ID NO: 1439391 - RNA, 19 nt, Human
aauuuuuuuaauuuacaaa

SEQ ID NO: 1439392 - RNA, 15 nt, Human
aauuuuuuuagaaag

SEQ ID NO: 1439393 - RNA, 17 nt, Human
aauuuuuuguugacauu

SEQ ID NO: 1439394 - RNA, 22 nt, Human
aauuuuuuguugacauuagucu

SEQ ID NO: 1439395 - RNA, 14 nt, Human
aauuuuuguaauuu

SEQ ID NO: 1439396 - RNA, 16 nt, Human
aauuuuucuucuugag

SEQ ID NO: 1439397 - RNA, 14 nt, Human
aauuuuucuucuug

SEQ ID NO: 1439398 - RNA, 13 nt, Human
aauuuuucuucuu

SEQ ID NO: 1439399 - RNA, 13 nt, Human
aauuuuugauacu

SEQ ID NO: 1439400 - RNA, 16 nt, Human
aauuuuuacagaauug

SEQ ID NO: 1439401 - RNA, 14 nt, Human
aauuuuuacagaau

SEQ ID NO: 1439402 - RNA, 12 nt, Human
aauuuguugcau

SEQ ID NO: 1439403 - RNA, 21 nt, Human
aauuuguucuuguauuuauug

SEQ ID NO: 1439404 - RNA, 16 nt, Human
aauuuguucuuguauu

SEQ ID NO: 1439405 - RNA, 15 nt, Human
aauuuguucuuguau

SEQ ID NO: 1439406 - RNA, 19 nt, Human
aauuuuuaaacaaguauuu

SEQ ID NO: 1439407 - RNA, 15 nt, Human
aauuuuuaaacaagu

SEQ ID NO: 1439408 - RNA, 13 nt, Human
aauuuuuaaacaa

SEQ ID NO: 1439409 - RNA, 22 nt, Human
aauuuuuaaucuuuaauuuuac

SEQ ID NO: 1439410 - RNA, 14 nt, Human
aauuuguucuugua

SEQ ID NO: 1439411 - RNA, 18 nt, Human
aauuuguuauuuugcaac

SEQ ID NO: 1439412 - RNA, 21 nt, Human
aauuugguuuucacauuggaa

SEQ ID NO: 1439413 - RNA, 15 nt, Human
aauuugguuuucaca

SEQ ID NO: 1439414 - RNA, 22 nt, Human
aauuugccuguaacaagccaga

SEQ ID NO: 1439415 - RNA, 16 nt, Human
aauuugccuguaacaa

SEQ ID NO: 1439416 - RNA, 15 nt, Human
aauuugccugcuggg

SEQ ID NO: 1439417 - RNA, 13 nt, Human
aauuugccugcug

SEQ ID NO: 1439418 - RNA, 20 nt, Human
aauuugcauuaaauuacaga

SEQ ID NO: 1439419 - RNA, 23 nt, Human
aauuugcauuaaauucacaaacu

SEQ ID NO: 1439420 - RNA, 21 nt, Human
aauuugggggacuuacaugau

SEQ ID NO: 1439421 - RNA, 18 nt, Human
aauuugggggacuuacau

SEQ ID NO: 1439422 - RNA, 13 nt, Human
aauuugguuuuca

SEQ ID NO: 1439423 - RNA, 21 nt, Human
uacuuuuaaacagugagccug

SEQ ID NO: 1439424 - RNA, 15 nt, Human
uacuuuuaaacugug

SEQ ID NO: 1439425 - RNA, 14 nt, Human
uacuuuuaaacugu

SEQ ID NO: 1439426 - RNA, 21 nt, Human
aauuugcauuaaauucacaaa

SEQ ID NO: 1439427 - RNA, 18 nt, Human
aauuugcauuaaauucac

SEQ ID NO: 1439428 - RNA, 17 nt, Human
aauuugcauuaaauuca

SEQ ID NO: 1439429 - RNA, 17 nt, Human
aauuugcauuaaauuac

SEQ ID NO: 1439430 - RNA, 15 nt, Human
aauuugcauuaaauu

SEQ ID NO: 1439431 - RNA, 13 nt, Human
uacuuuuuguuau

SEQ ID NO: 1439432 - RNA, 17 nt, Human
uacuuccccauggcccu

SEQ ID NO: 1439433 - RNA, 14 nt, Human
uacuuccaaacuaa

SEQ ID NO: 1439434 - RNA, 19 nt, Human
uacuuauuuuugacagugu

SEQ ID NO: 1439435 - RNA, 17 nt, Human
uacuuauuuuugacagu

SEQ ID NO: 1439436 - RNA, 18 nt, Human
uacuuauuuguauauggu

SEQ ID NO: 1439437 - RNA, 18 nt, Human
uacuucgacacuguucuu

SEQ ID NO: 1439438 - RNA, 20 nt, Human
uacuucggggcugggaaguc

SEQ ID NO: 1439439 - RNA, 16 nt, Human
uacuuccuccucccca

SEQ ID NO: 1439440 - RNA, 14 nt, Human
uacuuccuccuccc

SEQ ID NO: 1439441 - RNA, 20 nt, Human
aauuugauugauuugaagaa

SEQ ID NO: 1439442 - RNA, 17 nt, Human
aauuugauugauuugaa

SEQ ID NO: 1439443 - RNA, 16 nt, Human
uacuuauauggaaauu

SEQ ID NO: 1439444 - RNA, 17 nt, Human
uacuuauauaauugcca

SEQ ID NO: 1439445 - RNA, 16 nt, Human
aauuugauugauuuga

SEQ ID NO: 1439446 - RNA, 15 nt, Human
aauuugauugauuug

SEQ ID NO: 1439447 - RNA, 14 nt, Human
aauuugauugauuu

SEQ ID NO: 1439448 - RNA, 13 nt, Human
aauuugauugauu

SEQ ID NO: 1439449 - RNA, 12 nt, Human
aauuugauugau

SEQ ID NO: 1439450 - RNA, 17 nt, Human
aauuugauuauuaacau

SEQ ID NO: 1439451 - RNA, 15 nt, Human
aauuugaaacacuuu

SEQ ID NO: 1439452 - RNA, 14 nt, Human
uacuucuugaaggu

SEQ ID NO: 1439453 - RNA, 20 nt, Human
uacuucuguaauugugugga

SEQ ID NO: 1439454 - RNA, 17 nt, Human
uacuucuguaauugugu

SEQ ID NO: 1439455 - RNA, 16 nt, Human
uacuucuguaauugug

SEQ ID NO: 1439456 - RNA, 13 nt, Human
uacuucugaggua

SEQ ID NO: 1439457 - RNA, 20 nt, Human
uacuucucauuuuuuaaaaa

SEQ ID NO: 1439458 - RNA, 22 nt, Human
uacuucguguccgacucuucug

SEQ ID NO: 1439459 - RNA, 19 nt, Human
uacuucuuaggguuaugau

SEQ ID NO: 1439460 - RNA, 14 nt, Human
uacuuugacuuuuu

SEQ ID NO: 1439461 - RNA, 15 nt, Human
uacuuugacaguguu

SEQ ID NO: 1439462 - RNA, 22 nt, Human
uacuuugaauguguuucacagu

SEQ ID NO: 1439463 - RNA, 20 nt, Human
uacuuugaauguguuucaca

SEQ ID NO: 1439464 - RNA, 18 nt, Human
uacuuugaauguguuuca

SEQ ID NO: 1439465 - RNA, 14 nt, Human
uacuuugaaugugu

SEQ ID NO: 1439466 - RNA, 13 nt, Human
uacuuugaaugug

SEQ ID NO: 1439467 - RNA, 18 nt, Human
uacuuugaagucauacca

SEQ ID NO: 1439468 - RNA, 14 nt, Human
uacuuugaagucau

SEQ ID NO: 1439469 - RNA, 15 nt, Human
uacuuugugcauucu

SEQ ID NO: 1439470 - RNA, 20 nt, Human
uacuuugacaguguuuuuag

SEQ ID NO: 1439471 - RNA, 19 nt, Human
uacuuucccuacccucuag

SEQ ID NO: 1439472 - RNA, 21 nt, Human
uacuuucccuacccucuagag

SEQ ID NO: 1439473 - RNA, 18 nt, Human
uacuuucccuacccucua

SEQ ID NO: 1439474 - RNA, 15 nt, Human
uacuuucccuacccu

SEQ ID NO: 1439475 - RNA, 22 nt, Human
uacuucuguaauuguguggauu

SEQ ID NO: 1439476 - RNA, 19 nt, Human
uacuucuuguguguaugca

SEQ ID NO: 1439477 - RNA, 20 nt, Human
uacuucuuuuuucaaaagaa

SEQ ID NO: 1439478 - RNA, 22 nt, Human
uacuucuuuuuucaaaagaaag

SEQ ID NO: 1439479 - RNA, 15 nt, Human
uacuugaaaauuaac

SEQ ID NO: 1439480 - RNA, 16 nt, Human
aauuuaguguauccau

SEQ ID NO: 1439481 - RNA, 17 nt, Human
aauuuaguguauccaua

SEQ ID NO: 1439482 - RNA, 13 nt, Human
aauuuaguauuuu

SEQ ID NO: 1439483 - RNA, 19 nt, Human
aauugcuuguuugcuucaa

SEQ ID NO: 1439484 - RNA, 16 nt, Human
aauugcuuguuugcuu

SEQ ID NO: 1439485 - RNA, 19 nt, Human
aauugcuuauuuauuguau

SEQ ID NO: 1439486 - RNA, 22 nt, Human
aauugcuuauuuauuguauucu

SEQ ID NO: 1439487 - RNA, 13 nt, Human
aauugcuuauuua

SEQ ID NO: 1439488 - RNA, 23 nt, Human
aauugcauugacuuuccccacca

SEQ ID NO: 1439489 - RNA, 20 nt, Human
aauuggaagcugcccugccc

SEQ ID NO: 1439490 - RNA, 15 nt, Human
aauuggaaagcaggu

SEQ ID NO: 1439491 - RNA, 15 nt, Human
aauuggagcucgugg

SEQ ID NO: 1439492 - RNA, 13 nt, Human
aauuuaaauguua

SEQ ID NO: 1439493 - RNA, 11 nt, Human
aauuuaaaugu

SEQ ID NO: 1439494 - RNA, 17 nt, Human
aauuucuaggacugaau

SEQ ID NO: 1439495 - RNA, 17 nt, Human
aauuuauuauggcacau

SEQ ID NO: 1439496 - RNA, 22 nt, Human
aauuucuaggacugaauuauga

SEQ ID NO: 1439497 - RNA, 18 nt, Human
aauuucuaggacugaauu

SEQ ID NO: 1439498 - RNA, 13 nt, Human
aauuuauuauggc

SEQ ID NO: 1439499 - RNA, 14 nt, Human
aauuuauuauggca

SEQ ID NO: 1439500 - RNA, 20 nt, Human
aauuucuuaacuucuugcuu

SEQ ID NO: 1439501 - RNA, 16 nt, Human
aauuucuuaacuucuu

SEQ ID NO: 1439502 - RNA, 15 nt, Human
aauuucuuaacuucu

SEQ ID NO: 1439503 - RNA, 23 nt, Human
aauuucuaggacugaauuaugaa

SEQ ID NO: 1439504 - RNA, 16 nt, Human
aauuuauauuguaaau

SEQ ID NO: 1439505 - RNA, 22 nt, Human
aauuuauaaaaagguguuuuga

SEQ ID NO: 1439506 - RNA, 16 nt, Human
aauuuauaaaaaggug

SEQ ID NO: 1439507 - RNA, 21 nt, Human
aauuuaguuucauauaaagua

SEQ ID NO: 1439508 - RNA, 22 nt, Human
aauuuaguuucauauaaaguau

SEQ ID NO: 1439509 - RNA, 14 nt, Human
aauuuaguuucaua

SEQ ID NO: 1439510 - RNA, 12 nt, Human
aauuuaguuuca

SEQ ID NO: 1439511 - RNA, 23 nt, Human
aauuuauaacguguucaauauuu

SEQ ID NO: 1439512 - RNA, 22 nt, Human
aauuuauaaacuuuuuucuuac

SEQ ID NO: 1439513 - RNA, 19 nt, Human
aauugaauacuuugaaugu

SEQ ID NO: 1439514 - RNA, 18 nt, Human
aauugaauacuuugaaug

SEQ ID NO: 1439515 - RNA, 16 nt, Human
aauugaauacuuugaa

SEQ ID NO: 1439516 - RNA, 16 nt, Human
aauguguguauaugga

SEQ ID NO: 1439517 - RNA, 17 nt, Human
aauguguguauauggac

SEQ ID NO: 1439518 - RNA, 15 nt, Human
aauguguguauaugg

SEQ ID NO: 1439519 - RNA, 13 nt, Human
aauguguguauau

SEQ ID NO: 1439520 - RNA, 17 nt, Human
aaugugucuuuagauag

SEQ ID NO: 1439521 - RNA, 23 nt, Human
aaugugucuuuagauagcccugu

SEQ ID NO: 1439522 - RNA, 15 nt, Human
aaugugucuuuagau

SEQ ID NO: 1439523 - RNA, 14 nt, Human
aaugugucuuuaga

SEQ ID NO: 1439524 - RNA, 13 nt, Human
aaugugucuuuag

SEQ ID NO: 1439525 - RNA, 12 nt, Human
aaugugucuuua

SEQ ID NO: 1439526 - RNA, 11 nt, Human
aaugugucuuu

SEQ ID NO: 1439527 - RNA, 14 nt, Human
aauguguauaaaca

SEQ ID NO: 1439528 - RNA, 15 nt, Human
aauguguauaaacaa

SEQ ID NO: 1439529 - RNA, 22 nt, Human
aauguguaguucauguaaauaa

SEQ ID NO: 1439530 - RNA, 21 nt, Human
aauguguaguucauguaaaua

SEQ ID NO: 1439531 - RNA, 16 nt, Human
aauguguaguucaugu

SEQ ID NO: 1439532 - RNA, 16 nt, Human
aaugugguagccucac

SEQ ID NO: 1439533 - RNA, 14 nt, Human
aaugugauguucua

SEQ ID NO: 1439534 - RNA, 14 nt, Human
aaugugggauuaug

SEQ ID NO: 1439535 - RNA, 18 nt, Human
aauugaaugcaaaccaua

SEQ ID NO: 1439536 - RNA, 15 nt, Human
aauugaauauuauuc

SEQ ID NO: 1439537 - RNA, 22 nt, Human
aauugaaucacugcucacacug

SEQ ID NO: 1439538 - RNA, 15 nt, Human
aauugaaucacugcu

SEQ ID NO: 1439539 - RNA, 14 nt, Human
aauugaauauuauu

SEQ ID NO: 1439540 - RNA, 21 nt, Human
aauugaauacuuugaaugugu

SEQ ID NO: 1439541 - RNA, 15 nt, Human
uacgcuuugauucau

SEQ ID NO: 1439542 - RNA, 14 nt, Human
uacgcuuugauuca

SEQ ID NO: 1439543 - RNA, 14 nt, Human
uacgcuguccagaa

SEQ ID NO: 1439544 - RNA, 17 nt, Human
uacggacagagaccaag

SEQ ID NO: 1439545 - RNA, 17 nt, Human
uacggauuuucaguuac

SEQ ID NO: 1439546 - RNA, 15 nt, Human
uacggauuuucaguu

SEQ ID NO: 1439547 - RNA, 19 nt, Human
uacuagagucugaacagcu

SEQ ID NO: 1439548 - RNA, 12 nt, Human
uacuauuucaca

SEQ ID NO: 1439549 - RNA, 13 nt, Human
uacuauuucacaa

SEQ ID NO: 1439550 - RNA, 16 nt, Human
uacuauuuaacugacu

SEQ ID NO: 1439551 - RNA, 19 nt, Human
uacuauuuaacugacuauu

SEQ ID NO: 1439552 - RNA, 14 nt, Human
uacuauuuaacuga

SEQ ID NO: 1439553 - RNA, 13 nt, Human
uacuauuuaacug

SEQ ID NO: 1439554 - RNA, 12 nt, Human
uacuauuuaacu

SEQ ID NO: 1439555 - RNA, 22 nt, Human
uacuauuuaaagccuccucauc

SEQ ID NO: 1439556 - RNA, 21 nt, Human
uacuauuuaaagccuccucau

SEQ ID NO: 1439557 - RNA, 19 nt, Human
uacuauuuaaagccuccuc

SEQ ID NO: 1439558 - RNA, 12 nt, Human
uacuauuuaaag

SEQ ID NO: 1439559 - RNA, 21 nt, Human
uacuagggaucccucaucugu

SEQ ID NO: 1439560 - RNA, 20 nt, Human
uacuagggagccauuugaga

SEQ ID NO: 1439561 - RNA, 19 nt, Human
uacuagggagccauuugag

SEQ ID NO: 1439562 - RNA, 18 nt, Human
uacuagggaaaugccuuu

SEQ ID NO: 1439563 - RNA, 22 nt, Human
aauugauuugcauugaacacaa

SEQ ID NO: 1439564 - RNA, 20 nt, Human
aauugauuugcauugaacac

SEQ ID NO: 1439565 - RNA, 16 nt, Human
aauugauuugcauuga

SEQ ID NO: 1439566 - RNA, 14 nt, Human
aauugauuugcauu

SEQ ID NO: 1439567 - RNA, 13 nt, Human
aauugauuugcau

SEQ ID NO: 1439568 - RNA, 22 nt, Human
aauugcacgcggagugaguuuu

SEQ ID NO: 1439569 - RNA, 20 nt, Human
aauugcacaccuuggaauuc

SEQ ID NO: 1439570 - RNA, 20 nt, Human
aauugauuuuuauaaauacu

SEQ ID NO: 1439571 - RNA, 18 nt, Human
aauugcaaaucuugaaau

SEQ ID NO: 1439572 - RNA, 14 nt, Human
aauugcaaaucuug

SEQ ID NO: 1439573 - RNA, 14 nt, Human
aauugauuuugaac

SEQ ID NO: 1439574 - RNA, 13 nt, Human
aauugauuuugaa

SEQ ID NO: 1439575 - RNA, 23 nt, Human
aauugauuugcauugaacacaaa

SEQ ID NO: 1439576 - RNA, 18 nt, Human
aauugcauugacuuuccc

SEQ ID NO: 1439577 - RNA, 11 nt, Human
aauugcauuga

SEQ ID NO: 1439578 - RNA, 21 nt, Human
aauugcauugacuuuccccac

SEQ ID NO: 1439579 - RNA, 20 nt, Human
aauugcauugacuuucccca

SEQ ID NO: 1439580 - RNA, 19 nt, Human
uacuguacagcuggcucua

SEQ ID NO: 1439581 - RNA, 19 nt, Human
aauugagaaaaauauauac

SEQ ID NO: 1439582 - RNA, 23 nt, Human
aauugagaaaaauauauacuaaa

SEQ ID NO: 1439583 - RNA, 18 nt, Human
uacuguacaugaaaacac

SEQ ID NO: 1439584 - RNA, 15 nt, Human
aauugagaaggaaaa

SEQ ID NO: 1439585 - RNA, 18 nt, Human
aauugaggacacugauau

SEQ ID NO: 1439586 - RNA, 16 nt, Human
uacuguaauuccucaa

SEQ ID NO: 1439587 - RNA, 15 nt, Human
uacuguaauuccuca

SEQ ID NO: 1439588 - RNA, 13 nt, Human
uacuguaauuccu

SEQ ID NO: 1439589 - RNA, 19 nt, Human
uacuguacagacagaaaaa

SEQ ID NO: 1439590 - RNA, 14 nt, Human
uacuguacagcugg

SEQ ID NO: 1439591 - RNA, 23 nt, Human
uacuguacagacagaaaaaacug

SEQ ID NO: 1439592 - RNA, 18 nt, Human
uacugguccaaaagauug

SEQ ID NO: 1439593 - RNA, 13 nt, Human
uacugguccaaaa

SEQ ID NO: 1439594 - RNA, 24 nt, Human
uacuggggaaacuggccauggccu

SEQ ID NO: 1439595 - RNA, 21 nt, Human
uacuggggaaacuggccaugg

SEQ ID NO: 1439596 - RNA, 19 nt, Human
uacuggggaaacuggccau

SEQ ID NO: 1439597 - RNA, 16 nt, Human
uacuggggaaacuggc

SEQ ID NO: 1439598 - RNA, 17 nt, Human
uacugggaaggcuacuu

SEQ ID NO: 1439599 - RNA, 13 nt, Human
uacugggaaggcu

SEQ ID NO: 1439600 - RNA, 22 nt, Human
uacugacuuugcuugcuuugaa

SEQ ID NO: 1439601 - RNA, 20 nt, Human
uacugacuuugcuugcuuug

SEQ ID NO: 1439602 - RNA, 18 nt, Human
uacugacuuugcuugcuu

SEQ ID NO: 1439603 - RNA, 18 nt, Human
uacuggucuuguggaauu

SEQ ID NO: 1439604 - RNA, 19 nt, Human
uacuggucucucuaugccu

SEQ ID NO: 1439605 - RNA, 13 nt, Human
uacuggucucucu

SEQ ID NO: 1439606 - RNA, 12 nt, Human
uacuggucucuc

SEQ ID NO: 1439607 - RNA, 22 nt, Human
uacuggggaaacuggccauggc

SEQ ID NO: 1439608 - RNA, 23 nt, Human
uacugguccaaaagauugcugaa

SEQ ID NO: 1439609 - RNA, 15 nt, Human
uacuguaauuuguga

SEQ ID NO: 1439610 - RNA, 16 nt, Human
uacuguaauuugugau

SEQ ID NO: 1439611 - RNA, 17 nt, Human
uacuguaauuugugaua

SEQ ID NO: 1439612 - RNA, 16 nt, Human
uacucuuucuguauau

SEQ ID NO: 1439613 - RNA, 15 nt, Human
uacucuuucuguaua

SEQ ID NO: 1439614 - RNA, 14 nt, Human
uacucuuucuguau

SEQ ID NO: 1439615 - RNA, 22 nt, Human
uacucuccccacgagggcuggc

SEQ ID NO: 1439616 - RNA, 13 nt, Human
uacucuuucugua

SEQ ID NO: 1439617 - RNA, 20 nt, Human
uacucuccccacgagggcug

SEQ ID NO: 1439618 - RNA, 15 nt, Human
uacucuccccacgag

SEQ ID NO: 1439619 - RNA, 14 nt, Human
uacucuagaugaag

SEQ ID NO: 1439620 - RNA, 17 nt, Human
uacugacuuugcuugcu

SEQ ID NO: 1439621 - RNA, 16 nt, Human
uacugacuuugcuugc

SEQ ID NO: 1439622 - RNA, 22 nt, Human
uacugacauguggggccagguc

SEQ ID NO: 1439623 - RNA, 22 nt, Human
uacugaaauaaacgucuuaaau

SEQ ID NO: 1439624 - RNA, 19 nt, Human
uacugaaauaaacgucuua

SEQ ID NO: 1439625 - RNA, 15 nt, Human
uauccuccaccgucu

SEQ ID NO: 1439626 - RNA, 16 nt, Human
uauccuaucucuccaa

SEQ ID NO: 1439627 - RNA, 20 nt, Human
uaucucagaaagugccugac

SEQ ID NO: 1439628 - RNA, 19 nt, Human
uaucucagaaagugccuga

SEQ ID NO: 1439629 - RNA, 13 nt, Human
uaucucagaaagu

SEQ ID NO: 1439630 - RNA, 12 nt, Human
uaucucagaaag

SEQ ID NO: 1439631 - RNA, 10 nt, Human
uaucucagaa

SEQ ID NO: 1439632 - RNA, 19 nt, Human
uaucccuccuguugggaga

SEQ ID NO: 1439633 - RNA, 20 nt, Human
uaucccuccuguugggagag

SEQ ID NO: 1439634 - RNA, 14 nt, Human
uaucccuccuguug

SEQ ID NO: 1439635 - RNA, 15 nt, Human
uaucccucaccugua

SEQ ID NO: 1439636 - RNA, 15 nt, Human
uaucccuacauguau

SEQ ID NO: 1439637 - RNA, 19 nt, Human
uaucccuacuguaauuugu

SEQ ID NO: 1439638 - RNA, 20 nt, Human
uaucccuacuguaauuugug

SEQ ID NO: 1439639 - RNA, 20 nt, Human
uauauuuauuacuguaagaa

SEQ ID NO: 1439640 - RNA, 19 nt, Human
uauauuuauuacuguaaga

SEQ ID NO: 1439641 - RNA, 15 nt, Human
uauauuuauuacugu

SEQ ID NO: 1439642 - RNA, 14 nt, Human
acagagagucugga

SEQ ID NO: 1439643 - RNA, 12 nt, Human
uaucucuguguu

SEQ ID NO: 1439644 - RNA, 23 nt, Human
uaucucugugugcacaaauauuu

SEQ ID NO: 1439645 - RNA, 18 nt, Human
uaucucugugugcacaaa

SEQ ID NO: 1439646 - RNA, 17 nt, Human
uaucucugugugcacaa

SEQ ID NO: 1439647 - RNA, 16 nt, Human
uaucucugugugcaca

SEQ ID NO: 1439648 - RNA, 11 nt, Human
uaucucugugu

SEQ ID NO: 1439649 - RNA, 20 nt, Human
uaucucuacugaaugucauu

SEQ ID NO: 1439650 - RNA, 14 nt, Human
acagagccaggaga

SEQ ID NO: 1439651 - RNA, 13 nt, Human
acagagccaggag

SEQ ID NO: 1439652 - RNA, 11 nt, Human
acagagccagg

SEQ ID NO: 1439653 - RNA, 22 nt, Human
acagagccaggagaagcucagc

SEQ ID NO: 1439654 - RNA, 17 nt, Human
acagagccaggagaagc

SEQ ID NO: 1439655 - RNA, 16 nt, Human
acagagccaggagaag

SEQ ID NO: 1439656 - RNA, 16 nt, Human
acagagauucugaacu

SEQ ID NO: 1439657 - RNA, 16 nt, Human
acagagcuucccugac

SEQ ID NO: 1439658 - RNA, 15 nt, Human
acagagcuucccuga

SEQ ID NO: 1439659 - RNA, 14 nt, Human
acagagcuucccug

SEQ ID NO: 1439660 - RNA, 16 nt, Human
acagaguuguuacauu

SEQ ID NO: 1439661 - RNA, 20 nt, Human
acagagccaggagaagcuca

SEQ ID NO: 1439662 - RNA, 23 nt, Human
acagagcuggagaugaggccaga

SEQ ID NO: 1439663 - RNA, 17 nt, Human
acagaguuguuacauuu

SEQ ID NO: 1439664 - RNA, 18 nt, Human
acagaguuguuacauuuu

SEQ ID NO: 1439665 - RNA, 19 nt, Human
acagaguuguuacauuuuu

SEQ ID NO: 1439666 - RNA, 20 nt, Human
acagaguuguuacauuuuua

SEQ ID NO: 1439667 - RNA, 16 nt, Human
acagcaaaugcaaaaa

SEQ ID NO: 1439668 - RNA, 15 nt, Human
acagcaaacaggugc

SEQ ID NO: 1439669 - RNA, 22 nt, Human
acagcaaacaggugcuaauuug

SEQ ID NO: 1439670 - RNA, 14 nt, Human
acagauggccagcc

SEQ ID NO: 1439671 - RNA, 22 nt, Human
acagaugccuccuuccucuuuu

SEQ ID NO: 1439672 - RNA, 18 nt, Human
acagaugccuccuuccuc

SEQ ID NO: 1439673 - RNA, 17 nt, Human
acagaugccuccuuccu

SEQ ID NO: 1439674 - RNA, 13 nt, Human
acagaugccuccu

SEQ ID NO: 1439675 - RNA, 16 nt, Human
acagaugggcaaauua

SEQ ID NO: 1439676 - RNA, 22 nt, Human
acagauggcacuuugaaggggc

SEQ ID NO: 1439677 - RNA, 21 nt, Human
acagaguuguuacauuuuuaa

SEQ ID NO: 1439678 - RNA, 22 nt, Human
acagaguuguuacauuuuuaag

SEQ ID NO: 1439679 - RNA, 23 nt, Human
uaucuuggugaauuuuuuuuucc

SEQ ID NO: 1439680 - RNA, 20 nt, Human
acagcaacaauuuaugaauu

SEQ ID NO: 1439681 - RNA, 17 nt, Human
acagcaacaauuuauga

SEQ ID NO: 1439682 - RNA, 16 nt, Human
acagcaaggagauuua

SEQ ID NO: 1439683 - RNA, 14 nt, Human
acagcaaccccagg

SEQ ID NO: 1439684 - RNA, 21 nt, Human
acagcccuucuuuccacagaa

SEQ ID NO: 1439685 - RNA, 20 nt, Human
acagcccuucuuuccacaga

SEQ ID NO: 1439686 - RNA, 23 nt, Human
acagaaacuaaacucuuaccaua

SEQ ID NO: 1439687 - RNA, 20 nt, Human
acagaaaccuuuuuaaaaau

SEQ ID NO: 1439688 - RNA, 15 nt, Human
acagaaaccuuuuua

SEQ ID NO: 1439689 - RNA, 17 nt, Human
acagaaacaaaaacacu

SEQ ID NO: 1439690 - RNA, 12 nt, Human
acagaaacaaaa

SEQ ID NO: 1439691 - RNA, 16 nt, Human
acacuuugguaccaga

SEQ ID NO: 1439692 - RNA, 19 nt, Human
acacuuugccauauuuuca

SEQ ID NO: 1439693 - RNA, 22 nt, Human
acacuuugcacugauauaucau

SEQ ID NO: 1439694 - RNA, 19 nt, Human
acacuuugcacugauauau

SEQ ID NO: 1439695 - RNA, 17 nt, Human
acacuuugcacugauau

SEQ ID NO: 1439696 - RNA, 22 nt, Human
acacuuuaauuaccaaccuguu

SEQ ID NO: 1439697 - RNA, 17 nt, Human
acacuuguccacauagg

SEQ ID NO: 1439698 - RNA, 23 nt, Human
acacuguucuuagcucaaugagc

SEQ ID NO: 1439699 - RNA, 16 nt, Human
acacuguuucaaacuu

SEQ ID NO: 1439700 - RNA, 15 nt, Human
acacuguuucaaacu

SEQ ID NO: 1439701 - RNA, 22 nt, Human
uauauucaggacuugaaagaaa

SEQ ID NO: 1439702 - RNA, 12 nt, Human
uauauuauuaua

SEQ ID NO: 1439703 - RNA, 20 nt, Human
uauauuauuacuuguaaaua

SEQ ID NO: 1439704 - RNA, 19 nt, Human
uauauuauuacuuguaaau

SEQ ID NO: 1439705 - RNA, 16 nt, Human
uauauuauuacuugua

SEQ ID NO: 1439706 - RNA, 12 nt, Human
uauauuauuacu

SEQ ID NO: 1439707 - RNA, 13 nt, Human
uauauuaucuuuu

SEQ ID NO: 1439708 - RNA, 19 nt, Human
uauauuuaacucucuuuau

SEQ ID NO: 1439709 - RNA, 15 nt, Human
uauauuuaacaagau

SEQ ID NO: 1439710 - RNA, 15 nt, Human
uauauuuaaaaauaa

SEQ ID NO: 1439711 - RNA, 18 nt, Human
uauauuuaaaagugucaa

SEQ ID NO: 1439712 - RNA, 17 nt, Human
uauauuuaaaaauaagu

SEQ ID NO: 1439713 - RNA, 14 nt, Human
uauauuuaaaaaua

SEQ ID NO: 1439714 - RNA, 12 nt, Human
uauauuuacaaa

SEQ ID NO: 1439715 - RNA, 16 nt, Human
acacucagcacaaggc

SEQ ID NO: 1439716 - RNA, 13 nt, Human
acacucagcacaa

SEQ ID NO: 1439717 - RNA, 19 nt, Human
acacucagauccuccucau

SEQ ID NO: 1439718 - RNA, 20 nt, Human
acacucagaagccugggggc

SEQ ID NO: 1439719 - RNA, 19 nt, Human
acacucagaccugaauucu

SEQ ID NO: 1439720 - RNA, 14 nt, Human
acacucagaccuga

SEQ ID NO: 1439721 - RNA, 19 nt, Human
acacucagaagccuggggg

SEQ ID NO: 1439722 - RNA, 17 nt, Human
acacucagaagccuggg

SEQ ID NO: 1439723 - RNA, 16 nt, Human
acacucagaagccugg

SEQ ID NO: 1439724 - RNA, 15 nt, Human
acacucagaagccug

SEQ ID NO: 1439725 - RNA, 14 nt, Human
acacucagaagccu

SEQ ID NO: 1439726 - RNA, 13 nt, Human
acacucagaagcc

SEQ ID NO: 1439727 - RNA, 16 nt, Human
uauaaguagcaggcca

SEQ ID NO: 1439728 - RNA, 21 nt, Human
uauaaggugcucucuuucugu

SEQ ID NO: 1439729 - RNA, 22 nt, Human
uauaaggugcucucuuucuguc

SEQ ID NO: 1439730 - RNA, 16 nt, Human
uauaaggugcucucuu

SEQ ID NO: 1439731 - RNA, 22 nt, Human
acacucaguggcccauggcauu

SEQ ID NO: 1439732 - RNA, 17 nt, Human
acacucguaugauacuu

SEQ ID NO: 1439733 - RNA, 20 nt, Human
acacucucaaagcaaauaau

SEQ ID NO: 1439734 - RNA, 22 nt, Human
acacuguucuuagcucaaugag

SEQ ID NO: 1439735 - RNA, 21 nt, Human
acacuguucuuagcucaauga

SEQ ID NO: 1439736 - RNA, 18 nt, Human
acacuguucuuagcucaa

SEQ ID NO: 1439737 - RNA, 15 nt, Human
acacuguucuuagcu

SEQ ID NO: 1439738 - RNA, 12 nt, Human
acacuguucuua

SEQ ID NO: 1439739 - RNA, 21 nt, Human
acacucuuuugcuuuauucca

SEQ ID NO: 1439740 - RNA, 23 nt, Human
acacugaaaaaucuaagugauau

SEQ ID NO: 1439741 - RNA, 16 nt, Human
acacucuuuguaagag

SEQ ID NO: 1439742 - RNA, 12 nt, Human
acacucuuugua

SEQ ID NO: 1439743 - RNA, 16 nt, Human
acacucugcuguuuga

SEQ ID NO: 1439744 - RNA, 17 nt, Human
acacucuuucuccugcu

SEQ ID NO: 1439745 - RNA, 13 nt, Human
acacucuguaauu

SEQ ID NO: 1439746 - RNA, 17 nt, Human
acacucugcuguuugac

SEQ ID NO: 1439747 - RNA, 12 nt, Human
acacucugcugu

SEQ ID NO: 1439748 - RNA, 14 nt, Human
acacugaagaagca

SEQ ID NO: 1439749 - RNA, 12 nt, Human
acacugaagaag

SEQ ID NO: 1439750 - RNA, 21 nt, Human
uagcucaaugagcauguuuag

SEQ ID NO: 1439751 - RNA, 16 nt, Human
uagcuuaugaaaagaa

SEQ ID NO: 1439752 - RNA, 19 nt, Human
uagcuuaucuacuuccaaa

SEQ ID NO: 1439753 - RNA, 15 nt, Human
uagcuuaucuacuuc

SEQ ID NO: 1439754 - RNA, 12 nt, Human
uagcuuaugaaa

SEQ ID NO: 1439755 - RNA, 22 nt, Human
uagcuuaucuacuuccaaacua

SEQ ID NO: 1439756 - RNA, 18 nt, Human
acaaugcuguauuuuaaa

SEQ ID NO: 1439757 - RNA, 17 nt, Human
acaaugcuguauuuuaa

SEQ ID NO: 1439758 - RNA, 14 nt, Human
acaaugcuguauuu

SEQ ID NO: 1439759 - RNA, 20 nt, Human
acacaagauugguguuuuuu

SEQ ID NO: 1439760 - RNA, 19 nt, Human
acacaagauugguguuuuu

SEQ ID NO: 1439761 - RNA, 18 nt, Human
acacaagauugguguuuu

SEQ ID NO: 1439762 - RNA, 17 nt, Human
acacaagauugguguuu

SEQ ID NO: 1439763 - RNA, 16 nt, Human
acacaagauugguguu

SEQ ID NO: 1439764 - RNA, 22 nt, Human
acacaagaagaagggcacccua

SEQ ID NO: 1439765 - RNA, 13 nt, Human
acacaacucacuc

SEQ ID NO: 1439766 - RNA, 21 nt, Human
acaauguagauaaguguucug

SEQ ID NO: 1439767 - RNA, 20 nt, Human
acaauguagauaaguguucu

SEQ ID NO: 1439768 - RNA, 17 nt, Human
acaauguagauaagugu

SEQ ID NO: 1439769 - RNA, 18 nt, Human
acaauguaauuauuuaug

SEQ ID NO: 1439770 - RNA, 15 nt, Human
acaauguaauuauuu

SEQ ID NO: 1439771 - RNA, 13 nt, Human
acaauguaauuau

SEQ ID NO: 1439772 - RNA, 12 nt, Human
acaauguaauua

SEQ ID NO: 1439773 - RNA, 17 nt, Human
acacaacuauauuguuu

SEQ ID NO: 1439774 - RNA, 12 nt, Human
acacacaguacg

SEQ ID NO: 1439775 - RNA, 17 nt, Human
acacaccaggcgcuaau

SEQ ID NO: 1439776 - RNA, 14 nt, Human
acacaccaggcgcu

SEQ ID NO: 1439777 - RNA, 23 nt, Human
acacacauugcugugaacaggaa

SEQ ID NO: 1439778 - RNA, 20 nt, Human
acacaccuguagcacuuacu

SEQ ID NO: 1439779 - RNA, 11 nt, Human
acacaccugua

SEQ ID NO: 1439780 - RNA, 13 nt, Human
acacacugaagaa

SEQ ID NO: 1439781 - RNA, 14 nt, Human
uaguaauagccugg

SEQ ID NO: 1439782 - RNA, 12 nt, Human
uaguccugugaa

SEQ ID NO: 1439783 - RNA, 12 nt, Human
uagucgugagcu

SEQ ID NO: 1439784 - RNA, 22 nt, Human
uaguccugugaaugccacugcc

SEQ ID NO: 1439785 - RNA, 11 nt, Human
uaguccuguga

SEQ ID NO: 1439786 - RNA, 21 nt, Human
uagucgugagcucuugugagg

SEQ ID NO: 1439787 - RNA, 17 nt, Human
uaguguuggagaagaac

SEQ ID NO: 1439788 - RNA, 16 nt, Human
uaguguuggagaagaa

SEQ ID NO: 1439789 - RNA, 21 nt, Human
uagucuuuugcuuuuggcaaa

SEQ ID NO: 1439790 - RNA, 16 nt, Human
uagucuuuugcuuuug

SEQ ID NO: 1439791 - RNA, 15 nt, Human
uagucuuuugcuuuu

SEQ ID NO: 1439792 - RNA, 12 nt, Human
uaguguuggaga

SEQ ID NO: 1439793 - RNA, 17 nt, Human
uagucucagugaagacu

SEQ ID NO: 1439794 - RNA, 15 nt, Human
uagucucagugaaga

SEQ ID NO: 1439795 - RNA, 14 nt, Human
uagucuuuugcuuu

SEQ ID NO: 1439796 - RNA, 13 nt, Human
uagucuuuugcuu

SEQ ID NO: 1439797 - RNA, 12 nt, Human
uagucuuuugcu

SEQ ID NO: 1439798 - RNA, 15 nt, Human
uagucuuuggagaaa

SEQ ID NO: 1439799 - RNA, 12 nt, Human
acacaguauuuu

SEQ ID NO: 1439800 - RNA, 12 nt, Human
acacagcugccg

SEQ ID NO: 1439801 - RNA, 11 nt, Human
acacagcugcc

SEQ ID NO: 1439802 - RNA, 14 nt, Human
acacacugaagaag

SEQ ID NO: 1439803 - RNA, 19 nt, Human
uagguugcacacuuuggua

SEQ ID NO: 1439804 - RNA, 14 nt, Human
uagguuucaaagau

SEQ ID NO: 1439805 - RNA, 11 nt, Human
uagguuucaaa

SEQ ID NO: 1439806 - RNA, 22 nt, Human
uagguuuggacaaaauggaaua

SEQ ID NO: 1439807 - RNA, 22 nt, Human
uaguucagcauccgcaggugcu

SEQ ID NO: 1439808 - RNA, 22 nt, Human
uaguuuugauuuaauguuuuca

SEQ ID NO: 1439809 - RNA, 23 nt, Human
uaguucagaauuuaguguaucca

SEQ ID NO: 1439810 - RNA, 16 nt, Human
uaguucagaauuuagu

SEQ ID NO: 1439811 - RNA, 21 nt, Human
uaguuuuucauuaaauaaauu

SEQ ID NO: 1439812 - RNA, 14 nt, Human
uaguuuuucauuaa

SEQ ID NO: 1439813 - RNA, 15 nt, Human
uaguuuuuauauguu

SEQ ID NO: 1439814 - RNA, 17 nt, Human
uagucuuuugcuuuugc

SEQ ID NO: 1439815 - RNA, 23 nt, Human
uauaaaauaugaagacauaaacc

SEQ ID NO: 1439816 - RNA, 14 nt, Human
uauaaaaucagcca

SEQ ID NO: 1439817 - RNA, 21 nt, Human
uauaaaauaugaagacauaaa

SEQ ID NO: 1439818 - RNA, 16 nt, Human
uauaaaaucagccaau

SEQ ID NO: 1439819 - RNA, 17 nt, Human
uauaaaaucagccaauu

SEQ ID NO: 1439820 - RNA, 19 nt, Human
uauaaaaucagccaauuau

SEQ ID NO: 1439821 - RNA, 20 nt, Human
uauaaaaucagccaauuaug

SEQ ID NO: 1439822 - RNA, 19 nt, Human
uauaaaauagacaaauaga

SEQ ID NO: 1439823 - RNA, 12 nt, Human
uauaaaauagac

SEQ ID NO: 1439824 - RNA, 12 nt, Human
uauaaaauacag

SEQ ID NO: 1439825 - RNA, 15 nt, Human
uauaaaacuuuccuc

SEQ ID NO: 1439826 - RNA, 19 nt, Human
uauaaaaauaaaaaagauc

SEQ ID NO: 1439827 - RNA, 22 nt, Human
uauaaaaauaaaaaagauccca

SEQ ID NO: 1439828 - RNA, 17 nt, Human
uaguuuuuucaucuuca

SEQ ID NO: 1439829 - RNA, 15 nt, Human
uaguuuuuucaucuu

SEQ ID NO: 1439830 - RNA, 14 nt, Human
uaguuuuuucaucu

SEQ ID NO: 1439831 - RNA, 13 nt, Human
uaguuuuuucauc

SEQ ID NO: 1439832 - RNA, 21 nt, Human
uaguuuuuucaucuucaguug

SEQ ID NO: 1439833 - RNA, 21 nt, Human
uauaaaaauaaaaaacacugg

SEQ ID NO: 1439834 - RNA, 15 nt, Human
acacccacacucaga

SEQ ID NO: 1439835 - RNA, 17 nt, Human
acacauuugcuuuuugu

SEQ ID NO: 1439836 - RNA, 14 nt, Human
acacauuugcuuuu

SEQ ID NO: 1439837 - RNA, 13 nt, Human
acacauuuuauuu

SEQ ID NO: 1439838 - RNA, 22 nt, Human
acacauugaguuggaaucacug

SEQ ID NO: 1439839 - RNA, 21 nt, Human
acacauugcugugaacaggaa

SEQ ID NO: 1439840 - RNA, 15 nt, Human
acacauguauuuggu

SEQ ID NO: 1439841 - RNA, 16 nt, Human
acacauuaggaaaagu

SEQ ID NO: 1439842 - RNA, 19 nt, Human
acacaugcuucccuuuccu

SEQ ID NO: 1439843 - RNA, 21 nt, Human
acacaugcuucccuuuccuga

SEQ ID NO: 1439844 - RNA, 23 nt, Human
acacaugcuucccuuuccugagu

SEQ ID NO: 1439845 - RNA, 18 nt, Human
acacaugcugaacaucac

SEQ ID NO: 1439846 - RNA, 21 nt, Human
uauaaaaucagccaauuaugu

SEQ ID NO: 1439847 - RNA, 20 nt, Human
uauaacguguucaauauuuu

SEQ ID NO: 1439848 - RNA, 14 nt, Human
uauaacuaacaugu

SEQ ID NO: 1439849 - RNA, 19 nt, Human
uauaacguguucaauauuu

SEQ ID NO: 1439850 - RNA, 14 nt, Human
uauaacguguucaa

SEQ ID NO: 1439851 - RNA, 20 nt, Human
uauaaccuuaauuuauuauu

SEQ ID NO: 1439852 - RNA, 15 nt, Human
uauaaccuuaauuua

SEQ ID NO: 1439853 - RNA, 14 nt, Human
uauaagcuuuucuu

SEQ ID NO: 1439854 - RNA, 23 nt, Human
acacuagccuuggccucuuuccu

SEQ ID NO: 1439855 - RNA, 20 nt, Human
acacuagcccaaugaaauga

SEQ ID NO: 1439856 - RNA, 17 nt, Human
acacuagcccaaugaaa

SEQ ID NO: 1439857 - RNA, 22 nt, Human
uauaaccaguguuguggauuua

SEQ ID NO: 1439858 - RNA, 23 nt, Human
acacuaccgaaugugucuuuaga

SEQ ID NO: 1439859 - RNA, 16 nt, Human
acacuagacaagccag

SEQ ID NO: 1439860 - RNA, 21 nt, Human
acacuaccgaaugugucuuua

SEQ ID NO: 1439861 - RNA, 20 nt, Human
acacuaccgaaugugucuuu

SEQ ID NO: 1439862 - RNA, 19 nt, Human
acacuaccgaaugugucuu

SEQ ID NO: 1439863 - RNA, 18 nt, Human
acacuaccgaaugugucu

SEQ ID NO: 1439864 - RNA, 23 nt, Human
acacuacacccagcaauagagac

SEQ ID NO: 1439865 - RNA, 16 nt, Human
acacuaccgaaugugu

SEQ ID NO: 1439866 - RNA, 17 nt, Human
acacuacacccagcaau

SEQ ID NO: 1439867 - RNA, 17 nt, Human
acacuaagagagaauga

SEQ ID NO: 1439868 - RNA, 17 nt, Human
acacuacacacugugua

SEQ ID NO: 1439869 - RNA, 20 nt, Human
acaccuuggacauccuccuc

SEQ ID NO: 1439870 - RNA, 13 nt, Human
acacuacacccag

SEQ ID NO: 1439871 - RNA, 14 nt, Human
acacuacacccagc

SEQ ID NO: 1439872 - RNA, 15 nt, Human
acacuacacccagca

SEQ ID NO: 1439873 - RNA, 19 nt, Human
acacuaagagagaaugaga

SEQ ID NO: 1439874 - RNA, 18 nt, Human
acacuaagagagaaugag

SEQ ID NO: 1439875 - RNA, 19 nt, Human
acaccuccuucccucucug

SEQ ID NO: 1439876 - RNA, 13 nt, Human
acaccugcccugc

SEQ ID NO: 1439877 - RNA, 14 nt, Human
acaccugcccugcc

SEQ ID NO: 1439878 - RNA, 12 nt, Human
acaccugcccug

SEQ ID NO: 1439879 - RNA, 15 nt, Human
acaccugcccugccc

SEQ ID NO: 1439880 - RNA, 17 nt, Human
acaccugcccugcccug

SEQ ID NO: 1439881 - RNA, 18 nt, Human
acaccugcccugcccugc

SEQ ID NO: 1439882 - RNA, 20 nt, Human
acaccugcccugcccugcca

SEQ ID NO: 1439883 - RNA, 22 nt, Human
acaccugcccugcccugccacc

SEQ ID NO: 1439884 - RNA, 19 nt, Human
acaccucccaggagacagu

SEQ ID NO: 1439885 - RNA, 13 nt, Human
acaccucccagga

SEQ ID NO: 1439886 - RNA, 22 nt, Human
acaccuccuucccucucuggag

SEQ ID NO: 1439887 - RNA, 18 nt, Human
acaccuccuucccucucu

SEQ ID NO: 1439888 - RNA, 11 nt, Human
acaccuccuuc

SEQ ID NO: 1439889 - RNA, 16 nt, Human
acacccauuuuuccuu

SEQ ID NO: 1439890 - RNA, 17 nt, Human
acaccccgacuuuuguu

SEQ ID NO: 1439891 - RNA, 23 nt, Human
acacccagcaauagagacgggac

SEQ ID NO: 1439892 - RNA, 13 nt, Human
acacccagcaaua

SEQ ID NO: 1439893 - RNA, 13 nt, Human
aauaaaguauuua

SEQ ID NO: 1439894 - RNA, 14 nt, Human
aauaaaguauuuaa

SEQ ID NO: 1439895 - RNA, 15 nt, Human
aauaaaguauuuaau

SEQ ID NO: 1439896 - RNA, 16 nt, Human
aauaaaguauuuaauu

SEQ ID NO: 1439897 - RNA, 19 nt, Human
aauaaaguauuuaauuagu

SEQ ID NO: 1439898 - RNA, 13 nt, Human
aauaaaagaaaau

SEQ ID NO: 1439899 - RNA, 20 nt, Human
aauaaaacccguugauuacu

SEQ ID NO: 1439900 - RNA, 18 nt, Human
aauaaaacuuuuuaaaau

SEQ ID NO: 1439901 - RNA, 12 nt, Human
aauaaaacuuuu

SEQ ID NO: 1439902 - RNA, 14 nt, Human
aauaaaacuuuuua

SEQ ID NO: 1439903 - RNA, 15 nt, Human
aauaaaacuuuuuaa

SEQ ID NO: 1439904 - RNA, 14 nt, Human
aauaaaucuuccua

SEQ ID NO: 1439905 - RNA, 20 nt, Human
aauaaaucugacccagugcc

SEQ ID NO: 1439906 - RNA, 17 nt, Human
aauaaaucugacccagu

SEQ ID NO: 1439907 - RNA, 16 nt, Human
aauaaaucugacccag

SEQ ID NO: 1439908 - RNA, 15 nt, Human
aauaaaucugaccca

SEQ ID NO: 1439909 - RNA, 18 nt, Human
aauaaaguguaacaauug

SEQ ID NO: 1439910 - RNA, 15 nt, Human
aauaaaguguaacaa

SEQ ID NO: 1439911 - RNA, 12 nt, Human
aauaaaguguau

SEQ ID NO: 1439912 - RNA, 17 nt, Human
aauaaagucagauggaa

SEQ ID NO: 1439913 - RNA, 12 nt, Human
aauaaagugacc

SEQ ID NO: 1439914 - RNA, 20 nt, Human
aauaaaguauuuaauuagug

SEQ ID NO: 1439915 - RNA, 21 nt, Human
aauaaaguauuuaauuagugc

SEQ ID NO: 1439916 - RNA, 22 nt, Human
aauaaaguauuuaauuagugcu

SEQ ID NO: 1439917 - RNA, 23 nt, Human
aauaaaguauuuaauuagugcua

SEQ ID NO: 1439918 - RNA, 21 nt, Human
aauaaauuugacuuuucugua

SEQ ID NO: 1439919 - RNA, 19 nt, Human
aauaacaaugugcucucgg

SEQ ID NO: 1439920 - RNA, 13 nt, Human
aauaacaaugugc

SEQ ID NO: 1439921 - RNA, 20 nt, Human
aauaaauuugacuuuucugu

SEQ ID NO: 1439922 - RNA, 13 nt, Human
aauaaauuugacu

SEQ ID NO: 1439923 - RNA, 20 nt, Human
aauaaauuuauuuucuugga

SEQ ID NO: 1439924 - RNA, 21 nt, Human
aauaacuggaaaacagaacac

SEQ ID NO: 1439925 - RNA, 18 nt, Human
aauaacuggaaaacagaa

SEQ ID NO: 1439926 - RNA, 15 nt, Human
aauaacgauaaaaga

SEQ ID NO: 1439927 - RNA, 15 nt, Human
aauaaaugucacuuu

SEQ ID NO: 1439928 - RNA, 19 nt, Human
aauaaaugucacuuuuuga

SEQ ID NO: 1439929 - RNA, 14 nt, Human
aauaaaugucacuu

SEQ ID NO: 1439930 - RNA, 13 nt, Human
aauaaaugucacu

SEQ ID NO: 1439931 - RNA, 21 nt, Human
aauaaaugucaccagguacuu

SEQ ID NO: 1439932 - RNA, 11 nt, Human
aauaaauguca

SEQ ID NO: 1439933 - RNA, 22 nt, Human
aauaaauugauuuuuauaaaua

SEQ ID NO: 1439934 - RNA, 14 nt, Human
aauaaaugucuugc

SEQ ID NO: 1439935 - RNA, 12 nt, Human
aauaaaugucuu

SEQ ID NO: 1439936 - RNA, 18 nt, Human
aauaaauuguacagccgg

SEQ ID NO: 1439937 - RNA, 12 nt, Human
aauaaauuguau

SEQ ID NO: 1439938 - RNA, 13 nt, Human
aauaaauuguaua

SEQ ID NO: 1439939 - RNA, 15 nt, Human
aauaaauuguauauu

SEQ ID NO: 1439940 - RNA, 16 nt, Human
aauaaauuguauauuc

SEQ ID NO: 1439941 - RNA, 17 nt, Human
aauaaauuguauauuca

SEQ ID NO: 1439942 - RNA, 18 nt, Human
aauaaauuguauauucac

SEQ ID NO: 1439943 - RNA, 21 nt, Human
aauaacaaugaaaguugauaa

SEQ ID NO: 1439944 - RNA, 16 nt, Human
aauaaaaagcuuuugu

SEQ ID NO: 1439945 - RNA, 18 nt, Human
aauaaaaagcuuuugucu

SEQ ID NO: 1439946 - RNA, 13 nt, Human
aauaaaaagcuuu

SEQ ID NO: 1439947 - RNA, 23 nt, Human
aauaaaaagaucacuuucucagu

SEQ ID NO: 1439948 - RNA, 19 nt, Human
aauaaaaagaucacuuucu

SEQ ID NO: 1439949 - RNA, 17 nt, Human
aauaaaaagaucacuuu

SEQ ID NO: 1439950 - RNA, 13 nt, Human
aauaaaaccagcu

SEQ ID NO: 1439951 - RNA, 18 nt, Human
uaaaguauucuucucuuc

SEQ ID NO: 1439952 - RNA, 14 nt, Human
uaaaguauucuucu

SEQ ID NO: 1439953 - RNA, 13 nt, Human
uaaaguauucuuc

SEQ ID NO: 1439954 - RNA, 12 nt, Human
uaaaguauuuaa

SEQ ID NO: 1439955 - RNA, 14 nt, Human
uaaaguauuuaauu

SEQ ID NO: 1439956 - RNA, 16 nt, Human
uaaaguauuuaauuag

SEQ ID NO: 1439957 - RNA, 17 nt, Human
uaaaguauuuaauuagu

SEQ ID NO: 1439958 - RNA, 21 nt, Human
uaaaguauguauuauuuacau

SEQ ID NO: 1439959 - RNA, 19 nt, Human
uaaaguauguauuauuuac

SEQ ID NO: 1439960 - RNA, 19 nt, Human
uaaaguauuuaauuagugc

SEQ ID NO: 1439961 - RNA, 21 nt, Human
uaaaguauuuaauuagugcua

SEQ ID NO: 1439962 - RNA, 22 nt, Human
uaaaguauuuaauuagugcuaa

SEQ ID NO: 1439963 - RNA, 20 nt, Human
aaguuuuuauggcuuuugug

SEQ ID NO: 1439964 - RNA, 22 nt, Human
uaaagguuacaagccugcacaa

SEQ ID NO: 1439965 - RNA, 22 nt, Human
uaaaggugacaucggaaaaaua

SEQ ID NO: 1439966 - RNA, 21 nt, Human
uaaaggugacaucggaaaaau

SEQ ID NO: 1439967 - RNA, 22 nt, Human
uaaagguccacaggucuagacu

SEQ ID NO: 1439968 - RNA, 21 nt, Human
uaaagguccacaggucuagac

SEQ ID NO: 1439969 - RNA, 20 nt, Human
uaaagguccacaggucuaga

SEQ ID NO: 1439970 - RNA, 19 nt, Human
uaaagguccacaggucuag

SEQ ID NO: 1439971 - RNA, 22 nt, Human
uaaaggggagaccucagaagua

SEQ ID NO: 1439972 - RNA, 15 nt, Human
guuuugaaggcaaaa

SEQ ID NO: 1439973 - RNA, 19 nt, Human
guuuugaagcuacugugug

SEQ ID NO: 1439974 - RNA, 18 nt, Human
guuuugaagcuacugugu

SEQ ID NO: 1439975 - RNA, 17 nt, Human
guuuucuuuugccauga

SEQ ID NO: 1439976 - RNA, 17 nt, Human
uaaaguaguccugugaa

SEQ ID NO: 1439977 - RNA, 16 nt, Human
uaaaguacuuguaguu

SEQ ID NO: 1439978 - RNA, 15 nt, Human
uaaaguacuuguagu

SEQ ID NO: 1439979 - RNA, 22 nt, Human
uaaagguucaugcaaacuuuau

SEQ ID NO: 1439980 - RNA, 19 nt, Human
uaaaguaaaaacaaagaaa

SEQ ID NO: 1439981 - RNA, 21 nt, Human
uaaaguaaaaacaaagaaauu

SEQ ID NO: 1439982 - RNA, 22 nt, Human
uaaaguaaaaacaaagaaauua

SEQ ID NO: 1439983 - RNA, 22 nt, Human
uaaauacugcaaaucaggcuuu

SEQ ID NO: 1439984 - RNA, 16 nt, Human
uaaauacugcaaauca

SEQ ID NO: 1439985 - RNA, 13 nt, Human
uaaauacugcaaa

SEQ ID NO: 1439986 - RNA, 17 nt, Human
uaaauacugcaaaucag

SEQ ID NO: 1439987 - RNA, 17 nt, Human
uaaauagaccauuaauc

SEQ ID NO: 1439988 - RNA, 15 nt, Human
uaaauagacacgcac

SEQ ID NO: 1439989 - RNA, 14 nt, Human
uaaaucuccaaaau

SEQ ID NO: 1439990 - RNA, 15 nt, Human
uaaaucuccaaaaua

SEQ ID NO: 1439991 - RNA, 18 nt, Human
uaaaucuccaaaauaaaa

SEQ ID NO: 1439992 - RNA, 14 nt, Human
uaaaucugacccag

SEQ ID NO: 1439993 - RNA, 20 nt, Human
uaaaucugcuggaguuucau

SEQ ID NO: 1439994 - RNA, 17 nt, Human
uaaaucugacccagugc

SEQ ID NO: 1439995 - RNA, 16 nt, Human
uaaaucugacccagug

SEQ ID NO: 1439996 - RNA, 15 nt, Human
uaaaucugacccagu

SEQ ID NO: 1439997 - RNA, 12 nt, Human
uaaaucugccac

SEQ ID NO: 1439998 - RNA, 14 nt, Human
uaaaugcauuauag

SEQ ID NO: 1439999 - RNA, 16 nt, Human
uaaaugcauaaaugca

SEQ ID NO: 1440000 - RNA, 13 nt, Human
uaaaucuuuuaua

SEQ ID NO: 1440001 - RNA, 14 nt, Human
uaaaucuuuuacaa

SEQ ID NO: 1440002 - RNA, 23 nt, Human
uaaaugcaccuggaauauauaac

SEQ ID NO: 1440003 - RNA, 22 nt, Human
uaaauguuaugacuauguaaac

SEQ ID NO: 1440004 - RNA, 23 nt, Human
uaaauguuaugacuauguaaacu

SEQ ID NO: 1440005 - RNA, 15 nt, Human
uaaauguugacaugg

SEQ ID NO: 1440006 - RNA, 13 nt, Human
uaaauguuauuau

SEQ ID NO: 1440007 - RNA, 24 nt, Human
uaaauguuuuuuuuuaaagacuuu

SEQ ID NO: 1440008 - RNA, 12 nt, Human
uaaauuaacuuu

SEQ ID NO: 1440009 - RNA, 14 nt, Human
uaaauuaacuuuua

SEQ ID NO: 1440010 - RNA, 15 nt, Human
uaaauuaacuuuuau

SEQ ID NO: 1440011 - RNA, 16 nt, Human
uaaauuaacuuuuaua

SEQ ID NO: 1440012 - RNA, 17 nt, Human
uaaauuaacuuuuauaa

SEQ ID NO: 1440013 - RNA, 18 nt, Human
uaaauuaacuuuuauaaa

SEQ ID NO: 1440014 - RNA, 23 nt, Human
uaaauacagucuuccauuugcaa

SEQ ID NO: 1440015 - RNA, 22 nt, Human
uaaauacagucuuccauuugca

SEQ ID NO: 1440016 - RNA, 20 nt, Human
uaaauacagucuuccauuug

SEQ ID NO: 1440017 - RNA, 17 nt, Human
uaaauacagucuuccau

SEQ ID NO: 1440018 - RNA, 13 nt, Human
uaaauacagucuu

SEQ ID NO: 1440019 - RNA, 18 nt, Human
uaaauacaggaaacaguu

SEQ ID NO: 1440020 - RNA, 17 nt, Human
uaaauacaggaaacagu

SEQ ID NO: 1440021 - RNA, 16 nt, Human
uaaauacaggaaacag

SEQ ID NO: 1440022 - RNA, 15 nt, Human
uaaauacaggaaaca

SEQ ID NO: 1440023 - RNA, 14 nt, Human
uaaauacaggaaac

SEQ ID NO: 1440024 - RNA, 13 nt, Human
uaaauacaggaaa

SEQ ID NO: 1440025 - RNA, 15 nt, Human
uaaauaagauucuaa

SEQ ID NO: 1440026 - RNA, 14 nt, Human
uaaauaagauucua

SEQ ID NO: 1440027 - RNA, 13 nt, Human
uaaauaagauucu

SEQ ID NO: 1440028 - RNA, 15 nt, Human
uaaauaagaaacuuu

SEQ ID NO: 1440029 - RNA, 16 nt, Human
uaaauaagaaacuuuu

SEQ ID NO: 1440030 - RNA, 13 nt, Human
uaaauaagaaacu

SEQ ID NO: 1440031 - RNA, 11 nt, Human
uaaauaagaaa

SEQ ID NO: 1440032 - RNA, 22 nt, Human
uaaauaagaaacaacucuuuga

SEQ ID NO: 1440033 - RNA, 21 nt, Human
uaaauaagaaacaacucuuug

SEQ ID NO: 1440034 - RNA, 16 nt, Human
uaaauaaugcuuugaa

SEQ ID NO: 1440035 - RNA, 13 nt, Human
uaaauaaugcuuu

SEQ ID NO: 1440036 - RNA, 14 nt, Human
uaaauaauacauua

SEQ ID NO: 1440037 - RNA, 18 nt, Human
uaaauaagauucuaacgg

SEQ ID NO: 1440038 - RNA, 17 nt, Human
uaaauaaggaaaagcuu

SEQ ID NO: 1440039 - RNA, 19 nt, Human
uaaauaaugugaaacugga

SEQ ID NO: 1440040 - RNA, 22 nt, Human
aauacaagacugccauauuaaa

SEQ ID NO: 1440041 - RNA, 18 nt, Human
aauacaaauggauuuugg

SEQ ID NO: 1440042 - RNA, 13 nt, Human
aauacaaauggau

SEQ ID NO: 1440043 - RNA, 12 nt, Human
aauacaaaugga

SEQ ID NO: 1440044 - RNA, 22 nt, Human
aauaauuuuucacuucaaaaca

SEQ ID NO: 1440045 - RNA, 20 nt, Human
aauaauuuuuauauuugaaa

SEQ ID NO: 1440046 - RNA, 12 nt, Human
uaaauaaaguuu

SEQ ID NO: 1440047 - RNA, 21 nt, Human
uaaauaaaguuuguugaaaca

SEQ ID NO: 1440048 - RNA, 21 nt, Human
aauaauucugaguuuuguguu

SEQ ID NO: 1440049 - RNA, 22 nt, Human
aauaauucugaguuuuguguuu

SEQ ID NO: 1440050 - RNA, 19 nt, Human
aauaauucugaguuuugug

SEQ ID NO: 1440051 - RNA, 17 nt, Human
aauaauucugaguuuug

SEQ ID NO: 1440052 - RNA, 18 nt, Human
aauaagaauagaaauaaa

SEQ ID NO: 1440053 - RNA, 13 nt, Human
aauaagaauagaa

SEQ ID NO: 1440054 - RNA, 22 nt, Human
aauaagaaacaacucuuugaga

SEQ ID NO: 1440055 - RNA, 13 nt, Human
aauaagaaacuuu

SEQ ID NO: 1440056 - RNA, 20 nt, Human
aauaacuggaaaacagaaca

SEQ ID NO: 1440057 - RNA, 19 nt, Human
aauaauuuuuauauuugaa

SEQ ID NO: 1440058 - RNA, 17 nt, Human
aauaauuuuuauauuug

SEQ ID NO: 1440059 - RNA, 15 nt, Human
aauaauuuuguaaug

SEQ ID NO: 1440060 - RNA, 14 nt, Human
aauaauuuuguaau

SEQ ID NO: 1440061 - RNA, 13 nt, Human
aauaauuuuguaa

SEQ ID NO: 1440062 - RNA, 16 nt, Human
aauaauuuuuauauuu

SEQ ID NO: 1440063 - RNA, 15 nt, Human
aauaauuucuaaugu

SEQ ID NO: 1440064 - RNA, 13 nt, Human
aauaauuucuaau

SEQ ID NO: 1440065 - RNA, 21 nt, Human
aauaauuuagacuucaagcau

SEQ ID NO: 1440066 - RNA, 12 nt, Human
aauaauuuagac

SEQ ID NO: 1440067 - RNA, 18 nt, Human
aauaauuguuguucuguu

SEQ ID NO: 1440068 - RNA, 22 nt, Human
aauaauuguuguucuguuaacu

SEQ ID NO: 1440069 - RNA, 17 nt, Human
aauaauuguuguucugu

SEQ ID NO: 1440070 - RNA, 16 nt, Human
aauaauuguuguucug

SEQ ID NO: 1440071 - RNA, 14 nt, Human
aauaauuguuguuc

SEQ ID NO: 1440072 - RNA, 12 nt, Human
aauaauuguugu

SEQ ID NO: 1440073 - RNA, 16 nt, Human
aauaauuucuaauguu

SEQ ID NO: 1440074 - RNA, 16 nt, Human
aauaauuuuaaacaaa

SEQ ID NO: 1440075 - RNA, 11 nt, Human
aauaauuuuau

SEQ ID NO: 1440076 - RNA, 14 nt, Human
aauaauuuuaucuc

SEQ ID NO: 1440077 - RNA, 16 nt, Human
aauaugauguuaaaaa

SEQ ID NO: 1440078 - RNA, 15 nt, Human
aauaugcacacauuu

SEQ ID NO: 1440079 - RNA, 12 nt, Human
aauauuucuuca

SEQ ID NO: 1440080 - RNA, 11 nt, Human
aauauuugaau

SEQ ID NO: 1440081 - RNA, 15 nt, Human
aauauuucagauaau

SEQ ID NO: 1440082 - RNA, 18 nt, Human
aauauuguuuuacaauag

SEQ ID NO: 1440083 - RNA, 17 nt, Human
aauauuguuuuacaaua

SEQ ID NO: 1440084 - RNA, 24 nt, Human
aaucagaagucaucuugcuaccag

SEQ ID NO: 1440085 - RNA, 20 nt, Human
aaucagaagucaucuugcua

SEQ ID NO: 1440086 - RNA, 23 nt, Human
aaucagaacucaaauggggccag

SEQ ID NO: 1440087 - RNA, 12 nt, Human
aaucagaacuca

SEQ ID NO: 1440088 - RNA, 11 nt, Human
aaucagaacuc

SEQ ID NO: 1440089 - RNA, 16 nt, Human
aaucacuuaggaaaug

SEQ ID NO: 1440090 - RNA, 21 nt, Human
aaucacuguuuagaacacaca

SEQ ID NO: 1440091 - RNA, 19 nt, Human
aaucacuguuuagaacaca

SEQ ID NO: 1440092 - RNA, 12 nt, Human
aauauuuuccuc

SEQ ID NO: 1440093 - RNA, 12 nt, Human
aauauuugaauc

SEQ ID NO: 1440094 - RNA, 13 nt, Human
aauauuugaaucu

SEQ ID NO: 1440095 - RNA, 16 nt, Human
aauauuugaaucuugu

SEQ ID NO: 1440096 - RNA, 16 nt, Human
aauauuuuaaagaauu

SEQ ID NO: 1440097 - RNA, 14 nt, Human
aauauuugaaucuu

SEQ ID NO: 1440098 - RNA, 22 nt, Human
uaagaccuacuguucuaaagcu

SEQ ID NO: 1440099 - RNA, 21 nt, Human
uaagaccuacuguucuaaagc

SEQ ID NO: 1440100 - RNA, 20 nt, Human
uaagaccuacuguucuaaag

SEQ ID NO: 1440101 - RNA, 19 nt, Human
uaagaccuacuguucuaaa

SEQ ID NO: 1440102 - RNA, 18 nt, Human
uaagaccuacuguucuaa

SEQ ID NO: 1440103 - RNA, 17 nt, Human
uaagaccuacuguucua

SEQ ID NO: 1440104 - RNA, 16 nt, Human
uaagaccuacuguucu

SEQ ID NO: 1440105 - RNA, 14 nt, Human
uaagaccuacuguu

SEQ ID NO: 1440106 - RNA, 21 nt, Human
uaagacaugauuuccuugaau

SEQ ID NO: 1440107 - RNA, 20 nt, Human
uaagacaugauuuccuugaa

SEQ ID NO: 1440108 - RNA, 14 nt, Human
uaagaaucuuuaga

SEQ ID NO: 1440109 - RNA, 21 nt, Human
uaagaaucuagcaagaauuga

SEQ ID NO: 1440110 - RNA, 17 nt, Human
uaagaaucuagcaagaa

SEQ ID NO: 1440111 - RNA, 21 nt, Human
uaacuuuguuuuauuuucaaa

SEQ ID NO: 1440112 - RNA, 18 nt, Human
uaacuuuguuuuauuuuc

SEQ ID NO: 1440113 - RNA, 14 nt, Human
uaacuuuguuuuau

SEQ ID NO: 1440114 - RNA, 12 nt, Human
uaacuuuguuuu

SEQ ID NO: 1440115 - RNA, 14 nt, Human
uaacuacuuuauaa

SEQ ID NO: 1440116 - RNA, 13 nt, Human
uaacuacuuuaua

SEQ ID NO: 1440117 - RNA, 19 nt, Human
uaacuuuuauaaacuuuac

SEQ ID NO: 1440118 - RNA, 16 nt, Human
uaacuaacauguccug

SEQ ID NO: 1440119 - RNA, 20 nt, Human
uaacuaaaauaauuuuguaa

SEQ ID NO: 1440120 - RNA, 21 nt, Human
uaacuaaaauaauuuuguaau

SEQ ID NO: 1440121 - RNA, 23 nt, Human
uaacuacaaagguuuaaaugaac

SEQ ID NO: 1440122 - RNA, 22 nt, Human
uaacuacaaagguuuaaaugaa

SEQ ID NO: 1440123 - RNA, 21 nt, Human
uaacuacaaagguuuaaauga

SEQ ID NO: 1440124 - RNA, 18 nt, Human
uaacuaacugcauacacu

SEQ ID NO: 1440125 - RNA, 15 nt, Human
uaacuuuuauaaacu

SEQ ID NO: 1440126 - RNA, 17 nt, Human
uaacuuuuauaaacuuu

SEQ ID NO: 1440127 - RNA, 18 nt, Human
uaacuuuuauaaacuuua

SEQ ID NO: 1440128 - RNA, 17 nt, Human
aauaucuucacuuguca

SEQ ID NO: 1440129 - RNA, 17 nt, Human
aauaucuguaaugguac

SEQ ID NO: 1440130 - RNA, 12 nt, Human
aauaucugaagc

SEQ ID NO: 1440131 - RNA, 13 nt, Human
aauauccugcuug

SEQ ID NO: 1440132 - RNA, 11 nt, Human
uaagaccuggc

SEQ ID NO: 1440133 - RNA, 13 nt, Human
uaagaccuggcag

SEQ ID NO: 1440134 - RNA, 21 nt, Human
aauaucuccgucaacucauau

SEQ ID NO: 1440135 - RNA, 16 nt, Human
aauaucuccgucaacu

SEQ ID NO: 1440136 - RNA, 22 nt, Human
uaacauaccuaagaaguacauu

SEQ ID NO: 1440137 - RNA, 19 nt, Human
uaacauaagcuauuuuucu

SEQ ID NO: 1440138 - RNA, 15 nt, Human
uaacauaagcuauuu

SEQ ID NO: 1440139 - RNA, 14 nt, Human
uaacauaagcuauu

SEQ ID NO: 1440140 - RNA, 14 nt, Human
uaacaugauuuggg

SEQ ID NO: 1440141 - RNA, 17 nt, Human
aauauccuaaacaucau

SEQ ID NO: 1440142 - RNA, 16 nt, Human
aauauccuaaacauca

SEQ ID NO: 1440143 - RNA, 15 nt, Human
aauauccuaaacauc

SEQ ID NO: 1440144 - RNA, 19 nt, Human
uaacuaaaauaauuuugua

SEQ ID NO: 1440145 - RNA, 18 nt, Human
uaacuaaaauaauuuugu

SEQ ID NO: 1440146 - RNA, 12 nt, Human
uaacuaaaauaa

SEQ ID NO: 1440147 - RNA, 18 nt, Human
uaaccugucucaccugga

SEQ ID NO: 1440148 - RNA, 17 nt, Human
uaaccucuucagaggcc

SEQ ID NO: 1440149 - RNA, 14 nt, Human
uaaccucugcacua

SEQ ID NO: 1440150 - RNA, 16 nt, Human
uaaccucgggccugcu

SEQ ID NO: 1440151 - RNA, 16 nt, Human
uaaccucuaaauucuu

SEQ ID NO: 1440152 - RNA, 18 nt, Human
aauauccuaaacaucauu

SEQ ID NO: 1440153 - RNA, 14 nt, Human
aauauccuaaacau

SEQ ID NO: 1440154 - RNA, 22 nt, Human
aauaucccuccuguugggagag

SEQ ID NO: 1440155 - RNA, 19 nt, Human
aauaucccuccuguuggga

SEQ ID NO: 1440156 - RNA, 12 nt, Human
aauaucccuccu

SEQ ID NO: 1440157 - RNA, 23 nt, Human
aauaucccuccuguugggagagg

SEQ ID NO: 1440158 - RNA, 19 nt, Human
aauaucccuacauguauug

SEQ ID NO: 1440159 - RNA, 18 nt, Human
aauaucccuacauguauu

SEQ ID NO: 1440160 - RNA, 17 nt, Human
aauaucccuacauguau

SEQ ID NO: 1440161 - RNA, 16 nt, Human
aauaucccuacaugua

SEQ ID NO: 1440162 - RNA, 20 nt, Human
aauaucacuugucaauaaaa

SEQ ID NO: 1440163 - RNA, 15 nt, Human
aauaucacuugucaa

SEQ ID NO: 1440164 - RNA, 16 nt, Human
aauauauguauauaca

SEQ ID NO: 1440165 - RNA, 15 nt, Human
aauaguauuucccau

SEQ ID NO: 1440166 - RNA, 16 nt, Human
aauaguauuucccauu

SEQ ID NO: 1440167 - RNA, 20 nt, Human
aauauauuauuacuuguaaa

SEQ ID NO: 1440168 - RNA, 18 nt, Human
aauauauuauuacuugua

SEQ ID NO: 1440169 - RNA, 15 nt, Human
aauauauuauuacuu

SEQ ID NO: 1440170 - RNA, 13 nt, Human
aauauauuauuac

SEQ ID NO: 1440171 - RNA, 14 nt, Human
aauauauguauaua

SEQ ID NO: 1440172 - RNA, 21 nt, Human
aauauauuauuacuuguaaau

SEQ ID NO: 1440173 - RNA, 12 nt, Human
aauaucacuugu

SEQ ID NO: 1440174 - RNA, 23 nt, Human
aauagccacauuuggaauacuuu

SEQ ID NO: 1440175 - RNA, 22 nt, Human
aauagccacauuuggaauacuu

SEQ ID NO: 1440176 - RNA, 20 nt, Human
aauagccacauuuggaauac

SEQ ID NO: 1440177 - RNA, 20 nt, Human
aauagcaugucacuaaagca

SEQ ID NO: 1440178 - RNA, 12 nt, Human
aauagauucucu

SEQ ID NO: 1440179 - RNA, 11 nt, Human
aauagauucuc

SEQ ID NO: 1440180 - RNA, 19 nt, Human
aauagauguuugauagauu

SEQ ID NO: 1440181 - RNA, 19 nt, Human
aauagauaugaaagcugau

SEQ ID NO: 1440182 - RNA, 22 nt, Human
aauagauguuugauagauuuuc

SEQ ID NO: 1440183 - RNA, 11 nt, Human
aauagauguuu

SEQ ID NO: 1440184 - RNA, 21 nt, Human
aauagccacuaaccuugccug

SEQ ID NO: 1440185 - RNA, 20 nt, Human
aauagccacuaaccuugccu

SEQ ID NO: 1440186 - RNA, 23 nt, Human
aauagccacuaaccuugccuggu

SEQ ID NO: 1440187 - RNA, 21 nt, Human
aauagccauauuuguaaaaug

SEQ ID NO: 1440188 - RNA, 18 nt, Human
aauagccauauuuguaaa

SEQ ID NO: 1440189 - RNA, 15 nt, Human
aauagccauauuugu

SEQ ID NO: 1440190 - RNA, 18 nt, Human
aauagauaugaaagcuga

SEQ ID NO: 1440191 - RNA, 20 nt, Human
aauagauaagaguagaaacu

SEQ ID NO: 1440192 - RNA, 16 nt, Human
aauagacagcaugaga

SEQ ID NO: 1440193 - RNA, 23 nt, Human
aauagacacuccccgaagucuuu

SEQ ID NO: 1440194 - RNA, 22 nt, Human
aauagacacuccccgaagucuu

SEQ ID NO: 1440195 - RNA, 14 nt, Human
uaaauuuuuuuccu

SEQ ID NO: 1440196 - RNA, 23 nt, Human
aauagacaauuuauuauggcaca

SEQ ID NO: 1440197 - RNA, 20 nt, Human
uaaauuuuuuguugacauua

SEQ ID NO: 1440198 - RNA, 18 nt, Human
uaaauuuuuuguugacau

SEQ ID NO: 1440199 - RNA, 16 nt, Human
uaaauuuuuuguugac

SEQ ID NO: 1440200 - RNA, 18 nt, Human
aauagacaauuuauuaug

SEQ ID NO: 1440201 - RNA, 16 nt, Human
aauagcuuuaaugaua

SEQ ID NO: 1440202 - RNA, 15 nt, Human
aauagcuuuaaugau

SEQ ID NO: 1440203 - RNA, 18 nt, Human
aauagcuuaugaaaagaa

SEQ ID NO: 1440204 - RNA, 19 nt, Human
aauagcuuaugaaaagaau

SEQ ID NO: 1440205 - RNA, 17 nt, Human
aauagcuuaugaaaaga

SEQ ID NO: 1440206 - RNA, 16 nt, Human
aauagcuuaugaaaag

SEQ ID NO: 1440207 - RNA, 18 nt, Human
aauagcuguaaacuucca

SEQ ID NO: 1440208 - RNA, 22 nt, Human
aauagccauauuuguaaaauga

SEQ ID NO: 1440209 - RNA, 24 nt, Human
aauagcuuuuuucucugauacaga

SEQ ID NO: 1440210 - RNA, 20 nt, Human
aauaggguauauuuuccuau

SEQ ID NO: 1440211 - RNA, 19 nt, Human
aauaggguauauuuuccua

SEQ ID NO: 1440212 - RNA, 21 nt, Human
aauagggcugagcucucugug

SEQ ID NO: 1440213 - RNA, 18 nt, Human
aauagggacuaucuaucu

SEQ ID NO: 1440214 - RNA, 19 nt, Human
aauaggcggggcuugccuu

SEQ ID NO: 1440215 - RNA, 18 nt, Human
aauaggcggggcuugccu

SEQ ID NO: 1440216 - RNA, 14 nt, Human
aauaggcaggaagc

SEQ ID NO: 1440217 - RNA, 22 nt, Human
aauaggcgaucacaacgugcau

SEQ ID NO: 1440218 - RNA, 16 nt, Human
aauaggaauugguuuc

SEQ ID NO: 1440219 - RNA, 18 nt, Human
aauaggcguaacuaauuu

SEQ ID NO: 1440220 - RNA, 20 nt, Human
uaaguucaaauucuucugaa

SEQ ID NO: 1440221 - RNA, 19 nt, Human
uaaguucaaauucuucuga

SEQ ID NO: 1440222 - RNA, 20 nt, Human
uaaguuauugcaguuuauca

SEQ ID NO: 1440223 - RNA, 16 nt, Human
uaaguuauugcaguuu

SEQ ID NO: 1440224 - RNA, 15 nt, Human
uaaguuauugcaguu

SEQ ID NO: 1440225 - RNA, 14 nt, Human
uaaguuauugcagu

SEQ ID NO: 1440226 - RNA, 12 nt, Human
uaaguuauugca

SEQ ID NO: 1440227 - RNA, 16 nt, Human
uaaguuugauuucauu

SEQ ID NO: 1440228 - RNA, 17 nt, Human
uaaguuucucugcagaa

SEQ ID NO: 1440229 - RNA, 14 nt, Human
uaaguuucugggac

SEQ ID NO: 1440230 - RNA, 18 nt, Human
uaaguuuuuuuuuaaaaa

SEQ ID NO: 1440231 - RNA, 20 nt, Human
uaaguuuuuauggcuuuugu

SEQ ID NO: 1440232 - RNA, 21 nt, Human
aaucagauagauauuccuauu

SEQ ID NO: 1440233 - RNA, 16 nt, Human
aaucagauagauauuc

SEQ ID NO: 1440234 - RNA, 14 nt, Human
aaucagauagauau

SEQ ID NO: 1440235 - RNA, 20 nt, Human
aaucagagaccuuccagaaa

SEQ ID NO: 1440236 - RNA, 16 nt, Human
aaucagagaaggaaca

SEQ ID NO: 1440237 - RNA, 12 nt, Human
aaucagacugac

SEQ ID NO: 1440238 - RNA, 13 nt, Human
aaucagaauuaga

SEQ ID NO: 1440239 - RNA, 14 nt, Human
aaucagacuaugaa

SEQ ID NO: 1440240 - RNA, 17 nt, Human
aaucagacuaugaaguu

SEQ ID NO: 1440241 - RNA, 23 nt, Human
aaucaugaauuaguuuuauaugc

SEQ ID NO: 1440242 - RNA, 17 nt, Human
aaucaugaauuaguuuu

SEQ ID NO: 1440243 - RNA, 19 nt, Human
aaucaugaauuaguuuuau

SEQ ID NO: 1440244 - RNA, 15 nt, Human
aaucauguguguuaa

SEQ ID NO: 1440245 - RNA, 13 nt, Human
aaucauguguguu

SEQ ID NO: 1440246 - RNA, 12 nt, Human
aaucaugugugu

SEQ ID NO: 1440247 - RNA, 17 nt, Human
aaucauggugcucagag

SEQ ID NO: 1440248 - RNA, 13 nt, Human
uaauaaaagaaaa

SEQ ID NO: 1440249 - RNA, 14 nt, Human
uaauaaaagaaaau

SEQ ID NO: 1440250 - RNA, 12 nt, Human
uaauaaaagaaa

SEQ ID NO: 1440251 - RNA, 11 nt, Human
uaauaaaagaa

SEQ ID NO: 1440252 - RNA, 15 nt, Human
uaauaaaaauaauuu

SEQ ID NO: 1440253 - RNA, 20 nt, Human
aaucauccauccuugccaau

SEQ ID NO: 1440254 - RNA, 22 nt, Human
aaucaucagaaaggaaaaacaa

SEQ ID NO: 1440255 - RNA, 12 nt, Human
aaucaucaagua

SEQ ID NO: 1440256 - RNA, 23 nt, Human
aaucaucaagagaauuuggggcu

SEQ ID NO: 1440257 - RNA, 21 nt, Human
aaucaucaagagaauuugggg

SEQ ID NO: 1440258 - RNA, 15 nt, Human
aaucaucaagagaau

SEQ ID NO: 1440259 - RNA, 15 nt, Human
aaucaucaagucuuu

SEQ ID NO: 1440260 - RNA, 22 nt, Human
aaucuagauaucgacuuguuuu

SEQ ID NO: 1440261 - RNA, 16 nt, Human
aaucuacucaaagcau

SEQ ID NO: 1440262 - RNA, 17 nt, Human
aaucuacucaaagcaug

SEQ ID NO: 1440263 - RNA, 17 nt, Human
aaucuacuaauuccaca

SEQ ID NO: 1440264 - RNA, 22 nt, Human
aaucugucacguagaacuugga

SEQ ID NO: 1440265 - RNA, 15 nt, Human
aaucucaaauuucua

SEQ ID NO: 1440266 - RNA, 14 nt, Human
aaucucaaauuucu

SEQ ID NO: 1440267 - RNA, 12 nt, Human
aaucucaaauuu

SEQ ID NO: 1440268 - RNA, 14 nt, Human
aaucuuauaauuua

SEQ ID NO: 1440269 - RNA, 16 nt, Human
aaucuuauaauuuaaa

SEQ ID NO: 1440270 - RNA, 15 nt, Human
aaucuuauaauuguu

SEQ ID NO: 1440271 - RNA, 14 nt, Human
aaucuuauaauugu

SEQ ID NO: 1440272 - RNA, 23 nt, Human
aaucuuaguguaugauuacuggc

SEQ ID NO: 1440273 - RNA, 16 nt, Human
aaucuacuaauuccac

SEQ ID NO: 1440274 - RNA, 15 nt, Human
aaucuacuaauucca

SEQ ID NO: 1440275 - RNA, 17 nt, Human
aauccuugaugauugac

SEQ ID NO: 1440276 - RNA, 18 nt, Human
aaucuaaauggaaccacu

SEQ ID NO: 1440277 - RNA, 13 nt, Human
aaucuaaauggaa

SEQ ID NO: 1440278 - RNA, 15 nt, Human
aaucuaaauggaacc

SEQ ID NO: 1440279 - RNA, 18 nt, Human
aauccuugcuuaugacau

SEQ ID NO: 1440280 - RNA, 17 nt, Human
aauccuugcuuaugaca

SEQ ID NO: 1440281 - RNA, 13 nt, Human
aauccuugcuuau

SEQ ID NO: 1440282 - RNA, 20 nt, Human
aauccuuagaucuggcaugu

SEQ ID NO: 1440283 - RNA, 19 nt, Human
aauccuuagaucuggcaug

SEQ ID NO: 1440284 - RNA, 13 nt, Human
aauccuugaagau

SEQ ID NO: 1440285 - RNA, 20 nt, Human
aaucauuucuauuucuccuc

SEQ ID NO: 1440286 - RNA, 19 nt, Human
aaucauuucuauuucuccu

SEQ ID NO: 1440287 - RNA, 12 nt, Human
aaucauuucuau

SEQ ID NO: 1440288 - RNA, 14 nt, Human
aaucauuguaugug

SEQ ID NO: 1440289 - RNA, 18 nt, Human
aauccuaugcaugguuuc

SEQ ID NO: 1440290 - RNA, 15 nt, Human
aauccuaugcauggu

SEQ ID NO: 1440291 - RNA, 15 nt, Human
aauccuaccucaaaa

SEQ ID NO: 1440292 - RNA, 17 nt, Human
aauccuaccucaaaauu

SEQ ID NO: 1440293 - RNA, 21 nt, Human
aauccuaugcaugguuucagc

SEQ ID NO: 1440294 - RNA, 22 nt, Human
aauccuaugcaugguuucagca

SEQ ID NO: 1440295 - RNA, 20 nt, Human
aauccucaguuuuugugaaa

SEQ ID NO: 1440296 - RNA, 19 nt, Human
aaucuugucauguguauaa

SEQ ID NO: 1440297 - RNA, 18 nt, Human
aaucuugucauguguaua

SEQ ID NO: 1440298 - RNA, 13 nt, Human
aaucuugucucaa

SEQ ID NO: 1440299 - RNA, 15 nt, Human
aaucuugucucaaug

SEQ ID NO: 1440300 - RNA, 17 nt, Human
aaucuugucucaaugcu

SEQ ID NO: 1440301 - RNA, 13 nt, Human
uaaugguguagaa

SEQ ID NO: 1440302 - RNA, 18 nt, Human
uaauggugccuucauuug

SEQ ID NO: 1440303 - RNA, 16 nt, Human
uaauggugccuucauu

SEQ ID NO: 1440304 - RNA, 19 nt, Human
uaaugguguagaacacuaa

SEQ ID NO: 1440305 - RNA, 16 nt, Human
uaaugauaacuggaaa

SEQ ID NO: 1440306 - RNA, 23 nt, Human
aaucuuuuacaacugccucgaaa

SEQ ID NO: 1440307 - RNA, 21 nt, Human
aaucuuuuacaacugccucga

SEQ ID NO: 1440308 - RNA, 12 nt, Human
aaucuuuuacaa

SEQ ID NO: 1440309 - RNA, 21 nt, Human
aaucuuugaaagguuagagaa

SEQ ID NO: 1440310 - RNA, 14 nt, Human
aaucuuucuuucuu

SEQ ID NO: 1440311 - RNA, 16 nt, Human
aaucuuucuuucuuag

SEQ ID NO: 1440312 - RNA, 17 nt, Human
aaucuuucuuucuuaga

SEQ ID NO: 1440313 - RNA, 18 nt, Human
aaucuuucuuucuuagaa

SEQ ID NO: 1440314 - RNA, 19 nt, Human
aaucuuucuuucuuagaaa

SEQ ID NO: 1440315 - RNA, 20 nt, Human
aaucuuucuuucuuagaaau

SEQ ID NO: 1440316 - RNA, 21 nt, Human
aaucuuucuuucuuagaaauu

SEQ ID NO: 1440317 - RNA, 22 nt, Human
aaucuuucuuucuuagaaauuu

SEQ ID NO: 1440318 - RNA, 17 nt, Human
aaucuuuaaaagaugcu

SEQ ID NO: 1440319 - RNA, 21 nt, Human
aaucuuuaaaagaugcuuuua

SEQ ID NO: 1440320 - RNA, 18 nt, Human
aaucuugucucaaugcuc

SEQ ID NO: 1440321 - RNA, 20 nt, Human
aaucuugucucaaugcucau

SEQ ID NO: 1440322 - RNA, 21 nt, Human
aaucuugucucaaugcucaua

SEQ ID NO: 1440323 - RNA, 13 nt, Human
aaugagaaucuac

SEQ ID NO: 1440324 - RNA, 18 nt, Human
aaugacuuacuguacaug

SEQ ID NO: 1440325 - RNA, 14 nt, Human
aaugacuuacugua

SEQ ID NO: 1440326 - RNA, 17 nt, Human
aaugacuuacuguacau

SEQ ID NO: 1440327 - RNA, 21 nt, Human
aaugagagacacacugaagaa

SEQ ID NO: 1440328 - RNA, 13 nt, Human
aaugagacaucca

SEQ ID NO: 1440329 - RNA, 14 nt, Human
aaugagacauccag

SEQ ID NO: 1440330 - RNA, 15 nt, Human
aaugagacauccagc

SEQ ID NO: 1440331 - RNA, 18 nt, Human
aaugacauuuauaucaca

SEQ ID NO: 1440332 - RNA, 19 nt, Human
aaugacaugaauuuuagcu

SEQ ID NO: 1440333 - RNA, 13 nt, Human
aaugacaugaauu

SEQ ID NO: 1440334 - RNA, 22 nt, Human
aaugacaguccgucaaaacaga

SEQ ID NO: 1440335 - RNA, 15 nt, Human
aaugacaggccuguc

SEQ ID NO: 1440336 - RNA, 19 nt, Human
aaugacacucauauaauua

SEQ ID NO: 1440337 - RNA, 11 nt, Human
aaugacacugu

SEQ ID NO: 1440338 - RNA, 17 nt, Human
aaugacacucauauaau

SEQ ID NO: 1440339 - RNA, 14 nt, Human
aaugacacucauau

SEQ ID NO: 1440340 - RNA, 15 nt, Human
aaugaaaaugucuug

SEQ ID NO: 1440341 - RNA, 15 nt, Human
aaugaaaauguccau

SEQ ID NO: 1440342 - RNA, 14 nt, Human
aaugaaaauaagaa

SEQ ID NO: 1440343 - RNA, 18 nt, Human
aaugaaaacucuuugcug

SEQ ID NO: 1440344 - RNA, 18 nt, Human
aaugaaaacagaaugucu

SEQ ID NO: 1440345 - RNA, 16 nt, Human
aaugaaaacagaaugu

SEQ ID NO: 1440346 - RNA, 15 nt, Human
aaugaaaaccacauu

SEQ ID NO: 1440347 - RNA, 23 nt, Human
uaaucaguucauuagaaauauuu

SEQ ID NO: 1440348 - RNA, 17 nt, Human
uaaucacgcuuuccuga

SEQ ID NO: 1440349 - RNA, 22 nt, Human
uaaucauauaauaaauguacau

SEQ ID NO: 1440350 - RNA, 20 nt, Human
uaaucauauaauaaauguac

SEQ ID NO: 1440351 - RNA, 15 nt, Human
uaaucauauaauaaa

SEQ ID NO: 1440352 - RNA, 18 nt, Human
uaaucaucaaguaauaca

SEQ ID NO: 1440353 - RNA, 22 nt, Human
uaaucaucaagagaauuugggg

SEQ ID NO: 1440354 - RNA, 23 nt, Human
uaaugaaacaaagaguucaagaa

SEQ ID NO: 1440355 - RNA, 20 nt, Human
uaaugacaggccuguccaac

SEQ ID NO: 1440356 - RNA, 15 nt, Human
uaaugacaggccugu

SEQ ID NO: 1440357 - RNA, 15 nt, Human
uaaugaauuuaguga

SEQ ID NO: 1440358 - RNA, 17 nt, Human
uaaugaaacaaagaguu

SEQ ID NO: 1440359 - RNA, 23 nt, Human
uaauacugcugagauacauacag

SEQ ID NO: 1440360 - RNA, 14 nt, Human
uaauacugcugaga

SEQ ID NO: 1440361 - RNA, 21 nt, Human
uaauacucaaaugaguaacau

SEQ ID NO: 1440362 - RNA, 20 nt, Human
uaauacucaaaugaguaaca

SEQ ID NO: 1440363 - RNA, 18 nt, Human
uaauacucaaaugaguaa

SEQ ID NO: 1440364 - RNA, 16 nt, Human
uaauacucaaaugagu

SEQ ID NO: 1440365 - RNA, 15 nt, Human
uaauacuaccuugaa

SEQ ID NO: 1440366 - RNA, 14 nt, Human
uaauacuaccuuga

SEQ ID NO: 1440367 - RNA, 17 nt, Human
aaucuuauaauuguucu

SEQ ID NO: 1440368 - RNA, 14 nt, Human
aaucuuccuguuua

SEQ ID NO: 1440369 - RNA, 15 nt, Human
uaaucacgcuuuccu

SEQ ID NO: 1440370 - RNA, 18 nt, Human
uaaucaauguuucuucua

SEQ ID NO: 1440371 - RNA, 11 nt, Human
uaauagcugua

SEQ ID NO: 1440372 - RNA, 19 nt, Human
uaauacugcugagauacau

SEQ ID NO: 1440373 - RNA, 14 nt, Human
uaauagguuuggac

SEQ ID NO: 1440374 - RNA, 19 nt, Human
uaauagguuuggacaaaau

SEQ ID NO: 1440375 - RNA, 20 nt, Human
uaauagggcaauuaauuccu

SEQ ID NO: 1440376 - RNA, 19 nt, Human
aauguauuuuauguuauau

SEQ ID NO: 1440377 - RNA, 20 nt, Human
aauguauuuuauguuauaua

SEQ ID NO: 1440378 - RNA, 18 nt, Human
aauguauuuuauguuaua

SEQ ID NO: 1440379 - RNA, 15 nt, Human
aauguauuuuauguu

SEQ ID NO: 1440380 - RNA, 13 nt, Human
aauguauuuuaug

SEQ ID NO: 1440381 - RNA, 21 nt, Human
aauguggcuugagaaauaugg

SEQ ID NO: 1440382 - RNA, 16 nt, Human
aauguggcuugagaaa

SEQ ID NO: 1440383 - RNA, 12 nt, Human
aauguggcuuga

SEQ ID NO: 1440384 - RNA, 13 nt, Human
aaugugauguucu

SEQ ID NO: 1440385 - RNA, 16 nt, Human
aaugugaugaauacug

SEQ ID NO: 1440386 - RNA, 20 nt, Human
aaugugaugaauacuguauu

SEQ ID NO: 1440387 - RNA, 12 nt, Human
aaugugaugaau

SEQ ID NO: 1440388 - RNA, 13 nt, Human
aauguaugucugg

SEQ ID NO: 1440389 - RNA, 21 nt, Human
uacauagugcugcugugugcu

SEQ ID NO: 1440390 - RNA, 19 nt, Human
uacauagugcugcugugug

SEQ ID NO: 1440391 - RNA, 17 nt, Human
uacauagugcugcugug

SEQ ID NO: 1440392 - RNA, 19 nt, Human
uacauauaagugauugcug

SEQ ID NO: 1440393 - RNA, 21 nt, Human
uacauaugugcuggaauucua

SEQ ID NO: 1440394 - RNA, 22 nt, Human
uacauagugcugcugugugcuu

SEQ ID NO: 1440395 - RNA, 22 nt, Human
uacauauaagugauugcugguu

SEQ ID NO: 1440396 - RNA, 21 nt, Human
uacauagggauaugcguauua

SEQ ID NO: 1440397 - RNA, 17 nt, Human
uacauagaugcuuaguc

SEQ ID NO: 1440398 - RNA, 21 nt, Human
uacauaaugcgugcauaccac

SEQ ID NO: 1440399 - RNA, 19 nt, Human
uacauaaugcgugcauacc

SEQ ID NO: 1440400 - RNA, 20 nt, Human
uacauaaugcgugcauacca

SEQ ID NO: 1440401 - RNA, 17 nt, Human
uacauaaugcgugcaua

SEQ ID NO: 1440402 - RNA, 20 nt, Human
uacaccacucuggcagccac

SEQ ID NO: 1440403 - RNA, 21 nt, Human
uacaccacucuggcagccaca

SEQ ID NO: 1440404 - RNA, 19 nt, Human
uacaccacucuggcagcca

SEQ ID NO: 1440405 - RNA, 17 nt, Human
uacaccacucuggcagc

SEQ ID NO: 1440406 - RNA, 16 nt, Human
uacaccacucuggcag

SEQ ID NO: 1440407 - RNA, 14 nt, Human
uacaccacucuggc

SEQ ID NO: 1440408 - RNA, 12 nt, Human
uacaccacucug

SEQ ID NO: 1440409 - RNA, 19 nt, Human
uacaccacuacauucuguu

SEQ ID NO: 1440410 - RNA, 20 nt, Human
uacaccacuacauucuguua

SEQ ID NO: 1440411 - RNA, 15 nt, Human
uacaccacuacauuc

SEQ ID NO: 1440412 - RNA, 16 nt, Human
uacaccacuacauucu

SEQ ID NO: 1440413 - RNA, 17 nt, Human
uacaccacuacauucug

SEQ ID NO: 1440414 - RNA, 18 nt, Human
uacaccacuacauucugu

SEQ ID NO: 1440415 - RNA, 21 nt, Human
aauggaggaacuuuccaaaca

SEQ ID NO: 1440416 - RNA, 20 nt, Human
aauggagauucaguuuucau

SEQ ID NO: 1440417 - RNA, 21 nt, Human
aauggaccggagagugggggu

SEQ ID NO: 1440418 - RNA, 19 nt, Human
aauggacuuuuguacauag

SEQ ID NO: 1440419 - RNA, 15 nt, Human
uacagagcuucccug

SEQ ID NO: 1440420 - RNA, 16 nt, Human
uacagagcuucccuga

SEQ ID NO: 1440421 - RNA, 19 nt, Human
uacacuaagagagaaugag

SEQ ID NO: 1440422 - RNA, 15 nt, Human
uacaggccucacaca

SEQ ID NO: 1440423 - RNA, 18 nt, Human
uacaguaggagcccagcu

SEQ ID NO: 1440424 - RNA, 15 nt, Human
uacaguaggagccca

SEQ ID NO: 1440425 - RNA, 14 nt, Human
uacaguaggagccc

SEQ ID NO: 1440426 - RNA, 13 nt, Human
uacaguaggagcc

SEQ ID NO: 1440427 - RNA, 21 nt, Human
uacaguagauuuuccaaaugu

SEQ ID NO: 1440428 - RNA, 17 nt, Human
uacaguagauuuuccaa

SEQ ID NO: 1440429 - RNA, 22 nt, Human
uacaguaggagcccagcucuga

SEQ ID NO: 1440430 - RNA, 20 nt, Human
uacaguaggagcccagcucu

SEQ ID NO: 1440431 - RNA, 16 nt, Human
uaauucaauucaaagc

SEQ ID NO: 1440432 - RNA, 22 nt, Human
uaauucaaggaauuucuuaacu

SEQ ID NO: 1440433 - RNA, 20 nt, Human
uaauucaaggaauuucuuaa

SEQ ID NO: 1440434 - RNA, 18 nt, Human
uaauucaaggaauuucuu

SEQ ID NO: 1440435 - RNA, 18 nt, Human
uaauuauuuauguauggu

SEQ ID NO: 1440436 - RNA, 16 nt, Human
uaauuauuuauguaug

SEQ ID NO: 1440437 - RNA, 14 nt, Human
uaauuauuuaugua

SEQ ID NO: 1440438 - RNA, 14 nt, Human
aaugaggagacaca

SEQ ID NO: 1440439 - RNA, 23 nt, Human
aaugagcuuucugaacagcuggu

SEQ ID NO: 1440440 - RNA, 22 nt, Human
aaugagcuuucugaacagcugg

SEQ ID NO: 1440441 - RNA, 21 nt, Human
aaugagcuuucugaacagcug

SEQ ID NO: 1440442 - RNA, 20 nt, Human
aaugagcuuucugaacagcu

SEQ ID NO: 1440443 - RNA, 16 nt, Human
aaugagcuuucugaac

SEQ ID NO: 1440444 - RNA, 15 nt, Human
aaugagcuuucugaa

SEQ ID NO: 1440445 - RNA, 14 nt, Human
aaugagcuuucuga

SEQ ID NO: 1440446 - RNA, 13 nt, Human
aaugagcuuucug

SEQ ID NO: 1440447 - RNA, 12 nt, Human
aaugagcuuucu

SEQ ID NO: 1440448 - RNA, 17 nt, Human
uaauuccacaccuuuua

SEQ ID NO: 1440449 - RNA, 15 nt, Human
uaauuccacaccuuu

SEQ ID NO: 1440450 - RNA, 22 nt, Human
uaauuucaggaggaauacugaa

SEQ ID NO: 1440451 - RNA, 23 nt, Human
uaauuucaggaggaauacugaac

SEQ ID NO: 1440452 - RNA, 21 nt, Human
uaauuucaggaggaauacuga

SEQ ID NO: 1440453 - RNA, 20 nt, Human
uaauuucaaaaugcuuuuua

SEQ ID NO: 1440454 - RNA, 16 nt, Human
uaauuucaaaaugcuu

SEQ ID NO: 1440455 - RNA, 15 nt, Human
uaauuucaaaaugcu

SEQ ID NO: 1440456 - RNA, 12 nt, Human
uaauuucaaaau

SEQ ID NO: 1440457 - RNA, 14 nt, Human
uaauuuauuauuaa

SEQ ID NO: 1440458 - RNA, 14 nt, Human
uaauuuaugcagaa

SEQ ID NO: 1440459 - RNA, 22 nt, Human
uacaaaacaaacucauucauua

SEQ ID NO: 1440460 - RNA, 17 nt, Human
uacaaaacaaacucauu

SEQ ID NO: 1440461 - RNA, 14 nt, Human
uacaaaacaaacuc

SEQ ID NO: 1440462 - RNA, 13 nt, Human
uacaaaaauuccu

SEQ ID NO: 1440463 - RNA, 20 nt, Human
uacaaaaauauaaaauauga

SEQ ID NO: 1440464 - RNA, 19 nt, Human
uacaaaauaaacaaauaac

SEQ ID NO: 1440465 - RNA, 21 nt, Human
uacaaaagaagggcugguauu

SEQ ID NO: 1440466 - RNA, 15 nt, Human
uacaaaagcauguga

SEQ ID NO: 1440467 - RNA, 18 nt, Human
uacaaaaauauaaaauau

SEQ ID NO: 1440468 - RNA, 17 nt, Human
uacaaaaauauaaaaua

SEQ ID NO: 1440469 - RNA, 14 nt, Human
uacaaaaauauaaa

SEQ ID NO: 1440470 - RNA, 18 nt, Human
uacaaguauuuuuaauua

SEQ ID NO: 1440471 - RNA, 17 nt, Human
uacaaguauuuuuaauu

SEQ ID NO: 1440472 - RNA, 15 nt, Human
aaugcaguugucucu

SEQ ID NO: 1440473 - RNA, 10 nt, Human
uacaaaauca

SEQ ID NO: 1440474 - RNA, 20 nt, Human
uacaaaauaaacaaauaaca

SEQ ID NO: 1440475 - RNA, 19 nt, Human
uacaaguaacaaaaauaaa

SEQ ID NO: 1440476 - RNA, 15 nt, Human
uacaaguaacaaaaa

SEQ ID NO: 1440477 - RNA, 14 nt, Human
aaugcauucuucuc

SEQ ID NO: 1440478 - RNA, 19 nt, Human
aaugcauucuucucuguug

SEQ ID NO: 1440479 - RNA, 12 nt, Human
aaugcauuuugu

SEQ ID NO: 1440480 - RNA, 18 nt, Human
aaugcauuuuguuuggua

SEQ ID NO: 1440481 - RNA, 20 nt, Human
aaugcauuuuguuugguauu

SEQ ID NO: 1440482 - RNA, 21 nt, Human
aaugcauuuuguuugguauug

SEQ ID NO: 1440483 - RNA, 23 nt, Human
aaugcauuauaggaucauuuguu

SEQ ID NO: 1440484 - RNA, 14 nt, Human
aaugcauacaaguu

SEQ ID NO: 1440485 - RNA, 22 nt, Human
aaugcauuauaggaucauuugu

SEQ ID NO: 1440486 - RNA, 14 nt, Human
aaugcauaaaugca

SEQ ID NO: 1440487 - RNA, 19 nt, Human
aaugcaguugucucuguuu

SEQ ID NO: 1440488 - RNA, 16 nt, Human
aaugcaguugucucug

SEQ ID NO: 1440489 - RNA, 19 nt, Human
aaugccaagcacuucuuuu

SEQ ID NO: 1440490 - RNA, 14 nt, Human
aaugccaagcacuu

SEQ ID NO: 1440491 - RNA, 21 nt, Human
aaugccaaauuaaaaaagaua

SEQ ID NO: 1440492 - RNA, 17 nt, Human
aaugccaaauuaaaaaa

SEQ ID NO: 1440493 - RNA, 16 nt, Human
aaugccaaauuaaaaa

SEQ ID NO: 1440494 - RNA, 22 nt, Human
aaugccaaauuaaaaaagauaa

SEQ ID NO: 1440495 - RNA, 15 nt, Human
aaugccaaauuaaaa

SEQ ID NO: 1440496 - RNA, 23 nt, Human
aaugcauuuuguuugguauugua

SEQ ID NO: 1440497 - RNA, 20 nt, Human
aaugcuuuuuauuucugcau

SEQ ID NO: 1440498 - RNA, 19 nt, Human
aaugcuuuuuauuucugca

SEQ ID NO: 1440499 - RNA, 18 nt, Human
aaugcuuugauauuucaa

SEQ ID NO: 1440500 - RNA, 12 nt, Human
aaugcuuugaua

SEQ ID NO: 1440501 - RNA, 22 nt, Human
aaugcuuugaaauugaaccuuu

SEQ ID NO: 1440502 - RNA, 14 nt, Human
aaugcuuugaaauu

SEQ ID NO: 1440503 - RNA, 21 nt, Human
aauggaaugugauguucaugg

SEQ ID NO: 1440504 - RNA, 21 nt, Human
aaugccccugaauuuaaauag

SEQ ID NO: 1440505 - RNA, 13 nt, Human
aaugcugugcccu

SEQ ID NO: 1440506 - RNA, 20 nt, Human
aaugcugugcccuaaagugu

SEQ ID NO: 1440507 - RNA, 21 nt, Human
aaugcugugcccuaaagugua

SEQ ID NO: 1440508 - RNA, 21 nt, Human
ucagcgcugucaggauugcga

SEQ ID NO: 1440509 - RNA, 20 nt, Human
ucagcgcugucaggauugcg

SEQ ID NO: 1440510 - RNA, 23 nt, Human
ucagcgacuccguuggccacucc

SEQ ID NO: 1440511 - RNA, 20 nt, Human
ucagcgacuccguuggccac

SEQ ID NO: 1440512 - RNA, 19 nt, Human
ucagcgacuccguuggcca

SEQ ID NO: 1440513 - RNA, 17 nt, Human
ucagccuugccagagau

SEQ ID NO: 1440514 - RNA, 16 nt, Human
ucagccuugccagaga

SEQ ID NO: 1440515 - RNA, 15 nt, Human
ucagccuugccagag

SEQ ID NO: 1440516 - RNA, 14 nt, Human
ucagccuugccaga

SEQ ID NO: 1440517 - RNA, 17 nt, Human
accccuguaggccucag

SEQ ID NO: 1440518 - RNA, 16 nt, Human
accccuguaggccuca

SEQ ID NO: 1440519 - RNA, 15 nt, Human
accccuguaggccuc

SEQ ID NO: 1440520 - RNA, 20 nt, Human
accccccuuucacaggcagc

SEQ ID NO: 1440521 - RNA, 21 nt, Human
accccccuuucacaggcagcc

SEQ ID NO: 1440522 - RNA, 18 nt, Human
accccccuuucacaggca

SEQ ID NO: 1440523 - RNA, 14 nt, Human
accccccuguacac

SEQ ID NO: 1440524 - RNA, 22 nt, Human
accccccuguacacaacucacu

SEQ ID NO: 1440525 - RNA, 11 nt, Human
accccccucug

SEQ ID NO: 1440526 - RNA, 21 nt, Human
ucagcuucguuuauuuucaag

SEQ ID NO: 1440527 - RNA, 19 nt, Human
ucagcuucguuuauuuuca

SEQ ID NO: 1440528 - RNA, 15 nt, Human
ucagcucauccaugc

SEQ ID NO: 1440529 - RNA, 12 nt, Human
ucagcucaugga

SEQ ID NO: 1440530 - RNA, 15 nt, Human
ucaggaaaggaauca

SEQ ID NO: 1440531 - RNA, 21 nt, Human
ucaggaaacgagacuuuccau

SEQ ID NO: 1440532 - RNA, 22 nt, Human
ucaggaaacgagacuuuccauu

SEQ ID NO: 1440533 - RNA, 18 nt, Human
ucaggaaaauugaaugca

SEQ ID NO: 1440534 - RNA, 19 nt, Human
ucaggaaagagaacuucca

SEQ ID NO: 1440535 - RNA, 12 nt, Human
ucaggaaaauug

SEQ ID NO: 1440536 - RNA, 18 nt, Human
ucaggaaaaggccugggg

SEQ ID NO: 1440537 - RNA, 19 nt, Human
ucaggaaaaggccuggggu

SEQ ID NO: 1440538 - RNA, 17 nt, Human
ucaggaaaaggccuggg

SEQ ID NO: 1440539 - RNA, 16 nt, Human
ucaggaaaaggccugg

SEQ ID NO: 1440540 - RNA, 15 nt, Human
ucaggaaaaggccug

SEQ ID NO: 1440541 - RNA, 14 nt, Human
ucaggaaaaggccu

SEQ ID NO: 1440542 - RNA, 13 nt, Human
ucaggaaagagaa

SEQ ID NO: 1440543 - RNA, 19 nt, Human
ucagccuacaggccucaca

SEQ ID NO: 1440544 - RNA, 12 nt, Human
ucagcauuugac

SEQ ID NO: 1440545 - RNA, 11 nt, Human
ucagcauuuga

SEQ ID NO: 1440546 - RNA, 21 nt, Human
ucagagccuccuuucuggcuu

SEQ ID NO: 1440547 - RNA, 22 nt, Human
ucagagaggccuuuuggaaugu

SEQ ID NO: 1440548 - RNA, 21 nt, Human
ucagagaggccuuuuggaaug

SEQ ID NO: 1440549 - RNA, 20 nt, Human
ucagccagugaccaaccuuu

SEQ ID NO: 1440550 - RNA, 19 nt, Human
ucagccaggagcugggcag

SEQ ID NO: 1440551 - RNA, 23 nt, Human
ucagccaagguuuuauaaggcug

SEQ ID NO: 1440552 - RNA, 22 nt, Human
ucagccaagguuuuauaaggcu

SEQ ID NO: 1440553 - RNA, 16 nt, Human
accccacgccuuaucc

SEQ ID NO: 1440554 - RNA, 21 nt, Human
accccaccuuuauuccuucau

SEQ ID NO: 1440555 - RNA, 14 nt, Human
accccaccucuucc

SEQ ID NO: 1440556 - RNA, 20 nt, Human
acccaggcuggagugcagug

SEQ ID NO: 1440557 - RNA, 19 nt, Human
acccaggcuggagugcagu

SEQ ID NO: 1440558 - RNA, 18 nt, Human
acccaggcuggagugcag

SEQ ID NO: 1440559 - RNA, 19 nt, Human
acccaggccaggcaugugg

SEQ ID NO: 1440560 - RNA, 14 nt, Human
acccaggaucccca

SEQ ID NO: 1440561 - RNA, 15 nt, Human
acccagcggacacac

SEQ ID NO: 1440562 - RNA, 16 nt, Human
accccagggcacagga

SEQ ID NO: 1440563 - RNA, 15 nt, Human
accccagggcacagg

SEQ ID NO: 1440564 - RNA, 12 nt, Human
accccagggcac

SEQ ID NO: 1440565 - RNA, 11 nt, Human
accccagggca

SEQ ID NO: 1440566 - RNA, 10 nt, Human
accccagggc

SEQ ID NO: 1440567 - RNA, 20 nt, Human
accccaggcugaagcagguu

SEQ ID NO: 1440568 - RNA, 14 nt, Human
accccagacacugg

SEQ ID NO: 1440569 - RNA, 14 nt, Human
accccacucccaca

SEQ ID NO: 1440570 - RNA, 13 nt, Human
accccacucccac

SEQ ID NO: 1440571 - RNA, 12 nt, Human
accccacuccca

SEQ ID NO: 1440572 - RNA, 23 nt, Human
accccagcuggggccaggcuggg

SEQ ID NO: 1440573 - RNA, 23 nt, Human
ucagaauuaaacuuuuaauucau

SEQ ID NO: 1440574 - RNA, 20 nt, Human
ucagaauuaaacuuuuaauu

SEQ ID NO: 1440575 - RNA, 18 nt, Human
ucagaauuaaacuuuuaa

SEQ ID NO: 1440576 - RNA, 16 nt, Human
ucagaauuaaacuuuu

SEQ ID NO: 1440577 - RNA, 14 nt, Human
ucagaaugucauuu

SEQ ID NO: 1440578 - RNA, 17 nt, Human
ucagaaucucucuucuu

SEQ ID NO: 1440579 - RNA, 21 nt, Human
ucagaagccugggggccuggc

SEQ ID NO: 1440580 - RNA, 20 nt, Human
ucagaagccugggggccugg

SEQ ID NO: 1440581 - RNA, 19 nt, Human
ucagaagccugggggccug

SEQ ID NO: 1440582 - RNA, 16 nt, Human
ucagaagccugggggc

SEQ ID NO: 1440583 - RNA, 15 nt, Human
ucagaagccuggggg

SEQ ID NO: 1440584 - RNA, 14 nt, Human
ucagaagccugggg

SEQ ID NO: 1440585 - RNA, 13 nt, Human
ucagaagccuggg

SEQ ID NO: 1440586 - RNA, 12 nt, Human
ucagaagccugg

SEQ ID NO: 1440587 - RNA, 16 nt, Human
acccagcccucauccc

SEQ ID NO: 1440588 - RNA, 15 nt, Human
acccagcccucaucc

SEQ ID NO: 1440589 - RNA, 17 nt, Human
acccagccccagccagg

SEQ ID NO: 1440590 - RNA, 22 nt, Human
acccagaggaaggggccagagg

SEQ ID NO: 1440591 - RNA, 15 nt, Human
ucagaagucaucuug

SEQ ID NO: 1440592 - RNA, 22 nt, Human
ucagaagccugggggccuggcu

SEQ ID NO: 1440593 - RNA, 23 nt, Human
ucagaagccugggggccuggcug

SEQ ID NO: 1440594 - RNA, 22 nt, Human
ucagaagucaucuugcuaccag

SEQ ID NO: 1440595 - RNA, 18 nt, Human
ucagaagucaucuugcua

SEQ ID NO: 1440596 - RNA, 17 nt, Human
ucagaaguuaguuugua

SEQ ID NO: 1440597 - RNA, 13 nt, Human
accauuuucuggu

SEQ ID NO: 1440598 - RNA, 15 nt, Human
accauuuuaaaguua

SEQ ID NO: 1440599 - RNA, 20 nt, Human
accauuuggcaucccugggc

SEQ ID NO: 1440600 - RNA, 19 nt, Human
accauuuggcaucccuggg

SEQ ID NO: 1440601 - RNA, 22 nt, Human
accauuuggcaucccugggccu

SEQ ID NO: 1440602 - RNA, 23 nt, Human
accauuuggauccuguguggaga

SEQ ID NO: 1440603 - RNA, 19 nt, Human
accauugucucagagcagg

SEQ ID NO: 1440604 - RNA, 18 nt, Human
accauugucucagagcag

SEQ ID NO: 1440605 - RNA, 15 nt, Human
accauugucucagag

SEQ ID NO: 1440606 - RNA, 14 nt, Human
accauugucucaga

SEQ ID NO: 1440607 - RNA, 23 nt, Human
accauuucuugagguaaaagcau

SEQ ID NO: 1440608 - RNA, 22 nt, Human
acccagaccuguuagcagacag

SEQ ID NO: 1440609 - RNA, 19 nt, Human
acccagacauaaaggaaaa

SEQ ID NO: 1440610 - RNA, 20 nt, Human
acccagacauaaaggaaaag

SEQ ID NO: 1440611 - RNA, 18 nt, Human
acccagacauaaaggaaa

SEQ ID NO: 1440612 - RNA, 15 nt, Human
acccagacucagaca

SEQ ID NO: 1440613 - RNA, 21 nt, Human
acccagauaaagguucaugca

SEQ ID NO: 1440614 - RNA, 16 nt, Human
accauuauaaugaauu

SEQ ID NO: 1440615 - RNA, 21 nt, Human
accauuauaaccuuaauuuau

SEQ ID NO: 1440616 - RNA, 17 nt, Human
accauuauaaugaauuu

SEQ ID NO: 1440617 - RNA, 19 nt, Human
accauuauaaccuuaauuu

SEQ ID NO: 1440618 - RNA, 14 nt, Human
accauuaaaccauc

SEQ ID NO: 1440619 - RNA, 13 nt, Human
accauuaaccaga

SEQ ID NO: 1440620 - RNA, 19 nt, Human
accauuaaaccaucucccu

SEQ ID NO: 1440621 - RNA, 13 nt, Human
accauuaaaccau

SEQ ID NO: 1440622 - RNA, 18 nt, Human
accauugaauucuugguu

SEQ ID NO: 1440623 - RNA, 16 nt, Human
accauugaaggcuuaa

SEQ ID NO: 1440624 - RNA, 13 nt, Human
accauugaaggcu

SEQ ID NO: 1440625 - RNA, 24 nt, Human
accauucugacucgguuucuccaa

SEQ ID NO: 1440626 - RNA, 21 nt, Human
accauuccaagucuccacccc

SEQ ID NO: 1440627 - RNA, 17 nt, Human
accauguagaaaauuug

SEQ ID NO: 1440628 - RNA, 17 nt, Human
accauguacaugaagaa

SEQ ID NO: 1440629 - RNA, 11 nt, Human
accauguacau

SEQ ID NO: 1440630 - RNA, 14 nt, Human
accauguacauagc

SEQ ID NO: 1440631 - RNA, 12 nt, Human
accauguaaugg

SEQ ID NO: 1440632 - RNA, 21 nt, Human
accaugguuaagaguccaaga

SEQ ID NO: 1440633 - RNA, 19 nt, Human
accaugguuaagaguccaa

SEQ ID NO: 1440634 - RNA, 17 nt, Human
accaugguuaagagucc

SEQ ID NO: 1440635 - RNA, 22 nt, Human
accauggucggaaaacaugcua

SEQ ID NO: 1440636 - RNA, 16 nt, Human
ucacacucgacaugaa

SEQ ID NO: 1440637 - RNA, 12 nt, Human
ucacacucgaca

SEQ ID NO: 1440638 - RNA, 21 nt, Human
ucacacucaguugugacuaac

SEQ ID NO: 1440639 - RNA, 20 nt, Human
ucaccaggcagccucugggg

SEQ ID NO: 1440640 - RNA, 22 nt, Human
ucaccaggcagccucugggggg

SEQ ID NO: 1440641 - RNA, 19 nt, Human
ucaccaggcagccucuggg

SEQ ID NO: 1440642 - RNA, 17 nt, Human
ucaccaggcagccucug

SEQ ID NO: 1440643 - RNA, 21 nt, Human
ucacaugaauuauuacagugu

SEQ ID NO: 1440644 - RNA, 22 nt, Human
ucacaugaauuauuacaguguu

SEQ ID NO: 1440645 - RNA, 18 nt, Human
ucacaugaauuauuacag

SEQ ID NO: 1440646 - RNA, 17 nt, Human
ucacaugaauuauuaca

SEQ ID NO: 1440647 - RNA, 16 nt, Human
ucacaugaauuauuac

SEQ ID NO: 1440648 - RNA, 15 nt, Human
ucacaugaauuauua

SEQ ID NO: 1440649 - RNA, 23 nt, Human
ucaccaguguguggcuuucagag

SEQ ID NO: 1440650 - RNA, 18 nt, Human
ucaccaguguguggcuuu

SEQ ID NO: 1440651 - RNA, 19 nt, Human
ucacccaggcuggagugca

SEQ ID NO: 1440652 - RNA, 19 nt, Human
ucacccaggcuggacugca

SEQ ID NO: 1440653 - RNA, 22 nt, Human
ucacccagacauaaaggaaaag

SEQ ID NO: 1440654 - RNA, 19 nt, Human
ucacccagguuggagugca

SEQ ID NO: 1440655 - RNA, 14 nt, Human
ucaagucagcucuu

SEQ ID NO: 1440656 - RNA, 20 nt, Human
ucaagugaucugcccaccuc

SEQ ID NO: 1440657 - RNA, 15 nt, Human
accaaucaugaauua

SEQ ID NO: 1440658 - RNA, 13 nt, Human
accaaucaugaau

SEQ ID NO: 1440659 - RNA, 18 nt, Human
accacaaacuguaauaca

SEQ ID NO: 1440660 - RNA, 14 nt, Human
accacaaacuguaa

SEQ ID NO: 1440661 - RNA, 22 nt, Human
accaauugcugcuacuuauaua

SEQ ID NO: 1440662 - RNA, 16 nt, Human
accaauuauuuucauc

SEQ ID NO: 1440663 - RNA, 20 nt, Human
accaaucauuuuaauuauua

SEQ ID NO: 1440664 - RNA, 13 nt, Human
accaaucauuuua

SEQ ID NO: 1440665 - RNA, 14 nt, Human
accaauuauuuuca

SEQ ID NO: 1440666 - RNA, 17 nt, Human
accacacccuguacugu

SEQ ID NO: 1440667 - RNA, 13 nt, Human
accacacccugua

SEQ ID NO: 1440668 - RNA, 18 nt, Human
accacacccggcuaauuu

SEQ ID NO: 1440669 - RNA, 17 nt, Human
ucacaaaguggaacgaa

SEQ ID NO: 1440670 - RNA, 15 nt, Human
ucaauucuugccaaa

SEQ ID NO: 1440671 - RNA, 17 nt, Human
ucaauucuucccuaucu

SEQ ID NO: 1440672 - RNA, 19 nt, Human
ucaauucuucccuaucuuu

SEQ ID NO: 1440673 - RNA, 22 nt, Human
ucaauuuuaucccucaccugua

SEQ ID NO: 1440674 - RNA, 21 nt, Human
ucaauuuuaucccucaccugu

SEQ ID NO: 1440675 - RNA, 16 nt, Human
ucaauuuuaucccuca

SEQ ID NO: 1440676 - RNA, 23 nt, Human
ucaauucuucccuaucuuugcca

SEQ ID NO: 1440677 - RNA, 18 nt, Human
ucaccuucaccuucaucc

SEQ ID NO: 1440678 - RNA, 21 nt, Human
ucaccugugcuucgggcccuu

SEQ ID NO: 1440679 - RNA, 20 nt, Human
ucaccugugcuucgggcccu

SEQ ID NO: 1440680 - RNA, 21 nt, Human
ucacuaggcccccacuugccu

SEQ ID NO: 1440681 - RNA, 19 nt, Human
ucacuaggcccccacuugc

SEQ ID NO: 1440682 - RNA, 21 nt, Human
ucacuagcccuccuuuuucca

SEQ ID NO: 1440683 - RNA, 18 nt, Human
ucacuagcccuccuuuuu

SEQ ID NO: 1440684 - RNA, 20 nt, Human
ucacuccccaacccccaacu

SEQ ID NO: 1440685 - RNA, 22 nt, Human
ucacuaggcccccacuugccuc

SEQ ID NO: 1440686 - RNA, 13 nt, Human
ucaccugcacuaa

SEQ ID NO: 1440687 - RNA, 16 nt, Human
ucaccugccccaacuc

SEQ ID NO: 1440688 - RNA, 19 nt, Human
ucaccugagucacccuacc

SEQ ID NO: 1440689 - RNA, 23 nt, Human
ucaccucuagguccccauacucc

SEQ ID NO: 1440690 - RNA, 22 nt, Human
ucaccucuagguccccauacuc

SEQ ID NO: 1440691 - RNA, 19 nt, Human
accaggcuugccugcaggc

SEQ ID NO: 1440692 - RNA, 17 nt, Human
accaggcugccucccuu

SEQ ID NO: 1440693 - RNA, 19 nt, Human
accaggcugcucagggcug

SEQ ID NO: 1440694 - RNA, 22 nt, Human
accagccgugagcauguuugga

SEQ ID NO: 1440695 - RNA, 14 nt, Human
accagccucaccag

SEQ ID NO: 1440696 - RNA, 18 nt, Human
accaggcuugccugcagg

SEQ ID NO: 1440697 - RNA, 19 nt, Human
accagccgugagcauguuu

SEQ ID NO: 1440698 - RNA, 14 nt, Human
accagccgugagca

SEQ ID NO: 1440699 - RNA, 15 nt, Human
accagacucuugccu

SEQ ID NO: 1440700 - RNA, 21 nt, Human
accacugcugauauuuucucu

SEQ ID NO: 1440701 - RNA, 15 nt, Human
accacuucagggcuu

SEQ ID NO: 1440702 - RNA, 16 nt, Human
accacuguguauuuaa

SEQ ID NO: 1440703 - RNA, 16 nt, Human
accacuggucuguagg

SEQ ID NO: 1440704 - RNA, 18 nt, Human
accacuuguguuuugcaa

SEQ ID NO: 1440705 - RNA, 15 nt, Human
accacuuuuguucuu

SEQ ID NO: 1440706 - RNA, 16 nt, Human
accacuuuuguucuug

SEQ ID NO: 1440707 - RNA, 21 nt, Human
accacuuuuguucuugguuug

SEQ ID NO: 1440708 - RNA, 16 nt, Human
accagacucuugccug

SEQ ID NO: 1440709 - RNA, 22 nt, Human
accagacuagauggaccugccu

SEQ ID NO: 1440710 - RNA, 23 nt, Human
accagacuacuugggagcaccgc

SEQ ID NO: 1440711 - RNA, 21 nt, Human
accagacuacuugggagcacc

SEQ ID NO: 1440712 - RNA, 17 nt, Human
accagacacccaggacu

SEQ ID NO: 1440713 - RNA, 16 nt, Human
accagacacccaggac

SEQ ID NO: 1440714 - RNA, 15 nt, Human
accagacacccagga

SEQ ID NO: 1440715 - RNA, 14 nt, Human
accagacacccagg

SEQ ID NO: 1440716 - RNA, 20 nt, Human
accagaagcucccccagcaa

SEQ ID NO: 1440717 - RNA, 19 nt, Human
accagaagcucccccagca

SEQ ID NO: 1440718 - RNA, 17 nt, Human
accagaagcucccccag

SEQ ID NO: 1440719 - RNA, 19 nt, Human
accagaaccaauuauuuuc

SEQ ID NO: 1440720 - RNA, 21 nt, Human
accagaaccaauuauuuucau

SEQ ID NO: 1440721 - RNA, 23 nt, Human
accagaaagcaguugagacaaga

SEQ ID NO: 1440722 - RNA, 12 nt, Human
accacuuuuuag

SEQ ID NO: 1440723 - RNA, 13 nt, Human
accacuuuuugca

SEQ ID NO: 1440724 - RNA, 22 nt, Human
accacuuuuguucuugguuugu

SEQ ID NO: 1440725 - RNA, 14 nt, Human
accacuuuuugcag

SEQ ID NO: 1440726 - RNA, 15 nt, Human
accacuuuuugcagc

SEQ ID NO: 1440727 - RNA, 16 nt, Human
accacuuuuugcagcu

SEQ ID NO: 1440728 - RNA, 17 nt, Human
accacuuuuugcagcuu

SEQ ID NO: 1440729 - RNA, 24 nt, Human
accagaaagcaguugagacaagaa

SEQ ID NO: 1440730 - RNA, 17 nt, Human
accagaaaagcccaagu

SEQ ID NO: 1440731 - RNA, 18 nt, Human
accacuuuuugcagcuuu

SEQ ID NO: 1440732 - RNA, 20 nt, Human
accacuuuuugcagcuuucu

SEQ ID NO: 1440733 - RNA, 17 nt, Human
acauauggaauuuugca

SEQ ID NO: 1440734 - RNA, 13 nt, Human
acauauggaauuu

SEQ ID NO: 1440735 - RNA, 19 nt, Human
acauaugaucugucugugg

SEQ ID NO: 1440736 - RNA, 18 nt, Human
acauaugaucugucugug

SEQ ID NO: 1440737 - RNA, 17 nt, Human
acauaugaucugucugu

SEQ ID NO: 1440738 - RNA, 16 nt, Human
acauaugaucugucug

SEQ ID NO: 1440739 - RNA, 15 nt, Human
acauaucuuagaugg

SEQ ID NO: 1440740 - RNA, 21 nt, Human
acauaugugcuggaauucuaa

SEQ ID NO: 1440741 - RNA, 20 nt, Human
acauauggaauuuugcaaag

SEQ ID NO: 1440742 - RNA, 14 nt, Human
acauauugauuucc

SEQ ID NO: 1440743 - RNA, 16 nt, Human
acauauugauuuccgu

SEQ ID NO: 1440744 - RNA, 18 nt, Human
acauauugauuuccguua

SEQ ID NO: 1440745 - RNA, 22 nt, Human
acauauugauuuccguuaaaau

SEQ ID NO: 1440746 - RNA, 23 nt, Human
acauauugauuuccguuaaaaua

SEQ ID NO: 1440747 - RNA, 21 nt, Human
acauagcccacuuacauuuac

SEQ ID NO: 1440748 - RNA, 19 nt, Human
acauagcccacuuacauuu

SEQ ID NO: 1440749 - RNA, 16 nt, Human
acauagcccacuuaca

SEQ ID NO: 1440750 - RNA, 21 nt, Human
acauagagccgggugucccca

SEQ ID NO: 1440751 - RNA, 16 nt, Human
acauagauaaaacauc

SEQ ID NO: 1440752 - RNA, 22 nt, Human
acauagagccggguguccccaa

SEQ ID NO: 1440753 - RNA, 19 nt, Human
acauagagccggguguccc

SEQ ID NO: 1440754 - RNA, 17 nt, Human
acauagacagaagaaac

SEQ ID NO: 1440755 - RNA, 18 nt, Human
acauagacagaagaaaca

SEQ ID NO: 1440756 - RNA, 16 nt, Human
acauagacagaagaaa

SEQ ID NO: 1440757 - RNA, 23 nt, Human
acauauaauguuguuauuuaaag

SEQ ID NO: 1440758 - RNA, 19 nt, Human
acauauauaacaaugcugu

SEQ ID NO: 1440759 - RNA, 15 nt, Human
acauaguuauuuauu

SEQ ID NO: 1440760 - RNA, 20 nt, Human
acauagugggacccugucuc

SEQ ID NO: 1440761 - RNA, 14 nt, Human
acauaguauucaug

SEQ ID NO: 1440762 - RNA, 19 nt, Human
acauaguauucaugacuau

SEQ ID NO: 1440763 - RNA, 22 nt, Human
acauagcuugauaaagggccaa

SEQ ID NO: 1440764 - RNA, 23 nt, Human
uauuuguaaaaugacaaucaugu

SEQ ID NO: 1440765 - RNA, 15 nt, Human
uauuuguaaaaugac

SEQ ID NO: 1440766 - RNA, 14 nt, Human
uauuuguaaaauga

SEQ ID NO: 1440767 - RNA, 17 nt, Human
uauuuggugauuacauu

SEQ ID NO: 1440768 - RNA, 22 nt, Human
uauuuggugauuacauuuuaaa

SEQ ID NO: 1440769 - RNA, 22 nt, Human
acaugaaaacacauuuuucuua

SEQ ID NO: 1440770 - RNA, 18 nt, Human
acaugaaaacacauuuuu

SEQ ID NO: 1440771 - RNA, 19 nt, Human
acaugaaaacacauuuuuc

SEQ ID NO: 1440772 - RNA, 17 nt, Human
acaugaaaacacauuuu

SEQ ID NO: 1440773 - RNA, 16 nt, Human
acaucugugucuuguu

SEQ ID NO: 1440774 - RNA, 15 nt, Human
acaucugugucuugu

SEQ ID NO: 1440775 - RNA, 19 nt, Human
acaucuguaaaucuacaca

SEQ ID NO: 1440776 - RNA, 23 nt, Human
acaucugagguuuuauuucauuu

SEQ ID NO: 1440777 - RNA, 21 nt, Human
acaucugagguuuuauuucau

SEQ ID NO: 1440778 - RNA, 14 nt, Human
acauauuuuaaaau

SEQ ID NO: 1440779 - RNA, 12 nt, Human
acaucaaagagg

SEQ ID NO: 1440780 - RNA, 14 nt, Human
acaucacaagacua

SEQ ID NO: 1440781 - RNA, 14 nt, Human
acaucaaucuuuaa

SEQ ID NO: 1440782 - RNA, 18 nt, Human
acaucaacccgagucauu

SEQ ID NO: 1440783 - RNA, 19 nt, Human
acaucacuuguacaaaaua

SEQ ID NO: 1440784 - RNA, 16 nt, Human
acaucacuuguacaaa

SEQ ID NO: 1440785 - RNA, 15 nt, Human
acaucacuuguacaa

SEQ ID NO: 1440786 - RNA, 14 nt, Human
acaucacagcccag

SEQ ID NO: 1440787 - RNA, 16 nt, Human
acaucacagcccagcc

SEQ ID NO: 1440788 - RNA, 23 nt, Human
acaucucccuuuuccaugacugu

SEQ ID NO: 1440789 - RNA, 12 nt, Human
acaucucauuuu

SEQ ID NO: 1440790 - RNA, 22 nt, Human
acaucucaacaggccucagggc

SEQ ID NO: 1440791 - RNA, 21 nt, Human
acaucucaacaggccucaggg

SEQ ID NO: 1440792 - RNA, 20 nt, Human
acaucucaacaggccucagg

SEQ ID NO: 1440793 - RNA, 17 nt, Human
acaucucaacaggccuc

SEQ ID NO: 1440794 - RNA, 23 nt, Human
acaucuauuuuggauuguauauu

SEQ ID NO: 1440795 - RNA, 19 nt, Human
acaucuauuuuggauugua

SEQ ID NO: 1440796 - RNA, 18 nt, Human
acaucuauuuuggauugu

SEQ ID NO: 1440797 - RNA, 22 nt, Human
acaucagagugacauccaggag

SEQ ID NO: 1440798 - RNA, 12 nt, Human
acaucagcaaac

SEQ ID NO: 1440799 - RNA, 20 nt, Human
acaguuuuccuaugcuuuga

SEQ ID NO: 1440800 - RNA, 19 nt, Human
acaguuuuaacuguggaua

SEQ ID NO: 1440801 - RNA, 17 nt, Human
acaguuuuaacugugga

SEQ ID NO: 1440802 - RNA, 21 nt, Human
acaguuuuaacuguggauauu

SEQ ID NO: 1440803 - RNA, 13 nt, Human
acaguuuuaacug

SEQ ID NO: 1440804 - RNA, 16 nt, Human
acaguuuguuaguaug

SEQ ID NO: 1440805 - RNA, 20 nt, Human
acaguuuguuaguaugaggc

SEQ ID NO: 1440806 - RNA, 21 nt, Human
acauagaaauugccugacgaa

SEQ ID NO: 1440807 - RNA, 16 nt, Human
acauagaaauugccug

SEQ ID NO: 1440808 - RNA, 23 nt, Human
acauacuugaagggccagagcca

SEQ ID NO: 1440809 - RNA, 22 nt, Human
acauacuugaagggccagagcc

SEQ ID NO: 1440810 - RNA, 21 nt, Human
acauacuugaagggccagagc

SEQ ID NO: 1440811 - RNA, 20 nt, Human
acauacuugaagggccagag

SEQ ID NO: 1440812 - RNA, 19 nt, Human
acauacuugaagggccaga

SEQ ID NO: 1440813 - RNA, 18 nt, Human
acauacuugaagggccag

SEQ ID NO: 1440814 - RNA, 17 nt, Human
acauacuugaagggcca

SEQ ID NO: 1440815 - RNA, 16 nt, Human
acauacuugaagggcc

SEQ ID NO: 1440816 - RNA, 15 nt, Human
acauacuugaagggc

SEQ ID NO: 1440817 - RNA, 19 nt, Human
acauacuggccuggacugu

SEQ ID NO: 1440818 - RNA, 18 nt, Human
acauacuggccuggacug

SEQ ID NO: 1440819 - RNA, 17 nt, Human
acauacucauuuuucau

SEQ ID NO: 1440820 - RNA, 16 nt, Human
acauacucauuuuuca

SEQ ID NO: 1440821 - RNA, 14 nt, Human
acauacucauuuuu

SEQ ID NO: 1440822 - RNA, 13 nt, Human
acauacucauuuu

SEQ ID NO: 1440823 - RNA, 12 nt, Human
acauacucauuu

SEQ ID NO: 1440824 - RNA, 21 nt, Human
acauacuaaccagcagaaaug

SEQ ID NO: 1440825 - RNA, 22 nt, Human
acauacuaaccagcagaaaugc

SEQ ID NO: 1440826 - RNA, 21 nt, Human
acauacccuggccgcccccug

SEQ ID NO: 1440827 - RNA, 14 nt, Human
acauaccuaagaag

SEQ ID NO: 1440828 - RNA, 13 nt, Human
acauacuaaccag

SEQ ID NO: 1440829 - RNA, 20 nt, Human
acauacccuggccgcccccu

SEQ ID NO: 1440830 - RNA, 22 nt, Human
acauacccugaccuggcccccu

SEQ ID NO: 1440831 - RNA, 16 nt, Human
acauacccugaccugg

SEQ ID NO: 1440832 - RNA, 20 nt, Human
acauacccccucccccaccg

SEQ ID NO: 1440833 - RNA, 18 nt, Human
acauaccccuuacaaaug

SEQ ID NO: 1440834 - RNA, 14 nt, Human
acauacccccuccc

SEQ ID NO: 1440835 - RNA, 14 nt, Human
acauaaaaaggaca

SEQ ID NO: 1440836 - RNA, 22 nt, Human
acaguuugaaauaagcuauuug

SEQ ID NO: 1440837 - RNA, 20 nt, Human
acaguuugaaauaagcuauu

SEQ ID NO: 1440838 - RNA, 18 nt, Human
acaguuugaaauaagcua

SEQ ID NO: 1440839 - RNA, 15 nt, Human
acaguuugaaauaag

SEQ ID NO: 1440840 - RNA, 14 nt, Human
acaguuugaaauaa

SEQ ID NO: 1440841 - RNA, 13 nt, Human
acaguuugaaaua

SEQ ID NO: 1440842 - RNA, 19 nt, Human
acaguuuaccaguugccuu

SEQ ID NO: 1440843 - RNA, 15 nt, Human
acaguuuauuuguug

SEQ ID NO: 1440844 - RNA, 22 nt, Human
acaguuuaccaguugccuuuua

SEQ ID NO: 1440845 - RNA, 19 nt, Human
acaguuuaaugaagaucua

SEQ ID NO: 1440846 - RNA, 22 nt, Human
acaguuguauuuaacagaaauu

SEQ ID NO: 1440847 - RNA, 18 nt, Human
acaguuguauuuaacaga

SEQ ID NO: 1440848 - RNA, 13 nt, Human
acaguuguauuua

SEQ ID NO: 1440849 - RNA, 12 nt, Human
acaguuguauuu

SEQ ID NO: 1440850 - RNA, 24 nt, Human
acaguugguaacuuuugugaauua

SEQ ID NO: 1440851 - RNA, 16 nt, Human
acaguugguaacuuuu

SEQ ID NO: 1440852 - RNA, 15 nt, Human
acaguugguaacuuu

SEQ ID NO: 1440853 - RNA, 14 nt, Human
acaguugguaacuu

SEQ ID NO: 1440854 - RNA, 23 nt, Human
acaguugcauguaguaacacuaa

SEQ ID NO: 1440855 - RNA, 13 nt, Human
acaguugcaugua

SEQ ID NO: 1440856 - RNA, 22 nt, Human
acaguugaagggaggggcugug

SEQ ID NO: 1440857 - RNA, 22 nt, Human
acaguucuuugggccagacaug

SEQ ID NO: 1440858 - RNA, 21 nt, Human
acaguucuuugggccagacau

SEQ ID NO: 1440859 - RNA, 13 nt, Human
uauuuccucccuc

SEQ ID NO: 1440860 - RNA, 21 nt, Human
uaugaagaaggugaauagcca

SEQ ID NO: 1440861 - RNA, 17 nt, Human
uaugaagaacugaggag

SEQ ID NO: 1440862 - RNA, 16 nt, Human
uaugaagaacugagga

SEQ ID NO: 1440863 - RNA, 14 nt, Human
uaugaagacauaaa

SEQ ID NO: 1440864 - RNA, 18 nt, Human
uauuuccauucaacaaga

SEQ ID NO: 1440865 - RNA, 21 nt, Human
uaugaaauauuauguuaaaac

SEQ ID NO: 1440866 - RNA, 20 nt, Human
uaugaacuugaggacacaug

SEQ ID NO: 1440867 - RNA, 21 nt, Human
uaugaacuugaggacacaugu

SEQ ID NO: 1440868 - RNA, 14 nt, Human
uaugaagaacugag

SEQ ID NO: 1440869 - RNA, 23 nt, Human
uaugaacuugaggacacaugucc

SEQ ID NO: 1440870 - RNA, 22 nt, Human
uaugaacuugaggacacauguc

SEQ ID NO: 1440871 - RNA, 22 nt, Human
acauucauagucuuuggagaaa

SEQ ID NO: 1440872 - RNA, 20 nt, Human
acauucaccugccccaacuc

SEQ ID NO: 1440873 - RNA, 14 nt, Human
acauucaccugccc

SEQ ID NO: 1440874 - RNA, 13 nt, Human
acauucaccugcc

SEQ ID NO: 1440875 - RNA, 14 nt, Human
acauuagucucagu

SEQ ID NO: 1440876 - RNA, 22 nt, Human
acauuaacucauuagacuggaa

SEQ ID NO: 1440877 - RNA, 15 nt, Human
acauuaacucauuag

SEQ ID NO: 1440878 - RNA, 14 nt, Human
acauuaacucauua

SEQ ID NO: 1440879 - RNA, 13 nt, Human
acauuaacucauu

SEQ ID NO: 1440880 - RNA, 19 nt, Human
acauuaggaaaaguugcua

SEQ ID NO: 1440881 - RNA, 16 nt, Human
acaugcuccagauuag

SEQ ID NO: 1440882 - RNA, 14 nt, Human
acaugcugaacauc

SEQ ID NO: 1440883 - RNA, 21 nt, Human
acaugcugaacaucacagcuu

SEQ ID NO: 1440884 - RNA, 17 nt, Human
acaugucuguucuacau

SEQ ID NO: 1440885 - RNA, 19 nt, Human
acauguccuucugagcccg

SEQ ID NO: 1440886 - RNA, 23 nt, Human
acauguccugccuauuaucuguc

SEQ ID NO: 1440887 - RNA, 21 nt, Human
acauguccagugggaggugag

SEQ ID NO: 1440888 - RNA, 18 nt, Human
acaugucuguucuacaua

SEQ ID NO: 1440889 - RNA, 12 nt, Human
acaugucuuaau

SEQ ID NO: 1440890 - RNA, 22 nt, Human
acauuaaauuuuuuuuacauuu

SEQ ID NO: 1440891 - RNA, 22 nt, Human
ucaacagcguuccuagagaaga

SEQ ID NO: 1440892 - RNA, 19 nt, Human
ucaacagcagggugggcuu

SEQ ID NO: 1440893 - RNA, 16 nt, Human
ucaacagagacugaau

SEQ ID NO: 1440894 - RNA, 22 nt, Human
ucaacacccaguuuccuuggga

SEQ ID NO: 1440895 - RNA, 14 nt, Human
ucaacacccaguuu

SEQ ID NO: 1440896 - RNA, 23 nt, Human
ucaacaggccucagggcuccuug

SEQ ID NO: 1440897 - RNA, 21 nt, Human
ucaacaggccucagggcuccu

SEQ ID NO: 1440898 - RNA, 17 nt, Human
ucaacaggccucagggc

SEQ ID NO: 1440899 - RNA, 16 nt, Human
ucaacaggccucaggg

SEQ ID NO: 1440900 - RNA, 22 nt, Human
ucaacaccaugauuccuuuaac

SEQ ID NO: 1440901 - RNA, 14 nt, Human
ucaacaccaugauu

SEQ ID NO: 1440902 - RNA, 17 nt, Human
ucaacaauucuaaaaug

SEQ ID NO: 1440903 - RNA, 15 nt, Human
ucaacaauucuaaaa

SEQ ID NO: 1440904 - RNA, 14 nt, Human
ucaacaauucuaaa

SEQ ID NO: 1440905 - RNA, 20 nt, Human
ucaaauuuguaggguuucua

SEQ ID NO: 1440906 - RNA, 23 nt, Human
ucaaauuuguaggguuucuaggu

SEQ ID NO: 1440907 - RNA, 17 nt, Human
ucaaauuucuaaaucuc

SEQ ID NO: 1440908 - RNA, 22 nt, Human
acauuccaacucguauagcaug

SEQ ID NO: 1440909 - RNA, 15 nt, Human
acauuccaacucgua

SEQ ID NO: 1440910 - RNA, 17 nt, Human
acauuccaaagaacagc

SEQ ID NO: 1440911 - RNA, 19 nt, Human
acauucaggaauucuugga

SEQ ID NO: 1440912 - RNA, 16 nt, Human
acauuccaagacucua

SEQ ID NO: 1440913 - RNA, 13 nt, Human
acauuccauccuu

SEQ ID NO: 1440914 - RNA, 12 nt, Human
acauucuguuaa

SEQ ID NO: 1440915 - RNA, 15 nt, Human
acauucuguuaauca

SEQ ID NO: 1440916 - RNA, 15 nt, Human
ucaaauuucuaaauc

SEQ ID NO: 1440917 - RNA, 16 nt, Human
ucaaauuucuaaaucu

SEQ ID NO: 1440918 - RNA, 15 nt, Human
ucaagggucaggccu

SEQ ID NO: 1440919 - RNA, 13 nt, Human
ucaagggucaggc

SEQ ID NO: 1440920 - RNA, 12 nt, Human
ucaaguauuugg

SEQ ID NO: 1440921 - RNA, 23 nt, Human
ucaaguauuauaccuuuuuuaga

SEQ ID NO: 1440922 - RNA, 16 nt, Human
ucaaguauuauaccuu

SEQ ID NO: 1440923 - RNA, 21 nt, Human
ucaaguauuauaccuuuuuua

SEQ ID NO: 1440924 - RNA, 15 nt, Human
ucaaggucguuuuuu

SEQ ID NO: 1440925 - RNA, 16 nt, Human
ucaagggucaggccuu

SEQ ID NO: 1440926 - RNA, 11 nt, Human
ucaaguauuau

SEQ ID NO: 1440927 - RNA, 15 nt, Human
ucaaguauuauaccu

SEQ ID NO: 1440928 - RNA, 23 nt, Human
ucaagaaacugaggaauuuucuu

SEQ ID NO: 1440929 - RNA, 22 nt, Human
ucaagaaacugaggaauuuucu

SEQ ID NO: 1440930 - RNA, 20 nt, Human
ucaagaaacugaggaauuuu

SEQ ID NO: 1440931 - RNA, 18 nt, Human
ucaagaaacugaggaauu

SEQ ID NO: 1440932 - RNA, 17 nt, Human
ucaagaaacugaggaau

SEQ ID NO: 1440933 - RNA, 13 nt, Human
ucaagaaacugag

SEQ ID NO: 1440934 - RNA, 12 nt, Human
ucaagaaacuga

SEQ ID NO: 1440935 - RNA, 19 nt, Human
ucaagaaaacaggcacugc

SEQ ID NO: 1440936 - RNA, 15 nt, Human
ucaagaaaacaggca

SEQ ID NO: 1440937 - RNA, 23 nt, Human
ucaagaaaacaggcacugcccug

SEQ ID NO: 1440938 - RNA, 23 nt, Human
ucaacaguuuuccuaugcuuuga

SEQ ID NO: 1440939 - RNA, 22 nt, Human
ucaacaguuuuccuaugcuuug

SEQ ID NO: 1440940 - RNA, 20 nt, Human
ucaacaguuuuccuaugcuu

SEQ ID NO: 1440941 - RNA, 17 nt, Human
ucaacaguuuuccuaug

SEQ ID NO: 1440942 - RNA, 15 nt, Human
ucaacaguuuuccua

SEQ ID NO: 1440943 - RNA, 14 nt, Human
ucaacaguuuuccu

SEQ ID NO: 1440944 - RNA, 18 nt, Human
ucaacagugaagacagaa

SEQ ID NO: 1440945 - RNA, 22 nt, Human
ucaacagugaagacagaaguuu

SEQ ID NO: 1440946 - RNA, 17 nt, Human
ucaacagugaagacaga

SEQ ID NO: 1440947 - RNA, 15 nt, Human
ucaacagugaagaca

SEQ ID NO: 1440948 - RNA, 22 nt, Human
ucaacaguaaaccacugaaaaa

SEQ ID NO: 1440949 - RNA, 20 nt, Human
ucaacaguaaaccacugaaa

SEQ ID NO: 1440950 - RNA, 18 nt, Human
ucaacaguaaaccacuga

SEQ ID NO: 1440951 - RNA, 14 nt, Human
ucaacaguaaacca

SEQ ID NO: 1440952 - RNA, 13 nt, Human
ucaacaguaaacc

SEQ ID NO: 1440953 - RNA, 22 nt, Human
ucaacaggccucagggcuccuu

SEQ ID NO: 1440954 - RNA, 22 nt, Human
ucaagagcccugucaguagagu

SEQ ID NO: 1440955 - RNA, 15 nt, Human
ucaagagacugaguc

SEQ ID NO: 1440956 - RNA, 22 nt, Human
ucaagacccuuuuggguuucug

SEQ ID NO: 1440957 - RNA, 19 nt, Human
ucaagaauagcauuguaaa

SEQ ID NO: 1440958 - RNA, 21 nt, Human
ucaagaauaaucacgcuuucc

SEQ ID NO: 1440959 - RNA, 14 nt, Human
ucaagaaauaaguu

SEQ ID NO: 1440960 - RNA, 17 nt, Human
ucaagaaauaaguuuuu

SEQ ID NO: 1440961 - RNA, 22 nt, Human
ucaagaaauaaaaggaagccaa

SEQ ID NO: 1440962 - RNA, 21 nt, Human
ucaagaaauaaaaggaagcca

SEQ ID NO: 1440963 - RNA, 20 nt, Human
ucaagaaauaaaaggaagcc

SEQ ID NO: 1440964 - RNA, 21 nt, Human
ucaagaaagcuucaaacugca

SEQ ID NO: 1440965 - RNA, 22 nt, Human
ucaagaaaacaggcacugcccu

SEQ ID NO: 1440966 - RNA, 22 nt, Human
ucaagaagugaagaaugcacaa

SEQ ID NO: 1440967 - RNA, 22 nt, Human
ucaagaacacagcccugcuucu

SEQ ID NO: 1440968 - RNA, 14 nt, Human
acaugaaguauuuu

SEQ ID NO: 1440969 - RNA, 13 nt, Human
acaugaaguauuu

SEQ ID NO: 1440970 - RNA, 22 nt, Human
ucaaauacauuuaaaacauuaa

SEQ ID NO: 1440971 - RNA, 21 nt, Human
ucaaauacauuuaaaacauua

SEQ ID NO: 1440972 - RNA, 18 nt, Human
acaugaagauucuuuccc

SEQ ID NO: 1440973 - RNA, 17 nt, Human
acaugaagauucuuucc

SEQ ID NO: 1440974 - RNA, 15 nt, Human
acaugaagauucuuu

SEQ ID NO: 1440975 - RNA, 16 nt, Human
acaugaagaagcuaaa

SEQ ID NO: 1440976 - RNA, 20 nt, Human
ucaaauacgugggcauucaa

SEQ ID NO: 1440977 - RNA, 16 nt, Human
acaugaagguaaauaa

SEQ ID NO: 1440978 - RNA, 15 nt, Human
acaugaagguaaaua

SEQ ID NO: 1440979 - RNA, 13 nt, Human
acaugaagguaaa

SEQ ID NO: 1440980 - RNA, 13 nt, Human
acaugaagcuguu

SEQ ID NO: 1440981 - RNA, 19 nt, Human
acaugaagcuguuguguga

SEQ ID NO: 1440982 - RNA, 22 nt, Human
acaugaagauucuuucccaauu

SEQ ID NO: 1440983 - RNA, 12 nt, Human
acaugaaguauu

SEQ ID NO: 1440984 - RNA, 23 nt, Human
acaugaagguaaauaaaaagaaa

SEQ ID NO: 1440985 - RNA, 22 nt, Human
acaugaagguaaauaaaaagaa

SEQ ID NO: 1440986 - RNA, 21 nt, Human
acaugaagguaaauaaaaaga

SEQ ID NO: 1440987 - RNA, 16 nt, Human
acaugaaguccaagca

SEQ ID NO: 1440988 - RNA, 21 nt, Human
ucaaacaccaacauaaaaaug

SEQ ID NO: 1440989 - RNA, 20 nt, Human
ucaaacaaugacaaagcaga

SEQ ID NO: 1440990 - RNA, 21 nt, Human
ucaaacaaugacaaagcagau

SEQ ID NO: 1440991 - RNA, 19 nt, Human
ucaaacaaugacaaagcag

SEQ ID NO: 1440992 - RNA, 14 nt, Human
ucaaacaaugacaa

SEQ ID NO: 1440993 - RNA, 21 nt, Human
ucaaaauuuaacaguuaccug

SEQ ID NO: 1440994 - RNA, 22 nt, Human
ucaaaauguuaucuucucaagu

SEQ ID NO: 1440995 - RNA, 20 nt, Human
ucaaagcaugggauuauuag

SEQ ID NO: 1440996 - RNA, 19 nt, Human
ucaaagcaucuugcauuau

SEQ ID NO: 1440997 - RNA, 14 nt, Human
ucaaagcugaaaug

SEQ ID NO: 1440998 - RNA, 20 nt, Human
ucaaaggagcgagcaugucg

SEQ ID NO: 1440999 - RNA, 16 nt, Human
ucaaagcuuuuuccag

SEQ ID NO: 1441000 - RNA, 15 nt, Human
ucaaagcuuuuucca

SEQ ID NO: 1441001 - RNA, 19 nt, Human
ucaaagcuguguguuugga

SEQ ID NO: 1441002 - RNA, 18 nt, Human
ucaaagcugccugucccu

SEQ ID NO: 1441003 - RNA, 11 nt, Human
ucaaagcugcc

SEQ ID NO: 1441004 - RNA, 21 nt, Human
ucaaagcaugggauuauuaga

SEQ ID NO: 1441005 - RNA, 23 nt, Human
ucaaagccagcguccuccucugu

SEQ ID NO: 1441006 - RNA, 22 nt, Human
ucaaagccagcguccuccucug

SEQ ID NO: 1441007 - RNA, 12 nt, Human
ucaaagccagcg

SEQ ID NO: 1441008 - RNA, 13 nt, Human
ucaaaguuuaaua

SEQ ID NO: 1441009 - RNA, 14 nt, Human
ucaaaguuuaauaa

SEQ ID NO: 1441010 - RNA, 17 nt, Human
ucaaaagcuauuuaaag

SEQ ID NO: 1441011 - RNA, 14 nt, Human
ucaaaaguuuguuu

SEQ ID NO: 1441012 - RNA, 13 nt, Human
ucaaaaguuuguu

SEQ ID NO: 1441013 - RNA, 22 nt, Human
ucaaaagcuauuuaaagcaucu

SEQ ID NO: 1441014 - RNA, 22 nt, Human
ucaaaaguuccaagagucuaaa

SEQ ID NO: 1441015 - RNA, 17 nt, Human
ucaaaauagugccacua

SEQ ID NO: 1441016 - RNA, 22 nt, Human
ucaaaauagggacuaucuaucu

SEQ ID NO: 1441017 - RNA, 21 nt, Human
ucaaaauaugccccauucaac

SEQ ID NO: 1441018 - RNA, 18 nt, Human
ucaaaauauuuguacaua

SEQ ID NO: 1441019 - RNA, 19 nt, Human
ucaaaauauuuguacauag

SEQ ID NO: 1441020 - RNA, 17 nt, Human
ucaaaauauuuguacau

SEQ ID NO: 1441021 - RNA, 16 nt, Human
ucaaaauauuuguaca

SEQ ID NO: 1441022 - RNA, 23 nt, Human
ucaaaaucucuccacuuucagcu

SEQ ID NO: 1441023 - RNA, 22 nt, Human
ucaaaaucucuccacuuucagc

SEQ ID NO: 1441024 - RNA, 21 nt, Human
ucaaaaucucuccacuuucag

SEQ ID NO: 1441025 - RNA, 16 nt, Human
ucaaaaucucuccacu

SEQ ID NO: 1441026 - RNA, 14 nt, Human
ucaaaaucucucca

SEQ ID NO: 1441027 - RNA, 19 nt, Human
ucaaaaugcuuuuuauuuc

SEQ ID NO: 1441028 - RNA, 17 nt, Human
ucaaaaugcuuuuuauu

SEQ ID NO: 1441029 - RNA, 12 nt, Human
ucaaaaugcuuu

SEQ ID NO: 1441030 - RNA, 21 nt, Human
ucaaaauguuaucuucucaag

SEQ ID NO: 1441031 - RNA, 20 nt, Human
ucaaaauguuaucuucucaa

SEQ ID NO: 1441032 - RNA, 16 nt, Human
ucaaaauuguuacaaa

SEQ ID NO: 1441033 - RNA, 19 nt, Human
ucaaaauuguuacaaauug

SEQ ID NO: 1441034 - RNA, 14 nt, Human
uauuuuuaauuaau

SEQ ID NO: 1441035 - RNA, 21 nt, Human
uauuuuuaauuaauugggcca

SEQ ID NO: 1441036 - RNA, 17 nt, Human
uauuuguaaaucugcca

SEQ ID NO: 1441037 - RNA, 13 nt, Human
uauuuguaaaucu

SEQ ID NO: 1441038 - RNA, 16 nt, Human
uauuuguaaaaugaca

SEQ ID NO: 1441039 - RNA, 13 nt, Human
uauuuuucuaacu

SEQ ID NO: 1441040 - RNA, 12 nt, Human
uauuuuucuuga

SEQ ID NO: 1441041 - RNA, 16 nt, Human
uauuuuucuaacuaca

SEQ ID NO: 1441042 - RNA, 12 nt, Human
uauuuuuaucuu

SEQ ID NO: 1441043 - RNA, 16 nt, Human
ucauucugcaaguaua

SEQ ID NO: 1441044 - RNA, 18 nt, Human
ucauucugaaggagcccc

SEQ ID NO: 1441045 - RNA, 19 nt, Human
ucauucucugucucaucca

SEQ ID NO: 1441046 - RNA, 18 nt, Human
ucauucucugucucaucc

SEQ ID NO: 1441047 - RNA, 16 nt, Human
ucauucucugucucau

SEQ ID NO: 1441048 - RNA, 15 nt, Human
ucauucucugucuca

SEQ ID NO: 1441049 - RNA, 14 nt, Human
ucauucucugucuc

SEQ ID NO: 1441050 - RNA, 12 nt, Human
ucauuacuauaa

SEQ ID NO: 1441051 - RNA, 14 nt, Human
ucauuaauucuaua

SEQ ID NO: 1441052 - RNA, 13 nt, Human
ucauuaauucuau

SEQ ID NO: 1441053 - RNA, 17 nt, Human
ucauuaaucugccuccc

SEQ ID NO: 1441054 - RNA, 18 nt, Human
ucauuaaucugccucccu

SEQ ID NO: 1441055 - RNA, 23 nt, Human
ucaugauuagaaauuaccugugg

SEQ ID NO: 1441056 - RNA, 16 nt, Human
ucaugauccaacuaau

SEQ ID NO: 1441057 - RNA, 21 nt, Human
ucaugaauguaaauuuguacu

SEQ ID NO: 1441058 - RNA, 20 nt, Human
ucaugaauguaaauuuguac

SEQ ID NO: 1441059 - RNA, 19 nt, Human
ucaugaauguaaauuugua

SEQ ID NO: 1441060 - RNA, 14 nt, Human
ucaugaauguaaau

SEQ ID NO: 1441061 - RNA, 13 nt, Human
ucaugaauguaaa

SEQ ID NO: 1441062 - RNA, 21 nt, Human
ucaugaauuaguuuuauaugc

SEQ ID NO: 1441063 - RNA, 18 nt, Human
accuccuucccucucugg

SEQ ID NO: 1441064 - RNA, 17 nt, Human
accuccuucccucucug

SEQ ID NO: 1441065 - RNA, 16 nt, Human
accuccuucccucucu

SEQ ID NO: 1441066 - RNA, 15 nt, Human
accuccuucccucuc

SEQ ID NO: 1441067 - RNA, 14 nt, Human
accuccuucccucu

SEQ ID NO: 1441068 - RNA, 13 nt, Human
accuccuucccuc

SEQ ID NO: 1441069 - RNA, 22 nt, Human
accuccuucccucucuggagaa

SEQ ID NO: 1441070 - RNA, 21 nt, Human
accuccuucccucucuggaga

SEQ ID NO: 1441071 - RNA, 19 nt, Human
accuccuucccucucugga

SEQ ID NO: 1441072 - RNA, 17 nt, Human
accucgugauccacccg

SEQ ID NO: 1441073 - RNA, 17 nt, Human
ucauugccuuaacugga

SEQ ID NO: 1441074 - RNA, 20 nt, Human
ucauugccuuaacuggagcc

SEQ ID NO: 1441075 - RNA, 23 nt, Human
ucauugccuuaacuggagcccca

SEQ ID NO: 1441076 - RNA, 23 nt, Human
accugcacuggggagcccgucuc

SEQ ID NO: 1441077 - RNA, 18 nt, Human
accugcacuaacagagug

SEQ ID NO: 1441078 - RNA, 17 nt, Human
accugcacuaacagagu

SEQ ID NO: 1441079 - RNA, 16 nt, Human
accugauacggcuccc

SEQ ID NO: 1441080 - RNA, 19 nt, Human
accugauacggcuccccag

SEQ ID NO: 1441081 - RNA, 21 nt, Human
accugagucguacagaaagcu

SEQ ID NO: 1441082 - RNA, 23 nt, Human
accugagucacccuaccugugcc

SEQ ID NO: 1441083 - RNA, 22 nt, Human
accugagucacccuaccugugc

SEQ ID NO: 1441084 - RNA, 19 nt, Human
accugagggucuguagguu

SEQ ID NO: 1441085 - RNA, 18 nt, Human
accugagggucuguaggu

SEQ ID NO: 1441086 - RNA, 17 nt, Human
accugagggucuguagg

SEQ ID NO: 1441087 - RNA, 15 nt, Human
accugagggucugua

SEQ ID NO: 1441088 - RNA, 14 nt, Human
accugagggucugu

SEQ ID NO: 1441089 - RNA, 23 nt, Human
accugaccccugcucaguaaagc

SEQ ID NO: 1441090 - RNA, 17 nt, Human
accugaccccugcucag

SEQ ID NO: 1441091 - RNA, 16 nt, Human
accugaccccugcuca

SEQ ID NO: 1441092 - RNA, 16 nt, Human
accugaaauuccaaag

SEQ ID NO: 1441093 - RNA, 15 nt, Human
accugaaauuccaaa

SEQ ID NO: 1441094 - RNA, 14 nt, Human
accugaaauuccaa

SEQ ID NO: 1441095 - RNA, 21 nt, Human
accugaaaacacugugcacau

SEQ ID NO: 1441096 - RNA, 21 nt, Human
accugagccugccgagcaacc

SEQ ID NO: 1441097 - RNA, 17 nt, Human
accugagccugccgagc

SEQ ID NO: 1441098 - RNA, 19 nt, Human
accugagauuuauuaaaga

SEQ ID NO: 1441099 - RNA, 18 nt, Human
accugagauuuauuaaag

SEQ ID NO: 1441100 - RNA, 17 nt, Human
accugagauuuauuaaa

SEQ ID NO: 1441101 - RNA, 15 nt, Human
accugagauuuauua

SEQ ID NO: 1441102 - RNA, 15 nt, Human
accugagaccugaag

SEQ ID NO: 1441103 - RNA, 17 nt, Human
accugaggaacugucuc

SEQ ID NO: 1441104 - RNA, 20 nt, Human
accugaaaacacugugcaca

SEQ ID NO: 1441105 - RNA, 19 nt, Human
accugaaaacacugugcac

SEQ ID NO: 1441106 - RNA, 18 nt, Human
accugaaaacacugugca

SEQ ID NO: 1441107 - RNA, 11 nt, Human
accugaaaaca

SEQ ID NO: 1441108 - RNA, 17 nt, Human
accucuccccuggaacu

SEQ ID NO: 1441109 - RNA, 14 nt, Human
accucuaaauucuu

SEQ ID NO: 1441110 - RNA, 19 nt, Human
accucucaauauucaauaa

SEQ ID NO: 1441111 - RNA, 20 nt, Human
accucucaauauucaauaaa

SEQ ID NO: 1441112 - RNA, 21 nt, Human
accucucaauauucaauaaag

SEQ ID NO: 1441113 - RNA, 23 nt, Human
accucucaauauucaauaaagcu

SEQ ID NO: 1441114 - RNA, 16 nt, Human
accucuccagccucag

SEQ ID NO: 1441115 - RNA, 18 nt, Human
accucuccagccucagcu

SEQ ID NO: 1441116 - RNA, 20 nt, Human
accucuccagccucagcucu

SEQ ID NO: 1441117 - RNA, 22 nt, Human
accucuccagccucagcucuca

SEQ ID NO: 1441118 - RNA, 23 nt, Human
ucaucccgagcaccuccacaucc

SEQ ID NO: 1441119 - RNA, 21 nt, Human
ucaucccgagcaccuccacau

SEQ ID NO: 1441120 - RNA, 14 nt, Human
ucauccucaaagaa

SEQ ID NO: 1441121 - RNA, 22 nt, Human
accucaacugccuacuccaaaa

SEQ ID NO: 1441122 - RNA, 16 nt, Human
accucaacugccuacu

SEQ ID NO: 1441123 - RNA, 19 nt, Human
accucccucaaccucaucc

SEQ ID NO: 1441124 - RNA, 22 nt, Human
ucauccucaaagaaaguguauu

SEQ ID NO: 1441125 - RNA, 21 nt, Human
ucauccucaaagaaaguguau

SEQ ID NO: 1441126 - RNA, 18 nt, Human
ucauccucaaagaaagug

SEQ ID NO: 1441127 - RNA, 17 nt, Human
ucauccucaaagaaagu

SEQ ID NO: 1441128 - RNA, 13 nt, Human
ucauccugcaggc

SEQ ID NO: 1441129 - RNA, 12 nt, Human
ucauccugcagg

SEQ ID NO: 1441130 - RNA, 23 nt, Human
ucauccucacagugaacacucag

SEQ ID NO: 1441131 - RNA, 23 nt, Human
ucauccucaaagaaaguguauug

SEQ ID NO: 1441132 - RNA, 11 nt, Human
ucauccucugg

SEQ ID NO: 1441133 - RNA, 12 nt, Human
ucauccucuggc

SEQ ID NO: 1441134 - RNA, 22 nt, Human
ucauccucuccacagcugccuc

SEQ ID NO: 1441135 - RNA, 14 nt, Human
ucauccuugucuua

SEQ ID NO: 1441136 - RNA, 13 nt, Human
ucauccuugucuu

SEQ ID NO: 1441137 - RNA, 18 nt, Human
ucaucuagguaaauuaca

SEQ ID NO: 1441138 - RNA, 14 nt, Human
ucaucuaggauuuu

SEQ ID NO: 1441139 - RNA, 12 nt, Human
ucaugaauguaa

SEQ ID NO: 1441140 - RNA, 16 nt, Human
ucaugaauuaguuuua

SEQ ID NO: 1441141 - RNA, 13 nt, Human
ucaucucagcuca

SEQ ID NO: 1441142 - RNA, 18 nt, Human
ucaucucagcucacugca

SEQ ID NO: 1441143 - RNA, 20 nt, Human
accuaacaacauuguagccu

SEQ ID NO: 1441144 - RNA, 15 nt, Human
accuaaauggccuca

SEQ ID NO: 1441145 - RNA, 17 nt, Human
accuaaagaaaaacaaa

SEQ ID NO: 1441146 - RNA, 13 nt, Human
accuaaagaaaaa

SEQ ID NO: 1441147 - RNA, 12 nt, Human
accuaaagaaaa

SEQ ID NO: 1441148 - RNA, 23 nt, Human
accuaaacauagaaauugccuga

SEQ ID NO: 1441149 - RNA, 20 nt, Human
accgcuacaccacucuggca

SEQ ID NO: 1441150 - RNA, 21 nt, Human
accgcuacaccacucuggcag

SEQ ID NO: 1441151 - RNA, 19 nt, Human
accgcuacaccacucuggc

SEQ ID NO: 1441152 - RNA, 17 nt, Human
accgcuacaccacucug

SEQ ID NO: 1441153 - RNA, 14 nt, Human
accgcuacaccacu

SEQ ID NO: 1441154 - RNA, 16 nt, Human
accgcuaaaagaaacu

SEQ ID NO: 1441155 - RNA, 15 nt, Human
accgcuaaaagaaac

SEQ ID NO: 1441156 - RNA, 13 nt, Human
accgcuaaaagaa

SEQ ID NO: 1441157 - RNA, 17 nt, Human
accgcgacuaauuucaa

SEQ ID NO: 1441158 - RNA, 16 nt, Human
accgcgacuaauuuca

SEQ ID NO: 1441159 - RNA, 20 nt, Human
accgcgacuaauuucaaaau

SEQ ID NO: 1441160 - RNA, 19 nt, Human
accgcgucuacccugggau

SEQ ID NO: 1441161 - RNA, 18 nt, Human
accgcgucuacccuggga

SEQ ID NO: 1441162 - RNA, 17 nt, Human
accgcgucuacccuggg

SEQ ID NO: 1441163 - RNA, 22 nt, Human
ucaggaaaggaaucauuucuau

SEQ ID NO: 1441164 - RNA, 17 nt, Human
ucaggaaccgaggcagg

SEQ ID NO: 1441165 - RNA, 18 nt, Human
accuacaguuuuaacugu

SEQ ID NO: 1441166 - RNA, 19 nt, Human
accuacaguuuuaacugug

SEQ ID NO: 1441167 - RNA, 17 nt, Human
accuacaguuuuaacug

SEQ ID NO: 1441168 - RNA, 16 nt, Human
accuacaguuuuaacu

SEQ ID NO: 1441169 - RNA, 11 nt, Human
accuacaguuu

SEQ ID NO: 1441170 - RNA, 22 nt, Human
accuacagggggucuggcuggu

SEQ ID NO: 1441171 - RNA, 23 nt, Human
accuacagggggucuggcuggug

SEQ ID NO: 1441172 - RNA, 21 nt, Human
accuacagggggucuggcugg

SEQ ID NO: 1441173 - RNA, 19 nt, Human
accuacagggggucuggcu

SEQ ID NO: 1441174 - RNA, 17 nt, Human
accuacagggggucugg

SEQ ID NO: 1441175 - RNA, 21 nt, Human
accuaaucucuguaaagcuaa

SEQ ID NO: 1441176 - RNA, 17 nt, Human
accuaaucucuguaaag

SEQ ID NO: 1441177 - RNA, 22 nt, Human
accuaauccaggcagauccagg

SEQ ID NO: 1441178 - RNA, 15 nt, Human
accucaaaauuuaac

SEQ ID NO: 1441179 - RNA, 14 nt, Human
accuaguuuuccau

SEQ ID NO: 1441180 - RNA, 21 nt, Human
accuagggugauauuaaccag

SEQ ID NO: 1441181 - RNA, 21 nt, Human
accuggcaucgcaccauucug

SEQ ID NO: 1441182 - RNA, 17 nt, Human
accuggcagcucuggac

SEQ ID NO: 1441183 - RNA, 14 nt, Human
accuggcagcucug

SEQ ID NO: 1441184 - RNA, 19 nt, Human
accuggauggggcaggcca

SEQ ID NO: 1441185 - RNA, 14 nt, Human
accuggauggggca

SEQ ID NO: 1441186 - RNA, 19 nt, Human
uccaaugagcuuucugaac

SEQ ID NO: 1441187 - RNA, 18 nt, Human
uccaaugagcuuucugaa

SEQ ID NO: 1441188 - RNA, 17 nt, Human
uccaaugagcuuucuga

SEQ ID NO: 1441189 - RNA, 16 nt, Human
uccaaugagcuuucug

SEQ ID NO: 1441190 - RNA, 15 nt, Human
uccaaugagcuuucu

SEQ ID NO: 1441191 - RNA, 14 nt, Human
uccaaugagcuuuc

SEQ ID NO: 1441192 - RNA, 13 nt, Human
uccaaugagcuuu

SEQ ID NO: 1441193 - RNA, 12 nt, Human
uccaaugagcuu

SEQ ID NO: 1441194 - RNA, 21 nt, Human
accugguacucccucucagga

SEQ ID NO: 1441195 - RNA, 17 nt, Human
accugguacucccucuc

SEQ ID NO: 1441196 - RNA, 19 nt, Human
accugguacccuccuggcu

SEQ ID NO: 1441197 - RNA, 18 nt, Human
accugguacccuccuggc

SEQ ID NO: 1441198 - RNA, 16 nt, Human
accugguacccuccug

SEQ ID NO: 1441199 - RNA, 20 nt, Human
accuggguugcagacaggaa

SEQ ID NO: 1441200 - RNA, 18 nt, Human
accuggguugcagacagg

SEQ ID NO: 1441201 - RNA, 16 nt, Human
accuggguugcagaca

SEQ ID NO: 1441202 - RNA, 17 nt, Human
accuggcucucaccucu

SEQ ID NO: 1441203 - RNA, 20 nt, Human
accuggcucucaccucuagg

SEQ ID NO: 1441204 - RNA, 16 nt, Human
accuggcucucaccuc

SEQ ID NO: 1441205 - RNA, 15 nt, Human
accuggcucucaccu

SEQ ID NO: 1441206 - RNA, 11 nt, Human
accuggccuuc

SEQ ID NO: 1441207 - RNA, 24 nt, Human
uccaacucuucccccucucccagu

SEQ ID NO: 1441208 - RNA, 19 nt, Human
uccaacucgaaucugugug

SEQ ID NO: 1441209 - RNA, 18 nt, Human
uccaacucgaaucugugu

SEQ ID NO: 1441210 - RNA, 21 nt, Human
uccaaccugcaaagaucuguc

SEQ ID NO: 1441211 - RNA, 23 nt, Human
uccaacuuggcugcaggaaucuu

SEQ ID NO: 1441212 - RNA, 23 nt, Human
uccaacuggcccuauuuagauga

SEQ ID NO: 1441213 - RNA, 16 nt, Human
uccaauccuauguuuu

SEQ ID NO: 1441214 - RNA, 14 nt, Human
uccaagucuccacc

SEQ ID NO: 1441215 - RNA, 22 nt, Human
uccaagguuuaaagagucuaga

SEQ ID NO: 1441216 - RNA, 20 nt, Human
uccaagguuuaaagagucua

SEQ ID NO: 1441217 - RNA, 19 nt, Human
uccaagguuuaaagagucu

SEQ ID NO: 1441218 - RNA, 16 nt, Human
uccaagguuuaaagag

SEQ ID NO: 1441219 - RNA, 15 nt, Human
uccaagguuuaaaga

SEQ ID NO: 1441220 - RNA, 14 nt, Human
uccaagguuuaaag

SEQ ID NO: 1441221 - RNA, 13 nt, Human
uccaagguuuaaa

SEQ ID NO: 1441222 - RNA, 16 nt, Human
uccaagguggggugga

SEQ ID NO: 1441223 - RNA, 15 nt, Human
uccaacuuggcugca

SEQ ID NO: 1441224 - RNA, 23 nt, Human
uccaacccgucuggcccaccagg

SEQ ID NO: 1441225 - RNA, 22 nt, Human
uccaacccgucuggcccaccag

SEQ ID NO: 1441226 - RNA, 13 nt, Human
uccaacccuagca

SEQ ID NO: 1441227 - RNA, 14 nt, Human
uccaacccuagcaa

SEQ ID NO: 1441228 - RNA, 16 nt, Human
uccaacccgaggcccg

SEQ ID NO: 1441229 - RNA, 21 nt, Human
uccaaccggcuuuguggcacu

SEQ ID NO: 1441230 - RNA, 15 nt, Human
uccaacccuagcaaa

SEQ ID NO: 1441231 - RNA, 21 nt, Human
uccaggcagauccaggacuau

SEQ ID NO: 1441232 - RNA, 20 nt, Human
uccaggcagauccaggacua

SEQ ID NO: 1441233 - RNA, 19 nt, Human
uccaggcagauccaggacu

SEQ ID NO: 1441234 - RNA, 18 nt, Human
uccaggcagauccaggac

SEQ ID NO: 1441235 - RNA, 17 nt, Human
uccaggcagauccagga

SEQ ID NO: 1441236 - RNA, 16 nt, Human
uccaggcagauccagg

SEQ ID NO: 1441237 - RNA, 15 nt, Human
uccaggcagauccag

SEQ ID NO: 1441238 - RNA, 14 nt, Human
uccaggcagaucca

SEQ ID NO: 1441239 - RNA, 21 nt, Human
uccaggcaggucugaagcuca

SEQ ID NO: 1441240 - RNA, 20 nt, Human
uccaggcccaaggcucccgg

SEQ ID NO: 1441241 - RNA, 19 nt, Human
uccaggcccaaggcucccg

SEQ ID NO: 1441242 - RNA, 18 nt, Human
uccaggcccaaggcuccc

SEQ ID NO: 1441243 - RNA, 17 nt, Human
uccaggcccaaggcucc

SEQ ID NO: 1441244 - RNA, 15 nt, Human
uccaggcccaaggcu

SEQ ID NO: 1441245 - RNA, 11 nt, Human
uccaggcccaa

SEQ ID NO: 1441246 - RNA, 13 nt, Human
uccaggcagaucc

SEQ ID NO: 1441247 - RNA, 16 nt, Human
uccaggcacugagaua

SEQ ID NO: 1441248 - RNA, 14 nt, Human
uccaggcacugaga

SEQ ID NO: 1441249 - RNA, 21 nt, Human
uccagccccucuuggagaagu

SEQ ID NO: 1441250 - RNA, 20 nt, Human
uccagccccucuuggagaag

SEQ ID NO: 1441251 - RNA, 18 nt, Human
uccagccccucuuggaga

SEQ ID NO: 1441252 - RNA, 23 nt, Human
uccagccccucuggucgcuccug

SEQ ID NO: 1441253 - RNA, 18 nt, Human
uccagccccucuggucgc

SEQ ID NO: 1441254 - RNA, 16 nt, Human
uccagccccucugguc

SEQ ID NO: 1441255 - RNA, 15 nt, Human
uccagccccucuggu

SEQ ID NO: 1441256 - RNA, 14 nt, Human
uccagccccucugg

SEQ ID NO: 1441257 - RNA, 17 nt, Human
acgagagcagaggucuc

SEQ ID NO: 1441258 - RNA, 14 nt, Human
acgagacuuuccau

SEQ ID NO: 1441259 - RNA, 16 nt, Human
acgagacguuuccuac

SEQ ID NO: 1441260 - RNA, 22 nt, Human
acgaggaaucugugggucuggg

SEQ ID NO: 1441261 - RNA, 20 nt, Human
acgaggaaucugugggucug

SEQ ID NO: 1441262 - RNA, 19 nt, Human
acgagcuguuuacuaggga

SEQ ID NO: 1441263 - RNA, 17 nt, Human
uccaggcuucugcuggg

SEQ ID NO: 1441264 - RNA, 23 nt, Human
uccaggcuucugcuggggccugg

SEQ ID NO: 1441265 - RNA, 15 nt, Human
uccaggcuguguuug

SEQ ID NO: 1441266 - RNA, 19 nt, Human
accuuuuuuauacauaaac

SEQ ID NO: 1441267 - RNA, 20 nt, Human
accuuuuuuauacauaaaca

SEQ ID NO: 1441268 - RNA, 14 nt, Human
acgagaaaacaaua

SEQ ID NO: 1441269 - RNA, 21 nt, Human
accuuuuuuauacauaaacaa

SEQ ID NO: 1441270 - RNA, 22 nt, Human
accuuuuuuauacauaaacaag

SEQ ID NO: 1441271 - RNA, 14 nt, Human
uccagagagaccga

SEQ ID NO: 1441272 - RNA, 14 nt, Human
uccagagacuggga

SEQ ID NO: 1441273 - RNA, 23 nt, Human
uccagacugcuuccaauuuucug

SEQ ID NO: 1441274 - RNA, 22 nt, Human
uccagacugcuuccaauuuucu

SEQ ID NO: 1441275 - RNA, 15 nt, Human
uccagaccugaggcg

SEQ ID NO: 1441276 - RNA, 22 nt, Human
uccagaccugauccuggaggcc

SEQ ID NO: 1441277 - RNA, 19 nt, Human
uccagaccugauccuggag

SEQ ID NO: 1441278 - RNA, 18 nt, Human
uccagaccugauccugga

SEQ ID NO: 1441279 - RNA, 13 nt, Human
uccagaccugauc

SEQ ID NO: 1441280 - RNA, 16 nt, Human
uccagaccugaagaau

SEQ ID NO: 1441281 - RNA, 15 nt, Human
uccagaccugaagaa

SEQ ID NO: 1441282 - RNA, 11 nt, Human
uccagaccuga

SEQ ID NO: 1441283 - RNA, 19 nt, Human
accuucaaacuagggccaa

SEQ ID NO: 1441284 - RNA, 22 nt, Human
accuuagauguucuaagucuuu

SEQ ID NO: 1441285 - RNA, 19 nt, Human
uccacgacugucuccaugg

SEQ ID NO: 1441286 - RNA, 18 nt, Human
uccacgacugucuccaug

SEQ ID NO: 1441287 - RNA, 17 nt, Human
uccacgacugucuccau

SEQ ID NO: 1441288 - RNA, 21 nt, Human
uccacucaugugacucuuucc

SEQ ID NO: 1441289 - RNA, 14 nt, Human
uccacucaugugac

SEQ ID NO: 1441290 - RNA, 16 nt, Human
uccacgacugucucca

SEQ ID NO: 1441291 - RNA, 15 nt, Human
uccacgacugucucc

SEQ ID NO: 1441292 - RNA, 14 nt, Human
uccacgacugucuc

SEQ ID NO: 1441293 - RNA, 14 nt, Human
uccaccuuucccaa

SEQ ID NO: 1441294 - RNA, 19 nt, Human
acuaccgaaugugucuuua

SEQ ID NO: 1441295 - RNA, 23 nt, Human
acuaccgaaugugucuuuagaua

SEQ ID NO: 1441296 - RNA, 18 nt, Human
acuaccgaaugugucuuu

SEQ ID NO: 1441297 - RNA, 17 nt, Human
acuaccgaaugugucuu

SEQ ID NO: 1441298 - RNA, 16 nt, Human
acuaccgaaugugucu

SEQ ID NO: 1441299 - RNA, 19 nt, Human
acuacccagguuaagaaaa

SEQ ID NO: 1441300 - RNA, 22 nt, Human
acuacccagguuaagaaaauaa

SEQ ID NO: 1441301 - RNA, 19 nt, Human
uccccauuuagguuucuga

SEQ ID NO: 1441302 - RNA, 22 nt, Human
uccccauucuuccuaguuuucu

SEQ ID NO: 1441303 - RNA, 17 nt, Human
uccccauucuuccuagu

SEQ ID NO: 1441304 - RNA, 14 nt, Human
uccccauucuuccu

SEQ ID NO: 1441305 - RNA, 17 nt, Human
uccccauggcccugagc

SEQ ID NO: 1441306 - RNA, 19 nt, Human
uccccaucuucuaaaccca

SEQ ID NO: 1441307 - RNA, 23 nt, Human
ucccaguccaccugaggaacugu

SEQ ID NO: 1441308 - RNA, 16 nt, Human
ucccagguuggcucug

SEQ ID NO: 1441309 - RNA, 23 nt, Human
ucccagguuggcucugccagucc

SEQ ID NO: 1441310 - RNA, 21 nt, Human
ucccagguuggcucugccagu

SEQ ID NO: 1441311 - RNA, 20 nt, Human
ucccagguuggcucugccag

SEQ ID NO: 1441312 - RNA, 19 nt, Human
ucccagguuggcucugcca

SEQ ID NO: 1441313 - RNA, 17 nt, Human
ucccagguuggcucugc

SEQ ID NO: 1441314 - RNA, 14 nt, Human
ucccagcugccuag

SEQ ID NO: 1441315 - RNA, 12 nt, Human
ucccagcugccu

SEQ ID NO: 1441316 - RNA, 15 nt, Human
ucccauccccagcga

SEQ ID NO: 1441317 - RNA, 14 nt, Human
ucccauccccagcg

SEQ ID NO: 1441318 - RNA, 14 nt, Human
ucccauccagggcc

SEQ ID NO: 1441319 - RNA, 13 nt, Human
ucccauccagggc

SEQ ID NO: 1441320 - RNA, 23 nt, Human
uccccacccaccaacccucaggg

SEQ ID NO: 1441321 - RNA, 22 nt, Human
uccccacccaccaacccucagg

SEQ ID NO: 1441322 - RNA, 21 nt, Human
uccccacccaccaacccucag

SEQ ID NO: 1441323 - RNA, 13 nt, Human
uccccacccacca

SEQ ID NO: 1441324 - RNA, 17 nt, Human
uccccaccagaugcuga

SEQ ID NO: 1441325 - RNA, 20 nt, Human
uccccaccagaugcugaaaa

SEQ ID NO: 1441326 - RNA, 16 nt, Human
uccccaccagaugcug

SEQ ID NO: 1441327 - RNA, 15 nt, Human
uccccaccagaugcu

SEQ ID NO: 1441328 - RNA, 16 nt, Human
ucccauccuguguguu

SEQ ID NO: 1441329 - RNA, 15 nt, Human
ucccauccugugugu

SEQ ID NO: 1441330 - RNA, 14 nt, Human
ucccauccugugug

SEQ ID NO: 1441331 - RNA, 12 nt, Human
ucccaucccugc

SEQ ID NO: 1441332 - RNA, 14 nt, Human
ucccaucccugcgu

SEQ ID NO: 1441333 - RNA, 17 nt, Human
acuaacauguccugccu

SEQ ID NO: 1441334 - RNA, 17 nt, Human
acuaacauauaauguug

SEQ ID NO: 1441335 - RNA, 15 nt, Human
acuaacauauaaugu

SEQ ID NO: 1441336 - RNA, 18 nt, Human
acuaacaggccaaagagu

SEQ ID NO: 1441337 - RNA, 18 nt, Human
acguuggagaagcccgug

SEQ ID NO: 1441338 - RNA, 16 nt, Human
acguugagccccugga

SEQ ID NO: 1441339 - RNA, 13 nt, Human
acguugcucccca

SEQ ID NO: 1441340 - RNA, 19 nt, Human
acuacaaaucaaguauuug

SEQ ID NO: 1441341 - RNA, 13 nt, Human
acuacaaaucaag

SEQ ID NO: 1441342 - RNA, 11 nt, Human
acuacaaauca

SEQ ID NO: 1441343 - RNA, 23 nt, Human
acuacaaagguuuaaaugaacaa

SEQ ID NO: 1441344 - RNA, 22 nt, Human
acuacaaagguuuaaaugaaca

SEQ ID NO: 1441345 - RNA, 21 nt, Human
acuacaaagguuuaaaugaac

SEQ ID NO: 1441346 - RNA, 20 nt, Human
acuacaaagguuuaaaugaa

SEQ ID NO: 1441347 - RNA, 19 nt, Human
acuacaaagguuuaaauga

SEQ ID NO: 1441348 - RNA, 18 nt, Human
acuacaaagguuuaaaug

SEQ ID NO: 1441349 - RNA, 17 nt, Human
acuacaaagguuuaaau

SEQ ID NO: 1441350 - RNA, 22 nt, Human
acuaaccaagcugaguuuccua

SEQ ID NO: 1441351 - RNA, 21 nt, Human
acuaaccaagcugaguuuccu

SEQ ID NO: 1441352 - RNA, 18 nt, Human
acuaaccaagcugaguuu

SEQ ID NO: 1441353 - RNA, 15 nt, Human
acuaaccaagcugag

SEQ ID NO: 1441354 - RNA, 13 nt, Human
acuacacacagua

SEQ ID NO: 1441355 - RNA, 16 nt, Human
acuacaaccaauggaa

SEQ ID NO: 1441356 - RNA, 23 nt, Human
acuacagcuggggugcagggaug

SEQ ID NO: 1441357 - RNA, 21 nt, Human
acuacagcuggggugcaggga

SEQ ID NO: 1441358 - RNA, 19 nt, Human
acuacagcuggggugcagg

SEQ ID NO: 1441359 - RNA, 18 nt, Human
acuacagcuggggugcag

SEQ ID NO: 1441360 - RNA, 17 nt, Human
acuacagcuggggugca

SEQ ID NO: 1441361 - RNA, 22 nt, Human
acuacacacuguguacugcagu

SEQ ID NO: 1441362 - RNA, 17 nt, Human
acuacaggcgugagcca

SEQ ID NO: 1441363 - RNA, 20 nt, Human
acuacaggcacacaccacca

SEQ ID NO: 1441364 - RNA, 13 nt, Human
acuacaguuuguu

SEQ ID NO: 1441365 - RNA, 14 nt, Human
acuacaguuuguua

SEQ ID NO: 1441366 - RNA, 20 nt, Human
ucccagcaugcugagauuac

SEQ ID NO: 1441367 - RNA, 17 nt, Human
acuacagucuaaagcug

SEQ ID NO: 1441368 - RNA, 16 nt, Human
acuacagucuaaagcu

SEQ ID NO: 1441369 - RNA, 17 nt, Human
acuacagcuucagugau

SEQ ID NO: 1441370 - RNA, 15 nt, Human
acuacaguuagggcu

SEQ ID NO: 1441371 - RNA, 15 nt, Human
acuacauucuguuaa

SEQ ID NO: 1441372 - RNA, 14 nt, Human
acuacauucuguua

SEQ ID NO: 1441373 - RNA, 15 nt, Human
acuacaguuuguuag

SEQ ID NO: 1441374 - RNA, 12 nt, Human
acuacauucugu

SEQ ID NO: 1441375 - RNA, 13 nt, Human
acuacauucuguu

SEQ ID NO: 1441376 - RNA, 20 nt, Human
uccauccuugagucaaaaaa

SEQ ID NO: 1441377 - RNA, 20 nt, Human
uccaucucuuguuuaaauuc

SEQ ID NO: 1441378 - RNA, 18 nt, Human
uccauucucacagguccc

SEQ ID NO: 1441379 - RNA, 14 nt, Human
uccauucuccugag

SEQ ID NO: 1441380 - RNA, 12 nt, Human
uccauucuggaa

SEQ ID NO: 1441381 - RNA, 20 nt, Human
uccauucugcuccuucccca

SEQ ID NO: 1441382 - RNA, 13 nt, Human
uccauucuggaag

SEQ ID NO: 1441383 - RNA, 14 nt, Human
uccauucuggaagu

SEQ ID NO: 1441384 - RNA, 23 nt, Human
uccauuuaauggggugcaccugu

SEQ ID NO: 1441385 - RNA, 22 nt, Human
ucccaaacgcccuuuccuccuc

SEQ ID NO: 1441386 - RNA, 20 nt, Human
ucccaaaccacgccucuuga

SEQ ID NO: 1441387 - RNA, 20 nt, Human
ucccaaaauguugaaauaug

SEQ ID NO: 1441388 - RNA, 24 nt, Human
ucccaaacgcccuuuccuccucag

SEQ ID NO: 1441389 - RNA, 21 nt, Human
ucccaaagaaguucugguaug

SEQ ID NO: 1441390 - RNA, 12 nt, Human
uccauuucuaau

SEQ ID NO: 1441391 - RNA, 18 nt, Human
uccauuuccccuccuucc

SEQ ID NO: 1441392 - RNA, 13 nt, Human
uccauuucuaauu

SEQ ID NO: 1441393 - RNA, 14 nt, Human
uccauuucuaauua

SEQ ID NO: 1441394 - RNA, 12 nt, Human
uccauuugcaag

SEQ ID NO: 1441395 - RNA, 14 nt, Human
ucccaaaaaacuac

SEQ ID NO: 1441396 - RNA, 20 nt, Human
ucccaaaagcccauucauuc

SEQ ID NO: 1441397 - RNA, 20 nt, Human
ucccaaagcaagcaagaggc

SEQ ID NO: 1441398 - RNA, 14 nt, Human
ucccaaagcaagca

SEQ ID NO: 1441399 - RNA, 21 nt, Human
ucccaaaguccugggauuaca

SEQ ID NO: 1441400 - RNA, 13 nt, Human
ucccaaagugcug

SEQ ID NO: 1441401 - RNA, 19 nt, Human
ucccaaguagaaucucagu

SEQ ID NO: 1441402 - RNA, 17 nt, Human
ucccaaguagaaucuca

SEQ ID NO: 1441403 - RNA, 23 nt, Human
ucccaaagugcugagauuacagg

SEQ ID NO: 1441404 - RNA, 16 nt, Human
ucccaaguagaaucuc

SEQ ID NO: 1441405 - RNA, 20 nt, Human
ucccaaagugcugagauuac

SEQ ID NO: 1441406 - RNA, 19 nt, Human
ucccaaagugcugagauua

SEQ ID NO: 1441407 - RNA, 18 nt, Human
ucccaaagugcugagauu

SEQ ID NO: 1441408 - RNA, 23 nt, Human
ucccaaguagcugggauuacagg

SEQ ID NO: 1441409 - RNA, 21 nt, Human
ucccaaguagcugggauuaca

SEQ ID NO: 1441410 - RNA, 20 nt, Human
ucccaaguagcugggauuac

SEQ ID NO: 1441411 - RNA, 20 nt, Human
ucccaaguagcugagacuac

SEQ ID NO: 1441412 - RNA, 21 nt, Human
ucccacaagccugagggaaag

SEQ ID NO: 1441413 - RNA, 17 nt, Human
ucccaagugagucucuc

SEQ ID NO: 1441414 - RNA, 21 nt, Human
ucccaagugagucucucuggg

SEQ ID NO: 1441415 - RNA, 16 nt, Human
ucccacaagccugagg

SEQ ID NO: 1441416 - RNA, 15 nt, Human
ucccacaagccugag

SEQ ID NO: 1441417 - RNA, 14 nt, Human
ucccacaagccuga

SEQ ID NO: 1441418 - RNA, 14 nt, Human
ucccacaagccucu

SEQ ID NO: 1441419 - RNA, 16 nt, Human
ucccacagccacgugu

SEQ ID NO: 1441420 - RNA, 20 nt, Human
ucccacccccacccccagcu

SEQ ID NO: 1441421 - RNA, 18 nt, Human
ucccacccccacccccag

SEQ ID NO: 1441422 - RNA, 22 nt, Human
acgggaugguucuggcuguuug

SEQ ID NO: 1441423 - RNA, 18 nt, Human
acgggacugcggaggaag

SEQ ID NO: 1441424 - RNA, 21 nt, Human
acgguggggguagggggcugg

SEQ ID NO: 1441425 - RNA, 17 nt, Human
acgggccuguccacagg

SEQ ID NO: 1441426 - RNA, 15 nt, Human
acggggacucagccc

SEQ ID NO: 1441427 - RNA, 15 nt, Human
acguauuuaauagca

SEQ ID NO: 1441428 - RNA, 13 nt, Human
acguauuuaauag

SEQ ID NO: 1441429 - RNA, 17 nt, Human
acguaugucugguucuc

SEQ ID NO: 1441430 - RNA, 18 nt, Human
acguaugucugguucuca

SEQ ID NO: 1441431 - RNA, 14 nt, Human
acguacucugguua

SEQ ID NO: 1441432 - RNA, 20 nt, Human
acguacugcagccuccagag

SEQ ID NO: 1441433 - RNA, 22 nt, Human
acguauaaaagccuguuuaaga

SEQ ID NO: 1441434 - RNA, 20 nt, Human
acgugggcauucaaauguau

SEQ ID NO: 1441435 - RNA, 17 nt, Human
acgugggcauucaaaug

SEQ ID NO: 1441436 - RNA, 14 nt, Human
ucccuccccuugcc

SEQ ID NO: 1441437 - RNA, 13 nt, Human
ucccuccccuugc

SEQ ID NO: 1441438 - RNA, 15 nt, Human
ucccuccccuucucu

SEQ ID NO: 1441439 - RNA, 14 nt, Human
ucccuccccuucuc

SEQ ID NO: 1441440 - RNA, 22 nt, Human
ucccucccagaggagccaccag

SEQ ID NO: 1441441 - RNA, 23 nt, Human
ucccucccagagcaccugcuguc

SEQ ID NO: 1441442 - RNA, 21 nt, Human
ucccgggacaccuaggcuagg

SEQ ID NO: 1441443 - RNA, 15 nt, Human
ucccuccccuugccu

SEQ ID NO: 1441444 - RNA, 19 nt, Human
acucacuccuuuuaaagaa

SEQ ID NO: 1441445 - RNA, 18 nt, Human
acucacuccuuuuaaaga

SEQ ID NO: 1441446 - RNA, 16 nt, Human
acucacuccuuuuaaa

SEQ ID NO: 1441447 - RNA, 22 nt, Human
acucacuaggcccccacuugcc

SEQ ID NO: 1441448 - RNA, 21 nt, Human
acucacuaggcccccacuugc

SEQ ID NO: 1441449 - RNA, 17 nt, Human
acucacuaggcccccac

SEQ ID NO: 1441450 - RNA, 15 nt, Human
acucacuaggccccc

SEQ ID NO: 1441451 - RNA, 14 nt, Human
acucacuaggcccc

SEQ ID NO: 1441452 - RNA, 20 nt, Human
acucacuaauucauuaaucu

SEQ ID NO: 1441453 - RNA, 18 nt, Human
acucacuaauucauuaau

SEQ ID NO: 1441454 - RNA, 15 nt, Human
ucccugaggacugau

SEQ ID NO: 1441455 - RNA, 23 nt, Human
ucccugagcuagaacccucuguu

SEQ ID NO: 1441456 - RNA, 13 nt, Human
ucccugagauggg

SEQ ID NO: 1441457 - RNA, 15 nt, Human
ucccugacugggagu

SEQ ID NO: 1441458 - RNA, 21 nt, Human
ucccugaggacugauuucaga

SEQ ID NO: 1441459 - RNA, 20 nt, Human
ucccugaggacugauuucag

SEQ ID NO: 1441460 - RNA, 23 nt, Human
ucccugagaugggcuucccaagg

SEQ ID NO: 1441461 - RNA, 14 nt, Human
ucccugacugggag

SEQ ID NO: 1441462 - RNA, 22 nt, Human
uccccuugggcccacaccuccu

SEQ ID NO: 1441463 - RNA, 19 nt, Human
uccccuugggcccacaccu

SEQ ID NO: 1441464 - RNA, 18 nt, Human
uccccuugggcccacacc

SEQ ID NO: 1441465 - RNA, 16 nt, Human
uccccuugggcccaca

SEQ ID NO: 1441466 - RNA, 23 nt, Human
uccccuugccugugccaggugag

SEQ ID NO: 1441467 - RNA, 16 nt, Human
uccccuugccugugcc

SEQ ID NO: 1441468 - RNA, 12 nt, Human
uccccuugccug

SEQ ID NO: 1441469 - RNA, 16 nt, Human
uccccucuccuuccug

SEQ ID NO: 1441470 - RNA, 15 nt, Human
uccccucuccuuccu

SEQ ID NO: 1441471 - RNA, 15 nt, Human
ucccgagcuccucuu

SEQ ID NO: 1441472 - RNA, 22 nt, Human
ucccgagcaccuccacauccuc

SEQ ID NO: 1441473 - RNA, 24 nt, Human
uccccuuugcuucauucaagucag

SEQ ID NO: 1441474 - RNA, 14 nt, Human
uccccuccccaacu

SEQ ID NO: 1441475 - RNA, 18 nt, Human
uccccuccaucccuggcc

SEQ ID NO: 1441476 - RNA, 20 nt, Human
uccccuccaucccuggcccc

SEQ ID NO: 1441477 - RNA, 16 nt, Human
uccccuccaucccugg

SEQ ID NO: 1441478 - RNA, 15 nt, Human
uccccuccaucccug

SEQ ID NO: 1441479 - RNA, 14 nt, Human
uccccuccaucccu

SEQ ID NO: 1441480 - RNA, 15 nt, Human
uccccuagaguccca

SEQ ID NO: 1441481 - RNA, 16 nt, Human
uccccuagagucccag

SEQ ID NO: 1441482 - RNA, 20 nt, Human
uccccuaagcagaccacuga

SEQ ID NO: 1441483 - RNA, 13 nt, Human
acucaccacugcc

SEQ ID NO: 1441484 - RNA, 21 nt, Human
acuacuagggaaaugccuuug

SEQ ID NO: 1441485 - RNA, 17 nt, Human
acucacuuuucccacuc

SEQ ID NO: 1441486 - RNA, 18 nt, Human
acucacuuuucccacucc

SEQ ID NO: 1441487 - RNA, 16 nt, Human
acucacuuuucccacu

SEQ ID NO: 1441488 - RNA, 15 nt, Human
acucacuuuucccac

SEQ ID NO: 1441489 - RNA, 14 nt, Human
acucacuuuuccca

SEQ ID NO: 1441490 - RNA, 19 nt, Human
acucaugugacucuuucca

SEQ ID NO: 1441491 - RNA, 18 nt, Human
acucaugugacucuuucc

SEQ ID NO: 1441492 - RNA, 19 nt, Human
acucauucugaaggagccc

SEQ ID NO: 1441493 - RNA, 15 nt, Human
acucauucugaagga

SEQ ID NO: 1441494 - RNA, 16 nt, Human
acucauucauuaguca

SEQ ID NO: 1441495 - RNA, 13 nt, Human
acucauucauuag

SEQ ID NO: 1441496 - RNA, 21 nt, Human
acucauuagacuggaacuuga

SEQ ID NO: 1441497 - RNA, 15 nt, Human
acucauuagacugga

SEQ ID NO: 1441498 - RNA, 14 nt, Human
acucauuagacugg

SEQ ID NO: 1441499 - RNA, 13 nt, Human
acucauuagacug

SEQ ID NO: 1441500 - RNA, 20 nt, Human
acuccucugacucagggcuc

SEQ ID NO: 1441501 - RNA, 14 nt, Human
acuccucugacuca

SEQ ID NO: 1441502 - RNA, 16 nt, Human
acuccuccuuuuucca

SEQ ID NO: 1441503 - RNA, 13 nt, Human
acuccugaaaaaa

SEQ ID NO: 1441504 - RNA, 21 nt, Human
acuccucugcugaccugcuga

SEQ ID NO: 1441505 - RNA, 16 nt, Human
acuccucugcugaccu

SEQ ID NO: 1441506 - RNA, 13 nt, Human
acuccucugcuga

SEQ ID NO: 1441507 - RNA, 15 nt, Human
acuccugaccucaag

SEQ ID NO: 1441508 - RNA, 19 nt, Human
acuccugaaaaaaaaccug

SEQ ID NO: 1441509 - RNA, 16 nt, Human
acuccugaaaaaaaac

SEQ ID NO: 1441510 - RNA, 14 nt, Human
acuccugaaaaaaa

SEQ ID NO: 1441511 - RNA, 14 nt, Human
ucccuuaauauccu

SEQ ID NO: 1441512 - RNA, 22 nt, Human
ucccuuaacaguuguauuuaac

SEQ ID NO: 1441513 - RNA, 20 nt, Human
ucccuuaacaguuguauuua

SEQ ID NO: 1441514 - RNA, 17 nt, Human
ucccuuaacaguuguau

SEQ ID NO: 1441515 - RNA, 16 nt, Human
ucccuuaacaguugua

SEQ ID NO: 1441516 - RNA, 22 nt, Human
ucccuuaaacaaaaauuaaaau

SEQ ID NO: 1441517 - RNA, 15 nt, Human
ucccuuaaacaaaaa

SEQ ID NO: 1441518 - RNA, 19 nt, Human
ucccuguuuucccacgagg

SEQ ID NO: 1441519 - RNA, 19 nt, Human
ucccuguuuuccccccaag

SEQ ID NO: 1441520 - RNA, 16 nt, Human
ucccugugccuccucc

SEQ ID NO: 1441521 - RNA, 19 nt, Human
ucccugugccuccucccuc

SEQ ID NO: 1441522 - RNA, 17 nt, Human
ucccuuaauauccuaaa

SEQ ID NO: 1441523 - RNA, 21 nt, Human
ucccuuaauauccuaaacauc

SEQ ID NO: 1441524 - RNA, 14 nt, Human
ucccugugccuccu

SEQ ID NO: 1441525 - RNA, 14 nt, Human
ucccugugccccca

SEQ ID NO: 1441526 - RNA, 15 nt, Human
ucccuggugcuuaug

SEQ ID NO: 1441527 - RNA, 11 nt, Human
ucccuggugcu

SEQ ID NO: 1441528 - RNA, 14 nt, Human
ucccuggucccuug

SEQ ID NO: 1441529 - RNA, 19 nt, Human
ucccuggucccuuggagac

SEQ ID NO: 1441530 - RNA, 12 nt, Human
ucccuggucccu

SEQ ID NO: 1441531 - RNA, 13 nt, Human
ucccuggucccuu

SEQ ID NO: 1441532 - RNA, 20 nt, Human
ucccuggguagcgggggagg

SEQ ID NO: 1441533 - RNA, 21 nt, Human
uccgggaccuggugcugccuc

SEQ ID NO: 1441534 - RNA, 20 nt, Human
ucccuuuucuguucuaguuu

SEQ ID NO: 1441535 - RNA, 16 nt, Human
ucccuuuucuguucua

SEQ ID NO: 1441536 - RNA, 14 nt, Human
ucccuuuucuguuc

SEQ ID NO: 1441537 - RNA, 13 nt, Human
ucccuuuucuguu

SEQ ID NO: 1441538 - RNA, 14 nt, Human
ucccuuuuccauga

SEQ ID NO: 1441539 - RNA, 16 nt, Human
uccuaagagugcuggg

SEQ ID NO: 1441540 - RNA, 20 nt, Human
uccuaaauuuuccuguccuc

SEQ ID NO: 1441541 - RNA, 19 nt, Human
uccuaaauuuuccuguccu

SEQ ID NO: 1441542 - RNA, 18 nt, Human
uccuaaauuuuccugucc

SEQ ID NO: 1441543 - RNA, 21 nt, Human
uccuaaauauuaugagaugcu

SEQ ID NO: 1441544 - RNA, 14 nt, Human
uccuaaauauuaug

SEQ ID NO: 1441545 - RNA, 19 nt, Human
uccuaaauauauuuuaaga

SEQ ID NO: 1441546 - RNA, 22 nt, Human
ucggggugcacaggaggggguc

SEQ ID NO: 1441547 - RNA, 19 nt, Human
ucggggugcacaggagggg

SEQ ID NO: 1441548 - RNA, 17 nt, Human
ucggggugcacaggagg

SEQ ID NO: 1441549 - RNA, 16 nt, Human
ucggggugcacaggag

SEQ ID NO: 1441550 - RNA, 15 nt, Human
ucggggugcacagga

SEQ ID NO: 1441551 - RNA, 14 nt, Human
ucggggugcacagg

SEQ ID NO: 1441552 - RNA, 13 nt, Human
ucgggcccuuccc

SEQ ID NO: 1441553 - RNA, 15 nt, Human
ucggcugaccaugcu

SEQ ID NO: 1441554 - RNA, 19 nt, Human
ucggcuccccauguguccu

SEQ ID NO: 1441555 - RNA, 19 nt, Human
ucggccugcccccacccca

SEQ ID NO: 1441556 - RNA, 16 nt, Human
ucggccugcccccacc

SEQ ID NO: 1441557 - RNA, 21 nt, Human
ucgggaaaagguagaggaguc

SEQ ID NO: 1441558 - RNA, 16 nt, Human
ucggcugaccaugcuc

SEQ ID NO: 1441559 - RNA, 11 nt, Human
ucuaaagcaaa

SEQ ID NO: 1441560 - RNA, 23 nt, Human
ucuaaagauucuauaguucuaga

SEQ ID NO: 1441561 - RNA, 22 nt, Human
ucuaaagauucuauaguucuag

SEQ ID NO: 1441562 - RNA, 20 nt, Human
ucuaaagauucuauaguucu

SEQ ID NO: 1441563 - RNA, 16 nt, Human
ucuaaagauucuauag

SEQ ID NO: 1441564 - RNA, 15 nt, Human
ucuaaagauucuaua

SEQ ID NO: 1441565 - RNA, 13 nt, Human
ucuaaagauucua

SEQ ID NO: 1441566 - RNA, 23 nt, Human
ucuaaagauggaguuucuaaggu

SEQ ID NO: 1441567 - RNA, 22 nt, Human
ucuaaagauggaguuucuaagg

SEQ ID NO: 1441568 - RNA, 21 nt, Human
ucuaaagauggaguuucuaag

SEQ ID NO: 1441569 - RNA, 20 nt, Human
ucuaaagauggaguuucuaa

SEQ ID NO: 1441570 - RNA, 19 nt, Human
ucuaaagauggaguuucua

SEQ ID NO: 1441571 - RNA, 23 nt, Human
ucuaaaaucuuauaguucuaggc

SEQ ID NO: 1441572 - RNA, 18 nt, Human
ucuaaagauggaguuucu

SEQ ID NO: 1441573 - RNA, 22 nt, Human
ucuaaaaucuuauaguucuagg

SEQ ID NO: 1441574 - RNA, 19 nt, Human
ucuaaaaucuuauaguucu

SEQ ID NO: 1441575 - RNA, 18 nt, Human
ucuaaaaucuuauaguuc

SEQ ID NO: 1441576 - RNA, 15 nt, Human
ucuaaaaucuuauag

SEQ ID NO: 1441577 - RNA, 11 nt, Human
ucuaaaacucc

SEQ ID NO: 1441578 - RNA, 17 nt, Human
ucguuuuuuucauucca

SEQ ID NO: 1441579 - RNA, 20 nt, Human
ucguuuuuuuuuuguuuguu

SEQ ID NO: 1441580 - RNA, 14 nt, Human
ucguuuuuuacaaa

SEQ ID NO: 1441581 - RNA, 21 nt, Human
ucguuuucuuaaagugccagu

SEQ ID NO: 1441582 - RNA, 13 nt, Human
ucguuuucuuaaa

SEQ ID NO: 1441583 - RNA, 20 nt, Human
ucguuuguuuguuuguuuaa

SEQ ID NO: 1441584 - RNA, 13 nt, Human
ucguuuguuuguu

SEQ ID NO: 1441585 - RNA, 15 nt, Human
ucguuuguguucugu

SEQ ID NO: 1441586 - RNA, 14 nt, Human
ucguuuguguucug

SEQ ID NO: 1441587 - RNA, 13 nt, Human
ucguaaagauuug

SEQ ID NO: 1441588 - RNA, 22 nt, Human
ucguuuucaaaauuguuacaaa

SEQ ID NO: 1441589 - RNA, 15 nt, Human
ucguaaagauuuggg

SEQ ID NO: 1441590 - RNA, 13 nt, Human
ucgguuucuccaa

SEQ ID NO: 1441591 - RNA, 16 nt, Human
ucguaaaauuaagaaa

SEQ ID NO: 1441592 - RNA, 12 nt, Human
ucggugaagaaa

SEQ ID NO: 1441593 - RNA, 14 nt, Human
ucggucugugcccc

SEQ ID NO: 1441594 - RNA, 20 nt, Human
ucgguauccccccaucuugc

SEQ ID NO: 1441595 - RNA, 16 nt, Human
ucgguagguucagcca

SEQ ID NO: 1441596 - RNA, 13 nt, Human
ucguaaaauuaag

SEQ ID NO: 1441597 - RNA, 16 nt, Human
acugucccuugccuca

SEQ ID NO: 1441598 - RNA, 22 nt, Human
acugucagcagggacuguaaac

SEQ ID NO: 1441599 - RNA, 19 nt, Human
acugucagcagggacugua

SEQ ID NO: 1441600 - RNA, 12 nt, Human
acugggaaggcu

SEQ ID NO: 1441601 - RNA, 11 nt, Human
acugggaaggc

SEQ ID NO: 1441602 - RNA, 20 nt, Human
acugggaaccccuuucccac

SEQ ID NO: 1441603 - RNA, 19 nt, Human
acugggaaccccuuuccca

SEQ ID NO: 1441604 - RNA, 17 nt, Human
acugggaaccccuuucc

SEQ ID NO: 1441605 - RNA, 16 nt, Human
acugggaaccccuuuc

SEQ ID NO: 1441606 - RNA, 23 nt, Human
acuggcuuuuauuaaugcacuuu

SEQ ID NO: 1441607 - RNA, 21 nt, Human
acuggcuuuuauuaaugcacu

SEQ ID NO: 1441608 - RNA, 20 nt, Human
acuggcuuuuauuaaugcac

SEQ ID NO: 1441609 - RNA, 18 nt, Human
acugggacaggggagaac

SEQ ID NO: 1441610 - RNA, 16 nt, Human
acugggagaaaugaaa

SEQ ID NO: 1441611 - RNA, 15 nt, Human
acugucacuguuccu

SEQ ID NO: 1441612 - RNA, 15 nt, Human
acugggaccaggcac

SEQ ID NO: 1441613 - RNA, 17 nt, Human
acugggaaggcuacuuc

SEQ ID NO: 1441614 - RNA, 20 nt, Human
acugggaaggcuugggauuu

SEQ ID NO: 1441615 - RNA, 17 nt, Human
acugggagaaaugaaaa

SEQ ID NO: 1441616 - RNA, 18 nt, Human
acuguggguagacacaca

SEQ ID NO: 1441617 - RNA, 18 nt, Human
acuguguacauaacugaa

SEQ ID NO: 1441618 - RNA, 16 nt, Human
acuguguacauaacug

SEQ ID NO: 1441619 - RNA, 12 nt, Human
acuguguacaua

SEQ ID NO: 1441620 - RNA, 13 nt, Human
acuguguaauuag

SEQ ID NO: 1441621 - RNA, 21 nt, Human
acuguguaagggccagaaaua

SEQ ID NO: 1441622 - RNA, 19 nt, Human
acuguguaagggccagaaa

SEQ ID NO: 1441623 - RNA, 17 nt, Human
acuguguaacugcccaa

SEQ ID NO: 1441624 - RNA, 15 nt, Human
acuguguaacugccc

SEQ ID NO: 1441625 - RNA, 14 nt, Human
acuguguaacugcc

SEQ ID NO: 1441626 - RNA, 13 nt, Human
acuguguaacugc

SEQ ID NO: 1441627 - RNA, 12 nt, Human
acuguguaacug

SEQ ID NO: 1441628 - RNA, 16 nt, Human
acuguguauuccaaga

SEQ ID NO: 1441629 - RNA, 15 nt, Human
acuguguauuccaag

SEQ ID NO: 1441630 - RNA, 17 nt, Human
acuguguacauaacuga

SEQ ID NO: 1441631 - RNA, 21 nt, Human
acuguguauuccaagacaugu

SEQ ID NO: 1441632 - RNA, 12 nt, Human
acugugugcuca

SEQ ID NO: 1441633 - RNA, 15 nt, Human
acugugugcucagga

SEQ ID NO: 1441634 - RNA, 19 nt, Human
acugugugcucaggagccc

SEQ ID NO: 1441635 - RNA, 20 nt, Human
acugugugcucaggagcccu

SEQ ID NO: 1441636 - RNA, 21 nt, Human
acugugugcucaggagcccug

SEQ ID NO: 1441637 - RNA, 15 nt, Human
acuuacuugcuuauu

SEQ ID NO: 1441638 - RNA, 18 nt, Human
acuuaccaggcaccaaaa

SEQ ID NO: 1441639 - RNA, 19 nt, Human
acuuacauuuacaaacuga

SEQ ID NO: 1441640 - RNA, 15 nt, Human
acuuacauuuacaaa

SEQ ID NO: 1441641 - RNA, 14 nt, Human
acuuacauuuacaa

SEQ ID NO: 1441642 - RNA, 22 nt, Human
acuuaccaggcaccaaaagaag

SEQ ID NO: 1441643 - RNA, 21 nt, Human
acuuaccaggcaccaaaagaa

SEQ ID NO: 1441644 - RNA, 18 nt, Human
acuuacaugauucauuuu

SEQ ID NO: 1441645 - RNA, 17 nt, Human
acuuacaugauucauuu

SEQ ID NO: 1441646 - RNA, 19 nt, Human
acuuacaugauucauuuua

SEQ ID NO: 1441647 - RNA, 16 nt, Human
acuuaaucaaaacuca

SEQ ID NO: 1441648 - RNA, 19 nt, Human
acuuaauacucaaaugagu

SEQ ID NO: 1441649 - RNA, 13 nt, Human
acuuaaucuaaau

SEQ ID NO: 1441650 - RNA, 15 nt, Human
acuuaaucuaaaugg

SEQ ID NO: 1441651 - RNA, 16 nt, Human
acuuaaucuaaaugga

SEQ ID NO: 1441652 - RNA, 21 nt, Human
acuuagaaaaccagcucagca

SEQ ID NO: 1441653 - RNA, 20 nt, Human
acuuagaaaaccagcucagc

SEQ ID NO: 1441654 - RNA, 21 nt, Human
acuuacuuuuucuggucucua

SEQ ID NO: 1441655 - RNA, 13 nt, Human
acuuacuuuuucu

SEQ ID NO: 1441656 - RNA, 16 nt, Human
acuuacuugcuuauuu

SEQ ID NO: 1441657 - RNA, 21 nt, Human
acuuauagccucugucuggca

SEQ ID NO: 1441658 - RNA, 15 nt, Human
acuuauagccucugu

SEQ ID NO: 1441659 - RNA, 14 nt, Human
acuuauagccucug

SEQ ID NO: 1441660 - RNA, 13 nt, Human
acuuauagccucu

SEQ ID NO: 1441661 - RNA, 17 nt, Human
acuuauaauuuuccuaa

SEQ ID NO: 1441662 - RNA, 18 nt, Human
acuuauauggaaauucug

SEQ ID NO: 1441663 - RNA, 14 nt, Human
acuuauaguacaug

SEQ ID NO: 1441664 - RNA, 15 nt, Human
acuuauaguacauga

SEQ ID NO: 1441665 - RNA, 17 nt, Human
acuuauaguacaugaua

SEQ ID NO: 1441666 - RNA, 18 nt, Human
acuuauaguacaugauaa

SEQ ID NO: 1441667 - RNA, 21 nt, Human
acuguuggaauggauuuuucu

SEQ ID NO: 1441668 - RNA, 12 nt, Human
acuguuggaaug

SEQ ID NO: 1441669 - RNA, 18 nt, Human
acuguugggguggguaua

SEQ ID NO: 1441670 - RNA, 13 nt, Human
acuguucuuagcu

SEQ ID NO: 1441671 - RNA, 20 nt, Human
acuguugggguggguauaaa

SEQ ID NO: 1441672 - RNA, 21 nt, Human
acuguugggguggguauaaaa

SEQ ID NO: 1441673 - RNA, 22 nt, Human
acuguugggguggguauaaaag

SEQ ID NO: 1441674 - RNA, 19 nt, Human
acuguucuuagcucaauga

SEQ ID NO: 1441675 - RNA, 17 nt, Human
acuguucugugucuuuc

SEQ ID NO: 1441676 - RNA, 16 nt, Human
acuguucugugucuuu

SEQ ID NO: 1441677 - RNA, 15 nt, Human
acuguucugugucuu

SEQ ID NO: 1441678 - RNA, 13 nt, Human
acuguucuguguc

SEQ ID NO: 1441679 - RNA, 21 nt, Human
acuuaauacuaccuugaaaau

SEQ ID NO: 1441680 - RNA, 19 nt, Human
acuuaauacuaccuugaaa

SEQ ID NO: 1441681 - RNA, 18 nt, Human
acuuaauacuaccuugaa

SEQ ID NO: 1441682 - RNA, 17 nt, Human
acuuaauacuaccuuga

SEQ ID NO: 1441683 - RNA, 21 nt, Human
acuuaagcccagugcacugaa

SEQ ID NO: 1441684 - RNA, 21 nt, Human
acuuaagcaucuggcucuaau

SEQ ID NO: 1441685 - RNA, 20 nt, Human
acuuaagcaucuggcucuaa

SEQ ID NO: 1441686 - RNA, 20 nt, Human
acuuaaauaaugugaaacug

SEQ ID NO: 1441687 - RNA, 19 nt, Human
acuguuguagaagacaaaa

SEQ ID NO: 1441688 - RNA, 16 nt, Human
acuuaaauaaugugaa

SEQ ID NO: 1441689 - RNA, 17 nt, Human
acuuaaauaaugugaaa

SEQ ID NO: 1441690 - RNA, 18 nt, Human
acuuaaauaaugugaaac

SEQ ID NO: 1441691 - RNA, 20 nt, Human
ucuaccauuuucugguucuu

SEQ ID NO: 1441692 - RNA, 17 nt, Human
ucuaccauuuucugguu

SEQ ID NO: 1441693 - RNA, 18 nt, Human
ucuaccauuucagagagg

SEQ ID NO: 1441694 - RNA, 15 nt, Human
ucuaccauuucagag

SEQ ID NO: 1441695 - RNA, 14 nt, Human
ucuaccauuucaga

SEQ ID NO: 1441696 - RNA, 18 nt, Human
acuguucuaaagcucuga

SEQ ID NO: 1441697 - RNA, 17 nt, Human
acuguucuaaagcucug

SEQ ID NO: 1441698 - RNA, 16 nt, Human
acuguucuaaagcucu

SEQ ID NO: 1441699 - RNA, 14 nt, Human
acuguucuaaagcu

SEQ ID NO: 1441700 - RNA, 13 nt, Human
acuguucuaaagc

SEQ ID NO: 1441701 - RNA, 21 nt, Human
acuguucuaaagcucugacau

SEQ ID NO: 1441702 - RNA, 18 nt, Human
ucuacagucucgucucuu

SEQ ID NO: 1441703 - RNA, 15 nt, Human
ucuaaguaaauacaa

SEQ ID NO: 1441704 - RNA, 14 nt, Human
ucuaaguaaauaca

SEQ ID NO: 1441705 - RNA, 23 nt, Human
ucuaagguccgguguucuaagau

SEQ ID NO: 1441706 - RNA, 22 nt, Human
ucuaagguccgguguucuaaga

SEQ ID NO: 1441707 - RNA, 20 nt, Human
ucuaagguccgguguucuaa

SEQ ID NO: 1441708 - RNA, 22 nt, Human
ucuaaggcucugagagucuaga

SEQ ID NO: 1441709 - RNA, 23 nt, Human
ucuaaggcucugagagucuagau

SEQ ID NO: 1441710 - RNA, 20 nt, Human
ucuaaggcucugagagucua

SEQ ID NO: 1441711 - RNA, 17 nt, Human
ucuaaggcucugagagu

SEQ ID NO: 1441712 - RNA, 16 nt, Human
ucuaaggcucugagag

SEQ ID NO: 1441713 - RNA, 15 nt, Human
ucuaaggcucugaga

SEQ ID NO: 1441714 - RNA, 14 nt, Human
ucuaaggcucugag

SEQ ID NO: 1441715 - RNA, 13 nt, Human
ucuaaggcucuga

SEQ ID NO: 1441716 - RNA, 22 nt, Human
ucuaaggccuaggauucuaaaa

SEQ ID NO: 1441717 - RNA, 21 nt, Human
ucuaaggccuaggauucuaaa

SEQ ID NO: 1441718 - RNA, 20 nt, Human
ucuaaggccuaggauucuaa

SEQ ID NO: 1441719 - RNA, 19 nt, Human
ucuaaggccuaggauucua

SEQ ID NO: 1441720 - RNA, 18 nt, Human
ucuaaggccuaggauucu

SEQ ID NO: 1441721 - RNA, 23 nt, Human
ucuaaggaccugaaauuccaaag

SEQ ID NO: 1441722 - RNA, 21 nt, Human
ucuaaggaccugaaauuccaa

SEQ ID NO: 1441723 - RNA, 17 nt, Human
ucuaaggaccugaaauu

SEQ ID NO: 1441724 - RNA, 14 nt, Human
ucuaaagcucugac

SEQ ID NO: 1441725 - RNA, 12 nt, Human
ucuaaagcucug

SEQ ID NO: 1441726 - RNA, 12 nt, Human
ucuaaagcaaau

SEQ ID NO: 1441727 - RNA, 20 nt, Human
ucuaaagccauuguaguccu

SEQ ID NO: 1441728 - RNA, 19 nt, Human
uccuagagaagacaggcug

SEQ ID NO: 1441729 - RNA, 20 nt, Human
uccuagagaagacaggcugg

SEQ ID NO: 1441730 - RNA, 18 nt, Human
acugcauacuuuuuaaau

SEQ ID NO: 1441731 - RNA, 17 nt, Human
acugcauacuuuuuaaa

SEQ ID NO: 1441732 - RNA, 16 nt, Human
acugcauacuuuuuaa

SEQ ID NO: 1441733 - RNA, 13 nt, Human
acugcauacuuuu

SEQ ID NO: 1441734 - RNA, 18 nt, Human
uccuagagaagacaggcu

SEQ ID NO: 1441735 - RNA, 19 nt, Human
uccuacuggucucucuaug

SEQ ID NO: 1441736 - RNA, 17 nt, Human
uccuacuggucucucua

SEQ ID NO: 1441737 - RNA, 16 nt, Human
uccuacuggucucucu

SEQ ID NO: 1441738 - RNA, 22 nt, Human
acugcaugcccagagacccagc

SEQ ID NO: 1441739 - RNA, 17 nt, Human
acugcaugcccagagac

SEQ ID NO: 1441740 - RNA, 14 nt, Human
acugcaugcccaga

SEQ ID NO: 1441741 - RNA, 18 nt, Human
acugcaugcacuucuuac

SEQ ID NO: 1441742 - RNA, 14 nt, Human
acugcaugcacuuc

SEQ ID NO: 1441743 - RNA, 12 nt, Human
acugcaugcacu

SEQ ID NO: 1441744 - RNA, 15 nt, Human
acugcauguuuguga

SEQ ID NO: 1441745 - RNA, 16 nt, Human
acugcauguuugugau

SEQ ID NO: 1441746 - RNA, 23 nt, Human
acugcauacuuuuuaaauguaaa

SEQ ID NO: 1441747 - RNA, 20 nt, Human
acugcauacuuuuuaaaugu

SEQ ID NO: 1441748 - RNA, 14 nt, Human
acugcauccagccu

SEQ ID NO: 1441749 - RNA, 15 nt, Human
acugcauccagccug

SEQ ID NO: 1441750 - RNA, 22 nt, Human
acugccuucgcuucuugccucu

SEQ ID NO: 1441751 - RNA, 21 nt, Human
acugccuucgcuucuugccuc

SEQ ID NO: 1441752 - RNA, 17 nt, Human
acugccuucgcuucuug

SEQ ID NO: 1441753 - RNA, 16 nt, Human
acugccuucgcuucuu

SEQ ID NO: 1441754 - RNA, 15 nt, Human
acugccuucgcuucu

SEQ ID NO: 1441755 - RNA, 14 nt, Human
acugccugcuuggg

SEQ ID NO: 1441756 - RNA, 19 nt, Human
acugccugcucccauccug

SEQ ID NO: 1441757 - RNA, 15 nt, Human
acugccugcucccau

SEQ ID NO: 1441758 - RNA, 13 nt, Human
acugccugcuccc

SEQ ID NO: 1441759 - RNA, 11 nt, Human
acugccugcuc

SEQ ID NO: 1441760 - RNA, 9 nt, Human
acugccugc

SEQ ID NO: 1441761 - RNA, 14 nt, Human
acugcauuauauuu

SEQ ID NO: 1441762 - RNA, 23 nt, Human
acugcauucuucugagcacuguu

SEQ ID NO: 1441763 - RNA, 15 nt, Human
acugcauuauauuua

SEQ ID NO: 1441764 - RNA, 19 nt, Human
acugccucgaaacacagaa

SEQ ID NO: 1441765 - RNA, 17 nt, Human
acugccucgaaacacag

SEQ ID NO: 1441766 - RNA, 16 nt, Human
acugccuauuuuaaua

SEQ ID NO: 1441767 - RNA, 21 nt, Human
acugccuauuuuaauaaacac

SEQ ID NO: 1441768 - RNA, 21 nt, Human
acuggccaagcugaggugccc

SEQ ID NO: 1441769 - RNA, 19 nt, Human
acuggccaagcugaggugc

SEQ ID NO: 1441770 - RNA, 18 nt, Human
acuggccaagcugaggug

SEQ ID NO: 1441771 - RNA, 17 nt, Human
acuggccaagcugaggu

SEQ ID NO: 1441772 - RNA, 16 nt, Human
acuggccaagcugagg

SEQ ID NO: 1441773 - RNA, 14 nt, Human
acuggccaagcuga

SEQ ID NO: 1441774 - RNA, 22 nt, Human
acuggauuaaacuuaaucuaaa

SEQ ID NO: 1441775 - RNA, 15 nt, Human
acuggauuaaacuua

SEQ ID NO: 1441776 - RNA, 19 nt, Human
acugcuuucuguuccaaau

SEQ ID NO: 1441777 - RNA, 18 nt, Human
acugcuuucuguuccaaa

SEQ ID NO: 1441778 - RNA, 17 nt, Human
acugcuuucuguuccaa

SEQ ID NO: 1441779 - RNA, 16 nt, Human
acugcuuucuguucca

SEQ ID NO: 1441780 - RNA, 14 nt, Human
acugcuuucuguuc

SEQ ID NO: 1441781 - RNA, 12 nt, Human
acugcuuucugu

SEQ ID NO: 1441782 - RNA, 22 nt, Human
acuggagugugcgugguggucc

SEQ ID NO: 1441783 - RNA, 17 nt, Human
acuggagugugcguggu

SEQ ID NO: 1441784 - RNA, 20 nt, Human
acugcuguggccaggaggug

SEQ ID NO: 1441785 - RNA, 19 nt, Human
acugcuguggccaggaggu

SEQ ID NO: 1441786 - RNA, 18 nt, Human
acugcuguggccaggagg

SEQ ID NO: 1441787 - RNA, 16 nt, Human
acugcuuaauucaaau

SEQ ID NO: 1441788 - RNA, 20 nt, Human
acugcuuaacuucacauauu

SEQ ID NO: 1441789 - RNA, 13 nt, Human
acugcuuaauuca

SEQ ID NO: 1441790 - RNA, 17 nt, Human
acugcuguggccaggag

SEQ ID NO: 1441791 - RNA, 16 nt, Human
acugcuguggccagga

SEQ ID NO: 1441792 - RNA, 15 nt, Human
acugcuguggccagg

SEQ ID NO: 1441793 - RNA, 14 nt, Human
acugcuguggccag

SEQ ID NO: 1441794 - RNA, 18 nt, Human
acugcuuaacuucacaua

SEQ ID NO: 1441795 - RNA, 13 nt, Human
acugcuccuccuc

SEQ ID NO: 1441796 - RNA, 18 nt, Human
acugcucuaacagcccuc

SEQ ID NO: 1441797 - RNA, 16 nt, Human
acugcuacagcaauuu

SEQ ID NO: 1441798 - RNA, 14 nt, Human
acugcuacagcaau

SEQ ID NO: 1441799 - RNA, 20 nt, Human
acugcuaaauaaaauuuguu

SEQ ID NO: 1441800 - RNA, 19 nt, Human
acugcuaaauaaaauuugu

SEQ ID NO: 1441801 - RNA, 17 nt, Human
acugcuaaauaaaauuu

SEQ ID NO: 1441802 - RNA, 16 nt, Human
acugcuaaauaaaauu

SEQ ID NO: 1441803 - RNA, 15 nt, Human
acugcuaaauaaaau

SEQ ID NO: 1441804 - RNA, 14 nt, Human
acugcuaaauaaaa

SEQ ID NO: 1441805 - RNA, 13 nt, Human
acugcuaaauaaa

SEQ ID NO: 1441806 - RNA, 23 nt, Human
acugccuucgcuucuugccucug

SEQ ID NO: 1441807 - RNA, 20 nt, Human
acugccuucucaacuccaaa

SEQ ID NO: 1441808 - RNA, 19 nt, Human
acugccuucucaacuccaa

SEQ ID NO: 1441809 - RNA, 13 nt, Human
acugccuucucaa

SEQ ID NO: 1441810 - RNA, 19 nt, Human
acuggcuuuuauuaaugca

SEQ ID NO: 1441811 - RNA, 18 nt, Human
acuggcuuuuauuaaugc

SEQ ID NO: 1441812 - RNA, 14 nt, Human
acuggcuuuuauua

SEQ ID NO: 1441813 - RNA, 18 nt, Human
ucgcuccccacucugcuc

SEQ ID NO: 1441814 - RNA, 15 nt, Human
ucgcuccccacucug

SEQ ID NO: 1441815 - RNA, 14 nt, Human
ucgcuccccacucu

SEQ ID NO: 1441816 - RNA, 18 nt, Human
ucgcuccaccuugcagcu

SEQ ID NO: 1441817 - RNA, 22 nt, Human
ucgcggcccucaguagucccug

SEQ ID NO: 1441818 - RNA, 17 nt, Human
ucgcggcccucaguagu

SEQ ID NO: 1441819 - RNA, 23 nt, Human
ucgcuagcauuucccaacacaaa

SEQ ID NO: 1441820 - RNA, 21 nt, Human
ucgcuagcaguggcaggcaga

SEQ ID NO: 1441821 - RNA, 22 nt, Human
ucgcuagcaguggcaggcagag

SEQ ID NO: 1441822 - RNA, 21 nt, Human
ucgagaucccaacacugccag

SEQ ID NO: 1441823 - RNA, 18 nt, Human
ucgagaucccaacacugc

SEQ ID NO: 1441824 - RNA, 14 nt, Human
ucgagcgcccugca

SEQ ID NO: 1441825 - RNA, 23 nt, Human
ucgagaggggccgaugcccagag

SEQ ID NO: 1441826 - RNA, 19 nt, Human
ucgagcgcccugcagaccc

SEQ ID NO: 1441827 - RNA, 18 nt, Human
ucgagcgcccugcagacc

SEQ ID NO: 1441828 - RNA, 17 nt, Human
ucgagcgcccugcagac

SEQ ID NO: 1441829 - RNA, 16 nt, Human
ucgagcgcccugcaga

SEQ ID NO: 1441830 - RNA, 15 nt, Human
ucgagcgcccugcag

SEQ ID NO: 1441831 - RNA, 14 nt, Human
ucgaaugacacugu

SEQ ID NO: 1441832 - RNA, 15 nt, Human
ucgaaugacacuguu

SEQ ID NO: 1441833 - RNA, 17 nt, Human
ucgaaugaaauuaacug

SEQ ID NO: 1441834 - RNA, 12 nt, Human
ucgaaugaaauu

SEQ ID NO: 1441835 - RNA, 22 nt, Human
ucgaaucucugugccuucgucu

SEQ ID NO: 1441836 - RNA, 17 nt, Human
ucgaaucucugugccuu

SEQ ID NO: 1441837 - RNA, 16 nt, Human
ucgaaucucugugccu

SEQ ID NO: 1441838 - RNA, 14 nt, Human
ucgaaucucugugc

SEQ ID NO: 1441839 - RNA, 20 nt, Human
ucgaaucuacuaauuccaca

SEQ ID NO: 1441840 - RNA, 20 nt, Human
ucgagaaagaggcaccagga

SEQ ID NO: 1441841 - RNA, 19 nt, Human
ucgagaaagaggcaccagg

SEQ ID NO: 1441842 - RNA, 21 nt, Human
ucgagaaagaggcaccaggaa

SEQ ID NO: 1441843 - RNA, 17 nt, Human
ucgagaucccaacacug

SEQ ID NO: 1441844 - RNA, 19 nt, Human
uccuuucuagagcacugcc

SEQ ID NO: 1441845 - RNA, 20 nt, Human
uccuuucuagagcacugcca

SEQ ID NO: 1441846 - RNA, 12 nt, Human
uccuuucuuuuc

SEQ ID NO: 1441847 - RNA, 12 nt, Human
uccuuucuuccg

SEQ ID NO: 1441848 - RNA, 20 nt, Human
uccuuucuuccggccccucc

SEQ ID NO: 1441849 - RNA, 13 nt, Human
uccuuucuggcuu

SEQ ID NO: 1441850 - RNA, 13 nt, Human
uccuuucuuuucc

SEQ ID NO: 1441851 - RNA, 12 nt, Human
ucgaagugcuga

SEQ ID NO: 1441852 - RNA, 13 nt, Human
ucgaagugcugag

SEQ ID NO: 1441853 - RNA, 23 nt, Human
uccuugugggccugggcuccugg

SEQ ID NO: 1441854 - RNA, 19 nt, Human
uccuugugggccugggcuc

SEQ ID NO: 1441855 - RNA, 18 nt, Human
uccuugugggccugggcu

SEQ ID NO: 1441856 - RNA, 16 nt, Human
uccuugugggccuggg

SEQ ID NO: 1441857 - RNA, 15 nt, Human
uccuugugccagaga

SEQ ID NO: 1441858 - RNA, 16 nt, Human
uccuugugccagagaa

SEQ ID NO: 1441859 - RNA, 19 nt, Human
uccuugugaugugcacgua

SEQ ID NO: 1441860 - RNA, 20 nt, Human
uccuugugaugugcacguaa

SEQ ID NO: 1441861 - RNA, 17 nt, Human
uccuugugaugugcacg

SEQ ID NO: 1441862 - RNA, 13 nt, Human
uccuugucacugg

SEQ ID NO: 1441863 - RNA, 16 nt, Human
uccuucugagcuccug

SEQ ID NO: 1441864 - RNA, 24 nt, Human
uccuucugagcccgguaagagcaa

SEQ ID NO: 1441865 - RNA, 18 nt, Human
uccuucugagcuccuguc

SEQ ID NO: 1441866 - RNA, 15 nt, Human
uccuuuaauuguaaa

SEQ ID NO: 1441867 - RNA, 13 nt, Human
uccuuuaauugua

SEQ ID NO: 1441868 - RNA, 11 nt, Human
uccuuuaacaa

SEQ ID NO: 1441869 - RNA, 21 nt, Human
uccuuguuguuucuugccuga

SEQ ID NO: 1441870 - RNA, 14 nt, Human
uccuuguguuacua

SEQ ID NO: 1441871 - RNA, 23 nt, Human
uccuuguguuacuaaguuuuuau

SEQ ID NO: 1441872 - RNA, 22 nt, Human
uccuucccagaggggccugcca

SEQ ID NO: 1441873 - RNA, 12 nt, Human
uccuucccagag

SEQ ID NO: 1441874 - RNA, 10 nt, Human
uccuucccaa

SEQ ID NO: 1441875 - RNA, 24 nt, Human
uccuuccagugucauuucucaucc

SEQ ID NO: 1441876 - RNA, 22 nt, Human
uccuuccagcuagugacccaca

SEQ ID NO: 1441877 - RNA, 16 nt, Human
uccuuccagcuaguga

SEQ ID NO: 1441878 - RNA, 20 nt, Human
uccuuccaaugucuggagac

SEQ ID NO: 1441879 - RNA, 15 nt, Human
uccuuccaccaaguu

SEQ ID NO: 1441880 - RNA, 22 nt, Human
acuggccucaaagcaagcauuc

SEQ ID NO: 1441881 - RNA, 15 nt, Human
acuggccucaaagca

SEQ ID NO: 1441882 - RNA, 17 nt, Human
acuggccucaaagcaag

SEQ ID NO: 1441883 - RNA, 11 nt, Human
acuggccaggg

SEQ ID NO: 1441884 - RNA, 15 nt, Human
acuggccauggccug

SEQ ID NO: 1441885 - RNA, 22 nt, Human
acuggccagggccacgcuccag

SEQ ID NO: 1441886 - RNA, 16 nt, Human
acuggccauggccugc

SEQ ID NO: 1441887 - RNA, 21 nt, Human
acuggccauggccugcaaacu

SEQ ID NO: 1441888 - RNA, 12 nt, Human
acuggccccacc

SEQ ID NO: 1441889 - RNA, 13 nt, Human
acuggccccaccc

SEQ ID NO: 1441890 - RNA, 17 nt, Human
acuucggggcugggaag

SEQ ID NO: 1441891 - RNA, 21 nt, Human
acuucuauuuuaaagacaaug

SEQ ID NO: 1441892 - RNA, 14 nt, Human
acuucuaauugcca

SEQ ID NO: 1441893 - RNA, 17 nt, Human
acuucuaauugccaugu

SEQ ID NO: 1441894 - RNA, 19 nt, Human
acuucucauuuuuuaaaaa

SEQ ID NO: 1441895 - RNA, 21 nt, Human
acuucucaggacacaggccug

SEQ ID NO: 1441896 - RNA, 22 nt, Human
acuucucaggacacaggccugu

SEQ ID NO: 1441897 - RNA, 20 nt, Human
acuucucaggacacaggccu

SEQ ID NO: 1441898 - RNA, 18 nt, Human
acuucucaggacacaggc

SEQ ID NO: 1441899 - RNA, 17 nt, Human
acuucucaggacacagg

SEQ ID NO: 1441900 - RNA, 17 nt, Human
acuucucacuaauuugu

SEQ ID NO: 1441901 - RNA, 21 nt, Human
acuucgacacuguucuuagcu

SEQ ID NO: 1441902 - RNA, 23 nt, Human
acuucgacacuguucuuagcuca

SEQ ID NO: 1441903 - RNA, 16 nt, Human
acuucgacacuguucu

SEQ ID NO: 1441904 - RNA, 14 nt, Human
acuucgacacuguu

SEQ ID NO: 1441905 - RNA, 23 nt, Human
acuuccuguccagcuccaaccug

SEQ ID NO: 1441906 - RNA, 22 nt, Human
acuuccuguccagcuccaaccu

SEQ ID NO: 1441907 - RNA, 18 nt, Human
acuuccuguccagcucca

SEQ ID NO: 1441908 - RNA, 16 nt, Human
ucucacuauaccagua

SEQ ID NO: 1441909 - RNA, 16 nt, Human
ucuauuucugccuccc

SEQ ID NO: 1441910 - RNA, 20 nt, Human
ucuauuucuccuccauggga

SEQ ID NO: 1441911 - RNA, 16 nt, Human
ucuauuucuccuccau

SEQ ID NO: 1441912 - RNA, 15 nt, Human
ucuauuucuccucca

SEQ ID NO: 1441913 - RNA, 14 nt, Human
ucuauuucuccucc

SEQ ID NO: 1441914 - RNA, 14 nt, Human
ucuauuucauguuu

SEQ ID NO: 1441915 - RNA, 16 nt, Human
ucuauuucauguuuuu

SEQ ID NO: 1441916 - RNA, 14 nt, Human
ucuauuucacugga

SEQ ID NO: 1441917 - RNA, 17 nt, Human
ucuauuucacuggagca

SEQ ID NO: 1441918 - RNA, 22 nt, Human
ucucacggccacacagcugccg

SEQ ID NO: 1441919 - RNA, 21 nt, Human
ucucacggccacacagcugcc

SEQ ID NO: 1441920 - RNA, 20 nt, Human
ucucacggccacacagcugc

SEQ ID NO: 1441921 - RNA, 21 nt, Human
ucucaccuggcccugcuuccu

SEQ ID NO: 1441922 - RNA, 19 nt, Human
ucucaccuggcccugcuuc

SEQ ID NO: 1441923 - RNA, 16 nt, Human
ucucaccuggcccugc

SEQ ID NO: 1441924 - RNA, 14 nt, Human
ucucaccuggcccu

SEQ ID NO: 1441925 - RNA, 12 nt, Human
ucucaccuggcc

SEQ ID NO: 1441926 - RNA, 24 nt, Human
ucucaccuggacuuaagcaucugg

SEQ ID NO: 1441927 - RNA, 13 nt, Human
ucucaccuggacu

SEQ ID NO: 1441928 - RNA, 14 nt, Human
ucucacuaaaucuu

SEQ ID NO: 1441929 - RNA, 19 nt, Human
ucucacacuggucugcugu

SEQ ID NO: 1441930 - RNA, 21 nt, Human
ucucaccucuagguccccaua

SEQ ID NO: 1441931 - RNA, 14 nt, Human
ucucaccucuaggu

SEQ ID NO: 1441932 - RNA, 21 nt, Human
ucucacagcuccaagaauuuc

SEQ ID NO: 1441933 - RNA, 20 nt, Human
acuucucauuuuuuaaaaaa

SEQ ID NO: 1441934 - RNA, 22 nt, Human
acuugaagggccagagccaggg

SEQ ID NO: 1441935 - RNA, 21 nt, Human
acuugaagggccagagccagg

SEQ ID NO: 1441936 - RNA, 20 nt, Human
acuugaagggccagagccag

SEQ ID NO: 1441937 - RNA, 19 nt, Human
acuugaagggccagagcca

SEQ ID NO: 1441938 - RNA, 18 nt, Human
acuugaagggccagagcc

SEQ ID NO: 1441939 - RNA, 17 nt, Human
acuugaagggccagagc

SEQ ID NO: 1441940 - RNA, 15 nt, Human
acuugaagggccaga

SEQ ID NO: 1441941 - RNA, 21 nt, Human
acuugagaccuaaucucugua

SEQ ID NO: 1441942 - RNA, 24 nt, Human
acuugaaugcuaguuauacuuauu

SEQ ID NO: 1441943 - RNA, 20 nt, Human
acuugaaugaaaauguccau

SEQ ID NO: 1441944 - RNA, 13 nt, Human
acuugaaugaaaa

SEQ ID NO: 1441945 - RNA, 12 nt, Human
acuugagcaugu

SEQ ID NO: 1441946 - RNA, 14 nt, Human
acuugagaccuaau

SEQ ID NO: 1441947 - RNA, 11 nt, Human
acuugaggaca

SEQ ID NO: 1441948 - RNA, 12 nt, Human
acuugaggacac

SEQ ID NO: 1441949 - RNA, 13 nt, Human
acuugaggacaca

SEQ ID NO: 1441950 - RNA, 14 nt, Human
acuugaggacacau

SEQ ID NO: 1441951 - RNA, 23 nt, Human
acuugucauuguuauauaaucau

SEQ ID NO: 1441952 - RNA, 21 nt, Human
acuugucaggaguguguguga

SEQ ID NO: 1441953 - RNA, 13 nt, Human
acuugucauguga

SEQ ID NO: 1441954 - RNA, 19 nt, Human
acuugucaggagugugugu

SEQ ID NO: 1441955 - RNA, 21 nt, Human
acuuggcucgaaucucugugc

SEQ ID NO: 1441956 - RNA, 20 nt, Human
acuuggcucgaaucucugug

SEQ ID NO: 1441957 - RNA, 19 nt, Human
acuuggcucgaaucucugu

SEQ ID NO: 1441958 - RNA, 18 nt, Human
acuuggcucgaaucucug

SEQ ID NO: 1441959 - RNA, 19 nt, Human
acuuggcucacacucgaca

SEQ ID NO: 1441960 - RNA, 16 nt, Human
acuugucaauaaaauc

SEQ ID NO: 1441961 - RNA, 24 nt, Human
acuugucauuguuauauaaucauu

SEQ ID NO: 1441962 - RNA, 23 nt, Human
acuugucccgggacaccuaggcu

SEQ ID NO: 1441963 - RNA, 20 nt, Human
acuugcucagguacuuguaa

SEQ ID NO: 1441964 - RNA, 22 nt, Human
acuugcucagguacuuguaaau

SEQ ID NO: 1441965 - RNA, 20 nt, Human
acuugcgguuccggcaugga

SEQ ID NO: 1441966 - RNA, 22 nt, Human
acuugcgagaaauucguguguu

SEQ ID NO: 1441967 - RNA, 17 nt, Human
acuugcgagaaauucgu

SEQ ID NO: 1441968 - RNA, 21 nt, Human
acuugccugccuuuccaucca

SEQ ID NO: 1441969 - RNA, 18 nt, Human
acuugccugccuuuccau

SEQ ID NO: 1441970 - RNA, 14 nt, Human
acuugccugccuuu

SEQ ID NO: 1441971 - RNA, 13 nt, Human
acuugccugccuu

SEQ ID NO: 1441972 - RNA, 17 nt, Human
acuugccucuuccuuga

SEQ ID NO: 1441973 - RNA, 13 nt, Human
acuugccucuucc

SEQ ID NO: 1441974 - RNA, 15 nt, Human
acuugaggacacaug

SEQ ID NO: 1441975 - RNA, 16 nt, Human
acuugaggacacaugu

SEQ ID NO: 1441976 - RNA, 15 nt, Human
acuuggccucucucu

SEQ ID NO: 1441977 - RNA, 17 nt, Human
acuuggcagccuuguga

SEQ ID NO: 1441978 - RNA, 15 nt, Human
acuuggcagccuugu

SEQ ID NO: 1441979 - RNA, 14 nt, Human
acuuggcagccuug

SEQ ID NO: 1441980 - RNA, 13 nt, Human
acuuggcagccuu

SEQ ID NO: 1441981 - RNA, 20 nt, Human
acuuggauuuaguuucagua

SEQ ID NO: 1441982 - RNA, 22 nt, Human
acuuggauucuuuccauuugca

SEQ ID NO: 1441983 - RNA, 18 nt, Human
acuuggauucuuuccauu

SEQ ID NO: 1441984 - RNA, 17 nt, Human
acuuggauucuuuccau

SEQ ID NO: 1441985 - RNA, 16 nt, Human
acuuggauucuuucca

SEQ ID NO: 1441986 - RNA, 18 nt, Human
acuuggauacuuggauuu

SEQ ID NO: 1441987 - RNA, 17 nt, Human
acuuggaguggagagga

SEQ ID NO: 1441988 - RNA, 14 nt, Human
acuugcucuugaug

SEQ ID NO: 1441989 - RNA, 23 nt, Human
ucucccagauaaugugaaaaugg

SEQ ID NO: 1441990 - RNA, 21 nt, Human
ucucccagauaaugugaaaau

SEQ ID NO: 1441991 - RNA, 18 nt, Human
ucucccagauaaugugaa

SEQ ID NO: 1441992 - RNA, 16 nt, Human
ucucccagauaaugug

SEQ ID NO: 1441993 - RNA, 16 nt, Human
ucucccacucuccuag

SEQ ID NO: 1441994 - RNA, 15 nt, Human
ucucccacucuccua

SEQ ID NO: 1441995 - RNA, 14 nt, Human
ucucccacucuccu

SEQ ID NO: 1441996 - RNA, 19 nt, Human
ucucccacuagacaagucc

SEQ ID NO: 1441997 - RNA, 19 nt, Human
ucucccacccucuuccuac

SEQ ID NO: 1441998 - RNA, 14 nt, Human
ucucccaccuagca

SEQ ID NO: 1441999 - RNA, 20 nt, Human
ucucccacccucuuccuacu

SEQ ID NO: 1442000 - RNA, 17 nt, Human
ucucccacccucuuccu

SEQ ID NO: 1442001 - RNA, 16 nt, Human
ucucccacccucuucc

SEQ ID NO: 1442002 - RNA, 15 nt, Human
ucucccacccucuuc

SEQ ID NO: 1442003 - RNA, 14 nt, Human
ucucccacccucuu

SEQ ID NO: 1442004 - RNA, 13 nt, Human
ucucccacccucu

SEQ ID NO: 1442005 - RNA, 12 nt, Human
ucucccacccuc

SEQ ID NO: 1442006 - RNA, 16 nt, Human
ucuccauucugcuccu

SEQ ID NO: 1442007 - RNA, 15 nt, Human
ucuccauucugcucc

SEQ ID NO: 1442008 - RNA, 20 nt, Human
ucuccauggcccugccaugc

SEQ ID NO: 1442009 - RNA, 24 nt, Human
ucuccauggcccugccaugcucuc

SEQ ID NO: 1442010 - RNA, 14 nt, Human
ucuccauggcccug

SEQ ID NO: 1442011 - RNA, 18 nt, Human
ucuccauggcccugcaaa

SEQ ID NO: 1442012 - RNA, 15 nt, Human
ucuccauggcccugc

SEQ ID NO: 1442013 - RNA, 16 nt, Human
ucuccauggcccugcc

SEQ ID NO: 1442014 - RNA, 17 nt, Human
ucuccauggcccugcca

SEQ ID NO: 1442015 - RNA, 23 nt, Human
ucucccauuuuggaauuugccug

SEQ ID NO: 1442016 - RNA, 13 nt, Human
ucucccaguuguc

SEQ ID NO: 1442017 - RNA, 21 nt, Human
ucuccuaggcauucuggaccu

SEQ ID NO: 1442018 - RNA, 23 nt, Human
ucuccuaggcauucuggaccucu

SEQ ID NO: 1442019 - RNA, 19 nt, Human
ucuccuaggcauucuggac

SEQ ID NO: 1442020 - RNA, 15 nt, Human
ucuccuaggcauucu

SEQ ID NO: 1442021 - RNA, 14 nt, Human
ucuccuagccccug

SEQ ID NO: 1442022 - RNA, 23 nt, Human
ucuccuaagcaccuguaaugugc

SEQ ID NO: 1442023 - RNA, 21 nt, Human
ucuccguuagcuccuguggcc

SEQ ID NO: 1442024 - RNA, 23 nt, Human
ucuccguuagcuccuguggcccc

SEQ ID NO: 1442025 - RNA, 22 nt, Human
ucuccguuagcuccuguggccc

SEQ ID NO: 1442026 - RNA, 19 nt, Human
ucuccuaagcuggagugca

SEQ ID NO: 1442027 - RNA, 19 nt, Human
acuuuaauuaccaaccugu

SEQ ID NO: 1442028 - RNA, 23 nt, Human
acuuuaacauaagcuauuuuucu

SEQ ID NO: 1442029 - RNA, 19 nt, Human
acuuuaacauaagcuauuu

SEQ ID NO: 1442030 - RNA, 18 nt, Human
acuuuaacauaagcuauu

SEQ ID NO: 1442031 - RNA, 16 nt, Human
acuuuaacauaagcua

SEQ ID NO: 1442032 - RNA, 14 nt, Human
acuuuaacauaagc

SEQ ID NO: 1442033 - RNA, 13 nt, Human
acuuuaaauugug

SEQ ID NO: 1442034 - RNA, 12 nt, Human
acuuuaaagcgu

SEQ ID NO: 1442035 - RNA, 17 nt, Human
acuuucucaguuuucau

SEQ ID NO: 1442036 - RNA, 14 nt, Human
acuuucucaguuuu

SEQ ID NO: 1442037 - RNA, 13 nt, Human
acuuucucaguuu

SEQ ID NO: 1442038 - RNA, 17 nt, Human
acuuucuauccucugua

SEQ ID NO: 1442039 - RNA, 12 nt, Human
ucuccucccagg

SEQ ID NO: 1442040 - RNA, 20 nt, Human
ucuccuccaugggagaaaau

SEQ ID NO: 1442041 - RNA, 16 nt, Human
acuuguguuuugcaag

SEQ ID NO: 1442042 - RNA, 19 nt, Human
ucuccauccacaugggagc

SEQ ID NO: 1442043 - RNA, 13 nt, Human
ucuccauccacau

SEQ ID NO: 1442044 - RNA, 18 nt, Human
ucuccaguggauucccag

SEQ ID NO: 1442045 - RNA, 15 nt, Human
ucuccagugcaccug

SEQ ID NO: 1442046 - RNA, 19 nt, Human
ucuccaguauccacuuugc

SEQ ID NO: 1442047 - RNA, 23 nt, Human
ucuccaggggcugcuuccuccug

SEQ ID NO: 1442048 - RNA, 22 nt, Human
ucuccaggggcugcuuccuccu

SEQ ID NO: 1442049 - RNA, 20 nt, Human
ucuccaggggcugcuuccuc

SEQ ID NO: 1442050 - RNA, 18 nt, Human
ucuccaggggcugcuucc

SEQ ID NO: 1442051 - RNA, 17 nt, Human
ucuccaggggcugcuuc

SEQ ID NO: 1442052 - RNA, 19 nt, Human
ucuccaagcagcuuagagu

SEQ ID NO: 1442053 - RNA, 13 nt, Human
ucuccaagcagcu

SEQ ID NO: 1442054 - RNA, 21 nt, Human
ucuccaacaucacagcccagc

SEQ ID NO: 1442055 - RNA, 19 nt, Human
ucuccaacaucacagccca

SEQ ID NO: 1442056 - RNA, 17 nt, Human
ucuccaacaucacagcc

SEQ ID NO: 1442057 - RNA, 24 nt, Human
ucucauuggaaauuuagcauugua

SEQ ID NO: 1442058 - RNA, 23 nt, Human
ucuccaaacugaagcagccucuc

SEQ ID NO: 1442059 - RNA, 20 nt, Human
ucuccaacaucacagcccag

SEQ ID NO: 1442060 - RNA, 20 nt, Human
ucucauuggacccuuccaug

SEQ ID NO: 1442061 - RNA, 22 nt, Human
ucuccaaacugaagcagccucu

SEQ ID NO: 1442062 - RNA, 14 nt, Human
ucuccaaaccacuu

SEQ ID NO: 1442063 - RNA, 22 nt, Human
ucuccaaaauaaaacuuuuuaa

SEQ ID NO: 1442064 - RNA, 17 nt, Human
ucuccaaaauaaaacuu

SEQ ID NO: 1442065 - RNA, 19 nt, Human
ucuccaaaauaaaacuuuu

SEQ ID NO: 1442066 - RNA, 19 nt, Human
ucucauuggacccuuccau

SEQ ID NO: 1442067 - RNA, 23 nt, Human
ucucauuggaaauuuagcauugu

SEQ ID NO: 1442068 - RNA, 21 nt, Human
ucucauuggaaauuuagcauu

SEQ ID NO: 1442069 - RNA, 20 nt, Human
ucucauuggaaauuuagcau

SEQ ID NO: 1442070 - RNA, 19 nt, Human
ucucauuggaaauuuagca

SEQ ID NO: 1442071 - RNA, 17 nt, Human
ucucauuggaaauuuag

SEQ ID NO: 1442072 - RNA, 14 nt, Human
ucucauuggaaauu

SEQ ID NO: 1442073 - RNA, 15 nt, Human
ucucauugcuuacaa

SEQ ID NO: 1442074 - RNA, 20 nt, Human
ucucauuaaaagaauaucug

SEQ ID NO: 1442075 - RNA, 16 nt, Human
ucucauuaaaagaaua

SEQ ID NO: 1442076 - RNA, 15 nt, Human
ucucauuaaaagaau

SEQ ID NO: 1442077 - RNA, 17 nt, Human
ucucagggccaggccuc

SEQ ID NO: 1442078 - RNA, 14 nt, Human
ucucagggccaggc

SEQ ID NO: 1442079 - RNA, 17 nt, Human
ucucaggcugccugagu

SEQ ID NO: 1442080 - RNA, 16 nt, Human
ucucaggcugccugag

SEQ ID NO: 1442081 - RNA, 15 nt, Human
ucucaggcugccuga

SEQ ID NO: 1442082 - RNA, 14 nt, Human
ucucaggcugccug

SEQ ID NO: 1442083 - RNA, 13 nt, Human
ucucaggcugccu

SEQ ID NO: 1442084 - RNA, 21 nt, Human
ucucagcuccagguggcucug

SEQ ID NO: 1442085 - RNA, 16 nt, Human
ucucagcuccaggugg

SEQ ID NO: 1442086 - RNA, 15 nt, Human
ucucagcuaagcuca

SEQ ID NO: 1442087 - RNA, 18 nt, Human
ucucagcucacugcaacc

SEQ ID NO: 1442088 - RNA, 15 nt, Human
ucucagcucacugca

SEQ ID NO: 1442089 - RNA, 16 nt, Human
ucucagcucacugcaa

SEQ ID NO: 1442090 - RNA, 12 nt, Human
ucucuugccuca

SEQ ID NO: 1442091 - RNA, 15 nt, Human
ucucuugaguuuguc

SEQ ID NO: 1442092 - RNA, 14 nt, Human
ucucuugaguuugu

SEQ ID NO: 1442093 - RNA, 23 nt, Human
ucucuugggaacugaacucacuu

SEQ ID NO: 1442094 - RNA, 16 nt, Human
ucucuugggaacugaa

SEQ ID NO: 1442095 - RNA, 13 nt, Human
ucucuugccucaa

SEQ ID NO: 1442096 - RNA, 21 nt, Human
ucucuugccucaaccucccaa

SEQ ID NO: 1442097 - RNA, 18 nt, Human
ucucuuuaaaaggaaaga

SEQ ID NO: 1442098 - RNA, 19 nt, Human
ucucuuuaaaaggaaagaa

SEQ ID NO: 1442099 - RNA, 21 nt, Human
ucucuuuaaaaggaaagaaaa

SEQ ID NO: 1442100 - RNA, 15 nt, Human
agaaaaacaggcacu

SEQ ID NO: 1442101 - RNA, 14 nt, Human
agaaacuuccaaau

SEQ ID NO: 1442102 - RNA, 21 nt, Human
agaaacgucuucuaaacuucc

SEQ ID NO: 1442103 - RNA, 18 nt, Human
agaaacgucuucuaaacu

SEQ ID NO: 1442104 - RNA, 16 nt, Human
agaaacgucuucuaaa

SEQ ID NO: 1442105 - RNA, 15 nt, Human
agaaacgucuucuaa

SEQ ID NO: 1442106 - RNA, 18 nt, Human
agaaaccuuuuuaaaaau

SEQ ID NO: 1442107 - RNA, 19 nt, Human
agaaacaguugguaacuuu

SEQ ID NO: 1442108 - RNA, 18 nt, Human
agaaacaguugguaacuu

SEQ ID NO: 1442109 - RNA, 17 nt, Human
agaaacaguugguaacu

SEQ ID NO: 1442110 - RNA, 13 nt, Human
agaaacacucaag

SEQ ID NO: 1442111 - RNA, 23 nt, Human
agaaacacguaucccaccugaca

SEQ ID NO: 1442112 - RNA, 14 nt, Human
agaaaaagaagcaa

SEQ ID NO: 1442113 - RNA, 17 nt, Human
agaaaaaggaugcacag

SEQ ID NO: 1442114 - RNA, 21 nt, Human
agaaaacuuguauuaugugug

SEQ ID NO: 1442115 - RNA, 18 nt, Human
agaaaaaggaugcacaga

SEQ ID NO: 1442116 - RNA, 15 nt, Human
ucucuccagcugacu

SEQ ID NO: 1442117 - RNA, 19 nt, Human
ucucuccacuuucagcugu

SEQ ID NO: 1442118 - RNA, 18 nt, Human
ucucuccacuuucagcug

SEQ ID NO: 1442119 - RNA, 14 nt, Human
ucucuccuguaccu

SEQ ID NO: 1442120 - RNA, 16 nt, Human
ucucuccuguaccucu

SEQ ID NO: 1442121 - RNA, 17 nt, Human
ucucuccuguaccucuu

SEQ ID NO: 1442122 - RNA, 19 nt, Human
ucucuggaauuugaaacac

SEQ ID NO: 1442123 - RNA, 15 nt, Human
ucucuggaauuugaa

SEQ ID NO: 1442124 - RNA, 17 nt, Human
ucucuccacuuucagcu

SEQ ID NO: 1442125 - RNA, 16 nt, Human
ucucuccacuuucagc

SEQ ID NO: 1442126 - RNA, 16 nt, Human
ucucucauugucugug

SEQ ID NO: 1442127 - RNA, 22 nt, Human
ucucucaugaaccucaagcugc

SEQ ID NO: 1442128 - RNA, 17 nt, Human
ucucucaugaaccucaa

SEQ ID NO: 1442129 - RNA, 15 nt, Human
ucucucaugaaccuc

SEQ ID NO: 1442130 - RNA, 12 nt, Human
ucucucaugaac

SEQ ID NO: 1442131 - RNA, 16 nt, Human
ucucucagggccaggc

SEQ ID NO: 1442132 - RNA, 23 nt, Human
ucucucacucccucccuuucuau

SEQ ID NO: 1442133 - RNA, 13 nt, Human
ucucucaggugaa

SEQ ID NO: 1442134 - RNA, 12 nt, Human
ucucucagguga

SEQ ID NO: 1442135 - RNA, 15 nt, Human
ucucucauacccucc

SEQ ID NO: 1442136 - RNA, 18 nt, Human
acuuucucaguuuucaua

SEQ ID NO: 1442137 - RNA, 22 nt, Human
ucucucaacaccaugauuccuu

SEQ ID NO: 1442138 - RNA, 18 nt, Human
acuuugaccucugcagca

SEQ ID NO: 1442139 - RNA, 15 nt, Human
acuuugaccucugca

SEQ ID NO: 1442140 - RNA, 16 nt, Human
acuuugaccucugcag

SEQ ID NO: 1442141 - RNA, 21 nt, Human
ucucucacuuguuuuauuuaa

SEQ ID NO: 1442142 - RNA, 17 nt, Human
ucucucacuuguuuuau

SEQ ID NO: 1442143 - RNA, 19 nt, Human
ucugaauuuuuaaacaagu

SEQ ID NO: 1442144 - RNA, 17 nt, Human
ucugaauuuuuaaacaa

SEQ ID NO: 1442145 - RNA, 16 nt, Human
ucugaauuuuuaaaca

SEQ ID NO: 1442146 - RNA, 15 nt, Human
ucugaauuuuuaaac

SEQ ID NO: 1442147 - RNA, 17 nt, Human
ucugaagcccucccagg

SEQ ID NO: 1442148 - RNA, 16 nt, Human
ucugaagcccucccag

SEQ ID NO: 1442149 - RNA, 17 nt, Human
agaaaucauuuugcaau

SEQ ID NO: 1442150 - RNA, 12 nt, Human
ucugaagaagau

SEQ ID NO: 1442151 - RNA, 18 nt, Human
agaaaugaaaaaauauau

SEQ ID NO: 1442152 - RNA, 23 nt, Human
agaaaugaaaaaauauauaucaa

SEQ ID NO: 1442153 - RNA, 18 nt, Human
agaaaggaagcauuguaa

SEQ ID NO: 1442154 - RNA, 17 nt, Human
agaaaggaagcauugua

SEQ ID NO: 1442155 - RNA, 15 nt, Human
agaaaggaagcauug

SEQ ID NO: 1442156 - RNA, 18 nt, Human
agaaaggaaaaacaaacu

SEQ ID NO: 1442157 - RNA, 13 nt, Human
agaaagcugccug

SEQ ID NO: 1442158 - RNA, 23 nt, Human
agaaagcugacuuggcuggugug

SEQ ID NO: 1442159 - RNA, 22 nt, Human
agaaagcugacuuggcuggugu

SEQ ID NO: 1442160 - RNA, 21 nt, Human
agaaagcugacuuggcuggug

SEQ ID NO: 1442161 - RNA, 20 nt, Human
agaaagcugacuuggcuggu

SEQ ID NO: 1442162 - RNA, 17 nt, Human
agaaagcugacuuggcu

SEQ ID NO: 1442163 - RNA, 16 nt, Human
agaaagcugacuuggc

SEQ ID NO: 1442164 - RNA, 15 nt, Human
agaaagcugacuugg

SEQ ID NO: 1442165 - RNA, 13 nt, Human
agaaagcugacuu

SEQ ID NO: 1442166 - RNA, 11 nt, Human
agaaagcucaa

SEQ ID NO: 1442167 - RNA, 15 nt, Human
agaaagccuucuuuu

SEQ ID NO: 1442168 - RNA, 13 nt, Human
agaaagccuucuu

SEQ ID NO: 1442169 - RNA, 19 nt, Human
agaaacuuccaaauccccu

SEQ ID NO: 1442170 - RNA, 21 nt, Human
agaaagccugggugacauuug

SEQ ID NO: 1442171 - RNA, 20 nt, Human
agaaagccugggugacauuu

SEQ ID NO: 1442172 - RNA, 19 nt, Human
agaaagccugggugacauu

SEQ ID NO: 1442173 - RNA, 19 nt, Human
agaaacuuuuuuauuuaaa

SEQ ID NO: 1442174 - RNA, 15 nt, Human
agaaacuuuuuuauu

SEQ ID NO: 1442175 - RNA, 15 nt, Human
agaaacuuucuuucu

SEQ ID NO: 1442176 - RNA, 14 nt, Human
agaaaucauagcug

SEQ ID NO: 1442177 - RNA, 12 nt, Human
agaaaucuaaaa

SEQ ID NO: 1442178 - RNA, 22 nt, Human
agaaaucauuuugcaaucccuu

SEQ ID NO: 1442179 - RNA, 15 nt, Human
agaaaucuaaaaaac

SEQ ID NO: 1442180 - RNA, 17 nt, Human
agaaaugaaaaaauaua

SEQ ID NO: 1442181 - RNA, 14 nt, Human
ucugcagccucaga

SEQ ID NO: 1442182 - RNA, 13 nt, Human
ucugcagccucag

SEQ ID NO: 1442183 - RNA, 11 nt, Human
ucugcagccuc

SEQ ID NO: 1442184 - RNA, 15 nt, Human
ucugcaggucccuaa

SEQ ID NO: 1442185 - RNA, 16 nt, Human
ucugcaggucccuaau

SEQ ID NO: 1442186 - RNA, 17 nt, Human
ucugcaggucccuaaua

SEQ ID NO: 1442187 - RNA, 18 nt, Human
ucugcaggucccuaauaa

SEQ ID NO: 1442188 - RNA, 13 nt, Human
agaaauuaugugc

SEQ ID NO: 1442189 - RNA, 21 nt, Human
agaaauuaugugccagauuua

SEQ ID NO: 1442190 - RNA, 22 nt, Human
agaaauuaugugccagauuuau

SEQ ID NO: 1442191 - RNA, 16 nt, Human
agaaauuuauaaacuu

SEQ ID NO: 1442192 - RNA, 17 nt, Human
agaaauuuauaaacuuu

SEQ ID NO: 1442193 - RNA, 17 nt, Human
ucugaguuccugcaugc

SEQ ID NO: 1442194 - RNA, 23 nt, Human
ucugaguguuuuaugagaaagcc

SEQ ID NO: 1442195 - RNA, 20 nt, Human
ucugagagaggccauucuuu

SEQ ID NO: 1442196 - RNA, 14 nt, Human
ucugagagaggcca

SEQ ID NO: 1442197 - RNA, 14 nt, Human
ucugaccuuaaaug

SEQ ID NO: 1442198 - RNA, 19 nt, Human
ucugauuaaaaugcuuccu

SEQ ID NO: 1442199 - RNA, 16 nt, Human
ucugaugcagcuuaua

SEQ ID NO: 1442200 - RNA, 17 nt, Human
ucugaugcagcuuauac

SEQ ID NO: 1442201 - RNA, 13 nt, Human
ucugaugcagcuu

SEQ ID NO: 1442202 - RNA, 20 nt, Human
ucugaguuuuguguuuguug

SEQ ID NO: 1442203 - RNA, 14 nt, Human
ucugaguuuugugu

SEQ ID NO: 1442204 - RNA, 15 nt, Human
ucugauaaugaaaau

SEQ ID NO: 1442205 - RNA, 19 nt, Human
ucugauaagagaaucaaca

SEQ ID NO: 1442206 - RNA, 13 nt, Human
ucugauacagaaa

SEQ ID NO: 1442207 - RNA, 13 nt, Human
ucuuucuuccaaa

SEQ ID NO: 1442208 - RNA, 19 nt, Human
ucuuucuggcuaugcauuu

SEQ ID NO: 1442209 - RNA, 15 nt, Human
ucuuucuuagaaauu

SEQ ID NO: 1442210 - RNA, 16 nt, Human
ucuuucuuagaaauuu

SEQ ID NO: 1442211 - RNA, 18 nt, Human
ucuuucuggcuaugcauu

SEQ ID NO: 1442212 - RNA, 16 nt, Human
ucuuuauacagcugua

SEQ ID NO: 1442213 - RNA, 15 nt, Human
ucuuuauacagcugu

SEQ ID NO: 1442214 - RNA, 14 nt, Human
ucuuuauacagcug

SEQ ID NO: 1442215 - RNA, 19 nt, Human
ucuuuauaagaaagccuga

SEQ ID NO: 1442216 - RNA, 17 nt, Human
ucuuuauaagaaagccu

SEQ ID NO: 1442217 - RNA, 16 nt, Human
ucuuuauaagaaagcc

SEQ ID NO: 1442218 - RNA, 15 nt, Human
ucuuuauaagaaagc

SEQ ID NO: 1442219 - RNA, 14 nt, Human
ucuuuauaagaaag

SEQ ID NO: 1442220 - RNA, 21 nt, Human
agacuccuucaacaauucuaa

SEQ ID NO: 1442221 - RNA, 17 nt, Human
agacuccuucaacaauu

SEQ ID NO: 1442222 - RNA, 19 nt, Human
ucuuucuuagaaauuuauu

SEQ ID NO: 1442223 - RNA, 22 nt, Human
ucuugauaccccccucugucuu

SEQ ID NO: 1442224 - RNA, 21 nt, Human
ucuugauaccccccucugucu

SEQ ID NO: 1442225 - RNA, 20 nt, Human
ucuugauaccccccucuguc

SEQ ID NO: 1442226 - RNA, 17 nt, Human
ucuugauaccccccucu

SEQ ID NO: 1442227 - RNA, 17 nt, Human
ucuugaucaguuaagaa

SEQ ID NO: 1442228 - RNA, 16 nt, Human
ucuugaucaguuaaga

SEQ ID NO: 1442229 - RNA, 19 nt, Human
ucuugguugaaaauaaaaa

SEQ ID NO: 1442230 - RNA, 15 nt, Human
ucuugguugaggaaa

SEQ ID NO: 1442231 - RNA, 13 nt, Human
ucuugguugagga

SEQ ID NO: 1442232 - RNA, 23 nt, Human
ucuugguugaaaauaaaaagauc

SEQ ID NO: 1442233 - RNA, 14 nt, Human
ucuugguuuguaaa

SEQ ID NO: 1442234 - RNA, 20 nt, Human
ucuugguuuucccuuugccu

SEQ ID NO: 1442235 - RNA, 16 nt, Human
ucuugguuuguaaauu

SEQ ID NO: 1442236 - RNA, 14 nt, Human
ucuuuaauuuuaca

SEQ ID NO: 1442237 - RNA, 13 nt, Human
ucuuuauaagaaa

SEQ ID NO: 1442238 - RNA, 12 nt, Human
ucuuuauaagaa

SEQ ID NO: 1442239 - RNA, 19 nt, Human
ucuuguaauccgaaucucu

SEQ ID NO: 1442240 - RNA, 13 nt, Human
ucuuuaauucugu

SEQ ID NO: 1442241 - RNA, 21 nt, Human
agagacaaacaccucccagga

SEQ ID NO: 1442242 - RNA, 19 nt, Human
agagacaaacaccucccag

SEQ ID NO: 1442243 - RNA, 23 nt, Human
agagaauuucuaccauuucagag

SEQ ID NO: 1442244 - RNA, 22 nt, Human
agagaauuucuaccauuucaga

SEQ ID NO: 1442245 - RNA, 14 nt, Human
agagaaaaaagcca

SEQ ID NO: 1442246 - RNA, 20 nt, Human
agagacaaacaccucccagg

SEQ ID NO: 1442247 - RNA, 22 nt, Human
agacuugguugguaggguggga

SEQ ID NO: 1442248 - RNA, 21 nt, Human
agacuugguugguaggguggg

SEQ ID NO: 1442249 - RNA, 19 nt, Human
agacuucucuuugccucaa

SEQ ID NO: 1442250 - RNA, 20 nt, Human
agacuucucuuugccucaaa

SEQ ID NO: 1442251 - RNA, 18 nt, Human
agacuucucuuugccuca

SEQ ID NO: 1442252 - RNA, 17 nt, Human
agacuucucuuugccuc

SEQ ID NO: 1442253 - RNA, 16 nt, Human
agacuucucuuugccu

SEQ ID NO: 1442254 - RNA, 17 nt, Human
agacuuuaacauaagcu

SEQ ID NO: 1442255 - RNA, 21 nt, Human
agacuuuaacauaagcuauuu

SEQ ID NO: 1442256 - RNA, 12 nt, Human
agacuuuaacau

SEQ ID NO: 1442257 - RNA, 21 nt, Human
agacuuguuggcguaggcuac

SEQ ID NO: 1442258 - RNA, 16 nt, Human
agacuuguuggcguag

SEQ ID NO: 1442259 - RNA, 11 nt, Human
agacuuguugg

SEQ ID NO: 1442260 - RNA, 15 nt, Human
agacuuuccauuaca

SEQ ID NO: 1442261 - RNA, 17 nt, Human
agacuuuauguaguuuu

SEQ ID NO: 1442262 - RNA, 22 nt, Human
agacuuuccauuacaaguauuu

SEQ ID NO: 1442263 - RNA, 16 nt, Human
agacuuuauguaguuu

SEQ ID NO: 1442264 - RNA, 16 nt, Human
agacuuagggcaccag

SEQ ID NO: 1442265 - RNA, 18 nt, Human
agacuuacucuaagaucu

SEQ ID NO: 1442266 - RNA, 16 nt, Human
agacuuacucuaagau

SEQ ID NO: 1442267 - RNA, 15 nt, Human
agacuuacucuaaga

SEQ ID NO: 1442268 - RNA, 14 nt, Human
agacuuacucuaag

SEQ ID NO: 1442269 - RNA, 23 nt, Human
agacuuacagggauaaggccugu

SEQ ID NO: 1442270 - RNA, 18 nt, Human
agacuuaagcccagugca

SEQ ID NO: 1442271 - RNA, 23 nt, Human
agacuguuuuucagggagguggc

SEQ ID NO: 1442272 - RNA, 14 nt, Human
agacuucccagcua

SEQ ID NO: 1442273 - RNA, 19 nt, Human
agacuucccacggcuccuc

SEQ ID NO: 1442274 - RNA, 17 nt, Human
agacuuagggcaccagg

SEQ ID NO: 1442275 - RNA, 18 nt, Human
agacuggguaggaaagag

SEQ ID NO: 1442276 - RNA, 22 nt, Human
agacuggguaggaaagaggaag

SEQ ID NO: 1442277 - RNA, 23 nt, Human
agacucaaauguucuaaguuucu

SEQ ID NO: 1442278 - RNA, 20 nt, Human
agacucaaauguucuaaguu

SEQ ID NO: 1442279 - RNA, 17 nt, Human
agacucaaauguucuaa

SEQ ID NO: 1442280 - RNA, 16 nt, Human
agacucaaauguucua

SEQ ID NO: 1442281 - RNA, 15 nt, Human
agacucaaauguucu

SEQ ID NO: 1442282 - RNA, 21 nt, Human
agacuauuuuuagauuuucuu

SEQ ID NO: 1442283 - RNA, 14 nt, Human
agacuauuuuuaga

SEQ ID NO: 1442284 - RNA, 15 nt, Human
agaccugaauucuuu

SEQ ID NO: 1442285 - RNA, 22 nt, Human
ucuugaguuugucgcucaugug

SEQ ID NO: 1442286 - RNA, 21 nt, Human
ucuugaguuugucgcucaugu

SEQ ID NO: 1442287 - RNA, 20 nt, Human
ucuugagccuugaacuuuga

SEQ ID NO: 1442288 - RNA, 18 nt, Human
ucuugagccuugaacuuu

SEQ ID NO: 1442289 - RNA, 19 nt, Human
ucuugagccuugaacuuug

SEQ ID NO: 1442290 - RNA, 17 nt, Human
ucuugagccuugaacuu

SEQ ID NO: 1442291 - RNA, 13 nt, Human
agaccugaagaau

SEQ ID NO: 1442292 - RNA, 18 nt, Human
agaccucugugcacuuau

SEQ ID NO: 1442293 - RNA, 19 nt, Human
agaccucuacugccuugga

SEQ ID NO: 1442294 - RNA, 20 nt, Human
agaccucagugccuuccugu

SEQ ID NO: 1442295 - RNA, 18 nt, Human
agaccucagugccuuccu

SEQ ID NO: 1442296 - RNA, 15 nt, Human
agaccucagaaguaa

SEQ ID NO: 1442297 - RNA, 14 nt, Human
agaccucagaagua

SEQ ID NO: 1442298 - RNA, 22 nt, Human
agaccuacuguucuaaagcucu

SEQ ID NO: 1442299 - RNA, 21 nt, Human
agaccuacuguucuaaagcuc

SEQ ID NO: 1442300 - RNA, 20 nt, Human
agaccuacuguucuaaagcu

SEQ ID NO: 1442301 - RNA, 17 nt, Human
agacccuaaacauccau

SEQ ID NO: 1442302 - RNA, 13 nt, Human
agaccaaaauaaa

SEQ ID NO: 1442303 - RNA, 20 nt, Human
agacauuuuaaaaaaugguc

SEQ ID NO: 1442304 - RNA, 23 nt, Human
agaccggccugccaggaggaccc

SEQ ID NO: 1442305 - RNA, 20 nt, Human
agaccggccugccaggagga

SEQ ID NO: 1442306 - RNA, 19 nt, Human
agaccggccugccaggagg

SEQ ID NO: 1442307 - RNA, 18 nt, Human
agaccggccugccaggag

SEQ ID NO: 1442308 - RNA, 17 nt, Human
agaccggccugccagga

SEQ ID NO: 1442309 - RNA, 15 nt, Human
agaccggccugccag

SEQ ID NO: 1442310 - RNA, 19 nt, Human
agacccuuuuggguuucug

SEQ ID NO: 1442311 - RNA, 17 nt, Human
agacccuuuuggguuuc

SEQ ID NO: 1442312 - RNA, 15 nt, Human
agaccgaucggcggc

SEQ ID NO: 1442313 - RNA, 20 nt, Human
ucuucugggagggcagcagg

SEQ ID NO: 1442314 - RNA, 17 nt, Human
ucuucugggagggcagc

SEQ ID NO: 1442315 - RNA, 18 nt, Human
ucuucuggacugguuuuc

SEQ ID NO: 1442316 - RNA, 20 nt, Human
ucuuauucccuuccugccag

SEQ ID NO: 1442317 - RNA, 16 nt, Human
ucuuauucauuuucuc

SEQ ID NO: 1442318 - RNA, 15 nt, Human
ucuuauucauuuucu

SEQ ID NO: 1442319 - RNA, 17 nt, Human
ucuucugaauaaagcaa

SEQ ID NO: 1442320 - RNA, 16 nt, Human
ucuucugagcacuguu

SEQ ID NO: 1442321 - RNA, 21 nt, Human
ucuucugagcuauuucaucua

SEQ ID NO: 1442322 - RNA, 19 nt, Human
ucuucugagcuauuucauc

SEQ ID NO: 1442323 - RNA, 15 nt, Human
ucuucugagcacugu

SEQ ID NO: 1442324 - RNA, 18 nt, Human
ucuucugaauaaagcaau

SEQ ID NO: 1442325 - RNA, 19 nt, Human
agacauacuugaagggcca

SEQ ID NO: 1442326 - RNA, 17 nt, Human
agacauacuugaagggc

SEQ ID NO: 1442327 - RNA, 16 nt, Human
agacauacuugaaggg

SEQ ID NO: 1442328 - RNA, 14 nt, Human
agacauacuugaag

SEQ ID NO: 1442329 - RNA, 13 nt, Human
agacauacuugaa

SEQ ID NO: 1442330 - RNA, 17 nt, Human
ucuucuugaaauuuuaa

SEQ ID NO: 1442331 - RNA, 13 nt, Human
ucuucuugaaauu

SEQ ID NO: 1442332 - RNA, 22 nt, Human
ucuucuucucguccucguuugu

SEQ ID NO: 1442333 - RNA, 14 nt, Human
ucuucuuccaggua

SEQ ID NO: 1442334 - RNA, 15 nt, Human
ucuucuucaccauuu

SEQ ID NO: 1442335 - RNA, 14 nt, Human
ucuucuucaccauu

SEQ ID NO: 1442336 - RNA, 13 nt, Human
ucuucuucaccau

SEQ ID NO: 1442337 - RNA, 12 nt, Human
ucuucuuaugca

SEQ ID NO: 1442338 - RNA, 23 nt, Human
agacaugccacaaggacuuccug

SEQ ID NO: 1442339 - RNA, 15 nt, Human
agacaugcagagauu

SEQ ID NO: 1442340 - RNA, 14 nt, Human
agacaugcagagau

SEQ ID NO: 1442341 - RNA, 22 nt, Human
agacaugauuuccuugaaugug

SEQ ID NO: 1442342 - RNA, 15 nt, Human
agacaugauuuccuu

SEQ ID NO: 1442343 - RNA, 13 nt, Human
agacaugaagcca

SEQ ID NO: 1442344 - RNA, 23 nt, Human
agacauacuugaagggccagagc

SEQ ID NO: 1442345 - RNA, 21 nt, Human
agacauacuugaagggccaga

SEQ ID NO: 1442346 - RNA, 20 nt, Human
agacauacuugaagggccag

SEQ ID NO: 1442347 - RNA, 21 nt, Human
agacauggagguucuaaggcc

SEQ ID NO: 1442348 - RNA, 20 nt, Human
agacauggagguucuaaggc

SEQ ID NO: 1442349 - RNA, 19 nt, Human
agacauggagguucuaagg

SEQ ID NO: 1442350 - RNA, 17 nt, Human
agacauggagguucuaa

SEQ ID NO: 1442351 - RNA, 16 nt, Human
agacauggagguucua

SEQ ID NO: 1442352 - RNA, 15 nt, Human
agacauggagguucu

SEQ ID NO: 1442353 - RNA, 19 nt, Human
agacauuuuaaaaaauggu

SEQ ID NO: 1442354 - RNA, 22 nt, Human
agacauuuuaaaaaauggucac

SEQ ID NO: 1442355 - RNA, 15 nt, Human
agacaguucaagaaa

SEQ ID NO: 1442356 - RNA, 14 nt, Human
agacaguucaagaa

SEQ ID NO: 1442357 - RNA, 15 nt, Human
ucuuaaugaaguuug

SEQ ID NO: 1442358 - RNA, 16 nt, Human
ucuuaaugaaguuuga

SEQ ID NO: 1442359 - RNA, 17 nt, Human
ucuuaaugaaguuugaa

SEQ ID NO: 1442360 - RNA, 18 nt, Human
ucuuaaugaaguuugaau

SEQ ID NO: 1442361 - RNA, 19 nt, Human
ucuuaaugaaguuugaaug

SEQ ID NO: 1442362 - RNA, 20 nt, Human
ucuuaaugaaguuugaaugu

SEQ ID NO: 1442363 - RNA, 19 nt, Human
ucuuacaauaauucuauga

SEQ ID NO: 1442364 - RNA, 19 nt, Human
ucuuaauugccaccucuaa

SEQ ID NO: 1442365 - RNA, 11 nt, Human
ucuuaauugcc

SEQ ID NO: 1442366 - RNA, 21 nt, Human
ucuuaaugaaguuugaauguu

SEQ ID NO: 1442367 - RNA, 22 nt, Human
ucuuaaugaaguuugaauguua

SEQ ID NO: 1442368 - RNA, 23 nt, Human
ucuuaaugaaguuugaauguuaa

SEQ ID NO: 1442369 - RNA, 19 nt, Human
agacagugauauuggaacu

SEQ ID NO: 1442370 - RNA, 13 nt, Human
agacagugauauu

SEQ ID NO: 1442371 - RNA, 23 nt, Human
ucuuagaugcaguucugaagaag

SEQ ID NO: 1442372 - RNA, 23 nt, Human
ucuuaccuguaugucuccaguau

SEQ ID NO: 1442373 - RNA, 21 nt, Human
ucuuaccuguaugucuccagu

SEQ ID NO: 1442374 - RNA, 22 nt, Human
ucuuaccagaugcuuuccuguu

SEQ ID NO: 1442375 - RNA, 13 nt, Human
ucuuacagcaggc

SEQ ID NO: 1442376 - RNA, 15 nt, Human
ucuuacuauuucaca

SEQ ID NO: 1442377 - RNA, 22 nt, Human
ucuuacugcuuaauucaaauaa

SEQ ID NO: 1442378 - RNA, 15 nt, Human
ucuuacuuggaacug

SEQ ID NO: 1442379 - RNA, 20 nt, Human
ucuuacuuauuaucuucagg

SEQ ID NO: 1442380 - RNA, 12 nt, Human
ucuuacugcuug

SEQ ID NO: 1442381 - RNA, 19 nt, Human
ucuuacugucuuuuuucua

SEQ ID NO: 1442382 - RNA, 23 nt, Human
ucuguuucaaggcacucuagauu

SEQ ID NO: 1442383 - RNA, 12 nt, Human
ucuguuucaagg

SEQ ID NO: 1442384 - RNA, 19 nt, Human
agaauucucuaguuugauu

SEQ ID NO: 1442385 - RNA, 17 nt, Human
agacacacugaagaagc

SEQ ID NO: 1442386 - RNA, 14 nt, Human
agacacaccugagg

SEQ ID NO: 1442387 - RNA, 13 nt, Human
agacacaccugag

SEQ ID NO: 1442388 - RNA, 16 nt, Human
agacacacugaagaag

SEQ ID NO: 1442389 - RNA, 22 nt, Human
agacaccuuggacauccuccuc

SEQ ID NO: 1442390 - RNA, 20 nt, Human
agacacauuuuuuaggaaau

SEQ ID NO: 1442391 - RNA, 17 nt, Human
agacacauuuuuuagga

SEQ ID NO: 1442392 - RNA, 13 nt, Human
agacacaggcccu

SEQ ID NO: 1442393 - RNA, 13 nt, Human
agacacacuuguc

SEQ ID NO: 1442394 - RNA, 17 nt, Human
agacagaagaaacaagg

SEQ ID NO: 1442395 - RNA, 16 nt, Human
agacagaagaaacaag

SEQ ID NO: 1442396 - RNA, 15 nt, Human
agacagaagaaacaa

SEQ ID NO: 1442397 - RNA, 14 nt, Human
agacagaagaaaca

SEQ ID NO: 1442398 - RNA, 12 nt, Human
agacagaagaaa

SEQ ID NO: 1442399 - RNA, 17 nt, Human
agacagaaccccuacau

SEQ ID NO: 1442400 - RNA, 13 nt, Human
agacacgcacggc

SEQ ID NO: 1442401 - RNA, 15 nt, Human
agacacgcacggcag

SEQ ID NO: 1442402 - RNA, 20 nt, Human
agacacgcacggcagccaca

SEQ ID NO: 1442403 - RNA, 21 nt, Human
agacacgcacggcagccacag

SEQ ID NO: 1442404 - RNA, 13 nt, Human
agacacuuuggaa

SEQ ID NO: 1442405 - RNA, 12 nt, Human
agacaccaaagu

SEQ ID NO: 1442406 - RNA, 22 nt, Human
agacacgcacggcagccacagc

SEQ ID NO: 1442407 - RNA, 19 nt, Human
agacagaaccacagggcua

SEQ ID NO: 1442408 - RNA, 15 nt, Human
agacagaaccacagg

SEQ ID NO: 1442409 - RNA, 18 nt, Human
agacagaacaccuaugca

SEQ ID NO: 1442410 - RNA, 14 nt, Human
agacagaacaccua

SEQ ID NO: 1442411 - RNA, 12 nt, Human
agacagaacacc

SEQ ID NO: 1442412 - RNA, 12 nt, Human
agacagaaaaaa

SEQ ID NO: 1442413 - RNA, 18 nt, Human
agaacccagcccaccccc

SEQ ID NO: 1442414 - RNA, 19 nt, Human
agaaccccuacaugaaaca

SEQ ID NO: 1442415 - RNA, 17 nt, Human
agaaccccuacaugaaa

SEQ ID NO: 1442416 - RNA, 17 nt, Human
agaacccagcccacccc

SEQ ID NO: 1442417 - RNA, 22 nt, Human
agaaauucaauuuggauuuaaa

SEQ ID NO: 1442418 - RNA, 19 nt, Human
agaaauucaauuuggauuu

SEQ ID NO: 1442419 - RNA, 13 nt, Human
agaaauuuauuuc

SEQ ID NO: 1442420 - RNA, 15 nt, Human
agaaauuuauuuccu

SEQ ID NO: 1442421 - RNA, 23 nt, Human
agaaauuuauuuccuaguucugu

SEQ ID NO: 1442422 - RNA, 19 nt, Human
agaacccagcccacccccg

SEQ ID NO: 1442423 - RNA, 14 nt, Human
agaaauuucacaua

SEQ ID NO: 1442424 - RNA, 21 nt, Human
agaauguuaagacuugacagu

SEQ ID NO: 1442425 - RNA, 19 nt, Human
agaauguuaagacuugaca

SEQ ID NO: 1442426 - RNA, 14 nt, Human
agaauguuaagacu

SEQ ID NO: 1442427 - RNA, 23 nt, Human
agaaugucauuuugguacuuugg

SEQ ID NO: 1442428 - RNA, 20 nt, Human
agaaugucauuuugguacuu

SEQ ID NO: 1442429 - RNA, 16 nt, Human
agaaugucauuuuggu

SEQ ID NO: 1442430 - RNA, 20 nt, Human
agaauuacuguaacugauua

SEQ ID NO: 1442431 - RNA, 13 nt, Human
agaauuacuguaa

SEQ ID NO: 1442432 - RNA, 17 nt, Human
ucuggggugggcaguuu

SEQ ID NO: 1442433 - RNA, 21 nt, Human
ucugggguauggcguaaguac

SEQ ID NO: 1442434 - RNA, 20 nt, Human
ucugggggguggccaggccg

SEQ ID NO: 1442435 - RNA, 19 nt, Human
ucugggggguggccaggcc

SEQ ID NO: 1442436 - RNA, 18 nt, Human
ucugggggguggccaggc

SEQ ID NO: 1442437 - RNA, 17 nt, Human
ucugggggguggccagg

SEQ ID NO: 1442438 - RNA, 13 nt, Human
ucugggggguggc

SEQ ID NO: 1442439 - RNA, 15 nt, Human
ucugggggcugcagu

SEQ ID NO: 1442440 - RNA, 19 nt, Human
ucugggggcugaggagcag

SEQ ID NO: 1442441 - RNA, 15 nt, Human
ucugggggcugagga

SEQ ID NO: 1442442 - RNA, 19 nt, Human
ucugggggcacaagacuga

SEQ ID NO: 1442443 - RNA, 18 nt, Human
ucugggggcacaagacug

SEQ ID NO: 1442444 - RNA, 18 nt, Human
ucugggcuuccuggagca

SEQ ID NO: 1442445 - RNA, 19 nt, Human
ucugggcuuccuggagcag

SEQ ID NO: 1442446 - RNA, 17 nt, Human
ucugggcuuccuggagc

SEQ ID NO: 1442447 - RNA, 16 nt, Human
ucugggcuuccuggag

SEQ ID NO: 1442448 - RNA, 21 nt, Human
ucugguagaagggaaagccca

SEQ ID NO: 1442449 - RNA, 18 nt, Human
ucugguagaagggaaagc

SEQ ID NO: 1442450 - RNA, 22 nt, Human
ucugguaauauugacuuguaua

SEQ ID NO: 1442451 - RNA, 21 nt, Human
ucugguaauauugacuuguau

SEQ ID NO: 1442452 - RNA, 15 nt, Human
ucuggguugccuuua

SEQ ID NO: 1442453 - RNA, 15 nt, Human
ucugggcuuccugga

SEQ ID NO: 1442454 - RNA, 14 nt, Human
ucugggcuuccugg

SEQ ID NO: 1442455 - RNA, 13 nt, Human
ucugggcuuccug

SEQ ID NO: 1442456 - RNA, 21 nt, Human
ucugggcuuauaucuggccuc

SEQ ID NO: 1442457 - RNA, 20 nt, Human
ucugggcuuauaucuggccu

SEQ ID NO: 1442458 - RNA, 20 nt, Human
ucugggcuggaugagcuccc

SEQ ID NO: 1442459 - RNA, 19 nt, Human
ucugggcuggaugagcucc

SEQ ID NO: 1442460 - RNA, 11 nt, Human
ucugggcugga

SEQ ID NO: 1442461 - RNA, 14 nt, Human
ucugggcucugagu

SEQ ID NO: 1442462 - RNA, 12 nt, Human
ucugggcucuga

SEQ ID NO: 1442463 - RNA, 18 nt, Human
agaauucucuaguuugau

SEQ ID NO: 1442464 - RNA, 14 nt, Human
agaauucucuaguu

SEQ ID NO: 1442465 - RNA, 20 nt, Human
agaauuccaggguauggcca

SEQ ID NO: 1442466 - RNA, 14 nt, Human
agaauuacuguaac

SEQ ID NO: 1442467 - RNA, 23 nt, Human
ucugugggaugggaugguggagg

SEQ ID NO: 1442468 - RNA, 19 nt, Human
ucuguggagguggaaaagc

SEQ ID NO: 1442469 - RNA, 22 nt, Human
ucugugccagagccuggggcuc

SEQ ID NO: 1442470 - RNA, 23 nt, Human
ucugugccagagccuggggcucu

SEQ ID NO: 1442471 - RNA, 20 nt, Human
ucugugccagagccuggggc

SEQ ID NO: 1442472 - RNA, 19 nt, Human
ucugugccagagccugggg

SEQ ID NO: 1442473 - RNA, 18 nt, Human
ucugugccagagccuggg

SEQ ID NO: 1442474 - RNA, 17 nt, Human
ucugugccagagccugg

SEQ ID NO: 1442475 - RNA, 16 nt, Human
ucugugccagagccug

SEQ ID NO: 1442476 - RNA, 15 nt, Human
ucugugccagagccu

SEQ ID NO: 1442477 - RNA, 13 nt, Human
ucugugccagagc

SEQ ID NO: 1442478 - RNA, 19 nt, Human
ucugugaccaaugucuuga

SEQ ID NO: 1442479 - RNA, 17 nt, Human
ucuguucuuccucagcc

SEQ ID NO: 1442480 - RNA, 15 nt, Human
ucuguucuuccucag

SEQ ID NO: 1442481 - RNA, 16 nt, Human
ucuguucuguuucaag

SEQ ID NO: 1442482 - RNA, 18 nt, Human
ucuguucuuccucagcca

SEQ ID NO: 1442483 - RNA, 19 nt, Human
ucuguucuuccucagccag

SEQ ID NO: 1442484 - RNA, 23 nt, Human
ucuguuuagauaauacaccacua

SEQ ID NO: 1442485 - RNA, 16 nt, Human
ucuguuuagauaauac

SEQ ID NO: 1442486 - RNA, 19 nt, Human
ucuguuuagauaauacacc

SEQ ID NO: 1442487 - RNA, 20 nt, Human
ucuguaucaggacccagagg

SEQ ID NO: 1442488 - RNA, 15 nt, Human
ucuguauauacuuuu

SEQ ID NO: 1442489 - RNA, 22 nt, Human
ucuguagaaaugguuguauuag

SEQ ID NO: 1442490 - RNA, 12 nt, Human
ucuguagaaaug

SEQ ID NO: 1442491 - RNA, 17 nt, Human
ucuguagaaaugguugu

SEQ ID NO: 1442492 - RNA, 21 nt, Human
ucuguagaaaugguuguauua

SEQ ID NO: 1442493 - RNA, 23 nt, Human
ucugguagaagggaaagcccaua

SEQ ID NO: 1442494 - RNA, 20 nt, Human
ucugguaggaauagcauguc

SEQ ID NO: 1442495 - RNA, 22 nt, Human
ucugguaugaacuugaggacac

SEQ ID NO: 1442496 - RNA, 23 nt, Human
ucugguaugaacuugaggacaca

SEQ ID NO: 1442497 - RNA, 23 nt, Human
ucugucccccuuuagaucucuga

SEQ ID NO: 1442498 - RNA, 16 nt, Human
ucuguccccagccugg

SEQ ID NO: 1442499 - RNA, 15 nt, Human
ucuguccccagccug

SEQ ID NO: 1442500 - RNA, 18 nt, Human
ucugugaccaaugucuug

SEQ ID NO: 1442501 - RNA, 16 nt, Human
ucugugaccaaugucu

SEQ ID NO: 1442502 - RNA, 22 nt, Human
ucugucccccuuuagaucucug

SEQ ID NO: 1442503 - RNA, 19 nt, Human
ugaaagugggcaaaagcuu

SEQ ID NO: 1442504 - RNA, 15 nt, Human
ugaaaguuaauccac

SEQ ID NO: 1442505 - RNA, 20 nt, Human
agagcgugagcugagcaggc

SEQ ID NO: 1442506 - RNA, 16 nt, Human
agagcgugagcugagc

SEQ ID NO: 1442507 - RNA, 19 nt, Human
agagcgagagaucaaagau

SEQ ID NO: 1442508 - RNA, 18 nt, Human
agagcgugagcugagcag

SEQ ID NO: 1442509 - RNA, 23 nt, Human
ugaaagucuguccuugaaggacu

SEQ ID NO: 1442510 - RNA, 17 nt, Human
ugaaauauccugcuuga

SEQ ID NO: 1442511 - RNA, 15 nt, Human
ugaaauauccugcuu

SEQ ID NO: 1442512 - RNA, 22 nt, Human
ugaaauaauguguaguucaugu

SEQ ID NO: 1442513 - RNA, 23 nt, Human
ugaaauaauguguaguucaugua

SEQ ID NO: 1442514 - RNA, 16 nt, Human
ugaaauaauguguagu

SEQ ID NO: 1442515 - RNA, 14 nt, Human
ugaaauaaugugua

SEQ ID NO: 1442516 - RNA, 13 nt, Human
ugaaauaaugugu

SEQ ID NO: 1442517 - RNA, 16 nt, Human
ugaaauaagcuauuug

SEQ ID NO: 1442518 - RNA, 14 nt, Human
ugaaauaagcuauu

SEQ ID NO: 1442519 - RNA, 13 nt, Human
ugaaauaagcuau

SEQ ID NO: 1442520 - RNA, 22 nt, Human
ugaaauaagcuauuugauguaa

SEQ ID NO: 1442521 - RNA, 16 nt, Human
ugaaauaugauguuaa

SEQ ID NO: 1442522 - RNA, 20 nt, Human
ugaaauaugauguuaaaaaa

SEQ ID NO: 1442523 - RNA, 18 nt, Human
ugaaauauuauguuaaaa

SEQ ID NO: 1442524 - RNA, 15 nt, Human
ugaaauuguauuaca

SEQ ID NO: 1442525 - RNA, 22 nt, Human
ugaaauuuuauaugcuuacuga

SEQ ID NO: 1442526 - RNA, 18 nt, Human
ugaaauuuuauaugcuua

SEQ ID NO: 1442527 - RNA, 16 nt, Human
ugaaauuuuauaugcu

SEQ ID NO: 1442528 - RNA, 22 nt, Human
ugaaauuuuaaccuaugauauu

SEQ ID NO: 1442529 - RNA, 20 nt, Human
ugaaauuuuaaccuaugaua

SEQ ID NO: 1442530 - RNA, 14 nt, Human
ugaaauuuuaaccu

SEQ ID NO: 1442531 - RNA, 19 nt, Human
ugaaauuuuaaaaauuguu

SEQ ID NO: 1442532 - RNA, 23 nt, Human
ugaaauuuccugggagcuuuugu

SEQ ID NO: 1442533 - RNA, 19 nt, Human
agagccaccaagagggacg

SEQ ID NO: 1442534 - RNA, 15 nt, Human
agagccaccaagagg

SEQ ID NO: 1442535 - RNA, 15 nt, Human
agagcagugcuuuug

SEQ ID NO: 1442536 - RNA, 13 nt, Human
agagcagugcuuu

SEQ ID NO: 1442537 - RNA, 12 nt, Human
agagcagugcuu

SEQ ID NO: 1442538 - RNA, 15 nt, Human
agagccacugccauu

SEQ ID NO: 1442539 - RNA, 20 nt, Human
agagcagugaagacuagaaa

SEQ ID NO: 1442540 - RNA, 17 nt, Human
agagcaggugagauggg

SEQ ID NO: 1442541 - RNA, 18 nt, Human
agagcaggugcuggcucu

SEQ ID NO: 1442542 - RNA, 24 nt, Human
agagcagggauuaaccucugcacu

SEQ ID NO: 1442543 - RNA, 22 nt, Human
agagcagggauuaaccucugca

SEQ ID NO: 1442544 - RNA, 17 nt, Human
agagcagacuacagcug

SEQ ID NO: 1442545 - RNA, 22 nt, Human
agagcaggacugaugucuccua

SEQ ID NO: 1442546 - RNA, 12 nt, Human
agagcagagguc

SEQ ID NO: 1442547 - RNA, 22 nt, Human
ucuuuggcuccccuguaccuuu

SEQ ID NO: 1442548 - RNA, 15 nt, Human
ucuuugggaauauuu

SEQ ID NO: 1442549 - RNA, 14 nt, Human
ucuuuggcuccccu

SEQ ID NO: 1442550 - RNA, 22 nt, Human
ucuuuggagaaaugcuuagaaa

SEQ ID NO: 1442551 - RNA, 18 nt, Human
agagcaaaauaauuuuaa

SEQ ID NO: 1442552 - RNA, 16 nt, Human
ucuuugggaauauuug

SEQ ID NO: 1442553 - RNA, 18 nt, Human
ucuuugggaauauuugaa

SEQ ID NO: 1442554 - RNA, 20 nt, Human
ucuuugggaauauuugaauc

SEQ ID NO: 1442555 - RNA, 17 nt, Human
agagcaccugcugucug

SEQ ID NO: 1442556 - RNA, 14 nt, Human
agagcacugccacc

SEQ ID NO: 1442557 - RNA, 18 nt, Human
agagcacugccaccagua

SEQ ID NO: 1442558 - RNA, 15 nt, Human
agagcacugccacca

SEQ ID NO: 1442559 - RNA, 12 nt, Human
agagcacugcuc

SEQ ID NO: 1442560 - RNA, 16 nt, Human
agagcacugcuccagu

SEQ ID NO: 1442561 - RNA, 12 nt, Human
ugaaccugcccu

SEQ ID NO: 1442562 - RNA, 23 nt, Human
ugaaccugaugaaaauaaagaau

SEQ ID NO: 1442563 - RNA, 18 nt, Human
ugaaccugaugaaaauaa

SEQ ID NO: 1442564 - RNA, 12 nt, Human
ugaaccugaaua

SEQ ID NO: 1442565 - RNA, 18 nt, Human
ugaacucacuuuccuccu

SEQ ID NO: 1442566 - RNA, 17 nt, Human
ugaacucaacuuugaca

SEQ ID NO: 1442567 - RNA, 18 nt, Human
ugaacucaaacugaggaa

SEQ ID NO: 1442568 - RNA, 17 nt, Human
ugaacucaaacugagga

SEQ ID NO: 1442569 - RNA, 16 nt, Human
ugaacucaaacugagg

SEQ ID NO: 1442570 - RNA, 14 nt, Human
ugaacucaaacuga

SEQ ID NO: 1442571 - RNA, 18 nt, Human
ugaaccuuugugcccuau

SEQ ID NO: 1442572 - RNA, 21 nt, Human
ugaaccuuugugcccuaucac

SEQ ID NO: 1442573 - RNA, 17 nt, Human
ugaaccuuugugcccua

SEQ ID NO: 1442574 - RNA, 21 nt, Human
ugaacuaggauuguaguccca

SEQ ID NO: 1442575 - RNA, 11 nt, Human
ugaacuuugcu

SEQ ID NO: 1442576 - RNA, 15 nt, Human
ugaacuuugcugagc

SEQ ID NO: 1442577 - RNA, 22 nt, Human
ugaacuuugaccucugcagcaa

SEQ ID NO: 1442578 - RNA, 19 nt, Human
ugaacuuugaccucugcag

SEQ ID NO: 1442579 - RNA, 20 nt, Human
ugaacuuugaccucugcagc

SEQ ID NO: 1442580 - RNA, 21 nt, Human
ugaagaaaaucacuuaggaaa

SEQ ID NO: 1442581 - RNA, 15 nt, Human
ugaagaaaaucacuu

SEQ ID NO: 1442582 - RNA, 17 nt, Human
ugaacuuuuuauugauu

SEQ ID NO: 1442583 - RNA, 16 nt, Human
ugaacuuugcugagcc

SEQ ID NO: 1442584 - RNA, 12 nt, Human
agagcuucccug

SEQ ID NO: 1442585 - RNA, 21 nt, Human
agagcuggagaugaggccaga

SEQ ID NO: 1442586 - RNA, 12 nt, Human
agagcuggcucu

SEQ ID NO: 1442587 - RNA, 23 nt, Human
agagcuggagaugaggccagacc

SEQ ID NO: 1442588 - RNA, 22 nt, Human
agagcuggagaugaggccagac

SEQ ID NO: 1442589 - RNA, 22 nt, Human
agaggcucguugacuggcugug

SEQ ID NO: 1442590 - RNA, 18 nt, Human
agaggcucagauuguaau

SEQ ID NO: 1442591 - RNA, 10 nt, Human
agaggcucag

SEQ ID NO: 1442592 - RNA, 19 nt, Human
agaggcuauuauuuucacu

SEQ ID NO: 1442593 - RNA, 19 nt, Human
agaggcccaggcugccguc

SEQ ID NO: 1442594 - RNA, 18 nt, Human
agaggcccaggcugccgu

SEQ ID NO: 1442595 - RNA, 17 nt, Human
agaggcccaggcugccg

SEQ ID NO: 1442596 - RNA, 16 nt, Human
agaggcccaggcugcc

SEQ ID NO: 1442597 - RNA, 15 nt, Human
agaggcccaggcugc

SEQ ID NO: 1442598 - RNA, 21 nt, Human
agaggccauucuuucccaaca

SEQ ID NO: 1442599 - RNA, 19 nt, Human
agaggcagcccaggaaguc

SEQ ID NO: 1442600 - RNA, 16 nt, Human
agaggcagcccgcaca

SEQ ID NO: 1442601 - RNA, 14 nt, Human
agaggcagcccagg

SEQ ID NO: 1442602 - RNA, 13 nt, Human
agaggcagcccag

SEQ ID NO: 1442603 - RNA, 11 nt, Human
agaggcagccc

SEQ ID NO: 1442604 - RNA, 17 nt, Human
agagguauuuaucuuua

SEQ ID NO: 1442605 - RNA, 16 nt, Human
agaggcugaggcuggc

SEQ ID NO: 1442606 - RNA, 19 nt, Human
agaggcugaggccuggacu

SEQ ID NO: 1442607 - RNA, 18 nt, Human
agaggcugaggccuggac

SEQ ID NO: 1442608 - RNA, 17 nt, Human
agaggcugaggccugga

SEQ ID NO: 1442609 - RNA, 14 nt, Human
agaggcugaggccu

SEQ ID NO: 1442610 - RNA, 14 nt, Human
agagguugucugug

SEQ ID NO: 1442611 - RNA, 22 nt, Human
ugaagcaaacucuaaaauuaua

SEQ ID NO: 1442612 - RNA, 18 nt, Human
agaguagaauugcauuga

SEQ ID NO: 1442613 - RNA, 17 nt, Human
agaguagaauugcauug

SEQ ID NO: 1442614 - RNA, 20 nt, Human
ugaagcaaaugucaugcugc

SEQ ID NO: 1442615 - RNA, 20 nt, Human
ugaagcaaaucgaaugaaau

SEQ ID NO: 1442616 - RNA, 23 nt, Human
ugaagcaaaugucaugcugccuu

SEQ ID NO: 1442617 - RNA, 22 nt, Human
ugaagcacagugaucaaguuau

SEQ ID NO: 1442618 - RNA, 16 nt, Human
agaguagaauugcauu

SEQ ID NO: 1442619 - RNA, 15 nt, Human
agaguagaauugcau

SEQ ID NO: 1442620 - RNA, 20 nt, Human
agagguuugcagucccaagc

SEQ ID NO: 1442621 - RNA, 17 nt, Human
agagguuugcaguccca

SEQ ID NO: 1442622 - RNA, 15 nt, Human
agagguuugcagucc

SEQ ID NO: 1442623 - RNA, 22 nt, Human
agagguuugacuagaugaugga

SEQ ID NO: 1442624 - RNA, 12 nt, Human
agagguuuuaaa

SEQ ID NO: 1442625 - RNA, 19 nt, Human
ugacaaaaaauuaaagcau

SEQ ID NO: 1442626 - RNA, 22 nt, Human
ugaauuuuuuuuaacauuccuc

SEQ ID NO: 1442627 - RNA, 20 nt, Human
ugaauuuuuuuuuccuagcc

SEQ ID NO: 1442628 - RNA, 19 nt, Human
ugaauuuuuuuuuccuagc

SEQ ID NO: 1442629 - RNA, 16 nt, Human
ugaauuuuuuuuuccu

SEQ ID NO: 1442630 - RNA, 21 nt, Human
ugaauuuuuuuuaacauuccu

SEQ ID NO: 1442631 - RNA, 20 nt, Human
ugaauuuuuuuuaacauucc

SEQ ID NO: 1442632 - RNA, 19 nt, Human
ugaauuuuuuuuaacauuc

SEQ ID NO: 1442633 - RNA, 18 nt, Human
ugaauuuuuuuuaacauu

SEQ ID NO: 1442634 - RNA, 17 nt, Human
ugaauuuuuuuuaacau

SEQ ID NO: 1442635 - RNA, 16 nt, Human
ugaauuuuuuuuaaca

SEQ ID NO: 1442636 - RNA, 15 nt, Human
ugaauuuuuuuuaac

SEQ ID NO: 1442637 - RNA, 16 nt, Human
ugaauuuuagcuuuug

SEQ ID NO: 1442638 - RNA, 19 nt, Human
ugaauuuuagcuuuugugg

SEQ ID NO: 1442639 - RNA, 15 nt, Human
ugaauuuuagcuuuu

SEQ ID NO: 1442640 - RNA, 14 nt, Human
ugaauuuuagcuuu

SEQ ID NO: 1442641 - RNA, 21 nt, Human
agaucaccaguguguggcuuu

SEQ ID NO: 1442642 - RNA, 13 nt, Human
ugaauuuuagcuu

SEQ ID NO: 1442643 - RNA, 13 nt, Human
ugaauuucacugu

SEQ ID NO: 1442644 - RNA, 16 nt, Human
ugaauuuuacauggcu

SEQ ID NO: 1442645 - RNA, 15 nt, Human
ugaauuucuuuugcc

SEQ ID NO: 1442646 - RNA, 11 nt, Human
ugaauuucauc

SEQ ID NO: 1442647 - RNA, 16 nt, Human
agauauuggacaaaga

SEQ ID NO: 1442648 - RNA, 23 nt, Human
agauauuuacaugaauugcauuu

SEQ ID NO: 1442649 - RNA, 17 nt, Human
agauauuggacaaagaa

SEQ ID NO: 1442650 - RNA, 14 nt, Human
agauauuggacaaa

SEQ ID NO: 1442651 - RNA, 18 nt, Human
agauauuccuauugugca

SEQ ID NO: 1442652 - RNA, 18 nt, Human
agauauuaaugcccagac

SEQ ID NO: 1442653 - RNA, 17 nt, Human
agauauuaaugcccaga

SEQ ID NO: 1442654 - RNA, 11 nt, Human
agauauuaaug

SEQ ID NO: 1442655 - RNA, 17 nt, Human
agauaaagguucaugca

SEQ ID NO: 1442656 - RNA, 15 nt, Human
agauacugaaauaaa

SEQ ID NO: 1442657 - RNA, 13 nt, Human
agauacugaaaua

SEQ ID NO: 1442658 - RNA, 18 nt, Human
agauacuaaggacguugu

SEQ ID NO: 1442659 - RNA, 12 nt, Human
agauacugaaau

SEQ ID NO: 1442660 - RNA, 17 nt, Human
ugaauguguuucacagu

SEQ ID NO: 1442661 - RNA, 20 nt, Human
ugaauguguuucacaguuug

SEQ ID NO: 1442662 - RNA, 16 nt, Human
ugaauguguuucacag

SEQ ID NO: 1442663 - RNA, 18 nt, Human
ugaauguggcuugagaaa

SEQ ID NO: 1442664 - RNA, 20 nt, Human
agagucccagguuggcucug

SEQ ID NO: 1442665 - RNA, 19 nt, Human
agagucccagguuggcucu

SEQ ID NO: 1442666 - RNA, 17 nt, Human
agagucccugccuggac

SEQ ID NO: 1442667 - RNA, 14 nt, Human
agagucccugccug

SEQ ID NO: 1442668 - RNA, 21 nt, Human
agaguccaagguuuaaagagu

SEQ ID NO: 1442669 - RNA, 19 nt, Human
agaguccaagguuuaaaga

SEQ ID NO: 1442670 - RNA, 23 nt, Human
agaguccaucagccuccauccua

SEQ ID NO: 1442671 - RNA, 17 nt, Human
ugaaugugaagccuucc

SEQ ID NO: 1442672 - RNA, 16 nt, Human
ugaaugugaagccuuc

SEQ ID NO: 1442673 - RNA, 15 nt, Human
ugaaugugaagccuu

SEQ ID NO: 1442674 - RNA, 14 nt, Human
ugaaugugaagccu

SEQ ID NO: 1442675 - RNA, 13 nt, Human
ugaaugugaagcc

SEQ ID NO: 1442676 - RNA, 19 nt, Human
ugaauguaaauuuguacua

SEQ ID NO: 1442677 - RNA, 18 nt, Human
ugaauguaaauuuguacu

SEQ ID NO: 1442678 - RNA, 16 nt, Human
ugaauguaaauuugua

SEQ ID NO: 1442679 - RNA, 15 nt, Human
ugaauguaaauuugu

SEQ ID NO: 1442680 - RNA, 22 nt, Human
ugaagcaaaugucaugcugccu

SEQ ID NO: 1442681 - RNA, 21 nt, Human
ugaagcaaaugucaugcugcc

SEQ ID NO: 1442682 - RNA, 18 nt, Human
agagucuggugaagcuca

SEQ ID NO: 1442683 - RNA, 23 nt, Human
agagucuggauaacuuccacagg

SEQ ID NO: 1442684 - RNA, 16 nt, Human
agagucugaaccuauu

SEQ ID NO: 1442685 - RNA, 17 nt, Human
agagucugaacagcugu

SEQ ID NO: 1442686 - RNA, 16 nt, Human
agagucugaacagcug

SEQ ID NO: 1442687 - RNA, 13 nt, Human
agagucugaacag

SEQ ID NO: 1442688 - RNA, 12 nt, Human
agagucugaaca

SEQ ID NO: 1442689 - RNA, 13 nt, Human
agagucucccagg

SEQ ID NO: 1442690 - RNA, 15 nt, Human
agagucucccaggga

SEQ ID NO: 1442691 - RNA, 17 nt, Human
agagucucccagggagc

SEQ ID NO: 1442692 - RNA, 23 nt, Human
agagucuggugaagcucacuucu

SEQ ID NO: 1442693 - RNA, 17 nt, Human
agaguugauacuacagu

SEQ ID NO: 1442694 - RNA, 20 nt, Human
agaguugauacuacaguuug

SEQ ID NO: 1442695 - RNA, 22 nt, Human
agaguugauacuacaguuuguu

SEQ ID NO: 1442696 - RNA, 15 nt, Human
agaguuggccauauu

SEQ ID NO: 1442697 - RNA, 13 nt, Human
agaguuggccaua

SEQ ID NO: 1442698 - RNA, 21 nt, Human
agaguugcugagagggcucga

SEQ ID NO: 1442699 - RNA, 20 nt, Human
agaguugaugguuguacaua

SEQ ID NO: 1442700 - RNA, 12 nt, Human
agaguuguuaca

SEQ ID NO: 1442701 - RNA, 14 nt, Human
agaguuuaaaauca

SEQ ID NO: 1442702 - RNA, 16 nt, Human
agaguuguuacauuuu

SEQ ID NO: 1442703 - RNA, 17 nt, Human
agaguuuagcuggaaaa

SEQ ID NO: 1442704 - RNA, 16 nt, Human
agaguuuagcuggaaa

SEQ ID NO: 1442705 - RNA, 18 nt, Human
ugacaguggcguuuguaa

SEQ ID NO: 1442706 - RNA, 14 nt, Human
ugacaguguuuuua

SEQ ID NO: 1442707 - RNA, 19 nt, Human
ugacaguguugaaaauguu

SEQ ID NO: 1442708 - RNA, 16 nt, Human
ugacaguguugaaaau

SEQ ID NO: 1442709 - RNA, 16 nt, Human
ugacaguggaacuaca

SEQ ID NO: 1442710 - RNA, 18 nt, Human
ugacaguggaacuacauu

SEQ ID NO: 1442711 - RNA, 14 nt, Human
ugacaggccugucc

SEQ ID NO: 1442712 - RNA, 20 nt, Human
ugacagcuaggaugugcauu

SEQ ID NO: 1442713 - RNA, 22 nt, Human
ugacagcuaggaugugcauucu

SEQ ID NO: 1442714 - RNA, 23 nt, Human
ugacacagaaaauguugagaauc

SEQ ID NO: 1442715 - RNA, 19 nt, Human
ugacacagaaaauguugag

SEQ ID NO: 1442716 - RNA, 18 nt, Human
ugacacagaaaauguuga

SEQ ID NO: 1442717 - RNA, 20 nt, Human
ugacacacuaaccaagcuga

SEQ ID NO: 1442718 - RNA, 12 nt, Human
ugacacacuaac

SEQ ID NO: 1442719 - RNA, 23 nt, Human
ugacacaccaggcgcuaauucaa

SEQ ID NO: 1442720 - RNA, 22 nt, Human
ugacacaccaggcgcuaauuca

SEQ ID NO: 1442721 - RNA, 16 nt, Human
ugacacaccaggcgcu

SEQ ID NO: 1442722 - RNA, 19 nt, Human
ugacauuuauauauugaau

SEQ ID NO: 1442723 - RNA, 16 nt, Human
ugacauuuauauauug

SEQ ID NO: 1442724 - RNA, 15 nt, Human
ugacauuuauauauu

SEQ ID NO: 1442725 - RNA, 14 nt, Human
ugacauaaaguuga

SEQ ID NO: 1442726 - RNA, 16 nt, Human
ugacauaaaguugaua

SEQ ID NO: 1442727 - RNA, 14 nt, Human
ugaccaaugucuug

SEQ ID NO: 1442728 - RNA, 13 nt, Human
ugaccaaugucuu

SEQ ID NO: 1442729 - RNA, 13 nt, Human
agaucaggaagag

SEQ ID NO: 1442730 - RNA, 17 nt, Human
agaucaggaagagaagg

SEQ ID NO: 1442731 - RNA, 15 nt, Human
agaucaguguaccau

SEQ ID NO: 1442732 - RNA, 13 nt, Human
agaucaguaaaga

SEQ ID NO: 1442733 - RNA, 15 nt, Human
ugaccaaugucuuga

SEQ ID NO: 1442734 - RNA, 18 nt, Human
agaucaggaagagaagga

SEQ ID NO: 1442735 - RNA, 19 nt, Human
agaucaggaagagaaggag

SEQ ID NO: 1442736 - RNA, 16 nt, Human
agaucauaaggcuuca

SEQ ID NO: 1442737 - RNA, 13 nt, Human
agaucauaaggcu

SEQ ID NO: 1442738 - RNA, 15 nt, Human
agaucaguaaagaac

SEQ ID NO: 1442739 - RNA, 21 nt, Human
agaucaguguaccauuugccu

SEQ ID NO: 1442740 - RNA, 18 nt, Human
agaucaguguaccauuug

SEQ ID NO: 1442741 - RNA, 12 nt, Human
agaucauuguga

SEQ ID NO: 1442742 - RNA, 17 nt, Human
agauguucuaagucuuu

SEQ ID NO: 1442743 - RNA, 15 nt, Human
agauguucacccaac

SEQ ID NO: 1442744 - RNA, 20 nt, Human
agaugugauauucuaagacu

SEQ ID NO: 1442745 - RNA, 19 nt, Human
agaugugauauucuaagac

SEQ ID NO: 1442746 - RNA, 18 nt, Human
agaugugauauucuaaga

SEQ ID NO: 1442747 - RNA, 17 nt, Human
agaugugauauucuaag

SEQ ID NO: 1442748 - RNA, 16 nt, Human
agaugugauauucuaa

SEQ ID NO: 1442749 - RNA, 15 nt, Human
agaugugauauucua

SEQ ID NO: 1442750 - RNA, 20 nt, Human
agaugcugugagucuuuggu

SEQ ID NO: 1442751 - RNA, 16 nt, Human
agaugcugugagucuu

SEQ ID NO: 1442752 - RNA, 22 nt, Human
agauguucuaagucuuuccauu

SEQ ID NO: 1442753 - RNA, 21 nt, Human
agauguucuaagucuuuccau

SEQ ID NO: 1442754 - RNA, 20 nt, Human
agauguucuaagucuuucca

SEQ ID NO: 1442755 - RNA, 12 nt, Human
agauguucucua

SEQ ID NO: 1442756 - RNA, 15 nt, Human
agauguucucuauca

SEQ ID NO: 1442757 - RNA, 17 nt, Human
agauguucucuaucauu

SEQ ID NO: 1442758 - RNA, 18 nt, Human
agauguucucuaucauuu

SEQ ID NO: 1442759 - RNA, 19 nt, Human
agauguucucuaucauuua

SEQ ID NO: 1442760 - RNA, 20 nt, Human
agauguucucuaucauuuaa

SEQ ID NO: 1442761 - RNA, 14 nt, Human
ugacccacaugcca

SEQ ID NO: 1442762 - RNA, 15 nt, Human
ugacccacaugccau

SEQ ID NO: 1442763 - RNA, 23 nt, Human
agaugcaccaccaagccaaggga

SEQ ID NO: 1442764 - RNA, 21 nt, Human
agaugcaccaccaagccaagg

SEQ ID NO: 1442765 - RNA, 22 nt, Human
agaucccaaguagaaucucagu

SEQ ID NO: 1442766 - RNA, 10 nt, Human
agaucccaaa

SEQ ID NO: 1442767 - RNA, 20 nt, Human
agaucccaacacugccagca

SEQ ID NO: 1442768 - RNA, 19 nt, Human
agaucccaacacugccagc

SEQ ID NO: 1442769 - RNA, 22 nt, Human
agauccagggacagaggcccca

SEQ ID NO: 1442770 - RNA, 19 nt, Human
agauccagggacagaggcc

SEQ ID NO: 1442771 - RNA, 16 nt, Human
agauccaggagcucca

SEQ ID NO: 1442772 - RNA, 15 nt, Human
agauccaggagcucc

SEQ ID NO: 1442773 - RNA, 14 nt, Human
agauccaggagcuc

SEQ ID NO: 1442774 - RNA, 17 nt, Human
agauccaggagcuccag

SEQ ID NO: 1442775 - RNA, 18 nt, Human
agaucccaacacugccag

SEQ ID NO: 1442776 - RNA, 19 nt, Human
agaugcacuuugcuuuaau

SEQ ID NO: 1442777 - RNA, 22 nt, Human
agaugcacuuugcuuuaauaua

SEQ ID NO: 1442778 - RNA, 15 nt, Human
agaugcacuuugcuu

SEQ ID NO: 1442779 - RNA, 18 nt, Human
agaugcuggcuugggcag

SEQ ID NO: 1442780 - RNA, 19 nt, Human
agaugcuggcuugggcagc

SEQ ID NO: 1442781 - RNA, 17 nt, Human
agaugcuggcuugggca

SEQ ID NO: 1442782 - RNA, 23 nt, Human
agaugcuggcccagggcccagag

SEQ ID NO: 1442783 - RNA, 22 nt, Human
agaugcuggcccagggcccaga

SEQ ID NO: 1442784 - RNA, 21 nt, Human
agaugcuggcccagggcccag

SEQ ID NO: 1442785 - RNA, 20 nt, Human
agaugcuggcccagggccca

SEQ ID NO: 1442786 - RNA, 16 nt, Human
agaugccuccuuccuc

SEQ ID NO: 1442787 - RNA, 13 nt, Human
agaugccuccuuc

SEQ ID NO: 1442788 - RNA, 13 nt, Human
agaugccucccug

SEQ ID NO: 1442789 - RNA, 20 nt, Human
agaugcaguucugaagaaga

SEQ ID NO: 1442790 - RNA, 19 nt, Human
agaugcaguucugaagaag

SEQ ID NO: 1442791 - RNA, 18 nt, Human
agaugcaguucugaagaa

SEQ ID NO: 1442792 - RNA, 12 nt, Human
ugcaaagaucug

SEQ ID NO: 1442793 - RNA, 23 nt, Human
ugcaaagaucuguccucagccuu

SEQ ID NO: 1442794 - RNA, 23 nt, Human
ugcaaagaaagaaaaaaaaccau

SEQ ID NO: 1442795 - RNA, 22 nt, Human
ugcaaagaaagaaaaaaaacca

SEQ ID NO: 1442796 - RNA, 16 nt, Human
ugcaaagaaagaaaaa

SEQ ID NO: 1442797 - RNA, 23 nt, Human
ugcaaauaaauauccuuuaauug

SEQ ID NO: 1442798 - RNA, 13 nt, Human
ugcaaauaaauau

SEQ ID NO: 1442799 - RNA, 20 nt, Human
ugcaaaguaucccuacugua

SEQ ID NO: 1442800 - RNA, 18 nt, Human
ugauuugcauugaacaca

SEQ ID NO: 1442801 - RNA, 14 nt, Human
ugauuugcauugaa

SEQ ID NO: 1442802 - RNA, 13 nt, Human
ugauuugcauuga

SEQ ID NO: 1442803 - RNA, 15 nt, Human
ugauuugcauugaac

SEQ ID NO: 1442804 - RNA, 12 nt, Human
ugauuugcauug

SEQ ID NO: 1442805 - RNA, 18 nt, Human
ugauuuccguuaaaauac

SEQ ID NO: 1442806 - RNA, 17 nt, Human
ugauuucauuucaacug

SEQ ID NO: 1442807 - RNA, 13 nt, Human
ugauuucauuuca

SEQ ID NO: 1442808 - RNA, 23 nt, Human
ugauuuauuaauauauauuaucu

SEQ ID NO: 1442809 - RNA, 22 nt, Human
ugauuuaucugagucaacuccu

SEQ ID NO: 1442810 - RNA, 18 nt, Human
ugauuuaucacacaaagc

SEQ ID NO: 1442811 - RNA, 16 nt, Human
ugauuuaucacacaaa

SEQ ID NO: 1442812 - RNA, 18 nt, Human
agccacgggugccagaag

SEQ ID NO: 1442813 - RNA, 19 nt, Human
agccacggggacucagccc

SEQ ID NO: 1442814 - RNA, 15 nt, Human
agccacgguguucug

SEQ ID NO: 1442815 - RNA, 21 nt, Human
ugcaaaugcuaugagaugcau

SEQ ID NO: 1442816 - RNA, 14 nt, Human
ugcaaaucuugaaa

SEQ ID NO: 1442817 - RNA, 20 nt, Human
ugcaaaucaggcuuuuguuu

SEQ ID NO: 1442818 - RNA, 23 nt, Human
ugcaaauacuguauauucaggac

SEQ ID NO: 1442819 - RNA, 13 nt, Human
ugcaaauaacaaa

SEQ ID NO: 1442820 - RNA, 17 nt, Human
ugcaaauaacaaaugcc

SEQ ID NO: 1442821 - RNA, 16 nt, Human
ugcaacagacuugaau

SEQ ID NO: 1442822 - RNA, 22 nt, Human
ugcaacacuggucugcuguucc

SEQ ID NO: 1442823 - RNA, 12 nt, Human
ugcaacacuggu

SEQ ID NO: 1442824 - RNA, 13 nt, Human
ugcaacaaaauuc

SEQ ID NO: 1442825 - RNA, 12 nt, Human
ugcaaauuucau

SEQ ID NO: 1442826 - RNA, 16 nt, Human
ugcaagcacagcccuu

SEQ ID NO: 1442827 - RNA, 15 nt, Human
ugcaagcacagcccu

SEQ ID NO: 1442828 - RNA, 21 nt, Human
ugcaagccagauuuuccugaa

SEQ ID NO: 1442829 - RNA, 15 nt, Human
ugcaagccagauuuu

SEQ ID NO: 1442830 - RNA, 19 nt, Human
ugcaauaaaucugacccag

SEQ ID NO: 1442831 - RNA, 19 nt, Human
ugcaaguugaggacuucuu

SEQ ID NO: 1442832 - RNA, 16 nt, Human
ugcaaguuuaucagua

SEQ ID NO: 1442833 - RNA, 18 nt, Human
ugcaaguugaggacuucu

SEQ ID NO: 1442834 - RNA, 13 nt, Human
ugcaaguugagga

SEQ ID NO: 1442835 - RNA, 15 nt, Human
ugcaaucccuuaaua

SEQ ID NO: 1442836 - RNA, 14 nt, Human
ugcaauaucugaag

SEQ ID NO: 1442837 - RNA, 15 nt, Human
ugcaauaucugaagc

SEQ ID NO: 1442838 - RNA, 23 nt, Human
agcccaggccaggacucugcagc

SEQ ID NO: 1442839 - RNA, 20 nt, Human
ugcaaguauacuagggagcc

SEQ ID NO: 1442840 - RNA, 17 nt, Human
ugcaaguauacuaggga

SEQ ID NO: 1442841 - RNA, 16 nt, Human
ugcaaggucuuugguu

SEQ ID NO: 1442842 - RNA, 22 nt, Human
ugcaagguauuacacucuguaa

SEQ ID NO: 1442843 - RNA, 21 nt, Human
ugcaagguauuacacucugua

SEQ ID NO: 1442844 - RNA, 18 nt, Human
ugcaagguacucugguga

SEQ ID NO: 1442845 - RNA, 16 nt, Human
ugcaagguacucuggu

SEQ ID NO: 1442846 - RNA, 15 nt, Human
ugcaaggucauuuuu

SEQ ID NO: 1442847 - RNA, 18 nt, Human
ugcaaggcagccgugggc

SEQ ID NO: 1442848 - RNA, 16 nt, Human
ugcaaggcagccgugg

SEQ ID NO: 1442849 - RNA, 15 nt, Human
ugcaaggcagccgug

SEQ ID NO: 1442850 - RNA, 14 nt, Human
ugcaaggcagccgu

SEQ ID NO: 1442851 - RNA, 17 nt, Human
ugcaaggaccuaaaaca

SEQ ID NO: 1442852 - RNA, 13 nt, Human
ugcaaggcaaaga

SEQ ID NO: 1442853 - RNA, 11 nt, Human
ugcaagggaaa

SEQ ID NO: 1442854 - RNA, 21 nt, Human
ugcaaggccugguguuucuug

SEQ ID NO: 1442855 - RNA, 23 nt, Human
ugcaaggccugguguuucuugau

SEQ ID NO: 1442856 - RNA, 15 nt, Human
agccccugucauggu

SEQ ID NO: 1442857 - RNA, 22 nt, Human
agccccugggguggccaccagu

SEQ ID NO: 1442858 - RNA, 21 nt, Human
agccccugggguggccaccag

SEQ ID NO: 1442859 - RNA, 20 nt, Human
agccccucuggucgcuccug

SEQ ID NO: 1442860 - RNA, 16 nt, Human
agccccucuggucgcu

SEQ ID NO: 1442861 - RNA, 13 nt, Human
agccccucugguc

SEQ ID NO: 1442862 - RNA, 12 nt, Human
agccccucuggu

SEQ ID NO: 1442863 - RNA, 23 nt, Human
agccccgcguggaacucgugucu

SEQ ID NO: 1442864 - RNA, 20 nt, Human
agcccugcaccaugcugcug

SEQ ID NO: 1442865 - RNA, 14 nt, Human
agcccugcaccaug

SEQ ID NO: 1442866 - RNA, 13 nt, Human
agcccugcaccau

SEQ ID NO: 1442867 - RNA, 12 nt, Human
agcccugcacca

SEQ ID NO: 1442868 - RNA, 16 nt, Human
agccccuuagacagag

SEQ ID NO: 1442869 - RNA, 23 nt, Human
ugcaccccaaagcuuuccugccc

SEQ ID NO: 1442870 - RNA, 22 nt, Human
ugcaccccaaagcuuuccugcc

SEQ ID NO: 1442871 - RNA, 21 nt, Human
ugcaccccaaagcuuuccugc

SEQ ID NO: 1442872 - RNA, 20 nt, Human
ugcaccccaaagcuuuccug

SEQ ID NO: 1442873 - RNA, 19 nt, Human
ugcaccccaaagcuuuccu

SEQ ID NO: 1442874 - RNA, 18 nt, Human
ugcaccccaaagcuuucc

SEQ ID NO: 1442875 - RNA, 23 nt, Human
ugcaccaggguugaccccagagg

SEQ ID NO: 1442876 - RNA, 16 nt, Human
ugcaccaaagagaaug

SEQ ID NO: 1442877 - RNA, 22 nt, Human
ugcacauuuauuuccucccucu

SEQ ID NO: 1442878 - RNA, 13 nt, Human
ugcacauuuauuu

SEQ ID NO: 1442879 - RNA, 18 nt, Human
ugcacauguuuccucuag

SEQ ID NO: 1442880 - RNA, 17 nt, Human
ugcacauguuuccucua

SEQ ID NO: 1442881 - RNA, 16 nt, Human
ugcacauguuuccucu

SEQ ID NO: 1442882 - RNA, 14 nt, Human
ugcacauguuuccu

SEQ ID NO: 1442883 - RNA, 13 nt, Human
ugcacauguuucc

SEQ ID NO: 1442884 - RNA, 17 nt, Human
agcccugccuggaggac

SEQ ID NO: 1442885 - RNA, 16 nt, Human
agcccugccuggagga

SEQ ID NO: 1442886 - RNA, 15 nt, Human
agcccugccuggagg

SEQ ID NO: 1442887 - RNA, 14 nt, Human
agcccugccuggag

SEQ ID NO: 1442888 - RNA, 13 nt, Human
agcccugccugga

SEQ ID NO: 1442889 - RNA, 12 nt, Human
agcccugccugg

SEQ ID NO: 1442890 - RNA, 22 nt, Human
agcccugcaccaugcugcuggg

SEQ ID NO: 1442891 - RNA, 18 nt, Human
agcccugggaggcucugg

SEQ ID NO: 1442892 - RNA, 20 nt, Human
agcccugggaggcucuggag

SEQ ID NO: 1442893 - RNA, 22 nt, Human
ugccagcucuguaucaggaccc

SEQ ID NO: 1442894 - RNA, 19 nt, Human
ugccagcuacuuccuccuc

SEQ ID NO: 1442895 - RNA, 16 nt, Human
ugccaguguccugagc

SEQ ID NO: 1442896 - RNA, 23 nt, Human
ugccaguguccugagccccaggg

SEQ ID NO: 1442897 - RNA, 16 nt, Human
ugccacagcuuuugca

SEQ ID NO: 1442898 - RNA, 17 nt, Human
ugccacagcuuuugcaa

SEQ ID NO: 1442899 - RNA, 11 nt, Human
ugccacagcuu

SEQ ID NO: 1442900 - RNA, 22 nt, Human
ugccacagcccugucagcauga

SEQ ID NO: 1442901 - RNA, 22 nt, Human
ugccacagccuccccugccagg

SEQ ID NO: 1442902 - RNA, 21 nt, Human
ugccacagccuccccugccag

SEQ ID NO: 1442903 - RNA, 17 nt, Human
ugccacagccuccccug

SEQ ID NO: 1442904 - RNA, 13 nt, Human
ugccacagccucc

SEQ ID NO: 1442905 - RNA, 21 nt, Human
ugccacagcccugucagcaug

SEQ ID NO: 1442906 - RNA, 17 nt, Human
ugccacagcccugucag

SEQ ID NO: 1442907 - RNA, 19 nt, Human
ugccagccccugccauugu

SEQ ID NO: 1442908 - RNA, 11 nt, Human
ugccagccccu

SEQ ID NO: 1442909 - RNA, 21 nt, Human
ugccaauauuaaaucugcugg

SEQ ID NO: 1442910 - RNA, 22 nt, Human
ugccaaggcagaggccugggcu

SEQ ID NO: 1442911 - RNA, 19 nt, Human
ugccaaggcagaggccugg

SEQ ID NO: 1442912 - RNA, 18 nt, Human
ugccaaggcagaggccug

SEQ ID NO: 1442913 - RNA, 17 nt, Human
ugccaaggcagaggccu

SEQ ID NO: 1442914 - RNA, 16 nt, Human
ugccaaggcagaggcc

SEQ ID NO: 1442915 - RNA, 23 nt, Human
ugccaagcuccaagccccaucuu

SEQ ID NO: 1442916 - RNA, 16 nt, Human
ugccaagcuccaagcc

SEQ ID NO: 1442917 - RNA, 15 nt, Human
ugccaagcuccaagc

SEQ ID NO: 1442918 - RNA, 13 nt, Human
ugccaagcuccaa

SEQ ID NO: 1442919 - RNA, 16 nt, Human
ugccacagcccuguca

SEQ ID NO: 1442920 - RNA, 14 nt, Human
ugccacagcccugu

SEQ ID NO: 1442921 - RNA, 12 nt, Human
ugccacagcccu

SEQ ID NO: 1442922 - RNA, 23 nt, Human
agcgcccugcagacccugcccuu

SEQ ID NO: 1442923 - RNA, 21 nt, Human
agcgcccugcagacccugccc

SEQ ID NO: 1442924 - RNA, 20 nt, Human
agcgcccugcagacccugcc

SEQ ID NO: 1442925 - RNA, 19 nt, Human
agcgcccugcagacccugc

SEQ ID NO: 1442926 - RNA, 18 nt, Human
agcgcccugcagacccug

SEQ ID NO: 1442927 - RNA, 17 nt, Human
agcgcccugcagacccu

SEQ ID NO: 1442928 - RNA, 16 nt, Human
agcgcccugcagaccc

SEQ ID NO: 1442929 - RNA, 19 nt, Human
ugcauuuaaaacagacacu

SEQ ID NO: 1442930 - RNA, 17 nt, Human
ugcauuuaaaacagaca

SEQ ID NO: 1442931 - RNA, 15 nt, Human
ugcauuuaaaacaga

SEQ ID NO: 1442932 - RNA, 13 nt, Human
ugcauugugcuuc

SEQ ID NO: 1442933 - RNA, 19 nt, Human
ugcauugugauuggccugu

SEQ ID NO: 1442934 - RNA, 12 nt, Human
ugcauugugcuu

SEQ ID NO: 1442935 - RNA, 17 nt, Human
ugcauugugauuggccu

SEQ ID NO: 1442936 - RNA, 15 nt, Human
ugcauugugcuucuu

SEQ ID NO: 1442937 - RNA, 22 nt, Human
ugcauuuaaaacagacacuggc

SEQ ID NO: 1442938 - RNA, 20 nt, Human
ugcauuuaaaacagacacug

SEQ ID NO: 1442939 - RNA, 16 nt, Human
ugcauuuaaaagauac

SEQ ID NO: 1442940 - RNA, 23 nt, Human
agccuucucuguucauuuccuca

SEQ ID NO: 1442941 - RNA, 22 nt, Human
agccuucucuguucauuuccuc

SEQ ID NO: 1442942 - RNA, 21 nt, Human
agccuucucuguucauuuccu

SEQ ID NO: 1442943 - RNA, 20 nt, Human
agccuucucuguucauuucc

SEQ ID NO: 1442944 - RNA, 19 nt, Human
agccuucucuguucauuuc

SEQ ID NO: 1442945 - RNA, 15 nt, Human
agccuucucuguuca

SEQ ID NO: 1442946 - RNA, 13 nt, Human
agccuugaacuuu

SEQ ID NO: 1442947 - RNA, 18 nt, Human
agccuuaaucagguccuc

SEQ ID NO: 1442948 - RNA, 19 nt, Human
agccugugacauacccccu

SEQ ID NO: 1442949 - RNA, 12 nt, Human
agccugugccuc

SEQ ID NO: 1442950 - RNA, 14 nt, Human
agcgcccugcagac

SEQ ID NO: 1442951 - RNA, 13 nt, Human
agcgcccugcaga

SEQ ID NO: 1442952 - RNA, 12 nt, Human
agcgcccugcag

SEQ ID NO: 1442953 - RNA, 23 nt, Human
agccuuggggauucuuccaucug

SEQ ID NO: 1442954 - RNA, 16 nt, Human
agccuuggggauucuu

SEQ ID NO: 1442955 - RNA, 19 nt, Human
agccuuggccucuuuccuc

SEQ ID NO: 1442956 - RNA, 12 nt, Human
agccuugcuugu

SEQ ID NO: 1442957 - RNA, 17 nt, Human
agccugugaacccagga

SEQ ID NO: 1442958 - RNA, 15 nt, Human
agccugugaacccag

SEQ ID NO: 1442959 - RNA, 18 nt, Human
agccuguccugucaucau

SEQ ID NO: 1442960 - RNA, 14 nt, Human
agccuguccuguca

SEQ ID NO: 1442961 - RNA, 13 nt, Human
agccuguccuguc

SEQ ID NO: 1442962 - RNA, 12 nt, Human
agccuguccugu

SEQ ID NO: 1442963 - RNA, 20 nt, Human
agccuguccugccuguggcc

SEQ ID NO: 1442964 - RNA, 24 nt, Human
agccuguccugccuguggccauga

SEQ ID NO: 1442965 - RNA, 17 nt, Human
agccuguccugccugug

SEQ ID NO: 1442966 - RNA, 16 nt, Human
agccuguccugccugu

SEQ ID NO: 1442967 - RNA, 15 nt, Human
agccuguccugccug

SEQ ID NO: 1442968 - RNA, 14 nt, Human
agccuguccugccu

SEQ ID NO: 1442969 - RNA, 22 nt, Human
agccugucagauccaggagcuc

SEQ ID NO: 1442970 - RNA, 21 nt, Human
agccugucagauccaggagcu

SEQ ID NO: 1442971 - RNA, 20 nt, Human
agccugucagauccaggagc

SEQ ID NO: 1442972 - RNA, 22 nt, Human
agccuguaaacuuuaucacuua

SEQ ID NO: 1442973 - RNA, 22 nt, Human
agccugugacauacccccuccc

SEQ ID NO: 1442974 - RNA, 22 nt, Human
agccugugaacccaggacaagc

SEQ ID NO: 1442975 - RNA, 20 nt, Human
agccugugaacccaggacaa

SEQ ID NO: 1442976 - RNA, 19 nt, Human
agccugugaacccaggaca

SEQ ID NO: 1442977 - RNA, 18 nt, Human
agccugugaacccaggac

SEQ ID NO: 1442978 - RNA, 19 nt, Human
agccugaguacuccacacu

SEQ ID NO: 1442979 - RNA, 23 nt, Human
agccugaguagaaaggccuuuaa

SEQ ID NO: 1442980 - RNA, 19 nt, Human
agccugagucaccugcaga

SEQ ID NO: 1442981 - RNA, 16 nt, Human
agccugagucaccugc

SEQ ID NO: 1442982 - RNA, 17 nt, Human
agccugaguagaaaggc

SEQ ID NO: 1442983 - RNA, 22 nt, Human
agccugaguagaaaggccuuua

SEQ ID NO: 1442984 - RNA, 22 nt, Human
agccugaguacuccacacugca

SEQ ID NO: 1442985 - RNA, 13 nt, Human
agccugaguagaa

SEQ ID NO: 1442986 - RNA, 23 nt, Human
agccugagggaaaggccagcacu

SEQ ID NO: 1442987 - RNA, 22 nt, Human
agccugagggaaaggccagcac

SEQ ID NO: 1442988 - RNA, 21 nt, Human
agccugagggaaaggccagca

SEQ ID NO: 1442989 - RNA, 20 nt, Human
agccugagggaaaggccagc

SEQ ID NO: 1442990 - RNA, 19 nt, Human
agccugagggaaaggccag

SEQ ID NO: 1442991 - RNA, 15 nt, Human
agccugagggaaagg

SEQ ID NO: 1442992 - RNA, 14 nt, Human
agccugagggaaag

SEQ ID NO: 1442993 - RNA, 21 nt, Human
ugcauggcauccuccagcccc

SEQ ID NO: 1442994 - RNA, 20 nt, Human
ugcauggcauccuccagccc

SEQ ID NO: 1442995 - RNA, 18 nt, Human
ugcauggcauccuccagc

SEQ ID NO: 1442996 - RNA, 11 nt, Human
ugcauggcauc

SEQ ID NO: 1442997 - RNA, 23 nt, Human
ugcauggcagggggcugcugcug

SEQ ID NO: 1442998 - RNA, 22 nt, Human
ugcauggcagggggcugcugcu

SEQ ID NO: 1442999 - RNA, 21 nt, Human
ugcauggcagggggcugcugc

SEQ ID NO: 1443000 - RNA, 20 nt, Human
ugcauggcagggggcugcug

SEQ ID NO: 1443001 - RNA, 19 nt, Human
ugcauggcagggggcugcu

SEQ ID NO: 1443002 - RNA, 20 nt, Human
ugcauggauuucuuugaaaa

SEQ ID NO: 1443003 - RNA, 16 nt, Human
ugcauggauuucuuug

SEQ ID NO: 1443004 - RNA, 14 nt, Human
ugcauggauuucuu

SEQ ID NO: 1443005 - RNA, 19 nt, Human
ugcauggaaauucccuuca

SEQ ID NO: 1443006 - RNA, 23 nt, Human
ugcauggaaauucccuucaucug

SEQ ID NO: 1443007 - RNA, 21 nt, Human
ugcaucuagaggcuuccuuca

SEQ ID NO: 1443008 - RNA, 20 nt, Human
ugcaugaaguaauaugcaca

SEQ ID NO: 1443009 - RNA, 20 nt, Human
ugcaugcccagagacccagc

SEQ ID NO: 1443010 - RNA, 23 nt, Human
ugcaugcccagagacccagcgga

SEQ ID NO: 1443011 - RNA, 18 nt, Human
ugcaugcccagagaccca

SEQ ID NO: 1443012 - RNA, 14 nt, Human
ugcaugcccagaga

SEQ ID NO: 1443013 - RNA, 22 nt, Human
ugcaugcacuguucccccugug

SEQ ID NO: 1443014 - RNA, 19 nt, Human
ugcaugcacuguucccccu

SEQ ID NO: 1443015 - RNA, 11 nt, Human
ugcauggaaau

SEQ ID NO: 1443016 - RNA, 13 nt, Human
ugcaguaaaucuu

SEQ ID NO: 1443017 - RNA, 12 nt, Human
ugcagguuccca

SEQ ID NO: 1443018 - RNA, 20 nt, Human
ugcagguggccaaguuccuc

SEQ ID NO: 1443019 - RNA, 21 nt, Human
ugcaguaucaugcccugugca

SEQ ID NO: 1443020 - RNA, 16 nt, Human
ugcaguaucaugcccu

SEQ ID NO: 1443021 - RNA, 16 nt, Human
ugcauaccacuuuugu

SEQ ID NO: 1443022 - RNA, 18 nt, Human
ugcauaccacuuuuguuc

SEQ ID NO: 1443023 - RNA, 20 nt, Human
ugcauaccacuuuuguucuu

SEQ ID NO: 1443024 - RNA, 21 nt, Human
ugcauaccacuuuuguucuug

SEQ ID NO: 1443025 - RNA, 23 nt, Human
ugcauacuuuuuaaauguaaaga

SEQ ID NO: 1443026 - RNA, 22 nt, Human
ugcauacuuuuuaaauguaaag

SEQ ID NO: 1443027 - RNA, 19 nt, Human
ugcauacuuuuuaaaugua

SEQ ID NO: 1443028 - RNA, 18 nt, Human
ugcauacuuuuuaaaugu

SEQ ID NO: 1443029 - RNA, 17 nt, Human
ugcauagaauaaaauuu

SEQ ID NO: 1443030 - RNA, 17 nt, Human
agccucugucuggcaau

SEQ ID NO: 1443031 - RNA, 14 nt, Human
agccucugucuggc

SEQ ID NO: 1443032 - RNA, 20 nt, Human
agccucuccccugccugccc

SEQ ID NO: 1443033 - RNA, 21 nt, Human
agccucuccccugccugcccu

SEQ ID NO: 1443034 - RNA, 19 nt, Human
agccucuccccugccugcc

SEQ ID NO: 1443035 - RNA, 14 nt, Human
agccucuccccugc

SEQ ID NO: 1443036 - RNA, 20 nt, Human
ugcagccucagagacaucag

SEQ ID NO: 1443037 - RNA, 14 nt, Human
ugcagccucagaga

SEQ ID NO: 1443038 - RNA, 12 nt, Human
ugcagccucaga

SEQ ID NO: 1443039 - RNA, 22 nt, Human
ugcaggguccucuucugggccu

SEQ ID NO: 1443040 - RNA, 19 nt, Human
ugcaggguccucuucuggg

SEQ ID NO: 1443041 - RNA, 15 nt, Human
ugcaggguccucuuc

SEQ ID NO: 1443042 - RNA, 22 nt, Human
ugcagggggugugucugcucag

SEQ ID NO: 1443043 - RNA, 19 nt, Human
ugcagggggugugucugcu

SEQ ID NO: 1443044 - RNA, 21 nt, Human
ugcagccucaggacugggagc

SEQ ID NO: 1443045 - RNA, 22 nt, Human
ugcagccucaggacugggagcc

SEQ ID NO: 1443046 - RNA, 20 nt, Human
ugcagccucaggacugggag

SEQ ID NO: 1443047 - RNA, 19 nt, Human
ugcagccucaggacuggga

SEQ ID NO: 1443048 - RNA, 18 nt, Human
ugcagccucaggacuggg

SEQ ID NO: 1443049 - RNA, 17 nt, Human
ugcagccucaggacugg

SEQ ID NO: 1443050 - RNA, 16 nt, Human
ugcagccucaggacug

SEQ ID NO: 1443051 - RNA, 13 nt, Human
ugcagccucagga

SEQ ID NO: 1443052 - RNA, 13 nt, Human
ugcagguggggag

SEQ ID NO: 1443053 - RNA, 19 nt, Human
ugcagguggccaaguuccu

SEQ ID NO: 1443054 - RNA, 11 nt, Human
ugcaggucccu

SEQ ID NO: 1443055 - RNA, 22 nt, Human
ugcaggucccuaauaaagcugu

SEQ ID NO: 1443056 - RNA, 20 nt, Human
ugcagacaggaaucuuaagg

SEQ ID NO: 1443057 - RNA, 18 nt, Human
ugcagacaggaaucuuaa

SEQ ID NO: 1443058 - RNA, 16 nt, Human
ugcagacaggaaucuu

SEQ ID NO: 1443059 - RNA, 15 nt, Human
ugcagacaggaaucu

SEQ ID NO: 1443060 - RNA, 13 nt, Human
ugcagacaggaau

SEQ ID NO: 1443061 - RNA, 23 nt, Human
agccucuccccagguccagcucu

SEQ ID NO: 1443062 - RNA, 22 nt, Human
agccucuccccagguccagcuc

SEQ ID NO: 1443063 - RNA, 18 nt, Human
agccucuccccaggucca

SEQ ID NO: 1443064 - RNA, 16 nt, Human
agccucuccccagguc

SEQ ID NO: 1443065 - RNA, 23 nt, Human
agccucuagagcagacuacagcu

SEQ ID NO: 1443066 - RNA, 19 nt, Human
agccucuagagcagacuac

SEQ ID NO: 1443067 - RNA, 19 nt, Human
agccucgccccuggcagag

SEQ ID NO: 1443068 - RNA, 18 nt, Human
agccucgccccuggcaga

SEQ ID NO: 1443069 - RNA, 22 nt, Human
agccucuagagcagacuacagc

SEQ ID NO: 1443070 - RNA, 16 nt, Human
agccucuccacucaug

SEQ ID NO: 1443071 - RNA, 20 nt, Human
agccucgccccuggcagaga

SEQ ID NO: 1443072 - RNA, 16 nt, Human
agccucgccccuggca

SEQ ID NO: 1443073 - RNA, 15 nt, Human
agccucgccccuggc

SEQ ID NO: 1443074 - RNA, 14 nt, Human
agccucgccccugg

SEQ ID NO: 1443075 - RNA, 20 nt, Human
agccucgcccauccccuuga

SEQ ID NO: 1443076 - RNA, 23 nt, Human
agccucgcaacccgugccaaguc

SEQ ID NO: 1443077 - RNA, 21 nt, Human
agccucgcaacccgugccaag

SEQ ID NO: 1443078 - RNA, 19 nt, Human
agccucgcaacccgugcca

SEQ ID NO: 1443079 - RNA, 18 nt, Human
agccucgcaacccgugcc

SEQ ID NO: 1443080 - RNA, 16 nt, Human
agccuccuuucuggcu

SEQ ID NO: 1443081 - RNA, 17 nt, Human
agccuccuuagaaaaaa

SEQ ID NO: 1443082 - RNA, 13 nt, Human
agcaggugcugac

SEQ ID NO: 1443083 - RNA, 19 nt, Human
agcagggugggcuuguggg

SEQ ID NO: 1443084 - RNA, 23 nt, Human
agcagggcuacccugagcugagg

SEQ ID NO: 1443085 - RNA, 23 nt, Human
agcagggccggggaacuggccaa

SEQ ID NO: 1443086 - RNA, 22 nt, Human
agcagggccggggaacuggcca

SEQ ID NO: 1443087 - RNA, 14 nt, Human
agcagggccgggga

SEQ ID NO: 1443088 - RNA, 22 nt, Human
agcagggauuaaccucugcacu

SEQ ID NO: 1443089 - RNA, 21 nt, Human
agcagggauuaaccucugcac

SEQ ID NO: 1443090 - RNA, 20 nt, Human
agcagggauuaaccucugca

SEQ ID NO: 1443091 - RNA, 19 nt, Human
agcagggauuaaccucugc

SEQ ID NO: 1443092 - RNA, 16 nt, Human
agcagggacuguaaac

SEQ ID NO: 1443093 - RNA, 21 nt, Human
agcaggccuuuugauauuaaa

SEQ ID NO: 1443094 - RNA, 24 nt, Human
agcaggccacacuucaaacuacuu

SEQ ID NO: 1443095 - RNA, 18 nt, Human
agcaggccagguccagag

SEQ ID NO: 1443096 - RNA, 19 nt, Human
agcaggccagguccagaga

SEQ ID NO: 1443097 - RNA, 23 nt, Human
agcaggccagguccagagagacc

SEQ ID NO: 1443098 - RNA, 23 nt, Human
agcaggccacacuucaaacuacu

SEQ ID NO: 1443099 - RNA, 13 nt, Human
agcaggccacacu

SEQ ID NO: 1443100 - RNA, 19 nt, Human
agcaggcagccagcaucug

SEQ ID NO: 1443101 - RNA, 17 nt, Human
agcaggcagccagcauc

SEQ ID NO: 1443102 - RNA, 16 nt, Human
agcaggcagccagcau

SEQ ID NO: 1443103 - RNA, 15 nt, Human
agcaggcagccagca

SEQ ID NO: 1443104 - RNA, 14 nt, Human
agcaggcagccagc

SEQ ID NO: 1443105 - RNA, 12 nt, Human
agcaggcagcca

SEQ ID NO: 1443106 - RNA, 11 nt, Human
agcaggcagcc

SEQ ID NO: 1443107 - RNA, 21 nt, Human
agcaggaggggggagggaagg

SEQ ID NO: 1443108 - RNA, 16 nt, Human
agcaggaggggggagg

SEQ ID NO: 1443109 - RNA, 14 nt, Human
agcaggagggggga

SEQ ID NO: 1443110 - RNA, 16 nt, Human
agcaggaggccuagga

SEQ ID NO: 1443111 - RNA, 19 nt, Human
agcaggacugaugucuccu

SEQ ID NO: 1443112 - RNA, 22 nt, Human
agcaggacugaugucuccuaag

SEQ ID NO: 1443113 - RNA, 16 nt, Human
agcaggacugaugucu

SEQ ID NO: 1443114 - RNA, 22 nt, Human
agcaggacuccaggcccaaggc

SEQ ID NO: 1443115 - RNA, 23 nt, Human
agcaggacuccaggcccaaggcu

SEQ ID NO: 1443116 - RNA, 19 nt, Human
agcaggacuccaggcccaa

SEQ ID NO: 1443117 - RNA, 18 nt, Human
agcaggacuccaggccca

SEQ ID NO: 1443118 - RNA, 15 nt, Human
agcaggacuccaggc

SEQ ID NO: 1443119 - RNA, 14 nt, Human
agcaggacuccagg

SEQ ID NO: 1443120 - RNA, 17 nt, Human
agcaggaaugggaagga

SEQ ID NO: 1443121 - RNA, 19 nt, Human
agcagcaucucuaccuucu

SEQ ID NO: 1443122 - RNA, 20 nt, Human
agcaggaagcugugagagca

SEQ ID NO: 1443123 - RNA, 20 nt, Human
agcagcaucucuaccuucuc

SEQ ID NO: 1443124 - RNA, 11 nt, Human
agcagcaucuc

SEQ ID NO: 1443125 - RNA, 22 nt, Human
agcagcaggaggggggagggaa

SEQ ID NO: 1443126 - RNA, 21 nt, Human
agcagcaggaggggggaggga

SEQ ID NO: 1443127 - RNA, 18 nt, Human
agcagcaggaggggggag

SEQ ID NO: 1443128 - RNA, 17 nt, Human
agcagcaggagggggga

SEQ ID NO: 1443129 - RNA, 15 nt, Human
agcagcaggaggggg

SEQ ID NO: 1443130 - RNA, 13 nt, Human
agcagcagccucg

SEQ ID NO: 1443131 - RNA, 18 nt, Human
agcagcacuuauaaauca

SEQ ID NO: 1443132 - RNA, 15 nt, Human
agcagcacuuauaaa

SEQ ID NO: 1443133 - RNA, 14 nt, Human
agcagcacuuauaa

SEQ ID NO: 1443134 - RNA, 22 nt, Human
agcagcaccugcccuaccugcc

SEQ ID NO: 1443135 - RNA, 20 nt, Human
agcagcaccugcccuaccug

SEQ ID NO: 1443136 - RNA, 19 nt, Human
agcagcaccugcccuaccu

SEQ ID NO: 1443137 - RNA, 17 nt, Human
agcagcaccugcccuac

SEQ ID NO: 1443138 - RNA, 16 nt, Human
agcagcaccugcccua

SEQ ID NO: 1443139 - RNA, 14 nt, Human
agcagcaccugccc

SEQ ID NO: 1443140 - RNA, 21 nt, Human
agcagcaccuccucagccuga

SEQ ID NO: 1443141 - RNA, 20 nt, Human
agcagcaccuccucagccug

SEQ ID NO: 1443142 - RNA, 17 nt, Human
agcagcaccuccucagc

SEQ ID NO: 1443143 - RNA, 14 nt, Human
agcagcaccuccuc

SEQ ID NO: 1443144 - RNA, 13 nt, Human
agcagcaccuccu

SEQ ID NO: 1443145 - RNA, 20 nt, Human
agcagcaccguucugugcac

SEQ ID NO: 1443146 - RNA, 19 nt, Human
agcagcaccguucugugca

SEQ ID NO: 1443147 - RNA, 14 nt, Human
ugaguuacagaaau

SEQ ID NO: 1443148 - RNA, 19 nt, Human
ugaguguuuuaugagaaag

SEQ ID NO: 1443149 - RNA, 21 nt, Human
ugaguguuuuaugagaaagcc

SEQ ID NO: 1443150 - RNA, 17 nt, Human
ugaguuccagaaaguaa

SEQ ID NO: 1443151 - RNA, 18 nt, Human
ugaguuccagaaaguaaa

SEQ ID NO: 1443152 - RNA, 22 nt, Human
ugagugugcggcugugugugca

SEQ ID NO: 1443153 - RNA, 19 nt, Human
ugagugugcggcugugugu

SEQ ID NO: 1443154 - RNA, 13 nt, Human
ugauaauuuuaaa

SEQ ID NO: 1443155 - RNA, 14 nt, Human
ugauaauuuuaaau

SEQ ID NO: 1443156 - RNA, 14 nt, Human
ugauaauagauucu

SEQ ID NO: 1443157 - RNA, 15 nt, Human
ugauaauagauucuc

SEQ ID NO: 1443158 - RNA, 14 nt, Human
ugauacaaugcugu

SEQ ID NO: 1443159 - RNA, 15 nt, Human
ugauacaaugcugug

SEQ ID NO: 1443160 - RNA, 14 nt, Human
ugagugggaagccc

SEQ ID NO: 1443161 - RNA, 13 nt, Human
ugagugggaagcc

SEQ ID NO: 1443162 - RNA, 12 nt, Human
ugagugggaagc

SEQ ID NO: 1443163 - RNA, 12 nt, Human
ugaguggcccuu

SEQ ID NO: 1443164 - RNA, 21 nt, Human
ugaguggcaggggacaggagu

SEQ ID NO: 1443165 - RNA, 13 nt, Human
ugaguggcagggg

SEQ ID NO: 1443166 - RNA, 15 nt, Human
ugagugcaguccuga

SEQ ID NO: 1443167 - RNA, 21 nt, Human
ugagucagagccaugucuucu

SEQ ID NO: 1443168 - RNA, 21 nt, Human
ugaguaccccugcuuugggcu

SEQ ID NO: 1443169 - RNA, 19 nt, Human
ugaguaccccugcuuuggg

SEQ ID NO: 1443170 - RNA, 20 nt, Human
ugaguacguugugcauuugg

SEQ ID NO: 1443171 - RNA, 22 nt, Human
ugagucacccuaccugugccug

SEQ ID NO: 1443172 - RNA, 20 nt, Human
ugagucacccuaccugugcc

SEQ ID NO: 1443173 - RNA, 15 nt, Human
agcaguuugaaauug

SEQ ID NO: 1443174 - RNA, 20 nt, Human
agcaguuugguuucuagcau

SEQ ID NO: 1443175 - RNA, 22 nt, Human
agcaguuugguuucuagcauga

SEQ ID NO: 1443176 - RNA, 23 nt, Human
agcaguuugguuucuagcaugaa

SEQ ID NO: 1443177 - RNA, 22 nt, Human
agcaguccuuggccugcuaagg

SEQ ID NO: 1443178 - RNA, 17 nt, Human
agcagucgugccugugu

SEQ ID NO: 1443179 - RNA, 16 nt, Human
agcagucgugccugug

SEQ ID NO: 1443180 - RNA, 14 nt, Human
agcagucgugccug

SEQ ID NO: 1443181 - RNA, 18 nt, Human
agcaguccuuggccugcu

SEQ ID NO: 1443182 - RNA, 16 nt, Human
agcaguccuuggccug

SEQ ID NO: 1443183 - RNA, 15 nt, Human
agcaguccuuggccu

SEQ ID NO: 1443184 - RNA, 13 nt, Human
agcaguccuuggc

SEQ ID NO: 1443185 - RNA, 12 nt, Human
agcaguccuugg

SEQ ID NO: 1443186 - RNA, 22 nt, Human
agcaguccccuucccuccaaga

SEQ ID NO: 1443187 - RNA, 18 nt, Human
agcaguccccuucccucc

SEQ ID NO: 1443188 - RNA, 16 nt, Human
agcaguccccuucccu

SEQ ID NO: 1443189 - RNA, 15 nt, Human
agcaguccccuuccc

SEQ ID NO: 1443190 - RNA, 19 nt, Human
agcagucaggaaagagaac

SEQ ID NO: 1443191 - RNA, 18 nt, Human
agcagguucccaagcuca

SEQ ID NO: 1443192 - RNA, 17 nt, Human
agcagguucccaagcuc

SEQ ID NO: 1443193 - RNA, 16 nt, Human
agcagguucccaagcu

SEQ ID NO: 1443194 - RNA, 14 nt, Human
agcagguucuuguu

SEQ ID NO: 1443195 - RNA, 23 nt, Human
agcagguucccaagcucagaggc

SEQ ID NO: 1443196 - RNA, 14 nt, Human
agcagguuucaagg

SEQ ID NO: 1443197 - RNA, 12 nt, Human
agcaguauuuuu

SEQ ID NO: 1443198 - RNA, 18 nt, Human
agcagucaggaaagagaa

SEQ ID NO: 1443199 - RNA, 17 nt, Human
agcagucaggaaagaga

SEQ ID NO: 1443200 - RNA, 17 nt, Human
agcauaaaagaugaaag

SEQ ID NO: 1443201 - RNA, 23 nt, Human
agcauaaaagaugaaagagcagu

SEQ ID NO: 1443202 - RNA, 15 nt, Human
agcauaaaagaugaa

SEQ ID NO: 1443203 - RNA, 23 nt, Human
agcauaggugauccauguaacug

SEQ ID NO: 1443204 - RNA, 20 nt, Human
agcauaggugauccauguaa

SEQ ID NO: 1443205 - RNA, 23 nt, Human
ugaguacagaguguggacucugg

SEQ ID NO: 1443206 - RNA, 19 nt, Human
ugaguaaugguguagaaca

SEQ ID NO: 1443207 - RNA, 17 nt, Human
ugaguaauuuuggauuu

SEQ ID NO: 1443208 - RNA, 18 nt, Human
ugaguaaugguguagaac

SEQ ID NO: 1443209 - RNA, 17 nt, Human
ugaguaaugguguagaa

SEQ ID NO: 1443210 - RNA, 15 nt, Human
ugaguaaugguguag

SEQ ID NO: 1443211 - RNA, 15 nt, Human
agcauaucugccuuu

SEQ ID NO: 1443212 - RNA, 16 nt, Human
agcauaucugccuuua

SEQ ID NO: 1443213 - RNA, 15 nt, Human
agcauauagauuguc

SEQ ID NO: 1443214 - RNA, 13 nt, Human
agcauaucugccu

SEQ ID NO: 1443215 - RNA, 16 nt, Human
ugaguacguugugcau

SEQ ID NO: 1443216 - RNA, 17 nt, Human
ugaguacguugugcauu

SEQ ID NO: 1443217 - RNA, 18 nt, Human
ugaguacguugugcauuu

SEQ ID NO: 1443218 - RNA, 19 nt, Human
ugaguacguugugcauuug

SEQ ID NO: 1443219 - RNA, 21 nt, Human
agcauucagaagaaaaagaag

SEQ ID NO: 1443220 - RNA, 19 nt, Human
agcauucagaagaaaaaga

SEQ ID NO: 1443221 - RNA, 17 nt, Human
agcauucagaagaaaaa

SEQ ID NO: 1443222 - RNA, 15 nt, Human
agcauucagaagaaa

SEQ ID NO: 1443223 - RNA, 14 nt, Human
agcauucagaagaa

SEQ ID NO: 1443224 - RNA, 18 nt, Human
agcauucacaacuuguuu

SEQ ID NO: 1443225 - RNA, 22 nt, Human
agcauggucccacaucccuggg

SEQ ID NO: 1443226 - RNA, 23 nt, Human
agcauggucccacaucccugggc

SEQ ID NO: 1443227 - RNA, 21 nt, Human
agcauggucccacaucccugg

SEQ ID NO: 1443228 - RNA, 19 nt, Human
agcauucccagguaggcca

SEQ ID NO: 1443229 - RNA, 13 nt, Human
agcauucccaggu

SEQ ID NO: 1443230 - RNA, 12 nt, Human
agcauucccagg

SEQ ID NO: 1443231 - RNA, 20 nt, Human
agcauuccagccccucuggu

SEQ ID NO: 1443232 - RNA, 19 nt, Human
agcauuccagccccucugg

SEQ ID NO: 1443233 - RNA, 16 nt, Human
agcauuccagccccuc

SEQ ID NO: 1443234 - RNA, 12 nt, Human
agcauucugucu

SEQ ID NO: 1443235 - RNA, 22 nt, Human
agcauucucauuggaaauuuag

SEQ ID NO: 1443236 - RNA, 14 nt, Human
agcauucucauugg

SEQ ID NO: 1443237 - RNA, 23 nt, Human
agcauuuaaccccccuguacaca

SEQ ID NO: 1443238 - RNA, 22 nt, Human
agcauuuaaccccccuguacac

SEQ ID NO: 1443239 - RNA, 21 nt, Human
agcauuuaaccccccuguaca

SEQ ID NO: 1443240 - RNA, 22 nt, Human
agcauuuagauguauagguuga

SEQ ID NO: 1443241 - RNA, 22 nt, Human
agccaaaauguaggcuuaguuu

SEQ ID NO: 1443242 - RNA, 17 nt, Human
agccaaaauguaggcuu

SEQ ID NO: 1443243 - RNA, 22 nt, Human
agccaaaaauagcuaaauaccu

SEQ ID NO: 1443244 - RNA, 18 nt, Human
agccaaaaauagcuaaau

SEQ ID NO: 1443245 - RNA, 15 nt, Human
agccaaaaauagcua

SEQ ID NO: 1443246 - RNA, 14 nt, Human
agccaaaaauagcu

SEQ ID NO: 1443247 - RNA, 17 nt, Human
agcauuuuguaaguuga

SEQ ID NO: 1443248 - RNA, 13 nt, Human
agcauuuuguaau

SEQ ID NO: 1443249 - RNA, 21 nt, Human
agcauuugacccuugcuguga

SEQ ID NO: 1443250 - RNA, 16 nt, Human
agcauuugucaacaaa

SEQ ID NO: 1443251 - RNA, 15 nt, Human
agcauuuagaaaacu

SEQ ID NO: 1443252 - RNA, 17 nt, Human
agcauuugaaugcauuu

SEQ ID NO: 1443253 - RNA, 17 nt, Human
agcauuuguuucuacuu

SEQ ID NO: 1443254 - RNA, 19 nt, Human
agcauuuguuucuacuuug

SEQ ID NO: 1443255 - RNA, 14 nt, Human
agcauuuguuucua

SEQ ID NO: 1443256 - RNA, 18 nt, Human
agcauuuguguugaagag

SEQ ID NO: 1443257 - RNA, 17 nt, Human
agcauuuguguugaaga

SEQ ID NO: 1443258 - RNA, 15 nt, Human
ugauaccccccucug

SEQ ID NO: 1443259 - RNA, 14 nt, Human
ugauaccagcugga

SEQ ID NO: 1443260 - RNA, 14 nt, Human
ugauacauuuuugu

SEQ ID NO: 1443261 - RNA, 22 nt, Human
ugauacauccaaagcagacagc

SEQ ID NO: 1443262 - RNA, 16 nt, Human
ugauacauccaaagca

SEQ ID NO: 1443263 - RNA, 18 nt, Human
ugauacaaugcugugccc

SEQ ID NO: 1443264 - RNA, 15 nt, Human
ugauacgaugcuuca

SEQ ID NO: 1443265 - RNA, 19 nt, Human
ugauaccccccucugucuu

SEQ ID NO: 1443266 - RNA, 18 nt, Human
ugauaccccccucugucu

SEQ ID NO: 1443267 - RNA, 17 nt, Human
ugauaccccccucuguc

SEQ ID NO: 1443268 - RNA, 22 nt, Human
ugaucaauuauaguuucugagg

SEQ ID NO: 1443269 - RNA, 20 nt, Human
ugaucaauuauaguuucuga

SEQ ID NO: 1443270 - RNA, 18 nt, Human
ugaucaauuauaguuucu

SEQ ID NO: 1443271 - RNA, 21 nt, Human
ugaucaauuauaguuucugag

SEQ ID NO: 1443272 - RNA, 17 nt, Human
ugaucaccgacugaaaa

SEQ ID NO: 1443273 - RNA, 19 nt, Human
ugaucaccgacugaaaaua

SEQ ID NO: 1443274 - RNA, 13 nt, Human
agcaucaugccuc

SEQ ID NO: 1443275 - RNA, 22 nt, Human
agcaucaggguuaagaagacuu

SEQ ID NO: 1443276 - RNA, 21 nt, Human
agcauccgcaggugcuggucc

SEQ ID NO: 1443277 - RNA, 18 nt, Human
agcauccccuugaacucu

SEQ ID NO: 1443278 - RNA, 16 nt, Human
agcauccgcaggugcu

SEQ ID NO: 1443279 - RNA, 13 nt, Human
agcauccuggaau

SEQ ID NO: 1443280 - RNA, 15 nt, Human
agcauccuggaauau

SEQ ID NO: 1443281 - RNA, 14 nt, Human
agcauccuggaaua

SEQ ID NO: 1443282 - RNA, 22 nt, Human
agcaucauuauuuauguauugu

SEQ ID NO: 1443283 - RNA, 21 nt, Human
agcaucauuauuuauguauug

SEQ ID NO: 1443284 - RNA, 19 nt, Human
agcaucauuauuuauguau

SEQ ID NO: 1443285 - RNA, 18 nt, Human
agcaucauuauuuaugua

SEQ ID NO: 1443286 - RNA, 23 nt, Human
agcaucaugccucugaggccagc

SEQ ID NO: 1443287 - RNA, 22 nt, Human
agcaucaugccucugaggccag

SEQ ID NO: 1443288 - RNA, 21 nt, Human
agcaucaugccucugaggcca

SEQ ID NO: 1443289 - RNA, 19 nt, Human
agcaucaugccucugaggc

SEQ ID NO: 1443290 - RNA, 18 nt, Human
agcaucaugccucugagg

SEQ ID NO: 1443291 - RNA, 16 nt, Human
agcaucaugccucuga

SEQ ID NO: 1443292 - RNA, 15 nt, Human
agcaucaugccucug

SEQ ID NO: 1443293 - RNA, 20 nt, Human
agcauccccuugaacucuuc

SEQ ID NO: 1443294 - RNA, 17 nt, Human
agcauccccuugaacuc

SEQ ID NO: 1443295 - RNA, 15 nt, Human
agcaucccucaccca

SEQ ID NO: 1443296 - RNA, 14 nt, Human
agccaccaguucuc

SEQ ID NO: 1443297 - RNA, 12 nt, Human
agccaccaguuc

SEQ ID NO: 1443298 - RNA, 20 nt, Human
agccacacuucucaggacac

SEQ ID NO: 1443299 - RNA, 23 nt, Human
agccacacuucucaggacacagg

SEQ ID NO: 1443300 - RNA, 19 nt, Human
agccacacuucucaggaca

SEQ ID NO: 1443301 - RNA, 18 nt, Human
agccacacuucucaggac

SEQ ID NO: 1443302 - RNA, 17 nt, Human
agccacacuucucagga

SEQ ID NO: 1443303 - RNA, 17 nt, Human
agccacaccaggauaga

SEQ ID NO: 1443304 - RNA, 24 nt, Human
agccacaccaggauagagacugga

SEQ ID NO: 1443305 - RNA, 14 nt, Human
agccacaccaggau

SEQ ID NO: 1443306 - RNA, 13 nt, Human
agccacaccagga

SEQ ID NO: 1443307 - RNA, 18 nt, Human
agccaauucagacaggca

SEQ ID NO: 1443308 - RNA, 17 nt, Human
agccaauucagacaggc

SEQ ID NO: 1443309 - RNA, 16 nt, Human
agccaauucagacagg

SEQ ID NO: 1443310 - RNA, 20 nt, Human
agccaauuauguuaaacuag

SEQ ID NO: 1443311 - RNA, 16 nt, Human
agccaauuauguuaaa

SEQ ID NO: 1443312 - RNA, 17 nt, Human
agccaauuauguuaaac

SEQ ID NO: 1443313 - RNA, 23 nt, Human
agccaaucccucaccuucugagu

SEQ ID NO: 1443314 - RNA, 15 nt, Human
agccaauuauguuaa

SEQ ID NO: 1443315 - RNA, 17 nt, Human
agccaaaccucaccaac

SEQ ID NO: 1443316 - RNA, 15 nt, Human
agccaaaccucacca

SEQ ID NO: 1443317 - RNA, 21 nt, Human
agccaaacauauauauacuau

SEQ ID NO: 1443318 - RNA, 19 nt, Human
ugaucccuguguugucucu

SEQ ID NO: 1443319 - RNA, 19 nt, Human
ugaucccagagagcccgag

SEQ ID NO: 1443320 - RNA, 20 nt, Human
ugaucccuguguugucucua

SEQ ID NO: 1443321 - RNA, 15 nt, Human
ugauccauguaacug

SEQ ID NO: 1443322 - RNA, 13 nt, Human
ugauccagaaaga

SEQ ID NO: 1443323 - RNA, 16 nt, Human
agccaccccaugcugg

SEQ ID NO: 1443324 - RNA, 19 nt, Human
agccaccccaugcuggccu

SEQ ID NO: 1443325 - RNA, 23 nt, Human
ugauccagaaagaaaacuuguau

SEQ ID NO: 1443326 - RNA, 13 nt, Human
agccaccccugag

SEQ ID NO: 1443327 - RNA, 21 nt, Human
ugauccauuucuaauuaugua

SEQ ID NO: 1443328 - RNA, 18 nt, Human
ugauccauuucuaauuau

SEQ ID NO: 1443329 - RNA, 17 nt, Human
ugauccauuucuaauua

SEQ ID NO: 1443330 - RNA, 16 nt, Human
ugauccauuucuaauu

SEQ ID NO: 1443331 - RNA, 15 nt, Human
ugauccauuucuaau

SEQ ID NO: 1443332 - RNA, 14 nt, Human
ugauccauuucuaa

SEQ ID NO: 1443333 - RNA, 20 nt, Human
ugauccauguaacugccuag

SEQ ID NO: 1443334 - RNA, 19 nt, Human
ugauccauguaacugccua

SEQ ID NO: 1443335 - RNA, 18 nt, Human
ugauccauguaacugccu

SEQ ID NO: 1443336 - RNA, 17 nt, Human
ugauccauguaacugcc

SEQ ID NO: 1443337 - RNA, 20 nt, Human
ugaucuacuucuguaauugu

SEQ ID NO: 1443338 - RNA, 18 nt, Human
ugaucuacuucuguaauu

SEQ ID NO: 1443339 - RNA, 17 nt, Human
ugauggcuuaugauagc

SEQ ID NO: 1443340 - RNA, 17 nt, Human
ugauggcaauuuuguaa

SEQ ID NO: 1443341 - RNA, 15 nt, Human
ugauggcaauuuugu

SEQ ID NO: 1443342 - RNA, 23 nt, Human
ugauggcaacagaucuggaaccu

SEQ ID NO: 1443343 - RNA, 20 nt, Human
ugauggcagccauagugcau

SEQ ID NO: 1443344 - RNA, 19 nt, Human
ugauggcaacagaucugga

SEQ ID NO: 1443345 - RNA, 18 nt, Human
ugauggcaacagaucugg

SEQ ID NO: 1443346 - RNA, 21 nt, Human
ugaucuacuucuguaauugug

SEQ ID NO: 1443347 - RNA, 16 nt, Human
ugauggcaacagaucu

SEQ ID NO: 1443348 - RNA, 17 nt, Human
ugauuaaauaagauucu

SEQ ID NO: 1443349 - RNA, 21 nt, Human
ugauguuuuaaggaugcuugu

SEQ ID NO: 1443350 - RNA, 22 nt, Human
ugauuaaauaagauucuaacgg

SEQ ID NO: 1443351 - RNA, 20 nt, Human
ugauuaaauaagauucuaac

SEQ ID NO: 1443352 - RNA, 19 nt, Human
ugauuaaauaagauucuaa

SEQ ID NO: 1443353 - RNA, 18 nt, Human
ugauuaaauaagauucua

SEQ ID NO: 1443354 - RNA, 17 nt, Human
ugauuaaauucuugcaa

SEQ ID NO: 1443355 - RNA, 13 nt, Human
ugauuaaauucuu

SEQ ID NO: 1443356 - RNA, 16 nt, Human
ugauuaaauucuugca

SEQ ID NO: 1443357 - RNA, 16 nt, Human
ugauuaaguaaugaua

SEQ ID NO: 1443358 - RNA, 14 nt, Human
ugauuaaaugacac

SEQ ID NO: 1443359 - RNA, 13 nt, Human
ugauuaaaugaca

SEQ ID NO: 1443360 - RNA, 15 nt, Human
ugauuaaguaaugau

SEQ ID NO: 1443361 - RNA, 18 nt, Human
aggacugauuucagagug

SEQ ID NO: 1443362 - RNA, 20 nt, Human
aggacugaugucuccuaagc

SEQ ID NO: 1443363 - RNA, 17 nt, Human
aggacugaugucuccua

SEQ ID NO: 1443364 - RNA, 16 nt, Human
aggacugaugucuccu

SEQ ID NO: 1443365 - RNA, 22 nt, Human
aggacugggagcccccagccug

SEQ ID NO: 1443366 - RNA, 21 nt, Human
aggacugggagcccccagccu

SEQ ID NO: 1443367 - RNA, 20 nt, Human
aggacugggagcccccagcc

SEQ ID NO: 1443368 - RNA, 19 nt, Human
aggacugggagcccccagc

SEQ ID NO: 1443369 - RNA, 18 nt, Human
aggacugggagcccccag

SEQ ID NO: 1443370 - RNA, 16 nt, Human
aggacugggagccccc

SEQ ID NO: 1443371 - RNA, 20 nt, Human
aggacugcugguuuguaguu

SEQ ID NO: 1443372 - RNA, 23 nt, Human
aggacugggagcccccagccugu

SEQ ID NO: 1443373 - RNA, 22 nt, Human
aggacuuccuguccagcuccaa

SEQ ID NO: 1443374 - RNA, 16 nt, Human
aggagaugcuccuugg

SEQ ID NO: 1443375 - RNA, 15 nt, Human
aggacugaugucucc

SEQ ID NO: 1443376 - RNA, 22 nt, Human
aggagauccagggcaaggccau

SEQ ID NO: 1443377 - RNA, 13 nt, Human
aggacuugcccuc

SEQ ID NO: 1443378 - RNA, 16 nt, Human
aggacuugaaagaaau

SEQ ID NO: 1443379 - RNA, 13 nt, Human
aggacuugaaaga

SEQ ID NO: 1443380 - RNA, 22 nt, Human
aggagaugcuccuugggcccuu

SEQ ID NO: 1443381 - RNA, 18 nt, Human
aggagaugcuccuugggc

SEQ ID NO: 1443382 - RNA, 17 nt, Human
aggagaugcuccuuggg

SEQ ID NO: 1443383 - RNA, 12 nt, Human
aggagcccccac

SEQ ID NO: 1443384 - RNA, 21 nt, Human
aggagccccauuccugggaaa

SEQ ID NO: 1443385 - RNA, 19 nt, Human
aggagccccauuccuggga

SEQ ID NO: 1443386 - RNA, 18 nt, Human
aggagccccauuccuggg

SEQ ID NO: 1443387 - RNA, 16 nt, Human
aggagccccauuccug

SEQ ID NO: 1443388 - RNA, 15 nt, Human
aggagccccauuccu

SEQ ID NO: 1443389 - RNA, 14 nt, Human
aggagccccagcua

SEQ ID NO: 1443390 - RNA, 22 nt, Human
aggagcccaggccaggacucug

SEQ ID NO: 1443391 - RNA, 20 nt, Human
aggagcccaggccaggacuc

SEQ ID NO: 1443392 - RNA, 19 nt, Human
aggagcccaggccaggacu

SEQ ID NO: 1443393 - RNA, 18 nt, Human
aggagcccaggccaggac

SEQ ID NO: 1443394 - RNA, 17 nt, Human
aggagcccaggccagga

SEQ ID NO: 1443395 - RNA, 16 nt, Human
aggagcccaggccagg

SEQ ID NO: 1443396 - RNA, 15 nt, Human
aggagcccaggccag

SEQ ID NO: 1443397 - RNA, 14 nt, Human
aggagcccaggcca

SEQ ID NO: 1443398 - RNA, 13 nt, Human
aggagcccaggcc

SEQ ID NO: 1443399 - RNA, 10 nt, Human
aggagcccag

SEQ ID NO: 1443400 - RNA, 23 nt, Human
aggagcacggcucuguccccagc

SEQ ID NO: 1443401 - RNA, 15 nt, Human
aggagcacggcucug

SEQ ID NO: 1443402 - RNA, 20 nt, Human
aggagcagcaggagggggga

SEQ ID NO: 1443403 - RNA, 16 nt, Human
aggagcacggcucugu

SEQ ID NO: 1443404 - RNA, 22 nt, Human
aggagcccccacccuguuccug

SEQ ID NO: 1443405 - RNA, 19 nt, Human
aggagcccccacccuguuc

SEQ ID NO: 1443406 - RNA, 23 nt, Human
aggagcccuucuauacccaccca

SEQ ID NO: 1443407 - RNA, 17 nt, Human
aggacucugcagccuca

SEQ ID NO: 1443408 - RNA, 19 nt, Human
aggacucugcagccucaga

SEQ ID NO: 1443409 - RNA, 16 nt, Human
aggacucugcagccuc

SEQ ID NO: 1443410 - RNA, 15 nt, Human
aggacucugcagccu

SEQ ID NO: 1443411 - RNA, 14 nt, Human
aggacucugcagcc

SEQ ID NO: 1443412 - RNA, 13 nt, Human
aggacucugcagc

SEQ ID NO: 1443413 - RNA, 12 nt, Human
aggacucucagg

SEQ ID NO: 1443414 - RNA, 17 nt, Human
aggacuccugaaaaaaa

SEQ ID NO: 1443415 - RNA, 14 nt, Human
aggacuccugaaaa

SEQ ID NO: 1443416 - RNA, 21 nt, Human
aggacuccuccuuuuuccaug

SEQ ID NO: 1443417 - RNA, 17 nt, Human
aggacuccuuaaauuug

SEQ ID NO: 1443418 - RNA, 19 nt, Human
aggacuccuccuuuuucca

SEQ ID NO: 1443419 - RNA, 20 nt, Human
aggacuccaggcccaaggcu

SEQ ID NO: 1443420 - RNA, 23 nt, Human
aggacuccaggcccaaggcuccc

SEQ ID NO: 1443421 - RNA, 16 nt, Human
aggacuccaggcccaa

SEQ ID NO: 1443422 - RNA, 15 nt, Human
aggacuccaggccca

SEQ ID NO: 1443423 - RNA, 13 nt, Human
aggacuaauagaa

SEQ ID NO: 1443424 - RNA, 14 nt, Human
aggacuaaccaugu

SEQ ID NO: 1443425 - RNA, 23 nt, Human
aggacuaacacucagaagccugg

SEQ ID NO: 1443426 - RNA, 22 nt, Human
aggacuaacacucagaagccug

SEQ ID NO: 1443427 - RNA, 21 nt, Human
aggacuaacacucagaagccu

SEQ ID NO: 1443428 - RNA, 20 nt, Human
aggacuaacacucagaagcc

SEQ ID NO: 1443429 - RNA, 18 nt, Human
aggacuaacacucagaag

SEQ ID NO: 1443430 - RNA, 17 nt, Human
aggacuaacacucagaa

SEQ ID NO: 1443431 - RNA, 14 nt, Human
aggacguacguaau

SEQ ID NO: 1443432 - RNA, 17 nt, Human
aggacucaccacugccc

SEQ ID NO: 1443433 - RNA, 20 nt, Human
aggacuauauuugggccugc

SEQ ID NO: 1443434 - RNA, 17 nt, Human
aggacuaauagaaaagu

SEQ ID NO: 1443435 - RNA, 14 nt, Human
aggacgcacugagc

SEQ ID NO: 1443436 - RNA, 22 nt, Human
aggaccuuuccaccacagccag

SEQ ID NO: 1443437 - RNA, 21 nt, Human
aggaccuuuccaccacagcca

SEQ ID NO: 1443438 - RNA, 20 nt, Human
aggaccuucgggcugugccc

SEQ ID NO: 1443439 - RNA, 19 nt, Human
aggaccuucgggcugugcc

SEQ ID NO: 1443440 - RNA, 18 nt, Human
aggaccuucgggcugugc

SEQ ID NO: 1443441 - RNA, 16 nt, Human
aggacacaggccugug

SEQ ID NO: 1443442 - RNA, 15 nt, Human
aggacacaggccugu

SEQ ID NO: 1443443 - RNA, 14 nt, Human
aggacacaggccug

SEQ ID NO: 1443444 - RNA, 13 nt, Human
aggacacaggccu

SEQ ID NO: 1443445 - RNA, 12 nt, Human
aggacacaggcc

SEQ ID NO: 1443446 - RNA, 11 nt, Human
aggacacaggc

SEQ ID NO: 1443447 - RNA, 13 nt, Human
aggacaagcaugg

SEQ ID NO: 1443448 - RNA, 20 nt, Human
aggauugcgagagaugugug

SEQ ID NO: 1443449 - RNA, 19 nt, Human
aggauugcgagagaugugu

SEQ ID NO: 1443450 - RNA, 18 nt, Human
aggauugcgagagaugug

SEQ ID NO: 1443451 - RNA, 17 nt, Human
aggauugcgagagaugu

SEQ ID NO: 1443452 - RNA, 16 nt, Human
aggauugcgagagaug

SEQ ID NO: 1443453 - RNA, 15 nt, Human
aggauugcgagagau

SEQ ID NO: 1443454 - RNA, 24 nt, Human
aggauugaaaauguccaggaaagu

SEQ ID NO: 1443455 - RNA, 21 nt, Human
aggauugaaaauguccaggaa

SEQ ID NO: 1443456 - RNA, 22 nt, Human
aggaugcacagaguuguuacau

SEQ ID NO: 1443457 - RNA, 21 nt, Human
aggauaucggcauuuguuucu

SEQ ID NO: 1443458 - RNA, 17 nt, Human
aggauaucggcauuugu

SEQ ID NO: 1443459 - RNA, 15 nt, Human
aggaucaguuaacua

SEQ ID NO: 1443460 - RNA, 23 nt, Human
aggaucaguuaacuauugcauuu

SEQ ID NO: 1443461 - RNA, 20 nt, Human
aggaucauuuguuggaauga

SEQ ID NO: 1443462 - RNA, 17 nt, Human
aggaucaguuaacuauu

SEQ ID NO: 1443463 - RNA, 18 nt, Human
aggaugaagggcccgaga

SEQ ID NO: 1443464 - RNA, 21 nt, Human
aggaucauuuguuggaaugaa

SEQ ID NO: 1443465 - RNA, 11 nt, Human
aggauccaggc

SEQ ID NO: 1443466 - RNA, 22 nt, Human
aggauagaugcuggcccagggc

SEQ ID NO: 1443467 - RNA, 21 nt, Human
aggauagaugcuggcccaggg

SEQ ID NO: 1443468 - RNA, 20 nt, Human
aggauagaugcuggcccagg

SEQ ID NO: 1443469 - RNA, 19 nt, Human
aggauagaugcuggcccag

SEQ ID NO: 1443470 - RNA, 18 nt, Human
aggauagaugcuggccca

SEQ ID NO: 1443471 - RNA, 15 nt, Human
aggauagaugcuggc

SEQ ID NO: 1443472 - RNA, 19 nt, Human
aggaggcuccagagggcac

SEQ ID NO: 1443473 - RNA, 18 nt, Human
aggaggcuccagagggca

SEQ ID NO: 1443474 - RNA, 17 nt, Human
aggaggcuccagagggc

SEQ ID NO: 1443475 - RNA, 16 nt, Human
aggaggcuccagaggg

SEQ ID NO: 1443476 - RNA, 13 nt, Human
aggaggcuccaga

SEQ ID NO: 1443477 - RNA, 20 nt, Human
aggaggcuaugcucaggggc

SEQ ID NO: 1443478 - RNA, 21 nt, Human
aggaggcuaugcucaggggcc

SEQ ID NO: 1443479 - RNA, 23 nt, Human
aggaggcuaugcucaggggcccu

SEQ ID NO: 1443480 - RNA, 20 nt, Human
aggaggagccuguccugccu

SEQ ID NO: 1443481 - RNA, 14 nt, Human
aggaggagccuguc

SEQ ID NO: 1443482 - RNA, 13 nt, Human
aggaggagccugu

SEQ ID NO: 1443483 - RNA, 18 nt, Human
aggaggacccagggcucu

SEQ ID NO: 1443484 - RNA, 18 nt, Human
uggaagccagcuuucccu

SEQ ID NO: 1443485 - RNA, 16 nt, Human
uggaagccagcuuucc

SEQ ID NO: 1443486 - RNA, 15 nt, Human
uggaagccagcuuuc

SEQ ID NO: 1443487 - RNA, 15 nt, Human
aggaggaauacugaa

SEQ ID NO: 1443488 - RNA, 18 nt, Human
aggaggaauacugaacau

SEQ ID NO: 1443489 - RNA, 14 nt, Human
aggaggaauacuga

SEQ ID NO: 1443490 - RNA, 21 nt, Human
aggaggaauaagcucccaggg

SEQ ID NO: 1443491 - RNA, 17 nt, Human
aggaggaaaucccuuca

SEQ ID NO: 1443492 - RNA, 12 nt, Human
aggaggacccag

SEQ ID NO: 1443493 - RNA, 13 nt, Human
aggaggacccagg

SEQ ID NO: 1443494 - RNA, 14 nt, Human
aggaggacccagga

SEQ ID NO: 1443495 - RNA, 15 nt, Human
aggaggacccaggac

SEQ ID NO: 1443496 - RNA, 16 nt, Human
aggaggacccaggaca

SEQ ID NO: 1443497 - RNA, 17 nt, Human
aggaggacccaggacag

SEQ ID NO: 1443498 - RNA, 17 nt, Human
aggaggacccagggcuc

SEQ ID NO: 1443499 - RNA, 16 nt, Human
aggaggacccagggcu

SEQ ID NO: 1443500 - RNA, 18 nt, Human
aggaggacccaggacagg

SEQ ID NO: 1443501 - RNA, 22 nt, Human
ugcuuugugauuuuuguaauuu

SEQ ID NO: 1443502 - RNA, 18 nt, Human
ugcuuuggaccuaaaugg

SEQ ID NO: 1443503 - RNA, 13 nt, Human
ugcuugaggaaaa

SEQ ID NO: 1443504 - RNA, 16 nt, Human
ugcuugaggaaaacaa

SEQ ID NO: 1443505 - RNA, 12 nt, Human
ugcuugaggaaa

SEQ ID NO: 1443506 - RNA, 15 nt, Human
ugcuuugggaagccg

SEQ ID NO: 1443507 - RNA, 23 nt, Human
ugcuuuggaccuaaauggccuca

SEQ ID NO: 1443508 - RNA, 22 nt, Human
ugcuuuggaccuaaauggccuc

SEQ ID NO: 1443509 - RNA, 21 nt, Human
ugcuuuggaccuaaauggccu

SEQ ID NO: 1443510 - RNA, 20 nt, Human
uggaagagcagcaccuccuc

SEQ ID NO: 1443511 - RNA, 16 nt, Human
uggaagagcagcaccu

SEQ ID NO: 1443512 - RNA, 17 nt, Human
uggaagacgcaagggcc

SEQ ID NO: 1443513 - RNA, 23 nt, Human
uggaagacgcaagggccugaugg

SEQ ID NO: 1443514 - RNA, 22 nt, Human
uggaagagcagcaccuccucag

SEQ ID NO: 1443515 - RNA, 17 nt, Human
uggaaauuuagcauugu

SEQ ID NO: 1443516 - RNA, 18 nt, Human
uggaaauuuagcauugua

SEQ ID NO: 1443517 - RNA, 15 nt, Human
uggaaauuuagcauu

SEQ ID NO: 1443518 - RNA, 22 nt, Human
uggaaauuuaaagcagguucuu

SEQ ID NO: 1443519 - RNA, 21 nt, Human
uggaaauuuaaagcagguucu

SEQ ID NO: 1443520 - RNA, 16 nt, Human
uggaaauuuaaagcag

SEQ ID NO: 1443521 - RNA, 14 nt, Human
uggaaauuuaaagc

SEQ ID NO: 1443522 - RNA, 13 nt, Human
uggaaauuuaaag

SEQ ID NO: 1443523 - RNA, 12 nt, Human
uggaaauuuaaa

SEQ ID NO: 1443524 - RNA, 18 nt, Human
uggaaauaaaucuuccua

SEQ ID NO: 1443525 - RNA, 17 nt, Human
uggaaauuggaagagca

SEQ ID NO: 1443526 - RNA, 16 nt, Human
uggaaauuggaagagc

SEQ ID NO: 1443527 - RNA, 23 nt, Human
uggaaauaaauguaucauagaaa

SEQ ID NO: 1443528 - RNA, 15 nt, Human
uggaaauaaauguau

SEQ ID NO: 1443529 - RNA, 13 nt, Human
uggaaauaaaugu

SEQ ID NO: 1443530 - RNA, 16 nt, Human
uggaaauaaagucaga

SEQ ID NO: 1443531 - RNA, 14 nt, Human
uggaaauaaaguca

SEQ ID NO: 1443532 - RNA, 12 nt, Human
uggaaauaaagu

SEQ ID NO: 1443533 - RNA, 21 nt, Human
ugcuuuuuccaacucagaaau

SEQ ID NO: 1443534 - RNA, 14 nt, Human
ugcuuuuuccaacu

SEQ ID NO: 1443535 - RNA, 15 nt, Human
ugcuuuuucaccaga

SEQ ID NO: 1443536 - RNA, 19 nt, Human
ugcuuuuuauuucugcaua

SEQ ID NO: 1443537 - RNA, 18 nt, Human
ugcuuuuuauuucugcau

SEQ ID NO: 1443538 - RNA, 15 nt, Human
ugcuuuuuauuucug

SEQ ID NO: 1443539 - RNA, 16 nt, Human
ugcuuuuuauggccug

SEQ ID NO: 1443540 - RNA, 17 nt, Human
aggccaccuccccagca

SEQ ID NO: 1443541 - RNA, 13 nt, Human
aggccagccuggc

SEQ ID NO: 1443542 - RNA, 23 nt, Human
aggccagccuggccuccugccuc

SEQ ID NO: 1443543 - RNA, 22 nt, Human
aggccagccuggccuccugccu

SEQ ID NO: 1443544 - RNA, 21 nt, Human
aggccagccuggccuccugcc

SEQ ID NO: 1443545 - RNA, 20 nt, Human
aggccagccuggccuccugc

SEQ ID NO: 1443546 - RNA, 19 nt, Human
aggccagccuggccuccug

SEQ ID NO: 1443547 - RNA, 18 nt, Human
aggccagccuggccuccu

SEQ ID NO: 1443548 - RNA, 17 nt, Human
aggccagccuggccucc

SEQ ID NO: 1443549 - RNA, 16 nt, Human
aggccagccuggccuc

SEQ ID NO: 1443550 - RNA, 15 nt, Human
aggccagccuggccu

SEQ ID NO: 1443551 - RNA, 14 nt, Human
aggccagccuggcc

SEQ ID NO: 1443552 - RNA, 15 nt, Human
aggccaccuccccag

SEQ ID NO: 1443553 - RNA, 14 nt, Human
aggccaccucccca

SEQ ID NO: 1443554 - RNA, 17 nt, Human
uggcaccagacacccag

SEQ ID NO: 1443555 - RNA, 16 nt, Human
uggcaccagacaccca

SEQ ID NO: 1443556 - RNA, 14 nt, Human
uggcaccagacacc

SEQ ID NO: 1443557 - RNA, 22 nt, Human
aggcccccagcccagggcuccu

SEQ ID NO: 1443558 - RNA, 19 nt, Human
aggcccccagcccagggcu

SEQ ID NO: 1443559 - RNA, 18 nt, Human
aggcccccagcccagggc

SEQ ID NO: 1443560 - RNA, 17 nt, Human
aggcccccagcccaggg

SEQ ID NO: 1443561 - RNA, 14 nt, Human
aggcccccagccca

SEQ ID NO: 1443562 - RNA, 20 nt, Human
aggcccccacuugccucuuc

SEQ ID NO: 1443563 - RNA, 18 nt, Human
aggcccccacuugccucu

SEQ ID NO: 1443564 - RNA, 17 nt, Human
aggcccccacuugccuc

SEQ ID NO: 1443565 - RNA, 13 nt, Human
aggcccccacuug

SEQ ID NO: 1443566 - RNA, 18 nt, Human
aggcccccaccuggcuca

SEQ ID NO: 1443567 - RNA, 17 nt, Human
aggcccccaccuggcuc

SEQ ID NO: 1443568 - RNA, 20 nt, Human
aggccccaugaccuccagcu

SEQ ID NO: 1443569 - RNA, 17 nt, Human
aggccccaugaccucca

SEQ ID NO: 1443570 - RNA, 16 nt, Human
aggccccaugaccucc

SEQ ID NO: 1443571 - RNA, 17 nt, Human
aggcccacauuggaaga

SEQ ID NO: 1443572 - RNA, 19 nt, Human
aggcccacauuggaagagc

SEQ ID NO: 1443573 - RNA, 17 nt, Human
aggcccaaggcucccgg

SEQ ID NO: 1443574 - RNA, 15 nt, Human
aggcccaaggcuccc

SEQ ID NO: 1443575 - RNA, 16 nt, Human
aggcccacugugccuc

SEQ ID NO: 1443576 - RNA, 18 nt, Human
aggcccccgccuuggccu

SEQ ID NO: 1443577 - RNA, 21 nt, Human
aggcccccaucauccucuggc

SEQ ID NO: 1443578 - RNA, 20 nt, Human
aggcccccaucauccucugg

SEQ ID NO: 1443579 - RNA, 19 nt, Human
aggcccccaucauccucug

SEQ ID NO: 1443580 - RNA, 18 nt, Human
aggcccccaucauccucu

SEQ ID NO: 1443581 - RNA, 19 nt, Human
aggcccccaccuggcucac

SEQ ID NO: 1443582 - RNA, 23 nt, Human
aggcccccagcccagggcuccug

SEQ ID NO: 1443583 - RNA, 19 nt, Human
aggcccccgccuuggccug

SEQ ID NO: 1443584 - RNA, 22 nt, Human
aggcccgagcagcugagcaggg

SEQ ID NO: 1443585 - RNA, 19 nt, Human
aggcccgcaugcggcccag

SEQ ID NO: 1443586 - RNA, 21 nt, Human
aggcccgagcagcugagcagg

SEQ ID NO: 1443587 - RNA, 19 nt, Human
aggcccgagcagcugagca

SEQ ID NO: 1443588 - RNA, 18 nt, Human
aggcccgagcagcugagc

SEQ ID NO: 1443589 - RNA, 15 nt, Human
aggcccgagcagcug

SEQ ID NO: 1443590 - RNA, 17 nt, Human
uggagucugccacccag

SEQ ID NO: 1443591 - RNA, 16 nt, Human
uggagguuaaggcaua

SEQ ID NO: 1443592 - RNA, 18 nt, Human
uggagucugccacccagg

SEQ ID NO: 1443593 - RNA, 22 nt, Human
uggagucugccacccaggaucc

SEQ ID NO: 1443594 - RNA, 23 nt, Human
uggagguggaaaagcaacauuca

SEQ ID NO: 1443595 - RNA, 20 nt, Human
uggaggucgguagguucagc

SEQ ID NO: 1443596 - RNA, 22 nt, Human
uggaguguuccccuuccacuga

SEQ ID NO: 1443597 - RNA, 19 nt, Human
uggaguguuccccuuccac

SEQ ID NO: 1443598 - RNA, 14 nt, Human
uggaguugaaaauc

SEQ ID NO: 1443599 - RNA, 19 nt, Human
uggaguguaugacugcaca

SEQ ID NO: 1443600 - RNA, 17 nt, Human
uggaguguaugacugca

SEQ ID NO: 1443601 - RNA, 14 nt, Human
uggaguguaugacu

SEQ ID NO: 1443602 - RNA, 20 nt, Human
uggaguggcagcccagccag

SEQ ID NO: 1443603 - RNA, 19 nt, Human
uggaguggcagcccagcca

SEQ ID NO: 1443604 - RNA, 18 nt, Human
uggaguggcagcccagcc

SEQ ID NO: 1443605 - RNA, 17 nt, Human
uggaguggcagcccagc

SEQ ID NO: 1443606 - RNA, 16 nt, Human
uggaguggcagcccag

SEQ ID NO: 1443607 - RNA, 13 nt, Human
uggaguggcagcc

SEQ ID NO: 1443608 - RNA, 17 nt, Human
uggagugcuguuuuguu

SEQ ID NO: 1443609 - RNA, 16 nt, Human
uggagugcuguuuugu

SEQ ID NO: 1443610 - RNA, 18 nt, Human
uggagugcaccaaagaga

SEQ ID NO: 1443611 - RNA, 16 nt, Human
uggagugcaccaaaga

SEQ ID NO: 1443612 - RNA, 13 nt, Human
uggagugcagugg

SEQ ID NO: 1443613 - RNA, 22 nt, Human
uggaguugaucuggaacccaga

SEQ ID NO: 1443614 - RNA, 19 nt, Human
uggaguugaucuggaaccc

SEQ ID NO: 1443615 - RNA, 17 nt, Human
uggaguugaucuggaac

SEQ ID NO: 1443616 - RNA, 15 nt, Human
uggaguugaucugga

SEQ ID NO: 1443617 - RNA, 21 nt, Human
uggauugcacguggccucuug

SEQ ID NO: 1443618 - RNA, 17 nt, Human
uggauugcacguggccu

SEQ ID NO: 1443619 - RNA, 23 nt, Human
uggcacaucagcacgauuucugu

SEQ ID NO: 1443620 - RNA, 19 nt, Human
uggauugcaauaucugaag

SEQ ID NO: 1443621 - RNA, 14 nt, Human
uggauucuuuccau

SEQ ID NO: 1443622 - RNA, 13 nt, Human
uggauucuaaaau

SEQ ID NO: 1443623 - RNA, 15 nt, Human
uggauucuaaaaugc

SEQ ID NO: 1443624 - RNA, 19 nt, Human
uggauuccccaucucaggc

SEQ ID NO: 1443625 - RNA, 22 nt, Human
uggauuccccaucucaggccag

SEQ ID NO: 1443626 - RNA, 18 nt, Human
uggauuccccaucucagg

SEQ ID NO: 1443627 - RNA, 12 nt, Human
uggauuccagag

SEQ ID NO: 1443628 - RNA, 23 nt, Human
aggcagggggaaggugggguccu

SEQ ID NO: 1443629 - RNA, 18 nt, Human
aggcaggggcuuccuggu

SEQ ID NO: 1443630 - RNA, 17 nt, Human
aggcaggggcuuccugg

SEQ ID NO: 1443631 - RNA, 16 nt, Human
aggcaggggcuuccug

SEQ ID NO: 1443632 - RNA, 15 nt, Human
aggcaggggcuuccu

SEQ ID NO: 1443633 - RNA, 14 nt, Human
aggcaggggcuucc

SEQ ID NO: 1443634 - RNA, 15 nt, Human
aggcaggggccucca

SEQ ID NO: 1443635 - RNA, 16 nt, Human
aggcaggggccuccau

SEQ ID NO: 1443636 - RNA, 23 nt, Human
aggcagggcucuccuggcuuccc

SEQ ID NO: 1443637 - RNA, 22 nt, Human
aggcagggcucuccuggcuucc

SEQ ID NO: 1443638 - RNA, 21 nt, Human
aggcagggcucuccuggcuuc

SEQ ID NO: 1443639 - RNA, 19 nt, Human
aggcagggcucuccuggcu

SEQ ID NO: 1443640 - RNA, 18 nt, Human
aggcagggcucuccuggc

SEQ ID NO: 1443641 - RNA, 17 nt, Human
aggcagggcucuccugg

SEQ ID NO: 1443642 - RNA, 15 nt, Human
aggcagggcucuccu

SEQ ID NO: 1443643 - RNA, 14 nt, Human
aggcagggcucucc

SEQ ID NO: 1443644 - RNA, 13 nt, Human
aggcagggcucuc

SEQ ID NO: 1443645 - RNA, 12 nt, Human
aggcagggcucu

SEQ ID NO: 1443646 - RNA, 16 nt, Human
aggcaggcucccaggg

SEQ ID NO: 1443647 - RNA, 15 nt, Human
aggcaggcucccagg

SEQ ID NO: 1443648 - RNA, 20 nt, Human
aggcaggcagggcucuccug

SEQ ID NO: 1443649 - RNA, 18 nt, Human
aggcaggcagggcucucc

SEQ ID NO: 1443650 - RNA, 16 nt, Human
aggcaggcagggcucu

SEQ ID NO: 1443651 - RNA, 15 nt, Human
aggcaggcagggcuc

SEQ ID NO: 1443652 - RNA, 14 nt, Human
aggcaggcagggcu

SEQ ID NO: 1443653 - RNA, 13 nt, Human
aggcaggcagggc

SEQ ID NO: 1443654 - RNA, 20 nt, Human
aggcaggauuggggaagaga

SEQ ID NO: 1443655 - RNA, 23 nt, Human
aggcaggauuggggaagagagcc

SEQ ID NO: 1443656 - RNA, 19 nt, Human
aggcaggauuggggaagag

SEQ ID NO: 1443657 - RNA, 16 nt, Human
aggcaggauuggggaa

SEQ ID NO: 1443658 - RNA, 22 nt, Human
aggcaggauugaaaauguccag

SEQ ID NO: 1443659 - RNA, 18 nt, Human
aggcaggauugaaaaugu

SEQ ID NO: 1443660 - RNA, 16 nt, Human
aggcaggauugaaaau

SEQ ID NO: 1443661 - RNA, 14 nt, Human
aggcaggauugaaa

SEQ ID NO: 1443662 - RNA, 13 nt, Human
aggcaggaagccc

SEQ ID NO: 1443663 - RNA, 20 nt, Human
aggcagcuuuuucucuccca

SEQ ID NO: 1443664 - RNA, 13 nt, Human
aggcacacagcua

SEQ ID NO: 1443665 - RNA, 15 nt, Human
aggcacacagcuacu

SEQ ID NO: 1443666 - RNA, 11 nt, Human
aggcacacagc

SEQ ID NO: 1443667 - RNA, 21 nt, Human
aggcauuugcaggguccucuu

SEQ ID NO: 1443668 - RNA, 18 nt, Human
aggcauuugcaggguccu

SEQ ID NO: 1443669 - RNA, 20 nt, Human
aggcauuuccuggguggcua

SEQ ID NO: 1443670 - RNA, 17 nt, Human
aggcauuuccugggugg

SEQ ID NO: 1443671 - RNA, 16 nt, Human
aggcauuuccugggug

SEQ ID NO: 1443672 - RNA, 15 nt, Human
aggcauuuccugggu

SEQ ID NO: 1443673 - RNA, 14 nt, Human
aggcauuuccuggg

SEQ ID NO: 1443674 - RNA, 13 nt, Human
aggcauuuccugg

SEQ ID NO: 1443675 - RNA, 12 nt, Human
aggcauuuccua

SEQ ID NO: 1443676 - RNA, 14 nt, Human
aggcauuggauauu

SEQ ID NO: 1443677 - RNA, 13 nt, Human
aggcauuggauau

SEQ ID NO: 1443678 - RNA, 21 nt, Human
aggcauugccaagggcuuugu

SEQ ID NO: 1443679 - RNA, 20 nt, Human
aggcauugccaagggcuuug

SEQ ID NO: 1443680 - RNA, 18 nt, Human
aggcauugccaagggcuu

SEQ ID NO: 1443681 - RNA, 16 nt, Human
aggcauugccaagggc

SEQ ID NO: 1443682 - RNA, 14 nt, Human
aggcauugccaagg

SEQ ID NO: 1443683 - RNA, 13 nt, Human
aggcauugccaag

SEQ ID NO: 1443684 - RNA, 21 nt, Human
aggcauacgagagcagagguc

SEQ ID NO: 1443685 - RNA, 20 nt, Human
aggcauacgagagcagaggu

SEQ ID NO: 1443686 - RNA, 14 nt, Human
aggcaguuugcaaa

SEQ ID NO: 1443687 - RNA, 14 nt, Human
aggcaguuuucuaa

SEQ ID NO: 1443688 - RNA, 13 nt, Human
aggcaguuuucua

SEQ ID NO: 1443689 - RNA, 12 nt, Human
aggcaguuuucu

SEQ ID NO: 1443690 - RNA, 19 nt, Human
aggcaguaauaaaaagauu

SEQ ID NO: 1443691 - RNA, 16 nt, Human
uggagcagaggggcug

SEQ ID NO: 1443692 - RNA, 13 nt, Human
uggagcagagggg

SEQ ID NO: 1443693 - RNA, 12 nt, Human
uggagcagaggg

SEQ ID NO: 1443694 - RNA, 17 nt, Human
uggagcagaccaccccg

SEQ ID NO: 1443695 - RNA, 13 nt, Human
uggagcagaccac

SEQ ID NO: 1443696 - RNA, 14 nt, Human
uggagcagaagcag

SEQ ID NO: 1443697 - RNA, 15 nt, Human
uggagcagaagcagc

SEQ ID NO: 1443698 - RNA, 22 nt, Human
uggagcacaauaaauggcugua

SEQ ID NO: 1443699 - RNA, 20 nt, Human
uggagcacaauaaauggcug

SEQ ID NO: 1443700 - RNA, 19 nt, Human
uggagcacaaagacccugg

SEQ ID NO: 1443701 - RNA, 22 nt, Human
uggagaaagggcccugggccug

SEQ ID NO: 1443702 - RNA, 21 nt, Human
uggagaaagggcccugggccu

SEQ ID NO: 1443703 - RNA, 13 nt, Human
uggagaaagggcc

SEQ ID NO: 1443704 - RNA, 23 nt, Human
uggagaaagcugacuuggcuggu

SEQ ID NO: 1443705 - RNA, 18 nt, Human
uggagaaagcugacuugg

SEQ ID NO: 1443706 - RNA, 15 nt, Human
uggagaaagcugacu

SEQ ID NO: 1443707 - RNA, 13 nt, Human
uggagaaagcuga

SEQ ID NO: 1443708 - RNA, 22 nt, Human
uggagaaaauggguuuauucac

SEQ ID NO: 1443709 - RNA, 13 nt, Human
uggagaaaauggg

SEQ ID NO: 1443710 - RNA, 15 nt, Human
uggacuucuggggua

SEQ ID NO: 1443711 - RNA, 19 nt, Human
uggacuuaagcaucuggcu

SEQ ID NO: 1443712 - RNA, 22 nt, Human
uggacuguuuucucucggcucc

SEQ ID NO: 1443713 - RNA, 20 nt, Human
uggacuguuuucucucggcu

SEQ ID NO: 1443714 - RNA, 17 nt, Human
uggacuguuuucucucg

SEQ ID NO: 1443715 - RNA, 23 nt, Human
aggauugcgagagauguguguug

SEQ ID NO: 1443716 - RNA, 21 nt, Human
aggauugcgagagaugugugu

SEQ ID NO: 1443717 - RNA, 21 nt, Human
uggagccagccgagcaggagg

SEQ ID NO: 1443718 - RNA, 23 nt, Human
aggcacacaccaccacgccuggc

SEQ ID NO: 1443719 - RNA, 21 nt, Human
uggagcauuucucaucaguag

SEQ ID NO: 1443720 - RNA, 17 nt, Human
uggagcauuucucauca

SEQ ID NO: 1443721 - RNA, 17 nt, Human
uggagcagaggggcuga

SEQ ID NO: 1443722 - RNA, 13 nt, Human
uggagcagccacc

SEQ ID NO: 1443723 - RNA, 16 nt, Human
uggagcagccacccca

SEQ ID NO: 1443724 - RNA, 22 nt, Human
uggagccagccgagcaggaggc

SEQ ID NO: 1443725 - RNA, 21 nt, Human
uggagcucgugggacagucac

SEQ ID NO: 1443726 - RNA, 21 nt, Human
uggagcucguggaacaguuac

SEQ ID NO: 1443727 - RNA, 17 nt, Human
uggagcucguggaacag

SEQ ID NO: 1443728 - RNA, 22 nt, Human
agcugugguuuucuuuugccau

SEQ ID NO: 1443729 - RNA, 21 nt, Human
agcuguguccaaaaccgccag

SEQ ID NO: 1443730 - RNA, 15 nt, Human
agcugugguuuucuu

SEQ ID NO: 1443731 - RNA, 19 nt, Human
agcugugcuuaugguacca

SEQ ID NO: 1443732 - RNA, 22 nt, Human
agcuguggcagaguuacaguuc

SEQ ID NO: 1443733 - RNA, 21 nt, Human
agcuguggcagaguuacaguu

SEQ ID NO: 1443734 - RNA, 18 nt, Human
agcuguggcagaguuaca

SEQ ID NO: 1443735 - RNA, 22 nt, Human
agcugugcuuaugguaccagau

SEQ ID NO: 1443736 - RNA, 14 nt, Human
agcugggucaggca

SEQ ID NO: 1443737 - RNA, 23 nt, Human
agcuggggugcagggaugugggu

SEQ ID NO: 1443738 - RNA, 19 nt, Human
ugccuguguccaugcgcuc

SEQ ID NO: 1443739 - RNA, 15 nt, Human
ugccuguguccaugc

SEQ ID NO: 1443740 - RNA, 23 nt, Human
ugccuguggcgccgucuccaggg

SEQ ID NO: 1443741 - RNA, 22 nt, Human
ugccuguggcgccgucuccagg

SEQ ID NO: 1443742 - RNA, 21 nt, Human
ugccuguggcgccgucuccag

SEQ ID NO: 1443743 - RNA, 11 nt, Human
ugccuguggcg

SEQ ID NO: 1443744 - RNA, 14 nt, Human
ugccuguggccaug

SEQ ID NO: 1443745 - RNA, 22 nt, Human
ugccuguguccaugcgcucagg

SEQ ID NO: 1443746 - RNA, 21 nt, Human
ugccuguguccaugcgcucag

SEQ ID NO: 1443747 - RNA, 19 nt, Human
ugccugugcuacaauucau

SEQ ID NO: 1443748 - RNA, 23 nt, Human
ugccugugccaggugaggucagc

SEQ ID NO: 1443749 - RNA, 16 nt, Human
ugccugugccagguga

SEQ ID NO: 1443750 - RNA, 12 nt, Human
ugccugugccag

SEQ ID NO: 1443751 - RNA, 21 nt, Human
agcugugugaauaccugcuca

SEQ ID NO: 1443752 - RNA, 22 nt, Human
agcuggggugcagggauguggg

SEQ ID NO: 1443753 - RNA, 16 nt, Human
ugccuuaacuggagcc

SEQ ID NO: 1443754 - RNA, 20 nt, Human
ugccuuacccucauguucuu

SEQ ID NO: 1443755 - RNA, 21 nt, Human
ugccuuacccucauguucuua

SEQ ID NO: 1443756 - RNA, 20 nt, Human
ugccuggaagagcagcccua

SEQ ID NO: 1443757 - RNA, 19 nt, Human
ugccuggaagagcagcccu

SEQ ID NO: 1443758 - RNA, 22 nt, Human
agcuggcggcuggggucccagc

SEQ ID NO: 1443759 - RNA, 23 nt, Human
agcuggcggcuggggucccagca

SEQ ID NO: 1443760 - RNA, 14 nt, Human
agcugcuuccagug

SEQ ID NO: 1443761 - RNA, 15 nt, Human
agcugcuuccagugu

SEQ ID NO: 1443762 - RNA, 18 nt, Human
ugccuggaagagcagccc

SEQ ID NO: 1443763 - RNA, 22 nt, Human
ugccugcuuuuuauggccugug

SEQ ID NO: 1443764 - RNA, 20 nt, Human
ugccugcuuuuuauggccug

SEQ ID NO: 1443765 - RNA, 21 nt, Human
ugccugcuuuuuauggccugu

SEQ ID NO: 1443766 - RNA, 21 nt, Human
ugccgauauacucuagaugaa

SEQ ID NO: 1443767 - RNA, 20 nt, Human
ugccgagcaaccguggcccu

SEQ ID NO: 1443768 - RNA, 21 nt, Human
ugccgagcaaccguggcccuu

SEQ ID NO: 1443769 - RNA, 19 nt, Human
ugccgagcaaccguggccc

SEQ ID NO: 1443770 - RNA, 17 nt, Human
ugccgagcaaccguggc

SEQ ID NO: 1443771 - RNA, 15 nt, Human
ugccgagcaaccgug

SEQ ID NO: 1443772 - RNA, 22 nt, Human
ugccgagaguccaucagccucc

SEQ ID NO: 1443773 - RNA, 19 nt, Human
agcugccccggccccuccc

SEQ ID NO: 1443774 - RNA, 17 nt, Human
agcugccccggccccuc

SEQ ID NO: 1443775 - RNA, 16 nt, Human
agcugccccggccccu

SEQ ID NO: 1443776 - RNA, 17 nt, Human
agcugcccacagcaggc

SEQ ID NO: 1443777 - RNA, 24 nt, Human
agcugccaguguccugagccccag

SEQ ID NO: 1443778 - RNA, 15 nt, Human
agcugccaguguccu

SEQ ID NO: 1443779 - RNA, 23 nt, Human
agcugccaggagcacggcucugu

SEQ ID NO: 1443780 - RNA, 22 nt, Human
agcugcacugaugcugccccuc

SEQ ID NO: 1443781 - RNA, 20 nt, Human
agcugcacugaugcugcccc

SEQ ID NO: 1443782 - RNA, 19 nt, Human
agcugcacugaugcugccc

SEQ ID NO: 1443783 - RNA, 17 nt, Human
agcugcacugaugcugc

SEQ ID NO: 1443784 - RNA, 11 nt, Human
agcugcacuga

SEQ ID NO: 1443785 - RNA, 23 nt, Human
agcugcaagguacucuggugagu

SEQ ID NO: 1443786 - RNA, 21 nt, Human
agcugcaagguacucugguga

SEQ ID NO: 1443787 - RNA, 14 nt, Human
agcucugggguggg

SEQ ID NO: 1443788 - RNA, 21 nt, Human
agcucugagaggcccuggauc

SEQ ID NO: 1443789 - RNA, 20 nt, Human
agcucugagaggcccuggau

SEQ ID NO: 1443790 - RNA, 19 nt, Human
agcucugagaggcccugga

SEQ ID NO: 1443791 - RNA, 18 nt, Human
agcucugagaggcccugg

SEQ ID NO: 1443792 - RNA, 17 nt, Human
agcucugagaggcccug

SEQ ID NO: 1443793 - RNA, 16 nt, Human
agcucugagaggcccu

SEQ ID NO: 1443794 - RNA, 15 nt, Human
agcucugagaggccc

SEQ ID NO: 1443795 - RNA, 13 nt, Human
agcucugagaggc

SEQ ID NO: 1443796 - RNA, 10 nt, Human
agcucugaga

SEQ ID NO: 1443797 - RNA, 20 nt, Human
agcucugacauucugauucg

SEQ ID NO: 1443798 - RNA, 16 nt, Human
agcucugaaagagaaa

SEQ ID NO: 1443799 - RNA, 22 nt, Human
agcucugaaagagaaacacgua

SEQ ID NO: 1443800 - RNA, 15 nt, Human
agcucugaaagagaa

SEQ ID NO: 1443801 - RNA, 19 nt, Human
agcucugaaaccaguguua

SEQ ID NO: 1443802 - RNA, 22 nt, Human
agcucuggggugggcaguuuuu

SEQ ID NO: 1443803 - RNA, 21 nt, Human
agcucuggggugggcaguuuu

SEQ ID NO: 1443804 - RNA, 20 nt, Human
agcucuggggugggcaguuu

SEQ ID NO: 1443805 - RNA, 19 nt, Human
agcucuggggugggcaguu

SEQ ID NO: 1443806 - RNA, 18 nt, Human
agcucugaaaccaguguu

SEQ ID NO: 1443807 - RNA, 13 nt, Human
agcucucugcccu

SEQ ID NO: 1443808 - RNA, 22 nt, Human
agcucgauguggucacagcugu

SEQ ID NO: 1443809 - RNA, 23 nt, Human
agcucgauguggucacagcugua

SEQ ID NO: 1443810 - RNA, 22 nt, Human
agcuccuuugggcuucagcugc

SEQ ID NO: 1443811 - RNA, 23 nt, Human
agcucccaggaccacaggcucag

SEQ ID NO: 1443812 - RNA, 23 nt, Human
agcuccaguguccugagcucagc

SEQ ID NO: 1443813 - RNA, 17 nt, Human
ugccauauuuucaccau

SEQ ID NO: 1443814 - RNA, 14 nt, Human
ugccauauuuucac

SEQ ID NO: 1443815 - RNA, 13 nt, Human
ugccauauuuuca

SEQ ID NO: 1443816 - RNA, 21 nt, Human
ugccauauugcacaugucuua

SEQ ID NO: 1443817 - RNA, 22 nt, Human
agcuccaguguccugagcucag

SEQ ID NO: 1443818 - RNA, 21 nt, Human
agcuccaguguccugagcuca

SEQ ID NO: 1443819 - RNA, 20 nt, Human
agcuccaguguccugagcuc

SEQ ID NO: 1443820 - RNA, 19 nt, Human
agcuccaguguccugagcu

SEQ ID NO: 1443821 - RNA, 18 nt, Human
agcuccaguguccugagc

SEQ ID NO: 1443822 - RNA, 16 nt, Human
agcuccaguguccuga

SEQ ID NO: 1443823 - RNA, 15 nt, Human
agcuccaguguccug

SEQ ID NO: 1443824 - RNA, 14 nt, Human
agcuccaguguccu

SEQ ID NO: 1443825 - RNA, 23 nt, Human
ugccaucaucuccugccuuccuc

SEQ ID NO: 1443826 - RNA, 16 nt, Human
ugccaucaucuccugc

SEQ ID NO: 1443827 - RNA, 15 nt, Human
ugccaucaucuccug

SEQ ID NO: 1443828 - RNA, 13 nt, Human
ugccaucaucucc

SEQ ID NO: 1443829 - RNA, 15 nt, Human
agcuuuccccagccc

SEQ ID NO: 1443830 - RNA, 22 nt, Human
agcuuucauguaaacugugcac

SEQ ID NO: 1443831 - RNA, 17 nt, Human
agcuuucagaauauguc

SEQ ID NO: 1443832 - RNA, 16 nt, Human
agcuuucagaauaugu

SEQ ID NO: 1443833 - RNA, 23 nt, Human
agcuuguuuacaugcuuauucca

SEQ ID NO: 1443834 - RNA, 19 nt, Human
agcuuguuuacaugcuuau

SEQ ID NO: 1443835 - RNA, 18 nt, Human
agcuuguuuacaugcuua

SEQ ID NO: 1443836 - RNA, 16 nt, Human
agcuuguuuacaugcu

SEQ ID NO: 1443837 - RNA, 13 nt, Human
agcuuguuuacau

SEQ ID NO: 1443838 - RNA, 15 nt, Human
agcuuuccugcccca

SEQ ID NO: 1443839 - RNA, 14 nt, Human
agcuuuccugcccc

SEQ ID NO: 1443840 - RNA, 13 nt, Human
agcuuuccugccc

SEQ ID NO: 1443841 - RNA, 12 nt, Human
agcuuuccugcc

SEQ ID NO: 1443842 - RNA, 16 nt, Human
agcuuucccugccucu

SEQ ID NO: 1443843 - RNA, 12 nt, Human
agcuuucccugc

SEQ ID NO: 1443844 - RNA, 10 nt, Human
agcuuugcuc

SEQ ID NO: 1443845 - RNA, 21 nt, Human
agcuuugcuaccaaagcaccu

SEQ ID NO: 1443846 - RNA, 16 nt, Human
agcuuugcuaccaaag

SEQ ID NO: 1443847 - RNA, 10 nt, Human
agcuuugcua

SEQ ID NO: 1443848 - RNA, 23 nt, Human
agcuuuccugccccaggccugaa

SEQ ID NO: 1443849 - RNA, 22 nt, Human
agcuuuccugccccaggccuga

SEQ ID NO: 1443850 - RNA, 21 nt, Human
agcuuuccugccccaggccug

SEQ ID NO: 1443851 - RNA, 20 nt, Human
agcuuuccugccccaggccu

SEQ ID NO: 1443852 - RNA, 23 nt, Human
agcuuugcucuuugguagaaaag

SEQ ID NO: 1443853 - RNA, 21 nt, Human
agcuuugcucuuugguagaaa

SEQ ID NO: 1443854 - RNA, 18 nt, Human
agcuuugcucuuugguag

SEQ ID NO: 1443855 - RNA, 18 nt, Human
agcuuuggaccuaaucca

SEQ ID NO: 1443856 - RNA, 18 nt, Human
agcuuuggaaguuuagcu

SEQ ID NO: 1443857 - RNA, 23 nt, Human
agcuuuggaaguuuagcucugag

SEQ ID NO: 1443858 - RNA, 19 nt, Human
agcuuuggaccuaauccaa

SEQ ID NO: 1443859 - RNA, 22 nt, Human
agcuuuggaaguuuagcucuga

SEQ ID NO: 1443860 - RNA, 14 nt, Human
aggaaaagacacau

SEQ ID NO: 1443861 - RNA, 17 nt, Human
agcuuguggcaagugaa

SEQ ID NO: 1443862 - RNA, 18 nt, Human
agcuuguggcaagugaau

SEQ ID NO: 1443863 - RNA, 23 nt, Human
agcuuguccaacccgaggcccgc

SEQ ID NO: 1443864 - RNA, 16 nt, Human
agcuuguagccagccg

SEQ ID NO: 1443865 - RNA, 22 nt, Human
agcuuguccaacccgaggcccg

SEQ ID NO: 1443866 - RNA, 15 nt, Human
agcuuguagccagcc

SEQ ID NO: 1443867 - RNA, 14 nt, Human
agcuuguagccagc

SEQ ID NO: 1443868 - RNA, 22 nt, Human
agcuugauguuggaucucaaga

SEQ ID NO: 1443869 - RNA, 18 nt, Human
agcuugauaaagggccaa

SEQ ID NO: 1443870 - RNA, 16 nt, Human
agcuugaccugaggcu

SEQ ID NO: 1443871 - RNA, 14 nt, Human
agcuugaccugagg

SEQ ID NO: 1443872 - RNA, 22 nt, Human
agcuuacaaauacuaaaaagaa

SEQ ID NO: 1443873 - RNA, 22 nt, Human
agcuuaauggcugauaauuuua

SEQ ID NO: 1443874 - RNA, 19 nt, Human
agcuuaauggcugauaauu

SEQ ID NO: 1443875 - RNA, 13 nt, Human
ugcuaauuuguuu

SEQ ID NO: 1443876 - RNA, 18 nt, Human
ugcuaauuuauccugaaa

SEQ ID NO: 1443877 - RNA, 22 nt, Human
ugcuaaucuucuuaugcaauuu

SEQ ID NO: 1443878 - RNA, 20 nt, Human
ugcuaaucuucuuaugcaau

SEQ ID NO: 1443879 - RNA, 13 nt, Human
ugcuaaucuucuu

SEQ ID NO: 1443880 - RNA, 23 nt, Human
ugcuaaucagggaggucauuuug

SEQ ID NO: 1443881 - RNA, 22 nt, Human
ugcuaaucagggaggucauuuu

SEQ ID NO: 1443882 - RNA, 20 nt, Human
ugcuaauauuuuccuccuga

SEQ ID NO: 1443883 - RNA, 18 nt, Human
ugcuaauauuuuccuccu

SEQ ID NO: 1443884 - RNA, 17 nt, Human
ugcuaagugugaacugg

SEQ ID NO: 1443885 - RNA, 19 nt, Human
ugcuaagugugaacuggac

SEQ ID NO: 1443886 - RNA, 18 nt, Human
ugcgguagccagcacaca

SEQ ID NO: 1443887 - RNA, 13 nt, Human
ugcuaagugugaa

SEQ ID NO: 1443888 - RNA, 14 nt, Human
ugcuaagugugaac

SEQ ID NO: 1443889 - RNA, 15 nt, Human
ugcuaagugugaacu

SEQ ID NO: 1443890 - RNA, 16 nt, Human
ugcuaagugugaacug

SEQ ID NO: 1443891 - RNA, 17 nt, Human
ugcgguagccagcacac

SEQ ID NO: 1443892 - RNA, 16 nt, Human
ugcgguagccagcaca

SEQ ID NO: 1443893 - RNA, 15 nt, Human
ugcgguagccagcac

SEQ ID NO: 1443894 - RNA, 23 nt, Human
ugccuugguuuuuacugcucuga

SEQ ID NO: 1443895 - RNA, 13 nt, Human
ugccuugguuuuu

SEQ ID NO: 1443896 - RNA, 19 nt, Human
ugccuuuugcaaccaggaa

SEQ ID NO: 1443897 - RNA, 15 nt, Human
ugccuugucacgcca

SEQ ID NO: 1443898 - RNA, 19 nt, Human
ugccuuuucccaacuccag

SEQ ID NO: 1443899 - RNA, 22 nt, Human
agcuguuuacuagggaucccuc

SEQ ID NO: 1443900 - RNA, 16 nt, Human
agcuguuuacuaggga

SEQ ID NO: 1443901 - RNA, 22 nt, Human
ugcuaccaguauuuagaagcca

SEQ ID NO: 1443902 - RNA, 18 nt, Human
ugcuaccaguauuuagaa

SEQ ID NO: 1443903 - RNA, 15 nt, Human
ugcuaccaguauuua

SEQ ID NO: 1443904 - RNA, 22 nt, Human
ugcuaccaccagcuguguccaa

SEQ ID NO: 1443905 - RNA, 21 nt, Human
ugcuaccaccagcugugucca

SEQ ID NO: 1443906 - RNA, 20 nt, Human
ugcuaccaccagcugugucc

SEQ ID NO: 1443907 - RNA, 18 nt, Human
ugcuaccaccagcugugu

SEQ ID NO: 1443908 - RNA, 17 nt, Human
ugcuaccaccagcugug

SEQ ID NO: 1443909 - RNA, 16 nt, Human
ugcuaccaccagcugu

SEQ ID NO: 1443910 - RNA, 15 nt, Human
ugcuaccaccagcug

SEQ ID NO: 1443911 - RNA, 14 nt, Human
ugcuaccaccagcu

SEQ ID NO: 1443912 - RNA, 13 nt, Human
ugcuaccaccagc

SEQ ID NO: 1443913 - RNA, 13 nt, Human
ugcuaccaaagca

SEQ ID NO: 1443914 - RNA, 18 nt, Human
ugcuacaggguccaacau

SEQ ID NO: 1443915 - RNA, 20 nt, Human
ugcuacaggguccaacauag

SEQ ID NO: 1443916 - RNA, 22 nt, Human
ugcuacaccuauuaucccagcu

SEQ ID NO: 1443917 - RNA, 16 nt, Human
ugcuaauuuugaaaaa

SEQ ID NO: 1443918 - RNA, 18 nt, Human
ugcuaauuuugaaaaacu

SEQ ID NO: 1443919 - RNA, 19 nt, Human
ugcuaauuuugaaaaacug

SEQ ID NO: 1443920 - RNA, 20 nt, Human
ugcuaauuuugaaaaacugc

SEQ ID NO: 1443921 - RNA, 15 nt, Human
aggaagccaaagagu

SEQ ID NO: 1443922 - RNA, 22 nt, Human
aggaagcauuguaaaauaauuc

SEQ ID NO: 1443923 - RNA, 21 nt, Human
aggaagcauuguaaaauaauu

SEQ ID NO: 1443924 - RNA, 19 nt, Human
aggaagcauuguaaaauaa

SEQ ID NO: 1443925 - RNA, 17 nt, Human
aggaagcauuguaaaau

SEQ ID NO: 1443926 - RNA, 16 nt, Human
aggaagcauuguaaaa

SEQ ID NO: 1443927 - RNA, 15 nt, Human
aggaagcauuguaaa

SEQ ID NO: 1443928 - RNA, 14 nt, Human
aggaagcagccaag

SEQ ID NO: 1443929 - RNA, 19 nt, Human
aggaagcaaauagaagaga

SEQ ID NO: 1443930 - RNA, 17 nt, Human
aggaagauuacucagua

SEQ ID NO: 1443931 - RNA, 18 nt, Human
aggaagaucccccagaaa

SEQ ID NO: 1443932 - RNA, 17 nt, Human
aggaagaucccccagaa

SEQ ID NO: 1443933 - RNA, 22 nt, Human
aggaaggaggacccaggacagg

SEQ ID NO: 1443934 - RNA, 16 nt, Human
aggaaggcagggagga

SEQ ID NO: 1443935 - RNA, 18 nt, Human
aggaaggcagggaggagg

SEQ ID NO: 1443936 - RNA, 20 nt, Human
aggaaggcagggaggaggca

SEQ ID NO: 1443937 - RNA, 22 nt, Human
aggaaggcagggaggaggcaga

SEQ ID NO: 1443938 - RNA, 16 nt, Human
aggaauuacgugcucu

SEQ ID NO: 1443939 - RNA, 23 nt, Human
aggaaugggaaggaugaagggcc

SEQ ID NO: 1443940 - RNA, 17 nt, Human
ugcugaggccugggccg

SEQ ID NO: 1443941 - RNA, 13 nt, Human
aggaaagucauug

SEQ ID NO: 1443942 - RNA, 16 nt, Human
ugcugaggccugggcc

SEQ ID NO: 1443943 - RNA, 15 nt, Human
ugcugaggccugggc

SEQ ID NO: 1443944 - RNA, 14 nt, Human
ugcugaggccuggg

SEQ ID NO: 1443945 - RNA, 13 nt, Human
ugcugaggccugg

SEQ ID NO: 1443946 - RNA, 23 nt, Human
ugcugagcucugagaggcccugg

SEQ ID NO: 1443947 - RNA, 22 nt, Human
ugcugagcucugagaggcccug

SEQ ID NO: 1443948 - RNA, 21 nt, Human
ugcugagcucugagaggcccu

SEQ ID NO: 1443949 - RNA, 17 nt, Human
ugcugagcucugagagg

SEQ ID NO: 1443950 - RNA, 15 nt, Human
ugcugagcucugaga

SEQ ID NO: 1443951 - RNA, 14 nt, Human
ugcugagcucugag

SEQ ID NO: 1443952 - RNA, 13 nt, Human
ugcugagcucuga

SEQ ID NO: 1443953 - RNA, 20 nt, Human
ugcugagauuacagguguga

SEQ ID NO: 1443954 - RNA, 19 nt, Human
ugcugagauacauacagaa

SEQ ID NO: 1443955 - RNA, 18 nt, Human
ugcugagauacauacaga

SEQ ID NO: 1443956 - RNA, 22 nt, Human
ugcugagagggcucgaggggug

SEQ ID NO: 1443957 - RNA, 10 nt, Human
ugcugagacu

SEQ ID NO: 1443958 - RNA, 20 nt, Human
ugcugagauacauacagaau

SEQ ID NO: 1443959 - RNA, 23 nt, Human
ugcugagccuguaaaauaaaagg

SEQ ID NO: 1443960 - RNA, 21 nt, Human
aggaagagccuuccacccagg

SEQ ID NO: 1443961 - RNA, 19 nt, Human
aggaagagccuuccaccca

SEQ ID NO: 1443962 - RNA, 17 nt, Human
aggaagagccuuccacc

SEQ ID NO: 1443963 - RNA, 15 nt, Human
aggaagagccuucca

SEQ ID NO: 1443964 - RNA, 20 nt, Human
aggaagaggggaagcagaaa

SEQ ID NO: 1443965 - RNA, 14 nt, Human
aggaagagggacag

SEQ ID NO: 1443966 - RNA, 16 nt, Human
aggaagaucccccaga

SEQ ID NO: 1443967 - RNA, 16 nt, Human
aggaaagucauuggcu

SEQ ID NO: 1443968 - RNA, 17 nt, Human
aggaaagucauuggcuu

SEQ ID NO: 1443969 - RNA, 19 nt, Human
aggaaagucauuggcuuua

SEQ ID NO: 1443970 - RNA, 20 nt, Human
aggaaagucauuggcuuuau

SEQ ID NO: 1443971 - RNA, 22 nt, Human
aggaaagucauuggcuuuaucc

SEQ ID NO: 1443972 - RNA, 23 nt, Human
aggaaagucauuggcuuuauccu

SEQ ID NO: 1443973 - RNA, 18 nt, Human
ugcucugaacacgaagcu

SEQ ID NO: 1443974 - RNA, 15 nt, Human
ugcucucuuucuguc

SEQ ID NO: 1443975 - RNA, 20 nt, Human
ugcucugagaauuguugaga

SEQ ID NO: 1443976 - RNA, 11 nt, Human
ugcucugagaa

SEQ ID NO: 1443977 - RNA, 23 nt, Human
ugcucccaccuccugacacccuu

SEQ ID NO: 1443978 - RNA, 18 nt, Human
ugcucccaccuccugaca

SEQ ID NO: 1443979 - RNA, 15 nt, Human
ugcucccaccuccug

SEQ ID NO: 1443980 - RNA, 14 nt, Human
ugcucccaccuccu

SEQ ID NO: 1443981 - RNA, 12 nt, Human
ugcucccaccuc

SEQ ID NO: 1443982 - RNA, 22 nt, Human
ugcucccaaggggccugagcag

SEQ ID NO: 1443983 - RNA, 21 nt, Human
ugcucccaaggggccugagca

SEQ ID NO: 1443984 - RNA, 18 nt, Human
ugcucuuagcugucugcu

SEQ ID NO: 1443985 - RNA, 14 nt, Human
ugcucuucaagaaa

SEQ ID NO: 1443986 - RNA, 23 nt, Human
ugcucugcgugucaccugugcuu

SEQ ID NO: 1443987 - RNA, 22 nt, Human
ugcucugcgugucaccugugcu

SEQ ID NO: 1443988 - RNA, 21 nt, Human
ugcugagaaccuggccuucag

SEQ ID NO: 1443989 - RNA, 20 nt, Human
ugcugagaaccuggccuuca

SEQ ID NO: 1443990 - RNA, 19 nt, Human
ugcugagaaccuggccuuc

SEQ ID NO: 1443991 - RNA, 18 nt, Human
ugcugagaaccuggccuu

SEQ ID NO: 1443992 - RNA, 17 nt, Human
ugcugagaaccuggccu

SEQ ID NO: 1443993 - RNA, 15 nt, Human
ugcugagaaaacaug

SEQ ID NO: 1443994 - RNA, 17 nt, Human
ugcucuugaugccuggc

SEQ ID NO: 1443995 - RNA, 22 nt, Human
aggaaacaguugcauguaguaa

SEQ ID NO: 1443996 - RNA, 21 nt, Human
aggaaacaguugcauguagua

SEQ ID NO: 1443997 - RNA, 20 nt, Human
aggaaacaguugcauguagu

SEQ ID NO: 1443998 - RNA, 19 nt, Human
aggaaacaguugcauguag

SEQ ID NO: 1443999 - RNA, 17 nt, Human
aggaaacaguugcaugu

SEQ ID NO: 1444000 - RNA, 14 nt, Human
aggaaaauugaaug

SEQ ID NO: 1444001 - RNA, 19 nt, Human
aggaaacaaccaugucauu

SEQ ID NO: 1444002 - RNA, 21 nt, Human
aggaaaauuuuagcgugcuca

SEQ ID NO: 1444003 - RNA, 16 nt, Human
aggaaaauugaaugca

SEQ ID NO: 1444004 - RNA, 23 nt, Human
aggaaaccaguuaggucucaaua

SEQ ID NO: 1444005 - RNA, 22 nt, Human
ugcuaucgcaccacuguguauu

SEQ ID NO: 1444006 - RNA, 13 nt, Human
ugcuauuugaagu

SEQ ID NO: 1444007 - RNA, 23 nt, Human
agggccaugcugaggccugggcc

SEQ ID NO: 1444008 - RNA, 22 nt, Human
agggccaugcugaggccugggc

SEQ ID NO: 1444009 - RNA, 21 nt, Human
agggccaugcugaggccuggg

SEQ ID NO: 1444010 - RNA, 20 nt, Human
agggccaugcugaggccugg

SEQ ID NO: 1444011 - RNA, 19 nt, Human
agggccaugcugaggccug

SEQ ID NO: 1444012 - RNA, 16 nt, Human
agggccagagccaggg

SEQ ID NO: 1444013 - RNA, 15 nt, Human
agggccagagccagg

SEQ ID NO: 1444014 - RNA, 14 nt, Human
agggccagagccag

SEQ ID NO: 1444015 - RNA, 13 nt, Human
agggccagagcca

SEQ ID NO: 1444016 - RNA, 12 nt, Human
agggccagagcc

SEQ ID NO: 1444017 - RNA, 11 nt, Human
agggccagagc

SEQ ID NO: 1444018 - RNA, 19 nt, Human
agggccgacuaagagaagu

SEQ ID NO: 1444019 - RNA, 20 nt, Human
agggccgacuaagagaaguu

SEQ ID NO: 1444020 - RNA, 13 nt, Human
agggcucacucag

SEQ ID NO: 1444021 - RNA, 15 nt, Human
agggcccugugucug

SEQ ID NO: 1444022 - RNA, 16 nt, Human
agggcccugggccugc

SEQ ID NO: 1444023 - RNA, 18 nt, Human
agggcccugggccugccu

SEQ ID NO: 1444024 - RNA, 15 nt, Human
agggcccuccuuccu

SEQ ID NO: 1444025 - RNA, 15 nt, Human
agggcaucucugggc

SEQ ID NO: 1444026 - RNA, 14 nt, Human
agggcaucucuggg

SEQ ID NO: 1444027 - RNA, 22 nt, Human
agggcaugccacgugggcucau

SEQ ID NO: 1444028 - RNA, 18 nt, Human
agggcaucucugggcugg

SEQ ID NO: 1444029 - RNA, 17 nt, Human
agggcaucucugggcug

SEQ ID NO: 1444030 - RNA, 16 nt, Human
agggcaucucugggcu

SEQ ID NO: 1444031 - RNA, 17 nt, Human
agggccacgcuccagcu

SEQ ID NO: 1444032 - RNA, 20 nt, Human
agggccacgcuccagcugcc

SEQ ID NO: 1444033 - RNA, 16 nt, Human
agggccacgcuccagc

SEQ ID NO: 1444034 - RNA, 15 nt, Human
agggccacgcuccag

SEQ ID NO: 1444035 - RNA, 21 nt, Human
agggccacaugggaggcucac

SEQ ID NO: 1444036 - RNA, 20 nt, Human
agggccacaugggaggcuca

SEQ ID NO: 1444037 - RNA, 17 nt, Human
agggcagcgccaggcug

SEQ ID NO: 1444038 - RNA, 18 nt, Human
agggcacugacggacuca

SEQ ID NO: 1444039 - RNA, 21 nt, Human
agggcacccuaguucuaccuc

SEQ ID NO: 1444040 - RNA, 21 nt, Human
agggcaccagggguuucucgc

SEQ ID NO: 1444041 - RNA, 19 nt, Human
agggcaccagggguuucuc

SEQ ID NO: 1444042 - RNA, 14 nt, Human
agggcaccaggggu

SEQ ID NO: 1444043 - RNA, 16 nt, Human
ugggcacuggauuagu

SEQ ID NO: 1444044 - RNA, 15 nt, Human
ugggcagaaggccaa

SEQ ID NO: 1444045 - RNA, 16 nt, Human
ugggcagaaggccaag

SEQ ID NO: 1444046 - RNA, 17 nt, Human
ugggcagaaggccaaga

SEQ ID NO: 1444047 - RNA, 18 nt, Human
ugggcagaaggccaagag

SEQ ID NO: 1444048 - RNA, 14 nt, Human
ugggccauguccaa

SEQ ID NO: 1444049 - RNA, 20 nt, Human
ugggccagucuguggaucag

SEQ ID NO: 1444050 - RNA, 16 nt, Human
ugggccagucugugga

SEQ ID NO: 1444051 - RNA, 23 nt, Human
ugggccauguccaaagaggcugc

SEQ ID NO: 1444052 - RNA, 19 nt, Human
ugggccauguccaaagagg

SEQ ID NO: 1444053 - RNA, 18 nt, Human
ugggccauguccaaagag

SEQ ID NO: 1444054 - RNA, 17 nt, Human
ugggccauguccaaaga

SEQ ID NO: 1444055 - RNA, 21 nt, Human
ugggccccaggggaacacugg

SEQ ID NO: 1444056 - RNA, 19 nt, Human
ugggccccauguuaacccc

SEQ ID NO: 1444057 - RNA, 15 nt, Human
agggaggcugguccu

SEQ ID NO: 1444058 - RNA, 14 nt, Human
agggaggcuggucc

SEQ ID NO: 1444059 - RNA, 22 nt, Human
agggaggcugcugcugcucuug

SEQ ID NO: 1444060 - RNA, 15 nt, Human
agggaggcugcugcu

SEQ ID NO: 1444061 - RNA, 23 nt, Human
agggaggccgaagcuaacaggga

SEQ ID NO: 1444062 - RNA, 16 nt, Human
agggaggccgaagcua

SEQ ID NO: 1444063 - RNA, 14 nt, Human
agggaggccgaagc

SEQ ID NO: 1444064 - RNA, 17 nt, Human
agggaggcauggucugc

SEQ ID NO: 1444065 - RNA, 20 nt, Human
ugggccccugccucucugca

SEQ ID NO: 1444066 - RNA, 15 nt, Human
ugggccccugccucu

SEQ ID NO: 1444067 - RNA, 19 nt, Human
ugggccccugccucucugc

SEQ ID NO: 1444068 - RNA, 19 nt, Human
agggaauaagguacaagaa

SEQ ID NO: 1444069 - RNA, 22 nt, Human
agggacaaguggacucagggca

SEQ ID NO: 1444070 - RNA, 21 nt, Human
agggacaaaggagccugugaa

SEQ ID NO: 1444071 - RNA, 20 nt, Human
agggacaaaggagccuguga

SEQ ID NO: 1444072 - RNA, 19 nt, Human
agggacaaaggagccugug

SEQ ID NO: 1444073 - RNA, 18 nt, Human
agggacaaaggagccugu

SEQ ID NO: 1444074 - RNA, 17 nt, Human
agggacaaaggagccug

SEQ ID NO: 1444075 - RNA, 16 nt, Human
agggacaaaggagccu

SEQ ID NO: 1444076 - RNA, 15 nt, Human
agggacaaaggagcc

SEQ ID NO: 1444077 - RNA, 14 nt, Human
agggacaaaggagc

SEQ ID NO: 1444078 - RNA, 13 nt, Human
agggaaugugaaa

SEQ ID NO: 1444079 - RNA, 16 nt, Human
agggaauugcagagua

SEQ ID NO: 1444080 - RNA, 14 nt, Human
agggaaugugaaau

SEQ ID NO: 1444081 - RNA, 16 nt, Human
agggaagggccugcca

SEQ ID NO: 1444082 - RNA, 14 nt, Human
agggaagggccugc

SEQ ID NO: 1444083 - RNA, 13 nt, Human
agggaagggccug

SEQ ID NO: 1444084 - RNA, 19 nt, Human
agggaagggagccaaggga

SEQ ID NO: 1444085 - RNA, 16 nt, Human
agggaagggagccaag

SEQ ID NO: 1444086 - RNA, 15 nt, Human
agggaagggagccaa

SEQ ID NO: 1444087 - RNA, 14 nt, Human
agggaagggagcca

SEQ ID NO: 1444088 - RNA, 13 nt, Human
agggaagggagcc

SEQ ID NO: 1444089 - RNA, 12 nt, Human
agggaagggagc

SEQ ID NO: 1444090 - RNA, 19 nt, Human
agggaaggcuggacuaggc

SEQ ID NO: 1444091 - RNA, 20 nt, Human
agggaagggagccaagggau

SEQ ID NO: 1444092 - RNA, 18 nt, Human
agggaagggccugccaca

SEQ ID NO: 1444093 - RNA, 18 nt, Human
agggaaggcaggcagggc

SEQ ID NO: 1444094 - RNA, 20 nt, Human
agggaaggcaggcagggcuc

SEQ ID NO: 1444095 - RNA, 16 nt, Human
agggaaggcaggcagg

SEQ ID NO: 1444096 - RNA, 15 nt, Human
agggaaggcaggcag

SEQ ID NO: 1444097 - RNA, 14 nt, Human
agggaaggcaggca

SEQ ID NO: 1444098 - RNA, 12 nt, Human
agggaaggcagg

SEQ ID NO: 1444099 - RNA, 19 nt, Human
agggaaggaggagccuguc

SEQ ID NO: 1444100 - RNA, 17 nt, Human
agggaaggaggagccug

SEQ ID NO: 1444101 - RNA, 23 nt, Human
agggaaggaucccaugagcuccu

SEQ ID NO: 1444102 - RNA, 22 nt, Human
agggaaggaucccaugagcucc

SEQ ID NO: 1444103 - RNA, 15 nt, Human
agggaaggaucccau

SEQ ID NO: 1444104 - RNA, 22 nt, Human
agggaaggauacaaaagcaugu

SEQ ID NO: 1444105 - RNA, 14 nt, Human
agggaagcucuugg

SEQ ID NO: 1444106 - RNA, 17 nt, Human
agggaagcagcagccuc

SEQ ID NO: 1444107 - RNA, 18 nt, Human
agggaagcagcagccucg

SEQ ID NO: 1444108 - RNA, 17 nt, Human
agggaaccacuuucuua

SEQ ID NO: 1444109 - RNA, 23 nt, Human
agggaacaauuuggcaauuuugu

SEQ ID NO: 1444110 - RNA, 21 nt, Human
agggaacaauuuggcaauuuu

SEQ ID NO: 1444111 - RNA, 14 nt, Human
agggaaccuguguc

SEQ ID NO: 1444112 - RNA, 22 nt, Human
agggaacccagcucuaauacau

SEQ ID NO: 1444113 - RNA, 23 nt, Human
agggaacccagcucuaauacauu

SEQ ID NO: 1444114 - RNA, 15 nt, Human
aggcccucgcugcca

SEQ ID NO: 1444115 - RNA, 23 nt, Human
aggcccucccuguuccccagaga

SEQ ID NO: 1444116 - RNA, 22 nt, Human
aggcccucccuguuccccagag

SEQ ID NO: 1444117 - RNA, 20 nt, Human
aggcccucccuguuccccag

SEQ ID NO: 1444118 - RNA, 23 nt, Human
aggcccuccacaccugcggccca

SEQ ID NO: 1444119 - RNA, 21 nt, Human
aggcccuccacaccugcggcc

SEQ ID NO: 1444120 - RNA, 20 nt, Human
aggcccuccacaccugcggc

SEQ ID NO: 1444121 - RNA, 19 nt, Human
aggcccuccacaccugcgg

SEQ ID NO: 1444122 - RNA, 18 nt, Human
aggcccuccacaccugcg

SEQ ID NO: 1444123 - RNA, 17 nt, Human
aggcccuccacaccugc

SEQ ID NO: 1444124 - RNA, 16 nt, Human
aggcccuccacaccug

SEQ ID NO: 1444125 - RNA, 23 nt, Human
aggcccucaagucuuucucuuuc

SEQ ID NO: 1444126 - RNA, 18 nt, Human
aggcccucaagucuuucu

SEQ ID NO: 1444127 - RNA, 20 nt, Human
aggcccgcucuacaucuucu

SEQ ID NO: 1444128 - RNA, 23 nt, Human
ugggagaaucgcuccugcagccc

SEQ ID NO: 1444129 - RNA, 18 nt, Human
ugggacugcuaaauaaaa

SEQ ID NO: 1444130 - RNA, 17 nt, Human
ugggacugcuaaauaaa

SEQ ID NO: 1444131 - RNA, 18 nt, Human
ugggacuaaaugcccugc

SEQ ID NO: 1444132 - RNA, 23 nt, Human
ugggacucagccuucagacagag

SEQ ID NO: 1444133 - RNA, 17 nt, Human
ugggacucagccuucag

SEQ ID NO: 1444134 - RNA, 13 nt, Human
ugggacucagccu

SEQ ID NO: 1444135 - RNA, 15 nt, Human
ugggacuaaaugccc

SEQ ID NO: 1444136 - RNA, 21 nt, Human
ugggacguggcucagccagca

SEQ ID NO: 1444137 - RNA, 18 nt, Human
ugggagaccuguaaucau

SEQ ID NO: 1444138 - RNA, 22 nt, Human
ugggagaccggccugccaggag

SEQ ID NO: 1444139 - RNA, 21 nt, Human
ugggagaccggccugccagga

SEQ ID NO: 1444140 - RNA, 20 nt, Human
ugggagaccggccugccagg

SEQ ID NO: 1444141 - RNA, 16 nt, Human
ugggagacaugugaca

SEQ ID NO: 1444142 - RNA, 15 nt, Human
ugggagacaugugac

SEQ ID NO: 1444143 - RNA, 14 nt, Human
ugggagacauguga

SEQ ID NO: 1444144 - RNA, 21 nt, Human
ugggagagacuuguuuuggau

SEQ ID NO: 1444145 - RNA, 15 nt, Human
ugggagagacuuguu

SEQ ID NO: 1444146 - RNA, 14 nt, Human
ugggagagacuugu

SEQ ID NO: 1444147 - RNA, 12 nt, Human
ugggagagacuu

SEQ ID NO: 1444148 - RNA, 23 nt, Human
ugggagaccggccugccaggagg

SEQ ID NO: 1444149 - RNA, 16 nt, Human
agggagagggggcugg

SEQ ID NO: 1444150 - RNA, 19 nt, Human
agggagagucucccaggga

SEQ ID NO: 1444151 - RNA, 20 nt, Human
agggagagucucccagggag

SEQ ID NO: 1444152 - RNA, 22 nt, Human
agggagagucucccagggagca

SEQ ID NO: 1444153 - RNA, 13 nt, Human
agggagagggggc

SEQ ID NO: 1444154 - RNA, 19 nt, Human
agggagcaaguccuucccu

SEQ ID NO: 1444155 - RNA, 21 nt, Human
agggagcaaguccuucccuuu

SEQ ID NO: 1444156 - RNA, 19 nt, Human
agggagagcccaggagcuc

SEQ ID NO: 1444157 - RNA, 21 nt, Human
agggagagcccaggagcuccc

SEQ ID NO: 1444158 - RNA, 18 nt, Human
agggagagcccaggagcu

SEQ ID NO: 1444159 - RNA, 14 nt, Human
agggagagcccagg

SEQ ID NO: 1444160 - RNA, 13 nt, Human
agggagagcccag

SEQ ID NO: 1444161 - RNA, 12 nt, Human
agggagagccca

SEQ ID NO: 1444162 - RNA, 16 nt, Human
agggacagaggcccca

SEQ ID NO: 1444163 - RNA, 14 nt, Human
agggacaccuggga

SEQ ID NO: 1444164 - RNA, 21 nt, Human
agggacaccugggagaaaucu

SEQ ID NO: 1444165 - RNA, 19 nt, Human
agggacaaguggacucagg

SEQ ID NO: 1444166 - RNA, 20 nt, Human
agggaggaggcagagaagaa

SEQ ID NO: 1444167 - RNA, 20 nt, Human
ugggguccuggagcagacca

SEQ ID NO: 1444168 - RNA, 21 nt, Human
uggggucccagcagcugccag

SEQ ID NO: 1444169 - RNA, 15 nt, Human
uggggucccagcagc

SEQ ID NO: 1444170 - RNA, 14 nt, Human
uggggucccagcag

SEQ ID NO: 1444171 - RNA, 14 nt, Human
uggggcuggccucc

SEQ ID NO: 1444172 - RNA, 17 nt, Human
uggggcuggagaggaca

SEQ ID NO: 1444173 - RNA, 20 nt, Human
uggggcucuaacgccugagc

SEQ ID NO: 1444174 - RNA, 19 nt, Human
uggggcucuaacgccugag

SEQ ID NO: 1444175 - RNA, 18 nt, Human
uggggcucuaacgccuga

SEQ ID NO: 1444176 - RNA, 17 nt, Human
uggggcucuaacgccug

SEQ ID NO: 1444177 - RNA, 19 nt, Human
uggggugcagggauguggg

SEQ ID NO: 1444178 - RNA, 18 nt, Human
uggggugcagggaugugg

SEQ ID NO: 1444179 - RNA, 15 nt, Human
uggggugcagggaug

SEQ ID NO: 1444180 - RNA, 11 nt, Human
uggggugcagg

SEQ ID NO: 1444181 - RNA, 23 nt, Human
uggggugacccggcacccccugc

SEQ ID NO: 1444182 - RNA, 22 nt, Human
uggggugacccggcacccccug

SEQ ID NO: 1444183 - RNA, 16 nt, Human
uggggucuguaaaauc

SEQ ID NO: 1444184 - RNA, 18 nt, Human
uggggucuggcagccucc

SEQ ID NO: 1444185 - RNA, 13 nt, Human
uggggucuguaaa

SEQ ID NO: 1444186 - RNA, 17 nt, Human
uggggucuggcagccuc

SEQ ID NO: 1444187 - RNA, 14 nt, Human
uggggucuggcagc

SEQ ID NO: 1444188 - RNA, 21 nt, Human
uggggucuggaguugaucugg

SEQ ID NO: 1444189 - RNA, 14 nt, Human
uggggucugacccc

SEQ ID NO: 1444190 - RNA, 20 nt, Human
ugggguggcugcagccucag

SEQ ID NO: 1444191 - RNA, 19 nt, Human
ugggguggcugcagccuca

SEQ ID NO: 1444192 - RNA, 18 nt, Human
ugggguggcugcagccuc

SEQ ID NO: 1444193 - RNA, 16 nt, Human
ugggguggcugcagcc

SEQ ID NO: 1444194 - RNA, 14 nt, Human
ugggguggcugcag

SEQ ID NO: 1444195 - RNA, 13 nt, Human
ugggguggcugca

SEQ ID NO: 1444196 - RNA, 12 nt, Human
ugggguggcugc

SEQ ID NO: 1444197 - RNA, 18 nt, Human
agggcuuuguuuugcaca

SEQ ID NO: 1444198 - RNA, 14 nt, Human
aggggaagaggccu

SEQ ID NO: 1444199 - RNA, 15 nt, Human
aggggaagaggccug

SEQ ID NO: 1444200 - RNA, 21 nt, Human
aggggaagcagaaauccaagc

SEQ ID NO: 1444201 - RNA, 17 nt, Human
uggggagcgggucugcu

SEQ ID NO: 1444202 - RNA, 16 nt, Human
uggggagcaggcagcc

SEQ ID NO: 1444203 - RNA, 21 nt, Human
uggggagcccgucucaguguu

SEQ ID NO: 1444204 - RNA, 19 nt, Human
uggggagcccgucucagug

SEQ ID NO: 1444205 - RNA, 18 nt, Human
uggggagcccgucucagu

SEQ ID NO: 1444206 - RNA, 17 nt, Human
uggggagcaggcagcca

SEQ ID NO: 1444207 - RNA, 23 nt, Human
uggggagacauaaccacugcuuc

SEQ ID NO: 1444208 - RNA, 13 nt, Human
uggggaggaggag

SEQ ID NO: 1444209 - RNA, 12 nt, Human
uggggaggacaa

SEQ ID NO: 1444210 - RNA, 20 nt, Human
uggggagcgggucugcuccc

SEQ ID NO: 1444211 - RNA, 19 nt, Human
uggggagcgggucugcucc

SEQ ID NO: 1444212 - RNA, 18 nt, Human
uggggagggauucugguu

SEQ ID NO: 1444213 - RNA, 12 nt, Human
uggggaggagga

SEQ ID NO: 1444214 - RNA, 17 nt, Human
uggggagacugggcuga

SEQ ID NO: 1444215 - RNA, 14 nt, Human
agggcucugaggcg

SEQ ID NO: 1444216 - RNA, 21 nt, Human
uggggagacugggcugaggga

SEQ ID NO: 1444217 - RNA, 13 nt, Human
uggggagagacgg

SEQ ID NO: 1444218 - RNA, 16 nt, Human
agggcucugaggcgcc

SEQ ID NO: 1444219 - RNA, 13 nt, Human
agggcucugaggc

SEQ ID NO: 1444220 - RNA, 12 nt, Human
agggcucugagg

SEQ ID NO: 1444221 - RNA, 11 nt, Human
agggcucugag

SEQ ID NO: 1444222 - RNA, 17 nt, Human
agggcucuccuggcuuc

SEQ ID NO: 1444223 - RNA, 16 nt, Human
agggcucuccuggcuu

SEQ ID NO: 1444224 - RNA, 15 nt, Human
agggcucuccuggcu

SEQ ID NO: 1444225 - RNA, 14 nt, Human
agggcucuccuggc

SEQ ID NO: 1444226 - RNA, 12 nt, Human
agggcucuccug

SEQ ID NO: 1444227 - RNA, 18 nt, Human
agggcucgaggggugggc

SEQ ID NO: 1444228 - RNA, 20 nt, Human
agggcucgaggggugggcug

SEQ ID NO: 1444229 - RNA, 23 nt, Human
agggcuccuugugggccugggcu

SEQ ID NO: 1444230 - RNA, 22 nt, Human
agggcuccuugugggccugggc

SEQ ID NO: 1444231 - RNA, 21 nt, Human
agggcuccuugugggccuggg

SEQ ID NO: 1444232 - RNA, 20 nt, Human
agggcuccuugugggccugg

SEQ ID NO: 1444233 - RNA, 19 nt, Human
agggcuccuugugggccug

SEQ ID NO: 1444234 - RNA, 22 nt, Human
uggggagggauucugguuccag

SEQ ID NO: 1444235 - RNA, 11 nt, Human
uggggccugua

SEQ ID NO: 1444236 - RNA, 14 nt, Human
uggggccugguucc

SEQ ID NO: 1444237 - RNA, 14 nt, Human
uggggccugggagg

SEQ ID NO: 1444238 - RNA, 13 nt, Human
uggggccugggag

SEQ ID NO: 1444239 - RNA, 22 nt, Human
uggggccugggacaacugcucc

SEQ ID NO: 1444240 - RNA, 14 nt, Human
uggggccugggaca

SEQ ID NO: 1444241 - RNA, 13 nt, Human
uggggccugggac

SEQ ID NO: 1444242 - RNA, 12 nt, Human
uggggccuggga

SEQ ID NO: 1444243 - RNA, 17 nt, Human
uggggcucagagccggg

SEQ ID NO: 1444244 - RNA, 13 nt, Human
uggggcucagagc

SEQ ID NO: 1444245 - RNA, 17 nt, Human
uggggcucacacaccug

SEQ ID NO: 1444246 - RNA, 20 nt, Human
uggggccuguacugccugcu

SEQ ID NO: 1444247 - RNA, 19 nt, Human
uggggccuguacugccugc

SEQ ID NO: 1444248 - RNA, 18 nt, Human
uggggccuguacugccug

SEQ ID NO: 1444249 - RNA, 23 nt, Human
uggggcuccuccaggguggcagc

SEQ ID NO: 1444250 - RNA, 15 nt, Human
aggggucaaguuauu

SEQ ID NO: 1444251 - RNA, 21 nt, Human
aggggucaaguuauuaauuuc

SEQ ID NO: 1444252 - RNA, 19 nt, Human
agggguaggggcugggaac

SEQ ID NO: 1444253 - RNA, 18 nt, Human
agggguaggggcugggaa

SEQ ID NO: 1444254 - RNA, 16 nt, Human
agggguaggggcuggg

SEQ ID NO: 1444255 - RNA, 15 nt, Human
agggguaggggcugg

SEQ ID NO: 1444256 - RNA, 14 nt, Human
agggguaggggcug

SEQ ID NO: 1444257 - RNA, 18 nt, Human
agggggcuggaggagccc

SEQ ID NO: 1444258 - RNA, 17 nt, Human
agggggcuggaggagcc

SEQ ID NO: 1444259 - RNA, 16 nt, Human
agggggcuggaggagc

SEQ ID NO: 1444260 - RNA, 14 nt, Human
agggggcuggagga

SEQ ID NO: 1444261 - RNA, 19 nt, Human
agggggcuggaggagccca

SEQ ID NO: 1444262 - RNA, 21 nt, Human
agggguugcuccgccuggccu

SEQ ID NO: 1444263 - RNA, 16 nt, Human
agggguuggggaaaca

SEQ ID NO: 1444264 - RNA, 23 nt, Human
aggguaaaucaguaagagguguu

SEQ ID NO: 1444265 - RNA, 14 nt, Human
aggguaaacaauau

SEQ ID NO: 1444266 - RNA, 13 nt, Human
aggguaaacaaua

SEQ ID NO: 1444267 - RNA, 11 nt, Human
aggguaaauca

SEQ ID NO: 1444268 - RNA, 13 nt, Human
agggggcuggagg

SEQ ID NO: 1444269 - RNA, 12 nt, Human
agggggcuggag

SEQ ID NO: 1444270 - RNA, 20 nt, Human
agggggcugcugcugggcuc

SEQ ID NO: 1444271 - RNA, 19 nt, Human
agggggcugcugcugggcu

SEQ ID NO: 1444272 - RNA, 14 nt, Human
agggggcugcugcu

SEQ ID NO: 1444273 - RNA, 13 nt, Human
agggggcugcugc

SEQ ID NO: 1444274 - RNA, 15 nt, Human
agggggcggccuaug

SEQ ID NO: 1444275 - RNA, 12 nt, Human
agggggcggccu

SEQ ID NO: 1444276 - RNA, 20 nt, Human
agggggcgccugugguucug

SEQ ID NO: 1444277 - RNA, 15 nt, Human
agggggcgccugugg

SEQ ID NO: 1444278 - RNA, 21 nt, Human
aggggcugcuuccuccuggaa

SEQ ID NO: 1444279 - RNA, 16 nt, Human
agggggcaagaggaau

SEQ ID NO: 1444280 - RNA, 20 nt, Human
aggggcugcuuccuccugga

SEQ ID NO: 1444281 - RNA, 18 nt, Human
aggggcugcuuccuccug

SEQ ID NO: 1444282 - RNA, 16 nt, Human
aggggcugcuuccucc

SEQ ID NO: 1444283 - RNA, 15 nt, Human
aggggcugcuuccuc

SEQ ID NO: 1444284 - RNA, 16 nt, Human
aggggcuccuuuccau

SEQ ID NO: 1444285 - RNA, 24 nt, Human
aggggagcccacuguccugggccu

SEQ ID NO: 1444286 - RNA, 21 nt, Human
aggggagcccacuguccuggg

SEQ ID NO: 1444287 - RNA, 17 nt, Human
aggggagcccacugucc

SEQ ID NO: 1444288 - RNA, 13 nt, Human
aggggagcccacu

SEQ ID NO: 1444289 - RNA, 12 nt, Human
aggggagcccac

SEQ ID NO: 1444290 - RNA, 22 nt, Human
aggggagcagaggggcagaggc

SEQ ID NO: 1444291 - RNA, 20 nt, Human
aggggagcagaggggcagag

SEQ ID NO: 1444292 - RNA, 16 nt, Human
aggggagcagaggggc

SEQ ID NO: 1444293 - RNA, 13 nt, Human
aggggagcagagg

SEQ ID NO: 1444294 - RNA, 16 nt, Human
aggggaaucagaacuc

SEQ ID NO: 1444295 - RNA, 15 nt, Human
aggggaaucagaacu

SEQ ID NO: 1444296 - RNA, 16 nt, Human
aggggaauugaggaca

SEQ ID NO: 1444297 - RNA, 24 nt, Human
ugguaacuuuugugaauuaggcug

SEQ ID NO: 1444298 - RNA, 16 nt, Human
ugguaacuuuugugaa

SEQ ID NO: 1444299 - RNA, 14 nt, Human
ugguaacuuuugug

SEQ ID NO: 1444300 - RNA, 22 nt, Human
ugguaacugcuuucuguuccaa

SEQ ID NO: 1444301 - RNA, 14 nt, Human
ugguaacugcuuuc

SEQ ID NO: 1444302 - RNA, 14 nt, Human
ugguacccucugga

SEQ ID NO: 1444303 - RNA, 21 nt, Human
ugguacccuccuggcucuuga

SEQ ID NO: 1444304 - RNA, 16 nt, Human
ugguacccuccuggcu

SEQ ID NO: 1444305 - RNA, 15 nt, Human
ugguacccuccuggc

SEQ ID NO: 1444306 - RNA, 13 nt, Human
ugguaccagaugc

SEQ ID NO: 1444307 - RNA, 18 nt, Human
ugguaccagauaacuuuu

SEQ ID NO: 1444308 - RNA, 14 nt, Human
ugguaccagauaac

SEQ ID NO: 1444309 - RNA, 13 nt, Human
ugguaccagauaa

SEQ ID NO: 1444310 - RNA, 17 nt, Human
ugguagaccacugccau

SEQ ID NO: 1444311 - RNA, 23 nt, Human
ugguagaccacugccauaugauu

SEQ ID NO: 1444312 - RNA, 17 nt, Human
ugguagaccaaaauaaa

SEQ ID NO: 1444313 - RNA, 20 nt, Human
uggucacguuuggugcuucu

SEQ ID NO: 1444314 - RNA, 21 nt, Human
agggucuguagguugcacacu

SEQ ID NO: 1444315 - RNA, 22 nt, Human
agggucuguagguugcacacuu

SEQ ID NO: 1444316 - RNA, 20 nt, Human
agggucuguagguugcacac

SEQ ID NO: 1444317 - RNA, 19 nt, Human
agggucuguagguugcaca

SEQ ID NO: 1444318 - RNA, 23 nt, Human
agggucugggggcacaagacuga

SEQ ID NO: 1444319 - RNA, 22 nt, Human
agggucugggggcacaagacug

SEQ ID NO: 1444320 - RNA, 23 nt, Human
agggucugcucuuucucugccag

SEQ ID NO: 1444321 - RNA, 22 nt, Human
agggucugcucuuucucugcca

SEQ ID NO: 1444322 - RNA, 21 nt, Human
agggucugcucuuucucugcc

SEQ ID NO: 1444323 - RNA, 20 nt, Human
agggucugcucuuucucugc

SEQ ID NO: 1444324 - RNA, 17 nt, Human
agggucugcucuuucuc

SEQ ID NO: 1444325 - RNA, 14 nt, Human
agggucugcucuuu

SEQ ID NO: 1444326 - RNA, 13 nt, Human
agggucugcucuu

SEQ ID NO: 1444327 - RNA, 23 nt, Human
agggugggcuuguggggccuggg

SEQ ID NO: 1444328 - RNA, 21 nt, Human
aggguggggggggggcgcggc

SEQ ID NO: 1444329 - RNA, 18 nt, Human
uggguccaugggcagagc

SEQ ID NO: 1444330 - RNA, 22 nt, Human
agggugggcuuguggggccugg

SEQ ID NO: 1444331 - RNA, 17 nt, Human
agggugggcuugugggg

SEQ ID NO: 1444332 - RNA, 13 nt, Human
ugggucccaggac

SEQ ID NO: 1444333 - RNA, 16 nt, Human
ugggucgcccuggacu

SEQ ID NO: 1444334 - RNA, 18 nt, Human
ugggucgcccuggacugu

SEQ ID NO: 1444335 - RNA, 23 nt, Human
ugggugccuaggccugggcagug

SEQ ID NO: 1444336 - RNA, 21 nt, Human
ugggugccuaggccugggcag

SEQ ID NO: 1444337 - RNA, 17 nt, Human
ugggugccuaggccugg

SEQ ID NO: 1444338 - RNA, 16 nt, Human
ugggugccuaggccug

SEQ ID NO: 1444339 - RNA, 22 nt, Human
ugggugaggaucccugaaggcc

SEQ ID NO: 1444340 - RNA, 12 nt, Human
ugggugacauuu

SEQ ID NO: 1444341 - RNA, 21 nt, Human
ugggucgcccuggacugugug

SEQ ID NO: 1444342 - RNA, 17 nt, Human
uggugcggcuggccaug

SEQ ID NO: 1444343 - RNA, 22 nt, Human
uggugcggcuggccauggagaa

SEQ ID NO: 1444344 - RNA, 16 nt, Human
uggugcggcuggccau

SEQ ID NO: 1444345 - RNA, 14 nt, Human
uggugcggcuggcc

SEQ ID NO: 1444346 - RNA, 14 nt, Human
uggugccuucauuu

SEQ ID NO: 1444347 - RNA, 12 nt, Human
uggugccuucau

SEQ ID NO: 1444348 - RNA, 13 nt, Human
uggugccuccaga

SEQ ID NO: 1444349 - RNA, 17 nt, Human
aggugaggucuguuccu

SEQ ID NO: 1444350 - RNA, 17 nt, Human
aggugaggucagcacau

SEQ ID NO: 1444351 - RNA, 23 nt, Human
uggugucucuucuuuagaacagg

SEQ ID NO: 1444352 - RNA, 17 nt, Human
uggugucucuucuuuag

SEQ ID NO: 1444353 - RNA, 15 nt, Human
ugguggcacaggccc

SEQ ID NO: 1444354 - RNA, 14 nt, Human
ugguuagaaaugca

SEQ ID NO: 1444355 - RNA, 13 nt, Human
ugguuagaaaugc

SEQ ID NO: 1444356 - RNA, 13 nt, Human
ugguuagaaaagu

SEQ ID NO: 1444357 - RNA, 15 nt, Human
ugguuaccaugucuu

SEQ ID NO: 1444358 - RNA, 13 nt, Human
ugguggagggcca

SEQ ID NO: 1444359 - RNA, 20 nt, Human
uggugcugggagaggcagcc

SEQ ID NO: 1444360 - RNA, 13 nt, Human
uggugcugggaga

SEQ ID NO: 1444361 - RNA, 23 nt, Human
uggugcuucucagauuucugagg

SEQ ID NO: 1444362 - RNA, 20 nt, Human
agguccacaggucuagacua

SEQ ID NO: 1444363 - RNA, 19 nt, Human
agguccacaggucuagacu

SEQ ID NO: 1444364 - RNA, 18 nt, Human
agguccacaggucuagac

SEQ ID NO: 1444365 - RNA, 15 nt, Human
agguccacaggucua

SEQ ID NO: 1444366 - RNA, 14 nt, Human
agguccacaggucu

SEQ ID NO: 1444367 - RNA, 15 nt, Human
aggucagccacuguu

SEQ ID NO: 1444368 - RNA, 16 nt, Human
aggucagcaugucuau

SEQ ID NO: 1444369 - RNA, 15 nt, Human
aggucagcaugucua

SEQ ID NO: 1444370 - RNA, 21 nt, Human
aggucagcacaucucaacagg

SEQ ID NO: 1444371 - RNA, 14 nt, Human
agguccagcucugg

SEQ ID NO: 1444372 - RNA, 13 nt, Human
agguccagcucug

SEQ ID NO: 1444373 - RNA, 19 nt, Human
agguccagagagaccgagg

SEQ ID NO: 1444374 - RNA, 20 nt, Human
agguccagagagaccgagga

SEQ ID NO: 1444375 - RNA, 18 nt, Human
agguccagcucuggaggg

SEQ ID NO: 1444376 - RNA, 17 nt, Human
agguccagcucuggagg

SEQ ID NO: 1444377 - RNA, 16 nt, Human
agguccagcucuggag

SEQ ID NO: 1444378 - RNA, 15 nt, Human
agguccagcucugga

SEQ ID NO: 1444379 - RNA, 21 nt, Human
aggucuucaucgaaucuacua

SEQ ID NO: 1444380 - RNA, 20 nt, Human
aggucuucaucgaaucuacu

SEQ ID NO: 1444381 - RNA, 19 nt, Human
aggugacaucggaaaaaua

SEQ ID NO: 1444382 - RNA, 13 nt, Human
aggugaccccagg

SEQ ID NO: 1444383 - RNA, 21 nt, Human
aggugaauagccauauuugua

SEQ ID NO: 1444384 - RNA, 22 nt, Human
aggugaauagccauauuuguaa

SEQ ID NO: 1444385 - RNA, 19 nt, Human
aggugaauagccauauuug

SEQ ID NO: 1444386 - RNA, 19 nt, Human
aggucuucuuaauauguuc

SEQ ID NO: 1444387 - RNA, 21 nt, Human
aggugaccccagggcacagga

SEQ ID NO: 1444388 - RNA, 24 nt, Human
aggugaccccagggcacaggagcu

SEQ ID NO: 1444389 - RNA, 19 nt, Human
aggugaccccagggcacag

SEQ ID NO: 1444390 - RNA, 18 nt, Human
aggugaccccagggcaca

SEQ ID NO: 1444391 - RNA, 17 nt, Human
aggugaccccagggcac

SEQ ID NO: 1444392 - RNA, 16 nt, Human
aggugaccccagggca

SEQ ID NO: 1444393 - RNA, 15 nt, Human
aggugaccccagggc

SEQ ID NO: 1444394 - RNA, 14 nt, Human
aggugaccccaggg

SEQ ID NO: 1444395 - RNA, 19 nt, Human
aggugaccaaaucagugug

SEQ ID NO: 1444396 - RNA, 21 nt, Human
aggugacugucuggggagcgg

SEQ ID NO: 1444397 - RNA, 18 nt, Human
aggugacugucuggggag

SEQ ID NO: 1444398 - RNA, 17 nt, Human
aggugacugucugggga

SEQ ID NO: 1444399 - RNA, 15 nt, Human
aggugacugucuggg

SEQ ID NO: 1444400 - RNA, 14 nt, Human
aggugacugucugg

SEQ ID NO: 1444401 - RNA, 14 nt, Human
aggugagaccaccu

SEQ ID NO: 1444402 - RNA, 15 nt, Human
aggugagaccaccuc

SEQ ID NO: 1444403 - RNA, 13 nt, Human
aggugagaaauuu

SEQ ID NO: 1444404 - RNA, 16 nt, Human
aggugagaccaccucu

SEQ ID NO: 1444405 - RNA, 21 nt, Human
aggugcccagaauaaguuauu

SEQ ID NO: 1444406 - RNA, 18 nt, Human
aggugccacuggagugug

SEQ ID NO: 1444407 - RNA, 14 nt, Human
aggugcccaggaga

SEQ ID NO: 1444408 - RNA, 15 nt, Human
aggugcccaggagaa

SEQ ID NO: 1444409 - RNA, 13 nt, Human
aggugcccaggag

SEQ ID NO: 1444410 - RNA, 12 nt, Human
aggugcccagga

SEQ ID NO: 1444411 - RNA, 13 nt, Human
aggugccacugga

SEQ ID NO: 1444412 - RNA, 15 nt, Human
aggugcauuuuuacu

SEQ ID NO: 1444413 - RNA, 18 nt, Human
aggugccugucccacccc

SEQ ID NO: 1444414 - RNA, 17 nt, Human
aggugccugucccaccc

SEQ ID NO: 1444415 - RNA, 22 nt, Human
agguucuccguuagcuccugug

SEQ ID NO: 1444416 - RNA, 21 nt, Human
agguucuccguuagcuccugu

SEQ ID NO: 1444417 - RNA, 20 nt, Human
agguucuccguuagcuccug

SEQ ID NO: 1444418 - RNA, 19 nt, Human
agguucuccguuagcuccu

SEQ ID NO: 1444419 - RNA, 21 nt, Human
agguucuccaacaucacagcc

SEQ ID NO: 1444420 - RNA, 13 nt, Human
agguucuccaaca

SEQ ID NO: 1444421 - RNA, 19 nt, Human
agguucuagguuucaaaga

SEQ ID NO: 1444422 - RNA, 17 nt, Human
agguucuagguuucaaa

SEQ ID NO: 1444423 - RNA, 17 nt, Human
agguguuaacauuccaa

SEQ ID NO: 1444424 - RNA, 23 nt, Human
agguguggcuuuaggagcagugg

SEQ ID NO: 1444425 - RNA, 20 nt, Human
agguguggagccgaggccua

SEQ ID NO: 1444426 - RNA, 14 nt, Human
agguucuuacugcu

SEQ ID NO: 1444427 - RNA, 16 nt, Human
agguucuuacugcuug

SEQ ID NO: 1444428 - RNA, 22 nt, Human
agguucuccaacaucacagccc

SEQ ID NO: 1444429 - RNA, 22 nt, Human
aggugucucaggcugccugagu

SEQ ID NO: 1444430 - RNA, 20 nt, Human
aggugucucaggcugccuga

SEQ ID NO: 1444431 - RNA, 19 nt, Human
aggugucucaggcugccug

SEQ ID NO: 1444432 - RNA, 18 nt, Human
aggugucucaggcugccu

SEQ ID NO: 1444433 - RNA, 17 nt, Human
aggugucucaggcugcc

SEQ ID NO: 1444434 - RNA, 16 nt, Human
aggugucucaggcugc

SEQ ID NO: 1444435 - RNA, 14 nt, Human
aggugucucaggcu

SEQ ID NO: 1444436 - RNA, 13 nt, Human
aggugucucaggc

SEQ ID NO: 1444437 - RNA, 20 nt, Human
agguguccuacagaaaaacc

SEQ ID NO: 1444438 - RNA, 19 nt, Human
agguguccuacagaaaaac

SEQ ID NO: 1444439 - RNA, 18 nt, Human
agguguccuacagaaaaa

SEQ ID NO: 1444440 - RNA, 17 nt, Human
agguguccuacagaaaa

SEQ ID NO: 1444441 - RNA, 16 nt, Human
agguguccuacagaaa

SEQ ID NO: 1444442 - RNA, 15 nt, Human
agguguccuacagaa

SEQ ID NO: 1444443 - RNA, 14 nt, Human
agguguccuacaga

SEQ ID NO: 1444444 - RNA, 17 nt, Human
ugguuugccuuccagaa

SEQ ID NO: 1444445 - RNA, 16 nt, Human
ugguuugccuuccaga

SEQ ID NO: 1444446 - RNA, 19 nt, Human
ugguuugcagcgacuggca

SEQ ID NO: 1444447 - RNA, 15 nt, Human
ugguuugcagguggc

SEQ ID NO: 1444448 - RNA, 15 nt, Human
ugguuuguaaauuaa

SEQ ID NO: 1444449 - RNA, 21 nt, Human
ugguuuguaaauuaacuuuua

SEQ ID NO: 1444450 - RNA, 19 nt, Human
uguaaacuguguauuccaa

SEQ ID NO: 1444451 - RNA, 18 nt, Human
ugguuugcagcgacuggc

SEQ ID NO: 1444452 - RNA, 18 nt, Human
ugguuucccaagagcuac

SEQ ID NO: 1444453 - RNA, 17 nt, Human
ugguuucccaagagcua

SEQ ID NO: 1444454 - RNA, 13 nt, Human
ugguuucccaaga

SEQ ID NO: 1444455 - RNA, 17 nt, Human
ugguuaugaauacuuug

SEQ ID NO: 1444456 - RNA, 13 nt, Human
uguaaacuuuuug

SEQ ID NO: 1444457 - RNA, 18 nt, Human
uguaaacuuuaucacuua

SEQ ID NO: 1444458 - RNA, 19 nt, Human
uguaaacuuuaucacuuaa

SEQ ID NO: 1444459 - RNA, 17 nt, Human
uguaaacuuuaucacuu

SEQ ID NO: 1444460 - RNA, 22 nt, Human
uguaaacuguguauuccaagac

SEQ ID NO: 1444461 - RNA, 19 nt, Human
uguaaaguauguauuauuu

SEQ ID NO: 1444462 - RNA, 21 nt, Human
uguaaaggagucaaaacuaca

SEQ ID NO: 1444463 - RNA, 19 nt, Human
uguaaaggagucaaaacua

SEQ ID NO: 1444464 - RNA, 16 nt, Human
uguaaaggagucaaaa

SEQ ID NO: 1444465 - RNA, 12 nt, Human
uguaaauauaaa

SEQ ID NO: 1444466 - RNA, 13 nt, Human
uguaaauauaaag

SEQ ID NO: 1444467 - RNA, 14 nt, Human
uguaaauaaaaaga

SEQ ID NO: 1444468 - RNA, 22 nt, Human
uguaaauaauacauuauauuuc

SEQ ID NO: 1444469 - RNA, 23 nt, Human
uguaaauaauacauuauauuucu

SEQ ID NO: 1444470 - RNA, 21 nt, Human
aguagaccuuguuacuucuga

SEQ ID NO: 1444471 - RNA, 20 nt, Human
aguagaccuuguuacuucug

SEQ ID NO: 1444472 - RNA, 14 nt, Human
aguagaaucucagu

SEQ ID NO: 1444473 - RNA, 14 nt, Human
aguagaauugcauu

SEQ ID NO: 1444474 - RNA, 15 nt, Human
aguagaauugcauug

SEQ ID NO: 1444475 - RNA, 23 nt, Human
aguagaccuuguuacuucugagg

SEQ ID NO: 1444476 - RNA, 18 nt, Human
aguagcguuuuuuaaaug

SEQ ID NO: 1444477 - RNA, 14 nt, Human
uguaggagggacug

SEQ ID NO: 1444478 - RNA, 19 nt, Human
uguaggagggacugucgcu

SEQ ID NO: 1444479 - RNA, 19 nt, Human
aguagcguuuuuuaaaugu

SEQ ID NO: 1444480 - RNA, 20 nt, Human
aguagcguuuuuuaaaugua

SEQ ID NO: 1444481 - RNA, 19 nt, Human
uguaguaauugacaugugc

SEQ ID NO: 1444482 - RNA, 13 nt, Human
uguagggagggcg

SEQ ID NO: 1444483 - RNA, 17 nt, Human
uguaggcuuaguuugug

SEQ ID NO: 1444484 - RNA, 20 nt, Human
uguaguauuuuuuguauaau

SEQ ID NO: 1444485 - RNA, 19 nt, Human
uguaguauuuuuuguauaa

SEQ ID NO: 1444486 - RNA, 18 nt, Human
uguaguauuuuuuguaua

SEQ ID NO: 1444487 - RNA, 16 nt, Human
uguaguagcguuuuuu

SEQ ID NO: 1444488 - RNA, 21 nt, Human
uguaguagcguuuuuuaaaug

SEQ ID NO: 1444489 - RNA, 22 nt, Human
uguaguagcguuuuuuaaaugu

SEQ ID NO: 1444490 - RNA, 20 nt, Human
uguaguaggcauuuuuacca

SEQ ID NO: 1444491 - RNA, 23 nt, Human
uguaguagcguuuuuuaaaugua

SEQ ID NO: 1444492 - RNA, 19 nt, Human
aguacccucucagcuccag

SEQ ID NO: 1444493 - RNA, 18 nt, Human
aguacccucucagcucca

SEQ ID NO: 1444494 - RNA, 16 nt, Human
aguacccucucagcuc

SEQ ID NO: 1444495 - RNA, 23 nt, Human
aguacccacucuggagcauuucu

SEQ ID NO: 1444496 - RNA, 23 nt, Human
aguaccauuuaauggggaggaca

SEQ ID NO: 1444497 - RNA, 12 nt, Human
aguaccauuuaa

SEQ ID NO: 1444498 - RNA, 21 nt, Human
aguagaaucucaguugauuuu

SEQ ID NO: 1444499 - RNA, 23 nt, Human
aguaaugguguagaacacuaauu

SEQ ID NO: 1444500 - RNA, 22 nt, Human
aguaaugguguagaacacuaau

SEQ ID NO: 1444501 - RNA, 19 nt, Human
aguaaugguguagaacacu

SEQ ID NO: 1444502 - RNA, 18 nt, Human
aguaaugguguagaacac

SEQ ID NO: 1444503 - RNA, 16 nt, Human
aguaaugguguagaac

SEQ ID NO: 1444504 - RNA, 15 nt, Human
aguaaugguguagaa

SEQ ID NO: 1444505 - RNA, 14 nt, Human
aguaaugguguaga

SEQ ID NO: 1444506 - RNA, 14 nt, Human
aguacauuguuacc

SEQ ID NO: 1444507 - RNA, 19 nt, Human
aguacauuguuaccucuau

SEQ ID NO: 1444508 - RNA, 22 nt, Human
aguacaugauaaaugauagaca

SEQ ID NO: 1444509 - RNA, 14 nt, Human
aguaauagccuggg

SEQ ID NO: 1444510 - RNA, 12 nt, Human
aguaaaagcaaa

SEQ ID NO: 1444511 - RNA, 17 nt, Human
aguaaaauaauaauuuu

SEQ ID NO: 1444512 - RNA, 14 nt, Human
aguaauaugcacac

SEQ ID NO: 1444513 - RNA, 15 nt, Human
aguaauaugcacaca

SEQ ID NO: 1444514 - RNA, 17 nt, Human
aguaaugauaacuggaa

SEQ ID NO: 1444515 - RNA, 17 nt, Human
aguaauaugcacacauu

SEQ ID NO: 1444516 - RNA, 20 nt, Human
aguaaugauaacuggaaacu

SEQ ID NO: 1444517 - RNA, 18 nt, Human
aguaaugauaacuggaaa

SEQ ID NO: 1444518 - RNA, 12 nt, Human
agguuuuuccuu

SEQ ID NO: 1444519 - RNA, 20 nt, Human
agguuuuauuucauuuuuca

SEQ ID NO: 1444520 - RNA, 23 nt, Human
agguuuuagguucuaaaguucua

SEQ ID NO: 1444521 - RNA, 17 nt, Human
agguuuuauaaggcuga

SEQ ID NO: 1444522 - RNA, 19 nt, Human
agguuuuagguucuaaagu

SEQ ID NO: 1444523 - RNA, 18 nt, Human
agguuuuagguucuaaag

SEQ ID NO: 1444524 - RNA, 17 nt, Human
agguuuuagguucuaaa

SEQ ID NO: 1444525 - RNA, 16 nt, Human
agguuuuagguucuaa

SEQ ID NO: 1444526 - RNA, 16 nt, Human
aguaaaagcaaaaaag

SEQ ID NO: 1444527 - RNA, 19 nt, Human
agguuuuuguuuguuuccu

SEQ ID NO: 1444528 - RNA, 19 nt, Human
agguuuuuguagugauuuu

SEQ ID NO: 1444529 - RNA, 13 nt, Human
aguaaaauccaca

SEQ ID NO: 1444530 - RNA, 15 nt, Human
agguuuuagguucua

SEQ ID NO: 1444531 - RNA, 22 nt, Human
agguuuuaauuuaguaaaccaa

SEQ ID NO: 1444532 - RNA, 14 nt, Human
agguuuuagguucu

SEQ ID NO: 1444533 - RNA, 20 nt, Human
agguuuuaauuuaguaaacc

SEQ ID NO: 1444534 - RNA, 17 nt, Human
agguuuuaauuuaguaa

SEQ ID NO: 1444535 - RNA, 16 nt, Human
agguuuuaauuuagua

SEQ ID NO: 1444536 - RNA, 17 nt, Human
uguagaacacuaauuca

SEQ ID NO: 1444537 - RNA, 15 nt, Human
uguagaacacuaauu

SEQ ID NO: 1444538 - RNA, 14 nt, Human
uguagaacacuaau

SEQ ID NO: 1444539 - RNA, 13 nt, Human
uguagaaaugguu

SEQ ID NO: 1444540 - RNA, 21 nt, Human
uguagaaaugguuguauuaga

SEQ ID NO: 1444541 - RNA, 23 nt, Human
uguagaaaauuuguuauuuugca

SEQ ID NO: 1444542 - RNA, 22 nt, Human
uguacuuggaguauuggggucu

SEQ ID NO: 1444543 - RNA, 14 nt, Human
agguuuacagaauu

SEQ ID NO: 1444544 - RNA, 16 nt, Human
agguuuaugaaaaaga

SEQ ID NO: 1444545 - RNA, 14 nt, Human
agguuuaugaaaaa

SEQ ID NO: 1444546 - RNA, 21 nt, Human
agguuuaugaaaaagaagaau

SEQ ID NO: 1444547 - RNA, 22 nt, Human
uguacuugcucuugaugccugg

SEQ ID NO: 1444548 - RNA, 23 nt, Human
uguacuugcucuugaugccuggc

SEQ ID NO: 1444549 - RNA, 19 nt, Human
agucacccuaccugugccu

SEQ ID NO: 1444550 - RNA, 17 nt, Human
agucacacaguguugga

SEQ ID NO: 1444551 - RNA, 20 nt, Human
agucacccuaccugugccug

SEQ ID NO: 1444552 - RNA, 17 nt, Human
agucaccucauggaauu

SEQ ID NO: 1444553 - RNA, 15 nt, Human
agucaccucauggaa

SEQ ID NO: 1444554 - RNA, 14 nt, Human
agucaccucaugga

SEQ ID NO: 1444555 - RNA, 14 nt, Human
aguauucuucucuu

SEQ ID NO: 1444556 - RNA, 12 nt, Human
aguauucuucuc

SEQ ID NO: 1444557 - RNA, 21 nt, Human
aguauuagaauaccacaggaa

SEQ ID NO: 1444558 - RNA, 22 nt, Human
aguauuucuaugaaauauuaug

SEQ ID NO: 1444559 - RNA, 18 nt, Human
aguauuucuaugaaauau

SEQ ID NO: 1444560 - RNA, 17 nt, Human
aguauuucuaugaaaua

SEQ ID NO: 1444561 - RNA, 20 nt, Human
ugucaaugcaguugucucug

SEQ ID NO: 1444562 - RNA, 23 nt, Human
ugucaaugcaguugucucuguuu

SEQ ID NO: 1444563 - RNA, 21 nt, Human
ugucaauaaaauccauacauu

SEQ ID NO: 1444564 - RNA, 18 nt, Human
aguauuagaauaccacag

SEQ ID NO: 1444565 - RNA, 13 nt, Human
aguagucagacug

SEQ ID NO: 1444566 - RNA, 21 nt, Human
ugucaaacaaauagucuauca

SEQ ID NO: 1444567 - RNA, 13 nt, Human
ugucaaacaaaua

SEQ ID NO: 1444568 - RNA, 21 nt, Human
ugucaaggguucaagauuguu

SEQ ID NO: 1444569 - RNA, 19 nt, Human
uguauucucuccuguaccu

SEQ ID NO: 1444570 - RNA, 20 nt, Human
uguauucucuccuguaccuc

SEQ ID NO: 1444571 - RNA, 13 nt, Human
uguauuacaaauc

SEQ ID NO: 1444572 - RNA, 22 nt, Human
uguauuacaaauccaaugaaau

SEQ ID NO: 1444573 - RNA, 17 nt, Human
uguaucauagaaaugua

SEQ ID NO: 1444574 - RNA, 16 nt, Human
uguaucauagaaaugu

SEQ ID NO: 1444575 - RNA, 15 nt, Human
uguaucauagaaaug

SEQ ID NO: 1444576 - RNA, 23 nt, Human
uguaucaaauacauuuaaaacau

SEQ ID NO: 1444577 - RNA, 21 nt, Human
uguaucaaauacauuuaaaac

SEQ ID NO: 1444578 - RNA, 14 nt, Human
uguaucaaauacau

SEQ ID NO: 1444579 - RNA, 22 nt, Human
uguauauuuuaagaaauaacag

SEQ ID NO: 1444580 - RNA, 16 nt, Human
uguaguguuggagaag

SEQ ID NO: 1444581 - RNA, 15 nt, Human
uguaguguuggagaa

SEQ ID NO: 1444582 - RNA, 15 nt, Human
uguagugcuuugaga

SEQ ID NO: 1444583 - RNA, 22 nt, Human
uguagugcuuugagagagaaag

SEQ ID NO: 1444584 - RNA, 15 nt, Human
uguagugcuacaggg

SEQ ID NO: 1444585 - RNA, 18 nt, Human
uguaguauggccuguguc

SEQ ID NO: 1444586 - RNA, 14 nt, Human
uguaguguuggaga

SEQ ID NO: 1444587 - RNA, 23 nt, Human
agucuuucucuuucccugguccc

SEQ ID NO: 1444588 - RNA, 19 nt, Human
agucuuucucuuucccugg

SEQ ID NO: 1444589 - RNA, 17 nt, Human
agucuuucucuuucccu

SEQ ID NO: 1444590 - RNA, 15 nt, Human
agucuuucucuuucc

SEQ ID NO: 1444591 - RNA, 14 nt, Human
agucuuucucuuuc

SEQ ID NO: 1444592 - RNA, 18 nt, Human
agucuuugguucuaagga

SEQ ID NO: 1444593 - RNA, 17 nt, Human
agucuuugguucuaagg

SEQ ID NO: 1444594 - RNA, 20 nt, Human
agucuuucucuuucccuggu

SEQ ID NO: 1444595 - RNA, 16 nt, Human
agucuuugguucuaag

SEQ ID NO: 1444596 - RNA, 15 nt, Human
agucuuugguucuaa

SEQ ID NO: 1444597 - RNA, 17 nt, Human
agucuuuggaacccuaa

SEQ ID NO: 1444598 - RNA, 17 nt, Human
ugugacucuuuccaacc

SEQ ID NO: 1444599 - RNA, 15 nt, Human
ugugacucuuuccaa

SEQ ID NO: 1444600 - RNA, 15 nt, Human
ugugacugaauuucu

SEQ ID NO: 1444601 - RNA, 16 nt, Human
ugugagagguuugacu

SEQ ID NO: 1444602 - RNA, 15 nt, Human
ugugagagguuugac

SEQ ID NO: 1444603 - RNA, 16 nt, Human
ugugacugaauuucuu

SEQ ID NO: 1444604 - RNA, 14 nt, Human
agucucucuucucu

SEQ ID NO: 1444605 - RNA, 18 nt, Human
agucucucuucucuccag

SEQ ID NO: 1444606 - RNA, 16 nt, Human
agucucucuucucucc

SEQ ID NO: 1444607 - RNA, 15 nt, Human
agucucucuucucuc

SEQ ID NO: 1444608 - RNA, 21 nt, Human
agucucaguuugugugucuua

SEQ ID NO: 1444609 - RNA, 20 nt, Human
agucucaguuugugugucuu

SEQ ID NO: 1444610 - RNA, 18 nt, Human
agucucaguuuguguguc

SEQ ID NO: 1444611 - RNA, 10 nt, Human
agucucaguu

SEQ ID NO: 1444612 - RNA, 19 nt, Human
agucucagugaagacuaug

SEQ ID NO: 1444613 - RNA, 15 nt, Human
agucucuauaccaau

SEQ ID NO: 1444614 - RNA, 17 nt, Human
agucucuauaccaauaa

SEQ ID NO: 1444615 - RNA, 19 nt, Human
agucucuauaccaauaaag

SEQ ID NO: 1444616 - RNA, 20 nt, Human
agucucuauaccaauaaagu

SEQ ID NO: 1444617 - RNA, 21 nt, Human
agucucuauaccaauaaagug

SEQ ID NO: 1444618 - RNA, 22 nt, Human
agucucuauaccaauaaaguga

SEQ ID NO: 1444619 - RNA, 22 nt, Human
ugucuugggcagagcuggcucu

SEQ ID NO: 1444620 - RNA, 21 nt, Human
ugucuugggcagagcuggcuc

SEQ ID NO: 1444621 - RNA, 16 nt, Human
ugucuugggcagagcu

SEQ ID NO: 1444622 - RNA, 13 nt, Human
ugucuugggcaga

SEQ ID NO: 1444623 - RNA, 12 nt, Human
ugucuugggcag

SEQ ID NO: 1444624 - RNA, 16 nt, Human
ugucagacccuggagg

SEQ ID NO: 1444625 - RNA, 17 nt, Human
ugucagacccuggaggc

SEQ ID NO: 1444626 - RNA, 15 nt, Human
ugucagacccuggag

SEQ ID NO: 1444627 - RNA, 21 nt, Human
ugucagaacuagaauuugauu

SEQ ID NO: 1444628 - RNA, 21 nt, Human
ugucacuuuuugaggcaaaag

SEQ ID NO: 1444629 - RNA, 19 nt, Human
ugucacuuuuugaggcaaa

SEQ ID NO: 1444630 - RNA, 18 nt, Human
ugucacuuuuugaggcaa

SEQ ID NO: 1444631 - RNA, 17 nt, Human
ugucacuuuuugaggca

SEQ ID NO: 1444632 - RNA, 15 nt, Human
ugucacuuuuugagg

SEQ ID NO: 1444633 - RNA, 12 nt, Human
ugucacuuuuug

SEQ ID NO: 1444634 - RNA, 20 nt, Human
agucacggcugcgcacugug

SEQ ID NO: 1444635 - RNA, 16 nt, Human
ugucacuuuuucugau

SEQ ID NO: 1444636 - RNA, 21 nt, Human
agucacggcugcgcacugugu

SEQ ID NO: 1444637 - RNA, 18 nt, Human
agucacgcaugcaguguu

SEQ ID NO: 1444638 - RNA, 20 nt, Human
ugugaaagggagaagugaca

SEQ ID NO: 1444639 - RNA, 14 nt, Human
ugugaaauuuacau

SEQ ID NO: 1444640 - RNA, 12 nt, Human
ugugaaauuauu

SEQ ID NO: 1444641 - RNA, 14 nt, Human
ugugacucuuucca

SEQ ID NO: 1444642 - RNA, 12 nt, Human
ugugacucuuuc

SEQ ID NO: 1444643 - RNA, 22 nt, Human
ugugaccugcugagcucugaga

SEQ ID NO: 1444644 - RNA, 18 nt, Human
ugugaccugcugagcucu

SEQ ID NO: 1444645 - RNA, 17 nt, Human
ugugaccugcugagcuc

SEQ ID NO: 1444646 - RNA, 16 nt, Human
ugugaccugcugagcu

SEQ ID NO: 1444647 - RNA, 15 nt, Human
ugugaccugcugagc

SEQ ID NO: 1444648 - RNA, 14 nt, Human
ugugaccugcugag

SEQ ID NO: 1444649 - RNA, 13 nt, Human
ugugaccugcuga

SEQ ID NO: 1444650 - RNA, 20 nt, Human
ugugaacaguuguguuugaa

SEQ ID NO: 1444651 - RNA, 21 nt, Human
ugugaacuggacccuguugcu

SEQ ID NO: 1444652 - RNA, 22 nt, Human
ugugaacuggacccuguugcua

SEQ ID NO: 1444653 - RNA, 17 nt, Human
ugugauuguggaaugga

SEQ ID NO: 1444654 - RNA, 14 nt, Human
ugugauuguggaau

SEQ ID NO: 1444655 - RNA, 18 nt, Human
ugugaugaauacuguauu

SEQ ID NO: 1444656 - RNA, 16 nt, Human
ugugaugaauacugua

SEQ ID NO: 1444657 - RNA, 14 nt, Human
ugugaugaauacug

SEQ ID NO: 1444658 - RNA, 13 nt, Human
ugugaucgucuga

SEQ ID NO: 1444659 - RNA, 18 nt, Human
ugugaucauguguggaag

SEQ ID NO: 1444660 - RNA, 15 nt, Human
agugaaagaaaauaa

SEQ ID NO: 1444661 - RNA, 16 nt, Human
agugaaauaaugugua

SEQ ID NO: 1444662 - RNA, 19 nt, Human
agugaaauaauguguaguu

SEQ ID NO: 1444663 - RNA, 15 nt, Human
agugaaauaaugugu

SEQ ID NO: 1444664 - RNA, 13 nt, Human
agugaaauaaugu

SEQ ID NO: 1444665 - RNA, 17 nt, Human
agugaaagaaaauaaca

SEQ ID NO: 1444666 - RNA, 21 nt, Human
ugugccaugucaaacaaauag

SEQ ID NO: 1444667 - RNA, 16 nt, Human
ugugccaugucaaaca

SEQ ID NO: 1444668 - RNA, 21 nt, Human
ugugccagggcaaugaugaau

SEQ ID NO: 1444669 - RNA, 18 nt, Human
ugugccagggcaaugaug

SEQ ID NO: 1444670 - RNA, 20 nt, Human
ugugccagauuuaugcauau

SEQ ID NO: 1444671 - RNA, 17 nt, Human
ugugccagagccugggg

SEQ ID NO: 1444672 - RNA, 16 nt, Human
ugugccagagccuggg

SEQ ID NO: 1444673 - RNA, 15 nt, Human
ugugccagagccugg

SEQ ID NO: 1444674 - RNA, 14 nt, Human
ugugccagagccug

SEQ ID NO: 1444675 - RNA, 13 nt, Human
ugugccagagccu

SEQ ID NO: 1444676 - RNA, 12 nt, Human
ugugccagagcc

SEQ ID NO: 1444677 - RNA, 23 nt, Human
ugugccagagaacccagcccacc

SEQ ID NO: 1444678 - RNA, 20 nt, Human
ugugccagagaacccagccc

SEQ ID NO: 1444679 - RNA, 21 nt, Human
ugugccagagccuggggcucu

SEQ ID NO: 1444680 - RNA, 22 nt, Human
ugugccagagccuggggcucua

SEQ ID NO: 1444681 - RNA, 20 nt, Human
ugugccagagccuggggcuc

SEQ ID NO: 1444682 - RNA, 18 nt, Human
ugugccagagccuggggc

SEQ ID NO: 1444683 - RNA, 18 nt, Human
ugugccagauuuaugcau

SEQ ID NO: 1444684 - RNA, 13 nt, Human
uguggccaggagg

SEQ ID NO: 1444685 - RNA, 14 nt, Human
uguggccaggaggu

SEQ ID NO: 1444686 - RNA, 12 nt, Human
uguggccaggag

SEQ ID NO: 1444687 - RNA, 11 nt, Human
uguggccagga

SEQ ID NO: 1444688 - RNA, 17 nt, Human
uguggcaugggugaaga

SEQ ID NO: 1444689 - RNA, 21 nt, Human
uguggcauccagagucccugc

SEQ ID NO: 1444690 - RNA, 19 nt, Human
uguggcauccagagucccu

SEQ ID NO: 1444691 - RNA, 19 nt, Human
agugagggagggcugucau

SEQ ID NO: 1444692 - RNA, 21 nt, Human
uguggccaugacccugccucu

SEQ ID NO: 1444693 - RNA, 22 nt, Human
ugugcccccaggguccugggag

SEQ ID NO: 1444694 - RNA, 16 nt, Human
ugugcccccagggucc

SEQ ID NO: 1444695 - RNA, 23 nt, Human
ugugcccccaaccauuuccucag

SEQ ID NO: 1444696 - RNA, 18 nt, Human
ugugcccccaaccauuuc

SEQ ID NO: 1444697 - RNA, 22 nt, Human
ugugcccaguuaaucuugcuuu

SEQ ID NO: 1444698 - RNA, 21 nt, Human
ugugcccaguuaaucuugcuu

SEQ ID NO: 1444699 - RNA, 12 nt, Human
ugugcccaguua

SEQ ID NO: 1444700 - RNA, 17 nt, Human
ugugcugggagcuccac

SEQ ID NO: 1444701 - RNA, 12 nt, Human
ugugcugggagc

SEQ ID NO: 1444702 - RNA, 10 nt, Human
ugugcuggga

SEQ ID NO: 1444703 - RNA, 13 nt, Human
ugugcuggccagc

SEQ ID NO: 1444704 - RNA, 18 nt, Human
ugugcuggaauucuaaca

SEQ ID NO: 1444705 - RNA, 21 nt, Human
uguggcagggguuagagcagg

SEQ ID NO: 1444706 - RNA, 20 nt, Human
uguggcagggguuagagcag

SEQ ID NO: 1444707 - RNA, 16 nt, Human
uguggcauccagaguc

SEQ ID NO: 1444708 - RNA, 23 nt, Human
uguggcagggguuagagcaggac

SEQ ID NO: 1444709 - RNA, 21 nt, Human
uguggcagaguuacaguucug

SEQ ID NO: 1444710 - RNA, 21 nt, Human
ugugcugggagcuccacucug

SEQ ID NO: 1444711 - RNA, 20 nt, Human
aguguagaaccuaauucaau

SEQ ID NO: 1444712 - RNA, 15 nt, Human
aguguagaaccuaau

SEQ ID NO: 1444713 - RNA, 23 nt, Human
aguguaccgcgucuacccuggga

SEQ ID NO: 1444714 - RNA, 22 nt, Human
aguguaacaauuguguagccuu

SEQ ID NO: 1444715 - RNA, 23 nt, Human
aguguaacaauuguguagccuuu

SEQ ID NO: 1444716 - RNA, 18 nt, Human
aguguaacaauuguguag

SEQ ID NO: 1444717 - RNA, 15 nt, Human
aguguaacaauugug

SEQ ID NO: 1444718 - RNA, 21 nt, Human
aguguaaaauauuuugaauca

SEQ ID NO: 1444719 - RNA, 18 nt, Human
aguguaaaauauuuugaa

SEQ ID NO: 1444720 - RNA, 14 nt, Human
aguguaaaauauuu

SEQ ID NO: 1444721 - RNA, 15 nt, Human
aguggugugaucuca

SEQ ID NO: 1444722 - RNA, 15 nt, Human
agugugcaaggcagc

SEQ ID NO: 1444723 - RNA, 13 nt, Human
agugugcaaggca

SEQ ID NO: 1444724 - RNA, 14 nt, Human
uguuacaaauugua

SEQ ID NO: 1444725 - RNA, 19 nt, Human
aguggacaaauuuugaguu

SEQ ID NO: 1444726 - RNA, 13 nt, Human
aguggacaggagu

SEQ ID NO: 1444727 - RNA, 17 nt, Human
aguggugguuuucuguu

SEQ ID NO: 1444728 - RNA, 18 nt, Human
aguggugguuuucuguuc

SEQ ID NO: 1444729 - RNA, 19 nt, Human
aguggugguuuucuguucu

SEQ ID NO: 1444730 - RNA, 20 nt, Human
aguggugguuuucuguucuu

SEQ ID NO: 1444731 - RNA, 21 nt, Human
aguggugguuuucuguucuuu

SEQ ID NO: 1444732 - RNA, 23 nt, Human
aguggugguuuucuguucuuucu

SEQ ID NO: 1444733 - RNA, 17 nt, Human
uguugcaagugcaauaa

SEQ ID NO: 1444734 - RNA, 16 nt, Human
uguucuguuuuguuuc

SEQ ID NO: 1444735 - RNA, 13 nt, Human
uguucuguuuugu

SEQ ID NO: 1444736 - RNA, 14 nt, Human
uguucuguuucaag

SEQ ID NO: 1444737 - RNA, 22 nt, Human
uguucuguuaacugaauaccac

SEQ ID NO: 1444738 - RNA, 23 nt, Human
uguucuguuaacugaauaccacu

SEQ ID NO: 1444739 - RNA, 21 nt, Human
uguucuguuaacugaauacca

SEQ ID NO: 1444740 - RNA, 19 nt, Human
uguucuguuaacugaauac

SEQ ID NO: 1444741 - RNA, 18 nt, Human
uguucuguuaacugaaua

SEQ ID NO: 1444742 - RNA, 17 nt, Human
uguucuguuaacugaau

SEQ ID NO: 1444743 - RNA, 16 nt, Human
uguucuguuaacugaa

SEQ ID NO: 1444744 - RNA, 14 nt, Human
uguucugugucuuu

SEQ ID NO: 1444745 - RNA, 13 nt, Human
uguucugugucuu

SEQ ID NO: 1444746 - RNA, 18 nt, Human
uguucugucccuugcccc

SEQ ID NO: 1444747 - RNA, 16 nt, Human
uguucugucccuugcc

SEQ ID NO: 1444748 - RNA, 15 nt, Human
uguucugugauauaa

SEQ ID NO: 1444749 - RNA, 18 nt, Human
uguucugugauauaagug

SEQ ID NO: 1444750 - RNA, 22 nt, Human
uguucccaagagcaucaugccu

SEQ ID NO: 1444751 - RNA, 16 nt, Human
uguucccaagagcauc

SEQ ID NO: 1444752 - RNA, 20 nt, Human
uguucccaccaggcugcuca

SEQ ID NO: 1444753 - RNA, 21 nt, Human
uguucccaccaggcugcucag

SEQ ID NO: 1444754 - RNA, 15 nt, Human
uguuccauuaaacga

SEQ ID NO: 1444755 - RNA, 18 nt, Human
uguuccaguaaucuaaua

SEQ ID NO: 1444756 - RNA, 23 nt, Human
uguucccaagagcaucaugccuc

SEQ ID NO: 1444757 - RNA, 13 nt, Human
uguucugucacca

SEQ ID NO: 1444758 - RNA, 15 nt, Human
uguuauauauaaaua

SEQ ID NO: 1444759 - RNA, 13 nt, Human
uguuauauauaaa

SEQ ID NO: 1444760 - RNA, 15 nt, Human
uguuauauaauuuag

SEQ ID NO: 1444761 - RNA, 12 nt, Human
uguuauauaauu

SEQ ID NO: 1444762 - RNA, 16 nt, Human
uguuauauaaucauua

SEQ ID NO: 1444763 - RNA, 15 nt, Human
uguuauauaaucauu

SEQ ID NO: 1444764 - RNA, 16 nt, Human
uguuauacaauacaga

SEQ ID NO: 1444765 - RNA, 18 nt, Human
uguuauauauaaauauau

SEQ ID NO: 1444766 - RNA, 17 nt, Human
uguuauauauaaauaua

SEQ ID NO: 1444767 - RNA, 16 nt, Human
uguuauauauaaauau

SEQ ID NO: 1444768 - RNA, 15 nt, Human
uguuauaaucuuuca

SEQ ID NO: 1444769 - RNA, 21 nt, Human
agugcugagauuacaggcaug

SEQ ID NO: 1444770 - RNA, 20 nt, Human
agugcugagauuacaggcau

SEQ ID NO: 1444771 - RNA, 12 nt, Human
agugcuguauaa

SEQ ID NO: 1444772 - RNA, 13 nt, Human
agugcuguauaaa

SEQ ID NO: 1444773 - RNA, 14 nt, Human
agugcuguauaaaa

SEQ ID NO: 1444774 - RNA, 15 nt, Human
agugcuguauaaaau

SEQ ID NO: 1444775 - RNA, 16 nt, Human
agugcuguauaaaauc

SEQ ID NO: 1444776 - RNA, 17 nt, Human
agugcuguauaaaauca

SEQ ID NO: 1444777 - RNA, 19 nt, Human
agugcuguauaaaaucagc

SEQ ID NO: 1444778 - RNA, 22 nt, Human
agugcuguauaaaaucagccaa

SEQ ID NO: 1444779 - RNA, 16 nt, Human
agugcugcauuuaaaa

SEQ ID NO: 1444780 - RNA, 17 nt, Human
agugcugcauuuaaaag

SEQ ID NO: 1444781 - RNA, 19 nt, Human
agugcugcauuuaaaagau

SEQ ID NO: 1444782 - RNA, 22 nt, Human
agugaggugugucacaaugaga

SEQ ID NO: 1444783 - RNA, 16 nt, Human
agugaggugugucaca

SEQ ID NO: 1444784 - RNA, 17 nt, Human
agugaguaauuuuggau

SEQ ID NO: 1444785 - RNA, 16 nt, Human
agugcugaacagugga

SEQ ID NO: 1444786 - RNA, 20 nt, Human
agugaguaauuuuggauuuu

SEQ ID NO: 1444787 - RNA, 15 nt, Human
agugcugaauuuccc

SEQ ID NO: 1444788 - RNA, 15 nt, Human
agugcugcacucaaa

SEQ ID NO: 1444789 - RNA, 15 nt, Human
agugcugagauuaca

SEQ ID NO: 1444790 - RNA, 19 nt, Human
agugcugaauuucccucuc

SEQ ID NO: 1444791 - RNA, 12 nt, Human
agugcugcauuu

SEQ ID NO: 1444792 - RNA, 13 nt, Human
agugcugcauuua

SEQ ID NO: 1444793 - RNA, 19 nt, Human
agugcuguuuuguuauaua

SEQ ID NO: 1444794 - RNA, 15 nt, Human
agugcuguuuuguua

SEQ ID NO: 1444795 - RNA, 12 nt, Human
agugcugugcug

SEQ ID NO: 1444796 - RNA, 22 nt, Human
agugcuguuuauuaaucuuagu

SEQ ID NO: 1444797 - RNA, 21 nt, Human
agugcuguuuauuaaucuuag

SEQ ID NO: 1444798 - RNA, 20 nt, Human
agugcuguuuauuaaucuua

SEQ ID NO: 1444799 - RNA, 17 nt, Human
agugcugugcugugcua

SEQ ID NO: 1444800 - RNA, 18 nt, Human
agugcugugcaagguauu

SEQ ID NO: 1444801 - RNA, 23 nt, Human
agugcugucuuaaacuaaaugug

SEQ ID NO: 1444802 - RNA, 16 nt, Human
agugcuguuuuguuau

SEQ ID NO: 1444803 - RNA, 23 nt, Human
uguggugugucccccucugucca

SEQ ID NO: 1444804 - RNA, 16 nt, Human
uguggguuccacagac

SEQ ID NO: 1444805 - RNA, 15 nt, Human
uguggguuccacaga

SEQ ID NO: 1444806 - RNA, 22 nt, Human
uguggguguuaauuuuugauac

SEQ ID NO: 1444807 - RNA, 14 nt, Human
uguggguguuaauu

SEQ ID NO: 1444808 - RNA, 21 nt, Human
uguguaacugcccaaagcagc

SEQ ID NO: 1444809 - RNA, 18 nt, Human
uguguaacugcccaaagc

SEQ ID NO: 1444810 - RNA, 18 nt, Human
uguguaagacaaaaagcu

SEQ ID NO: 1444811 - RNA, 14 nt, Human
ugugucuuuagaua

SEQ ID NO: 1444812 - RNA, 13 nt, Human
uguguaagauuug

SEQ ID NO: 1444813 - RNA, 12 nt, Human
uguguaagauuu

SEQ ID NO: 1444814 - RNA, 17 nt, Human
uguguaagaaauacaga

SEQ ID NO: 1444815 - RNA, 13 nt, Human
uguguaaguagau

SEQ ID NO: 1444816 - RNA, 13 nt, Human
ugugugugugaau

SEQ ID NO: 1444817 - RNA, 17 nt, Human
ugugugaaacuuucauu

SEQ ID NO: 1444818 - RNA, 22 nt, Human
ugugucuuucacagcuccuccc

SEQ ID NO: 1444819 - RNA, 18 nt, Human
ugugucuuucacagcucc

SEQ ID NO: 1444820 - RNA, 20 nt, Human
ugugugaaagguacuucaaa

SEQ ID NO: 1444821 - RNA, 16 nt, Human
uguuaauuuuugauac

SEQ ID NO: 1444822 - RNA, 15 nt, Human
uguuaauuuuugaua

SEQ ID NO: 1444823 - RNA, 13 nt, Human
uguuaauuuuuga

SEQ ID NO: 1444824 - RNA, 22 nt, Human
uguuaauuuagaaaacuuuaaa

SEQ ID NO: 1444825 - RNA, 20 nt, Human
uguuaauuuagaaaacuuua

SEQ ID NO: 1444826 - RNA, 18 nt, Human
uguuaauuuagaaaacuu

SEQ ID NO: 1444827 - RNA, 17 nt, Human
uguuaauuuagaaaacu

SEQ ID NO: 1444828 - RNA, 15 nt, Human
uguuaauuuagaaaa

SEQ ID NO: 1444829 - RNA, 17 nt, Human
uguuaaguauuuucaua

SEQ ID NO: 1444830 - RNA, 15 nt, Human
uguuaaguauuuuca

SEQ ID NO: 1444831 - RNA, 20 nt, Human
uguuaagggaagaauuccag

SEQ ID NO: 1444832 - RNA, 14 nt, Human
uguuaagcucugcu

SEQ ID NO: 1444833 - RNA, 13 nt, Human
uguuaagcucugc

SEQ ID NO: 1444834 - RNA, 18 nt, Human
uguuaaauacaggaaaca

SEQ ID NO: 1444835 - RNA, 19 nt, Human
uguguucccauuucagcug

SEQ ID NO: 1444836 - RNA, 19 nt, Human
uguguuaagcucugcuauu

SEQ ID NO: 1444837 - RNA, 13 nt, Human
uguguguuuggaa

SEQ ID NO: 1444838 - RNA, 21 nt, Human
uguguuaagcucugcuauuag

SEQ ID NO: 1444839 - RNA, 16 nt, Human
uguuaaauacaggaaa

SEQ ID NO: 1444840 - RNA, 18 nt, Human
uguuaaauaaauuguaua

SEQ ID NO: 1444841 - RNA, 20 nt, Human
uguuaaauaaauuguauauu

SEQ ID NO: 1444842 - RNA, 13 nt, Human
uguuaaauaaauu

SEQ ID NO: 1444843 - RNA, 14 nt, Human
uguuaaauaaauug

SEQ ID NO: 1444844 - RNA, 16 nt, Human
uguuaaauaaauugua

SEQ ID NO: 1444845 - RNA, 22 nt, Human
uguguugauacuguugcacgug

SEQ ID NO: 1444846 - RNA, 21 nt, Human
uguguugauacuguugcacgu

SEQ ID NO: 1444847 - RNA, 20 nt, Human
uguguugauacuguugcacg

SEQ ID NO: 1444848 - RNA, 19 nt, Human
uguguugauacuguugcac

SEQ ID NO: 1444849 - RNA, 18 nt, Human
uguguugauacuguugca

SEQ ID NO: 1444850 - RNA, 17 nt, Human
uguguugauacuguugc

SEQ ID NO: 1444851 - RNA, 16 nt, Human
uguguugauacuguug

SEQ ID NO: 1444852 - RNA, 15 nt, Human
uguguugauacuguu

SEQ ID NO: 1444853 - RNA, 13 nt, Human
uguguugaagagg

SEQ ID NO: 1444854 - RNA, 17 nt, Human
uguuuugaaggcaaaau

SEQ ID NO: 1444855 - RNA, 17 nt, Human
uguuuucuuuugguaaa

SEQ ID NO: 1444856 - RNA, 11 nt, Human
uguuuucuucu

SEQ ID NO: 1444857 - RNA, 16 nt, Human
uguuuuaugagaaagc

SEQ ID NO: 1444858 - RNA, 16 nt, Human
uguuuucccacgagga

SEQ ID NO: 1444859 - RNA, 18 nt, Human
uguuuggaauauugucca

SEQ ID NO: 1444860 - RNA, 13 nt, Human
uguuugcuuucug

SEQ ID NO: 1444861 - RNA, 22 nt, Human
uguuugcuuucugaucaaggcc

SEQ ID NO: 1444862 - RNA, 12 nt, Human
uguuugcuuucu

SEQ ID NO: 1444863 - RNA, 23 nt, Human
uguuugcuucaugugucccagaa

SEQ ID NO: 1444864 - RNA, 22 nt, Human
uguuugcuucaugugucccaga

SEQ ID NO: 1444865 - RNA, 21 nt, Human
uguuugcuucaugugucccag

SEQ ID NO: 1444866 - RNA, 15 nt, Human
uguuugcuucaacug

SEQ ID NO: 1444867 - RNA, 22 nt, Human
uguuugcaccuuucuaguugaa

SEQ ID NO: 1444868 - RNA, 23 nt, Human
uguuugcaccuuucuaguugaaa

SEQ ID NO: 1444869 - RNA, 20 nt, Human
uguuugcaccuuucuaguug

SEQ ID NO: 1444870 - RNA, 18 nt, Human
uguuugcaccuuucuagu

SEQ ID NO: 1444871 - RNA, 19 nt, Human
uguuuuaugagaaagccuu

SEQ ID NO: 1444872 - RNA, 15 nt, Human
uguuuuaugagaaag

SEQ ID NO: 1444873 - RNA, 14 nt, Human
uguuuuaugagaaa

SEQ ID NO: 1444874 - RNA, 21 nt, Human
uguuuuauuuaaccucuaaau

SEQ ID NO: 1444875 - RNA, 12 nt, Human
uguuuggaaaua

SEQ ID NO: 1444876 - RNA, 16 nt, Human
aguucugcucugguug

SEQ ID NO: 1444877 - RNA, 19 nt, Human
aguucugcuccagacaggg

SEQ ID NO: 1444878 - RNA, 18 nt, Human
aguucugcuccagacagg

SEQ ID NO: 1444879 - RNA, 17 nt, Human
aguucugcuccagacag

SEQ ID NO: 1444880 - RNA, 15 nt, Human
aguucugcuccagac

SEQ ID NO: 1444881 - RNA, 14 nt, Human
aguucugcuccaga

SEQ ID NO: 1444882 - RNA, 12 nt, Human
aguucugcucca

SEQ ID NO: 1444883 - RNA, 20 nt, Human
aguucugccaggagacaggu

SEQ ID NO: 1444884 - RNA, 14 nt, Human
aguucugccaggag

SEQ ID NO: 1444885 - RNA, 13 nt, Human
aguucugccagga

SEQ ID NO: 1444886 - RNA, 23 nt, Human
aguucuguacucaaauguagcca

SEQ ID NO: 1444887 - RNA, 12 nt, Human
aguucuguagaa

SEQ ID NO: 1444888 - RNA, 19 nt, Human
aguucuuacugcuuaauuc

SEQ ID NO: 1444889 - RNA, 23 nt, Human
aguucuuacugcuuaauucaaau

SEQ ID NO: 1444890 - RNA, 12 nt, Human
aguucugccagg

SEQ ID NO: 1444891 - RNA, 18 nt, Human
uguuuugcacagccaaau

SEQ ID NO: 1444892 - RNA, 14 nt, Human
uguuuugcaagcca

SEQ ID NO: 1444893 - RNA, 18 nt, Human
uguuugagauucucaaag

SEQ ID NO: 1444894 - RNA, 14 nt, Human
uguuugacaccucu

SEQ ID NO: 1444895 - RNA, 21 nt, Human
uguuugacgggaaacaaaacu

SEQ ID NO: 1444896 - RNA, 13 nt, Human
uguuugauagauu

SEQ ID NO: 1444897 - RNA, 15 nt, Human
uguuugaggaaagca

SEQ ID NO: 1444898 - RNA, 15 nt, Human
uguuucuugccucau

SEQ ID NO: 1444899 - RNA, 15 nt, Human
uguuucuguuccaaa

SEQ ID NO: 1444900 - RNA, 16 nt, Human
uguuucuguuccaaau

SEQ ID NO: 1444901 - RNA, 13 nt, Human
uguuucuguucca

SEQ ID NO: 1444902 - RNA, 13 nt, Human
uguuuauuucagg

SEQ ID NO: 1444903 - RNA, 14 nt, Human
uguuucuugccuca

SEQ ID NO: 1444904 - RNA, 21 nt, Human
uguuucuuucucugaggacaa

SEQ ID NO: 1444905 - RNA, 20 nt, Human
uguuucuuucucugaggaca

SEQ ID NO: 1444906 - RNA, 12 nt, Human
uguuucuugccu

SEQ ID NO: 1444907 - RNA, 18 nt, Human
uguuucuuuguaaugaaa

SEQ ID NO: 1444908 - RNA, 19 nt, Human
uguuucuuuguaaugaaaa

SEQ ID NO: 1444909 - RNA, 14 nt, Human
uguugcguuccuuu

SEQ ID NO: 1444910 - RNA, 11 nt, Human
uguugcuaagc

SEQ ID NO: 1444911 - RNA, 19 nt, Human
uguugccuugcauaauggu

SEQ ID NO: 1444912 - RNA, 13 nt, Human
uguugcugaauag

SEQ ID NO: 1444913 - RNA, 14 nt, Human
uguugcugaauagg

SEQ ID NO: 1444914 - RNA, 12 nt, Human
uguugcuaagcc

SEQ ID NO: 1444915 - RNA, 21 nt, Human
uguugcuaagccccagcaagc

SEQ ID NO: 1444916 - RNA, 22 nt, Human
uguugcuaagccccagcaagca

SEQ ID NO: 1444917 - RNA, 11 nt, Human
uguugcugaau

SEQ ID NO: 1444918 - RNA, 17 nt, Human
uguuuauguaauuucag

SEQ ID NO: 1444919 - RNA, 17 nt, Human
uguuuauuaaucuuagu

SEQ ID NO: 1444920 - RNA, 16 nt, Human
uguuuauguaauuuca

SEQ ID NO: 1444921 - RNA, 15 nt, Human
uguuuauuaaucuua

SEQ ID NO: 1444922 - RNA, 14 nt, Human
uguuuauuaaucuu

SEQ ID NO: 1444923 - RNA, 17 nt, Human
aguugcugcaaaccuga

SEQ ID NO: 1444924 - RNA, 16 nt, Human
aguugcugcaaaccug

SEQ ID NO: 1444925 - RNA, 12 nt, Human
aguugcugagag

SEQ ID NO: 1444926 - RNA, 15 nt, Human
aguugcuauuugaac

SEQ ID NO: 1444927 - RNA, 15 nt, Human
aguuggcuuaccugg

SEQ ID NO: 1444928 - RNA, 23 nt, Human
aguuggccauauuuaccucagcc

SEQ ID NO: 1444929 - RNA, 22 nt, Human
aguuggccauauuuaccucagc

SEQ ID NO: 1444930 - RNA, 18 nt, Human
aguuggcuuaccuggccc

SEQ ID NO: 1444931 - RNA, 17 nt, Human
aguuggcuuaccuggcc

SEQ ID NO: 1444932 - RNA, 18 nt, Human
aguugggacuacaggcgu

SEQ ID NO: 1444933 - RNA, 15 nt, Human
aguugcacucaggug

SEQ ID NO: 1444934 - RNA, 22 nt, Human
aguugcauagguuuaauaauuu

SEQ ID NO: 1444935 - RNA, 22 nt, Human
aguugcagcuguuuuguugaca

SEQ ID NO: 1444936 - RNA, 21 nt, Human
aguugcagcuguuuuguugac

SEQ ID NO: 1444937 - RNA, 17 nt, Human
aguugcagcuguuuugu

SEQ ID NO: 1444938 - RNA, 15 nt, Human
aguugcagcuguuuu

SEQ ID NO: 1444939 - RNA, 14 nt, Human
aguugcagcuguuu

SEQ ID NO: 1444940 - RNA, 10 nt, Human
aguugcagcc

SEQ ID NO: 1444941 - RNA, 13 nt, Human
aguugccuuuuau

SEQ ID NO: 1444942 - RNA, 17 nt, Human
aguugcagucacucuag

SEQ ID NO: 1444943 - RNA, 18 nt, Human
aguuguaaaguauguauu

SEQ ID NO: 1444944 - RNA, 13 nt, Human
aguuguaaaguau

SEQ ID NO: 1444945 - RNA, 12 nt, Human
aguuguaaagua

SEQ ID NO: 1444946 - RNA, 13 nt, Human
aguugguaacuuu

SEQ ID NO: 1444947 - RNA, 14 nt, Human
aguuuagggugggg

SEQ ID NO: 1444948 - RNA, 13 nt, Human
aguuuaggguggg

SEQ ID NO: 1444949 - RNA, 23 nt, Human
aguuuagggaacaauuuggcaau

SEQ ID NO: 1444950 - RNA, 21 nt, Human
aguuuagggaacaauuuggca

SEQ ID NO: 1444951 - RNA, 18 nt, Human
aguuuagggaacaauuug

SEQ ID NO: 1444952 - RNA, 12 nt, Human
aguuuaaugaag

SEQ ID NO: 1444953 - RNA, 12 nt, Human
aguuuagggugg

SEQ ID NO: 1444954 - RNA, 16 nt, Human
aguuuaggauaaaaua

SEQ ID NO: 1444955 - RNA, 20 nt, Human
aguuuaauggugccuucauu

SEQ ID NO: 1444956 - RNA, 22 nt, Human
aguuuaauggugccuucauuug

SEQ ID NO: 1444957 - RNA, 16 nt, Human
aguuuaaucagaggaa

SEQ ID NO: 1444958 - RNA, 17 nt, Human
aguuuaauaaauuuauu

SEQ ID NO: 1444959 - RNA, 15 nt, Human
aguuguuugugccuu

SEQ ID NO: 1444960 - RNA, 17 nt, Human
uuaaauuggaaagcagg

SEQ ID NO: 1444961 - RNA, 16 nt, Human
uuaaauuggaaagcag

SEQ ID NO: 1444962 - RNA, 18 nt, Human
uuaaauaagauucuaacg

SEQ ID NO: 1444963 - RNA, 17 nt, Human
uuaaauaagauucuaac

SEQ ID NO: 1444964 - RNA, 16 nt, Human
uuaaauaagauucuaa

SEQ ID NO: 1444965 - RNA, 15 nt, Human
uuaaauaagauucua

SEQ ID NO: 1444966 - RNA, 14 nt, Human
uuaaauaagauucu

SEQ ID NO: 1444967 - RNA, 13 nt, Human
uuaaauaagauuc

SEQ ID NO: 1444968 - RNA, 17 nt, Human
uuaaauaagaaacuuuu

SEQ ID NO: 1444969 - RNA, 15 nt, Human
uuaaauaagaaacuu

SEQ ID NO: 1444970 - RNA, 22 nt, Human
uuaaauaaauuugacuuuucug

SEQ ID NO: 1444971 - RNA, 13 nt, Human
uuaaauaauguga

SEQ ID NO: 1444972 - RNA, 15 nt, Human
uuaaauuguguuuua

SEQ ID NO: 1444973 - RNA, 17 nt, Human
uuaaauuuuuuuuacau

SEQ ID NO: 1444974 - RNA, 18 nt, Human
uuaacaaauguaucacua

SEQ ID NO: 1444975 - RNA, 18 nt, Human
uuaaauuuuuuuuacauu

SEQ ID NO: 1444976 - RNA, 19 nt, Human
uuaaauuuuuuuuacauuu

SEQ ID NO: 1444977 - RNA, 20 nt, Human
uuaaauuuuuuuuacauuuu

SEQ ID NO: 1444978 - RNA, 17 nt, Human
aguuucacagaaaauaa

SEQ ID NO: 1444979 - RNA, 22 nt, Human
aguuucacagaaaauaaggcac

SEQ ID NO: 1444980 - RNA, 17 nt, Human
uuaacauaccuaagaag

SEQ ID NO: 1444981 - RNA, 22 nt, Human
uuaacauaccuaagaaguacau

SEQ ID NO: 1444982 - RNA, 12 nt, Human
uuaacauaccua

SEQ ID NO: 1444983 - RNA, 21 nt, Human
uuaacauaagcuauuuuucua

SEQ ID NO: 1444984 - RNA, 18 nt, Human
uuaacauaagcuauuuuu

SEQ ID NO: 1444985 - RNA, 16 nt, Human
uuaacauaagcuauuu

SEQ ID NO: 1444986 - RNA, 15 nt, Human
uuaacauaagcuauu

SEQ ID NO: 1444987 - RNA, 14 nt, Human
uuaacauaagcuau

SEQ ID NO: 1444988 - RNA, 13 nt, Human
uuaacauaagcua

SEQ ID NO: 1444989 - RNA, 15 nt, Human
uuaacaguuguauuu

SEQ ID NO: 1444990 - RNA, 13 nt, Human
uuaacaguuguau

SEQ ID NO: 1444991 - RNA, 19 nt, Human
uuaacagagucugaaccua

SEQ ID NO: 1444992 - RNA, 22 nt, Human
uuaacaacauguuuccagcauu

SEQ ID NO: 1444993 - RNA, 14 nt, Human
uuaacaagaacuuu

SEQ ID NO: 1444994 - RNA, 14 nt, Human
uuaacaacuugucu

SEQ ID NO: 1444995 - RNA, 19 nt, Human
uuaacaacauguuuccagc

SEQ ID NO: 1444996 - RNA, 14 nt, Human
uuaacaacauguuu

SEQ ID NO: 1444997 - RNA, 17 nt, Human
uuaaauaaauuugacuu

SEQ ID NO: 1444998 - RNA, 16 nt, Human
uuaaauaaauuugacu

SEQ ID NO: 1444999 - RNA, 13 nt, Human
uuaaauaaauuug

SEQ ID NO: 1445000 - RNA, 18 nt, Human
uuaaauaaauuguauauu

SEQ ID NO: 1445001 - RNA, 20 nt, Human
uuaaauaaauuguauauuca

SEQ ID NO: 1445002 - RNA, 13 nt, Human
uuaaauaaauugu

SEQ ID NO: 1445003 - RNA, 15 nt, Human
uuaaauaaauuguau

SEQ ID NO: 1445004 - RNA, 17 nt, Human
uuaaauaaauuguauau

SEQ ID NO: 1445005 - RNA, 23 nt, Human
uuaaaggggagaccucagaagua

SEQ ID NO: 1445006 - RNA, 21 nt, Human
uuaaaggggagaccucagaag

SEQ ID NO: 1445007 - RNA, 12 nt, Human
uuaaaauuuguu

SEQ ID NO: 1445008 - RNA, 19 nt, Human
uuaaaauuuguucuuguau

SEQ ID NO: 1445009 - RNA, 24 nt, Human
aguuuagggaacaauuuggcaauu

SEQ ID NO: 1445010 - RNA, 13 nt, Human
uuaaaaagccagu

SEQ ID NO: 1445011 - RNA, 14 nt, Human
uuaaaaacugagug

SEQ ID NO: 1445012 - RNA, 20 nt, Human
uuaaaaaguaauaaaauuca

SEQ ID NO: 1445013 - RNA, 16 nt, Human
uuaaaaagguuuacag

SEQ ID NO: 1445014 - RNA, 22 nt, Human
uuaaaaaggcaguuugcaaaaa

SEQ ID NO: 1445015 - RNA, 20 nt, Human
uuaaaaaggcaguuugcaaa

SEQ ID NO: 1445016 - RNA, 13 nt, Human
uuaaaauguucac

SEQ ID NO: 1445017 - RNA, 16 nt, Human
uuaaaauuacaacuaa

SEQ ID NO: 1445018 - RNA, 20 nt, Human
uuacaaaacuacaugagaac

SEQ ID NO: 1445019 - RNA, 18 nt, Human
uuacaaaacuacaugaga

SEQ ID NO: 1445020 - RNA, 17 nt, Human
uuacaaaacuacaugag

SEQ ID NO: 1445021 - RNA, 18 nt, Human
uuacaaaacaaacucauu

SEQ ID NO: 1445022 - RNA, 17 nt, Human
uuacaaaacaaacucau

SEQ ID NO: 1445023 - RNA, 17 nt, Human
uuaauuuaguaaaccaa

SEQ ID NO: 1445024 - RNA, 16 nt, Human
uuaauuuagaaaacuu

SEQ ID NO: 1445025 - RNA, 15 nt, Human
uuaauuuagaaaacu

SEQ ID NO: 1445026 - RNA, 23 nt, Human
uuaauuuacaaaaauauaaaaua

SEQ ID NO: 1445027 - RNA, 22 nt, Human
uuaauuuacaaaaauauaaaau

SEQ ID NO: 1445028 - RNA, 14 nt, Human
uuaauuuacaaaaa

SEQ ID NO: 1445029 - RNA, 18 nt, Human
uuacaaaaauauaaaaua

SEQ ID NO: 1445030 - RNA, 22 nt, Human
auaaacaagaaaaauaaagaaa

SEQ ID NO: 1445031 - RNA, 21 nt, Human
auaaacaagaaaaauaaagaa

SEQ ID NO: 1445032 - RNA, 20 nt, Human
auaaacaagaaaaauaaaga

SEQ ID NO: 1445033 - RNA, 19 nt, Human
auaaacaagaaaaauaaag

SEQ ID NO: 1445034 - RNA, 17 nt, Human
auaaacaagaaaaauaa

SEQ ID NO: 1445035 - RNA, 23 nt, Human
auaaacaagaccacguuucuaaa

SEQ ID NO: 1445036 - RNA, 15 nt, Human
auaaacaagaccacg

SEQ ID NO: 1445037 - RNA, 22 nt, Human
auaaacaagaccacguuucuaa

SEQ ID NO: 1445038 - RNA, 16 nt, Human
auaaacaagaaaaaua

SEQ ID NO: 1445039 - RNA, 13 nt, Human
auaaacaagaaaa

SEQ ID NO: 1445040 - RNA, 16 nt, Human
auaaaauuuguugcau

SEQ ID NO: 1445041 - RNA, 13 nt, Human
auaaaauuuguug

SEQ ID NO: 1445042 - RNA, 20 nt, Human
auaaaauuuuuaaucuuuaa

SEQ ID NO: 1445043 - RNA, 21 nt, Human
uuaaguugagauaguuuucau

SEQ ID NO: 1445044 - RNA, 11 nt, Human
uuaaguugaga

SEQ ID NO: 1445045 - RNA, 22 nt, Human
uuaaguuauagugaauacugcu

SEQ ID NO: 1445046 - RNA, 20 nt, Human
uuaaguuaguuccacugaga

SEQ ID NO: 1445047 - RNA, 13 nt, Human
uuaauaaacacuc

SEQ ID NO: 1445048 - RNA, 18 nt, Human
uuaaguugcugaugaacu

SEQ ID NO: 1445049 - RNA, 23 nt, Human
uuaaguugagauaguuuucaucc

SEQ ID NO: 1445050 - RNA, 22 nt, Human
uuaaguugagauaguuuucauc

SEQ ID NO: 1445051 - RNA, 17 nt, Human
uuaauaaacacucuuga

SEQ ID NO: 1445052 - RNA, 18 nt, Human
uuaauuuaaacaccuccu

SEQ ID NO: 1445053 - RNA, 15 nt, Human
uuaauucuuagcuca

SEQ ID NO: 1445054 - RNA, 18 nt, Human
uuaaugaagaucuaaaua

SEQ ID NO: 1445055 - RNA, 14 nt, Human
uuaaugaaguuuga

SEQ ID NO: 1445056 - RNA, 15 nt, Human
uuaaugaaguuugaa

SEQ ID NO: 1445057 - RNA, 17 nt, Human
uuaaugaagaucuaaau

SEQ ID NO: 1445058 - RNA, 15 nt, Human
uuaaugaagaucuaa

SEQ ID NO: 1445059 - RNA, 23 nt, Human
uuaaugaagaaaguggaaaacaa

SEQ ID NO: 1445060 - RNA, 18 nt, Human
uuaaugaagaaaguggaa

SEQ ID NO: 1445061 - RNA, 14 nt, Human
uuaaugaagaaagu

SEQ ID NO: 1445062 - RNA, 14 nt, Human
uuaaugaacaaaug

SEQ ID NO: 1445063 - RNA, 17 nt, Human
uuaauuccuucagcacu

SEQ ID NO: 1445064 - RNA, 19 nt, Human
uuaauuccuucagcacuuu

SEQ ID NO: 1445065 - RNA, 20 nt, Human
uuaauuccuucagcacuuua

SEQ ID NO: 1445066 - RNA, 14 nt, Human
uuaagaaggcaaaa

SEQ ID NO: 1445067 - RNA, 12 nt, Human
uuaagaaggcaa

SEQ ID NO: 1445068 - RNA, 22 nt, Human
uuaagaagacugcauuauauuu

SEQ ID NO: 1445069 - RNA, 18 nt, Human
uuaaguaaggaauuuuau

SEQ ID NO: 1445070 - RNA, 17 nt, Human
uuaagugaaaauauagc

SEQ ID NO: 1445071 - RNA, 18 nt, Human
uuaaguaaugauaacugg

SEQ ID NO: 1445072 - RNA, 14 nt, Human
uuaagugcugcauu

SEQ ID NO: 1445073 - RNA, 11 nt, Human
auaaaauguac

SEQ ID NO: 1445074 - RNA, 18 nt, Human
auaaaaugcuagguucua

SEQ ID NO: 1445075 - RNA, 19 nt, Human
auaaaaugcuagguucuac

SEQ ID NO: 1445076 - RNA, 17 nt, Human
auaaaaugcuagguucu

SEQ ID NO: 1445077 - RNA, 19 nt, Human
auaaaauccauacauuugu

SEQ ID NO: 1445078 - RNA, 18 nt, Human
auaaaauccauacauuug

SEQ ID NO: 1445079 - RNA, 18 nt, Human
auaaaaucagccaauuau

SEQ ID NO: 1445080 - RNA, 22 nt, Human
auaaaaucagccaauuauguua

SEQ ID NO: 1445081 - RNA, 23 nt, Human
auaaaaucagccaauuauguuaa

SEQ ID NO: 1445082 - RNA, 22 nt, Human
auaaaauaauuuuuauauuuga

SEQ ID NO: 1445083 - RNA, 21 nt, Human
auaaaauaauuuuuauauuug

SEQ ID NO: 1445084 - RNA, 16 nt, Human
auaaaauaauuuuuau

SEQ ID NO: 1445085 - RNA, 20 nt, Human
auaaaaggucggaccagcuu

SEQ ID NO: 1445086 - RNA, 15 nt, Human
auaacuaacaugucc

SEQ ID NO: 1445087 - RNA, 21 nt, Human
auaacuaacaaccaaagacua

SEQ ID NO: 1445088 - RNA, 23 nt, Human
auaaaugucacuuuuugaggcaa

SEQ ID NO: 1445089 - RNA, 14 nt, Human
auaacuaaauaaag

SEQ ID NO: 1445090 - RNA, 19 nt, Human
auaaaugucacuuuuugag

SEQ ID NO: 1445091 - RNA, 12 nt, Human
auaaaugucacu

SEQ ID NO: 1445092 - RNA, 21 nt, Human
auaaauguaucauagaaaugu

SEQ ID NO: 1445093 - RNA, 17 nt, Human
auaaauguaucauagaa

SEQ ID NO: 1445094 - RNA, 13 nt, Human
auaaauguaucau

SEQ ID NO: 1445095 - RNA, 15 nt, Human
auaaauguacauuaa

SEQ ID NO: 1445096 - RNA, 18 nt, Human
auaaauguaccagagaga

SEQ ID NO: 1445097 - RNA, 15 nt, Human
uuacaggaacuucau

SEQ ID NO: 1445098 - RNA, 19 nt, Human
uuacaguaggagcccagcu

SEQ ID NO: 1445099 - RNA, 14 nt, Human
auaaauauccuuua

SEQ ID NO: 1445100 - RNA, 21 nt, Human
auaaauauccuuuaauugauc

SEQ ID NO: 1445101 - RNA, 23 nt, Human
auaaauauauuauuacuuguaaa

SEQ ID NO: 1445102 - RNA, 22 nt, Human
auaaauauauuauuacuuguaa

SEQ ID NO: 1445103 - RNA, 18 nt, Human
auaaauauauuauuacuu

SEQ ID NO: 1445104 - RNA, 14 nt, Human
auaaauauauuauu

SEQ ID NO: 1445105 - RNA, 12 nt, Human
auaaauauauua

SEQ ID NO: 1445106 - RNA, 21 nt, Human
auaaauauaucuaccccagac

SEQ ID NO: 1445107 - RNA, 13 nt, Human
auaaauauaucua

SEQ ID NO: 1445108 - RNA, 18 nt, Human
auaaauacugcaaaucag

SEQ ID NO: 1445109 - RNA, 20 nt, Human
auaaaguugauaaagauuuu

SEQ ID NO: 1445110 - RNA, 17 nt, Human
auaaaguugauaaagau

SEQ ID NO: 1445111 - RNA, 21 nt, Human
auaaaguugauaaagauuuuu

SEQ ID NO: 1445112 - RNA, 16 nt, Human
auaaaguugauaaaga

SEQ ID NO: 1445113 - RNA, 15 nt, Human
auaaaguucuguacu

SEQ ID NO: 1445114 - RNA, 14 nt, Human
auaaaguguaacaa

SEQ ID NO: 1445115 - RNA, 19 nt, Human
auaaaguguaacaauugug

SEQ ID NO: 1445116 - RNA, 18 nt, Human
auaaacacucuugaaaaa

SEQ ID NO: 1445117 - RNA, 20 nt, Human
uuaccuguggauauuuguau

SEQ ID NO: 1445118 - RNA, 13 nt, Human
uuaccuguggaua

SEQ ID NO: 1445119 - RNA, 12 nt, Human
uuaccuguggau

SEQ ID NO: 1445120 - RNA, 18 nt, Human
uuaccugggcauucuugu

SEQ ID NO: 1445121 - RNA, 14 nt, Human
uuacaucauuucuu

SEQ ID NO: 1445122 - RNA, 13 nt, Human
uuacaucauuucu

SEQ ID NO: 1445123 - RNA, 20 nt, Human
uuacauaauucacucugagu

SEQ ID NO: 1445124 - RNA, 23 nt, Human
uuacugauauauuuuacaauuuu

SEQ ID NO: 1445125 - RNA, 14 nt, Human
uuacugauauauuu

SEQ ID NO: 1445126 - RNA, 12 nt, Human
uuacucacugcu

SEQ ID NO: 1445127 - RNA, 18 nt, Human
uuacucagaauucucuag

SEQ ID NO: 1445128 - RNA, 23 nt, Human
uuacucagaauucucuaguuuga

SEQ ID NO: 1445129 - RNA, 23 nt, Human
uuagaagccugcauaauguuucu

SEQ ID NO: 1445130 - RNA, 13 nt, Human
uuagaagccugca

SEQ ID NO: 1445131 - RNA, 17 nt, Human
uuagaagacaauugaca

SEQ ID NO: 1445132 - RNA, 22 nt, Human
uuagacagaacaccuaugcaaa

SEQ ID NO: 1445133 - RNA, 14 nt, Human
uuagacagaacacc

SEQ ID NO: 1445134 - RNA, 22 nt, Human
uuagaaauaaagcaucucauuu

SEQ ID NO: 1445135 - RNA, 17 nt, Human
uuagaaauaaagcaucu

SEQ ID NO: 1445136 - RNA, 15 nt, Human
uuacuguaacugauu

SEQ ID NO: 1445137 - RNA, 17 nt, Human
uuacugguccaaaagau

SEQ ID NO: 1445138 - RNA, 15 nt, Human
uuacugguccaaaag

SEQ ID NO: 1445139 - RNA, 14 nt, Human
uuacugguccaaaa

SEQ ID NO: 1445140 - RNA, 18 nt, Human
uuacugguccaaaagauu

SEQ ID NO: 1445141 - RNA, 15 nt, Human
uuacuguaagaaaau

SEQ ID NO: 1445142 - RNA, 22 nt, Human
uucacuguagaaugauuucaug

SEQ ID NO: 1445143 - RNA, 15 nt, Human
uucacuguagaauga

SEQ ID NO: 1445144 - RNA, 21 nt, Human
uucagaauaugucagugcuga

SEQ ID NO: 1445145 - RNA, 20 nt, Human
uucagaaguuaguuuguaua

SEQ ID NO: 1445146 - RNA, 15 nt, Human
uucagaaguuaguuu

SEQ ID NO: 1445147 - RNA, 19 nt, Human
uucagaaaauguucuguuu

SEQ ID NO: 1445148 - RNA, 15 nt, Human
uucagaaaauguucu

SEQ ID NO: 1445149 - RNA, 16 nt, Human
uucagaaagacuuggu

SEQ ID NO: 1445150 - RNA, 14 nt, Human
auauauacuauuaa

SEQ ID NO: 1445151 - RNA, 17 nt, Human
uucacuggagcacaaua

SEQ ID NO: 1445152 - RNA, 15 nt, Human
uucacuggagcacaa

SEQ ID NO: 1445153 - RNA, 14 nt, Human
uucacuggagcaca

SEQ ID NO: 1445154 - RNA, 13 nt, Human
uucagcccaucuc

SEQ ID NO: 1445155 - RNA, 17 nt, Human
uucagccaggagcuggg

SEQ ID NO: 1445156 - RNA, 11 nt, Human
uucagccaagg

SEQ ID NO: 1445157 - RNA, 12 nt, Human
uucagccaggag

SEQ ID NO: 1445158 - RNA, 13 nt, Human
uucagccaggagc

SEQ ID NO: 1445159 - RNA, 15 nt, Human
uucagcccucagaau

SEQ ID NO: 1445160 - RNA, 19 nt, Human
uucagcacuagccaaaccu

SEQ ID NO: 1445161 - RNA, 17 nt, Human
uucagcacuagccaaac

SEQ ID NO: 1445162 - RNA, 16 nt, Human
uucagcacuagccaaa

SEQ ID NO: 1445163 - RNA, 13 nt, Human
uucagcacugucc

SEQ ID NO: 1445164 - RNA, 23 nt, Human
uucagcacuagccaaaccucacc

SEQ ID NO: 1445165 - RNA, 21 nt, Human
uucagcacuagccaaaccuca

SEQ ID NO: 1445166 - RNA, 21 nt, Human
uucagaauuuaguguauccau

SEQ ID NO: 1445167 - RNA, 23 nt, Human
uucagaauuuuauacuuucccua

SEQ ID NO: 1445168 - RNA, 15 nt, Human
uucagaauuuagugu

SEQ ID NO: 1445169 - RNA, 13 nt, Human
uucagaauuuagu

SEQ ID NO: 1445170 - RNA, 17 nt, Human
uucagaauuaaacuuuu

SEQ ID NO: 1445171 - RNA, 16 nt, Human
uucagaauuaaacuuu

SEQ ID NO: 1445172 - RNA, 17 nt, Human
uucagaucucuaacuuc

SEQ ID NO: 1445173 - RNA, 16 nt, Human
uucagaugugaaccau

SEQ ID NO: 1445174 - RNA, 15 nt, Human
uucagaugugaacca

SEQ ID NO: 1445175 - RNA, 18 nt, Human
uucagcaagacuucucuu

SEQ ID NO: 1445176 - RNA, 19 nt, Human
uucagcaaagugguucccu

SEQ ID NO: 1445177 - RNA, 20 nt, Human
uucagcaaacucuuuuccca

SEQ ID NO: 1445178 - RNA, 18 nt, Human
uucagaugugaaccauua

SEQ ID NO: 1445179 - RNA, 23 nt, Human
auauaaaugcaaauaacaaaugc

SEQ ID NO: 1445180 - RNA, 18 nt, Human
auauaaaugcaaauaaca

SEQ ID NO: 1445181 - RNA, 17 nt, Human
auauaaaugcaaauaac

SEQ ID NO: 1445182 - RNA, 15 nt, Human
auauaaaugcaaaua

SEQ ID NO: 1445183 - RNA, 14 nt, Human
auauaaaugcaaau

SEQ ID NO: 1445184 - RNA, 12 nt, Human
auauaaaugcaa

SEQ ID NO: 1445185 - RNA, 16 nt, Human
auauaaauauauuauu

SEQ ID NO: 1445186 - RNA, 16 nt, Human
auauaaauauauauuc

SEQ ID NO: 1445187 - RNA, 20 nt, Human
auauaaagacguuuuauaag

SEQ ID NO: 1445188 - RNA, 22 nt, Human
auauaaagacguuuuauaagca

SEQ ID NO: 1445189 - RNA, 16 nt, Human
auauaaagacguuuua

SEQ ID NO: 1445190 - RNA, 14 nt, Human
auauaaaauaugaa

SEQ ID NO: 1445191 - RNA, 23 nt, Human
auaguuuuacuuuuaaacugugu

SEQ ID NO: 1445192 - RNA, 22 nt, Human
auaguuuuacuuuuaaacugug

SEQ ID NO: 1445193 - RNA, 21 nt, Human
auaguuuuacuuuuaaacugu

SEQ ID NO: 1445194 - RNA, 15 nt, Human
auaguuuuacuuuua

SEQ ID NO: 1445195 - RNA, 19 nt, Human
auaguuuggauauguaaaa

SEQ ID NO: 1445196 - RNA, 23 nt, Human
auaguuuggauauguaaaacauu

SEQ ID NO: 1445197 - RNA, 18 nt, Human
auaguuuggauauguaaa

SEQ ID NO: 1445198 - RNA, 19 nt, Human
auaguuucugaggcuuuau

SEQ ID NO: 1445199 - RNA, 14 nt, Human
auaguuucugaggc

SEQ ID NO: 1445200 - RNA, 13 nt, Human
auaguuucugagg

SEQ ID NO: 1445201 - RNA, 20 nt, Human
auagguagaauguaaagcuu

SEQ ID NO: 1445202 - RNA, 18 nt, Human
auagguagaauguaaagc

SEQ ID NO: 1445203 - RNA, 20 nt, Human
auaggguuugugacagggcg

SEQ ID NO: 1445204 - RNA, 18 nt, Human
auagucaaauugugugaa

SEQ ID NO: 1445205 - RNA, 23 nt, Human
auauaguuuuacuuuuaaacugu

SEQ ID NO: 1445206 - RNA, 18 nt, Human
auauaguuuuacuuuuaa

SEQ ID NO: 1445207 - RNA, 16 nt, Human
auauaguuuuacuuuu

SEQ ID NO: 1445208 - RNA, 13 nt, Human
auauaguuuuacu

SEQ ID NO: 1445209 - RNA, 12 nt, Human
auauaguuuuac

SEQ ID NO: 1445210 - RNA, 17 nt, Human
auauaguuagcuaauaa

SEQ ID NO: 1445211 - RNA, 22 nt, Human
auauaguuagcuaauaaaaagc

SEQ ID NO: 1445212 - RNA, 19 nt, Human
auauauaacaaugcuguau

SEQ ID NO: 1445213 - RNA, 18 nt, Human
auauauaacaaugcugua

SEQ ID NO: 1445214 - RNA, 17 nt, Human
auauauaacaaugcugu

SEQ ID NO: 1445215 - RNA, 15 nt, Human
auauaacaaugcugu

SEQ ID NO: 1445216 - RNA, 12 nt, Human
auauaacaaugc

SEQ ID NO: 1445217 - RNA, 12 nt, Human
auauaagcuuuu

SEQ ID NO: 1445218 - RNA, 19 nt, Human
auauaagcuuguauuccuu

SEQ ID NO: 1445219 - RNA, 17 nt, Human
auauaacaaugcuguau

SEQ ID NO: 1445220 - RNA, 15 nt, Human
auaugcacaauagca

SEQ ID NO: 1445221 - RNA, 14 nt, Human
auauguaugguuuu

SEQ ID NO: 1445222 - RNA, 23 nt, Human
auauguauggguaggguaaauca

SEQ ID NO: 1445223 - RNA, 17 nt, Human
auauguauggguagggu

SEQ ID NO: 1445224 - RNA, 12 nt, Human
auauguaugggu

SEQ ID NO: 1445225 - RNA, 13 nt, Human
auaugcacacauu

SEQ ID NO: 1445226 - RNA, 17 nt, Human
uucauguacaagaugaa

SEQ ID NO: 1445227 - RNA, 21 nt, Human
uucauguacaagaugaaggag

SEQ ID NO: 1445228 - RNA, 18 nt, Human
uucauguaauccucaaga

SEQ ID NO: 1445229 - RNA, 19 nt, Human
uucauguaaacugugcacc

SEQ ID NO: 1445230 - RNA, 18 nt, Human
uucauguaaacugugcac

SEQ ID NO: 1445231 - RNA, 17 nt, Human
uucauguaaacugugca

SEQ ID NO: 1445232 - RNA, 14 nt, Human
uucauguaaacugu

SEQ ID NO: 1445233 - RNA, 23 nt, Human
uucauggcagauguaggagggac

SEQ ID NO: 1445234 - RNA, 17 nt, Human
uucauggcagaaggcaa

SEQ ID NO: 1445235 - RNA, 18 nt, Human
auaugucagugcugaugu

SEQ ID NO: 1445236 - RNA, 14 nt, Human
auaugucagugcug

SEQ ID NO: 1445237 - RNA, 22 nt, Human
auaugucaagugcugugcaagg

SEQ ID NO: 1445238 - RNA, 11 nt, Human
auauguccugg

SEQ ID NO: 1445239 - RNA, 13 nt, Human
auaugugaacagu

SEQ ID NO: 1445240 - RNA, 15 nt, Human
auaucuguaauggua

SEQ ID NO: 1445241 - RNA, 16 nt, Human
auaucuguaaugguac

SEQ ID NO: 1445242 - RNA, 19 nt, Human
auaucuggccucugcuuuc

SEQ ID NO: 1445243 - RNA, 13 nt, Human
auaucuggccucu

SEQ ID NO: 1445244 - RNA, 15 nt, Human
auaucugaagcccuc

SEQ ID NO: 1445245 - RNA, 23 nt, Human
auaucugccuuuauuguguuugu

SEQ ID NO: 1445246 - RNA, 20 nt, Human
auaucuuggacaaaucacau

SEQ ID NO: 1445247 - RNA, 19 nt, Human
auaucuuggacaaaucaca

SEQ ID NO: 1445248 - RNA, 22 nt, Human
auaugauucaaaugucuauaaa

SEQ ID NO: 1445249 - RNA, 13 nt, Human
auaugauucaaau

SEQ ID NO: 1445250 - RNA, 14 nt, Human
auaucugccuuuau

SEQ ID NO: 1445251 - RNA, 16 nt, Human
auaucugccuuuauug

SEQ ID NO: 1445252 - RNA, 18 nt, Human
auaucugccuuuauugug

SEQ ID NO: 1445253 - RNA, 20 nt, Human
auaucugccuuuauuguguu

SEQ ID NO: 1445254 - RNA, 15 nt, Human
uucauacuugaacgu

SEQ ID NO: 1445255 - RNA, 22 nt, Human
uucauacuguaacauucaggaa

SEQ ID NO: 1445256 - RNA, 17 nt, Human
uucaguauuauauguac

SEQ ID NO: 1445257 - RNA, 13 nt, Human
uucauagcccagu

SEQ ID NO: 1445258 - RNA, 13 nt, Human
uucauacuugaac

SEQ ID NO: 1445259 - RNA, 22 nt, Human
uucaguacccucucagcuccag

SEQ ID NO: 1445260 - RNA, 21 nt, Human
uucaguacccucucagcucca

SEQ ID NO: 1445261 - RNA, 15 nt, Human
auauauuaucuuuuc

SEQ ID NO: 1445262 - RNA, 14 nt, Human
auauauuaucuuuu

SEQ ID NO: 1445263 - RNA, 13 nt, Human
auauauuaucuuu

SEQ ID NO: 1445264 - RNA, 20 nt, Human
auauauuauauggaaauaua

SEQ ID NO: 1445265 - RNA, 16 nt, Human
auauauuauauggaaa

SEQ ID NO: 1445266 - RNA, 15 nt, Human
auauauuauauggaa

SEQ ID NO: 1445267 - RNA, 14 nt, Human
auauauuauaugga

SEQ ID NO: 1445268 - RNA, 22 nt, Human
auauauuauacuuguaauuaug

SEQ ID NO: 1445269 - RNA, 19 nt, Human
auauauuauacuuguaauu

SEQ ID NO: 1445270 - RNA, 17 nt, Human
auauauuauacuuguaa

SEQ ID NO: 1445271 - RNA, 14 nt, Human
auauauuauacuug

SEQ ID NO: 1445272 - RNA, 14 nt, Human
uucaucauuuuuua

SEQ ID NO: 1445273 - RNA, 21 nt, Human
uucauauuuuaaacagaggau

SEQ ID NO: 1445274 - RNA, 20 nt, Human
uucauccaaguuaaauguag

SEQ ID NO: 1445275 - RNA, 17 nt, Human
uucauccaaguuaaaug

SEQ ID NO: 1445276 - RNA, 17 nt, Human
uucauauuuuaaacaga

SEQ ID NO: 1445277 - RNA, 21 nt, Human
auaucuaccccagacuagaug

SEQ ID NO: 1445278 - RNA, 23 nt, Human
auaucuaccccagacuagaugua

SEQ ID NO: 1445279 - RNA, 22 nt, Human
auaucuauauuuuacauaaauu

SEQ ID NO: 1445280 - RNA, 20 nt, Human
auaucuauauuuuacauaaa

SEQ ID NO: 1445281 - RNA, 16 nt, Human
auaucuauauuuuaca

SEQ ID NO: 1445282 - RNA, 17 nt, Human
auaucuauauuuuacau

SEQ ID NO: 1445283 - RNA, 17 nt, Human
auaucgacuuguuuuug

SEQ ID NO: 1445284 - RNA, 18 nt, Human
auauauuauuauaaucuu

SEQ ID NO: 1445285 - RNA, 16 nt, Human
auauauuauuauaauc

SEQ ID NO: 1445286 - RNA, 14 nt, Human
auauauuauuauaa

SEQ ID NO: 1445287 - RNA, 13 nt, Human
auauauuauuaua

SEQ ID NO: 1445288 - RNA, 18 nt, Human
auauauuauuacuuguaa

SEQ ID NO: 1445289 - RNA, 14 nt, Human
auauauuauuacuu

SEQ ID NO: 1445290 - RNA, 16 nt, Human
auauauuaucuuuuca

SEQ ID NO: 1445291 - RNA, 18 nt, Human
auauauucagccuggcuu

SEQ ID NO: 1445292 - RNA, 14 nt, Human
uuauuuaaaucugu

SEQ ID NO: 1445293 - RNA, 16 nt, Human
uuauuuaaaauagcaa

SEQ ID NO: 1445294 - RNA, 15 nt, Human
uuauuuaaaauagca

SEQ ID NO: 1445295 - RNA, 17 nt, Human
uuauuuaaaaaacuaaa

SEQ ID NO: 1445296 - RNA, 20 nt, Human
uuauuuaaacucuguugcaa

SEQ ID NO: 1445297 - RNA, 23 nt, Human
uuauuuaaaccgcuaaaagaaac

SEQ ID NO: 1445298 - RNA, 21 nt, Human
uuauuuaaaauagcaaaagaa

SEQ ID NO: 1445299 - RNA, 22 nt, Human
uuauuuaaaauagcaaaagaag

SEQ ID NO: 1445300 - RNA, 12 nt, Human
auagcugugacu

SEQ ID NO: 1445301 - RNA, 19 nt, Human
uuauuguguuugucauuag

SEQ ID NO: 1445302 - RNA, 20 nt, Human
uuauuguguuugucauuagc

SEQ ID NO: 1445303 - RNA, 22 nt, Human
uuauuguguuugucauuagccu

SEQ ID NO: 1445304 - RNA, 15 nt, Human
auagcugcuuccagu

SEQ ID NO: 1445305 - RNA, 15 nt, Human
auagcuguaaacuuc

SEQ ID NO: 1445306 - RNA, 17 nt, Human
auagcugcuuccagugu

SEQ ID NO: 1445307 - RNA, 14 nt, Human
auagcugaucaguu

SEQ ID NO: 1445308 - RNA, 17 nt, Human
uuauuuaccccuccccu

SEQ ID NO: 1445309 - RNA, 15 nt, Human
uuauuuacauuuaau

SEQ ID NO: 1445310 - RNA, 13 nt, Human
uuauuuacauuua

SEQ ID NO: 1445311 - RNA, 16 nt, Human
uuauuuacauuuaaua

SEQ ID NO: 1445312 - RNA, 15 nt, Human
uuauuuauuggagau

SEQ ID NO: 1445313 - RNA, 21 nt, Human
uuauuuauguauugugcaaug

SEQ ID NO: 1445314 - RNA, 15 nt, Human
uuauuuauguauugu

SEQ ID NO: 1445315 - RNA, 14 nt, Human
uuauuuauguauug

SEQ ID NO: 1445316 - RNA, 13 nt, Human
uuauuuauguauu

SEQ ID NO: 1445317 - RNA, 21 nt, Human
uuauuuauguauggugcaaug

SEQ ID NO: 1445318 - RNA, 15 nt, Human
uuauuuauguauggu

SEQ ID NO: 1445319 - RNA, 12 nt, Human
uuauuuauguau

SEQ ID NO: 1445320 - RNA, 20 nt, Human
uuauuuaugccucuguauuu

SEQ ID NO: 1445321 - RNA, 14 nt, Human
uuauuuaugccucu

SEQ ID NO: 1445322 - RNA, 19 nt, Human
uuauuucaugauuagaaau

SEQ ID NO: 1445323 - RNA, 18 nt, Human
uuauuuccuaguucugua

SEQ ID NO: 1445324 - RNA, 19 nt, Human
uuauuuccuaguucuguag

SEQ ID NO: 1445325 - RNA, 12 nt, Human
uuauuucaauau

SEQ ID NO: 1445326 - RNA, 13 nt, Human
auagcucuggggu

SEQ ID NO: 1445327 - RNA, 12 nt, Human
auagcucugggg

SEQ ID NO: 1445328 - RNA, 22 nt, Human
auagcucuggggugggcaguuu

SEQ ID NO: 1445329 - RNA, 19 nt, Human
auagcucuggggugggcag

SEQ ID NO: 1445330 - RNA, 18 nt, Human
auagcuacuaauuuuaaa

SEQ ID NO: 1445331 - RNA, 15 nt, Human
auaagagcucaggau

SEQ ID NO: 1445332 - RNA, 21 nt, Human
auaacuugagaccuaaucucu

SEQ ID NO: 1445333 - RNA, 19 nt, Human
auaacuugagaccuaaucu

SEQ ID NO: 1445334 - RNA, 18 nt, Human
auaacuuccacagggucc

SEQ ID NO: 1445335 - RNA, 14 nt, Human
auaacuuccacagg

SEQ ID NO: 1445336 - RNA, 12 nt, Human
uuagacagaggc

SEQ ID NO: 1445337 - RNA, 16 nt, Human
auaagaguuggcuggu

SEQ ID NO: 1445338 - RNA, 16 nt, Human
auaagaguagaaacug

SEQ ID NO: 1445339 - RNA, 14 nt, Human
auagcuacuaauuu

SEQ ID NO: 1445340 - RNA, 17 nt, Human
auagcuacuaauuuuaa

SEQ ID NO: 1445341 - RNA, 17 nt, Human
auagcguucuuguaauu

SEQ ID NO: 1445342 - RNA, 15 nt, Human
auagcguucuuguaa

SEQ ID NO: 1445343 - RNA, 14 nt, Human
auagcguucuugua

SEQ ID NO: 1445344 - RNA, 13 nt, Human
auagcguucuugu

SEQ ID NO: 1445345 - RNA, 13 nt, Human
auagcuaaauacc

SEQ ID NO: 1445346 - RNA, 18 nt, Human
auagcguucuuguaauuu

SEQ ID NO: 1445347 - RNA, 13 nt, Human
auagcuaaguaca

SEQ ID NO: 1445348 - RNA, 14 nt, Human
auagcuaaguacac

SEQ ID NO: 1445349 - RNA, 15 nt, Human
auagcuaaguacaca

SEQ ID NO: 1445350 - RNA, 18 nt, Human
auagcuaaguacacaaua

SEQ ID NO: 1445351 - RNA, 15 nt, Human
uucacagugcucuuu

SEQ ID NO: 1445352 - RNA, 23 nt, Human
uucacaguacccaaacugcuuuu

SEQ ID NO: 1445353 - RNA, 19 nt, Human
uucacaguacccaaacugc

SEQ ID NO: 1445354 - RNA, 19 nt, Human
uucacaggcagccagugcc

SEQ ID NO: 1445355 - RNA, 16 nt, Human
uucacaggcagccagu

SEQ ID NO: 1445356 - RNA, 14 nt, Human
uucacaggcagcca

SEQ ID NO: 1445357 - RNA, 13 nt, Human
uucacaggcagcc

SEQ ID NO: 1445358 - RNA, 12 nt, Human
uucacaggcagc

SEQ ID NO: 1445359 - RNA, 17 nt, Human
uucacagcuccucccac

SEQ ID NO: 1445360 - RNA, 15 nt, Human
uucacagcuccuccc

SEQ ID NO: 1445361 - RNA, 13 nt, Human
uucacagcuccuc

SEQ ID NO: 1445362 - RNA, 21 nt, Human
uucaauaaaguauuuaauuag

SEQ ID NO: 1445363 - RNA, 13 nt, Human
uucaauaaagcug

SEQ ID NO: 1445364 - RNA, 12 nt, Human
uucaauaaagcu

SEQ ID NO: 1445365 - RNA, 14 nt, Human
uucaauaaaguauu

SEQ ID NO: 1445366 - RNA, 18 nt, Human
uucaauaaaguauuuaau

SEQ ID NO: 1445367 - RNA, 19 nt, Human
uucaauaaaguauuuaauu

SEQ ID NO: 1445368 - RNA, 13 nt, Human
uucacauuggaaa

SEQ ID NO: 1445369 - RNA, 23 nt, Human
uucacauagcccacuuacauuua

SEQ ID NO: 1445370 - RNA, 19 nt, Human
uucacauuguauucagagu

SEQ ID NO: 1445371 - RNA, 17 nt, Human
uucacauauugauuucc

SEQ ID NO: 1445372 - RNA, 18 nt, Human
uucaccagauuugcuaau

SEQ ID NO: 1445373 - RNA, 14 nt, Human
uucaccaaaucuug

SEQ ID NO: 1445374 - RNA, 19 nt, Human
uucacauuuuccuuuucaa

SEQ ID NO: 1445375 - RNA, 14 nt, Human
uucacauuggaaac

SEQ ID NO: 1445376 - RNA, 18 nt, Human
auagcuuaugaaaagaau

SEQ ID NO: 1445377 - RNA, 18 nt, Human
uucaccauuauaaugaau

SEQ ID NO: 1445378 - RNA, 24 nt, Human
uucaccauuuggcaaugccaucau

SEQ ID NO: 1445379 - RNA, 20 nt, Human
uucaccauuauaaugaauuu

SEQ ID NO: 1445380 - RNA, 15 nt, Human
uucaccauuauaaug

SEQ ID NO: 1445381 - RNA, 19 nt, Human
auaggaacuuaaauaaugu

SEQ ID NO: 1445382 - RNA, 21 nt, Human
auaggauuuauuuaaaauagc

SEQ ID NO: 1445383 - RNA, 16 nt, Human
auaggauuuauuuaaa

SEQ ID NO: 1445384 - RNA, 23 nt, Human
auaggaucauuuguuggaaugaa

SEQ ID NO: 1445385 - RNA, 23 nt, Human
auaggauuuauuuaaaauagcaa

SEQ ID NO: 1445386 - RNA, 17 nt, Human
auaggcacaggaaacca

SEQ ID NO: 1445387 - RNA, 12 nt, Human
auaggccagccg

SEQ ID NO: 1445388 - RNA, 20 nt, Human
auaggcaggaagcccaauug

SEQ ID NO: 1445389 - RNA, 13 nt, Human
auaggcaggaagc

SEQ ID NO: 1445390 - RNA, 22 nt, Human
auaggauuuauuuaaaauagca

SEQ ID NO: 1445391 - RNA, 14 nt, Human
auagggucuaacuc

SEQ ID NO: 1445392 - RNA, 14 nt, Human
auagggcugagcuc

SEQ ID NO: 1445393 - RNA, 17 nt, Human
auagggcugagcucucu

SEQ ID NO: 1445394 - RNA, 21 nt, Human
auagggcaauuaauuccuuca

SEQ ID NO: 1445395 - RNA, 22 nt, Human
auagggcaauuaauuccuucag

SEQ ID NO: 1445396 - RNA, 23 nt, Human
auagggcaauuaauuccuucagc

SEQ ID NO: 1445397 - RNA, 20 nt, Human
uucaagaaacugaggaauuu

SEQ ID NO: 1445398 - RNA, 13 nt, Human
uucaagaaacuga

SEQ ID NO: 1445399 - RNA, 12 nt, Human
uucaagaaacug

SEQ ID NO: 1445400 - RNA, 12 nt, Human
uucaacuuuucc

SEQ ID NO: 1445401 - RNA, 22 nt, Human
uucaagaaagcuucaaacugca

SEQ ID NO: 1445402 - RNA, 23 nt, Human
uucaagaaacugaggaauuuucu

SEQ ID NO: 1445403 - RNA, 22 nt, Human
uucaaggcacucuagauuccau

SEQ ID NO: 1445404 - RNA, 21 nt, Human
uucaaggcacucuagauucca

SEQ ID NO: 1445405 - RNA, 19 nt, Human
uucaaggcacucuagauuc

SEQ ID NO: 1445406 - RNA, 18 nt, Human
uucaaggcacucuagauu

SEQ ID NO: 1445407 - RNA, 17 nt, Human
uucaaggcacucuagau

SEQ ID NO: 1445408 - RNA, 16 nt, Human
uucaaggcacucuaga

SEQ ID NO: 1445409 - RNA, 14 nt, Human
uucaaggcacucua

SEQ ID NO: 1445410 - RNA, 19 nt, Human
uucaaggaguaugcaggga

SEQ ID NO: 1445411 - RNA, 19 nt, Human
uucaaggaauuucuuaacu

SEQ ID NO: 1445412 - RNA, 17 nt, Human
uucaaggaauuucuuaa

SEQ ID NO: 1445413 - RNA, 23 nt, Human
uucaaguuccaaguugcuaauac

SEQ ID NO: 1445414 - RNA, 19 nt, Human
uucaaguguaaaauauuuu

SEQ ID NO: 1445415 - RNA, 18 nt, Human
uucaagugcuucuccagc

SEQ ID NO: 1445416 - RNA, 22 nt, Human
uuauuucugcauauguugaaua

SEQ ID NO: 1445417 - RNA, 20 nt, Human
uuauuucugcauauguugaa

SEQ ID NO: 1445418 - RNA, 15 nt, Human
uuauuucugcauaug

SEQ ID NO: 1445419 - RNA, 13 nt, Human
uuauuucugcaua

SEQ ID NO: 1445420 - RNA, 12 nt, Human
uuauuucugcau

SEQ ID NO: 1445421 - RNA, 21 nt, Human
uuauuuccuaguucuguagaa

SEQ ID NO: 1445422 - RNA, 19 nt, Human
uucaacuuauuaacaauua

SEQ ID NO: 1445423 - RNA, 22 nt, Human
uucaaacuacuuugcugcuaau

SEQ ID NO: 1445424 - RNA, 13 nt, Human
uucaaacuacuuu

SEQ ID NO: 1445425 - RNA, 12 nt, Human
uucaaacuacuu

SEQ ID NO: 1445426 - RNA, 15 nt, Human
uucaaacauauauaa

SEQ ID NO: 1445427 - RNA, 20 nt, Human
uucaaaaugcuuuuuauuau

SEQ ID NO: 1445428 - RNA, 17 nt, Human
uucaaaaugcuuuuuau

SEQ ID NO: 1445429 - RNA, 20 nt, Human
uucaaaauaggguauauuuu

SEQ ID NO: 1445430 - RNA, 23 nt, Human
uucaaaauguuaucuucucaagu

SEQ ID NO: 1445431 - RNA, 15 nt, Human
uucaaaauguuaucu

SEQ ID NO: 1445432 - RNA, 19 nt, Human
uucaaaauaggguauauuu

SEQ ID NO: 1445433 - RNA, 16 nt, Human
uucaaaauggagggaa

SEQ ID NO: 1445434 - RNA, 16 nt, Human
uucaaaauuguuacaa

SEQ ID NO: 1445435 - RNA, 18 nt, Human
aucccuguguugucucua

SEQ ID NO: 1445436 - RNA, 15 nt, Human
aucccugggccuugg

SEQ ID NO: 1445437 - RNA, 20 nt, Human
aucccugggccuugggcucc

SEQ ID NO: 1445438 - RNA, 22 nt, Human
aucccugggccugcugcugaga

SEQ ID NO: 1445439 - RNA, 21 nt, Human
aucccugggccugcugcugag

SEQ ID NO: 1445440 - RNA, 20 nt, Human
aucccugggccugcugcuga

SEQ ID NO: 1445441 - RNA, 18 nt, Human
aucccugggccugcugcu

SEQ ID NO: 1445442 - RNA, 17 nt, Human
aucccugggccugcugc

SEQ ID NO: 1445443 - RNA, 16 nt, Human
aucccugggccugcug

SEQ ID NO: 1445444 - RNA, 15 nt, Human
aucccugggccugcu

SEQ ID NO: 1445445 - RNA, 14 nt, Human
aucccugggccugc

SEQ ID NO: 1445446 - RNA, 14 nt, Human
aucccucuccuccc

SEQ ID NO: 1445447 - RNA, 23 nt, Human
aucccucuacagagcuucccuga

SEQ ID NO: 1445448 - RNA, 22 nt, Human
aucccucuacagagcuucccug

SEQ ID NO: 1445449 - RNA, 21 nt, Human
aucccucuacagagcuucccu

SEQ ID NO: 1445450 - RNA, 20 nt, Human
aucccucuacagagcuuccc

SEQ ID NO: 1445451 - RNA, 11 nt, Human
aucccuggccc

SEQ ID NO: 1445452 - RNA, 10 nt, Human
aucccuggcc

SEQ ID NO: 1445453 - RNA, 13 nt, Human
aucccugggccug

SEQ ID NO: 1445454 - RNA, 22 nt, Human
aucccuggcccccucccuggau

SEQ ID NO: 1445455 - RNA, 16 nt, Human
aucccuggcccccucc

SEQ ID NO: 1445456 - RNA, 12 nt, Human
aucccuggcccc

SEQ ID NO: 1445457 - RNA, 17 nt, Human
aucccucuacagagcuu

SEQ ID NO: 1445458 - RNA, 13 nt, Human
aucccuccuguug

SEQ ID NO: 1445459 - RNA, 15 nt, Human
aucccuccuguuggg

SEQ ID NO: 1445460 - RNA, 12 nt, Human
aucccuccuguu

SEQ ID NO: 1445461 - RNA, 22 nt, Human
aucccucccccccaugcacugu

SEQ ID NO: 1445462 - RNA, 21 nt, Human
aucccucccccccaugcacug

SEQ ID NO: 1445463 - RNA, 19 nt, Human
aucccucccccccaugcac

SEQ ID NO: 1445464 - RNA, 18 nt, Human
aucccucccccccaugca

SEQ ID NO: 1445465 - RNA, 16 nt, Human
aucccuccccaguuca

SEQ ID NO: 1445466 - RNA, 15 nt, Human
aucccuccccaguuc

SEQ ID NO: 1445467 - RNA, 17 nt, Human
aucccucaucugucccu

SEQ ID NO: 1445468 - RNA, 13 nt, Human
aucccucaucugu

SEQ ID NO: 1445469 - RNA, 14 nt, Human
auccagguaaucca

SEQ ID NO: 1445470 - RNA, 15 nt, Human
aucauuuuaauuauu

SEQ ID NO: 1445471 - RNA, 14 nt, Human
aucauuuuaauuau

SEQ ID NO: 1445472 - RNA, 15 nt, Human
aucauuuguuuaaaa

SEQ ID NO: 1445473 - RNA, 14 nt, Human
aucauuuguuuaaa

SEQ ID NO: 1445474 - RNA, 13 nt, Human
aucauuuguuuaa

SEQ ID NO: 1445475 - RNA, 18 nt, Human
aucauuuguuggaaugaa

SEQ ID NO: 1445476 - RNA, 23 nt, Human
aucauuucuuuuugggagagacu

SEQ ID NO: 1445477 - RNA, 18 nt, Human
uucuguacucaaauguag

SEQ ID NO: 1445478 - RNA, 21 nt, Human
uucuguaccaguuaauuuuuc

SEQ ID NO: 1445479 - RNA, 17 nt, Human
aucccaacacugccagc

SEQ ID NO: 1445480 - RNA, 16 nt, Human
aucccaacacugccag

SEQ ID NO: 1445481 - RNA, 15 nt, Human
aucccaacacugcca

SEQ ID NO: 1445482 - RNA, 11 nt, Human
aucccaacacu

SEQ ID NO: 1445483 - RNA, 15 nt, Human
auccauucuccugag

SEQ ID NO: 1445484 - RNA, 13 nt, Human
auccauguaacug

SEQ ID NO: 1445485 - RNA, 16 nt, Human
auccauguaacugccu

SEQ ID NO: 1445486 - RNA, 18 nt, Human
aucauuuguuuaaaaagg

SEQ ID NO: 1445487 - RNA, 20 nt, Human
aucauuuuaccuuugacaaa

SEQ ID NO: 1445488 - RNA, 23 nt, Human
uucucuguugucguaaagauuug

SEQ ID NO: 1445489 - RNA, 22 nt, Human
uucucuguugucguaaagauuu

SEQ ID NO: 1445490 - RNA, 15 nt, Human
uucugaaaauauaac

SEQ ID NO: 1445491 - RNA, 20 nt, Human
uucucuguugucguaaagau

SEQ ID NO: 1445492 - RNA, 23 nt, Human
uucucugugucuaagauucuaga

SEQ ID NO: 1445493 - RNA, 22 nt, Human
uucucugugucuaagauucuag

SEQ ID NO: 1445494 - RNA, 21 nt, Human
uucucugugucuaagauucua

SEQ ID NO: 1445495 - RNA, 20 nt, Human
uucucugugucuaagauucu

SEQ ID NO: 1445496 - RNA, 18 nt, Human
uucucugugucuaagauu

SEQ ID NO: 1445497 - RNA, 17 nt, Human
uucucugugucuaagau

SEQ ID NO: 1445498 - RNA, 16 nt, Human
uucucugugucuaaga

SEQ ID NO: 1445499 - RNA, 17 nt, Human
uucucugucucauccau

SEQ ID NO: 1445500 - RNA, 22 nt, Human
uucugaacagcugguguagcua

SEQ ID NO: 1445501 - RNA, 18 nt, Human
uucugaacagcuggugua

SEQ ID NO: 1445502 - RNA, 16 nt, Human
uucugaacagcuggug

SEQ ID NO: 1445503 - RNA, 15 nt, Human
uucugaacagcuggu

SEQ ID NO: 1445504 - RNA, 14 nt, Human
uucugaacagcugg

SEQ ID NO: 1445505 - RNA, 13 nt, Human
uucugaacagcug

SEQ ID NO: 1445506 - RNA, 12 nt, Human
uucugaacagcu

SEQ ID NO: 1445507 - RNA, 21 nt, Human
uucugaaauuuccugggagcu

SEQ ID NO: 1445508 - RNA, 13 nt, Human
uucugaagaagau

SEQ ID NO: 1445509 - RNA, 12 nt, Human
uucugaagaaga

SEQ ID NO: 1445510 - RNA, 13 nt, Human
uucugaacuaaag

SEQ ID NO: 1445511 - RNA, 23 nt, Human
uucugaacagcugguguagcuac

SEQ ID NO: 1445512 - RNA, 14 nt, Human
uucugaagaagaug

SEQ ID NO: 1445513 - RNA, 14 nt, Human
uucugccuccccuu

SEQ ID NO: 1445514 - RNA, 12 nt, Human
uucugccaggag

SEQ ID NO: 1445515 - RNA, 18 nt, Human
uucugccucucuaggacc

SEQ ID NO: 1445516 - RNA, 17 nt, Human
uucugccucucuaggac

SEQ ID NO: 1445517 - RNA, 14 nt, Human
uucuguaccaguua

SEQ ID NO: 1445518 - RNA, 13 nt, Human
uucuguaccaguu

SEQ ID NO: 1445519 - RNA, 12 nt, Human
uucuguaccagu

SEQ ID NO: 1445520 - RNA, 11 nt, Human
uucuguaccag

SEQ ID NO: 1445521 - RNA, 22 nt, Human
uucuguacaugcauugagcucu

SEQ ID NO: 1445522 - RNA, 13 nt, Human
uucuguaauugug

SEQ ID NO: 1445523 - RNA, 22 nt, Human
uucuguaauucagguuuuuccu

SEQ ID NO: 1445524 - RNA, 21 nt, Human
uucuguaauucagguuuuucc

SEQ ID NO: 1445525 - RNA, 16 nt, Human
uucuguaauucagguu

SEQ ID NO: 1445526 - RNA, 11 nt, Human
uucuguaauuc

SEQ ID NO: 1445527 - RNA, 15 nt, Human
uucuguaagaaaccu

SEQ ID NO: 1445528 - RNA, 22 nt, Human
uucuguaaauaaugugcacuga

SEQ ID NO: 1445529 - RNA, 19 nt, Human
uucuguaagaaaccuacug

SEQ ID NO: 1445530 - RNA, 12 nt, Human
uucugccugcca

SEQ ID NO: 1445531 - RNA, 20 nt, Human
uucugguaggaauagcaugu

SEQ ID NO: 1445532 - RNA, 21 nt, Human
uucugguaugaacuugaggac

SEQ ID NO: 1445533 - RNA, 16 nt, Human
uucugguccuuuuugg

SEQ ID NO: 1445534 - RNA, 14 nt, Human
uucugguccuuuuu

SEQ ID NO: 1445535 - RNA, 22 nt, Human
uucugguaggaauagcauguca

SEQ ID NO: 1445536 - RNA, 22 nt, Human
uucugguaugaacuugaggaca

SEQ ID NO: 1445537 - RNA, 22 nt, Human
aucagagaugcaccaccaagcc

SEQ ID NO: 1445538 - RNA, 18 nt, Human
aucagaagucaucuugcu

SEQ ID NO: 1445539 - RNA, 14 nt, Human
aucagagaaggaac

SEQ ID NO: 1445540 - RNA, 23 nt, Human
aucagaacucaaauggggccaga

SEQ ID NO: 1445541 - RNA, 22 nt, Human
aucagaacucaaauggggccag

SEQ ID NO: 1445542 - RNA, 12 nt, Human
aucagaacagga

SEQ ID NO: 1445543 - RNA, 22 nt, Human
aucagaaagggagggcucugag

SEQ ID NO: 1445544 - RNA, 23 nt, Human
aucagaaagggagggcucugagg

SEQ ID NO: 1445545 - RNA, 21 nt, Human
aucagaaagggagggcucuga

SEQ ID NO: 1445546 - RNA, 20 nt, Human
aucagaaagggagggcucug

SEQ ID NO: 1445547 - RNA, 19 nt, Human
aucagaaagggagggcucu

SEQ ID NO: 1445548 - RNA, 12 nt, Human
uucucaucagua

SEQ ID NO: 1445549 - RNA, 14 nt, Human
aucagaaauacaga

SEQ ID NO: 1445550 - RNA, 15 nt, Human
aucagaaauacagau

SEQ ID NO: 1445551 - RNA, 19 nt, Human
aucagaaauacagauuuug

SEQ ID NO: 1445552 - RNA, 23 nt, Human
aucagaaauacagauuuugauag

SEQ ID NO: 1445553 - RNA, 13 nt, Human
uucucaucaguag

SEQ ID NO: 1445554 - RNA, 12 nt, Human
uucucauaacuu

SEQ ID NO: 1445555 - RNA, 15 nt, Human
uucucaguuuucaua

SEQ ID NO: 1445556 - RNA, 14 nt, Human
uucucaguuuucau

SEQ ID NO: 1445557 - RNA, 21 nt, Human
uucucacacuggucugcuguc

SEQ ID NO: 1445558 - RNA, 20 nt, Human
uucucaauuccaacaguuua

SEQ ID NO: 1445559 - RNA, 18 nt, Human
uucucaauuccaacaguu

SEQ ID NO: 1445560 - RNA, 17 nt, Human
uucucaauuccaacagu

SEQ ID NO: 1445561 - RNA, 20 nt, Human
uucucacagcuccaagaauu

SEQ ID NO: 1445562 - RNA, 18 nt, Human
uucuagguaggaaaugug

SEQ ID NO: 1445563 - RNA, 14 nt, Human
uucuagguaggaaa

SEQ ID NO: 1445564 - RNA, 21 nt, Human
uucuaggcacuguaguucuaa

SEQ ID NO: 1445565 - RNA, 23 nt, Human
uucuaggcacuguaguucuaaga

SEQ ID NO: 1445566 - RNA, 20 nt, Human
uucuagguuucaaagaugcu

SEQ ID NO: 1445567 - RNA, 13 nt, Human
uucuagguuucaa

SEQ ID NO: 1445568 - RNA, 15 nt, Human
uucuagguucuaaaa

SEQ ID NO: 1445569 - RNA, 17 nt, Human
uucuagguuucaaagau

SEQ ID NO: 1445570 - RNA, 14 nt, Human
uucuaguugaaaau

SEQ ID NO: 1445571 - RNA, 17 nt, Human
uucuaguucugccagga

SEQ ID NO: 1445572 - RNA, 14 nt, Human
uuccuuuuucagau

SEQ ID NO: 1445573 - RNA, 20 nt, Human
uuccuuuuuaauaugcuuaa

SEQ ID NO: 1445574 - RNA, 17 nt, Human
uuccuuuugccgacccc

SEQ ID NO: 1445575 - RNA, 14 nt, Human
uucucaauuccaac

SEQ ID NO: 1445576 - RNA, 13 nt, Human
uucucaauuccaa

SEQ ID NO: 1445577 - RNA, 23 nt, Human
uucucaaguucuaagauucuaau

SEQ ID NO: 1445578 - RNA, 22 nt, Human
uucucaaguucuaagauucuaa

SEQ ID NO: 1445579 - RNA, 20 nt, Human
uucucaaguucuaagauucu

SEQ ID NO: 1445580 - RNA, 18 nt, Human
uucucaaguucuaagauu

SEQ ID NO: 1445581 - RNA, 17 nt, Human
uucucaaguucuaagau

SEQ ID NO: 1445582 - RNA, 16 nt, Human
uucucaaguucuaaga

SEQ ID NO: 1445583 - RNA, 14 nt, Human
uucucaaguucuaa

SEQ ID NO: 1445584 - RNA, 13 nt, Human
uucucaaguucua

SEQ ID NO: 1445585 - RNA, 23 nt, Human
uucuauaaggccauaaaacaggu

SEQ ID NO: 1445586 - RNA, 14 nt, Human
uucucaagcccugc

SEQ ID NO: 1445587 - RNA, 15 nt, Human
uucucaagcccugca

SEQ ID NO: 1445588 - RNA, 21 nt, Human
uucuauaaggccauaaaacag

SEQ ID NO: 1445589 - RNA, 14 nt, Human
uucuauaaggccau

SEQ ID NO: 1445590 - RNA, 13 nt, Human
uucuauaaggcca

SEQ ID NO: 1445591 - RNA, 18 nt, Human
uucucaacuccaaacuga

SEQ ID NO: 1445592 - RNA, 14 nt, Human
uucucaacuccaaa

SEQ ID NO: 1445593 - RNA, 15 nt, Human
aucauagaaauguaa

SEQ ID NO: 1445594 - RNA, 12 nt, Human
aucauagaaaug

SEQ ID NO: 1445595 - RNA, 13 nt, Human
aucauaaggcuuc

SEQ ID NO: 1445596 - RNA, 19 nt, Human
aucaguguaccauuugccu

SEQ ID NO: 1445597 - RNA, 19 nt, Human
aucagucauaacuaaauaa

SEQ ID NO: 1445598 - RNA, 13 nt, Human
aucagucaauauu

SEQ ID NO: 1445599 - RNA, 20 nt, Human
aucagaugcuccaagauucu

SEQ ID NO: 1445600 - RNA, 17 nt, Human
aucagcacgauuucugu

SEQ ID NO: 1445601 - RNA, 18 nt, Human
aucagcacgauuucuguu

SEQ ID NO: 1445602 - RNA, 15 nt, Human
aucagauagcaucuu

SEQ ID NO: 1445603 - RNA, 16 nt, Human
aucagagugacaucca

SEQ ID NO: 1445604 - RNA, 17 nt, Human
aucagaguugcugcaaa

SEQ ID NO: 1445605 - RNA, 20 nt, Human
aucagagugacauccaggag

SEQ ID NO: 1445606 - RNA, 15 nt, Human
aucagcacgauuucu

SEQ ID NO: 1445607 - RNA, 16 nt, Human
aucagcacgauuucug

SEQ ID NO: 1445608 - RNA, 18 nt, Human
aucaucaaguaauacaaa

SEQ ID NO: 1445609 - RNA, 20 nt, Human
aucaucagaaaggaaaaaca

SEQ ID NO: 1445610 - RNA, 21 nt, Human
aucaucaaguaauacaaacua

SEQ ID NO: 1445611 - RNA, 16 nt, Human
aucaucaaguaauaca

SEQ ID NO: 1445612 - RNA, 14 nt, Human
aucaucaggacccu

SEQ ID NO: 1445613 - RNA, 15 nt, Human
aucaucaagagaauu

SEQ ID NO: 1445614 - RNA, 15 nt, Human
aucauucauuuuugu

SEQ ID NO: 1445615 - RNA, 14 nt, Human
aucauuauuuaugu

SEQ ID NO: 1445616 - RNA, 12 nt, Human
aucauucaagug

SEQ ID NO: 1445617 - RNA, 17 nt, Human
aucauuauuuauguauu

SEQ ID NO: 1445618 - RNA, 15 nt, Human
aucauuauuuaugua

SEQ ID NO: 1445619 - RNA, 14 nt, Human
aucauucauuuucu

SEQ ID NO: 1445620 - RNA, 18 nt, Human
aucacuguuuagaacaca

SEQ ID NO: 1445621 - RNA, 20 nt, Human
aucacuguuuagaacacaca

SEQ ID NO: 1445622 - RNA, 22 nt, Human
aucacuagcccuccuuuuucca

SEQ ID NO: 1445623 - RNA, 12 nt, Human
uuccuuuuauca

SEQ ID NO: 1445624 - RNA, 12 nt, Human
uuccuuuuaauu

SEQ ID NO: 1445625 - RNA, 13 nt, Human
uuccuuugugcuu

SEQ ID NO: 1445626 - RNA, 15 nt, Human
aucacaaaguggaac

SEQ ID NO: 1445627 - RNA, 24 nt, Human
aucacaaaguggaacgaaaaugaa

SEQ ID NO: 1445628 - RNA, 14 nt, Human
aucacaaaguggaa

SEQ ID NO: 1445629 - RNA, 15 nt, Human
aucacaacgugcauu

SEQ ID NO: 1445630 - RNA, 17 nt, Human
aucacaacgugcauugu

SEQ ID NO: 1445631 - RNA, 18 nt, Human
aucacaacgugcauugug

SEQ ID NO: 1445632 - RNA, 21 nt, Human
aucacaacgugcauugugcuu

SEQ ID NO: 1445633 - RNA, 17 nt, Human
aucacuagcccuccuuu

SEQ ID NO: 1445634 - RNA, 13 nt, Human
aucacacaaagca

SEQ ID NO: 1445635 - RNA, 22 nt, Human
aucacaacgugcauugugcuuc

SEQ ID NO: 1445636 - RNA, 16 nt, Human
aucacaagauggaauu

SEQ ID NO: 1445637 - RNA, 21 nt, Human
aucaauaauauauuuucuguu

SEQ ID NO: 1445638 - RNA, 20 nt, Human
aucaauaauauauuuucugu

SEQ ID NO: 1445639 - RNA, 18 nt, Human
aucaauaauauauuuucu

SEQ ID NO: 1445640 - RNA, 16 nt, Human
aucaaguauuugggaa

SEQ ID NO: 1445641 - RNA, 16 nt, Human
aucaauaauauauuuu

SEQ ID NO: 1445642 - RNA, 13 nt, Human
aucaaguauuaua

SEQ ID NO: 1445643 - RNA, 14 nt, Human
aucaaguauuauac

SEQ ID NO: 1445644 - RNA, 18 nt, Human
aucaaguauuauaccuuu

SEQ ID NO: 1445645 - RNA, 13 nt, Human
aucaagagacuga

SEQ ID NO: 1445646 - RNA, 12 nt, Human
auauuuugcagu

SEQ ID NO: 1445647 - RNA, 13 nt, Human
auauuuucuuuuc

SEQ ID NO: 1445648 - RNA, 14 nt, Human
auauuuugaaucaa

SEQ ID NO: 1445649 - RNA, 19 nt, Human
auauuuugaaucaauaaua

SEQ ID NO: 1445650 - RNA, 13 nt, Human
auauuuugaauca

SEQ ID NO: 1445651 - RNA, 12 nt, Human
auauuuugaauc

SEQ ID NO: 1445652 - RNA, 13 nt, Human
auauuuucuuucu

SEQ ID NO: 1445653 - RNA, 12 nt, Human
auauuuucuuuc

SEQ ID NO: 1445654 - RNA, 19 nt, Human
uuccuaauaaaguucugua

SEQ ID NO: 1445655 - RNA, 16 nt, Human
uuccuaauaaaguucu

SEQ ID NO: 1445656 - RNA, 15 nt, Human
uuccuaauaaaguuc

SEQ ID NO: 1445657 - RNA, 14 nt, Human
auauuuuaagacga

SEQ ID NO: 1445658 - RNA, 22 nt, Human
uuccucuaacuuggcucacacu

SEQ ID NO: 1445659 - RNA, 23 nt, Human
uuccuccugggcccucucugcuc

SEQ ID NO: 1445660 - RNA, 21 nt, Human
uuccuccugggcccucucugc

SEQ ID NO: 1445661 - RNA, 15 nt, Human
uuccuccugggcccu

SEQ ID NO: 1445662 - RNA, 14 nt, Human
uuccuccugggccc

SEQ ID NO: 1445663 - RNA, 11 nt, Human
uuccuccuggg

SEQ ID NO: 1445664 - RNA, 22 nt, Human
uuccuaauaaaguucuguacuc

SEQ ID NO: 1445665 - RNA, 17 nt, Human
uuccucuaguucuuugu

SEQ ID NO: 1445666 - RNA, 20 nt, Human
uuccucuucuauuuuguaaa

SEQ ID NO: 1445667 - RNA, 22 nt, Human
uuccucuguucaaagcugccug

SEQ ID NO: 1445668 - RNA, 18 nt, Human
uuccucugucuccuaagc

SEQ ID NO: 1445669 - RNA, 21 nt, Human
uuccuguguguccaaaacugc

SEQ ID NO: 1445670 - RNA, 20 nt, Human
uuccuggugccaauuucaag

SEQ ID NO: 1445671 - RNA, 19 nt, Human
uuccuggugccaauuucaa

SEQ ID NO: 1445672 - RNA, 22 nt, Human
uuccugguagaccacugccaua

SEQ ID NO: 1445673 - RNA, 22 nt, Human
uuccuggguggcuacucugugc

SEQ ID NO: 1445674 - RNA, 22 nt, Human
uuccuguguguccaaaacugcc

SEQ ID NO: 1445675 - RNA, 15 nt, Human
uuccugggagcuuuu

SEQ ID NO: 1445676 - RNA, 23 nt, Human
uuccuggguggcuacucugugcc

SEQ ID NO: 1445677 - RNA, 17 nt, Human
uuccuggguggcuacuc

SEQ ID NO: 1445678 - RNA, 16 nt, Human
uuccuggguggcuacu

SEQ ID NO: 1445679 - RNA, 16 nt, Human
uuccugggagcuuuug

SEQ ID NO: 1445680 - RNA, 17 nt, Human
uuccuguugucaagaau

SEQ ID NO: 1445681 - RNA, 19 nt, Human
uuccuucagcacuuuagaa

SEQ ID NO: 1445682 - RNA, 16 nt, Human
uuccuucagcacuuua

SEQ ID NO: 1445683 - RNA, 21 nt, Human
auauuuucaccauuugauuau

SEQ ID NO: 1445684 - RNA, 21 nt, Human
auauuuucaugcuguucauga

SEQ ID NO: 1445685 - RNA, 18 nt, Human
auauuuucaugcuguuca

SEQ ID NO: 1445686 - RNA, 18 nt, Human
uucaugugucccagaaga

SEQ ID NO: 1445687 - RNA, 22 nt, Human
uucauguuaguuaccuuauagu

SEQ ID NO: 1445688 - RNA, 18 nt, Human
uucauguuaguuaccuua

SEQ ID NO: 1445689 - RNA, 16 nt, Human
uucauguuaguuaccu

SEQ ID NO: 1445690 - RNA, 13 nt, Human
uucauguuaguua

SEQ ID NO: 1445691 - RNA, 16 nt, Human
uucaugugucccagaa

SEQ ID NO: 1445692 - RNA, 15 nt, Human
uucaugugucccaga

SEQ ID NO: 1445693 - RNA, 16 nt, Human
uucaugucugcuauca

SEQ ID NO: 1445694 - RNA, 16 nt, Human
auauuaaugcccagac

SEQ ID NO: 1445695 - RNA, 19 nt, Human
auauuaaccagauauauau

SEQ ID NO: 1445696 - RNA, 18 nt, Human
auauuaaccagauauaua

SEQ ID NO: 1445697 - RNA, 18 nt, Human
auauuaaauuuuuuguug

SEQ ID NO: 1445698 - RNA, 16 nt, Human
auauuaaauuuuuugu

SEQ ID NO: 1445699 - RNA, 13 nt, Human
auauuaaaucugc

SEQ ID NO: 1445700 - RNA, 12 nt, Human
auauuaaaucug

SEQ ID NO: 1445701 - RNA, 16 nt, Human
auauugaaaaaauaga

SEQ ID NO: 1445702 - RNA, 15 nt, Human
auauugauccagaaa

SEQ ID NO: 1445703 - RNA, 22 nt, Human
auauugauccagaaagaaaacu

SEQ ID NO: 1445704 - RNA, 19 nt, Human
auauugauuuccguuaaaa

SEQ ID NO: 1445705 - RNA, 21 nt, Human
auauugauuuccguuaaaaua

SEQ ID NO: 1445706 - RNA, 22 nt, Human
auauugauuuccguuaaaauac

SEQ ID NO: 1445707 - RNA, 23 nt, Human
auauucccuagaaacuuccaaau

SEQ ID NO: 1445708 - RNA, 17 nt, Human
auauucccuagaaacuu

SEQ ID NO: 1445709 - RNA, 23 nt, Human
auauuccuauugugcaauguaaa

SEQ ID NO: 1445710 - RNA, 22 nt, Human
auauuccuauugugcaauguaa

SEQ ID NO: 1445711 - RNA, 17 nt, Human
auauuccuauugugcaa

SEQ ID NO: 1445712 - RNA, 23 nt, Human
auauucucacagcuccaagaauu

SEQ ID NO: 1445713 - RNA, 22 nt, Human
auauucucacagcuccaagaau

SEQ ID NO: 1445714 - RNA, 17 nt, Human
auauugccauuaugcuu

SEQ ID NO: 1445715 - RNA, 19 nt, Human
auauugcacaugucuuaau

SEQ ID NO: 1445716 - RNA, 20 nt, Human
auauugcacaugucuuaaug

SEQ ID NO: 1445717 - RNA, 21 nt, Human
auauugcacaugucuuaauga

SEQ ID NO: 1445718 - RNA, 15 nt, Human
auauugauuuauuaa

SEQ ID NO: 1445719 - RNA, 13 nt, Human
auauugauuuauu

SEQ ID NO: 1445720 - RNA, 13 nt, Human
auauugcacaugu

SEQ ID NO: 1445721 - RNA, 15 nt, Human
auauugcacaugucu

SEQ ID NO: 1445722 - RNA, 16 nt, Human
auauugcacaugucuu

SEQ ID NO: 1445723 - RNA, 17 nt, Human
auauugcacaugucuua

SEQ ID NO: 1445724 - RNA, 13 nt, Human
auauuguguuugu

SEQ ID NO: 1445725 - RNA, 21 nt, Human
auauuguggguguuaauuuuu

SEQ ID NO: 1445726 - RNA, 20 nt, Human
auauuguugcauugcuuuuu

SEQ ID NO: 1445727 - RNA, 21 nt, Human
auauuguguuuguguauuuac

SEQ ID NO: 1445728 - RNA, 17 nt, Human
auauuguguuuguguau

SEQ ID NO: 1445729 - RNA, 14 nt, Human
auauuuaaaaauaa

SEQ ID NO: 1445730 - RNA, 13 nt, Human
auauuuaaaaaua

SEQ ID NO: 1445731 - RNA, 16 nt, Human
auauuguugcauugcu

SEQ ID NO: 1445732 - RNA, 16 nt, Human
auauuuaaaaguguca

SEQ ID NO: 1445733 - RNA, 16 nt, Human
auauuuaaaaauaagu

SEQ ID NO: 1445734 - RNA, 23 nt, Human
auauuucuauuuuauuaugaaga

SEQ ID NO: 1445735 - RNA, 21 nt, Human
auauuucuauuuuauuaugaa

SEQ ID NO: 1445736 - RNA, 15 nt, Human
auauuucuauuuuau

SEQ ID NO: 1445737 - RNA, 13 nt, Human
auauuucuauuuu

SEQ ID NO: 1445738 - RNA, 13 nt, Human
auauuugaaauau

SEQ ID NO: 1445739 - RNA, 20 nt, Human
auauuuuaaagaauuguguc

SEQ ID NO: 1445740 - RNA, 16 nt, Human
auauuuuaaagaauug

SEQ ID NO: 1445741 - RNA, 15 nt, Human
auauuuuaaagaauu

SEQ ID NO: 1445742 - RNA, 14 nt, Human
auauuuuaaagaau

SEQ ID NO: 1445743 - RNA, 14 nt, Human
auauuuuaaacaga

SEQ ID NO: 1445744 - RNA, 18 nt, Human
auauuuuaaaauuuguuc

SEQ ID NO: 1445745 - RNA, 17 nt, Human
auauuuuaaaauuuguu

SEQ ID NO: 1445746 - RNA, 15 nt, Human
auauuuuaaaauuug

SEQ ID NO: 1445747 - RNA, 13 nt, Human
auauuuuaaaauu

SEQ ID NO: 1445748 - RNA, 16 nt, Human
auauuuguuuauggua

SEQ ID NO: 1445749 - RNA, 15 nt, Human
auauuuguuauguag

SEQ ID NO: 1445750 - RNA, 18 nt, Human
auauuugugacaaaaaau

SEQ ID NO: 1445751 - RNA, 21 nt, Human
auauuugucaugcugggauuu

SEQ ID NO: 1445752 - RNA, 12 nt, Human
auauuuguacau

SEQ ID NO: 1445753 - RNA, 13 nt, Human
auauuuguacaua

SEQ ID NO: 1445754 - RNA, 15 nt, Human
auauuuguaaaauga

SEQ ID NO: 1445755 - RNA, 13 nt, Human
auauuuguaaaau

SEQ ID NO: 1445756 - RNA, 15 nt, Human
auauuugaaucuugu

SEQ ID NO: 1445757 - RNA, 16 nt, Human
auauuugaaucuuguc

SEQ ID NO: 1445758 - RNA, 19 nt, Human
auauuuguaaaaugacaau

SEQ ID NO: 1445759 - RNA, 17 nt, Human
auauuuguaaaaugaca

SEQ ID NO: 1445760 - RNA, 16 nt, Human
auauuuguaaaaugac

SEQ ID NO: 1445761 - RNA, 11 nt, Human
auauuugaauc

SEQ ID NO: 1445762 - RNA, 13 nt, Human
auauuugaaucuu

SEQ ID NO: 1445763 - RNA, 14 nt, Human
auauuugaaucuug

SEQ ID NO: 1445764 - RNA, 23 nt, Human
auauuugaaauauugacuuuuua

SEQ ID NO: 1445765 - RNA, 19 nt, Human
auauuugaaauauugacuu

SEQ ID NO: 1445766 - RNA, 14 nt, Human
auauuugaaauauu

SEQ ID NO: 1445767 - RNA, 21 nt, Human
aucuauuuuuggagguuuauu

SEQ ID NO: 1445768 - RNA, 23 nt, Human
aucuauuuuuggcagucugaauu

SEQ ID NO: 1445769 - RNA, 19 nt, Human
aucuauuuuuggcagucug

SEQ ID NO: 1445770 - RNA, 15 nt, Human
aucuauuuuuggagg

SEQ ID NO: 1445771 - RNA, 13 nt, Human
aucuauuuuugga

SEQ ID NO: 1445772 - RNA, 14 nt, Human
aucucaaauuucua

SEQ ID NO: 1445773 - RNA, 16 nt, Human
aucuagauaucgacuu

SEQ ID NO: 1445774 - RNA, 15 nt, Human
aucuacucaaagcau

SEQ ID NO: 1445775 - RNA, 19 nt, Human
aucuagauacuguaucaug

SEQ ID NO: 1445776 - RNA, 21 nt, Human
aucuaccuagauuuaauauaa

SEQ ID NO: 1445777 - RNA, 15 nt, Human
aucuaccuagauuua

SEQ ID NO: 1445778 - RNA, 22 nt, Human
aucuaccccagacuagauguag

SEQ ID NO: 1445779 - RNA, 21 nt, Human
aucuaccccagacuagaugua

SEQ ID NO: 1445780 - RNA, 20 nt, Human
aucuaccccagacuagaugu

SEQ ID NO: 1445781 - RNA, 14 nt, Human
aucuaccccagacu

SEQ ID NO: 1445782 - RNA, 19 nt, Human
aucuacuaauuccacaccu

SEQ ID NO: 1445783 - RNA, 15 nt, Human
aucuacuaauuccac

SEQ ID NO: 1445784 - RNA, 18 nt, Human
aucuagauacuguaucau

SEQ ID NO: 1445785 - RNA, 23 nt, Human
aucuaauuuauaaaaagguguuu

SEQ ID NO: 1445786 - RNA, 19 nt, Human
aucuaauuuauaaaaaggu

SEQ ID NO: 1445787 - RNA, 15 nt, Human
aucuaauuuauaaaa

SEQ ID NO: 1445788 - RNA, 14 nt, Human
aucuaauuuauaaa

SEQ ID NO: 1445789 - RNA, 13 nt, Human
aucuaauuuauaa

SEQ ID NO: 1445790 - RNA, 20 nt, Human
uugauacuguugcacgugug

SEQ ID NO: 1445791 - RNA, 18 nt, Human
uugauacuguugcacgug

SEQ ID NO: 1445792 - RNA, 17 nt, Human
uugauacuguugcacgu

SEQ ID NO: 1445793 - RNA, 16 nt, Human
uugauacuguugcacg

SEQ ID NO: 1445794 - RNA, 15 nt, Human
uugauacuguugcac

SEQ ID NO: 1445795 - RNA, 13 nt, Human
uugauagaaccau

SEQ ID NO: 1445796 - RNA, 13 nt, Human
uugauagcaaagc

SEQ ID NO: 1445797 - RNA, 15 nt, Human
uugauagaaaugcca

SEQ ID NO: 1445798 - RNA, 14 nt, Human
uugauacuguugca

SEQ ID NO: 1445799 - RNA, 13 nt, Human
uugauacuguugc

SEQ ID NO: 1445800 - RNA, 17 nt, Human
uugauacuacaguuugu

SEQ ID NO: 1445801 - RNA, 13 nt, Human
uugaguguuuaaa

SEQ ID NO: 1445802 - RNA, 23 nt, Human
uugagugggguuaucucuguguu

SEQ ID NO: 1445803 - RNA, 15 nt, Human
uugagugcucugauc

SEQ ID NO: 1445804 - RNA, 14 nt, Human
uugagugcucugau

SEQ ID NO: 1445805 - RNA, 16 nt, Human
uugagcaucacagaau

SEQ ID NO: 1445806 - RNA, 15 nt, Human
uugagcaucuguccc

SEQ ID NO: 1445807 - RNA, 15 nt, Human
uugagcaucacagaa

SEQ ID NO: 1445808 - RNA, 19 nt, Human
uugagcaguggcuggucca

SEQ ID NO: 1445809 - RNA, 23 nt, Human
uugagaaucccaaauuugauuga

SEQ ID NO: 1445810 - RNA, 18 nt, Human
uugacauugcguuugacc

SEQ ID NO: 1445811 - RNA, 14 nt, Human
uugacauugcguuu

SEQ ID NO: 1445812 - RNA, 20 nt, Human
uugacauucugaaugcuucu

SEQ ID NO: 1445813 - RNA, 18 nt, Human
uugacauucugaaugcuu

SEQ ID NO: 1445814 - RNA, 16 nt, Human
uugacauucugaaugc

SEQ ID NO: 1445815 - RNA, 15 nt, Human
uugacauucugaaug

SEQ ID NO: 1445816 - RNA, 14 nt, Human
uugacauucugaau

SEQ ID NO: 1445817 - RNA, 13 nt, Human
uugacauucugaa

SEQ ID NO: 1445818 - RNA, 18 nt, Human
uugacuuuucuguaauuc

SEQ ID NO: 1445819 - RNA, 13 nt, Human
uugacuuuucugu

SEQ ID NO: 1445820 - RNA, 12 nt, Human
uugacuuuuuau

SEQ ID NO: 1445821 - RNA, 16 nt, Human
uugacuuuuugcauuu

SEQ ID NO: 1445822 - RNA, 19 nt, Human
uugacuuuucuguaauuca

SEQ ID NO: 1445823 - RNA, 17 nt, Human
uugacuuuuugcauuua

SEQ ID NO: 1445824 - RNA, 11 nt, Human
uugagaaaaau

SEQ ID NO: 1445825 - RNA, 19 nt, Human
uugagaaaaauauauacua

SEQ ID NO: 1445826 - RNA, 12 nt, Human
uugacaccugcu

SEQ ID NO: 1445827 - RNA, 16 nt, Human
uugacacagaaaaugu

SEQ ID NO: 1445828 - RNA, 14 nt, Human
auccgaaucucuuu

SEQ ID NO: 1445829 - RNA, 15 nt, Human
aucccuuuuucaaug

SEQ ID NO: 1445830 - RNA, 20 nt, Human
aucccuucauacuugaacgu

SEQ ID NO: 1445831 - RNA, 16 nt, Human
aucccuucauacuuga

SEQ ID NO: 1445832 - RNA, 21 nt, Human
aucccuuaauauccuaaacau

SEQ ID NO: 1445833 - RNA, 20 nt, Human
aucccuuaauauccuaaaca

SEQ ID NO: 1445834 - RNA, 23 nt, Human
uugacacuagcccaaugaaauga

SEQ ID NO: 1445835 - RNA, 13 nt, Human
uugacaugggaca

SEQ ID NO: 1445836 - RNA, 14 nt, Human
uugccacagcuuuu

SEQ ID NO: 1445837 - RNA, 18 nt, Human
uugccacagcuuuugcaa

SEQ ID NO: 1445838 - RNA, 13 nt, Human
uugccacagcuuu

SEQ ID NO: 1445839 - RNA, 12 nt, Human
uugccacagcuu

SEQ ID NO: 1445840 - RNA, 18 nt, Human
uugccaauagugucaucc

SEQ ID NO: 1445841 - RNA, 21 nt, Human
uugccaagggcauaaauuauu

SEQ ID NO: 1445842 - RNA, 16 nt, Human
uugccaaggcagaggc

SEQ ID NO: 1445843 - RNA, 22 nt, Human
uugccaagcuccaagccccauc

SEQ ID NO: 1445844 - RNA, 18 nt, Human
uugccaaauauguccugg

SEQ ID NO: 1445845 - RNA, 17 nt, Human
uugccaaauauguccug

SEQ ID NO: 1445846 - RNA, 16 nt, Human
uugccaaauauguccu

SEQ ID NO: 1445847 - RNA, 19 nt, Human
uugcauguaguaacacuaa

SEQ ID NO: 1445848 - RNA, 17 nt, Human
uugcauguaguaacacu

SEQ ID NO: 1445849 - RNA, 13 nt, Human
uugcauguaguaa

SEQ ID NO: 1445850 - RNA, 22 nt, Human
uugcaccccaaagcuuuccugc

SEQ ID NO: 1445851 - RNA, 21 nt, Human
uugcaccccaaagcuuuccug

SEQ ID NO: 1445852 - RNA, 18 nt, Human
uugcaaucccuuaauauc

SEQ ID NO: 1445853 - RNA, 22 nt, Human
uugcaauaucugaagcccuccc

SEQ ID NO: 1445854 - RNA, 15 nt, Human
uugcaauaucugaag

SEQ ID NO: 1445855 - RNA, 22 nt, Human
aucucaccaggcagccucuggg

SEQ ID NO: 1445856 - RNA, 15 nt, Human
aucucaccaggcagc

SEQ ID NO: 1445857 - RNA, 22 nt, Human
aucucaacaggccucagggcuc

SEQ ID NO: 1445858 - RNA, 20 nt, Human
aucucaacaggccucagggc

SEQ ID NO: 1445859 - RNA, 19 nt, Human
aucucaacaggccucaggg

SEQ ID NO: 1445860 - RNA, 15 nt, Human
aucucaacaggccuc

SEQ ID NO: 1445861 - RNA, 16 nt, Human
aucucaaauuucuaaa

SEQ ID NO: 1445862 - RNA, 17 nt, Human
aucucaaauuucuaaau

SEQ ID NO: 1445863 - RNA, 19 nt, Human
aucucuuuuugcuuucgaa

SEQ ID NO: 1445864 - RNA, 18 nt, Human
aucucaccaggcagccuc

SEQ ID NO: 1445865 - RNA, 16 nt, Human
aucucuuguuuaaauu

SEQ ID NO: 1445866 - RNA, 18 nt, Human
aucugaagcccucccagg

SEQ ID NO: 1445867 - RNA, 15 nt, Human
aucugaagcccuccc

SEQ ID NO: 1445868 - RNA, 18 nt, Human
aucugacccagugccccc

SEQ ID NO: 1445869 - RNA, 14 nt, Human
aucugacccagugc

SEQ ID NO: 1445870 - RNA, 21 nt, Human
aucugaauaaaguguaacaau

SEQ ID NO: 1445871 - RNA, 18 nt, Human
aucugagaaaagcuuuga

SEQ ID NO: 1445872 - RNA, 21 nt, Human
aucugacccagugcccccacu

SEQ ID NO: 1445873 - RNA, 20 nt, Human
aucugacccagugcccccac

SEQ ID NO: 1445874 - RNA, 22 nt, Human
aucugagaaaagcuuugaaccc

SEQ ID NO: 1445875 - RNA, 19 nt, Human
uugauguuccuuccagugu

SEQ ID NO: 1445876 - RNA, 14 nt, Human
uugauguuccuucc

SEQ ID NO: 1445877 - RNA, 22 nt, Human
uugcaagccagauuuuccugaa

SEQ ID NO: 1445878 - RNA, 18 nt, Human
uugcaacuuuguauaaaa

SEQ ID NO: 1445879 - RNA, 16 nt, Human
uugcaacuuuguauaa

SEQ ID NO: 1445880 - RNA, 17 nt, Human
uugcaacuuuguauaaa

SEQ ID NO: 1445881 - RNA, 15 nt, Human
uugauuaaauucuug

SEQ ID NO: 1445882 - RNA, 16 nt, Human
uugauuaaauucuugc

SEQ ID NO: 1445883 - RNA, 20 nt, Human
uugauuaaauucuugcaaag

SEQ ID NO: 1445884 - RNA, 21 nt, Human
uugauuaaauucuugcaaagu

SEQ ID NO: 1445885 - RNA, 15 nt, Human
uugcuuuauuccaga

SEQ ID NO: 1445886 - RNA, 17 nt, Human
uugcuuccuccucccca

SEQ ID NO: 1445887 - RNA, 15 nt, Human
uugcuuccuccuccc

SEQ ID NO: 1445888 - RNA, 14 nt, Human
uugcuuccuccucc

SEQ ID NO: 1445889 - RNA, 19 nt, Human
uugcuucaugugucccaga

SEQ ID NO: 1445890 - RNA, 20 nt, Human
uugcuucaugugucccagaa

SEQ ID NO: 1445891 - RNA, 18 nt, Human
uugcuucaugugucccag

SEQ ID NO: 1445892 - RNA, 13 nt, Human
uugcuucaugugu

SEQ ID NO: 1445893 - RNA, 20 nt, Human
uugcuuauuuauuguauucu

SEQ ID NO: 1445894 - RNA, 13 nt, Human
uugcuuaugacau

SEQ ID NO: 1445895 - RNA, 19 nt, Human
uugcuuaucaacuuccuaa

SEQ ID NO: 1445896 - RNA, 21 nt, Human
uugcuuugaaguagcucuuuu

SEQ ID NO: 1445897 - RNA, 17 nt, Human
uugcuuuggaaguuuua

SEQ ID NO: 1445898 - RNA, 15 nt, Human
uugcuuugugauuuu

SEQ ID NO: 1445899 - RNA, 20 nt, Human
aucuuuaaaagaugcuuuua

SEQ ID NO: 1445900 - RNA, 14 nt, Human
aucuuuaaaccaau

SEQ ID NO: 1445901 - RNA, 21 nt, Human
aucuuuaaaagaugcuuuuaa

SEQ ID NO: 1445902 - RNA, 14 nt, Human
uugcucuugaugcc

SEQ ID NO: 1445903 - RNA, 17 nt, Human
uugcucuugaugccugg

SEQ ID NO: 1445904 - RNA, 13 nt, Human
uugcugaaaaaug

SEQ ID NO: 1445905 - RNA, 17 nt, Human
uugcugaaaaaugggca

SEQ ID NO: 1445906 - RNA, 18 nt, Human
uugcucuugaugccuggc

SEQ ID NO: 1445907 - RNA, 13 nt, Human
uuggacuucuggg

SEQ ID NO: 1445908 - RNA, 13 nt, Human
uugcuuugcccuu

SEQ ID NO: 1445909 - RNA, 20 nt, Human
uugcuuuguauuguauauua

SEQ ID NO: 1445910 - RNA, 20 nt, Human
uugcuuugugauuuuuguaa

SEQ ID NO: 1445911 - RNA, 16 nt, Human
uugcuuuuaaaaucca

SEQ ID NO: 1445912 - RNA, 21 nt, Human
uuggagaguuuccugaaacaa

SEQ ID NO: 1445913 - RNA, 16 nt, Human
uuggagaagucucagc

SEQ ID NO: 1445914 - RNA, 18 nt, Human
uuggagaagucucagcua

SEQ ID NO: 1445915 - RNA, 20 nt, Human
uuggagaagcccgugugaga

SEQ ID NO: 1445916 - RNA, 20 nt, Human
uuggagauaaucuagaacac

SEQ ID NO: 1445917 - RNA, 16 nt, Human
uuggacuugucccggg

SEQ ID NO: 1445918 - RNA, 15 nt, Human
uuggagaagaacuga

SEQ ID NO: 1445919 - RNA, 22 nt, Human
uuggagaagaacugaaaucaua

SEQ ID NO: 1445920 - RNA, 17 nt, Human
uuggagaagaacugaaa

SEQ ID NO: 1445921 - RNA, 19 nt, Human
aucuuaaaccuuaagauac

SEQ ID NO: 1445922 - RNA, 14 nt, Human
aucuguuuuucuaa

SEQ ID NO: 1445923 - RNA, 14 nt, Human
aucugugucuuguu

SEQ ID NO: 1445924 - RNA, 13 nt, Human
aucugugucuugu

SEQ ID NO: 1445925 - RNA, 12 nt, Human
aucugugucuug

SEQ ID NO: 1445926 - RNA, 23 nt, Human
aucugugggucugggagucacac

SEQ ID NO: 1445927 - RNA, 16 nt, Human
aucugugcacugccca

SEQ ID NO: 1445928 - RNA, 12 nt, Human
aucugucaguuc

SEQ ID NO: 1445929 - RNA, 19 nt, Human
uugcccuaagcagaaagug

SEQ ID NO: 1445930 - RNA, 18 nt, Human
uugcccuaagcagaaagu

SEQ ID NO: 1445931 - RNA, 16 nt, Human
uugcccuaagcagaaa

SEQ ID NO: 1445932 - RNA, 15 nt, Human
uugcccuaagcagaa

SEQ ID NO: 1445933 - RNA, 14 nt, Human
uugcccuaagcaga

SEQ ID NO: 1445934 - RNA, 21 nt, Human
uugcccccgugagccaauccc

SEQ ID NO: 1445935 - RNA, 13 nt, Human
uugccccugagac

SEQ ID NO: 1445936 - RNA, 16 nt, Human
uugccccccuggccuc

SEQ ID NO: 1445937 - RNA, 15 nt, Human
uugccccccuggccu

SEQ ID NO: 1445938 - RNA, 14 nt, Human
uugccccccuggcc

SEQ ID NO: 1445939 - RNA, 13 nt, Human
uugcccccauuuc

SEQ ID NO: 1445940 - RNA, 23 nt, Human
aucuuggggggguggccgcugag

SEQ ID NO: 1445941 - RNA, 20 nt, Human
aucuuggggggguggccgcu

SEQ ID NO: 1445942 - RNA, 16 nt, Human
aucuuggggggguggc

SEQ ID NO: 1445943 - RNA, 16 nt, Human
aucuuggacaaaucac

SEQ ID NO: 1445944 - RNA, 22 nt, Human
aucuuggacaaaucacauauuu

SEQ ID NO: 1445945 - RNA, 16 nt, Human
aucuuauaauuuaaaa

SEQ ID NO: 1445946 - RNA, 15 nt, Human
aucuuauaauuuaaa

SEQ ID NO: 1445947 - RNA, 18 nt, Human
augaaucugcacaucugu

SEQ ID NO: 1445948 - RNA, 22 nt, Human
augaagcaaaugucaugcugcc

SEQ ID NO: 1445949 - RNA, 21 nt, Human
augaagcaaaugucaugcugc

SEQ ID NO: 1445950 - RNA, 15 nt, Human
augaagcaaugcuuc

SEQ ID NO: 1445951 - RNA, 23 nt, Human
augaaccucaagcugcaucuaga

SEQ ID NO: 1445952 - RNA, 18 nt, Human
augaacccgaggcugaga

SEQ ID NO: 1445953 - RNA, 16 nt, Human
augaacagaacauaga

SEQ ID NO: 1445954 - RNA, 16 nt, Human
augaacacuuaauaaa

SEQ ID NO: 1445955 - RNA, 14 nt, Human
augaagaacugagg

SEQ ID NO: 1445956 - RNA, 14 nt, Human
augaagaaagugga

SEQ ID NO: 1445957 - RNA, 19 nt, Human
augaagaaaaucacuuagg

SEQ ID NO: 1445958 - RNA, 15 nt, Human
augaagaacugagga

SEQ ID NO: 1445959 - RNA, 14 nt, Human
augaagcaaugcuu

SEQ ID NO: 1445960 - RNA, 18 nt, Human
augaacaagagaagcauu

SEQ ID NO: 1445961 - RNA, 14 nt, Human
augaacaagagaag

SEQ ID NO: 1445962 - RNA, 12 nt, Human
augaacaaaugg

SEQ ID NO: 1445963 - RNA, 17 nt, Human
augaaauacuauuuaaa

SEQ ID NO: 1445964 - RNA, 13 nt, Human
augaaauauuaug

SEQ ID NO: 1445965 - RNA, 14 nt, Human
uuggaggaaguugg

SEQ ID NO: 1445966 - RNA, 14 nt, Human
uuggagcuucaugg

SEQ ID NO: 1445967 - RNA, 12 nt, Human
uuggccaucugc

SEQ ID NO: 1445968 - RNA, 21 nt, Human
uuggccauauuuaccucagcc

SEQ ID NO: 1445969 - RNA, 22 nt, Human
uuggccauauuuaccucagccu

SEQ ID NO: 1445970 - RNA, 13 nt, Human
uuggccaugcaga

SEQ ID NO: 1445971 - RNA, 19 nt, Human
uuggccaugcagaaagcau

SEQ ID NO: 1445972 - RNA, 12 nt, Human
uugguguuuuuu

SEQ ID NO: 1445973 - RNA, 14 nt, Human
uugguuugccuucc

SEQ ID NO: 1445974 - RNA, 14 nt, Human
uugguuuguaaauu

SEQ ID NO: 1445975 - RNA, 14 nt, Human
uugguggccacaua

SEQ ID NO: 1445976 - RNA, 13 nt, Human
uuggguccaggag

SEQ ID NO: 1445977 - RNA, 12 nt, Human
uuggguccagga

SEQ ID NO: 1445978 - RNA, 14 nt, Human
uuggguccaggagg

SEQ ID NO: 1445979 - RNA, 18 nt, Human
uuggugguuucagaaaug

SEQ ID NO: 1445980 - RNA, 19 nt, Human
uuggugguuucagaaaugu

SEQ ID NO: 1445981 - RNA, 23 nt, Human
uuggguagaaagagauacagagg

SEQ ID NO: 1445982 - RNA, 17 nt, Human
uuggguaaaauacuuuu

SEQ ID NO: 1445983 - RNA, 22 nt, Human
uuggggugccccucuccuucuu

SEQ ID NO: 1445984 - RNA, 18 nt, Human
uugggguggguauaaaag

SEQ ID NO: 1445985 - RNA, 20 nt, Human
uugggguggguauaaaagau

SEQ ID NO: 1445986 - RNA, 20 nt, Human
uuguaagaguggaaccaaca

SEQ ID NO: 1445987 - RNA, 22 nt, Human
uuguaagacaaagguuuuccuc

SEQ ID NO: 1445988 - RNA, 21 nt, Human
uuguaagacaaagguuuuccu

SEQ ID NO: 1445989 - RNA, 18 nt, Human
uuguaagacaaagguuuu

SEQ ID NO: 1445990 - RNA, 12 nt, Human
uuguaaccugcu

SEQ ID NO: 1445991 - RNA, 14 nt, Human
uuguaacccacuga

SEQ ID NO: 1445992 - RNA, 16 nt, Human
uugguuuugcuacaua

SEQ ID NO: 1445993 - RNA, 14 nt, Human
uugguuuucuucuu

SEQ ID NO: 1445994 - RNA, 13 nt, Human
uugguuuucuucu

SEQ ID NO: 1445995 - RNA, 20 nt, Human
uugguuuucacauuggaaac

SEQ ID NO: 1445996 - RNA, 15 nt, Human
uuguaauauguaaau

SEQ ID NO: 1445997 - RNA, 14 nt, Human
uuguaauauguaaa

SEQ ID NO: 1445998 - RNA, 21 nt, Human
uuguaauagauguuugauaga

SEQ ID NO: 1445999 - RNA, 15 nt, Human
uuguaauaauaaaga

SEQ ID NO: 1446000 - RNA, 22 nt, Human
uuguaagcaugcacaaauucug

SEQ ID NO: 1446001 - RNA, 22 nt, Human
uuguaauuuuacacgcuuuugu

SEQ ID NO: 1446002 - RNA, 16 nt, Human
uuguaauuuaaaauaa

SEQ ID NO: 1446003 - RNA, 23 nt, Human
uuguaauucuaaaugaauguuua

SEQ ID NO: 1446004 - RNA, 17 nt, Human
uuguaauucuaaaugaa

SEQ ID NO: 1446005 - RNA, 14 nt, Human
uuguaauucuaaau

SEQ ID NO: 1446006 - RNA, 17 nt, Human
uuguaaucugaauaaag

SEQ ID NO: 1446007 - RNA, 15 nt, Human
uuguaaucugaauaa

SEQ ID NO: 1446008 - RNA, 14 nt, Human
uuguaaucacuguu

SEQ ID NO: 1446009 - RNA, 12 nt, Human
uuguaaugaaaa

SEQ ID NO: 1446010 - RNA, 23 nt, Human
augcuccucuuccccagacgccu

SEQ ID NO: 1446011 - RNA, 20 nt, Human
augcuccucuuccccagacg

SEQ ID NO: 1446012 - RNA, 19 nt, Human
augcuccucuuccccagac

SEQ ID NO: 1446013 - RNA, 18 nt, Human
augcuccucuuccccaga

SEQ ID NO: 1446014 - RNA, 16 nt, Human
augcuccucuucccca

SEQ ID NO: 1446015 - RNA, 14 nt, Human
augcuccucuuccc

SEQ ID NO: 1446016 - RNA, 13 nt, Human
augcuccucuucc

SEQ ID NO: 1446017 - RNA, 15 nt, Human
augcuccaagauucu

SEQ ID NO: 1446018 - RNA, 16 nt, Human
augcucaucugcuggu

SEQ ID NO: 1446019 - RNA, 14 nt, Human
augcucaucugcug

SEQ ID NO: 1446020 - RNA, 13 nt, Human
augcucaucugcu

SEQ ID NO: 1446021 - RNA, 21 nt, Human
augcucauaacggaucagaaa

SEQ ID NO: 1446022 - RNA, 19 nt, Human
augcucaggugcuggggcc

SEQ ID NO: 1446023 - RNA, 16 nt, Human
augcucauaacggauc

SEQ ID NO: 1446024 - RNA, 18 nt, Human
augcucaggugcuggggc

SEQ ID NO: 1446025 - RNA, 12 nt, Human
augcucaggggc

SEQ ID NO: 1446026 - RNA, 21 nt, Human
augcucaggggcccuggagca

SEQ ID NO: 1446027 - RNA, 22 nt, Human
augcucaggggcccuggagcag

SEQ ID NO: 1446028 - RNA, 21 nt, Human
augcuucuguuuuauaauuuu

SEQ ID NO: 1446029 - RNA, 22 nt, Human
augcuguauuuuaaaagaauga

SEQ ID NO: 1446030 - RNA, 17 nt, Human
augcuuaaaauaagcag

SEQ ID NO: 1446031 - RNA, 16 nt, Human
augcuuaaaauaagca

SEQ ID NO: 1446032 - RNA, 23 nt, Human
augcuguauuuuaaaagaaugau

SEQ ID NO: 1446033 - RNA, 18 nt, Human
uuucauguacaagaugaa

SEQ ID NO: 1446034 - RNA, 12 nt, Human
uuucauguacaa

SEQ ID NO: 1446035 - RNA, 19 nt, Human
uuucauguaaacugugcac

SEQ ID NO: 1446036 - RNA, 18 nt, Human
uuucauguaaacugugca

SEQ ID NO: 1446037 - RNA, 18 nt, Human
uuuccauuacaaguauuu

SEQ ID NO: 1446038 - RNA, 15 nt, Human
uuuccauuacaagua

SEQ ID NO: 1446039 - RNA, 22 nt, Human
uuuccaugggaccacaacuauu

SEQ ID NO: 1446040 - RNA, 19 nt, Human
uuuccaugggaccacaacu

SEQ ID NO: 1446041 - RNA, 21 nt, Human
uuuccauggcaggaaggcuug

SEQ ID NO: 1446042 - RNA, 20 nt, Human
uuuccauggcaggaaggcuu

SEQ ID NO: 1446043 - RNA, 22 nt, Human
uuucccaaagcaucccucuuag

SEQ ID NO: 1446044 - RNA, 14 nt, Human
uuuccauuugcauu

SEQ ID NO: 1446045 - RNA, 21 nt, Human
uuuccauuugcauuuguuuau

SEQ ID NO: 1446046 - RNA, 22 nt, Human
uuuccauucgugaaaacacauu

SEQ ID NO: 1446047 - RNA, 15 nt, Human
uuucccaauucacau

SEQ ID NO: 1446048 - RNA, 12 nt, Human
uuucccaauuca

SEQ ID NO: 1446049 - RNA, 20 nt, Human
uuucauccauaacugaacau

SEQ ID NO: 1446050 - RNA, 19 nt, Human
uuucauccauaacugaaca

SEQ ID NO: 1446051 - RNA, 17 nt, Human
uuucauccauaacugaa

SEQ ID NO: 1446052 - RNA, 16 nt, Human
uuucauccauaacuga

SEQ ID NO: 1446053 - RNA, 13 nt, Human
uuucaucauuuuu

SEQ ID NO: 1446054 - RNA, 13 nt, Human
uuucagaaaugug

SEQ ID NO: 1446055 - RNA, 11 nt, Human
uuucagaaaug

SEQ ID NO: 1446056 - RNA, 12 nt, Human
uuucagaaaugu

SEQ ID NO: 1446057 - RNA, 15 nt, Human
uuucauccuugucuu

SEQ ID NO: 1446058 - RNA, 21 nt, Human
uuucaugcuguucaugaaaga

SEQ ID NO: 1446059 - RNA, 17 nt, Human
auggaauugauuugcau

SEQ ID NO: 1446060 - RNA, 16 nt, Human
auggaauugauuugca

SEQ ID NO: 1446061 - RNA, 15 nt, Human
auggaauugauuugc

SEQ ID NO: 1446062 - RNA, 14 nt, Human
auggaauugauuug

SEQ ID NO: 1446063 - RNA, 13 nt, Human
auggaauugauuu

SEQ ID NO: 1446064 - RNA, 19 nt, Human
uuucaaacauauauaacaa

SEQ ID NO: 1446065 - RNA, 12 nt, Human
uuucaaacuuua

SEQ ID NO: 1446066 - RNA, 15 nt, Human
uuucaaacuuuacua

SEQ ID NO: 1446067 - RNA, 20 nt, Human
uuucacgccugaggcaauua

SEQ ID NO: 1446068 - RNA, 18 nt, Human
uuucaccuguaaaccuga

SEQ ID NO: 1446069 - RNA, 17 nt, Human
uuucaccuguaaaccug

SEQ ID NO: 1446070 - RNA, 14 nt, Human
uuucaccuguaaac

SEQ ID NO: 1446071 - RNA, 13 nt, Human
uuucaccuguaaa

SEQ ID NO: 1446072 - RNA, 22 nt, Human
uuucaccuggaagcauuuguuu

SEQ ID NO: 1446073 - RNA, 18 nt, Human
uuucaccuggaagcauuu

SEQ ID NO: 1446074 - RNA, 19 nt, Human
uuucacauuggaaacaagu

SEQ ID NO: 1446075 - RNA, 14 nt, Human
uuucacauuggaaa

SEQ ID NO: 1446076 - RNA, 19 nt, Human
uuucacauuagaagacaau

SEQ ID NO: 1446077 - RNA, 18 nt, Human
uuucacauuagaagacaa

SEQ ID NO: 1446078 - RNA, 17 nt, Human
uuucacauuagaagaca

SEQ ID NO: 1446079 - RNA, 13 nt, Human
uuucacauuggaa

SEQ ID NO: 1446080 - RNA, 17 nt, Human
uuuacugcucugagaau

SEQ ID NO: 1446081 - RNA, 15 nt, Human
uuuacugcucugaga

SEQ ID NO: 1446082 - RNA, 13 nt, Human
uuuacucugccua

SEQ ID NO: 1446083 - RNA, 12 nt, Human
uuuacucugccu

SEQ ID NO: 1446084 - RNA, 17 nt, Human
uuuacuccguaacagau

SEQ ID NO: 1446085 - RNA, 15 nt, Human
uuuaccucagccugg

SEQ ID NO: 1446086 - RNA, 17 nt, Human
augcuaccaccagcugu

SEQ ID NO: 1446087 - RNA, 22 nt, Human
augcuaccaccagcugugucca

SEQ ID NO: 1446088 - RNA, 16 nt, Human
augcuaccaccagcug

SEQ ID NO: 1446089 - RNA, 15 nt, Human
augcuaccaccagcu

SEQ ID NO: 1446090 - RNA, 14 nt, Human
augcuaccaccagc

SEQ ID NO: 1446091 - RNA, 13 nt, Human
augcuaccaccag

SEQ ID NO: 1446092 - RNA, 17 nt, Human
augcguguuucugacuc

SEQ ID NO: 1446093 - RNA, 16 nt, Human
augcguguuucugacu

SEQ ID NO: 1446094 - RNA, 15 nt, Human
uuuaccuaagauuac

SEQ ID NO: 1446095 - RNA, 13 nt, Human
uuuacccuucagg

SEQ ID NO: 1446096 - RNA, 20 nt, Human
uuuacccuggccccucuccc

SEQ ID NO: 1446097 - RNA, 20 nt, Human
uuuacccuucuuuucugacu

SEQ ID NO: 1446098 - RNA, 13 nt, Human
uuuaccucagccu

SEQ ID NO: 1446099 - RNA, 12 nt, Human
uuuaccucagcc

SEQ ID NO: 1446100 - RNA, 13 nt, Human
uuuaggagcagug

SEQ ID NO: 1446101 - RNA, 17 nt, Human
uuuagggaacaauuugg

SEQ ID NO: 1446102 - RNA, 18 nt, Human
uuuaggcuauuuguaaau

SEQ ID NO: 1446103 - RNA, 17 nt, Human
uuuaggauaaaauaaug

SEQ ID NO: 1446104 - RNA, 23 nt, Human
uuuaggagcuaaggcucuaugag

SEQ ID NO: 1446105 - RNA, 16 nt, Human
uuuagggaacaauuug

SEQ ID NO: 1446106 - RNA, 17 nt, Human
uuuagggguagcauuug

SEQ ID NO: 1446107 - RNA, 14 nt, Human
uuuauauguacaug

SEQ ID NO: 1446108 - RNA, 13 nt, Human
uuuauauguacau

SEQ ID NO: 1446109 - RNA, 21 nt, Human
uuuauaugcuucuguuuuaua

SEQ ID NO: 1446110 - RNA, 13 nt, Human
uuuaucacuuaaa

SEQ ID NO: 1446111 - RNA, 17 nt, Human
uuuauauguacaugaga

SEQ ID NO: 1446112 - RNA, 21 nt, Human
uuuauauguaccguaggcuuu

SEQ ID NO: 1446113 - RNA, 24 nt, Human
uuuagugguagcauauagauuguc

SEQ ID NO: 1446114 - RNA, 16 nt, Human
uuuagugaacuugaaa

SEQ ID NO: 1446115 - RNA, 22 nt, Human
augcgugcauaccacuuuuguu

SEQ ID NO: 1446116 - RNA, 23 nt, Human
augccuuuucccaaaauguugaa

SEQ ID NO: 1446117 - RNA, 21 nt, Human
augccuuuucccaaaauguug

SEQ ID NO: 1446118 - RNA, 19 nt, Human
augcgagugcucauuucag

SEQ ID NO: 1446119 - RNA, 16 nt, Human
augccuccuuccucuu

SEQ ID NO: 1446120 - RNA, 14 nt, Human
augccuccuuccuc

SEQ ID NO: 1446121 - RNA, 17 nt, Human
augcccggcuaauuuuu

SEQ ID NO: 1446122 - RNA, 14 nt, Human
augccccuuucugg

SEQ ID NO: 1446123 - RNA, 16 nt, Human
augccccuggcuggga

SEQ ID NO: 1446124 - RNA, 22 nt, Human
augccuuuucccaacuccagaa

SEQ ID NO: 1446125 - RNA, 20 nt, Human
augccuuuucccaacuccag

SEQ ID NO: 1446126 - RNA, 22 nt, Human
augccagccaagcucugcaguc

SEQ ID NO: 1446127 - RNA, 21 nt, Human
augccagccaagcucugcagu

SEQ ID NO: 1446128 - RNA, 18 nt, Human
augccagccaagcucugc

SEQ ID NO: 1446129 - RNA, 17 nt, Human
augccagccaagcucug

SEQ ID NO: 1446130 - RNA, 17 nt, Human
augccacugccuucgcu

SEQ ID NO: 1446131 - RNA, 18 nt, Human
augccacugccuucgcuu

SEQ ID NO: 1446132 - RNA, 16 nt, Human
augccaggaccagucc

SEQ ID NO: 1446133 - RNA, 16 nt, Human
augccagcuacuuccu

SEQ ID NO: 1446134 - RNA, 23 nt, Human
augccaguaacgcgucuuccuga

SEQ ID NO: 1446135 - RNA, 22 nt, Human
augccaguaacgcgucuuccug

SEQ ID NO: 1446136 - RNA, 17 nt, Human
augccaguaacaggcuc

SEQ ID NO: 1446137 - RNA, 16 nt, Human
augccaucaucuccug

SEQ ID NO: 1446138 - RNA, 15 nt, Human
augccaucaucuccu

SEQ ID NO: 1446139 - RNA, 14 nt, Human
augccaucaucucc

SEQ ID NO: 1446140 - RNA, 20 nt, Human
augccccugaauuuaaauag

SEQ ID NO: 1446141 - RNA, 15 nt, Human
augccccugaauuua

SEQ ID NO: 1446142 - RNA, 13 nt, Human
augcaaaagcaag

SEQ ID NO: 1446143 - RNA, 23 nt, Human
augcaaaaacucuuugagagggu

SEQ ID NO: 1446144 - RNA, 17 nt, Human
augcaaaaacucuuuga

SEQ ID NO: 1446145 - RNA, 17 nt, Human
augauuuuucuuuacaa

SEQ ID NO: 1446146 - RNA, 21 nt, Human
augauuuuuuuuucauacacu

SEQ ID NO: 1446147 - RNA, 17 nt, Human
augauuuuuuuuucaua

SEQ ID NO: 1446148 - RNA, 15 nt, Human
augauuuuucuuuac

SEQ ID NO: 1446149 - RNA, 19 nt, Human
augauuuuucuuuacaaaa

SEQ ID NO: 1446150 - RNA, 20 nt, Human
augauuuccuugaauguggc

SEQ ID NO: 1446151 - RNA, 19 nt, Human
augauuuccuugaaugugg

SEQ ID NO: 1446152 - RNA, 18 nt, Human
augauuuccuugaaugug

SEQ ID NO: 1446153 - RNA, 17 nt, Human
augauuuccuugaaugu

SEQ ID NO: 1446154 - RNA, 16 nt, Human
augauuuccuugaaug

SEQ ID NO: 1446155 - RNA, 15 nt, Human
augauuuccuugaau

SEQ ID NO: 1446156 - RNA, 13 nt, Human
augauuuccuuga

SEQ ID NO: 1446157 - RNA, 14 nt, Human
augauuucauuuca

SEQ ID NO: 1446158 - RNA, 18 nt, Human
augauuuagagugcuguc

SEQ ID NO: 1446159 - RNA, 14 nt, Human
augauuuauaccua

SEQ ID NO: 1446160 - RNA, 13 nt, Human
augauuuacauuu

SEQ ID NO: 1446161 - RNA, 17 nt, Human
augauuuaauuugaaau

SEQ ID NO: 1446162 - RNA, 20 nt, Human
uuguucuugguuuguaaauu

SEQ ID NO: 1446163 - RNA, 17 nt, Human
uuguucuguuaacugaa

SEQ ID NO: 1446164 - RNA, 18 nt, Human
uuguucuguuaacugaau

SEQ ID NO: 1446165 - RNA, 16 nt, Human
uuguucuguuaacuga

SEQ ID NO: 1446166 - RNA, 16 nt, Human
uuguucagcaugcaau

SEQ ID NO: 1446167 - RNA, 17 nt, Human
uuguucuugguuuguaa

SEQ ID NO: 1446168 - RNA, 19 nt, Human
uuguucuugguuuguaaau

SEQ ID NO: 1446169 - RNA, 21 nt, Human
augcacuguucccccugugca

SEQ ID NO: 1446170 - RNA, 20 nt, Human
augcacugugaaggacccuu

SEQ ID NO: 1446171 - RNA, 19 nt, Human
augcacugugaaggacccu

SEQ ID NO: 1446172 - RNA, 18 nt, Human
augcacugugaaggaccc

SEQ ID NO: 1446173 - RNA, 13 nt, Human
augcacugugaag

SEQ ID NO: 1446174 - RNA, 12 nt, Human
augcacugugaa

SEQ ID NO: 1446175 - RNA, 22 nt, Human
augcacuguucccccugugcag

SEQ ID NO: 1446176 - RNA, 16 nt, Human
augcagaaagcauccc

SEQ ID NO: 1446177 - RNA, 19 nt, Human
augcagaauguugauuaca

SEQ ID NO: 1446178 - RNA, 21 nt, Human
augcagaauguugauuacagu

SEQ ID NO: 1446179 - RNA, 12 nt, Human
augcagaauguu

SEQ ID NO: 1446180 - RNA, 16 nt, Human
augcacugauguugug

SEQ ID NO: 1446181 - RNA, 15 nt, Human
augcagaaagcaucc

SEQ ID NO: 1446182 - RNA, 18 nt, Human
uuuaaaaaaauuccaagu

SEQ ID NO: 1446183 - RNA, 20 nt, Human
uuuaaggaugcuuguacaua

SEQ ID NO: 1446184 - RNA, 21 nt, Human
uuuaaggaugcuuguacauaa

SEQ ID NO: 1446185 - RNA, 22 nt, Human
uuuaaggaugcuuguacauaau

SEQ ID NO: 1446186 - RNA, 23 nt, Human
uuuaaaugaacaagagaagcauu

SEQ ID NO: 1446187 - RNA, 14 nt, Human
uuuaagagacagcc

SEQ ID NO: 1446188 - RNA, 19 nt, Human
uuuaaggaugcuuguacau

SEQ ID NO: 1446189 - RNA, 18 nt, Human
uuuaaaugcauaaaugca

SEQ ID NO: 1446190 - RNA, 14 nt, Human
uuuaaaugaagaaa

SEQ ID NO: 1446191 - RNA, 21 nt, Human
uuuaaaugaacaagagaagca

SEQ ID NO: 1446192 - RNA, 12 nt, Human
uuuaaaucuguu

SEQ ID NO: 1446193 - RNA, 11 nt, Human
uuuaaaugcac

SEQ ID NO: 1446194 - RNA, 18 nt, Human
uuuaaauguaaagauauu

SEQ ID NO: 1446195 - RNA, 15 nt, Human
uuuaaauguaaagau

SEQ ID NO: 1446196 - RNA, 12 nt, Human
uuuaaauguaua

SEQ ID NO: 1446197 - RNA, 13 nt, Human
uuuaaauguauac

SEQ ID NO: 1446198 - RNA, 20 nt, Human
uuuaaaucuguuuuucuaac

SEQ ID NO: 1446199 - RNA, 23 nt, Human
uuuaaaaauaagucaacaguaaa

SEQ ID NO: 1446200 - RNA, 21 nt, Human
uuuaaauauaugcuaagucuu

SEQ ID NO: 1446201 - RNA, 12 nt, Human
uuuaaaaaguaa

SEQ ID NO: 1446202 - RNA, 14 nt, Human
uuuaaaaagccagu

SEQ ID NO: 1446203 - RNA, 22 nt, Human
uuuaaaaauaagucaacaguaa

SEQ ID NO: 1446204 - RNA, 21 nt, Human
uuuaaaaauaagucaacagua

SEQ ID NO: 1446205 - RNA, 20 nt, Human
uuuaaaaauaagucaacagu

SEQ ID NO: 1446206 - RNA, 18 nt, Human
uuuaaaaauaagucaaca

SEQ ID NO: 1446207 - RNA, 11 nt, Human
uuuaaaaauaa

SEQ ID NO: 1446208 - RNA, 14 nt, Human
uuuaaaaaacuaaa

SEQ ID NO: 1446209 - RNA, 23 nt, Human
uuuaaaaaaccacauggcacaga

SEQ ID NO: 1446210 - RNA, 15 nt, Human
uuuaaaaaacuaaaa

SEQ ID NO: 1446211 - RNA, 21 nt, Human
uuuaaaaaacuaaaaacuaga

SEQ ID NO: 1446212 - RNA, 20 nt, Human
uuuaaaaaagaaacauuugg

SEQ ID NO: 1446213 - RNA, 15 nt, Human
uuguucagcaugcaa

SEQ ID NO: 1446214 - RNA, 19 nt, Human
uuguucaccauuauaauga

SEQ ID NO: 1446215 - RNA, 19 nt, Human
uugugucuggcaguuuaua

SEQ ID NO: 1446216 - RNA, 15 nt, Human
uugugucucuuaugg

SEQ ID NO: 1446217 - RNA, 16 nt, Human
uugugucccuaaugug

SEQ ID NO: 1446218 - RNA, 18 nt, Human
uugugucccaugaucccu

SEQ ID NO: 1446219 - RNA, 23 nt, Human
uuguguauuuacgcuuugauuca

SEQ ID NO: 1446220 - RNA, 22 nt, Human
uuguguauuuacgcuuugauuc

SEQ ID NO: 1446221 - RNA, 20 nt, Human
uuguguauuuacgcuuugau

SEQ ID NO: 1446222 - RNA, 19 nt, Human
uuguguauuuacgcuuuga

SEQ ID NO: 1446223 - RNA, 15 nt, Human
uuguguagccuuuuu

SEQ ID NO: 1446224 - RNA, 14 nt, Human
uuguguagccuuuu

SEQ ID NO: 1446225 - RNA, 13 nt, Human
uuguguagccuuu

SEQ ID NO: 1446226 - RNA, 15 nt, Human
uuguguacaguuauu

SEQ ID NO: 1446227 - RNA, 16 nt, Human
uugugauuggccugua

SEQ ID NO: 1446228 - RNA, 15 nt, Human
uugugauuggccugu

SEQ ID NO: 1446229 - RNA, 14 nt, Human
uugugauucugccu

SEQ ID NO: 1446230 - RNA, 23 nt, Human
uugugauucaaucuguaaacugu

SEQ ID NO: 1446231 - RNA, 19 nt, Human
uugugauucaaucuguaaa

SEQ ID NO: 1446232 - RNA, 18 nt, Human
uugugauuagacagaaca

SEQ ID NO: 1446233 - RNA, 19 nt, Human
uugugauuagacagaacac

SEQ ID NO: 1446234 - RNA, 17 nt, Human
uugugaugugcacguaa

SEQ ID NO: 1446235 - RNA, 21 nt, Human
uugugaugucauacagagaag

SEQ ID NO: 1446236 - RNA, 17 nt, Human
uugugauggagugcugu

SEQ ID NO: 1446237 - RNA, 16 nt, Human
uugugauggagugcug

SEQ ID NO: 1446238 - RNA, 23 nt, Human
uugugaucagaccauaauguuac

SEQ ID NO: 1446239 - RNA, 16 nt, Human
uugugauaugcacaau

SEQ ID NO: 1446240 - RNA, 21 nt, Human
uugugauaugcacaauguaga

SEQ ID NO: 1446241 - RNA, 13 nt, Human
uugugauaugcac

SEQ ID NO: 1446242 - RNA, 18 nt, Human
uugugaugugaguugcac

SEQ ID NO: 1446243 - RNA, 20 nt, Human
uugugaugucauacagagaa

SEQ ID NO: 1446244 - RNA, 18 nt, Human
uugugaugucauacagag

SEQ ID NO: 1446245 - RNA, 22 nt, Human
uugugacaaaaaauuaaagcau

SEQ ID NO: 1446246 - RNA, 16 nt, Human
uugugacaaaaaauua

SEQ ID NO: 1446247 - RNA, 14 nt, Human
uugugacaaaaaau

SEQ ID NO: 1446248 - RNA, 13 nt, Human
uugugacaaaaaa

SEQ ID NO: 1446249 - RNA, 23 nt, Human
uugugaauuaggcuguaacuacu

SEQ ID NO: 1446250 - RNA, 19 nt, Human
uugugaauuaggcuguaac

SEQ ID NO: 1446251 - RNA, 18 nt, Human
uugugaauuaggcuguaa

SEQ ID NO: 1446252 - RNA, 21 nt, Human
uugugacagggcggggguggc

SEQ ID NO: 1446253 - RNA, 16 nt, Human
uugugaggaaagucau

SEQ ID NO: 1446254 - RNA, 17 nt, Human
uugugaggaaagucauu

SEQ ID NO: 1446255 - RNA, 20 nt, Human
uugugauacaaugcugugcc

SEQ ID NO: 1446256 - RNA, 22 nt, Human
uugugaggaaagucauuggcuu

SEQ ID NO: 1446257 - RNA, 21 nt, Human
uugugaaucaagggucaggcc

SEQ ID NO: 1446258 - RNA, 20 nt, Human
uugugaaucaagggucaggc

SEQ ID NO: 1446259 - RNA, 23 nt, Human
uugugaaucaagggucaggccuu

SEQ ID NO: 1446260 - RNA, 19 nt, Human
uuguccagcugagcgccag

SEQ ID NO: 1446261 - RNA, 13 nt, Human
uuguccauugucc

SEQ ID NO: 1446262 - RNA, 16 nt, Human
augaguaacauuugcu

SEQ ID NO: 1446263 - RNA, 17 nt, Human
augaguaacauuugcug

SEQ ID NO: 1446264 - RNA, 19 nt, Human
uuguagcuggggcuuugau

SEQ ID NO: 1446265 - RNA, 18 nt, Human
uuguagcuggggcuuuga

SEQ ID NO: 1446266 - RNA, 14 nt, Human
uuguagcuggggcu

SEQ ID NO: 1446267 - RNA, 15 nt, Human
uuguagcuccucccc

SEQ ID NO: 1446268 - RNA, 12 nt, Human
uuguagcuccuc

SEQ ID NO: 1446269 - RNA, 21 nt, Human
uuguagcgucuuucuuuuuug

SEQ ID NO: 1446270 - RNA, 15 nt, Human
uuguagccagccggg

SEQ ID NO: 1446271 - RNA, 12 nt, Human
uuguagccagcc

SEQ ID NO: 1446272 - RNA, 14 nt, Human
uuguacaaaauaaa

SEQ ID NO: 1446273 - RNA, 12 nt, Human
uuguacaaaaua

SEQ ID NO: 1446274 - RNA, 23 nt, Human
uuguaauuuuuuuaauuuacaaa

SEQ ID NO: 1446275 - RNA, 15 nt, Human
uuguaauuuuacacg

SEQ ID NO: 1446276 - RNA, 13 nt, Human
uuguaauuuuaca

SEQ ID NO: 1446277 - RNA, 18 nt, Human
uuguagcauccuggaaua

SEQ ID NO: 1446278 - RNA, 16 nt, Human
uuguagcauccuggaa

SEQ ID NO: 1446279 - RNA, 19 nt, Human
uugucauuuuuuuucuuug

SEQ ID NO: 1446280 - RNA, 21 nt, Human
uuguccaacccgaggcccgca

SEQ ID NO: 1446281 - RNA, 17 nt, Human
uugucaggagugugugu

SEQ ID NO: 1446282 - RNA, 23 nt, Human
uugucagggaguguucccuaucc

SEQ ID NO: 1446283 - RNA, 16 nt, Human
uugucacuuuuucuga

SEQ ID NO: 1446284 - RNA, 14 nt, Human
uugucacuuuuucu

SEQ ID NO: 1446285 - RNA, 22 nt, Human
uugucaaugcaguugucucugu

SEQ ID NO: 1446286 - RNA, 18 nt, Human
augaguuccagaaaguaa

SEQ ID NO: 1446287 - RNA, 20 nt, Human
uugucaauaaaauccauaca

SEQ ID NO: 1446288 - RNA, 18 nt, Human
uuuuuguauaguuaacac

SEQ ID NO: 1446289 - RNA, 20 nt, Human
uuuuuggcguggcugacuua

SEQ ID NO: 1446290 - RNA, 21 nt, Human
uuuuugggggguuuucuugcc

SEQ ID NO: 1446291 - RNA, 22 nt, Human
uuuuugggggguuuucuugccu

SEQ ID NO: 1446292 - RNA, 20 nt, Human
uuuuugggcagcaauuuaaa

SEQ ID NO: 1446293 - RNA, 21 nt, Human
uuuuugggcagcaauuuaaau

SEQ ID NO: 1446294 - RNA, 23 nt, Human
uuuuugggcagcaauuuaaaugu

SEQ ID NO: 1446295 - RNA, 22 nt, Human
uuuuuggucgaggaguaacaau

SEQ ID NO: 1446296 - RNA, 21 nt, Human
uuuuuguauaguuaacacacu

SEQ ID NO: 1446297 - RNA, 18 nt, Human
uuuuuguauaaaauagac

SEQ ID NO: 1446298 - RNA, 11 nt, Human
uuuuuguagua

SEQ ID NO: 1446299 - RNA, 12 nt, Human
uuuuuauuucuu

SEQ ID NO: 1446300 - RNA, 17 nt, Human
uuuuuauauuugaaaua

SEQ ID NO: 1446301 - RNA, 12 nt, Human
uuuuuauuucug

SEQ ID NO: 1446302 - RNA, 15 nt, Human
uuuuuauuucuuccu

SEQ ID NO: 1446303 - RNA, 13 nt, Human
uuuuucaaaagaa

SEQ ID NO: 1446304 - RNA, 19 nt, Human
uuuuuggaagugaaaacuu

SEQ ID NO: 1446305 - RNA, 15 nt, Human
uuuuuggaagugaaa

SEQ ID NO: 1446306 - RNA, 22 nt, Human
uuuuuggaagaggacuccuuaa

SEQ ID NO: 1446307 - RNA, 16 nt, Human
uuuuugccacagcuuu

SEQ ID NO: 1446308 - RNA, 17 nt, Human
uuuuugcauuuaaaaca

SEQ ID NO: 1446309 - RNA, 16 nt, Human
uuuuugcaguaacugu

SEQ ID NO: 1446310 - RNA, 14 nt, Human
uuuuugcaguaacu

SEQ ID NO: 1446311 - RNA, 9 nt, Human
uuuuugcag

SEQ ID NO: 1446312 - RNA, 20 nt, Human
uuuuugcacauguuuccucu

SEQ ID NO: 1446313 - RNA, 16 nt, Human
uuuuugaucaaaaacu

SEQ ID NO: 1446314 - RNA, 12 nt, Human
uuuuugauauag

SEQ ID NO: 1446315 - RNA, 15 nt, Human
uuuuugauacuaagc

SEQ ID NO: 1446316 - RNA, 13 nt, Human
uuuuugauacuaa

SEQ ID NO: 1446317 - RNA, 15 nt, Human
uuuuugauaaagccu

SEQ ID NO: 1446318 - RNA, 13 nt, Human
uuuuugaggcaaa

SEQ ID NO: 1446319 - RNA, 16 nt, Human
uuuuugagacagaguc

SEQ ID NO: 1446320 - RNA, 17 nt, Human
auuaaaauguaugcaug

SEQ ID NO: 1446321 - RNA, 15 nt, Human
auuaaaauguaugca

SEQ ID NO: 1446322 - RNA, 23 nt, Human
auuaaaauguaugcauguugucu

SEQ ID NO: 1446323 - RNA, 11 nt, Human
auuaaaaugua

SEQ ID NO: 1446324 - RNA, 14 nt, Human
auuaaaaugcuucc

SEQ ID NO: 1446325 - RNA, 16 nt, Human
auuaaaauccucaauc

SEQ ID NO: 1446326 - RNA, 14 nt, Human
auuaaaauccucaa

SEQ ID NO: 1446327 - RNA, 21 nt, Human
uuuugcuuuuggcaaaacucu

SEQ ID NO: 1446328 - RNA, 21 nt, Human
uuuugcuuucgaacugcuagu

SEQ ID NO: 1446329 - RNA, 15 nt, Human
uuuuggacuucuggg

SEQ ID NO: 1446330 - RNA, 13 nt, Human
uuuuggaauuugc

SEQ ID NO: 1446331 - RNA, 16 nt, Human
uuuuguguuuguugua

SEQ ID NO: 1446332 - RNA, 17 nt, Human
uuuuguguguauuugcu

SEQ ID NO: 1446333 - RNA, 20 nt, Human
uuuuguguguauuugcuaau

SEQ ID NO: 1446334 - RNA, 21 nt, Human
uuuugugucucuuauggaugu

SEQ ID NO: 1446335 - RNA, 21 nt, Human
uuuugugggggacuguaaguu

SEQ ID NO: 1446336 - RNA, 14 nt, Human
uuuugugaauuagg

SEQ ID NO: 1446337 - RNA, 14 nt, Human
uuuugugaagcaaa

SEQ ID NO: 1446338 - RNA, 16 nt, Human
uuuuggaugcagugcu

SEQ ID NO: 1446339 - RNA, 13 nt, Human
uuuuguuggcaua

SEQ ID NO: 1446340 - RNA, 19 nt, Human
uuuuguugacauucugaau

SEQ ID NO: 1446341 - RNA, 20 nt, Human
uuuuguugacauucugaaug

SEQ ID NO: 1446342 - RNA, 18 nt, Human
uuuuguugacauucugaa

SEQ ID NO: 1446343 - RNA, 13 nt, Human
uuuuguugacauu

SEQ ID NO: 1446344 - RNA, 12 nt, Human
uuuuguugacau

SEQ ID NO: 1446345 - RNA, 23 nt, Human
uuuuguucgcauggucacacacu

SEQ ID NO: 1446346 - RNA, 21 nt, Human
uuuuguuguuucuuaaauaag

SEQ ID NO: 1446347 - RNA, 21 nt, Human
uuuuguuggcauagcucuggg

SEQ ID NO: 1446348 - RNA, 15 nt, Human
uuuuguuuuggcuga

SEQ ID NO: 1446349 - RNA, 19 nt, Human
uuuuguuguuucuuaaaua

SEQ ID NO: 1446350 - RNA, 23 nt, Human
uuuuuacaaauguuaaaaugugu

SEQ ID NO: 1446351 - RNA, 22 nt, Human
uuuuuacaaauguuaaaaugug

SEQ ID NO: 1446352 - RNA, 15 nt, Human
uuuuuacaaagcccu

SEQ ID NO: 1446353 - RNA, 23 nt, Human
uuuuuaauuuacaaaaauauaaa

SEQ ID NO: 1446354 - RNA, 14 nt, Human
uuuuuaauuaauug

SEQ ID NO: 1446355 - RNA, 12 nt, Human
uuuuuaauuauu

SEQ ID NO: 1446356 - RNA, 17 nt, Human
uuuuguuuuucauucag

SEQ ID NO: 1446357 - RNA, 17 nt, Human
uuuuuacaauguaauua

SEQ ID NO: 1446358 - RNA, 12 nt, Human
uuuuuacauuuu

SEQ ID NO: 1446359 - RNA, 11 nt, Human
uuuuuacauuu

SEQ ID NO: 1446360 - RNA, 15 nt, Human
uuuuuauauaugugu

SEQ ID NO: 1446361 - RNA, 16 nt, Human
auuagacuggacagcu

SEQ ID NO: 1446362 - RNA, 15 nt, Human
auuagacuggacagc

SEQ ID NO: 1446363 - RNA, 14 nt, Human
auuagacuggacag

SEQ ID NO: 1446364 - RNA, 22 nt, Human
auuagacuggaacuugaacuga

SEQ ID NO: 1446365 - RNA, 15 nt, Human
auuagacuggaacuu

SEQ ID NO: 1446366 - RNA, 15 nt, Human
auuagacagaacacc

SEQ ID NO: 1446367 - RNA, 17 nt, Human
auuagacagaacaccua

SEQ ID NO: 1446368 - RNA, 14 nt, Human
auuagacagaacac

SEQ ID NO: 1446369 - RNA, 13 nt, Human
auuagacagaaca

SEQ ID NO: 1446370 - RNA, 18 nt, Human
auuagacacuuuggaaga

SEQ ID NO: 1446371 - RNA, 18 nt, Human
auuagacugugauucaga

SEQ ID NO: 1446372 - RNA, 14 nt, Human
auuagacugugauu

SEQ ID NO: 1446373 - RNA, 19 nt, Human
auuagacuggacagcuugu

SEQ ID NO: 1446374 - RNA, 20 nt, Human
auuagacuggacagcuugug

SEQ ID NO: 1446375 - RNA, 21 nt, Human
auuacuuguaaauauaaagac

SEQ ID NO: 1446376 - RNA, 20 nt, Human
auuacuuguaaauauaaaga

SEQ ID NO: 1446377 - RNA, 18 nt, Human
auuacuuguaaauauaaa

SEQ ID NO: 1446378 - RNA, 17 nt, Human
auuacuuguaaauauaa

SEQ ID NO: 1446379 - RNA, 16 nt, Human
auuacuuguaaauaua

SEQ ID NO: 1446380 - RNA, 15 nt, Human
auuacuuguaaauau

SEQ ID NO: 1446381 - RNA, 13 nt, Human
auuacuuguaaau

SEQ ID NO: 1446382 - RNA, 13 nt, Human
auuaaguucuuua

SEQ ID NO: 1446383 - RNA, 15 nt, Human
auuacugguccaaaa

SEQ ID NO: 1446384 - RNA, 16 nt, Human
auuaaucaguucauua

SEQ ID NO: 1446385 - RNA, 16 nt, Human
auuacuguaagaaaau

SEQ ID NO: 1446386 - RNA, 15 nt, Human
auuacuguaagaaaa

SEQ ID NO: 1446387 - RNA, 15 nt, Human
auuccccauucuucc

SEQ ID NO: 1446388 - RNA, 14 nt, Human
auuccccauucuuc

SEQ ID NO: 1446389 - RNA, 18 nt, Human
auuccccaucucaggcca

SEQ ID NO: 1446390 - RNA, 16 nt, Human
auuccccaucucaggc

SEQ ID NO: 1446391 - RNA, 22 nt, Human
auucccacccaauucaaaacau

SEQ ID NO: 1446392 - RNA, 17 nt, Human
auuccagaccugaagaa

SEQ ID NO: 1446393 - RNA, 23 nt, Human
auuccagaaugcuguacaucuau

SEQ ID NO: 1446394 - RNA, 20 nt, Human
auuccagaaugcuguacauc

SEQ ID NO: 1446395 - RNA, 19 nt, Human
auuccagaaugcuguacau

SEQ ID NO: 1446396 - RNA, 15 nt, Human
auuccagaaugcugu

SEQ ID NO: 1446397 - RNA, 14 nt, Human
auuccagaaugcug

SEQ ID NO: 1446398 - RNA, 23 nt, Human
auuccagacugcuuccaauuuuc

SEQ ID NO: 1446399 - RNA, 18 nt, Human
auuccagaccugaagaau

SEQ ID NO: 1446400 - RNA, 14 nt, Human
auuccaagucucca

SEQ ID NO: 1446401 - RNA, 17 nt, Human
auuccaagugauugaaa

SEQ ID NO: 1446402 - RNA, 17 nt, Human
auucagguaauacaaac

SEQ ID NO: 1446403 - RNA, 16 nt, Human
auucagguaauacaaa

SEQ ID NO: 1446404 - RNA, 15 nt, Human
auucagguaauacaa

SEQ ID NO: 1446405 - RNA, 23 nt, Human
auucagggaaggaggagccuguc

SEQ ID NO: 1446406 - RNA, 20 nt, Human
auucagggaaggaggagccu

SEQ ID NO: 1446407 - RNA, 14 nt, Human
auucagggaaggag

SEQ ID NO: 1446408 - RNA, 20 nt, Human
auucagggaaagugggacag

SEQ ID NO: 1446409 - RNA, 19 nt, Human
auucaggacuugaaagaaa

SEQ ID NO: 1446410 - RNA, 18 nt, Human
auucaggacuugaaagaa

SEQ ID NO: 1446411 - RNA, 19 nt, Human
auucaguguuaaaugugau

SEQ ID NO: 1446412 - RNA, 14 nt, Human
auucagugucacug

SEQ ID NO: 1446413 - RNA, 18 nt, Human
auuccaagacucuagagu

SEQ ID NO: 1446414 - RNA, 17 nt, Human
auuccaagacucuagag

SEQ ID NO: 1446415 - RNA, 16 nt, Human
auuccaagacucuaga

SEQ ID NO: 1446416 - RNA, 22 nt, Human
auucagaaaauguucuguuugc

SEQ ID NO: 1446417 - RNA, 19 nt, Human
auucagaaaauguucuguu

SEQ ID NO: 1446418 - RNA, 18 nt, Human
auucagaaaauguucugu

SEQ ID NO: 1446419 - RNA, 20 nt, Human
auucagaaaauguucuguuu

SEQ ID NO: 1446420 - RNA, 14 nt, Human
auucagccuggcuu

SEQ ID NO: 1446421 - RNA, 20 nt, Human
auuauauggcuugaguuuaa

SEQ ID NO: 1446422 - RNA, 17 nt, Human
auuauauggaaauauau

SEQ ID NO: 1446423 - RNA, 16 nt, Human
auuauauggaaauaua

SEQ ID NO: 1446424 - RNA, 21 nt, Human
auuauauggaaauauauauua

SEQ ID NO: 1446425 - RNA, 20 nt, Human
auuauauggaaauauauauu

SEQ ID NO: 1446426 - RNA, 18 nt, Human
auuauauggaaauauaua

SEQ ID NO: 1446427 - RNA, 14 nt, Human
auuauucaguguca

SEQ ID NO: 1446428 - RNA, 13 nt, Human
auuauucaguguc

SEQ ID NO: 1446429 - RNA, 14 nt, Human
auuauucacuagua

SEQ ID NO: 1446430 - RNA, 12 nt, Human
auuauaacugua

SEQ ID NO: 1446431 - RNA, 17 nt, Human
auuauaacuggaaagaa

SEQ ID NO: 1446432 - RNA, 14 nt, Human
auuauaaccuuaau

SEQ ID NO: 1446433 - RNA, 22 nt, Human
auuauaaccuuaauuuauuauu

SEQ ID NO: 1446434 - RNA, 15 nt, Human
auuauaaaugacaac

SEQ ID NO: 1446435 - RNA, 13 nt, Human
auuaguuuugauu

SEQ ID NO: 1446436 - RNA, 21 nt, Human
auucacucugaguguuuuaug

SEQ ID NO: 1446437 - RNA, 19 nt, Human
auucaccugccccaacucu

SEQ ID NO: 1446438 - RNA, 16 nt, Human
auucacccccuuuccu

SEQ ID NO: 1446439 - RNA, 22 nt, Human
auucacccccuuuccuggacac

SEQ ID NO: 1446440 - RNA, 21 nt, Human
auucaaagguucuagguuuca

SEQ ID NO: 1446441 - RNA, 18 nt, Human
auucaaagguucuagguu

SEQ ID NO: 1446442 - RNA, 17 nt, Human
auucaaagguucuaggu

SEQ ID NO: 1446443 - RNA, 16 nt, Human
auucaaagguucuagg

SEQ ID NO: 1446444 - RNA, 15 nt, Human
auucaaagguucuag

SEQ ID NO: 1446445 - RNA, 14 nt, Human
auucaaagguucua

SEQ ID NO: 1446446 - RNA, 13 nt, Human
auucaaagguucu

SEQ ID NO: 1446447 - RNA, 17 nt, Human
auucaaaaguuccaaga

SEQ ID NO: 1446448 - RNA, 22 nt, Human
auuauuuaaaccgcuaaaagaa

SEQ ID NO: 1446449 - RNA, 12 nt, Human
auuauuuaaaca

SEQ ID NO: 1446450 - RNA, 11 nt, Human
auuauuuaaac

SEQ ID NO: 1446451 - RNA, 18 nt, Human
auuauuguugcauuaaaa

SEQ ID NO: 1446452 - RNA, 20 nt, Human
auuauuggaauauaauuguu

SEQ ID NO: 1446453 - RNA, 15 nt, Human
auuauucagugucac

SEQ ID NO: 1446454 - RNA, 16 nt, Human
auucaaaaguuccaag

SEQ ID NO: 1446455 - RNA, 14 nt, Human
auucaaaaguucca

SEQ ID NO: 1446456 - RNA, 13 nt, Human
auucaaaaguucc

SEQ ID NO: 1446457 - RNA, 11 nt, Human
auucaaaacau

SEQ ID NO: 1446458 - RNA, 16 nt, Human
auucaaaaauuaucua

SEQ ID NO: 1446459 - RNA, 23 nt, Human
auucaaaaauuaucuauagcuaa

SEQ ID NO: 1446460 - RNA, 15 nt, Human
auucagccuggcuuc

SEQ ID NO: 1446461 - RNA, 15 nt, Human
uuugacacugcucua

SEQ ID NO: 1446462 - RNA, 20 nt, Human
uuugacaccucuuuuuucgu

SEQ ID NO: 1446463 - RNA, 20 nt, Human
uuugacaacguuucagcgac

SEQ ID NO: 1446464 - RNA, 18 nt, Human
uuugacaaagguaaauca

SEQ ID NO: 1446465 - RNA, 14 nt, Human
uuugacaaggggca

SEQ ID NO: 1446466 - RNA, 19 nt, Human
uuugaccucugcagcaaua

SEQ ID NO: 1446467 - RNA, 21 nt, Human
uuugaccucugcagcaauaaa

SEQ ID NO: 1446468 - RNA, 16 nt, Human
uuucccuucaguaccc

SEQ ID NO: 1446469 - RNA, 12 nt, Human
uuucccuggucc

SEQ ID NO: 1446470 - RNA, 16 nt, Human
uuucccugccucucau

SEQ ID NO: 1446471 - RNA, 23 nt, Human
uuucccuacugaagcccuuguga

SEQ ID NO: 1446472 - RNA, 17 nt, Human
uuucccuacugaagccc

SEQ ID NO: 1446473 - RNA, 16 nt, Human
uuucccuacccucuag

SEQ ID NO: 1446474 - RNA, 20 nt, Human
uuucccuucaguacccucuc

SEQ ID NO: 1446475 - RNA, 19 nt, Human
uuucccuucaguacccucu

SEQ ID NO: 1446476 - RNA, 19 nt, Human
uuucccuuccuuccucucc

SEQ ID NO: 1446477 - RNA, 18 nt, Human
uuugaugaggcccuccac

SEQ ID NO: 1446478 - RNA, 12 nt, Human
uuugaugauaaa

SEQ ID NO: 1446479 - RNA, 15 nt, Human
uuugaugaguuguga

SEQ ID NO: 1446480 - RNA, 15 nt, Human
uuugacuuuucugua

SEQ ID NO: 1446481 - RNA, 14 nt, Human
uuugacuuuucugu

SEQ ID NO: 1446482 - RNA, 13 nt, Human
uuugacuuuucug

SEQ ID NO: 1446483 - RNA, 12 nt, Human
uuugacuuuucu

SEQ ID NO: 1446484 - RNA, 21 nt, Human
uuugagaaacaacaauuucua

SEQ ID NO: 1446485 - RNA, 17 nt, Human
uuugacuuuucuguaau

SEQ ID NO: 1446486 - RNA, 16 nt, Human
uuugacuuuucuguaa

SEQ ID NO: 1446487 - RNA, 13 nt, Human
uuugaccuuuuau

SEQ ID NO: 1446488 - RNA, 21 nt, Human
uuugagagaaauaugaagaac

SEQ ID NO: 1446489 - RNA, 20 nt, Human
uuugagacagagucuuccuc

SEQ ID NO: 1446490 - RNA, 21 nt, Human
uuugcgcuccuggcccagccu

SEQ ID NO: 1446491 - RNA, 15 nt, Human
uuugcgcuccuggcc

SEQ ID NO: 1446492 - RNA, 19 nt, Human
uuugcaaagaaagaaaaaa

SEQ ID NO: 1446493 - RNA, 18 nt, Human
uuugcaaaaaauguuuuu

SEQ ID NO: 1446494 - RNA, 20 nt, Human
uuugcaaaaaauguuuuugg

SEQ ID NO: 1446495 - RNA, 14 nt, Human
uuugauuucauuaa

SEQ ID NO: 1446496 - RNA, 14 nt, Human
uuugauuuaauguu

SEQ ID NO: 1446497 - RNA, 15 nt, Human
uuugauugauuugaa

SEQ ID NO: 1446498 - RNA, 22 nt, Human
uuugcuguaauguuaauauuga

SEQ ID NO: 1446499 - RNA, 14 nt, Human
uuugcuaaagacau

SEQ ID NO: 1446500 - RNA, 19 nt, Human
uuugcgugggagugugugc

SEQ ID NO: 1446501 - RNA, 15 nt, Human
uuugcuaaagacaug

SEQ ID NO: 1446502 - RNA, 16 nt, Human
uuuggauuugacauug

SEQ ID NO: 1446503 - RNA, 14 nt, Human
uuuggauuguauau

SEQ ID NO: 1446504 - RNA, 19 nt, Human
uuugcuaagcauuccaacu

SEQ ID NO: 1446505 - RNA, 20 nt, Human
uuuggauuuaaaagccugcu

SEQ ID NO: 1446506 - RNA, 14 nt, Human
uuuggauuugacau

SEQ ID NO: 1446507 - RNA, 21 nt, Human
uuuggcugaaauucuccugga

SEQ ID NO: 1446508 - RNA, 20 nt, Human
uuuggcugaaauucuccugg

SEQ ID NO: 1446509 - RNA, 15 nt, Human
uuugggaguuuuuau

SEQ ID NO: 1446510 - RNA, 13 nt, Human
uuuggcuuucagg

SEQ ID NO: 1446511 - RNA, 22 nt, Human
uuuggcugaaauucuccuggag

SEQ ID NO: 1446512 - RNA, 23 nt, Human
uuugggaguuuuuaugagaaacu

SEQ ID NO: 1446513 - RNA, 21 nt, Human
uuugggcagcaauuuaaaugu

SEQ ID NO: 1446514 - RNA, 20 nt, Human
uuugggggguuuucuugccu

SEQ ID NO: 1446515 - RNA, 20 nt, Human
uuugggcuucagcugccagu

SEQ ID NO: 1446516 - RNA, 15 nt, Human
uuugggcuugggccu

SEQ ID NO: 1446517 - RNA, 16 nt, Human
uuugggcuucagcugc

SEQ ID NO: 1446518 - RNA, 16 nt, Human
auguauaguaaaucac

SEQ ID NO: 1446519 - RNA, 15 nt, Human
auguauaguaaauca

SEQ ID NO: 1446520 - RNA, 12 nt, Human
auguauaguaaa

SEQ ID NO: 1446521 - RNA, 15 nt, Human
uuuggguccaggagg

SEQ ID NO: 1446522 - RNA, 13 nt, Human
uuuggguccagga

SEQ ID NO: 1446523 - RNA, 18 nt, Human
uuuggggugccccucucc

SEQ ID NO: 1446524 - RNA, 14 nt, Human
uuuggguccaggag

SEQ ID NO: 1446525 - RNA, 19 nt, Human
auguauacuauaguaccag

SEQ ID NO: 1446526 - RNA, 16 nt, Human
auguccaacccgucug

SEQ ID NO: 1446527 - RNA, 22 nt, Human
auguccaaagaggcugccccuc

SEQ ID NO: 1446528 - RNA, 21 nt, Human
auguccaaagaggcugccccu

SEQ ID NO: 1446529 - RNA, 20 nt, Human
auguccaaagaggcugcccc

SEQ ID NO: 1446530 - RNA, 19 nt, Human
auguccaaagaggcugccc

SEQ ID NO: 1446531 - RNA, 18 nt, Human
auguccaaagaggcugcc

SEQ ID NO: 1446532 - RNA, 16 nt, Human
auguccaaagaggcug

SEQ ID NO: 1446533 - RNA, 15 nt, Human
auguccaaagaggcu

SEQ ID NO: 1446534 - RNA, 12 nt, Human
auguccaaagag

SEQ ID NO: 1446535 - RNA, 18 nt, Human
augucauuucauuuccua

SEQ ID NO: 1446536 - RNA, 15 nt, Human
augucauuucauuuc

SEQ ID NO: 1446537 - RNA, 17 nt, Human
augucauuucagaaguu

SEQ ID NO: 1446538 - RNA, 16 nt, Human
augucauuucagaagu

SEQ ID NO: 1446539 - RNA, 16 nt, Human
augucaugcugccuua

SEQ ID NO: 1446540 - RNA, 13 nt, Human
augucauuaaaug

SEQ ID NO: 1446541 - RNA, 15 nt, Human
augucaugcugccuu

SEQ ID NO: 1446542 - RNA, 14 nt, Human
augucaugcugccu

SEQ ID NO: 1446543 - RNA, 13 nt, Human
augucaugcugcc

SEQ ID NO: 1446544 - RNA, 20 nt, Human
augucauacagagaagucac

SEQ ID NO: 1446545 - RNA, 18 nt, Human
augucauacagagaaguc

SEQ ID NO: 1446546 - RNA, 17 nt, Human
augucauacagagaagu

SEQ ID NO: 1446547 - RNA, 16 nt, Human
augucauacagagaag

SEQ ID NO: 1446548 - RNA, 15 nt, Human
augucauacagagaa

SEQ ID NO: 1446549 - RNA, 14 nt, Human
augucauacagaga

SEQ ID NO: 1446550 - RNA, 17 nt, Human
auguaucaaauacauuu

SEQ ID NO: 1446551 - RNA, 13 nt, Human
augucauacagag

SEQ ID NO: 1446552 - RNA, 15 nt, Human
augugauauauaagu

SEQ ID NO: 1446553 - RNA, 13 nt, Human
augugauauauaa

SEQ ID NO: 1446554 - RNA, 18 nt, Human
augugauaaggaaaucaa

SEQ ID NO: 1446555 - RNA, 20 nt, Human
augugauaaggaaaucaacu

SEQ ID NO: 1446556 - RNA, 17 nt, Human
augugauaaggaaauca

SEQ ID NO: 1446557 - RNA, 17 nt, Human
augugagagguuugacu

SEQ ID NO: 1446558 - RNA, 16 nt, Human
augugagagguuugac

SEQ ID NO: 1446559 - RNA, 14 nt, Human
augugagacugguu

SEQ ID NO: 1446560 - RNA, 19 nt, Human
augugacauuuauauauug

SEQ ID NO: 1446561 - RNA, 14 nt, Human
augugacauuuaua

SEQ ID NO: 1446562 - RNA, 13 nt, Human
augugacauuuau

SEQ ID NO: 1446563 - RNA, 14 nt, Human
augugacaguggcg

SEQ ID NO: 1446564 - RNA, 16 nt, Human
augugacagguaaacu

SEQ ID NO: 1446565 - RNA, 20 nt, Human
augucguggacacacacaga

SEQ ID NO: 1446566 - RNA, 19 nt, Human
augucguggacacacacag

SEQ ID NO: 1446567 - RNA, 23 nt, Human
augucgucaaagcugaaauggac

SEQ ID NO: 1446568 - RNA, 15 nt, Human
uuuguuuguuuaauu

SEQ ID NO: 1446569 - RNA, 11 nt, Human
uuuguuuguuu

SEQ ID NO: 1446570 - RNA, 15 nt, Human
uuuguuuccuuuguu

SEQ ID NO: 1446571 - RNA, 14 nt, Human
uuuguuuccuuugu

SEQ ID NO: 1446572 - RNA, 17 nt, Human
uuuguuuccucuguuca

SEQ ID NO: 1446573 - RNA, 12 nt, Human
uuuguuuccucu

SEQ ID NO: 1446574 - RNA, 17 nt, Human
uuuguuucaaugaggug

SEQ ID NO: 1446575 - RNA, 12 nt, Human
uuugugcccuau

SEQ ID NO: 1446576 - RNA, 22 nt, Human
uuuguuucaaugagguguccaa

SEQ ID NO: 1446577 - RNA, 22 nt, Human
uuugugcugaauguugggacug

SEQ ID NO: 1446578 - RNA, 19 nt, Human
uuugugauggagugcuguu

SEQ ID NO: 1446579 - RNA, 13 nt, Human
uuugugcauucug

SEQ ID NO: 1446580 - RNA, 20 nt, Human
uuugugauucaaucuguaaa

SEQ ID NO: 1446581 - RNA, 22 nt, Human
uuugugcauuaucuagauacug

SEQ ID NO: 1446582 - RNA, 15 nt, Human
uuugugauucaaucu

SEQ ID NO: 1446583 - RNA, 21 nt, Human
uuugugauggagugcuguuuu

SEQ ID NO: 1446584 - RNA, 18 nt, Human
uuugugauggagugcugu

SEQ ID NO: 1446585 - RNA, 22 nt, Human
uuugugauaugcacaauguaga

SEQ ID NO: 1446586 - RNA, 19 nt, Human
uuugugcauuaucuagaua

SEQ ID NO: 1446587 - RNA, 20 nt, Human
uuugugauaugcacaaugua

SEQ ID NO: 1446588 - RNA, 22 nt, Human
uuugugauacaaugcugugccc

SEQ ID NO: 1446589 - RNA, 16 nt, Human
uuugugauacaaugcu

SEQ ID NO: 1446590 - RNA, 18 nt, Human
augugauauucuaagacu

SEQ ID NO: 1446591 - RNA, 15 nt, Human
augugauauucuaag

SEQ ID NO: 1446592 - RNA, 14 nt, Human
augugauauucuaa

SEQ ID NO: 1446593 - RNA, 23 nt, Human
augugauauauaaguguacauau

SEQ ID NO: 1446594 - RNA, 22 nt, Human
augugauauauaaguguacaua

SEQ ID NO: 1446595 - RNA, 21 nt, Human
augugauauauaaguguacau

SEQ ID NO: 1446596 - RNA, 19 nt, Human
augugauauauaaguguac

SEQ ID NO: 1446597 - RNA, 17 nt, Human
augugauauauaagugu

SEQ ID NO: 1446598 - RNA, 16 nt, Human
augugauauauaagug

SEQ ID NO: 1446599 - RNA, 20 nt, Human
augugaucauguguggaagu

SEQ ID NO: 1446600 - RNA, 19 nt, Human
augugaucauguguggaag

SEQ ID NO: 1446601 - RNA, 16 nt, Human
augugauauucuaaga

SEQ ID NO: 1446602 - RNA, 20 nt, Human
uuuguaaguugaagcaaauc

SEQ ID NO: 1446603 - RNA, 16 nt, Human
uuuguaaguugaagca

SEQ ID NO: 1446604 - RNA, 18 nt, Human
uuuguaagguuuuuguag

SEQ ID NO: 1446605 - RNA, 19 nt, Human
augugaugaauacuguauu

SEQ ID NO: 1446606 - RNA, 17 nt, Human
augugaugaauacugua

SEQ ID NO: 1446607 - RNA, 22 nt, Human
uuuguagugauuuuuaugccac

SEQ ID NO: 1446608 - RNA, 17 nt, Human
uuuguaguagcguuuuu

SEQ ID NO: 1446609 - RNA, 17 nt, Human
uuuguaguguuggagaa

SEQ ID NO: 1446610 - RNA, 15 nt, Human
uuuguagugauuuuu

SEQ ID NO: 1446611 - RNA, 19 nt, Human
uuuguaguagcguuuuuua

SEQ ID NO: 1446612 - RNA, 15 nt, Human
uuuguaggguuucua

SEQ ID NO: 1446613 - RNA, 19 nt, Human
uuuguacauaguuauuuau

SEQ ID NO: 1446614 - RNA, 16 nt, Human
uuuguaggguuucuag

SEQ ID NO: 1446615 - RNA, 15 nt, Human
uuuguaguagcguuu

SEQ ID NO: 1446616 - RNA, 16 nt, Human
uuuguaauuuuuuuau

SEQ ID NO: 1446617 - RNA, 18 nt, Human
auguuggucauuuuaugu

SEQ ID NO: 1446618 - RNA, 14 nt, Human
auguuuaaaacauc

SEQ ID NO: 1446619 - RNA, 12 nt, Human
auguugggacug

SEQ ID NO: 1446620 - RNA, 20 nt, Human
auguugggaaacuuggcucg

SEQ ID NO: 1446621 - RNA, 19 nt, Human
auguugggaaacuuggcuc

SEQ ID NO: 1446622 - RNA, 21 nt, Human
auguuggccaggcuggucuaa

SEQ ID NO: 1446623 - RNA, 19 nt, Human
auguuggccaggcuggucu

SEQ ID NO: 1446624 - RNA, 14 nt, Human
auguuuaaaccuuu

SEQ ID NO: 1446625 - RNA, 18 nt, Human
auguuuacacucuuugua

SEQ ID NO: 1446626 - RNA, 16 nt, Human
auguuuacacucuuug

SEQ ID NO: 1446627 - RNA, 21 nt, Human
auguuuacacucuuuguaaga

SEQ ID NO: 1446628 - RNA, 19 nt, Human
auguuuacacucuuuguaa

SEQ ID NO: 1446629 - RNA, 18 nt, Human
uuuucuggaauguaauca

SEQ ID NO: 1446630 - RNA, 21 nt, Human
uuuucuggaauacaugaaaua

SEQ ID NO: 1446631 - RNA, 17 nt, Human
uuuucuggaauacauga

SEQ ID NO: 1446632 - RNA, 16 nt, Human
uuuucuuaaagugcca

SEQ ID NO: 1446633 - RNA, 13 nt, Human
uuuucuuaaagug

SEQ ID NO: 1446634 - RNA, 18 nt, Human
uuuucuuaaagugccagu

SEQ ID NO: 1446635 - RNA, 21 nt, Human
uuuucuuaaccagaucauugu

SEQ ID NO: 1446636 - RNA, 13 nt, Human
uuuucuguucuuu

SEQ ID NO: 1446637 - RNA, 16 nt, Human
auguuuuuaauguaua

SEQ ID NO: 1446638 - RNA, 19 nt, Human
auguuuuuaauguauagua

SEQ ID NO: 1446639 - RNA, 14 nt, Human
auguuuuuaaugua

SEQ ID NO: 1446640 - RNA, 13 nt, Human
auguuuuuaaugu

SEQ ID NO: 1446641 - RNA, 12 nt, Human
auguuuuuaaug

SEQ ID NO: 1446642 - RNA, 19 nt, Human
auguuuuuaauaaaagaaa

SEQ ID NO: 1446643 - RNA, 16 nt, Human
auguuuuuaauaaaag

SEQ ID NO: 1446644 - RNA, 15 nt, Human
auguuuuuaauaaaa

SEQ ID NO: 1446645 - RNA, 16 nt, Human
auguuuuucuaaagga

SEQ ID NO: 1446646 - RNA, 15 nt, Human
auuaaaaaagauaaa

SEQ ID NO: 1446647 - RNA, 17 nt, Human
auuaaaaaagauaaaca

SEQ ID NO: 1446648 - RNA, 14 nt, Human
auuaaaaaagauaa

SEQ ID NO: 1446649 - RNA, 13 nt, Human
auuaaaaaagaua

SEQ ID NO: 1446650 - RNA, 23 nt, Human
auuaaaaaucucaaauuucuaaa

SEQ ID NO: 1446651 - RNA, 22 nt, Human
auguuuuuugccacagcuuuug

SEQ ID NO: 1446652 - RNA, 20 nt, Human
auuaaaaaaaaagaucuguu

SEQ ID NO: 1446653 - RNA, 14 nt, Human
auuaaaaaaaaaga

SEQ ID NO: 1446654 - RNA, 21 nt, Human
auguuuuuugccacagcuuuu

SEQ ID NO: 1446655 - RNA, 19 nt, Human
auguuuuuugccacagcuu

SEQ ID NO: 1446656 - RNA, 18 nt, Human
auguuuuuugccacagcu

SEQ ID NO: 1446657 - RNA, 12 nt, Human
auguuuuuugcc

SEQ ID NO: 1446658 - RNA, 14 nt, Human
auguuuuucuaaag

SEQ ID NO: 1446659 - RNA, 15 nt, Human
auguuuuuuuuuaaa

SEQ ID NO: 1446660 - RNA, 18 nt, Human
uuuuauugacacagaaaa

SEQ ID NO: 1446661 - RNA, 16 nt, Human
uuuuauugacacagaa

SEQ ID NO: 1446662 - RNA, 13 nt, Human
uuuuauuaaugca

SEQ ID NO: 1446663 - RNA, 11 nt, Human
uuuuauuaaug

SEQ ID NO: 1446664 - RNA, 12 nt, Human
uuuuaguugaau

SEQ ID NO: 1446665 - RNA, 21 nt, Human
uuuuauggcuuuugugcauua

SEQ ID NO: 1446666 - RNA, 19 nt, Human
uuuuagugaacuugaaaua

SEQ ID NO: 1446667 - RNA, 21 nt, Human
uuuuagacagucucacuuugu

SEQ ID NO: 1446668 - RNA, 23 nt, Human
uuuuagaguugauacuacaguuu

SEQ ID NO: 1446669 - RNA, 19 nt, Human
uuuuaguugcaacuuugua

SEQ ID NO: 1446670 - RNA, 18 nt, Human
uuuuauggcuuuugugca

SEQ ID NO: 1446671 - RNA, 19 nt, Human
uuuuauggcuuuugugcau

SEQ ID NO: 1446672 - RNA, 21 nt, Human
uuuuccaacuuggcugcagga

SEQ ID NO: 1446673 - RNA, 18 nt, Human
uuuuccaacuacuaauag

SEQ ID NO: 1446674 - RNA, 14 nt, Human
uuuuccaacuacua

SEQ ID NO: 1446675 - RNA, 22 nt, Human
uuuuccaaauguaauaaacuuu

SEQ ID NO: 1446676 - RNA, 11 nt, Human
uuuuccaaaug

SEQ ID NO: 1446677 - RNA, 19 nt, Human
uuuuccaaagagugauagu

SEQ ID NO: 1446678 - RNA, 19 nt, Human
uuuucaguauuauauguac

SEQ ID NO: 1446679 - RNA, 20 nt, Human
uuuucaggcuagauguaugu

SEQ ID NO: 1446680 - RNA, 21 nt, Human
uuuucucugguaauauugacu

SEQ ID NO: 1446681 - RNA, 16 nt, Human
uuuucucugguaauau

SEQ ID NO: 1446682 - RNA, 14 nt, Human
uuuucucugguaau

SEQ ID NO: 1446683 - RNA, 15 nt, Human
uuuucucucaacacc

SEQ ID NO: 1446684 - RNA, 10 nt, Human
uuuucucuca

SEQ ID NO: 1446685 - RNA, 20 nt, Human
uuuucucuaggaaauauacu

SEQ ID NO: 1446686 - RNA, 17 nt, Human
uuuucucugaacacauu

SEQ ID NO: 1446687 - RNA, 21 nt, Human
uuuucucucaacaccaugauu

SEQ ID NO: 1446688 - RNA, 17 nt, Human
uuuucucugauacagaa

SEQ ID NO: 1446689 - RNA, 20 nt, Human
uuuuccagcuggaugagaau

SEQ ID NO: 1446690 - RNA, 16 nt, Human
uuuucuauaauuuaaa

SEQ ID NO: 1446691 - RNA, 23 nt, Human
auguuggacaccuuuagguucuu

SEQ ID NO: 1446692 - RNA, 17 nt, Human
uuuuagaguugauacua

SEQ ID NO: 1446693 - RNA, 22 nt, Human
auguuggacaccuuuagguucu

SEQ ID NO: 1446694 - RNA, 19 nt, Human
auguuggacaccuuuaggu

SEQ ID NO: 1446695 - RNA, 17 nt, Human
auguuggacaccuuuag

SEQ ID NO: 1446696 - RNA, 19 nt, Human
auguugcuggacugucaua

SEQ ID NO: 1446697 - RNA, 15 nt, Human
auguugcuggacugu

SEQ ID NO: 1446698 - RNA, 20 nt, Human
auguugcugaaaaaugggca

SEQ ID NO: 1446699 - RNA, 22 nt, Human
auguugaaauaugauguuaaaa

SEQ ID NO: 1446700 - RNA, 18 nt, Human
auguucacuuuugacaaa

SEQ ID NO: 1446701 - RNA, 14 nt, Human
auguucacuuuuga

SEQ ID NO: 1446702 - RNA, 23 nt, Human
auguucaaagucaaauaacuccu

SEQ ID NO: 1446703 - RNA, 14 nt, Human
auguucaaagucaa

SEQ ID NO: 1446704 - RNA, 20 nt, Human
auguuauuuuuuaauuauua

SEQ ID NO: 1446705 - RNA, 16 nt, Human
auguucuuuggaaagu

SEQ ID NO: 1446706 - RNA, 14 nt, Human
auguucuuuggaaa

SEQ ID NO: 1446707 - RNA, 13 nt, Human
auguucuuuggaa

SEQ ID NO: 1446708 - RNA, 19 nt, Human
auguucuuuggaaaguaca

SEQ ID NO: 1446709 - RNA, 20 nt, Human
auguucuuuuaaaugauuga

SEQ ID NO: 1446710 - RNA, 24 nt, Human
auguuaaauaggcggggcuugccu

SEQ ID NO: 1446711 - RNA, 22 nt, Human
auguuaaauaaauuguauauuc

SEQ ID NO: 1446712 - RNA, 19 nt, Human
auguuaaauaaauuguaua

SEQ ID NO: 1446713 - RNA, 20 nt, Human
auguuaaauaaauuguauau

SEQ ID NO: 1446714 - RNA, 14 nt, Human
auguuaaauaaauu

SEQ ID NO: 1446715 - RNA, 16 nt, Human
auguuaaauaaauugu

SEQ ID NO: 1446716 - RNA, 17 nt, Human
auguuaaauaaauugua

SEQ ID NO: 1446717 - RNA, 18 nt, Human
auguuaaauaaauuguau

SEQ ID NO: 1446718 - RNA, 20 nt, Human
auguuaagacuugacagugg

SEQ ID NO: 1446719 - RNA, 16 nt, Human
auguuaagacuugaca

SEQ ID NO: 1446720 - RNA, 13 nt, Human
auguuauuaucug

SEQ ID NO: 1446721 - RNA, 19 nt, Human
auguuauuuuuuaauuauu

SEQ ID NO: 1446722 - RNA, 17 nt, Human
auguuauuuuuuaauua

SEQ ID NO: 1446723 - RNA, 19 nt, Human
auguuauuuguaauagaug

SEQ ID NO: 1446724 - RNA, 15 nt, Human
auguuauuuguaaua

SEQ ID NO: 1446725 - RNA, 14 nt, Human
auguuacauuauua

SEQ ID NO: 1446726 - RNA, 18 nt, Human
auguuaagacuugacagu

SEQ ID NO: 1446727 - RNA, 22 nt, Human
auguuaucuucucaaguucuaa

SEQ ID NO: 1446728 - RNA, 21 nt, Human
auguuaucuucucaaguucua

SEQ ID NO: 1446729 - RNA, 20 nt, Human
auguuaucuucucaaguucu

SEQ ID NO: 1446730 - RNA, 17 nt, Human
auguuaucuucucaagu

SEQ ID NO: 1446731 - RNA, 18 nt, Human
auguuaugacuauguaaa

SEQ ID NO: 1446732 - RNA, 24 nt, Human
auguuaugacuauguaaacuacuu

SEQ ID NO: 1446733 - RNA, 17 nt, Human
uuuguuuuuccuuccaa

SEQ ID NO: 1446734 - RNA, 12 nt, Human
uuuguuuuucau

SEQ ID NO: 1446735 - RNA, 23 nt, Human
uuuguuuuuaaacuguacagugu

SEQ ID NO: 1446736 - RNA, 21 nt, Human
uuuguuuuuaaacuguacagu

SEQ ID NO: 1446737 - RNA, 20 nt, Human
uuuguuuuuaaacuguacag

SEQ ID NO: 1446738 - RNA, 19 nt, Human
uuuguuuuuaaacuguaca

SEQ ID NO: 1446739 - RNA, 16 nt, Human
uuuguuuuuaaacugu

SEQ ID NO: 1446740 - RNA, 17 nt, Human
uuuguuuuguuuuuaca

SEQ ID NO: 1446741 - RNA, 15 nt, Human
uuuguuuuguuuaca

SEQ ID NO: 1446742 - RNA, 14 nt, Human
uuuguuuugugucu

SEQ ID NO: 1446743 - RNA, 15 nt, Human
uuuguuuugugucuc

SEQ ID NO: 1446744 - RNA, 13 nt, Human
uuuguuuuguguc

SEQ ID NO: 1446745 - RNA, 12 nt, Human
uuuguuuugcac

SEQ ID NO: 1446746 - RNA, 21 nt, Human
augugccagggcaaugaugaa

SEQ ID NO: 1446747 - RNA, 20 nt, Human
augugccagggcaaugauga

SEQ ID NO: 1446748 - RNA, 17 nt, Human
augugcauucuccagcc

SEQ ID NO: 1446749 - RNA, 18 nt, Human
augugcuauacugcauac

SEQ ID NO: 1446750 - RNA, 19 nt, Human
augugcuauacugcauacu

SEQ ID NO: 1446751 - RNA, 21 nt, Human
augugcuaguaauuggaaagg

SEQ ID NO: 1446752 - RNA, 23 nt, Human
auguggaacugcugccacugagg

SEQ ID NO: 1446753 - RNA, 19 nt, Human
auguggaacugcugccacu

SEQ ID NO: 1446754 - RNA, 18 nt, Human
auguggaacugcugccac

SEQ ID NO: 1446755 - RNA, 17 nt, Human
auguggaacugcugcca

SEQ ID NO: 1446756 - RNA, 16 nt, Human
auguggaacugcugcc

SEQ ID NO: 1446757 - RNA, 15 nt, Human
auguggaacugcugc

SEQ ID NO: 1446758 - RNA, 14 nt, Human
augugcuuugagaa

SEQ ID NO: 1446759 - RNA, 16 nt, Human
auguguguauauggac

SEQ ID NO: 1446760 - RNA, 15 nt, Human
auguguguauaugga

SEQ ID NO: 1446761 - RNA, 22 nt, Human
auguguguccacgacugucucc

SEQ ID NO: 1446762 - RNA, 21 nt, Human
auguguguccacgacugucuc

SEQ ID NO: 1446763 - RNA, 23 nt, Human
auguuaaacuuauaacccacuuu

SEQ ID NO: 1446764 - RNA, 15 nt, Human
auguuaaaaaaauaa

SEQ ID NO: 1446765 - RNA, 13 nt, Human
auguuaaauaaau

SEQ ID NO: 1446766 - RNA, 17 nt, Human
auguguuugcuuucuga

SEQ ID NO: 1446767 - RNA, 16 nt, Human
auguguuugcuuucug

SEQ ID NO: 1446768 - RNA, 15 nt, Human
auguguuugcuuucu

SEQ ID NO: 1446769 - RNA, 12 nt, Human
auguguuugcuu

SEQ ID NO: 1446770 - RNA, 23 nt, Human
auguguuucacaguuugaaauaa

SEQ ID NO: 1446771 - RNA, 22 nt, Human
auguguguugauacuguugcac

SEQ ID NO: 1446772 - RNA, 23 nt, Human
auguguguugauacuguugcacg

SEQ ID NO: 1446773 - RNA, 21 nt, Human
auguguguugauacuguugca

SEQ ID NO: 1446774 - RNA, 20 nt, Human
auguguguugauacuguugc

SEQ ID NO: 1446775 - RNA, 19 nt, Human
auguguguugauacuguug

SEQ ID NO: 1446776 - RNA, 18 nt, Human
auguguguugauacuguu

SEQ ID NO: 1446777 - RNA, 17 nt, Human
auguguguugauacugu

SEQ ID NO: 1446778 - RNA, 16 nt, Human
auguguguugauacug

SEQ ID NO: 1446779 - RNA, 15 nt, Human
auguguguugauacu

SEQ ID NO: 1446780 - RNA, 23 nt, Human
auguguguccacgacugucucca

SEQ ID NO: 1446781 - RNA, 22 nt, Human
auguguuucacaguuugaaaua

SEQ ID NO: 1446782 - RNA, 21 nt, Human
auguguuucacaguuugaaau

SEQ ID NO: 1446783 - RNA, 20 nt, Human
auguguuucacaguuugaaa

SEQ ID NO: 1446784 - RNA, 18 nt, Human
auguguuucacaguuuga

SEQ ID NO: 1446785 - RNA, 17 nt, Human
auguguuucacaguuug

SEQ ID NO: 1446786 - RNA, 15 nt, Human
auguguguuuuaaaa

SEQ ID NO: 1446787 - RNA, 19 nt, Human
auugaaggcuuaaacccau

SEQ ID NO: 1446788 - RNA, 15 nt, Human
auugaaggcuuaaac

SEQ ID NO: 1446789 - RNA, 17 nt, Human
auugaaggaugcugucu

SEQ ID NO: 1446790 - RNA, 20 nt, Human
auugaacacaaacuguaaau

SEQ ID NO: 1446791 - RNA, 19 nt, Human
auugaacacaaacuguaaa

SEQ ID NO: 1446792 - RNA, 18 nt, Human
auugaacacaaacuguaa

SEQ ID NO: 1446793 - RNA, 17 nt, Human
auugaacacaaacugua

SEQ ID NO: 1446794 - RNA, 16 nt, Human
auugaacacaaacugu

SEQ ID NO: 1446795 - RNA, 15 nt, Human
auugaacacaaacug

SEQ ID NO: 1446796 - RNA, 14 nt, Human
auugaacacaaacu

SEQ ID NO: 1446797 - RNA, 21 nt, Human
auuccuauacgcagcgugcuu

SEQ ID NO: 1446798 - RNA, 24 nt, Human
auuccuagaaacugacacaugcug

SEQ ID NO: 1446799 - RNA, 18 nt, Human
auugaauacuuugaaugu

SEQ ID NO: 1446800 - RNA, 20 nt, Human
auugaauacuuugaaugugu

SEQ ID NO: 1446801 - RNA, 16 nt, Human
auugaauacuuugaau

SEQ ID NO: 1446802 - RNA, 15 nt, Human
auugaauacuuugaa

SEQ ID NO: 1446803 - RNA, 14 nt, Human
auugaauacuuuga

SEQ ID NO: 1446804 - RNA, 13 nt, Human
auugaauacuuug

SEQ ID NO: 1446805 - RNA, 16 nt, Human
auugaaguaaacuuuu

SEQ ID NO: 1446806 - RNA, 19 nt, Human
auugaaguauuuugcugga

SEQ ID NO: 1446807 - RNA, 22 nt, Human
auugaaguaaacuuuuuguucu

SEQ ID NO: 1446808 - RNA, 15 nt, Human
auugaaguaaacuuu

SEQ ID NO: 1446809 - RNA, 13 nt, Human
auugaauuaucuu

SEQ ID NO: 1446810 - RNA, 23 nt, Human
auugaauggcuauguuuuuaaug

SEQ ID NO: 1446811 - RNA, 22 nt, Human
auugaauggcuauguuuuuaau

SEQ ID NO: 1446812 - RNA, 21 nt, Human
auugaauggcuauguuuuuaa

SEQ ID NO: 1446813 - RNA, 23 nt, Human
auugaauucuugguugaggaaac

SEQ ID NO: 1446814 - RNA, 22 nt, Human
auugaauucuugguugaggaaa

SEQ ID NO: 1446815 - RNA, 20 nt, Human
auugaauucuugguugagga

SEQ ID NO: 1446816 - RNA, 21 nt, Human
auugaauuaucuugguugaaa

SEQ ID NO: 1446817 - RNA, 19 nt, Human
auugauuuuuauaaauacu

SEQ ID NO: 1446818 - RNA, 13 nt, Human
auugauuuugaac

SEQ ID NO: 1446819 - RNA, 12 nt, Human
auugauuuugaa

SEQ ID NO: 1446820 - RNA, 12 nt, Human
auugauuuuugg

SEQ ID NO: 1446821 - RNA, 20 nt, Human
auugauuugcauugaacaca

SEQ ID NO: 1446822 - RNA, 16 nt, Human
auugauuugcauugaa

SEQ ID NO: 1446823 - RNA, 15 nt, Human
auugauuugcauuga

SEQ ID NO: 1446824 - RNA, 13 nt, Human
auugauuugcauu

SEQ ID NO: 1446825 - RNA, 12 nt, Human
auugauuugcau

SEQ ID NO: 1446826 - RNA, 16 nt, Human
auugauuugaagaaca

SEQ ID NO: 1446827 - RNA, 14 nt, Human
auugauuugaagaa

SEQ ID NO: 1446828 - RNA, 23 nt, Human
auugcacguggccucuugagcag

SEQ ID NO: 1446829 - RNA, 19 nt, Human
auugcacguggccucuuga

SEQ ID NO: 1446830 - RNA, 17 nt, Human
auugcacguggccucuu

SEQ ID NO: 1446831 - RNA, 16 nt, Human
auugcacguggccucu

SEQ ID NO: 1446832 - RNA, 15 nt, Human
auugcacguggccuc

SEQ ID NO: 1446833 - RNA, 15 nt, Human
auugcacauuguaaa

SEQ ID NO: 1446834 - RNA, 22 nt, Human
auuggcauggaaauuuaaagca

SEQ ID NO: 1446835 - RNA, 23 nt, Human
auuggcauggaaauuuaaagcag

SEQ ID NO: 1446836 - RNA, 19 nt, Human
auuggcuagagguucaaag

SEQ ID NO: 1446837 - RNA, 20 nt, Human
auuggcuagagguucaaaga

SEQ ID NO: 1446838 - RNA, 22 nt, Human
auuggcuagagguucaaagaua

SEQ ID NO: 1446839 - RNA, 21 nt, Human
auuggcauggaaauuuaaagc

SEQ ID NO: 1446840 - RNA, 15 nt, Human
auuggcauggaaauu

SEQ ID NO: 1446841 - RNA, 19 nt, Human
auuggagcucgugggacag

SEQ ID NO: 1446842 - RNA, 17 nt, Human
auuggagcucgugggac

SEQ ID NO: 1446843 - RNA, 16 nt, Human
auuggagcucguggaa

SEQ ID NO: 1446844 - RNA, 18 nt, Human
auuggcuauuuaaaacuu

SEQ ID NO: 1446845 - RNA, 17 nt, Human
auuggcuauuuaaaacu

SEQ ID NO: 1446846 - RNA, 22 nt, Human
auuggccuguagaguugcugag

SEQ ID NO: 1446847 - RNA, 21 nt, Human
auuggccuguagaguugcuga

SEQ ID NO: 1446848 - RNA, 20 nt, Human
auuggccuguagaguugcug

SEQ ID NO: 1446849 - RNA, 12 nt, Human
auuggccuguag

SEQ ID NO: 1446850 - RNA, 23 nt, Human
auuggcuagagguucaaagauau

SEQ ID NO: 1446851 - RNA, 22 nt, Human
auuggggaagagagccugcagg

SEQ ID NO: 1446852 - RNA, 16 nt, Human
auuggggaagagagcc

SEQ ID NO: 1446853 - RNA, 23 nt, Human
auuggccuguagaguugcugaga

SEQ ID NO: 1446854 - RNA, 22 nt, Human
auuguacuaaagccaaacauau

SEQ ID NO: 1446855 - RNA, 15 nt, Human
auuguacuaaagcca

SEQ ID NO: 1446856 - RNA, 23 nt, Human
auuggggaagagagccugcagga

SEQ ID NO: 1446857 - RNA, 23 nt, Human
auugcaucucccagauaauguga

SEQ ID NO: 1446858 - RNA, 22 nt, Human
auugcaucucccagauaaugug

SEQ ID NO: 1446859 - RNA, 15 nt, Human
auugcaucucccaga

SEQ ID NO: 1446860 - RNA, 16 nt, Human
auugcaucaaagcauc

SEQ ID NO: 1446861 - RNA, 15 nt, Human
auugcauugacuuuc

SEQ ID NO: 1446862 - RNA, 14 nt, Human
auugcauugacuuu

SEQ ID NO: 1446863 - RNA, 18 nt, Human
auugccuuaacuggagcc

SEQ ID NO: 1446864 - RNA, 11 nt, Human
auugcauugac

SEQ ID NO: 1446865 - RNA, 15 nt, Human
auuggacccuuccau

SEQ ID NO: 1446866 - RNA, 24 nt, Human
auuggaagagcagcaccuccucag

SEQ ID NO: 1446867 - RNA, 22 nt, Human
auuggaagagcagcaccuccuc

SEQ ID NO: 1446868 - RNA, 21 nt, Human
auuggaagagcagcaccuccu

SEQ ID NO: 1446869 - RNA, 15 nt, Human
auuggaacuggaggc

SEQ ID NO: 1446870 - RNA, 18 nt, Human
auuggaacuggaggcagg

SEQ ID NO: 1446871 - RNA, 14 nt, Human
auuggaacuggagg

SEQ ID NO: 1446872 - RNA, 16 nt, Human
auuggaaauuuagcau

SEQ ID NO: 1446873 - RNA, 18 nt, Human
auugcgagagaugugugu

SEQ ID NO: 1446874 - RNA, 17 nt, Human
auugcgagagaugugug

SEQ ID NO: 1446875 - RNA, 16 nt, Human
auugcgagagaugugu

SEQ ID NO: 1446876 - RNA, 15 nt, Human
auugcgagagaugug

SEQ ID NO: 1446877 - RNA, 14 nt, Human
auugcgagagaugu

SEQ ID NO: 1446878 - RNA, 13 nt, Human
auugcgagagaug

SEQ ID NO: 1446879 - RNA, 23 nt, Human
auugccuuuuuucuguauaaaug

SEQ ID NO: 1446880 - RNA, 18 nt, Human
auugccuuuuuucuguau

SEQ ID NO: 1446881 - RNA, 17 nt, Human
auugccuuuuuucugua

SEQ ID NO: 1446882 - RNA, 14 nt, Human
auuggaaacaaguc

SEQ ID NO: 1446883 - RNA, 22 nt, Human
auuucuuugaaaaaaaauaaau

SEQ ID NO: 1446884 - RNA, 15 nt, Human
auuucuuugaaaaaa

SEQ ID NO: 1446885 - RNA, 12 nt, Human
auuucuuugaaa

SEQ ID NO: 1446886 - RNA, 17 nt, Human
auuugagagaaauauga

SEQ ID NO: 1446887 - RNA, 22 nt, Human
auuugacuuuucuguaauucag

SEQ ID NO: 1446888 - RNA, 16 nt, Human
auuucuuugaaaaaaa

SEQ ID NO: 1446889 - RNA, 17 nt, Human
auuugaggucuguucuu

SEQ ID NO: 1446890 - RNA, 18 nt, Human
auuugaggucuguucuuu

SEQ ID NO: 1446891 - RNA, 21 nt, Human
auuuggaguguuccccuucca

SEQ ID NO: 1446892 - RNA, 23 nt, Human
auuuggagggaagcucuuggagc

SEQ ID NO: 1446893 - RNA, 19 nt, Human
auuuggagggaagcucuug

SEQ ID NO: 1446894 - RNA, 18 nt, Human
auuugauguaauacuucu

SEQ ID NO: 1446895 - RNA, 17 nt, Human
auuugauguaauacuuc

SEQ ID NO: 1446896 - RNA, 13 nt, Human
auuugauguaaua

SEQ ID NO: 1446897 - RNA, 18 nt, Human
auuugagagaaauaugaa

SEQ ID NO: 1446898 - RNA, 22 nt, Human
auuugaggucuguucuuuccaa

SEQ ID NO: 1446899 - RNA, 21 nt, Human
auuugaggucuguucuuucca

SEQ ID NO: 1446900 - RNA, 19 nt, Human
auuugauaugugaacaguu

SEQ ID NO: 1446901 - RNA, 18 nt, Human
auuugauaugugaacagu

SEQ ID NO: 1446902 - RNA, 17 nt, Human
auuuggcaucccugggc

SEQ ID NO: 1446903 - RNA, 21 nt, Human
auuugguucauuaauucuaua

SEQ ID NO: 1446904 - RNA, 16 nt, Human
auuugguucauuaauu

SEQ ID NO: 1446905 - RNA, 16 nt, Human
auuuggcaucccuggg

SEQ ID NO: 1446906 - RNA, 14 nt, Human
auuuggcaucccug

SEQ ID NO: 1446907 - RNA, 19 nt, Human
auuuggcaaugccaucauc

SEQ ID NO: 1446908 - RNA, 20 nt, Human
auuuggcaucccugggccuu

SEQ ID NO: 1446909 - RNA, 21 nt, Human
auuuggugguuucagaaaugu

SEQ ID NO: 1446910 - RNA, 23 nt, Human
auuuggauuuaaaagccugcuca

SEQ ID NO: 1446911 - RNA, 20 nt, Human
auuuggauuuaaaagccugc

SEQ ID NO: 1446912 - RNA, 18 nt, Human
auuuggauuuaaaagccu

SEQ ID NO: 1446913 - RNA, 15 nt, Human
auuuggauccugugu

SEQ ID NO: 1446914 - RNA, 21 nt, Human
auuuguacauaguuauuuauu

SEQ ID NO: 1446915 - RNA, 23 nt, Human
auuuguaauuaaaagcaaaucau

SEQ ID NO: 1446916 - RNA, 22 nt, Human
auuuguaauuaaaagcaaauca

SEQ ID NO: 1446917 - RNA, 21 nt, Human
auuuguaauuaaaagcaaauc

SEQ ID NO: 1446918 - RNA, 19 nt, Human
auuuguaauuaaaagcaaa

SEQ ID NO: 1446919 - RNA, 13 nt, Human
auuuguaauuaaa

SEQ ID NO: 1446920 - RNA, 23 nt, Human
auuuguaaugucuugagcucuau

SEQ ID NO: 1446921 - RNA, 20 nt, Human
auuuguaaugucuugagcuc

SEQ ID NO: 1446922 - RNA, 19 nt, Human
auuuguaaugucuugagcu

SEQ ID NO: 1446923 - RNA, 22 nt, Human
auuuguaauagauguuugauag

SEQ ID NO: 1446924 - RNA, 17 nt, Human
auuuguaauagauguuu

SEQ ID NO: 1446925 - RNA, 14 nt, Human
auuugguuuucaca

SEQ ID NO: 1446926 - RNA, 12 nt, Human
auuugguuuuca

SEQ ID NO: 1446927 - RNA, 14 nt, Human
auuuccuaaauaua

SEQ ID NO: 1446928 - RNA, 15 nt, Human
auuuccuaguucugu

SEQ ID NO: 1446929 - RNA, 18 nt, Human
auuuccuaguucuguaga

SEQ ID NO: 1446930 - RNA, 20 nt, Human
auuuccuaguucuguagaaa

SEQ ID NO: 1446931 - RNA, 18 nt, Human
auuuccuaucaccuauuu

SEQ ID NO: 1446932 - RNA, 22 nt, Human
auuuccuaguucuguagaaaug

SEQ ID NO: 1446933 - RNA, 21 nt, Human
auuuccuaauacugucauccu

SEQ ID NO: 1446934 - RNA, 17 nt, Human
auuuccuaauacuguca

SEQ ID NO: 1446935 - RNA, 21 nt, Human
auuuccuaaauauauuuuaag

SEQ ID NO: 1446936 - RNA, 19 nt, Human
auuucuuaacuucuugcuu

SEQ ID NO: 1446937 - RNA, 14 nt, Human
auuucuuaacuucu

SEQ ID NO: 1446938 - RNA, 17 nt, Human
auuucuuaacuucuugc

SEQ ID NO: 1446939 - RNA, 14 nt, Human
auuucuaaaaucuu

SEQ ID NO: 1446940 - RNA, 20 nt, Human
auuucggauuuuuuccaaaa

SEQ ID NO: 1446941 - RNA, 19 nt, Human
auuucggauuuuuuccaaa

SEQ ID NO: 1446942 - RNA, 17 nt, Human
auuucggauuuuuucca

SEQ ID NO: 1446943 - RNA, 19 nt, Human
auuuccuuuuuuguuauua

SEQ ID NO: 1446944 - RNA, 20 nt, Human
auuuccuccgucaccucaga

SEQ ID NO: 1446945 - RNA, 16 nt, Human
auuuccuccacaaauu

SEQ ID NO: 1446946 - RNA, 19 nt, Human
auuuccuauuuuuggaaga

SEQ ID NO: 1446947 - RNA, 22 nt, Human
auuuccucaacguugcucccca

SEQ ID NO: 1446948 - RNA, 24 nt, Human
auuuccucaacguugcuccccauc

SEQ ID NO: 1446949 - RNA, 23 nt, Human
auuuccuugaauguggcuugaga

SEQ ID NO: 1446950 - RNA, 15 nt, Human
auuucaugauuagaa

SEQ ID NO: 1446951 - RNA, 18 nt, Human
auuucaugcuaucucugu

SEQ ID NO: 1446952 - RNA, 15 nt, Human
auuucaugauuucau

SEQ ID NO: 1446953 - RNA, 16 nt, Human
auuucauguuuuugau

SEQ ID NO: 1446954 - RNA, 22 nt, Human
auuuauuuuuucuuuucuuuac

SEQ ID NO: 1446955 - RNA, 17 nt, Human
auuuauuuuuucuuuuc

SEQ ID NO: 1446956 - RNA, 21 nt, Human
auuuauuuugacauaaaguug

SEQ ID NO: 1446957 - RNA, 14 nt, Human
auuuauuuugacau

SEQ ID NO: 1446958 - RNA, 13 nt, Human
auuuauuuugaca

SEQ ID NO: 1446959 - RNA, 12 nt, Human
auuuauuuugac

SEQ ID NO: 1446960 - RNA, 16 nt, Human
auuuauuguauucugg

SEQ ID NO: 1446961 - RNA, 15 nt, Human
auuuauugguuuugc

SEQ ID NO: 1446962 - RNA, 14 nt, Human
auuuauugguuuug

SEQ ID NO: 1446963 - RNA, 20 nt, Human
auuuauuacuguaagaaaau

SEQ ID NO: 1446964 - RNA, 19 nt, Human
auuuauuacuguaagaaaa

SEQ ID NO: 1446965 - RNA, 21 nt, Human
auuuauugcaggauggugucu

SEQ ID NO: 1446966 - RNA, 16 nt, Human
auuuaguguucauaaa

SEQ ID NO: 1446967 - RNA, 16 nt, Human
auuuaguuguaaacca

SEQ ID NO: 1446968 - RNA, 17 nt, Human
auuuagaaaacuuuaaa

SEQ ID NO: 1446969 - RNA, 14 nt, Human
auuuagaaaacuuu

SEQ ID NO: 1446970 - RNA, 13 nt, Human
auuuagaaaacuu

SEQ ID NO: 1446971 - RNA, 17 nt, Human
auuuaguguucauaaau

SEQ ID NO: 1446972 - RNA, 22 nt, Human
auuuauguauugugcaaugugu

SEQ ID NO: 1446973 - RNA, 15 nt, Human
auuuauguccaggug

SEQ ID NO: 1446974 - RNA, 19 nt, Human
auuuauguauugugcaaug

SEQ ID NO: 1446975 - RNA, 18 nt, Human
auuuauguauugugcaau

SEQ ID NO: 1446976 - RNA, 17 nt, Human
auuuauguauugugcaa

SEQ ID NO: 1446977 - RNA, 14 nt, Human
auuuauguauugug

SEQ ID NO: 1446978 - RNA, 12 nt, Human
auuuauguauug

SEQ ID NO: 1446979 - RNA, 14 nt, Human
auuuauguauggug

SEQ ID NO: 1446980 - RNA, 23 nt, Human
auuuaugguuguuaaaaauguca

SEQ ID NO: 1446981 - RNA, 15 nt, Human
auuuaugguuguuaa

SEQ ID NO: 1446982 - RNA, 20 nt, Human
auuuauaacguguucaauau

SEQ ID NO: 1446983 - RNA, 22 nt, Human
auuuauaaauauauuuaagaua

SEQ ID NO: 1446984 - RNA, 15 nt, Human
auuuauaaacuuuuu

SEQ ID NO: 1446985 - RNA, 22 nt, Human
auuuaaaauagcaaaagaagaa

SEQ ID NO: 1446986 - RNA, 21 nt, Human
auuuaaaauagcaaaagaaga

SEQ ID NO: 1446987 - RNA, 20 nt, Human
auuuaaaauagcaaaagaag

SEQ ID NO: 1446988 - RNA, 18 nt, Human
auuuaaaauagcaaaaga

SEQ ID NO: 1446989 - RNA, 15 nt, Human
auuuaaaauagcaaa

SEQ ID NO: 1446990 - RNA, 13 nt, Human
auuuaaaauagca

SEQ ID NO: 1446991 - RNA, 16 nt, Human
auuuaaaauaauuaua

SEQ ID NO: 1446992 - RNA, 15 nt, Human
auuuaaaagugucaa

SEQ ID NO: 1446993 - RNA, 17 nt, Human
auuuaaaagccugcuca

SEQ ID NO: 1446994 - RNA, 15 nt, Human
auuuaaaagccugcu

SEQ ID NO: 1446995 - RNA, 14 nt, Human
auuuaaaagccugc

SEQ ID NO: 1446996 - RNA, 19 nt, Human
auuguuuuaucugaauuuu

SEQ ID NO: 1446997 - RNA, 19 nt, Human
auuguuuuacaauaguucu

SEQ ID NO: 1446998 - RNA, 23 nt, Human
auuguagugcuuugagagagaaa

SEQ ID NO: 1446999 - RNA, 14 nt, Human
auuguagugcuuug

SEQ ID NO: 1447000 - RNA, 13 nt, Human
auuguaguaaucu

SEQ ID NO: 1447001 - RNA, 20 nt, Human
auuguagcgucuuucuuuuu

SEQ ID NO: 1447002 - RNA, 21 nt, Human
auuguacuaaagccaaacaua

SEQ ID NO: 1447003 - RNA, 20 nt, Human
auuguagcauccuggaauau

SEQ ID NO: 1447004 - RNA, 17 nt, Human
auuguagcauccuggaa

SEQ ID NO: 1447005 - RNA, 16 nt, Human
auuguaguccuguaau

SEQ ID NO: 1447006 - RNA, 21 nt, Human
auuuaaauacagucuuccauu

SEQ ID NO: 1447007 - RNA, 23 nt, Human
auuuaaaauagcaaaagaagaag

SEQ ID NO: 1447008 - RNA, 16 nt, Human
auuuaaauagcuuuuu

SEQ ID NO: 1447009 - RNA, 16 nt, Human
auuuacaggaacuuca

SEQ ID NO: 1447010 - RNA, 15 nt, Human
auuuacaggaacuuc

SEQ ID NO: 1447011 - RNA, 13 nt, Human
auuuaaaucuguu

SEQ ID NO: 1447012 - RNA, 19 nt, Human
auuuaaauguaaagacaaa

SEQ ID NO: 1447013 - RNA, 15 nt, Human
auuuacauuuaauag

SEQ ID NO: 1447014 - RNA, 19 nt, Human
auuuacauguuuuaaagaa

SEQ ID NO: 1447015 - RNA, 22 nt, Human
auuuaccacuuguguuuugcaa

SEQ ID NO: 1447016 - RNA, 16 nt, Human
auuuacaucauuucuu

SEQ ID NO: 1447017 - RNA, 18 nt, Human
auuuacaugaauugcauu

SEQ ID NO: 1447018 - RNA, 20 nt, Human
auuuacaugaauugcauuuu

SEQ ID NO: 1447019 - RNA, 21 nt, Human
auuuacaugaauugcauuuua

SEQ ID NO: 1447020 - RNA, 15 nt, Human
auuuaccacuugugu

SEQ ID NO: 1447021 - RNA, 20 nt, Human
aaucaaucuugcauguaacg

SEQ ID NO: 1447022 - RNA, 12 nt, Human
aaucaauaauau

SEQ ID NO: 1447023 - RNA, 15 nt, Human
aaucaaacauuuuga

SEQ ID NO: 1447024 - RNA, 23 nt, Human
aaucaaacauuuugaaagucugu

SEQ ID NO: 1447025 - RNA, 17 nt, Human
aaucaaacauuuucugg

SEQ ID NO: 1447026 - RNA, 16 nt, Human
aaucaaacauuuucug

SEQ ID NO: 1447027 - RNA, 13 nt, Human
aaucaaacauuuu

SEQ ID NO: 1447028 - RNA, 19 nt, Human
aaucaaaaucucuccacuu

SEQ ID NO: 1447029 - RNA, 16 nt, Human
aaucaaaaucucucca

SEQ ID NO: 1447030 - RNA, 15 nt, Human
aaucaaaaucucucc

SEQ ID NO: 1447031 - RNA, 12 nt, Human
aaucaaaaucuc

SEQ ID NO: 1447032 - RNA, 20 nt, Human
aaucaaaagggccaaagaac

SEQ ID NO: 1447033 - RNA, 23 nt, Human
aaucaaaagggccaaagaaccaa

SEQ ID NO: 1447034 - RNA, 19 nt, Human
aaucaaaagggccaaagaa

SEQ ID NO: 1447035 - RNA, 18 nt, Human
aaucaaaagggccaaaga

SEQ ID NO: 1447036 - RNA, 20 nt, Human
aaucacgcuuuuugaaaaag

SEQ ID NO: 1447037 - RNA, 16 nt, Human
aaucacgcuuuuugaa

SEQ ID NO: 1447038 - RNA, 15 nt, Human
aaucacgcuuuuuga

SEQ ID NO: 1447039 - RNA, 14 nt, Human
aaucacgcuuuuug

SEQ ID NO: 1447040 - RNA, 18 nt, Human
aaucacgcuuuuugaaaa

SEQ ID NO: 1447041 - RNA, 17 nt, Human
aaucacgcuuuuugaaa

SEQ ID NO: 1447042 - RNA, 16 nt, Human
aaucacgcuuuccuga

SEQ ID NO: 1447043 - RNA, 18 nt, Human
aaucaaucuugcauguaa

SEQ ID NO: 1447044 - RNA, 16 nt, Human
aaucaaucuugcaugu

SEQ ID NO: 1447045 - RNA, 14 nt, Human
aaucaaucuugcau

SEQ ID NO: 1447046 - RNA, 21 nt, Human
aauauuaaaucugcuggaguu

SEQ ID NO: 1447047 - RNA, 13 nt, Human
aauauuaaaucug

SEQ ID NO: 1447048 - RNA, 13 nt, Human
aauauguccuggg

SEQ ID NO: 1447049 - RNA, 12 nt, Human
aauauguccugg

SEQ ID NO: 1447050 - RNA, 11 nt, Human
aauaugucagu

SEQ ID NO: 1447051 - RNA, 16 nt, Human
aauauauaucaaauau

SEQ ID NO: 1447052 - RNA, 19 nt, Human
aaugauggcaauuuuguaa

SEQ ID NO: 1447053 - RNA, 18 nt, Human
aaugauggcaauuuugua

SEQ ID NO: 1447054 - RNA, 17 nt, Human
aaugauggcaauuuugu

SEQ ID NO: 1447055 - RNA, 14 nt, Human
aaugauggcaauuu

SEQ ID NO: 1447056 - RNA, 19 nt, Human
aaugaaguuugaauguuaa

SEQ ID NO: 1447057 - RNA, 20 nt, Human
aaugaaguuugaauguuaaa

SEQ ID NO: 1447058 - RNA, 21 nt, Human
aaugaaguuugaauguuaaau

SEQ ID NO: 1447059 - RNA, 22 nt, Human
aaugaaguuugaauguuaaaua

SEQ ID NO: 1447060 - RNA, 20 nt, Human
aaugaauacuuuauaaagga

SEQ ID NO: 1447061 - RNA, 20 nt, Human
aaugaagauacugaaauaaa

SEQ ID NO: 1447062 - RNA, 17 nt, Human
aaugaaguuugaauguu

SEQ ID NO: 1447063 - RNA, 18 nt, Human
aaugaaguuugaauguua

SEQ ID NO: 1447064 - RNA, 23 nt, Human
aaugaagcaaaugucaugcugcc

SEQ ID NO: 1447065 - RNA, 24 nt, Human
aaugaagaucuaaauaaaaugcua

SEQ ID NO: 1447066 - RNA, 12 nt, Human
aaugaagaucua

SEQ ID NO: 1447067 - RNA, 14 nt, Human
aaugaagcaaugcu

SEQ ID NO: 1447068 - RNA, 17 nt, Human
aaucugacccagugccc

SEQ ID NO: 1447069 - RNA, 15 nt, Human
aaucugacccagugc

SEQ ID NO: 1447070 - RNA, 14 nt, Human
aaucugacccagug

SEQ ID NO: 1447071 - RNA, 13 nt, Human
aaucugacccagu

SEQ ID NO: 1447072 - RNA, 12 nt, Human
aaucugacccag

SEQ ID NO: 1447073 - RNA, 21 nt, Human
aaucucaguugauuuucugga

SEQ ID NO: 1447074 - RNA, 16 nt, Human
aaucucaguugauuuu

SEQ ID NO: 1447075 - RNA, 22 nt, Human
aaucucaguugauuuucuggau

SEQ ID NO: 1447076 - RNA, 16 nt, Human
aaucucaauauuucag

SEQ ID NO: 1447077 - RNA, 17 nt, Human
aaucucaauucuucccu

SEQ ID NO: 1447078 - RNA, 21 nt, Human
aauaauguguaguucauguaa

SEQ ID NO: 1447079 - RNA, 20 nt, Human
aauaauguguaguucaugua

SEQ ID NO: 1447080 - RNA, 22 nt, Human
aauaauguguaguucauguaaa

SEQ ID NO: 1447081 - RNA, 19 nt, Human
aauaauguguaguucaugu

SEQ ID NO: 1447082 - RNA, 14 nt, Human
aauaauguguaguu

SEQ ID NO: 1447083 - RNA, 17 nt, Human
aauaaugugcacugaau

SEQ ID NO: 1447084 - RNA, 12 nt, Human
aauaaagaaugg

SEQ ID NO: 1447085 - RNA, 17 nt, Human
aauaaagaaaagaugca

SEQ ID NO: 1447086 - RNA, 20 nt, Human
aauaaagaaaagaugcacuu

SEQ ID NO: 1447087 - RNA, 16 nt, Human
aauaaagaaaagaugc

SEQ ID NO: 1447088 - RNA, 15 nt, Human
aauaaagaaaagaug

SEQ ID NO: 1447089 - RNA, 17 nt, Human
aauaaagaauggaaagc

SEQ ID NO: 1447090 - RNA, 11 nt, Human
aauaaagcaau

SEQ ID NO: 1447091 - RNA, 12 nt, Human
aauaaagcaauu

SEQ ID NO: 1447092 - RNA, 14 nt, Human
aauaaagcagcguu

SEQ ID NO: 1447093 - RNA, 17 nt, Human
aauaaugugaaacugga

SEQ ID NO: 1447094 - RNA, 22 nt, Human
aauaaugugaaacuggauuaaa

SEQ ID NO: 1447095 - RNA, 17 nt, Human
aaguggacucagggcag

SEQ ID NO: 1447096 - RNA, 19 nt, Human
aaguggccaagaagcagug

SEQ ID NO: 1447097 - RNA, 22 nt, Human
aagugcugcauuuaaaagauac

SEQ ID NO: 1447098 - RNA, 14 nt, Human
aaguuguaaaguau

SEQ ID NO: 1447099 - RNA, 17 nt, Human
aaguuguaaaguaugua

SEQ ID NO: 1447100 - RNA, 21 nt, Human
aaguugggcuugcuauucugu

SEQ ID NO: 1447101 - RNA, 20 nt, Human
aaguugggcuugcuauucug

SEQ ID NO: 1447102 - RNA, 17 nt, Human
aaguugggcuugcuauu

SEQ ID NO: 1447103 - RNA, 21 nt, Human
aaguuggggacacauguauuu

SEQ ID NO: 1447104 - RNA, 23 nt, Human
aaguuggaguuuuguuuccucug

SEQ ID NO: 1447105 - RNA, 12 nt, Human
aaguugaauuuu

SEQ ID NO: 1447106 - RNA, 14 nt, Human
aauaaagaaaagau

SEQ ID NO: 1447107 - RNA, 13 nt, Human
aauaaagaaaaga

SEQ ID NO: 1447108 - RNA, 13 nt, Human
aauaaacuuuaau

SEQ ID NO: 1447109 - RNA, 19 nt, Human
aauaaacacucuugaaaaa

SEQ ID NO: 1447110 - RNA, 17 nt, Human
aaguuuaauaaauuuau

SEQ ID NO: 1447111 - RNA, 14 nt, Human
aaguuuaauaaauu

SEQ ID NO: 1447112 - RNA, 11 nt, Human
aauaaacacuc

SEQ ID NO: 1447113 - RNA, 16 nt, Human
aauaaacacucuugaa

SEQ ID NO: 1447114 - RNA, 24 nt, Human
aagagucuaaagauggaguuucua

SEQ ID NO: 1447115 - RNA, 14 nt, Human
aagagucuaaagau

SEQ ID NO: 1447116 - RNA, 13 nt, Human
aagagucuaaaga

SEQ ID NO: 1447117 - RNA, 15 nt, Human
aagaguuuaaaauca

SEQ ID NO: 1447118 - RNA, 14 nt, Human
aagaguuggcuggu

SEQ ID NO: 1447119 - RNA, 16 nt, Human
aagaguucaagaaaua

SEQ ID NO: 1447120 - RNA, 14 nt, Human
aagaguucaagaaa

SEQ ID NO: 1447121 - RNA, 18 nt, Human
aagacaccguucauucag

SEQ ID NO: 1447122 - RNA, 21 nt, Human
aagacacauuuuuuaggaaau

SEQ ID NO: 1447123 - RNA, 22 nt, Human
aagacaagaacuccccuuuuuu

SEQ ID NO: 1447124 - RNA, 22 nt, Human
aagacaaugacuuacuguacau

SEQ ID NO: 1447125 - RNA, 13 nt, Human
aagaagaagggca

SEQ ID NO: 1447126 - RNA, 18 nt, Human
aagaacuuugagcuacug

SEQ ID NO: 1447127 - RNA, 13 nt, Human
aagaacuuugagc

SEQ ID NO: 1447128 - RNA, 17 nt, Human
aagaacuuuaaauugug

SEQ ID NO: 1447129 - RNA, 20 nt, Human
aagaacuuugagcuacugcc

SEQ ID NO: 1447130 - RNA, 16 nt, Human
aagaagacaaacuuug

SEQ ID NO: 1447131 - RNA, 19 nt, Human
aagaagacaaacuuugcau

SEQ ID NO: 1447132 - RNA, 15 nt, Human
aagaagacaaacuuu

SEQ ID NO: 1447133 - RNA, 15 nt, Human
aagaagacugcauua

SEQ ID NO: 1447134 - RNA, 21 nt, Human
aagaagaccugagaauguauc

SEQ ID NO: 1447135 - RNA, 20 nt, Human
aagaagaccugagaauguau

SEQ ID NO: 1447136 - RNA, 20 nt, Human
aagaagacugcauuauauuu

SEQ ID NO: 1447137 - RNA, 21 nt, Human
aagacaaggaaaaaauaacaa

SEQ ID NO: 1447138 - RNA, 23 nt, Human
aagaacugcaggcccuggccucc

SEQ ID NO: 1447139 - RNA, 22 nt, Human
aagaacugcaggcccuggccuc

SEQ ID NO: 1447140 - RNA, 18 nt, Human
aagaacugcaggcccugg

SEQ ID NO: 1447141 - RNA, 15 nt, Human
aagaacugaaaucau

SEQ ID NO: 1447142 - RNA, 13 nt, Human
aagaacugaaauc

SEQ ID NO: 1447143 - RNA, 12 nt, Human
aagaacugaaau

SEQ ID NO: 1447144 - RNA, 13 nt, Human
aagaaccacuugu

SEQ ID NO: 1447145 - RNA, 11 nt, Human
aagaacugaaa

SEQ ID NO: 1447146 - RNA, 20 nt, Human
aagaaccaguccccccaccc

SEQ ID NO: 1447147 - RNA, 17 nt, Human
aagaaccagucccccca

SEQ ID NO: 1447148 - RNA, 16 nt, Human
aagaaccaaagaagaa

SEQ ID NO: 1447149 - RNA, 11 nt, Human
aagaacaugug

SEQ ID NO: 1447150 - RNA, 14 nt, Human
aagaaccuggaacu

SEQ ID NO: 1447151 - RNA, 14 nt, Human
aagaacggaagaag

SEQ ID NO: 1447152 - RNA, 21 nt, Human
aagacaugauuuccuugaaug

SEQ ID NO: 1447153 - RNA, 15 nt, Human
aagaccacguuucua

SEQ ID NO: 1447154 - RNA, 17 nt, Human
aagaccacguuucuaaa

SEQ ID NO: 1447155 - RNA, 20 nt, Human
aagacaugauuuccuugaau

SEQ ID NO: 1447156 - RNA, 16 nt, Human
aagacaugauuuccuu

SEQ ID NO: 1447157 - RNA, 15 nt, Human
aagacaugauuuccu

SEQ ID NO: 1447158 - RNA, 14 nt, Human
aagacaugauuucc

SEQ ID NO: 1447159 - RNA, 12 nt, Human
aagacaugaagc

SEQ ID NO: 1447160 - RNA, 18 nt, Human
aagacagaaguuugcacu

SEQ ID NO: 1447161 - RNA, 16 nt, Human
aagacagaaguuugca

SEQ ID NO: 1447162 - RNA, 20 nt, Human
aagacagaaccacagggcua

SEQ ID NO: 1447163 - RNA, 22 nt, Human
aagacagagccccacccucaga

SEQ ID NO: 1447164 - RNA, 20 nt, Human
aagagaaacaguugguaacu

SEQ ID NO: 1447165 - RNA, 11 nt, Human
aagagaaaaag

SEQ ID NO: 1447166 - RNA, 14 nt, Human
aagagacagugaua

SEQ ID NO: 1447167 - RNA, 16 nt, Human
aagagauaacuguaaa

SEQ ID NO: 1447168 - RNA, 14 nt, Human
aagagauacagagg

SEQ ID NO: 1447169 - RNA, 15 nt, Human
aagagaucaggaaga

SEQ ID NO: 1447170 - RNA, 16 nt, Human
aagagaucaggaagag

SEQ ID NO: 1447171 - RNA, 22 nt, Human
aagagaucaggaagagaaggag

SEQ ID NO: 1447172 - RNA, 17 nt, Human
aaggcauacgagagcag

SEQ ID NO: 1447173 - RNA, 19 nt, Human
aaggcaguuugcaaaaaau

SEQ ID NO: 1447174 - RNA, 15 nt, Human
aaggcaguuuucuaa

SEQ ID NO: 1447175 - RNA, 15 nt, Human
aaggcaguuugcaaa

SEQ ID NO: 1447176 - RNA, 23 nt, Human
aaggcaguuaccauuaaaccauc

SEQ ID NO: 1447177 - RNA, 22 nt, Human
aaggcaguuaccauuaaaccau

SEQ ID NO: 1447178 - RNA, 22 nt, Human
aaggcauacgagagcagagguc

SEQ ID NO: 1447179 - RNA, 21 nt, Human
aaggcauacgagagcagaggu

SEQ ID NO: 1447180 - RNA, 13 nt, Human
aagcugaguauua

SEQ ID NO: 1447181 - RNA, 19 nt, Human
aaggcagggaggaggcaga

SEQ ID NO: 1447182 - RNA, 14 nt, Human
aaggcagggaggag

SEQ ID NO: 1447183 - RNA, 18 nt, Human
aaggcaagcacuuguggg

SEQ ID NO: 1447184 - RNA, 21 nt, Human
aaggcaacaaaagaagcccgg

SEQ ID NO: 1447185 - RNA, 22 nt, Human
aaggcaacaaaagaagcccggc

SEQ ID NO: 1447186 - RNA, 16 nt, Human
aaggagaaucaucagg

SEQ ID NO: 1447187 - RNA, 17 nt, Human
aaggagaaucaucagga

SEQ ID NO: 1447188 - RNA, 18 nt, Human
aaggagaaucaucaggac

SEQ ID NO: 1447189 - RNA, 19 nt, Human
aaggagaaucaucaggacc

SEQ ID NO: 1447190 - RNA, 15 nt, Human
aaggagaaccagcac

SEQ ID NO: 1447191 - RNA, 17 nt, Human
aaggacuuuguacauuu

SEQ ID NO: 1447192 - RNA, 15 nt, Human
aaggacuuuguacau

SEQ ID NO: 1447193 - RNA, 14 nt, Human
aaggacuuuguaca

SEQ ID NO: 1447194 - RNA, 18 nt, Human
aagcugauuuuuuuuaau

SEQ ID NO: 1447195 - RNA, 15 nt, Human
aagcugauuaaauga

SEQ ID NO: 1447196 - RNA, 16 nt, Human
aagcugauuaaaugac

SEQ ID NO: 1447197 - RNA, 22 nt, Human
aagcugaguuuccuaugggaac

SEQ ID NO: 1447198 - RNA, 15 nt, Human
aagcugaguuuccua

SEQ ID NO: 1447199 - RNA, 14 nt, Human
aagcugaguuuccu

SEQ ID NO: 1447200 - RNA, 13 nt, Human
aagcugaguuucc

SEQ ID NO: 1447201 - RNA, 23 nt, Human
aagcugaguuaggugucuguccu

SEQ ID NO: 1447202 - RNA, 22 nt, Human
aagcugaguuaggugucugucc

SEQ ID NO: 1447203 - RNA, 19 nt, Human
aagcugaguauuaaaaugu

SEQ ID NO: 1447204 - RNA, 18 nt, Human
aagcugaguauuaaaaug

SEQ ID NO: 1447205 - RNA, 21 nt, Human
aagcuagacacaugaagguaa

SEQ ID NO: 1447206 - RNA, 17 nt, Human
aagcuagacacaugaag

SEQ ID NO: 1447207 - RNA, 16 nt, Human
aagcuagacacaugaa

SEQ ID NO: 1447208 - RNA, 15 nt, Human
aagcuagacacauga

SEQ ID NO: 1447209 - RNA, 19 nt, Human
aagcuagaauugaguguuu

SEQ ID NO: 1447210 - RNA, 22 nt, Human
aagcuagacacaugaagguaaa

SEQ ID NO: 1447211 - RNA, 20 nt, Human
aagcuagacacaugaaggua

SEQ ID NO: 1447212 - RNA, 18 nt, Human
aagcuagacacaugaagg

SEQ ID NO: 1447213 - RNA, 22 nt, Human
aagauacagaacucuuucaaaa

SEQ ID NO: 1447214 - RNA, 20 nt, Human
aagauacagaacucuuucaa

SEQ ID NO: 1447215 - RNA, 15 nt, Human
aagauaauucacugu

SEQ ID NO: 1447216 - RNA, 12 nt, Human
aagauaauuaua

SEQ ID NO: 1447217 - RNA, 17 nt, Human
aagauacaguuacucag

SEQ ID NO: 1447218 - RNA, 23 nt, Human
aagauacaguuacucagaauucu

SEQ ID NO: 1447219 - RNA, 23 nt, Human
aagccaggaauuucccaggaccc

SEQ ID NO: 1447220 - RNA, 20 nt, Human
aagaguuugaugaggcccuc

SEQ ID NO: 1447221 - RNA, 16 nt, Human
aagccaggucccucuc

SEQ ID NO: 1447222 - RNA, 15 nt, Human
aagccaggucccucu

SEQ ID NO: 1447223 - RNA, 13 nt, Human
aagccaggucccu

SEQ ID NO: 1447224 - RNA, 24 nt, Human
aagccaggaauuucccaggacccu

SEQ ID NO: 1447225 - RNA, 17 nt, Human
aagccaggucccucuca

SEQ ID NO: 1447226 - RNA, 23 nt, Human
aagccagguuccacagaggacac

SEQ ID NO: 1447227 - RNA, 21 nt, Human
aagccagguuccacagaggac

SEQ ID NO: 1447228 - RNA, 23 nt, Human
aagccaguuuggguaaaauacuu

SEQ ID NO: 1447229 - RNA, 20 nt, Human
aagccaguuuggguaaaaua

SEQ ID NO: 1447230 - RNA, 14 nt, Human
aagcgauucuccug

SEQ ID NO: 1447231 - RNA, 15 nt, Human
aagcgaaaaaaucag

SEQ ID NO: 1447232 - RNA, 14 nt, Human
aagcggugucucuc

SEQ ID NO: 1447233 - RNA, 20 nt, Human
aagcgauucucuugccucaa

SEQ ID NO: 1447234 - RNA, 19 nt, Human
aagcgauucucuugccuca

SEQ ID NO: 1447235 - RNA, 21 nt, Human
aagcggugucucuccugcccc

SEQ ID NO: 1447236 - RNA, 23 nt, Human
aagcuacugugugugugaaugaa

SEQ ID NO: 1447237 - RNA, 22 nt, Human
aagcuacugugugugugaauga

SEQ ID NO: 1447238 - RNA, 13 nt, Human
aagcuacuuauug

SEQ ID NO: 1447239 - RNA, 15 nt, Human
aaaaucucaaauuuc

SEQ ID NO: 1447240 - RNA, 16 nt, Human
aaaaucucaaauuucu

SEQ ID NO: 1447241 - RNA, 18 nt, Human
aaaaucucaaauuucuaa

SEQ ID NO: 1447242 - RNA, 11 nt, Human
aaagaaaaaaa

SEQ ID NO: 1447243 - RNA, 23 nt, Human
aaacuuuuuuucuguaccaguua

SEQ ID NO: 1447244 - RNA, 20 nt, Human
aaacucuguugcaagugcaa

SEQ ID NO: 1447245 - RNA, 19 nt, Human
aaacucuguugcaagugca

SEQ ID NO: 1447246 - RNA, 22 nt, Human
aaacucuguuacacuuuuugga

SEQ ID NO: 1447247 - RNA, 18 nt, Human
aaacucuguuacacuuuu

SEQ ID NO: 1447248 - RNA, 15 nt, Human
aaaccgccagcucug

SEQ ID NO: 1447249 - RNA, 14 nt, Human
aaaccgccagcucu

SEQ ID NO: 1447250 - RNA, 13 nt, Human
aaaccgccagcuc

SEQ ID NO: 1447251 - RNA, 18 nt, Human
aaacccaccugcuagugu

SEQ ID NO: 1447252 - RNA, 22 nt, Human
aaaccgaacugauguaaguaaa

SEQ ID NO: 1447253 - RNA, 24 nt, Human
aaaccagguccaaugagcuuucug

SEQ ID NO: 1447254 - RNA, 22 nt, Human
aaaccagguccaaugagcuuuc

SEQ ID NO: 1447255 - RNA, 20 nt, Human
aaaccagguccaaugagcuu

SEQ ID NO: 1447256 - RNA, 15 nt, Human
aaacccaauccaaau

SEQ ID NO: 1447257 - RNA, 19 nt, Human
aaaccaguguuagggaagg

SEQ ID NO: 1447258 - RNA, 16 nt, Human
aaagauauuuuuaucu

SEQ ID NO: 1447259 - RNA, 21 nt, Human
aaagaaaaaaauugaaaugua

SEQ ID NO: 1447260 - RNA, 22 nt, Human
aaagaaaaaaauugaaauguaa

SEQ ID NO: 1447261 - RNA, 19 nt, Human
aaagaaaaaaauugaaaug

SEQ ID NO: 1447262 - RNA, 18 nt, Human
aaagaaaaaaauugaaau

SEQ ID NO: 1447263 - RNA, 16 nt, Human
aaagaaaaaaauugaa

SEQ ID NO: 1447264 - RNA, 15 nt, Human
aaagaaaaaaauuga

SEQ ID NO: 1447265 - RNA, 13 nt, Human
aaagaaaaaaauu

SEQ ID NO: 1447266 - RNA, 18 nt, Human
aaagaaaaaaauguauuu

SEQ ID NO: 1447267 - RNA, 22 nt, Human
aaagaaaaaaauguauuuuaug

SEQ ID NO: 1447268 - RNA, 17 nt, Human
aaagaaaaaaauguauu

SEQ ID NO: 1447269 - RNA, 23 nt, Human
aaagaaaaaaaaccaucaaguug

SEQ ID NO: 1447270 - RNA, 10 nt, Human
aaagaaaaaa

SEQ ID NO: 1447271 - RNA, 20 nt, Human
aaagaucuguccucagccuu

SEQ ID NO: 1447272 - RNA, 19 nt, Human
aaagaucuguccucagccu

SEQ ID NO: 1447273 - RNA, 18 nt, Human
aaagaucuguccucagcc

SEQ ID NO: 1447274 - RNA, 13 nt, Human
aaagaucccaaau

SEQ ID NO: 1447275 - RNA, 13 nt, Human
aaagaucuguuuu

SEQ ID NO: 1447276 - RNA, 21 nt, Human
aaagaucuguccucagccuug

SEQ ID NO: 1447277 - RNA, 16 nt, Human
aaagaucuguuuugaa

SEQ ID NO: 1447278 - RNA, 18 nt, Human
aaagccugggugacauuu

SEQ ID NO: 1447279 - RNA, 17 nt, Human
aaagccugggugacauu

SEQ ID NO: 1447280 - RNA, 12 nt, Human
aaagccugcuca

SEQ ID NO: 1447281 - RNA, 19 nt, Human
aaagccugaguacuccaca

SEQ ID NO: 1447282 - RNA, 13 nt, Human
aaagccaugcugg

SEQ ID NO: 1447283 - RNA, 15 nt, Human
aaaagugaagacaga

SEQ ID NO: 1447284 - RNA, 13 nt, Human
aaaagugaaauaa

SEQ ID NO: 1447285 - RNA, 24 nt, Human
aaaaucagccaauuauguuaaacu

SEQ ID NO: 1447286 - RNA, 22 nt, Human
aaaauaaaacccguugauuacu

SEQ ID NO: 1447287 - RNA, 22 nt, Human
aaaaucagccaauuauguuaaa

SEQ ID NO: 1447288 - RNA, 16 nt, Human
aaaauaaaacuuuuua

SEQ ID NO: 1447289 - RNA, 13 nt, Human
aaaauaaaaaugg

SEQ ID NO: 1447290 - RNA, 14 nt, Human
aaaauaaaacuuuu

SEQ ID NO: 1447291 - RNA, 22 nt, Human
aaaaguugcuauuugaacuuuu

SEQ ID NO: 1447292 - RNA, 21 nt, Human
aaaaguugcagcuguuuuguu

SEQ ID NO: 1447293 - RNA, 18 nt, Human
aaaaguugcagcuguuuu

SEQ ID NO: 1447294 - RNA, 15 nt, Human
aaaaguugcagcugu

SEQ ID NO: 1447295 - RNA, 14 nt, Human
aaaaguugcagcug

SEQ ID NO: 1447296 - RNA, 18 nt, Human
aaaaguugaauuuuacau

SEQ ID NO: 1447297 - RNA, 14 nt, Human
aaaaguugcuauuu

SEQ ID NO: 1447298 - RNA, 23 nt, Human
aaaagaucuguuuugaaggcaaa

SEQ ID NO: 1447299 - RNA, 10 nt, Human
aaaagauccc

SEQ ID NO: 1447300 - RNA, 15 nt, Human
aaaagauauaagugc

SEQ ID NO: 1447301 - RNA, 18 nt, Human
aaaagauauaagugcugu

SEQ ID NO: 1447302 - RNA, 19 nt, Human
aaaagauauaagugcugua

SEQ ID NO: 1447303 - RNA, 23 nt, Human
aaaagauauaagugcuguauaaa

SEQ ID NO: 1447304 - RNA, 12 nt, Human
aaaagauauaag

SEQ ID NO: 1447305 - RNA, 13 nt, Human
aaaagauauaagu

SEQ ID NO: 1447306 - RNA, 14 nt, Human
aaaagauauaagug

SEQ ID NO: 1447307 - RNA, 12 nt, Human
aaaagacucauc

SEQ ID NO: 1447308 - RNA, 11 nt, Human
aaaagacucau

SEQ ID NO: 1447309 - RNA, 10 nt, Human
aaaagacuca

SEQ ID NO: 1447310 - RNA, 17 nt, Human
aaaagauaaacacaaga

SEQ ID NO: 1447311 - RNA, 19 nt, Human
aaaagauaaacacaagauu

SEQ ID NO: 1447312 - RNA, 12 nt, Human
aaaagauaaaca

SEQ ID NO: 1447313 - RNA, 19 nt, Human
aaaacuuuggaaccagacu

SEQ ID NO: 1447314 - RNA, 17 nt, Human
aaaacuuuggaaccaga

SEQ ID NO: 1447315 - RNA, 16 nt, Human
aaaacuuuggaaccag

SEQ ID NO: 1447316 - RNA, 11 nt, Human
aaaacuuugga

SEQ ID NO: 1447317 - RNA, 22 nt, Human
aaaacagguagaauuaucuaau

SEQ ID NO: 1447318 - RNA, 17 nt, Human
aaaacagguagaauuau

SEQ ID NO: 1447319 - RNA, 12 nt, Human
aaaacagguaga

SEQ ID NO: 1447320 - RNA, 23 nt, Human
aaaacaggcacugcccugguggc

SEQ ID NO: 1447321 - RNA, 18 nt, Human
aaaacaggcacugcccug

SEQ ID NO: 1447322 - RNA, 17 nt, Human
aaaacaggcacugcccu

SEQ ID NO: 1447323 - RNA, 17 nt, Human
aaaacagacacuggcau

SEQ ID NO: 1447324 - RNA, 13 nt, Human
aaaacagaagccu

SEQ ID NO: 1447325 - RNA, 14 nt, Human
aaaacagaacacuu

SEQ ID NO: 1447326 - RNA, 13 nt, Human
aaaacacugugca

SEQ ID NO: 1447327 - RNA, 21 nt, Human
aaaacacuaaaaauaaaaaug

SEQ ID NO: 1447328 - RNA, 17 nt, Human
aaaacacauuuuucuua

SEQ ID NO: 1447329 - RNA, 13 nt, Human
aaaagacucaucc

SEQ ID NO: 1447330 - RNA, 15 nt, Human
aaaagacauucagga

SEQ ID NO: 1447331 - RNA, 13 nt, Human
aaaagacauucag

SEQ ID NO: 1447332 - RNA, 20 nt, Human
aaaagacacacuuguccaca

SEQ ID NO: 1447333 - RNA, 22 nt, Human
aaaagaauuguuggggguuuuu

SEQ ID NO: 1447334 - RNA, 13 nt, Human
aaaagaauuguug

SEQ ID NO: 1447335 - RNA, 11 nt, Human
aaaagaaugau

SEQ ID NO: 1447336 - RNA, 11 nt, Human
aaaagaaguaa

SEQ ID NO: 1447337 - RNA, 14 nt, Human
aaaagaagaaguuu

SEQ ID NO: 1447338 - RNA, 20 nt, Human
aaaagacaaggaaaaaauaa

SEQ ID NO: 1447339 - RNA, 19 nt, Human
aaaagaagcccggcuccug

SEQ ID NO: 1447340 - RNA, 12 nt, Human
aaaagaagaagu

SEQ ID NO: 1447341 - RNA, 11 nt, Human
aaaagaaaggc

SEQ ID NO: 1447342 - RNA, 18 nt, Human
aaaagaaaggcuguuaaa

SEQ ID NO: 1447343 - RNA, 12 nt, Human
aaaagaaacuuu

SEQ ID NO: 1447344 - RNA, 13 nt, Human
aaaagaaaaagau

SEQ ID NO: 1447345 - RNA, 22 nt, Human
aaaagaaaaucuuuauaaaugu

SEQ ID NO: 1447346 - RNA, 11 nt, Human
aaaagaaaauu

SEQ ID NO: 1447347 - RNA, 15 nt, Human
aaaagaaaauuuuug

SEQ ID NO: 1447348 - RNA, 13 nt, Human
aaaggaugugauu

SEQ ID NO: 1447349 - RNA, 23 nt, Human
aaaggaugugauauauaagugua

SEQ ID NO: 1447350 - RNA, 19 nt, Human
aaaggaugugauauauaag

SEQ ID NO: 1447351 - RNA, 17 nt, Human
aaaggaugugauauaua

SEQ ID NO: 1447352 - RNA, 14 nt, Human
aaaggaugugauau

SEQ ID NO: 1447353 - RNA, 12 nt, Human
aaaggaugugau

SEQ ID NO: 1447354 - RNA, 18 nt, Human
aaagccuguucauggcag

SEQ ID NO: 1447355 - RNA, 17 nt, Human
aaagccuguucauggca

SEQ ID NO: 1447356 - RNA, 23 nt, Human
aaagccuggguuugguguauggu

SEQ ID NO: 1447357 - RNA, 20 nt, Human
aaagccuggguuugguguau

SEQ ID NO: 1447358 - RNA, 13 nt, Human
aaagccugcucaa

SEQ ID NO: 1447359 - RNA, 16 nt, Human
aaaucucaauucuucc

SEQ ID NO: 1447360 - RNA, 19 nt, Human
aaaucuccaaaauaaaacu

SEQ ID NO: 1447361 - RNA, 23 nt, Human
aaaucuuucuuucuuagaaauuu

SEQ ID NO: 1447362 - RNA, 15 nt, Human
aaaucaaaaucucuc

SEQ ID NO: 1447363 - RNA, 14 nt, Human
aaaucaaaaucucu

SEQ ID NO: 1447364 - RNA, 13 nt, Human
aaaucaaaaucuc

SEQ ID NO: 1447365 - RNA, 22 nt, Human
aaaucaaaagggccaaagaacc

SEQ ID NO: 1447366 - RNA, 22 nt, Human
aaauauuuuuggucauuguaau

SEQ ID NO: 1447367 - RNA, 17 nt, Human
aaaucaaaaucucucca

SEQ ID NO: 1447368 - RNA, 16 nt, Human
aaaucaaaaucucucc

SEQ ID NO: 1447369 - RNA, 18 nt, Human
aaaucucaauauuucaga

SEQ ID NO: 1447370 - RNA, 23 nt, Human
aaaugcuggcuauagaugucuuu

SEQ ID NO: 1447371 - RNA, 11 nt, Human
aaaucuuuuac

SEQ ID NO: 1447372 - RNA, 18 nt, Human
aaaucuuuuauaggauuu

SEQ ID NO: 1447373 - RNA, 14 nt, Human
aaaugaaaaaauau

SEQ ID NO: 1447374 - RNA, 19 nt, Human
aaaugcuuagaaauucagc

SEQ ID NO: 1447375 - RNA, 18 nt, Human
aaaugcuuuuuauuucug

SEQ ID NO: 1447376 - RNA, 17 nt, Human
aaauauuuuaaagaauu

SEQ ID NO: 1447377 - RNA, 16 nt, Human
aaauauuuuaaagaau

SEQ ID NO: 1447378 - RNA, 15 nt, Human
aaauauuuuaaagaa

SEQ ID NO: 1447379 - RNA, 18 nt, Human
aaauauuuuaaagaauug

SEQ ID NO: 1447380 - RNA, 22 nt, Human
aaauauuuugaaucaauaauau

SEQ ID NO: 1447381 - RNA, 14 nt, Human
aaauauuuuaaaga

SEQ ID NO: 1447382 - RNA, 19 nt, Human
aaauauuuuaaaaucagcu

SEQ ID NO: 1447383 - RNA, 22 nt, Human
aaauauuuguacauaguuauuu

SEQ ID NO: 1447384 - RNA, 15 nt, Human
aaauauuuguacaua

SEQ ID NO: 1447385 - RNA, 14 nt, Human
aaauauuuguacau

SEQ ID NO: 1447386 - RNA, 22 nt, Human
aaauauuuagauguaauuuugu

SEQ ID NO: 1447387 - RNA, 21 nt, Human
aaauauuuauuuuaauaaugu

SEQ ID NO: 1447388 - RNA, 17 nt, Human
aaauagcaaaagaagaa

SEQ ID NO: 1447389 - RNA, 21 nt, Human
aaauagauaagaguagaaacu

SEQ ID NO: 1447390 - RNA, 16 nt, Human
aaauagcaaaagaaga

SEQ ID NO: 1447391 - RNA, 22 nt, Human
aaauauuguuuuacaauaguuc

SEQ ID NO: 1447392 - RNA, 13 nt, Human
aaauggccauuug

SEQ ID NO: 1447393 - RNA, 16 nt, Human
aaauggccauuugcuu

SEQ ID NO: 1447394 - RNA, 21 nt, Human
aaauguuuuuggucuuuuaua

SEQ ID NO: 1447395 - RNA, 14 nt, Human
aaauguuuuugguc

SEQ ID NO: 1447396 - RNA, 12 nt, Human
aaauguuuuugg

SEQ ID NO: 1447397 - RNA, 22 nt, Human
aaauguuuuuaauaaaagaaaa

SEQ ID NO: 1447398 - RNA, 21 nt, Human
aaauguuuuuaauaaaagaaa

SEQ ID NO: 1447399 - RNA, 20 nt, Human
aaauguuuuuaauaaaagaa

SEQ ID NO: 1447400 - RNA, 19 nt, Human
aaauguugagaaucccaaa

SEQ ID NO: 1447401 - RNA, 19 nt, Human
aaauguugcugaaaaaugg

SEQ ID NO: 1447402 - RNA, 11 nt, Human
aaauguugcug

SEQ ID NO: 1447403 - RNA, 23 nt, Human
aaauguugacaugggacauuugc

SEQ ID NO: 1447404 - RNA, 21 nt, Human
aaauguuauuuuuuaauuauu

SEQ ID NO: 1447405 - RNA, 21 nt, Human
aaauguucagaagguugcucu

SEQ ID NO: 1447406 - RNA, 15 nt, Human
aaauguucagaaggu

SEQ ID NO: 1447407 - RNA, 16 nt, Human
aaauguucacuuuuga

SEQ ID NO: 1447408 - RNA, 13 nt, Human
aaauguucacuuu

SEQ ID NO: 1447409 - RNA, 22 nt, Human
aaauguugacaugggacauuug

SEQ ID NO: 1447410 - RNA, 18 nt, Human
aaccguuuugaagcuacu

SEQ ID NO: 1447411 - RNA, 17 nt, Human
aaccguuuugaagcuac

SEQ ID NO: 1447412 - RNA, 17 nt, Human
aaccuaaaacucuuucg

SEQ ID NO: 1447413 - RNA, 19 nt, Human
aaccguggcccuuccugga

SEQ ID NO: 1447414 - RNA, 21 nt, Human
aaccguggcccuuccuggaca

SEQ ID NO: 1447415 - RNA, 18 nt, Human
aaccguggcccuuccugg

SEQ ID NO: 1447416 - RNA, 17 nt, Human
aaccguggcccuuccug

SEQ ID NO: 1447417 - RNA, 11 nt, Human
aaccguggccc

SEQ ID NO: 1447418 - RNA, 22 nt, Human
aaccgucuguuaugcugugaca

SEQ ID NO: 1447419 - RNA, 18 nt, Human
aaccgucuguuaugcugu

SEQ ID NO: 1447420 - RNA, 16 nt, Human
aaccgucuguuaugcu

SEQ ID NO: 1447421 - RNA, 17 nt, Human
aaccguagaugauuuca

SEQ ID NO: 1447422 - RNA, 18 nt, Human
aacccucuguuccuuccc

SEQ ID NO: 1447423 - RNA, 18 nt, Human
aacccucagggcaaagcc

SEQ ID NO: 1447424 - RNA, 20 nt, Human
aacccucagggcaaagccag

SEQ ID NO: 1447425 - RNA, 11 nt, Human
aacccucaggg

SEQ ID NO: 1447426 - RNA, 10 nt, Human
aacccucagg

SEQ ID NO: 1447427 - RNA, 23 nt, Human
aacaugguuaccaugucuuucuc

SEQ ID NO: 1447428 - RNA, 13 nt, Human
aacauggcuuuga

SEQ ID NO: 1447429 - RNA, 12 nt, Human
aaccuuuuuaaa

SEQ ID NO: 1447430 - RNA, 16 nt, Human
aaccuuugugcccuau

SEQ ID NO: 1447431 - RNA, 14 nt, Human
aaccuuugugcccu

SEQ ID NO: 1447432 - RNA, 18 nt, Human
aaccuuuguuugcaucug

SEQ ID NO: 1447433 - RNA, 23 nt, Human
aaauucuucugaacucaaacuga

SEQ ID NO: 1447434 - RNA, 18 nt, Human
aaauucuugcaaaguauc

SEQ ID NO: 1447435 - RNA, 15 nt, Human
aaauucuugcaaagu

SEQ ID NO: 1447436 - RNA, 19 nt, Human
aacagcccuccucugcacu

SEQ ID NO: 1447437 - RNA, 17 nt, Human
aacagcccuccucugca

SEQ ID NO: 1447438 - RNA, 19 nt, Human
aacagccaacuagccccug

SEQ ID NO: 1447439 - RNA, 18 nt, Human
aacagccacuacauuacu

SEQ ID NO: 1447440 - RNA, 18 nt, Human
aacagccugacaacauuu

SEQ ID NO: 1447441 - RNA, 18 nt, Human
aacaggcacuuggcagcc

SEQ ID NO: 1447442 - RNA, 13 nt, Human
aacaggcacuugg

SEQ ID NO: 1447443 - RNA, 18 nt, Human
aacaggcacugcccuggu

SEQ ID NO: 1447444 - RNA, 17 nt, Human
aacaggcacugcccugg

SEQ ID NO: 1447445 - RNA, 16 nt, Human
aacaggcacugcccug

SEQ ID NO: 1447446 - RNA, 21 nt, Human
aacaucuuugaaauuauguaa

SEQ ID NO: 1447447 - RNA, 20 nt, Human
aacaugacccuaaaucuuga

SEQ ID NO: 1447448 - RNA, 18 nt, Human
aacaugaggccacuggag

SEQ ID NO: 1447449 - RNA, 20 nt, Human
aacaggccucagggcuccuu

SEQ ID NO: 1447450 - RNA, 15 nt, Human
aacaggccucagggc

SEQ ID NO: 1447451 - RNA, 14 nt, Human
aacaggccucaggg

SEQ ID NO: 1447452 - RNA, 21 nt, Human
aacaggcacuuggcagccuug

SEQ ID NO: 1447453 - RNA, 14 nt, Human
aacaggcucagagg

SEQ ID NO: 1447454 - RNA, 22 nt, Human
aacaucuuugaaauuauguaaa

SEQ ID NO: 1447455 - RNA, 12 nt, Human
aacaucuuuaag

SEQ ID NO: 1447456 - RNA, 18 nt, Human
aacaucuuuaaggggagg

SEQ ID NO: 1447457 - RNA, 15 nt, Human
acaaacaccucccag

SEQ ID NO: 1447458 - RNA, 17 nt, Human
acaaacacacacaaaag

SEQ ID NO: 1447459 - RNA, 13 nt, Human
acaaacaaugaaa

SEQ ID NO: 1447460 - RNA, 14 nt, Human
acaaccauuccaga

SEQ ID NO: 1447461 - RNA, 22 nt, Human
acaaccaugucauuucagaagu

SEQ ID NO: 1447462 - RNA, 15 nt, Human
acaaccacuggucug

SEQ ID NO: 1447463 - RNA, 16 nt, Human
acaaccaauggaaugu

SEQ ID NO: 1447464 - RNA, 22 nt, Human
acaacauuucuauagccaaaaa

SEQ ID NO: 1447465 - RNA, 20 nt, Human
acaacauuucuauagccaaa

SEQ ID NO: 1447466 - RNA, 14 nt, Human
acaacauuucuaua

SEQ ID NO: 1447467 - RNA, 19 nt, Human
acaacauguuuccagcauu

SEQ ID NO: 1447468 - RNA, 21 nt, Human
acaacauguuuccagcauucc

SEQ ID NO: 1447469 - RNA, 16 nt, Human
acaacauguuuccagc

SEQ ID NO: 1447470 - RNA, 16 nt, Human
acaaacuguguaacug

SEQ ID NO: 1447471 - RNA, 15 nt, Human
acaaacuguguaacu

SEQ ID NO: 1447472 - RNA, 19 nt, Human
acaaacuguaauacaauga

SEQ ID NO: 1447473 - RNA, 11 nt, Human
acaaacugaag

SEQ ID NO: 1447474 - RNA, 20 nt, Human
acaaacucguuuuuuacaaa

SEQ ID NO: 1447475 - RNA, 21 nt, Human
acaaacucguuuuuuacaaag

SEQ ID NO: 1447476 - RNA, 14 nt, Human
acaaacaugacccu

SEQ ID NO: 1447477 - RNA, 17 nt, Human
acaaacuguaauacaau

SEQ ID NO: 1447478 - RNA, 16 nt, Human
acaaacuguaauacaa

SEQ ID NO: 1447479 - RNA, 13 nt, Human
acaaacuguaaau

SEQ ID NO: 1447480 - RNA, 19 nt, Human
acaacuggcaggcaggcuc

SEQ ID NO: 1447481 - RNA, 16 nt, Human
acaacuggcaggcagg

SEQ ID NO: 1447482 - RNA, 17 nt, Human
acaacugcucccaccuc

SEQ ID NO: 1447483 - RNA, 22 nt, Human
acaacugccucgaaacacagaa

SEQ ID NO: 1447484 - RNA, 21 nt, Human
acaacugccucgaaacacaga

SEQ ID NO: 1447485 - RNA, 21 nt, Human
acaacucacuccuuuuaaaga

SEQ ID NO: 1447486 - RNA, 14 nt, Human
acaacucauacacu

SEQ ID NO: 1447487 - RNA, 19 nt, Human
acaacucacuccuuuuaaa

SEQ ID NO: 1447488 - RNA, 14 nt, Human
acaaccaugucauu

SEQ ID NO: 1447489 - RNA, 14 nt, Human
acaagugcccucca

SEQ ID NO: 1447490 - RNA, 16 nt, Human
acaaggucuuuaaagu

SEQ ID NO: 1447491 - RNA, 23 nt, Human
acaagguccucugucagucacag

SEQ ID NO: 1447492 - RNA, 15 nt, Human
acaaguggacucagg

SEQ ID NO: 1447493 - RNA, 14 nt, Human
acaagugcugaaca

SEQ ID NO: 1447494 - RNA, 19 nt, Human
acaagugcccuccaggcuu

SEQ ID NO: 1447495 - RNA, 19 nt, Human
acaaguggacucagggcag

SEQ ID NO: 1447496 - RNA, 18 nt, Human
acaaguggacucagggca

SEQ ID NO: 1447497 - RNA, 16 nt, Human
acaaguuauuuaaauc

SEQ ID NO: 1447498 - RNA, 20 nt, Human
acacagaaaauguugagaau

SEQ ID NO: 1447499 - RNA, 19 nt, Human
acacagaaaauguugagaa

SEQ ID NO: 1447500 - RNA, 18 nt, Human
acacagaaaauguugaga

SEQ ID NO: 1447501 - RNA, 20 nt, Human
acacagcauuguauauguga

SEQ ID NO: 1447502 - RNA, 18 nt, Human
acacagcauuguauaugu

SEQ ID NO: 1447503 - RNA, 17 nt, Human
acacagcauuguauaug

SEQ ID NO: 1447504 - RNA, 21 nt, Human
acaccaagcacagcagccugg

SEQ ID NO: 1447505 - RNA, 20 nt, Human
acaccaagcacagcagccug

SEQ ID NO: 1447506 - RNA, 19 nt, Human
acaccaagcacagcagccu

SEQ ID NO: 1447507 - RNA, 18 nt, Human
acaccaagcacagcagcc

SEQ ID NO: 1447508 - RNA, 16 nt, Human
acaccaagcacagcag

SEQ ID NO: 1447509 - RNA, 17 nt, Human
acacgugacacaaacac

SEQ ID NO: 1447510 - RNA, 22 nt, Human
acacguauuugaauggccuuca

SEQ ID NO: 1447511 - RNA, 19 nt, Human
acacguauuugaauggccu

SEQ ID NO: 1447512 - RNA, 19 nt, Human
acacguaucccaccugaca

SEQ ID NO: 1447513 - RNA, 14 nt, Human
acacuaaaaauaaa

SEQ ID NO: 1447514 - RNA, 17 nt, Human
acacgcaccugccucag

SEQ ID NO: 1447515 - RNA, 16 nt, Human
acacgcaccugccuca

SEQ ID NO: 1447516 - RNA, 14 nt, Human
acacgcaccugccu

SEQ ID NO: 1447517 - RNA, 13 nt, Human
acacgcaccugcc

SEQ ID NO: 1447518 - RNA, 21 nt, Human
acacgcacggcagccacagcu

SEQ ID NO: 1447519 - RNA, 22 nt, Human
aauuucccaggacccugaaggg

SEQ ID NO: 1447520 - RNA, 21 nt, Human
aauuucccaggacccugaagg

SEQ ID NO: 1447521 - RNA, 17 nt, Human
aauuucccaggacccug

SEQ ID NO: 1447522 - RNA, 16 nt, Human
aauuucccaggacccu

SEQ ID NO: 1447523 - RNA, 15 nt, Human
aauuucccaggaccc

SEQ ID NO: 1447524 - RNA, 14 nt, Human
aauuucccaggacc

SEQ ID NO: 1447525 - RNA, 12 nt, Human
aauuucccagga

SEQ ID NO: 1447526 - RNA, 11 nt, Human
aauuguaauag

SEQ ID NO: 1447527 - RNA, 13 nt, Human
aauuguaaucuga

SEQ ID NO: 1447528 - RNA, 20 nt, Human
aauugggccagcuuuucaaa

SEQ ID NO: 1447529 - RNA, 19 nt, Human
aauugggccagcuuuucaa

SEQ ID NO: 1447530 - RNA, 17 nt, Human
aauuguacuaaagccaa

SEQ ID NO: 1447531 - RNA, 16 nt, Human
aauuguacuaaagcca

SEQ ID NO: 1447532 - RNA, 14 nt, Human
aauuguacagccgg

SEQ ID NO: 1447533 - RNA, 15 nt, Human
aauuuccugggagcu

SEQ ID NO: 1447534 - RNA, 12 nt, Human
aauuuccuggga

SEQ ID NO: 1447535 - RNA, 17 nt, Human
aauuuccugggagcuuu

SEQ ID NO: 1447536 - RNA, 15 nt, Human
aauucuccuggaggu

SEQ ID NO: 1447537 - RNA, 13 nt, Human
aauucuccuggag

SEQ ID NO: 1447538 - RNA, 12 nt, Human
aauucuccugga

SEQ ID NO: 1447539 - RNA, 18 nt, Human
aauucucauuaaaagaau

SEQ ID NO: 1447540 - RNA, 15 nt, Human
aauucucuaguuuga

SEQ ID NO: 1447541 - RNA, 17 nt, Human
aauucucuaguuugauu

SEQ ID NO: 1447542 - RNA, 23 nt, Human
aauucuauuaaagugcuaagguu

SEQ ID NO: 1447543 - RNA, 15 nt, Human
aauucuauuaaagug

SEQ ID NO: 1447544 - RNA, 15 nt, Human
aauucuaugccuguc

SEQ ID NO: 1447545 - RNA, 13 nt, Human
aauucuaugccug

SEQ ID NO: 1447546 - RNA, 22 nt, Human
aauucuauaaggccauaaaaca

SEQ ID NO: 1447547 - RNA, 16 nt, Human
aauucuauaaggccau

SEQ ID NO: 1447548 - RNA, 19 nt, Human
aauucuaaaugaauguuua

SEQ ID NO: 1447549 - RNA, 13 nt, Human
aauucuaaaugaa

SEQ ID NO: 1447550 - RNA, 14 nt, Human
aauucuaaaaugau

SEQ ID NO: 1447551 - RNA, 12 nt, Human
aauucuaaaaug

SEQ ID NO: 1447552 - RNA, 22 nt, Human
aauucguguguuuuuuuaugaa

SEQ ID NO: 1447553 - RNA, 13 nt, Human
aauucguguguuu

SEQ ID NO: 1447554 - RNA, 23 nt, Human
aauucuaccaaggucuucuuaau

SEQ ID NO: 1447555 - RNA, 21 nt, Human
aauugggagcuugggaaugga

SEQ ID NO: 1447556 - RNA, 23 nt, Human
aauuggcauggaaauuuaaagca

SEQ ID NO: 1447557 - RNA, 20 nt, Human
aauuggcaccgaagcccaga

SEQ ID NO: 1447558 - RNA, 17 nt, Human
aauuggauuuccuaaua

SEQ ID NO: 1447559 - RNA, 15 nt, Human
aauuggauuuccuaa

SEQ ID NO: 1447560 - RNA, 11 nt, Human
aauuggauuuc

SEQ ID NO: 1447561 - RNA, 16 nt, Human
aauugggccagcuuuu

SEQ ID NO: 1447562 - RNA, 23 nt, Human
aauucugaguuuuguguuuguug

SEQ ID NO: 1447563 - RNA, 17 nt, Human
aauucugaguuuugugu

SEQ ID NO: 1447564 - RNA, 21 nt, Human
aauucuggcugguagagcagg

SEQ ID NO: 1447565 - RNA, 16 nt, Human
aauucugcucagauag

SEQ ID NO: 1447566 - RNA, 16 nt, Human
aauucugugccuuguu

SEQ ID NO: 1447567 - RNA, 15 nt, Human
aauucggugugcacc

SEQ ID NO: 1447568 - RNA, 22 nt, Human
aauuauguagcucuuugucagg

SEQ ID NO: 1447569 - RNA, 16 nt, Human
aauuauguagcucuuu

SEQ ID NO: 1447570 - RNA, 13 nt, Human
aauuauguagcuc

SEQ ID NO: 1447571 - RNA, 12 nt, Human
aauuauguagcu

SEQ ID NO: 1447572 - RNA, 17 nt, Human
aauuauguaaauuauca

SEQ ID NO: 1447573 - RNA, 17 nt, Human
aauuauguaaauuaugu

SEQ ID NO: 1447574 - RNA, 15 nt, Human
aauuauguaaauuau

SEQ ID NO: 1447575 - RNA, 12 nt, Human
aauuauguaaau

SEQ ID NO: 1447576 - RNA, 19 nt, Human
aauuaugccuuuuuugauc

SEQ ID NO: 1447577 - RNA, 17 nt, Human
aauuaugccuuuuuuga

SEQ ID NO: 1447578 - RNA, 18 nt, Human
aauuaugaaacuuuugga

SEQ ID NO: 1447579 - RNA, 23 nt, Human
aauuaucuauagcuaaguacaca

SEQ ID NO: 1447580 - RNA, 15 nt, Human
aauuaugaaacuuuu

SEQ ID NO: 1447581 - RNA, 13 nt, Human
aauuaugaaacuu

SEQ ID NO: 1447582 - RNA, 12 nt, Human
aauuaugaaacu

SEQ ID NO: 1447583 - RNA, 22 nt, Human
aauuaucaggcaaauuugcauu

SEQ ID NO: 1447584 - RNA, 13 nt, Human
aauuauccaggaa

SEQ ID NO: 1447585 - RNA, 18 nt, Human
aauuaucuaauuuauaaa

SEQ ID NO: 1447586 - RNA, 15 nt, Human
aauuaucuaauuuau

SEQ ID NO: 1447587 - RNA, 14 nt, Human
aauuaucuaauuua

SEQ ID NO: 1447588 - RNA, 19 nt, Human
aauuaucuaauuuauaaaa

SEQ ID NO: 1447589 - RNA, 15 nt, Human
aauuaucuauagcua

SEQ ID NO: 1447590 - RNA, 22 nt, Human
aauuaucuauagcuaaguacac

SEQ ID NO: 1447591 - RNA, 21 nt, Human
aauuauauaacuguauuugaa

SEQ ID NO: 1447592 - RNA, 19 nt, Human
aauuauauaacuguauuug

SEQ ID NO: 1447593 - RNA, 17 nt, Human
aauuauauaacuguauu

SEQ ID NO: 1447594 - RNA, 14 nt, Human
aauuauauaacugu

SEQ ID NO: 1447595 - RNA, 21 nt, Human
aauuauaguuucugaggcuuu

SEQ ID NO: 1447596 - RNA, 17 nt, Human
aauuauaguuucugagg

SEQ ID NO: 1447597 - RNA, 16 nt, Human
aauuauaguuucugag

SEQ ID NO: 1447598 - RNA, 15 nt, Human
aauuauaguuucuga

SEQ ID NO: 1447599 - RNA, 14 nt, Human
aauuauaguuucug

SEQ ID NO: 1447600 - RNA, 13 nt, Human
aauuauaguuucu

SEQ ID NO: 1447601 - RNA, 22 nt, Human
aauuauagugauguaaucuuga

SEQ ID NO: 1447602 - RNA, 14 nt, Human
aauuauauguugua

SEQ ID NO: 1447603 - RNA, 22 nt, Human
acauguuugcaccuuucuaguu

SEQ ID NO: 1447604 - RNA, 16 nt, Human
acauguuuuaaagaaa

SEQ ID NO: 1447605 - RNA, 21 nt, Human
acauguuugcaccuuucuagu

SEQ ID NO: 1447606 - RNA, 20 nt, Human
acauguguuaaguauuuuca

SEQ ID NO: 1447607 - RNA, 18 nt, Human
acauccaaagcagacagc

SEQ ID NO: 1447608 - RNA, 17 nt, Human
acauccaaagcagacag

SEQ ID NO: 1447609 - RNA, 16 nt, Human
acauccaaagcagaca

SEQ ID NO: 1447610 - RNA, 15 nt, Human
acauccaaagcagac

SEQ ID NO: 1447611 - RNA, 21 nt, Human
acauccaaaauaguuaagaca

SEQ ID NO: 1447612 - RNA, 22 nt, Human
acaucauuucuuuuugggagag

SEQ ID NO: 1447613 - RNA, 13 nt, Human
acaucauuucuuu

SEQ ID NO: 1447614 - RNA, 12 nt, Human
acaucauuucuu

SEQ ID NO: 1447615 - RNA, 11 nt, Human
acaucauuucu

SEQ ID NO: 1447616 - RNA, 15 nt, Human
acaucauucuugaga

SEQ ID NO: 1447617 - RNA, 20 nt, Human
acauacagaauuacuguaac

SEQ ID NO: 1447618 - RNA, 19 nt, Human
acauacagaauuacuguaa

SEQ ID NO: 1447619 - RNA, 18 nt, Human
acauacagaauuacugua

SEQ ID NO: 1447620 - RNA, 21 nt, Human
acauacaccuaugucauuuca

SEQ ID NO: 1447621 - RNA, 23 nt, Human
acauaaucuucugccuucucaug

SEQ ID NO: 1447622 - RNA, 21 nt, Human
acauaaugcgugcauaccacu

SEQ ID NO: 1447623 - RNA, 16 nt, Human
acauaaccacugcuuc

SEQ ID NO: 1447624 - RNA, 20 nt, Human
acauaacugaaaaugugcua

SEQ ID NO: 1447625 - RNA, 12 nt, Human
acauaacugaaa

SEQ ID NO: 1447626 - RNA, 19 nt, Human
acauaaguuuaggauaaaa

SEQ ID NO: 1447627 - RNA, 20 nt, Human
acauaaguauuuaauucaug

SEQ ID NO: 1447628 - RNA, 18 nt, Human
acauguggggccagguca

SEQ ID NO: 1447629 - RNA, 16 nt, Human
acauguggggccaggu

SEQ ID NO: 1447630 - RNA, 18 nt, Human
acaugugcugcccuacag

SEQ ID NO: 1447631 - RNA, 22 nt, Human
acaugugccagggcaaugauga

SEQ ID NO: 1447632 - RNA, 18 nt, Human
acaugcgguagccagcac

SEQ ID NO: 1447633 - RNA, 17 nt, Human
acaugcgguagccagca

SEQ ID NO: 1447634 - RNA, 17 nt, Human
acaucccugggccugcu

SEQ ID NO: 1447635 - RNA, 16 nt, Human
acaucccugggccugc

SEQ ID NO: 1447636 - RNA, 15 nt, Human
acaucccugggccug

SEQ ID NO: 1447637 - RNA, 14 nt, Human
acaucccugggccu

SEQ ID NO: 1447638 - RNA, 13 nt, Human
acaucccugggcc

SEQ ID NO: 1447639 - RNA, 12 nt, Human
acaucccugggc

SEQ ID NO: 1447640 - RNA, 21 nt, Human
acaucauuucuuuuugggaga

SEQ ID NO: 1447641 - RNA, 19 nt, Human
acauccaaagcagacagcu

SEQ ID NO: 1447642 - RNA, 22 nt, Human
acaugcacuuggcugcauaaau

SEQ ID NO: 1447643 - RNA, 18 nt, Human
acaugcacuuggcugcau

SEQ ID NO: 1447644 - RNA, 21 nt, Human
acaucccugggccugcugcug

SEQ ID NO: 1447645 - RNA, 20 nt, Human
acaucccugggccugcugcu

SEQ ID NO: 1447646 - RNA, 19 nt, Human
acaucccugggccugcugc

SEQ ID NO: 1447647 - RNA, 18 nt, Human
acaucccugggccugcug

SEQ ID NO: 1447648 - RNA, 20 nt, Human
acaucccuuaccugggaaag

SEQ ID NO: 1447649 - RNA, 22 nt, Human
accaccagggcaucucugggcu

SEQ ID NO: 1447650 - RNA, 21 nt, Human
accaccagggcaucucugggc

SEQ ID NO: 1447651 - RNA, 20 nt, Human
accaccagggcaucucuggg

SEQ ID NO: 1447652 - RNA, 17 nt, Human
accaccagggcaucucu

SEQ ID NO: 1447653 - RNA, 17 nt, Human
accaccagcugugucca

SEQ ID NO: 1447654 - RNA, 15 nt, Human
accaccagcuguguc

SEQ ID NO: 1447655 - RNA, 13 nt, Human
accaccagcugug

SEQ ID NO: 1447656 - RNA, 12 nt, Human
accaccagcugu

SEQ ID NO: 1447657 - RNA, 19 nt, Human
accaaccugaagacaccgu

SEQ ID NO: 1447658 - RNA, 18 nt, Human
accaccccgccugcccuc

SEQ ID NO: 1447659 - RNA, 14 nt, Human
accaccccaucugc

SEQ ID NO: 1447660 - RNA, 18 nt, Human
accaccccaucugcauuc

SEQ ID NO: 1447661 - RNA, 13 nt, Human
accacguuucuaa

SEQ ID NO: 1447662 - RNA, 14 nt, Human
accacguuucuaaa

SEQ ID NO: 1447663 - RNA, 21 nt, Human
accaacccucagggcaaagcc

SEQ ID NO: 1447664 - RNA, 16 nt, Human
accaacccucagggca

SEQ ID NO: 1447665 - RNA, 21 nt, Human
acauuuguauaaaauaauuuu

SEQ ID NO: 1447666 - RNA, 19 nt, Human
acauuuguauaaaauaauu

SEQ ID NO: 1447667 - RNA, 16 nt, Human
acauuuguauaaaaua

SEQ ID NO: 1447668 - RNA, 16 nt, Human
acauuugcucauggaa

SEQ ID NO: 1447669 - RNA, 15 nt, Human
acauuugcucaugga

SEQ ID NO: 1447670 - RNA, 21 nt, Human
acaggauguguuugcuuucug

SEQ ID NO: 1447671 - RNA, 20 nt, Human
acaggauguguuugcuuucu

SEQ ID NO: 1447672 - RNA, 19 nt, Human
acaggauguguuugcuuuc

SEQ ID NO: 1447673 - RNA, 18 nt, Human
acaggauguguuugcuuu

SEQ ID NO: 1447674 - RNA, 16 nt, Human
acaggauguguuugcu

SEQ ID NO: 1447675 - RNA, 22 nt, Human
acaggauguguuugcuuucuga

SEQ ID NO: 1447676 - RNA, 24 nt, Human
acaggaugguucccuugaugaaga

SEQ ID NO: 1447677 - RNA, 21 nt, Human
acaguggcucacgccuguaau

SEQ ID NO: 1447678 - RNA, 13 nt, Human
acagugggagcca

SEQ ID NO: 1447679 - RNA, 14 nt, Human
acagugggagccag

SEQ ID NO: 1447680 - RNA, 15 nt, Human
acagugggagccagg

SEQ ID NO: 1447681 - RNA, 16 nt, Human
acagugggagccaggg

SEQ ID NO: 1447682 - RNA, 17 nt, Human
acagugggagccagggc

SEQ ID NO: 1447683 - RNA, 18 nt, Human
acaguggaucacaaagug

SEQ ID NO: 1447684 - RNA, 17 nt, Human
acaguggaucacaaagu

SEQ ID NO: 1447685 - RNA, 15 nt, Human
acaguggaucacaaa

SEQ ID NO: 1447686 - RNA, 18 nt, Human
acaguggaacuacauuag

SEQ ID NO: 1447687 - RNA, 16 nt, Human
acaguggaacuacauu

SEQ ID NO: 1447688 - RNA, 21 nt, Human
acagugcuuuuaagugaaaau

SEQ ID NO: 1447689 - RNA, 20 nt, Human
acagugcugaccagacagcc

SEQ ID NO: 1447690 - RNA, 21 nt, Human
acagugcucuuuucuccucac

SEQ ID NO: 1447691 - RNA, 17 nt, Human
acagugcucuuuucucc

SEQ ID NO: 1447692 - RNA, 16 nt, Human
acagugcucuuuucuc

SEQ ID NO: 1447693 - RNA, 15 nt, Human
acagugcucuuuucu

SEQ ID NO: 1447694 - RNA, 16 nt, Human
acaggcacugcccugg

SEQ ID NO: 1447695 - RNA, 15 nt, Human
acaggcacugcccug

SEQ ID NO: 1447696 - RNA, 20 nt, Human
acaggcacuuggcagccuug

SEQ ID NO: 1447697 - RNA, 16 nt, Human
acaggcacuuggcagc

SEQ ID NO: 1447698 - RNA, 13 nt, Human
acaggcacuuggc

SEQ ID NO: 1447699 - RNA, 23 nt, Human
acaggcacugcccugguggcccu

SEQ ID NO: 1447700 - RNA, 18 nt, Human
acaggcacugcccuggug

SEQ ID NO: 1447701 - RNA, 18 nt, Human
acagugauauuggaacuu

SEQ ID NO: 1447702 - RNA, 23 nt, Human
acagugaucaaguuauuuuuaau

SEQ ID NO: 1447703 - RNA, 16 nt, Human
acugugccauguguuu

SEQ ID NO: 1447704 - RNA, 15 nt, Human
acugugccucagaga

SEQ ID NO: 1447705 - RNA, 18 nt, Human
acugugccucagagacca

SEQ ID NO: 1447706 - RNA, 16 nt, Human
acuguaacugauuaca

SEQ ID NO: 1447707 - RNA, 22 nt, Human
acugucuuuuuucuaaaguaaa

SEQ ID NO: 1447708 - RNA, 23 nt, Human
acugucuuuuuucuaaaguaaaa

SEQ ID NO: 1447709 - RNA, 14 nt, Human
acugguuuucacau

SEQ ID NO: 1447710 - RNA, 14 nt, Human
acuguaaacacaga

SEQ ID NO: 1447711 - RNA, 16 nt, Human
acuguaaacacagaca

SEQ ID NO: 1447712 - RNA, 13 nt, Human
acuguaaacacag

SEQ ID NO: 1447713 - RNA, 22 nt, Human
acuguaaaaugugggauuaugg

SEQ ID NO: 1447714 - RNA, 21 nt, Human
acuguaaaaugugggauuaug

SEQ ID NO: 1447715 - RNA, 16 nt, Human
acuguaaaauguggga

SEQ ID NO: 1447716 - RNA, 18 nt, Human
acuguaaauaaaaagaaa

SEQ ID NO: 1447717 - RNA, 15 nt, Human
acuguaacauucagg

SEQ ID NO: 1447718 - RNA, 13 nt, Human
acuguaaagaugu

SEQ ID NO: 1447719 - RNA, 16 nt, Human
acugucuuuuuucuaa

SEQ ID NO: 1447720 - RNA, 20 nt, Human
acugccgucagugcugugcu

SEQ ID NO: 1447721 - RNA, 17 nt, Human
acugccguaauuuaacu

SEQ ID NO: 1447722 - RNA, 16 nt, Human
acugccguaauuuaac

SEQ ID NO: 1447723 - RNA, 14 nt, Human
acugccuaagcccu

SEQ ID NO: 1447724 - RNA, 15 nt, Human
acugccuaagcccuc

SEQ ID NO: 1447725 - RNA, 15 nt, Human
acugccguaauuuaa

SEQ ID NO: 1447726 - RNA, 17 nt, Human
acugcccaggcacugca

SEQ ID NO: 1447727 - RNA, 11 nt, Human
acugcccuggu

SEQ ID NO: 1447728 - RNA, 16 nt, Human
acugcccauggacagg

SEQ ID NO: 1447729 - RNA, 16 nt, Human
acuggaacacuagaca

SEQ ID NO: 1447730 - RNA, 11 nt, Human
acuggagcccc

SEQ ID NO: 1447731 - RNA, 22 nt, Human
acuggaacacuagacaagccag

SEQ ID NO: 1447732 - RNA, 12 nt, Human
acuggaaagaag

SEQ ID NO: 1447733 - RNA, 23 nt, Human
acuggaaagcuuuucuauuuuaa

SEQ ID NO: 1447734 - RNA, 23 nt, Human
acuggaaaacagaacacuuaugu

SEQ ID NO: 1447735 - RNA, 20 nt, Human
acuggaaaacagaacacuua

SEQ ID NO: 1447736 - RNA, 19 nt, Human
acuggaaaacagaacacuu

SEQ ID NO: 1447737 - RNA, 18 nt, Human
acuggaaaacagaacacu

SEQ ID NO: 1447738 - RNA, 17 nt, Human
acuggaaaacagaacac

SEQ ID NO: 1447739 - RNA, 16 nt, Human
acuggaaaacagaaca

SEQ ID NO: 1447740 - RNA, 23 nt, Human
acugccuagaaacaacacuguag

SEQ ID NO: 1447741 - RNA, 22 nt, Human
acugccuagaaacaacacugua

SEQ ID NO: 1447742 - RNA, 21 nt, Human
acugccuagaaacaacacugu

SEQ ID NO: 1447743 - RNA, 20 nt, Human
acugccuagaaacaacacug

SEQ ID NO: 1447744 - RNA, 19 nt, Human
acugccuagaaacaacacu

SEQ ID NO: 1447745 - RNA, 16 nt, Human
acugccuagaaacaac

SEQ ID NO: 1447746 - RNA, 15 nt, Human
acugccuagaaacaa

SEQ ID NO: 1447747 - RNA, 14 nt, Human
acugccuagaaaca

SEQ ID NO: 1447748 - RNA, 13 nt, Human
acugccuagaaac

SEQ ID NO: 1447749 - RNA, 18 nt, Human
acugccgucagugcugug

SEQ ID NO: 1447750 - RNA, 15 nt, Human
acugccuauuuuaau

SEQ ID NO: 1447751 - RNA, 17 nt, Human
acuguaaaauaauaacu

SEQ ID NO: 1447752 - RNA, 23 nt, Human
acuggugcaaguugaggacuucu

SEQ ID NO: 1447753 - RNA, 16 nt, Human
acuggagugugcgugg

SEQ ID NO: 1447754 - RNA, 15 nt, Human
acuguuuuuuaaguc

SEQ ID NO: 1447755 - RNA, 13 nt, Human
acuguuuuuuaag

SEQ ID NO: 1447756 - RNA, 18 nt, Human
acuguuuuucggacaguu

SEQ ID NO: 1447757 - RNA, 19 nt, Human
acuguuuuucggacaguuu

SEQ ID NO: 1447758 - RNA, 23 nt, Human
acuguuuuucagggagguggcug

SEQ ID NO: 1447759 - RNA, 19 nt, Human
acuguuucaaacuuuacua

SEQ ID NO: 1447760 - RNA, 15 nt, Human
acuguuucaaacuuu

SEQ ID NO: 1447761 - RNA, 18 nt, Human
acuguuucaaacuuuacu

SEQ ID NO: 1447762 - RNA, 19 nt, Human
acuucaaauccuugaagau

SEQ ID NO: 1447763 - RNA, 18 nt, Human
acuucaaauccuugaaga

SEQ ID NO: 1447764 - RNA, 18 nt, Human
acuucaaacuacuuugcu

SEQ ID NO: 1447765 - RNA, 17 nt, Human
acuucaaauccuugaag

SEQ ID NO: 1447766 - RNA, 20 nt, Human
acuuguacaaaauaaacaaa

SEQ ID NO: 1447767 - RNA, 18 nt, Human
acuuguacaaaauaaaca

SEQ ID NO: 1447768 - RNA, 14 nt, Human
acuuguacaaaaua

SEQ ID NO: 1447769 - RNA, 18 nt, Human
acuuguaauuuuuuuaau

SEQ ID NO: 1447770 - RNA, 16 nt, Human
acuuguaauuauggag

SEQ ID NO: 1447771 - RNA, 15 nt, Human
acuuguaauuaugga

SEQ ID NO: 1447772 - RNA, 13 nt, Human
acuuguaauuaug

SEQ ID NO: 1447773 - RNA, 16 nt, Human
acuugguaauuguacu

SEQ ID NO: 1447774 - RNA, 15 nt, Human
acuugggucuucccu

SEQ ID NO: 1447775 - RNA, 20 nt, Human
acuuggggguucaggcccgg

SEQ ID NO: 1447776 - RNA, 19 nt, Human
acuuggggguucaggcccg

SEQ ID NO: 1447777 - RNA, 21 nt, Human
acuucuuuuuucaaaagaaag

SEQ ID NO: 1447778 - RNA, 22 nt, Human
acuucuuuuuucaaaagaaagu

SEQ ID NO: 1447779 - RNA, 23 nt, Human
acuucuuuuuucaaaagaaaguc

SEQ ID NO: 1447780 - RNA, 12 nt, Human
acuugaaaauua

SEQ ID NO: 1447781 - RNA, 14 nt, Human
acuugaaaauuaac

SEQ ID NO: 1447782 - RNA, 16 nt, Human
acuugaaaauuaacau

SEQ ID NO: 1447783 - RNA, 21 nt, Human
acuucaaacuacuuugcugcu

SEQ ID NO: 1447784 - RNA, 16 nt, Human
acuucaaacugagauc

SEQ ID NO: 1447785 - RNA, 20 nt, Human
acuucuugaaggugcugacg

SEQ ID NO: 1447786 - RNA, 17 nt, Human
acuucagcgguuuauau

SEQ ID NO: 1447787 - RNA, 19 nt, Human
acuucuugcuucuuucuag

SEQ ID NO: 1447788 - RNA, 18 nt, Human
acuucuugcuucuuucua

SEQ ID NO: 1447789 - RNA, 11 nt, Human
acuucuugcuu

SEQ ID NO: 1447790 - RNA, 19 nt, Human
acuucuugcuggucuaguc

SEQ ID NO: 1447791 - RNA, 19 nt, Human
acuucuuguguguaugcac

SEQ ID NO: 1447792 - RNA, 15 nt, Human
acuucuuguguguau

SEQ ID NO: 1447793 - RNA, 20 nt, Human
acuucuugcuucuuucuaga

SEQ ID NO: 1447794 - RNA, 15 nt, Human
acuccccaaccccca

SEQ ID NO: 1447795 - RNA, 16 nt, Human
acuccccaacccccaa

SEQ ID NO: 1447796 - RNA, 22 nt, Human
acucccauuccugaagaaccag

SEQ ID NO: 1447797 - RNA, 21 nt, Human
acucccucucaggauccaagc

SEQ ID NO: 1447798 - RNA, 13 nt, Human
acucccucucagg

SEQ ID NO: 1447799 - RNA, 23 nt, Human
acuccgagaggugggccagucug

SEQ ID NO: 1447800 - RNA, 22 nt, Human
acuccgagaggugggccagucu

SEQ ID NO: 1447801 - RNA, 20 nt, Human
acuccauguuggcuagccuc

SEQ ID NO: 1447802 - RNA, 14 nt, Human
acuccauguuggcu

SEQ ID NO: 1447803 - RNA, 14 nt, Human
acucccaccugaca

SEQ ID NO: 1447804 - RNA, 20 nt, Human
acucccauuccugaagaacc

SEQ ID NO: 1447805 - RNA, 16 nt, Human
acucccauuccugaag

SEQ ID NO: 1447806 - RNA, 13 nt, Human
acucccauuccug

SEQ ID NO: 1447807 - RNA, 16 nt, Human
acucccaccugacaca

SEQ ID NO: 1447808 - RNA, 21 nt, Human
acuccguuggccacuccgaga

SEQ ID NO: 1447809 - RNA, 18 nt, Human
acuccguuggccacuccg

SEQ ID NO: 1447810 - RNA, 19 nt, Human
acuccguaacagauuuugu

SEQ ID NO: 1447811 - RNA, 17 nt, Human
acuccguuggccacucc

SEQ ID NO: 1447812 - RNA, 15 nt, Human
acuccguuggccacu

SEQ ID NO: 1447813 - RNA, 20 nt, Human
acuccgugcuuaaccaaaga

SEQ ID NO: 1447814 - RNA, 14 nt, Human
acucguuuuuuaca

SEQ ID NO: 1447815 - RNA, 21 nt, Human
acucuaaaauuauaaaugaca

SEQ ID NO: 1447816 - RNA, 15 nt, Human
acucuaaaauuauaa

SEQ ID NO: 1447817 - RNA, 19 nt, Human
acucguuaauuuguagugu

SEQ ID NO: 1447818 - RNA, 14 nt, Human
acucguuaauuugu

SEQ ID NO: 1447819 - RNA, 18 nt, Human
acugauguuguguuuuua

SEQ ID NO: 1447820 - RNA, 17 nt, Human
acugauguuguguuuuu

SEQ ID NO: 1447821 - RNA, 13 nt, Human
acugauguugugu

SEQ ID NO: 1447822 - RNA, 15 nt, Human
acugaucacaaaaac

SEQ ID NO: 1447823 - RNA, 22 nt, Human
acugacauguggggccagguca

SEQ ID NO: 1447824 - RNA, 19 nt, Human
acugauaugggucuugaua

SEQ ID NO: 1447825 - RNA, 13 nt, Human
acugaugucuccu

SEQ ID NO: 1447826 - RNA, 20 nt, Human
acugauguaugaggaauuuc

SEQ ID NO: 1447827 - RNA, 14 nt, Human
acugaucucguuuu

SEQ ID NO: 1447828 - RNA, 14 nt, Human
acugaugucuccua

SEQ ID NO: 1447829 - RNA, 17 nt, Human
acugaugucuccuaagc

SEQ ID NO: 1447830 - RNA, 14 nt, Human
acugauuacugccu

SEQ ID NO: 1447831 - RNA, 18 nt, Human
acugacauguggggccag

SEQ ID NO: 1447832 - RNA, 12 nt, Human
acugacaugugg

SEQ ID NO: 1447833 - RNA, 14 nt, Human
acugacagaggggg

SEQ ID NO: 1447834 - RNA, 13 nt, Human
acugacacacacg

SEQ ID NO: 1447835 - RNA, 18 nt, Human
acugacaagccaucuuga

SEQ ID NO: 1447836 - RNA, 13 nt, Human
acugacacaugcu

SEQ ID NO: 1447837 - RNA, 23 nt, Human
acugaauuucuuuugccguuauu

SEQ ID NO: 1447838 - RNA, 19 nt, Human
acucuacccauauuacaga

SEQ ID NO: 1447839 - RNA, 17 nt, Human
acucuacccauauuaca

SEQ ID NO: 1447840 - RNA, 14 nt, Human
acugaaugucauug

SEQ ID NO: 1447841 - RNA, 20 nt, Human
acugaaugaggucagcaugu

SEQ ID NO: 1447842 - RNA, 12 nt, Human
acugaaugaggu

SEQ ID NO: 1447843 - RNA, 20 nt, Human
acugaauuaugaaacuuuug

SEQ ID NO: 1447844 - RNA, 12 nt, Human
acugaauuucuu

SEQ ID NO: 1447845 - RNA, 15 nt, Human
acugaauuaugaaac

SEQ ID NO: 1447846 - RNA, 14 nt, Human
acugaauuaugaaa

SEQ ID NO: 1447847 - RNA, 13 nt, Human
acugaauuaugaa

SEQ ID NO: 1447848 - RNA, 18 nt, Human
accuuggcaccagacacc

SEQ ID NO: 1447849 - RNA, 17 nt, Human
accuuggcaccagacac

SEQ ID NO: 1447850 - RNA, 16 nt, Human
accuuggcaccagaca

SEQ ID NO: 1447851 - RNA, 14 nt, Human
accuuggcaccaga

SEQ ID NO: 1447852 - RNA, 19 nt, Human
accuuggacauccuccucc

SEQ ID NO: 1447853 - RNA, 18 nt, Human
accuuggacauccuccuc

SEQ ID NO: 1447854 - RNA, 22 nt, Human
accuuggcaccagacacccagg

SEQ ID NO: 1447855 - RNA, 22 nt, Human
accucuguauuugaaucagccu

SEQ ID NO: 1447856 - RNA, 19 nt, Human
accugugcacaccccacuc

SEQ ID NO: 1447857 - RNA, 11 nt, Human
accuguaauca

SEQ ID NO: 1447858 - RNA, 15 nt, Human
accuguaagugucuu

SEQ ID NO: 1447859 - RNA, 23 nt, Human
accuugcugcaagcacagcccuu

SEQ ID NO: 1447860 - RNA, 22 nt, Human
accuugcugcaagcacagcccu

SEQ ID NO: 1447861 - RNA, 14 nt, Human
accuguggauauuu

SEQ ID NO: 1447862 - RNA, 13 nt, Human
accuguggauauu

SEQ ID NO: 1447863 - RNA, 18 nt, Human
accuugccugguacagua

SEQ ID NO: 1447864 - RNA, 22 nt, Human
accugugcuucgggcccuuccc

SEQ ID NO: 1447865 - RNA, 19 nt, Human
accugugcuucgggcccuu

SEQ ID NO: 1447866 - RNA, 23 nt, Human
accugugcuucgggcccuuccca

SEQ ID NO: 1447867 - RNA, 20 nt, Human
accuguggaacauaaaaagg

SEQ ID NO: 1447868 - RNA, 10 nt, Human
accuguggau

SEQ ID NO: 1447869 - RNA, 23 nt, Human
accuguggaacauaaaaaggaca

SEQ ID NO: 1447870 - RNA, 16 nt, Human
acuaauggcaugagaa

SEQ ID NO: 1447871 - RNA, 13 nt, Human
acuaauggcauga

SEQ ID NO: 1447872 - RNA, 12 nt, Human
acuaauggcaug

SEQ ID NO: 1447873 - RNA, 24 nt, Human
acuaaugccuuacucuucuugaaa

SEQ ID NO: 1447874 - RNA, 23 nt, Human
acuaaugccuuacucuucuugaa

SEQ ID NO: 1447875 - RNA, 13 nt, Human
acuaauuccacac

SEQ ID NO: 1447876 - RNA, 18 nt, Human
acuaauucauaaucacuc

SEQ ID NO: 1447877 - RNA, 22 nt, Human
acuaauggcaugagaaauacaa

SEQ ID NO: 1447878 - RNA, 21 nt, Human
acuaauggcaugagaaauaca

SEQ ID NO: 1447879 - RNA, 20 nt, Human
acuaauguguaagacaaaaa

SEQ ID NO: 1447880 - RNA, 19 nt, Human
acgugcucuuuguuuugug

SEQ ID NO: 1447881 - RNA, 23 nt, Human
acgugcucuuuguuuugugucuc

SEQ ID NO: 1447882 - RNA, 18 nt, Human
acgugcucugugggucuc

SEQ ID NO: 1447883 - RNA, 15 nt, Human
acgcaaguucccagu

SEQ ID NO: 1447884 - RNA, 18 nt, Human
acgauuuuuaaaauguac

SEQ ID NO: 1447885 - RNA, 14 nt, Human
acgcacacugucug

SEQ ID NO: 1447886 - RNA, 20 nt, Human
acgauuucuguuuagauaau

SEQ ID NO: 1447887 - RNA, 23 nt, Human
acgauuucuguuuagauaauaca

SEQ ID NO: 1447888 - RNA, 16 nt, Human
acgcaccugccucagg

SEQ ID NO: 1447889 - RNA, 15 nt, Human
acgcaccugccucag

SEQ ID NO: 1447890 - RNA, 14 nt, Human
acgcaccugccuca

SEQ ID NO: 1447891 - RNA, 22 nt, Human
acgcaccaccaugccaggcuaa

SEQ ID NO: 1447892 - RNA, 23 nt, Human
acggacaaaaccccccagauauc

SEQ ID NO: 1447893 - RNA, 19 nt, Human
acgugacacaaacacacac

SEQ ID NO: 1447894 - RNA, 13 nt, Human
acgugacacaaac

SEQ ID NO: 1447895 - RNA, 12 nt, Human
acgucuucuaaa

SEQ ID NO: 1447896 - RNA, 14 nt, Human
acgucuuaaauauu

SEQ ID NO: 1447897 - RNA, 13 nt, Human
acgucuuaaauau

SEQ ID NO: 1447898 - RNA, 19 nt, Human
accuccaaagcuucccacg

SEQ ID NO: 1447899 - RNA, 21 nt, Human
accuccaaagcuucccacggc

SEQ ID NO: 1447900 - RNA, 17 nt, Human
accguggcccuuccugg

SEQ ID NO: 1447901 - RNA, 20 nt, Human
accgggccacuccuuccugc

SEQ ID NO: 1447902 - RNA, 19 nt, Human
accgggccacuccuuccug

SEQ ID NO: 1447903 - RNA, 12 nt, Human
accgggccacuc

SEQ ID NO: 1447904 - RNA, 21 nt, Human
accgggccacuccuuccugcc

SEQ ID NO: 1447905 - RNA, 13 nt, Human
accggggccuggg

SEQ ID NO: 1447906 - RNA, 15 nt, Human
accucaggcagcuca

SEQ ID NO: 1447907 - RNA, 12 nt, Human
accucaggcagc

SEQ ID NO: 1447908 - RNA, 17 nt, Human
accucagccugggcgcu

SEQ ID NO: 1447909 - RNA, 15 nt, Human
accucagccugggcg

SEQ ID NO: 1447910 - RNA, 14 nt, Human
accucagccugggc

SEQ ID NO: 1447911 - RNA, 13 nt, Human
accucagccuggg

SEQ ID NO: 1447912 - RNA, 12 nt, Human
accucagccugg

SEQ ID NO: 1447913 - RNA, 21 nt, Human
accucagccuggccagacaca

SEQ ID NO: 1447914 - RNA, 20 nt, Human
accucagccuggccagacac

SEQ ID NO: 1447915 - RNA, 19 nt, Human
accucagccuggccagaca

SEQ ID NO: 1447916 - RNA, 17 nt, Human
accucagccuggccaga

SEQ ID NO: 1447917 - RNA, 16 nt, Human
accucagccuggccag

SEQ ID NO: 1447918 - RNA, 15 nt, Human
accucagccuggcca

SEQ ID NO: 1447919 - RNA, 14 nt, Human
accucagccuggcc

SEQ ID NO: 1447920 - RNA, 13 nt, Human
accucagccuggc

SEQ ID NO: 1447921 - RNA, 16 nt, Human
accguggcccuuccug

SEQ ID NO: 1447922 - RNA, 11 nt, Human
accucagccug

SEQ ID NO: 1447923 - RNA, 23 nt, Human
accucagugccuuccuguuuuuc

SEQ ID NO: 1447924 - RNA, 21 nt, Human
accucaguaauuuagaaauca

SEQ ID NO: 1447925 - RNA, 17 nt, Human
accucaguaauuuagaa

SEQ ID NO: 1447926 - RNA, 15 nt, Human
accucaguaauuuag

SEQ ID NO: 1447927 - RNA, 17 nt, Human
accucaggcagcucaag

SEQ ID NO: 1447928 - RNA, 16 nt, Human
accucaggcagcucaa

SEQ ID NO: 1447929 - RNA, 13 nt, Human
acccguggaggcu

SEQ ID NO: 1447930 - RNA, 23 nt, Human
acccgugccaaguccagguccug

SEQ ID NO: 1447931 - RNA, 22 nt, Human
acccgugccaaguccagguccu

SEQ ID NO: 1447932 - RNA, 21 nt, Human
acccgugccaaguccaggucc

SEQ ID NO: 1447933 - RNA, 18 nt, Human
acccgugccaaguccagg

SEQ ID NO: 1447934 - RNA, 23 nt, Human
acccuauauuuugcauaguacca

SEQ ID NO: 1447935 - RNA, 21 nt, Human
acccuaguucuaccucaggca

SEQ ID NO: 1447936 - RNA, 15 nt, Human
acccuaguucuaccu

SEQ ID NO: 1447937 - RNA, 17 nt, Human
acccuagccuugcuugu

SEQ ID NO: 1447938 - RNA, 21 nt, Human
acccucacuggcucuccuggc

SEQ ID NO: 1447939 - RNA, 22 nt, Human
acccucacuggcucuccuggcc

SEQ ID NO: 1447940 - RNA, 19 nt, Human
acccucacuggcucuccug

SEQ ID NO: 1447941 - RNA, 15 nt, Human
acccucacuggcucu

SEQ ID NO: 1447942 - RNA, 15 nt, Human
acccucacacuggga

SEQ ID NO: 1447943 - RNA, 18 nt, Human
acccguucaugggggagg

SEQ ID NO: 1447944 - RNA, 23 nt, Human
acccguucaugggggagggggca

SEQ ID NO: 1447945 - RNA, 17 nt, Human
acccguucaugggggag

SEQ ID NO: 1447946 - RNA, 16 nt, Human
acccguucauggggga

SEQ ID NO: 1447947 - RNA, 21 nt, Human
acccguucaacuuuuccuuug

SEQ ID NO: 1447948 - RNA, 13 nt, Human
acccguucaacuu

SEQ ID NO: 1447949 - RNA, 17 nt, Human
acccguggaggcugcuc

SEQ ID NO: 1447950 - RNA, 15 nt, Human
acccguggaggcugc

SEQ ID NO: 1447951 - RNA, 16 nt, Human
acccuaaauaauaaaa

SEQ ID NO: 1447952 - RNA, 20 nt, Human
acccuaaauaauaaaaauaa

SEQ ID NO: 1447953 - RNA, 16 nt, Human
acccuaaaucuugacu

SEQ ID NO: 1447954 - RNA, 13 nt, Human
acccuaaccaagu

SEQ ID NO: 1447955 - RNA, 14 nt, Human
acccuaaccaaguu

SEQ ID NO: 1447956 - RNA, 15 nt, Human
acccuaaccaaguuc

SEQ ID NO: 1447957 - RNA, 17 nt, Human
acccuaccugugccuga

SEQ ID NO: 1447958 - RNA, 16 nt, Human
acccuaccugugccug

SEQ ID NO: 1447959 - RNA, 13 nt, Human
acccuaccugugc

SEQ ID NO: 1447960 - RNA, 16 nt, Human
acccuaaccaaguucc

SEQ ID NO: 1447961 - RNA, 17 nt, Human
acccuaaccaaguuccu

SEQ ID NO: 1447962 - RNA, 15 nt, Human
acccuagccuugcuu

SEQ ID NO: 1447963 - RNA, 12 nt, Human
acccuagccuug

SEQ ID NO: 1447964 - RNA, 14 nt, Human
acccuacuucuuuu

SEQ ID NO: 1447965 - RNA, 18 nt, Human
acccuacuucuuuugcuc

SEQ ID NO: 1447966 - RNA, 13 nt, Human
acccuagcaaaag

SEQ ID NO: 1447967 - RNA, 22 nt, Human
acccuguacuguucugugucuu

SEQ ID NO: 1447968 - RNA, 20 nt, Human
acccuguacuguucuguguc

SEQ ID NO: 1447969 - RNA, 19 nt, Human
acccuguccaaacugccua

SEQ ID NO: 1447970 - RNA, 15 nt, Human
acccuggugggccaa

SEQ ID NO: 1447971 - RNA, 11 nt, Human
acccuguccuc

SEQ ID NO: 1447972 - RNA, 13 nt, Human
acccugucugccc

SEQ ID NO: 1447973 - RNA, 21 nt, Human
acccugucugccccgcccuca

SEQ ID NO: 1447974 - RNA, 17 nt, Human
acccugggcccugggcu

SEQ ID NO: 1447975 - RNA, 15 nt, Human
acccugggcccuggg

SEQ ID NO: 1447976 - RNA, 14 nt, Human
acccugggcccugg

SEQ ID NO: 1447977 - RNA, 23 nt, Human
acccuggccuagaccagcagaca

SEQ ID NO: 1447978 - RNA, 22 nt, Human
acccuggccgcccccugccccc

SEQ ID NO: 1447979 - RNA, 19 nt, Human
acccuggccgcccccugcc

SEQ ID NO: 1447980 - RNA, 17 nt, Human
acccuggccgcccccug

SEQ ID NO: 1447981 - RNA, 16 nt, Human
acccuggccgcccccu

SEQ ID NO: 1447982 - RNA, 22 nt, Human
acccuggccgaguccaagcugg

SEQ ID NO: 1447983 - RNA, 21 nt, Human
acccuggccgaguccaagcug

SEQ ID NO: 1447984 - RNA, 18 nt, Human
acccuggccgaguccaag

SEQ ID NO: 1447985 - RNA, 19 nt, Human
acccuggccccucucccuu

SEQ ID NO: 1447986 - RNA, 18 nt, Human
acccuggccccucucccu

SEQ ID NO: 1447987 - RNA, 17 nt, Human
acccuggccccucuccc

SEQ ID NO: 1447988 - RNA, 16 nt, Human
acccuggccccucucc

SEQ ID NO: 1447989 - RNA, 15 nt, Human
acccuggcuccuugu

SEQ ID NO: 1447990 - RNA, 22 nt, Human
acccugggcccugggcuggaau

SEQ ID NO: 1447991 - RNA, 20 nt, Human
acccugggcccugggcugga

SEQ ID NO: 1447992 - RNA, 18 nt, Human
acccugggcccugggcug

SEQ ID NO: 1447993 - RNA, 21 nt, Human
acccucagggcaaagccaggu

SEQ ID NO: 1447994 - RNA, 19 nt, Human
acccucagggcaaagccag

SEQ ID NO: 1447995 - RNA, 18 nt, Human
acccucagggcaaagcca

SEQ ID NO: 1447996 - RNA, 20 nt, Human
acccucagaugcacaugagc

SEQ ID NO: 1447997 - RNA, 15 nt, Human
acccuggccccucuc

SEQ ID NO: 1447998 - RNA, 14 nt, Human
acccuggccccucu

SEQ ID NO: 1447999 - RNA, 21 nt, Human
acccuggaggccccaacccug

SEQ ID NO: 1448000 - RNA, 20 nt, Human
acccuggaggcaccuggugg

SEQ ID NO: 1448001 - RNA, 17 nt, Human
acccuggaggcaccugg

SEQ ID NO: 1448002 - RNA, 12 nt, Human
acccuggaggca

SEQ ID NO: 1448003 - RNA, 14 nt, Human
acccuggacccagc

SEQ ID NO: 1448004 - RNA, 18 nt, Human
acccucauacacagaaac

SEQ ID NO: 1448005 - RNA, 13 nt, Human
acccucaugcugu

SEQ ID NO: 1448006 - RNA, 14 nt, Human
acccucaucuuucu

SEQ ID NO: 1448007 - RNA, 13 nt, Human
acccucaucuuuc

SEQ ID NO: 1448008 - RNA, 19 nt, Human
acccucaucuuucuuccaa

SEQ ID NO: 1448009 - RNA, 16 nt, Human
acccucaucuuucuuc

SEQ ID NO: 1448010 - RNA, 12 nt, Human
acccucaugcug

SEQ ID NO: 1448011 - RNA, 21 nt, Human
auacuuuuuuuucuuuaaaaa

SEQ ID NO: 1448012 - RNA, 17 nt, Human
auacuuuuacucugccu

SEQ ID NO: 1448013 - RNA, 20 nt, Human
auacuuuuuacaauuaaaaa

SEQ ID NO: 1448014 - RNA, 13 nt, Human
auacuuuuuacaa

SEQ ID NO: 1448015 - RNA, 19 nt, Human
auacuuuuuaaauguaaag

SEQ ID NO: 1448016 - RNA, 16 nt, Human
auacuuuugcccuuug

SEQ ID NO: 1448017 - RNA, 20 nt, Human
auacuuuuacucugccuaca

SEQ ID NO: 1448018 - RNA, 16 nt, Human
auacuuuuacucugcc

SEQ ID NO: 1448019 - RNA, 15 nt, Human
auacuuuuacucugc

SEQ ID NO: 1448020 - RNA, 21 nt, Human
auacuuuuacaaguaacaaaa

SEQ ID NO: 1448021 - RNA, 20 nt, Human
auacuuuuacaaguaacaaa

SEQ ID NO: 1448022 - RNA, 19 nt, Human
auacuugaacguuuucuaa

SEQ ID NO: 1448023 - RNA, 16 nt, Human
auacuuuuacaaguaa

SEQ ID NO: 1448024 - RNA, 22 nt, Human
auacuugaagggccagagccag

SEQ ID NO: 1448025 - RNA, 21 nt, Human
auacuugaagggccagagcca

SEQ ID NO: 1448026 - RNA, 20 nt, Human
auacuugaagggccagagcc

SEQ ID NO: 1448027 - RNA, 19 nt, Human
auacuugaagggccagagc

SEQ ID NO: 1448028 - RNA, 18 nt, Human
auacuugaagggccagag

SEQ ID NO: 1448029 - RNA, 17 nt, Human
auacuugaagggccaga

SEQ ID NO: 1448030 - RNA, 16 nt, Human
auacuugaagggccag

SEQ ID NO: 1448031 - RNA, 21 nt, Human
auacuugaacguuuucuaauu

SEQ ID NO: 1448032 - RNA, 19 nt, Human
auacuguugcacguguguu

SEQ ID NO: 1448033 - RNA, 15 nt, Human
auacuguugugcgca

SEQ ID NO: 1448034 - RNA, 18 nt, Human
auacuguugcacgugugu

SEQ ID NO: 1448035 - RNA, 15 nt, Human
auacuguugcacgug

SEQ ID NO: 1448036 - RNA, 14 nt, Human
auacuguugcacgu

SEQ ID NO: 1448037 - RNA, 13 nt, Human
auacuguugcacg

SEQ ID NO: 1448038 - RNA, 12 nt, Human
auacuguugcac

SEQ ID NO: 1448039 - RNA, 11 nt, Human
auacuguugca

SEQ ID NO: 1448040 - RNA, 19 nt, Human
auacuguauuuuguauugu

SEQ ID NO: 1448041 - RNA, 11 nt, Human
auacacugugu

SEQ ID NO: 1448042 - RNA, 18 nt, Human
auacacuguguaaauacc

SEQ ID NO: 1448043 - RNA, 17 nt, Human
auacacuguguaaauac

SEQ ID NO: 1448044 - RNA, 24 nt, Human
auacacccaagaugggcaucuuuu

SEQ ID NO: 1448045 - RNA, 17 nt, Human
auacaccacuacauucu

SEQ ID NO: 1448046 - RNA, 18 nt, Human
auacaccacuacauucug

SEQ ID NO: 1448047 - RNA, 22 nt, Human
auaaagacguuuuauaagcauc

SEQ ID NO: 1448048 - RNA, 21 nt, Human
auaaagacguuuuauaagcau

SEQ ID NO: 1448049 - RNA, 20 nt, Human
auaaagacguuuuauaagca

SEQ ID NO: 1448050 - RNA, 16 nt, Human
auaaagacguuuuaua

SEQ ID NO: 1448051 - RNA, 14 nt, Human
auaaagaccacuuu

SEQ ID NO: 1448052 - RNA, 20 nt, Human
auaaaagaugaaagagcagu

SEQ ID NO: 1448053 - RNA, 10 nt, Human
auaaaagaug

SEQ ID NO: 1448054 - RNA, 20 nt, Human
auaaaacaucuuugaaauua

SEQ ID NO: 1448055 - RNA, 24 nt, Human
auaaagacguuuuauaagcaucau

SEQ ID NO: 1448056 - RNA, 21 nt, Human
auaaagaugagugagcaugcc

SEQ ID NO: 1448057 - RNA, 12 nt, Human
auaagugcccuc

SEQ ID NO: 1448058 - RNA, 13 nt, Human
auaagugcuguau

SEQ ID NO: 1448059 - RNA, 14 nt, Human
auaagugcuguaua

SEQ ID NO: 1448060 - RNA, 15 nt, Human
auaagugcuguauaa

SEQ ID NO: 1448061 - RNA, 16 nt, Human
auaagugcuguauaaa

SEQ ID NO: 1448062 - RNA, 13 nt, Human
auaaguaaguuug

SEQ ID NO: 1448063 - RNA, 22 nt, Human
auaaguggacaaauuuugaguu

SEQ ID NO: 1448064 - RNA, 22 nt, Human
auaagugcuguauaaaaucagc

SEQ ID NO: 1448065 - RNA, 17 nt, Human
auaagugcuguauaaaa

SEQ ID NO: 1448066 - RNA, 18 nt, Human
auaagugcuguauaaaau

SEQ ID NO: 1448067 - RNA, 19 nt, Human
auaagugcuguauaaaauc

SEQ ID NO: 1448068 - RNA, 20 nt, Human
auaagugcuguauaaaauca

SEQ ID NO: 1448069 - RNA, 20 nt, Human
auaauguguaguucauguaa

SEQ ID NO: 1448070 - RNA, 23 nt, Human
auaauguguaguucauguaaaua

SEQ ID NO: 1448071 - RNA, 19 nt, Human
auaauguguaguucaugua

SEQ ID NO: 1448072 - RNA, 18 nt, Human
auaauguguaguucaugu

SEQ ID NO: 1448073 - RNA, 15 nt, Human
auacaccacuacauu

SEQ ID NO: 1448074 - RNA, 23 nt, Human
auacaaugcugugcccuaaagug

SEQ ID NO: 1448075 - RNA, 18 nt, Human
auaagcuauuuuucuaac

SEQ ID NO: 1448076 - RNA, 16 nt, Human
auaagcuauuuuucua

SEQ ID NO: 1448077 - RNA, 23 nt, Human
auaagcuauuugauguaauacuu

SEQ ID NO: 1448078 - RNA, 22 nt, Human
auaagcuauuugauguaauacu

SEQ ID NO: 1448079 - RNA, 18 nt, Human
auaagcuauuugauguaa

SEQ ID NO: 1448080 - RNA, 16 nt, Human
auaagcuauuugaugu

SEQ ID NO: 1448081 - RNA, 15 nt, Human
auaagcuauuugaug

SEQ ID NO: 1448082 - RNA, 13 nt, Human
auaagcuauuuga

SEQ ID NO: 1448083 - RNA, 19 nt, Human
auaagguuuuaauuuagua

SEQ ID NO: 1448084 - RNA, 18 nt, Human
auaagcuuaugcuuaaau

SEQ ID NO: 1448085 - RNA, 20 nt, Human
aguuguuagauuaagaaaua

SEQ ID NO: 1448086 - RNA, 21 nt, Human
aguuguucgggccaaggaccu

SEQ ID NO: 1448087 - RNA, 19 nt, Human
aguuguuccuuaagucaga

SEQ ID NO: 1448088 - RNA, 12 nt, Human
aguugaauauug

SEQ ID NO: 1448089 - RNA, 19 nt, Human
aguucuuuuugaaguauuu

SEQ ID NO: 1448090 - RNA, 14 nt, Human
aguugaagcaaauc

SEQ ID NO: 1448091 - RNA, 22 nt, Human
aguucuuuguucauagcccagu

SEQ ID NO: 1448092 - RNA, 21 nt, Human
aguucuuuguucauagcccag

SEQ ID NO: 1448093 - RNA, 16 nt, Human
aguuccagaaaguaaa

SEQ ID NO: 1448094 - RNA, 15 nt, Human
aguuccagaaaguaa

SEQ ID NO: 1448095 - RNA, 20 nt, Human
aguuccacuuauagccucug

SEQ ID NO: 1448096 - RNA, 15 nt, Human
aguuccacugagacc

SEQ ID NO: 1448097 - RNA, 13 nt, Human
aguuccacugaga

SEQ ID NO: 1448098 - RNA, 20 nt, Human
aguuccaagagucuaaagau

SEQ ID NO: 1448099 - RNA, 19 nt, Human
aguucuuuguucauagccc

SEQ ID NO: 1448100 - RNA, 21 nt, Human
aguucuuugggccagacaugc

SEQ ID NO: 1448101 - RNA, 14 nt, Human
aguuccagaagugu

SEQ ID NO: 1448102 - RNA, 18 nt, Human
aguuccagaagugugacu

SEQ ID NO: 1448103 - RNA, 22 nt, Human
aguucauauguaccauguacau

SEQ ID NO: 1448104 - RNA, 18 nt, Human
aguucauauguaccaugu

SEQ ID NO: 1448105 - RNA, 14 nt, Human
agugcucaaggcca

SEQ ID NO: 1448106 - RNA, 16 nt, Human
agugcucaaggccagc

SEQ ID NO: 1448107 - RNA, 11 nt, Human
agugcucccuc

SEQ ID NO: 1448108 - RNA, 17 nt, Human
agugcucauuucaggau

SEQ ID NO: 1448109 - RNA, 17 nt, Human
agugcucccucacaugu

SEQ ID NO: 1448110 - RNA, 14 nt, Human
agugcucccucaca

SEQ ID NO: 1448111 - RNA, 20 nt, Human
aguggcaucaucucagcuca

SEQ ID NO: 1448112 - RNA, 19 nt, Human
aguggcaucaucucagcuc

SEQ ID NO: 1448113 - RNA, 14 nt, Human
agugcucgcuguug

SEQ ID NO: 1448114 - RNA, 19 nt, Human
aguggcccauggcauuuua

SEQ ID NO: 1448115 - RNA, 18 nt, Human
aguggccaagaagcagug

SEQ ID NO: 1448116 - RNA, 11 nt, Human
aguguuucuuu

SEQ ID NO: 1448117 - RNA, 22 nt, Human
aguuaacacacuaccgaaugug

SEQ ID NO: 1448118 - RNA, 16 nt, Human
aguuaacacacuaccg

SEQ ID NO: 1448119 - RNA, 13 nt, Human
aguuaacacacua

SEQ ID NO: 1448120 - RNA, 12 nt, Human
aguuaacacacu

SEQ ID NO: 1448121 - RNA, 12 nt, Human
aguuaaauguag

SEQ ID NO: 1448122 - RNA, 15 nt, Human
aguguuuucucugaa

SEQ ID NO: 1448123 - RNA, 15 nt, Human
aguguuuucugggau

SEQ ID NO: 1448124 - RNA, 13 nt, Human
aguguuuucuggg

SEQ ID NO: 1448125 - RNA, 14 nt, Human
aguguuuucucuga

SEQ ID NO: 1448126 - RNA, 21 nt, Human
aguguuuuaugagaaagccuu

SEQ ID NO: 1448127 - RNA, 18 nt, Human
aguguuuuaugagaaagc

SEQ ID NO: 1448128 - RNA, 19 nt, Human
aguuaacagacaacacguu

SEQ ID NO: 1448129 - RNA, 15 nt, Human
aguuaacuauugcau

SEQ ID NO: 1448130 - RNA, 17 nt, Human
aguuaacuauugcauuu

SEQ ID NO: 1448131 - RNA, 19 nt, Human
aguuaacuauugcauuuau

SEQ ID NO: 1448132 - RNA, 23 nt, Human
aguuaauuuuuccaacuacuaau

SEQ ID NO: 1448133 - RNA, 17 nt, Human
aguuaauuuuuccaacu

SEQ ID NO: 1448134 - RNA, 15 nt, Human
aguuaauuuuuccaa

SEQ ID NO: 1448135 - RNA, 14 nt, Human
aguuaauuuaaagu

SEQ ID NO: 1448136 - RNA, 24 nt, Human
aguuaacuauugcauuuauaugua

SEQ ID NO: 1448137 - RNA, 20 nt, Human
aguuaacuauugcauuuaua

SEQ ID NO: 1448138 - RNA, 23 nt, Human
aguuucugucguuaaaaacagau

SEQ ID NO: 1448139 - RNA, 22 nt, Human
aguuucugucguuaaaaacaga

SEQ ID NO: 1448140 - RNA, 20 nt, Human
aguuucugucguuaaaaaca

SEQ ID NO: 1448141 - RNA, 17 nt, Human
aguuucugggaccucag

SEQ ID NO: 1448142 - RNA, 18 nt, Human
aguuugaugaggcccucc

SEQ ID NO: 1448143 - RNA, 16 nt, Human
aguuugauuaaauucu

SEQ ID NO: 1448144 - RNA, 17 nt, Human
aguuugaugaggcccuc

SEQ ID NO: 1448145 - RNA, 16 nt, Human
aguuugaugaggcccu

SEQ ID NO: 1448146 - RNA, 14 nt, Human
aguuugauuaaauu

SEQ ID NO: 1448147 - RNA, 12 nt, Human
auaaaacaggua

SEQ ID NO: 1448148 - RNA, 16 nt, Human
auaaaaaugaucuaaa

SEQ ID NO: 1448149 - RNA, 12 nt, Human
auaaaaauguuu

SEQ ID NO: 1448150 - RNA, 17 nt, Human
auaaaaaugaucuaaac

SEQ ID NO: 1448151 - RNA, 18 nt, Human
auaaaaagaucacuuucu

SEQ ID NO: 1448152 - RNA, 22 nt, Human
auaaaaagaucacuuucucagu

SEQ ID NO: 1448153 - RNA, 16 nt, Human
auaaaagacagugaaa

SEQ ID NO: 1448154 - RNA, 15 nt, Human
auaaaagacagugaa

SEQ ID NO: 1448155 - RNA, 16 nt, Human
auaaaaaagaucccaa

SEQ ID NO: 1448156 - RNA, 15 nt, Human
auaaaaaagauccca

SEQ ID NO: 1448157 - RNA, 11 nt, Human
auaaaaaagau

SEQ ID NO: 1448158 - RNA, 17 nt, Human
auaaaaaagaucccaaa

SEQ ID NO: 1448159 - RNA, 13 nt, Human
auaaaaaaugguu

SEQ ID NO: 1448160 - RNA, 14 nt, Human
auaaaaagaaaggc

SEQ ID NO: 1448161 - RNA, 14 nt, Human
auaaaaagaucacu

SEQ ID NO: 1448162 - RNA, 13 nt, Human
auaaaaagaauga

SEQ ID NO: 1448163 - RNA, 15 nt, Human
aggggccagaggcuc

SEQ ID NO: 1448164 - RNA, 14 nt, Human
aggggccagaggcu

SEQ ID NO: 1448165 - RNA, 13 nt, Human
aggggccagaggc

SEQ ID NO: 1448166 - RNA, 12 nt, Human
aggggccagagg

SEQ ID NO: 1448167 - RNA, 17 nt, Human
aggggccagaggcucgu

SEQ ID NO: 1448168 - RNA, 14 nt, Human
aguaaacuuuuugu

SEQ ID NO: 1448169 - RNA, 23 nt, Human
aguaaaccacugaaaaaauauau

SEQ ID NO: 1448170 - RNA, 17 nt, Human
aguaaaccacugaaaaa

SEQ ID NO: 1448171 - RNA, 15 nt, Human
aguaaaccacugaaa

SEQ ID NO: 1448172 - RNA, 22 nt, Human
aguaaaauugccauauugcaca

SEQ ID NO: 1448173 - RNA, 23 nt, Human
aguaaaauugccauauugcacau

SEQ ID NO: 1448174 - RNA, 17 nt, Human
aguaaaauugccauauu

SEQ ID NO: 1448175 - RNA, 19 nt, Human
aguaaaauugccauauugc

SEQ ID NO: 1448176 - RNA, 20 nt, Human
aguaaaauugccauauugca

SEQ ID NO: 1448177 - RNA, 21 nt, Human
aguaaaauugccauauugcac

SEQ ID NO: 1448178 - RNA, 14 nt, Human
aguaaaauugccau

SEQ ID NO: 1448179 - RNA, 16 nt, Human
aguaaaauugccauau

SEQ ID NO: 1448180 - RNA, 14 nt, Human
aguaaauaaugcuu

SEQ ID NO: 1448181 - RNA, 18 nt, Human
aguaaagucaaggagaaa

SEQ ID NO: 1448182 - RNA, 16 nt, Human
aguaaagucaaggaga

SEQ ID NO: 1448183 - RNA, 15 nt, Human
aguaaagaauuauuu

SEQ ID NO: 1448184 - RNA, 16 nt, Human
aguaaagaauuauuuu

SEQ ID NO: 1448185 - RNA, 22 nt, Human
aguaaagaacguggucagagua

SEQ ID NO: 1448186 - RNA, 15 nt, Human
aguaaauacaauuuu

SEQ ID NO: 1448187 - RNA, 21 nt, Human
aguaaaugggggugcauuuga

SEQ ID NO: 1448188 - RNA, 19 nt, Human
aguaaaugggggugcauuu

SEQ ID NO: 1448189 - RNA, 20 nt, Human
aguaaaugggggugcauuug

SEQ ID NO: 1448190 - RNA, 13 nt, Human
aguaccugagggu

SEQ ID NO: 1448191 - RNA, 17 nt, Human
aguaacuguuuuuuaag

SEQ ID NO: 1448192 - RNA, 19 nt, Human
aguaacuucuuauggaauu

SEQ ID NO: 1448193 - RNA, 17 nt, Human
aguaacuucuuauggaa

SEQ ID NO: 1448194 - RNA, 23 nt, Human
aguaacuguuuuuuaagucucuc

SEQ ID NO: 1448195 - RNA, 11 nt, Human
aguaacuguuu

SEQ ID NO: 1448196 - RNA, 14 nt, Human
aguaacucaucugu

SEQ ID NO: 1448197 - RNA, 18 nt, Human
aguaacgcgucuuccuga

SEQ ID NO: 1448198 - RNA, 17 nt, Human
aguaacgcgucuuccug

SEQ ID NO: 1448199 - RNA, 16 nt, Human
aguaacgcgucuuccu

SEQ ID NO: 1448200 - RNA, 22 nt, Human
aguaacgcgucuuccugagugg

SEQ ID NO: 1448201 - RNA, 19 nt, Human
aguaacgcgucuuccugag

SEQ ID NO: 1448202 - RNA, 17 nt, Human
aguaacuacaguuaggg

SEQ ID NO: 1448203 - RNA, 19 nt, Human
aguaacuacaguuagggcu

SEQ ID NO: 1448204 - RNA, 20 nt, Human
aguacuccacacugcacaau

SEQ ID NO: 1448205 - RNA, 19 nt, Human
aguacuccacacugcacaa

SEQ ID NO: 1448206 - RNA, 18 nt, Human
aguacuccacacugcaca

SEQ ID NO: 1448207 - RNA, 16 nt, Human
aguacuccacacugca

SEQ ID NO: 1448208 - RNA, 15 nt, Human
aguacuccacacugc

SEQ ID NO: 1448209 - RNA, 14 nt, Human
aguacuccacacug

SEQ ID NO: 1448210 - RNA, 13 nt, Human
aguacuccacacu

SEQ ID NO: 1448211 - RNA, 18 nt, Human
aguacgaaccuacaguuu

SEQ ID NO: 1448212 - RNA, 16 nt, Human
aguacgaaccuacagu

SEQ ID NO: 1448213 - RNA, 19 nt, Human
aguaccuuuuauaucccau

SEQ ID NO: 1448214 - RNA, 18 nt, Human
aguaccugggcaagcugg

SEQ ID NO: 1448215 - RNA, 19 nt, Human
aguaccugggcaagcuggc

SEQ ID NO: 1448216 - RNA, 13 nt, Human
aguaccugggcaa

SEQ ID NO: 1448217 - RNA, 22 nt, Human
aguaccugagggucuguagguu

SEQ ID NO: 1448218 - RNA, 21 nt, Human
aguaccugagggucuguaggu

SEQ ID NO: 1448219 - RNA, 19 nt, Human
aguaccugagggucuguag

SEQ ID NO: 1448220 - RNA, 16 nt, Human
aguaccugagggucug

SEQ ID NO: 1448221 - RNA, 15 nt, Human
aguaccugagggucu

SEQ ID NO: 1448222 - RNA, 14 nt, Human
aguacguugugcau

SEQ ID NO: 1448223 - RNA, 21 nt, Human
aguauauugauaaccuugaaa

SEQ ID NO: 1448224 - RNA, 22 nt, Human
aguauauugauccagaaagaaa

SEQ ID NO: 1448225 - RNA, 14 nt, Human
agugaaugcuggga

SEQ ID NO: 1448226 - RNA, 15 nt, Human
agugaaugcugggac

SEQ ID NO: 1448227 - RNA, 11 nt, Human
agugacagcua

SEQ ID NO: 1448228 - RNA, 13 nt, Human
agugaaugauuca

SEQ ID NO: 1448229 - RNA, 20 nt, Human
agugaauacugcuacagcaa

SEQ ID NO: 1448230 - RNA, 16 nt, Human
agugaauacugcuaca

SEQ ID NO: 1448231 - RNA, 17 nt, Human
agugaauaaaugucuug

SEQ ID NO: 1448232 - RNA, 14 nt, Human
agugaauaaauguc

SEQ ID NO: 1448233 - RNA, 19 nt, Human
agugaaugauucaguguua

SEQ ID NO: 1448234 - RNA, 17 nt, Human
agugaaugauucagugu

SEQ ID NO: 1448235 - RNA, 16 nt, Human
agugaaugauucagug

SEQ ID NO: 1448236 - RNA, 19 nt, Human
agugcgguuuacucacugc

SEQ ID NO: 1448237 - RNA, 16 nt, Human
agugcggguccggcag

SEQ ID NO: 1448238 - RNA, 15 nt, Human
agugcguccacgagc

SEQ ID NO: 1448239 - RNA, 21 nt, Human
agugccuuucaggaucuauuu

SEQ ID NO: 1448240 - RNA, 19 nt, Human
agugccuuucaggaucuau

SEQ ID NO: 1448241 - RNA, 17 nt, Human
agugccuuucaggaucu

SEQ ID NO: 1448242 - RNA, 13 nt, Human
agugccuuucagg

SEQ ID NO: 1448243 - RNA, 19 nt, Human
agugccuuccuguuuuuca

SEQ ID NO: 1448244 - RNA, 16 nt, Human
agugcuacagggucca

SEQ ID NO: 1448245 - RNA, 14 nt, Human
agugcuaaguguga

SEQ ID NO: 1448246 - RNA, 21 nt, Human
agugcuaagguucuaaggccu

SEQ ID NO: 1448247 - RNA, 18 nt, Human
agugcuaagguucuaagg

SEQ ID NO: 1448248 - RNA, 17 nt, Human
agugcuaagguucuaag

SEQ ID NO: 1448249 - RNA, 16 nt, Human
agugcuaagguucuaa

SEQ ID NO: 1448250 - RNA, 13 nt, Human
agugcuaagugug

SEQ ID NO: 1448251 - RNA, 15 nt, Human
agugcuaagguucua

SEQ ID NO: 1448252 - RNA, 14 nt, Human
agugcuaagguucu

SEQ ID NO: 1448253 - RNA, 13 nt, Human
agugcuaagguuc

SEQ ID NO: 1448254 - RNA, 20 nt, Human
aguaucaucagauagcaucu

SEQ ID NO: 1448255 - RNA, 15 nt, Human
aguaucaugcccugu

SEQ ID NO: 1448256 - RNA, 19 nt, Human
aguaucaugcccugugcaa

SEQ ID NO: 1448257 - RNA, 22 nt, Human
agucauuugcugagcauguacu

SEQ ID NO: 1448258 - RNA, 19 nt, Human
agucauuugcugagcaugu

SEQ ID NO: 1448259 - RNA, 22 nt, Human
aguccugugaaugccacugccu

SEQ ID NO: 1448260 - RNA, 21 nt, Human
aguccuuuuuuuccaucuuua

SEQ ID NO: 1448261 - RNA, 16 nt, Human
aguccuuuuuuuccau

SEQ ID NO: 1448262 - RNA, 14 nt, Human
aguccuuggccugc

SEQ ID NO: 1448263 - RNA, 24 nt, Human
aguccuuaaaauguaagauuauag

SEQ ID NO: 1448264 - RNA, 19 nt, Human
agucgauagagcuguauua

SEQ ID NO: 1448265 - RNA, 13 nt, Human
agugaauaaaugu

SEQ ID NO: 1448266 - RNA, 13 nt, Human
agucuguccuuga

SEQ ID NO: 1448267 - RNA, 12 nt, Human
agucuguccuug

SEQ ID NO: 1448268 - RNA, 15 nt, Human
agucuggugaagcuc

SEQ ID NO: 1448269 - RNA, 21 nt, Human
agucuggauaacuuccacagg

SEQ ID NO: 1448270 - RNA, 23 nt, Human
agucuggauaacuuccacagggu

SEQ ID NO: 1448271 - RNA, 20 nt, Human
agucuggauaacuuccacag

SEQ ID NO: 1448272 - RNA, 16 nt, Human
augcauguccuguaaa

SEQ ID NO: 1448273 - RNA, 20 nt, Human
augcaugguuucagcacuag

SEQ ID NO: 1448274 - RNA, 19 nt, Human
augcaugguuucagcacua

SEQ ID NO: 1448275 - RNA, 18 nt, Human
augcaugguuucagcacu

SEQ ID NO: 1448276 - RNA, 17 nt, Human
augcaugguuucagcac

SEQ ID NO: 1448277 - RNA, 16 nt, Human
augcaugguuucagca

SEQ ID NO: 1448278 - RNA, 13 nt, Human
augcaugguuuca

SEQ ID NO: 1448279 - RNA, 22 nt, Human
augcauggugccccaggaccag

SEQ ID NO: 1448280 - RNA, 21 nt, Human
augcauggugccccaggacca

SEQ ID NO: 1448281 - RNA, 17 nt, Human
augcauguccuguaaag

SEQ ID NO: 1448282 - RNA, 14 nt, Human
augcauaaaugcau

SEQ ID NO: 1448283 - RNA, 14 nt, Human
augcauacaaguuu

SEQ ID NO: 1448284 - RNA, 20 nt, Human
augcauggugccccaggacc

SEQ ID NO: 1448285 - RNA, 19 nt, Human
augcauggugccccaggac

SEQ ID NO: 1448286 - RNA, 18 nt, Human
augcauggugccccagga

SEQ ID NO: 1448287 - RNA, 17 nt, Human
augcauggugccccagg

SEQ ID NO: 1448288 - RNA, 16 nt, Human
augcauggugccccag

SEQ ID NO: 1448289 - RNA, 23 nt, Human
augcauggagggcugcccuguac

SEQ ID NO: 1448290 - RNA, 16 nt, Human
augcauggaaauuccc

SEQ ID NO: 1448291 - RNA, 20 nt, Human
augcaucagaaagggagggc

SEQ ID NO: 1448292 - RNA, 18 nt, Human
augcaucagaaagggagg

SEQ ID NO: 1448293 - RNA, 15 nt, Human
augcaucagaaaggg

SEQ ID NO: 1448294 - RNA, 14 nt, Human
augcaucagaaagg

SEQ ID NO: 1448295 - RNA, 16 nt, Human
augcauauuuguuuau

SEQ ID NO: 1448296 - RNA, 17 nt, Human
augcauacacucucaaa

SEQ ID NO: 1448297 - RNA, 12 nt, Human
augcauauuugu

SEQ ID NO: 1448298 - RNA, 24 nt, Human
augcauauuauuuuauguugcaua

SEQ ID NO: 1448299 - RNA, 17 nt, Human
auggagugcaccaaaga

SEQ ID NO: 1448300 - RNA, 20 nt, Human
auggagauugaccuggaugg

SEQ ID NO: 1448301 - RNA, 17 nt, Human
auggagauugaccugga

SEQ ID NO: 1448302 - RNA, 20 nt, Human
auggagauucaguuuucauu

SEQ ID NO: 1448303 - RNA, 18 nt, Human
auggagagcccugggacc

SEQ ID NO: 1448304 - RNA, 15 nt, Human
auggagagcccuggg

SEQ ID NO: 1448305 - RNA, 13 nt, Human
auggagagcccug

SEQ ID NO: 1448306 - RNA, 19 nt, Human
auggagauucaguuuucau

SEQ ID NO: 1448307 - RNA, 16 nt, Human
auggagagcccuggga

SEQ ID NO: 1448308 - RNA, 16 nt, Human
augcuuugaaacagaa

SEQ ID NO: 1448309 - RNA, 19 nt, Human
augcuuugaaauugaaccu

SEQ ID NO: 1448310 - RNA, 21 nt, Human
augcuuugaaauugaaccuuu

SEQ ID NO: 1448311 - RNA, 18 nt, Human
augcuuugaaacagaaaa

SEQ ID NO: 1448312 - RNA, 17 nt, Human
augcuuugaaacagaaa

SEQ ID NO: 1448313 - RNA, 15 nt, Human
augcucuuaauugcc

SEQ ID NO: 1448314 - RNA, 23 nt, Human
augcucuuaauugccaccucuaa

SEQ ID NO: 1448315 - RNA, 19 nt, Human
augcucuuaauugccaccu

SEQ ID NO: 1448316 - RNA, 16 nt, Human
augcucuuaauugcca

SEQ ID NO: 1448317 - RNA, 15 nt, Human
auggaguuucuaagg

SEQ ID NO: 1448318 - RNA, 16 nt, Human
auggaguuucuaaggu

SEQ ID NO: 1448319 - RNA, 14 nt, Human
auggaguuucuaag

SEQ ID NO: 1448320 - RNA, 13 nt, Human
auggaguuucuaa

SEQ ID NO: 1448321 - RNA, 16 nt, Human
auggaguguacaagua

SEQ ID NO: 1448322 - RNA, 22 nt, Human
auggaguggcagcccagccagc

SEQ ID NO: 1448323 - RNA, 20 nt, Human
auggaguggcagcccagcca

SEQ ID NO: 1448324 - RNA, 18 nt, Human
auggaguggcagcccagc

SEQ ID NO: 1448325 - RNA, 17 nt, Human
auggaguggcagcccag

SEQ ID NO: 1448326 - RNA, 21 nt, Human
auggagugcuguuuuguuaua

SEQ ID NO: 1448327 - RNA, 20 nt, Human
auggagugcuguuuuguuau

SEQ ID NO: 1448328 - RNA, 19 nt, Human
auggagugcuguuuuguua

SEQ ID NO: 1448329 - RNA, 18 nt, Human
auggagugcuguuuuguu

SEQ ID NO: 1448330 - RNA, 13 nt, Human
auggagugcuguu

SEQ ID NO: 1448331 - RNA, 12 nt, Human
auggagugcugu

SEQ ID NO: 1448332 - RNA, 20 nt, Human
auggagugcaccaaagagaa

SEQ ID NO: 1448333 - RNA, 19 nt, Human
auggagugcaccaaagaga

SEQ ID NO: 1448334 - RNA, 18 nt, Human
auggagugcaccaaagag

SEQ ID NO: 1448335 - RNA, 23 nt, Human
auggcuuccuggcaauagucaaa

SEQ ID NO: 1448336 - RNA, 17 nt, Human
augggaacaauugaagu

SEQ ID NO: 1448337 - RNA, 20 nt, Human
augggacauuugcucaugga

SEQ ID NO: 1448338 - RNA, 13 nt, Human
augaggcuuucca

SEQ ID NO: 1448339 - RNA, 14 nt, Human
augagggaaaagaa

SEQ ID NO: 1448340 - RNA, 13 nt, Human
augagggaaaaga

SEQ ID NO: 1448341 - RNA, 11 nt, Human
aucuaggauuu

SEQ ID NO: 1448342 - RNA, 18 nt, Human
aucuaggcaacauaguau

SEQ ID NO: 1448343 - RNA, 19 nt, Human
aucuaggauuuuaagggaa

SEQ ID NO: 1448344 - RNA, 21 nt, Human
augagcuuugucuacuucaaa

SEQ ID NO: 1448345 - RNA, 22 nt, Human
augagcuuucugaacagcuggu

SEQ ID NO: 1448346 - RNA, 21 nt, Human
augagcuuucugaacagcugg

SEQ ID NO: 1448347 - RNA, 20 nt, Human
augagcuuucugaacagcug

SEQ ID NO: 1448348 - RNA, 19 nt, Human
augagcuuucugaacagcu

SEQ ID NO: 1448349 - RNA, 18 nt, Human
augagcuuucugaacagc

SEQ ID NO: 1448350 - RNA, 17 nt, Human
augagcuuucugaacag

SEQ ID NO: 1448351 - RNA, 15 nt, Human
augagcuuucugaac

SEQ ID NO: 1448352 - RNA, 14 nt, Human
augagcuuucugaa

SEQ ID NO: 1448353 - RNA, 13 nt, Human
augagcuuucuga

SEQ ID NO: 1448354 - RNA, 12 nt, Human
augagcuuucug

SEQ ID NO: 1448355 - RNA, 16 nt, Human
augagcucuucauguu

SEQ ID NO: 1448356 - RNA, 19 nt, Human
augaggcccuccacaccug

SEQ ID NO: 1448357 - RNA, 20 nt, Human
augaggcccuccacaccugc

SEQ ID NO: 1448358 - RNA, 15 nt, Human
augaggcccuccaca

SEQ ID NO: 1448359 - RNA, 14 nt, Human
augaggcccuccac

SEQ ID NO: 1448360 - RNA, 23 nt, Human
augagcuuucugaacagcuggug

SEQ ID NO: 1448361 - RNA, 15 nt, Human
augaggccacuggag

SEQ ID NO: 1448362 - RNA, 12 nt, Human
augaggccagac

SEQ ID NO: 1448363 - RNA, 13 nt, Human
augaggccagacc

SEQ ID NO: 1448364 - RNA, 14 nt, Human
augaggccagacca

SEQ ID NO: 1448365 - RNA, 21 nt, Human
augaggccauggacucugucc

SEQ ID NO: 1448366 - RNA, 15 nt, Human
augaggccauggacu

SEQ ID NO: 1448367 - RNA, 17 nt, Human
augaggccagaccaugg

SEQ ID NO: 1448368 - RNA, 13 nt, Human
augaagcuguugu

SEQ ID NO: 1448369 - RNA, 23 nt, Human
augaaguaauaugcacacauuuu

SEQ ID NO: 1448370 - RNA, 14 nt, Human
augaaguaauaugc

SEQ ID NO: 1448371 - RNA, 21 nt, Human
augaaguaauaugcacacauu

SEQ ID NO: 1448372 - RNA, 12 nt, Human
augaauacuuug

SEQ ID NO: 1448373 - RNA, 21 nt, Human
augaauacuguauuuuguauu

SEQ ID NO: 1448374 - RNA, 21 nt, Human
augaauacauuuccaaaaugg

SEQ ID NO: 1448375 - RNA, 14 nt, Human
augaauacauuucc

SEQ ID NO: 1448376 - RNA, 20 nt, Human
augaagccuccuuagaaaaa

SEQ ID NO: 1448377 - RNA, 16 nt, Human
augaaacuuuuggaag

SEQ ID NO: 1448378 - RNA, 21 nt, Human
aucaaacccuagccuugcuug

SEQ ID NO: 1448379 - RNA, 20 nt, Human
aucaaacccuagccuugcuu

SEQ ID NO: 1448380 - RNA, 18 nt, Human
aucaaacccuagccuugc

SEQ ID NO: 1448381 - RNA, 17 nt, Human
aucaaacccuagccuug

SEQ ID NO: 1448382 - RNA, 16 nt, Human
aucaaacauuuugaaa

SEQ ID NO: 1448383 - RNA, 15 nt, Human
aucaaacauuuugaa

SEQ ID NO: 1448384 - RNA, 14 nt, Human
aucaaacauuuuga

SEQ ID NO: 1448385 - RNA, 22 nt, Human
aucaaaagggccaaagaaccaa

SEQ ID NO: 1448386 - RNA, 18 nt, Human
aucaaaagggccaaagaa

SEQ ID NO: 1448387 - RNA, 22 nt, Human
aucaaacccuagccuugcuugu

SEQ ID NO: 1448388 - RNA, 18 nt, Human
auauuuuuuucugaaauu

SEQ ID NO: 1448389 - RNA, 16 nt, Human
auauuuuuuucugaaa

SEQ ID NO: 1448390 - RNA, 18 nt, Human
auauuuuuuucuuuucuu

SEQ ID NO: 1448391 - RNA, 14 nt, Human
auauuuuuuucuga

SEQ ID NO: 1448392 - RNA, 21 nt, Human
aucaaaacuuucuuuucugga

SEQ ID NO: 1448393 - RNA, 15 nt, Human
aucaaaacuuucuuu

SEQ ID NO: 1448394 - RNA, 19 nt, Human
aucaaaaaaggcaguuacc

SEQ ID NO: 1448395 - RNA, 23 nt, Human
auauuuuuuuuuaagcucugagc

SEQ ID NO: 1448396 - RNA, 21 nt, Human
auauuuuuuuuuaagcucuga

SEQ ID NO: 1448397 - RNA, 18 nt, Human
auauuuuuuuuuaagcuc

SEQ ID NO: 1448398 - RNA, 19 nt, Human
auauuuuuuucugaaauuu

SEQ ID NO: 1448399 - RNA, 21 nt, Human
aucauccuuuagguaagaagu

SEQ ID NO: 1448400 - RNA, 15 nt, Human
aucauccucuggcuu

SEQ ID NO: 1448401 - RNA, 13 nt, Human
aucauccucuggc

SEQ ID NO: 1448402 - RNA, 20 nt, Human
aucaugacaaagacugagua

SEQ ID NO: 1448403 - RNA, 14 nt, Human
aucaaauacauuua

SEQ ID NO: 1448404 - RNA, 13 nt, Human
aucaaauacauuu

SEQ ID NO: 1448405 - RNA, 12 nt, Human
aucaugcccugu

SEQ ID NO: 1448406 - RNA, 21 nt, Human
aucaugcauguccuguaaagg

SEQ ID NO: 1448407 - RNA, 23 nt, Human
aucaugagugaauaaaugucuug

SEQ ID NO: 1448408 - RNA, 21 nt, Human
aucaucuaccuagauuuaaua

SEQ ID NO: 1448409 - RNA, 22 nt, Human
aucaugccucugaggccagccu

SEQ ID NO: 1448410 - RNA, 20 nt, Human
aucaugccucugaggccagc

SEQ ID NO: 1448411 - RNA, 19 nt, Human
aucaugccucugaggccag

SEQ ID NO: 1448412 - RNA, 17 nt, Human
aucaugccucugaggcc

SEQ ID NO: 1448413 - RNA, 16 nt, Human
aucaugccucugaggc

SEQ ID NO: 1448414 - RNA, 15 nt, Human
aucaugccucugagg

SEQ ID NO: 1448415 - RNA, 14 nt, Human
aucaugccucugag

SEQ ID NO: 1448416 - RNA, 23 nt, Human
aucaugccucugaggccagccug

SEQ ID NO: 1448417 - RNA, 23 nt, Human
auccacuuuaucuugaauaaugu

SEQ ID NO: 1448418 - RNA, 23 nt, Human
auccagccuaacuuacauucuua

SEQ ID NO: 1448419 - RNA, 12 nt, Human
auccagccuggg

SEQ ID NO: 1448420 - RNA, 19 nt, Human
auccagccuggggcugagg

SEQ ID NO: 1448421 - RNA, 12 nt, Human
auccacuuugca

SEQ ID NO: 1448422 - RNA, 22 nt, Human
auccaggcagauccaggacuau

SEQ ID NO: 1448423 - RNA, 17 nt, Human
auccagccuggggucug

SEQ ID NO: 1448424 - RNA, 21 nt, Human
auccagccuggggcugaggcu

SEQ ID NO: 1448425 - RNA, 14 nt, Human
auccaggccggcuu

SEQ ID NO: 1448426 - RNA, 21 nt, Human
auccagggacagaggccccag

SEQ ID NO: 1448427 - RNA, 20 nt, Human
auccagggacagaggcccca

SEQ ID NO: 1448428 - RNA, 19 nt, Human
auccagggacagaggcccc

SEQ ID NO: 1448429 - RNA, 16 nt, Human
auccagggacagaggc

SEQ ID NO: 1448430 - RNA, 14 nt, Human
auccagggacagag

SEQ ID NO: 1448431 - RNA, 13 nt, Human
auccagggacaga

SEQ ID NO: 1448432 - RNA, 12 nt, Human
auccagggacag

SEQ ID NO: 1448433 - RNA, 23 nt, Human
auccaggccggcuugccacaccc

SEQ ID NO: 1448434 - RNA, 15 nt, Human
aucgaaccguuuuga

SEQ ID NO: 1448435 - RNA, 14 nt, Human
aucgaaugaaauua

SEQ ID NO: 1448436 - RNA, 13 nt, Human
aucgaaugaaauu

SEQ ID NO: 1448437 - RNA, 21 nt, Human
aucgacuuguuuuugcacaug

SEQ ID NO: 1448438 - RNA, 20 nt, Human
aucgaaucuacuaauuccac

SEQ ID NO: 1448439 - RNA, 18 nt, Human
aucgaaucuacuaauucc

SEQ ID NO: 1448440 - RNA, 17 nt, Human
auccuuccucacaccag

SEQ ID NO: 1448441 - RNA, 12 nt, Human
auccuugaagau

SEQ ID NO: 1448442 - RNA, 23 nt, Human
auccagggaggcugguccuaugg

SEQ ID NO: 1448443 - RNA, 17 nt, Human
auccagggggcaagagg

SEQ ID NO: 1448444 - RNA, 15 nt, Human
auccccaguaaaauu

SEQ ID NO: 1448445 - RNA, 21 nt, Human
auccccaguaaaauugccaua

SEQ ID NO: 1448446 - RNA, 12 nt, Human
aucccccagaaa

SEQ ID NO: 1448447 - RNA, 20 nt, Human
auccccccaucuugcuuccc

SEQ ID NO: 1448448 - RNA, 17 nt, Human
auccccccaucuugcuu

SEQ ID NO: 1448449 - RNA, 15 nt, Human
auccccccaucuugc

SEQ ID NO: 1448450 - RNA, 17 nt, Human
aucccccagaaaagaaa

SEQ ID NO: 1448451 - RNA, 12 nt, Human
aucccccagccu

SEQ ID NO: 1448452 - RNA, 12 nt, Human
agaacacuuaug

SEQ ID NO: 1448453 - RNA, 16 nt, Human
agaacacuaauucaua

SEQ ID NO: 1448454 - RNA, 19 nt, Human
agaacacuaauucauaauc

SEQ ID NO: 1448455 - RNA, 15 nt, Human
agaacacuaauucau

SEQ ID NO: 1448456 - RNA, 14 nt, Human
agaacacuaauuca

SEQ ID NO: 1448457 - RNA, 11 nt, Human
agaacacuaau

SEQ ID NO: 1448458 - RNA, 17 nt, Human
agaacaccuaugcaaag

SEQ ID NO: 1448459 - RNA, 11 nt, Human
agaacacaguu

SEQ ID NO: 1448460 - RNA, 20 nt, Human
agaacacagcaauuccucag

SEQ ID NO: 1448461 - RNA, 15 nt, Human
agaacacacacacuu

SEQ ID NO: 1448462 - RNA, 14 nt, Human
agaacacacacacu

SEQ ID NO: 1448463 - RNA, 12 nt, Human
agaacacacaca

SEQ ID NO: 1448464 - RNA, 15 nt, Human
agaacaaugugcuau

SEQ ID NO: 1448465 - RNA, 10 nt, Human
agaacaaggc

SEQ ID NO: 1448466 - RNA, 18 nt, Human
agaacagcagacucagcu

SEQ ID NO: 1448467 - RNA, 21 nt, Human
agaacauagacagaagaaaca

SEQ ID NO: 1448468 - RNA, 19 nt, Human
agaacauagacagaagaaa

SEQ ID NO: 1448469 - RNA, 22 nt, Human
agaacagggaaaauaggcagga

SEQ ID NO: 1448470 - RNA, 20 nt, Human
agaacagggaaaauaggcag

SEQ ID NO: 1448471 - RNA, 19 nt, Human
agaacagggaaaauaggca

SEQ ID NO: 1448472 - RNA, 22 nt, Human
agaacaugugagagguuugacu

SEQ ID NO: 1448473 - RNA, 13 nt, Human
agaacaugugaga

SEQ ID NO: 1448474 - RNA, 18 nt, Human
agaacauggccuaagggc

SEQ ID NO: 1448475 - RNA, 20 nt, Human
agaacaucuguauacccucu

SEQ ID NO: 1448476 - RNA, 13 nt, Human
agaacaucccucc

SEQ ID NO: 1448477 - RNA, 17 nt, Human
agaacaucccuccuggg

SEQ ID NO: 1448478 - RNA, 23 nt, Human
agaaucuuuagagaaguauacau

SEQ ID NO: 1448479 - RNA, 14 nt, Human
agaaucuuuagaga

SEQ ID NO: 1448480 - RNA, 12 nt, Human
agaaugagccuc

SEQ ID NO: 1448481 - RNA, 20 nt, Human
agaaucuugguuugccuucc

SEQ ID NO: 1448482 - RNA, 19 nt, Human
agaaucuugguuugccuuc

SEQ ID NO: 1448483 - RNA, 17 nt, Human
agaaucugcaauucaaa

SEQ ID NO: 1448484 - RNA, 18 nt, Human
agaaucuauauuuaacaa

SEQ ID NO: 1448485 - RNA, 17 nt, Human
agaaucgaggugcuguu

SEQ ID NO: 1448486 - RNA, 19 nt, Human
agaaugcacaagaauggau

SEQ ID NO: 1448487 - RNA, 20 nt, Human
agaaugcacaagaauggauc

SEQ ID NO: 1448488 - RNA, 17 nt, Human
agaaugcacaagaaugg

SEQ ID NO: 1448489 - RNA, 16 nt, Human
agaaugcacaagaaug

SEQ ID NO: 1448490 - RNA, 21 nt, Human
agaagggcugcuucccugaag

SEQ ID NO: 1448491 - RNA, 23 nt, Human
agaagggagggcagagcuggugc

SEQ ID NO: 1448492 - RNA, 22 nt, Human
agaagggagggcagagcuggug

SEQ ID NO: 1448493 - RNA, 21 nt, Human
agaagggagggcagagcuggu

SEQ ID NO: 1448494 - RNA, 19 nt, Human
agaagggagggcagagcug

SEQ ID NO: 1448495 - RNA, 16 nt, Human
agaagggagggcagag

SEQ ID NO: 1448496 - RNA, 15 nt, Human
agaagggagggcaga

SEQ ID NO: 1448497 - RNA, 18 nt, Human
agaagaugaaugagcaaa

SEQ ID NO: 1448498 - RNA, 21 nt, Human
agaagucacagggcaguaccu

SEQ ID NO: 1448499 - RNA, 19 nt, Human
agaagucacagggcaguac

SEQ ID NO: 1448500 - RNA, 18 nt, Human
agaagucacagggcagua

SEQ ID NO: 1448501 - RNA, 17 nt, Human
agaagucacagggcagu

SEQ ID NO: 1448502 - RNA, 16 nt, Human
agaagucacagggcag

SEQ ID NO: 1448503 - RNA, 15 nt, Human
agaagucacagggca

SEQ ID NO: 1448504 - RNA, 14 nt, Human
agaagucacagggc

SEQ ID NO: 1448505 - RNA, 13 nt, Human
agaagucucagcu

SEQ ID NO: 1448506 - RNA, 23 nt, Human
agaagucacagggcaguaccuga

SEQ ID NO: 1448507 - RNA, 22 nt, Human
agaaucccuuaacaguuguauu

SEQ ID NO: 1448508 - RNA, 21 nt, Human
agaauccuaggcuccacccca

SEQ ID NO: 1448509 - RNA, 15 nt, Human
agaagucucuuccag

SEQ ID NO: 1448510 - RNA, 22 nt, Human
agaagucucagcuaagcucacg

SEQ ID NO: 1448511 - RNA, 14 nt, Human
agaagucucagcua

SEQ ID NO: 1448512 - RNA, 24 nt, Human
agaagagcgagagaucaaagauga

SEQ ID NO: 1448513 - RNA, 18 nt, Human
agaaccaaaucuggaagc

SEQ ID NO: 1448514 - RNA, 16 nt, Human
agaaccaaaucuggaa

SEQ ID NO: 1448515 - RNA, 13 nt, Human
agaaccaaaucug

SEQ ID NO: 1448516 - RNA, 16 nt, Human
agaaccaaagaagaaa

SEQ ID NO: 1448517 - RNA, 22 nt, Human
agaaccacagggcuauuuuguu

SEQ ID NO: 1448518 - RNA, 19 nt, Human
agaaccaaagaagaaaguc

SEQ ID NO: 1448519 - RNA, 11 nt, Human
agaaccaaaga

SEQ ID NO: 1448520 - RNA, 20 nt, Human
agaaccaguccccccacccu

SEQ ID NO: 1448521 - RNA, 19 nt, Human
agaaccaguccccccaccc

SEQ ID NO: 1448522 - RNA, 16 nt, Human
agaaccagucccccca

SEQ ID NO: 1448523 - RNA, 16 nt, Human
agaaccaggcuacaag

SEQ ID NO: 1448524 - RNA, 21 nt, Human
agaagacugcauuauauuuau

SEQ ID NO: 1448525 - RNA, 20 nt, Human
agagaaucaacauuucucaa

SEQ ID NO: 1448526 - RNA, 15 nt, Human
agagaaucaacauuu

SEQ ID NO: 1448527 - RNA, 12 nt, Human
agagaaucaaca

SEQ ID NO: 1448528 - RNA, 13 nt, Human
agagaauaaauug

SEQ ID NO: 1448529 - RNA, 12 nt, Human
agagaaguugua

SEQ ID NO: 1448530 - RNA, 23 nt, Human
agagaagucacagggcaguaccu

SEQ ID NO: 1448531 - RNA, 20 nt, Human
agagaagucacagggcagua

SEQ ID NO: 1448532 - RNA, 19 nt, Human
agagaagucacagggcagu

SEQ ID NO: 1448533 - RNA, 14 nt, Human
agagaacccagccc

SEQ ID NO: 1448534 - RNA, 13 nt, Human
agagaaccaggcu

SEQ ID NO: 1448535 - RNA, 23 nt, Human
agagaaauaagugcccucuccca

SEQ ID NO: 1448536 - RNA, 14 nt, Human
agagaaauaugaag

SEQ ID NO: 1448537 - RNA, 15 nt, Human
agagaacccagccca

SEQ ID NO: 1448538 - RNA, 18 nt, Human
agagaacccagcccaccc

SEQ ID NO: 1448539 - RNA, 18 nt, Human
agagaaguauacauaagu

SEQ ID NO: 1448540 - RNA, 18 nt, Human
agagaagucacagggcag

SEQ ID NO: 1448541 - RNA, 15 nt, Human
agagaagucacaggg

SEQ ID NO: 1448542 - RNA, 21 nt, Human
agagaaaccagcuuccuucag

SEQ ID NO: 1448543 - RNA, 22 nt, Human
agagaaaccagcuuccuucaga

SEQ ID NO: 1448544 - RNA, 20 nt, Human
agagaaaccagcuuccuuca

SEQ ID NO: 1448545 - RNA, 19 nt, Human
agagaaaccagcuuccuuc

SEQ ID NO: 1448546 - RNA, 18 nt, Human
agagaaaccagcuuccuu

SEQ ID NO: 1448547 - RNA, 17 nt, Human
agagaaaccagcuuccu

SEQ ID NO: 1448548 - RNA, 15 nt, Human
agagaaaccagcuuc

SEQ ID NO: 1448549 - RNA, 14 nt, Human
agagaaaccagcuu

SEQ ID NO: 1448550 - RNA, 13 nt, Human
agagaaaccagcu

SEQ ID NO: 1448551 - RNA, 12 nt, Human
agagaaaccagc

SEQ ID NO: 1448552 - RNA, 16 nt, Human
agagaaacaguuggua

SEQ ID NO: 1448553 - RNA, 13 nt, Human
agagaaacaguug

SEQ ID NO: 1448554 - RNA, 22 nt, Human
agacugacaguuuacagacgcu

SEQ ID NO: 1448555 - RNA, 22 nt, Human
agacugaauagauaugaaagcu

SEQ ID NO: 1448556 - RNA, 21 nt, Human
agacugaauagauaugaaagc

SEQ ID NO: 1448557 - RNA, 18 nt, Human
agacucuuuuccuucccu

SEQ ID NO: 1448558 - RNA, 21 nt, Human
agacucuuuuccuucccuuuu

SEQ ID NO: 1448559 - RNA, 24 nt, Human
agacugaauagauaugaaagcuga

SEQ ID NO: 1448560 - RNA, 20 nt, Human
agagaaaaugcgguuauaaa

SEQ ID NO: 1448561 - RNA, 16 nt, Human
agagccugcaggaucu

SEQ ID NO: 1448562 - RNA, 14 nt, Human
agagccugcaggau

SEQ ID NO: 1448563 - RNA, 13 nt, Human
agagccugaggga

SEQ ID NO: 1448564 - RNA, 14 nt, Human
agagccugagggau

SEQ ID NO: 1448565 - RNA, 14 nt, Human
agagcccagcucca

SEQ ID NO: 1448566 - RNA, 13 nt, Human
agagcccagcucc

SEQ ID NO: 1448567 - RNA, 12 nt, Human
agagcccagcuc

SEQ ID NO: 1448568 - RNA, 23 nt, Human
agagcccacuccaucugguagaa

SEQ ID NO: 1448569 - RNA, 17 nt, Human
agagccugcaggaucuc

SEQ ID NO: 1448570 - RNA, 12 nt, Human
agagaggccauu

SEQ ID NO: 1448571 - RNA, 23 nt, Human
agagaggccauucuuucccaaca

SEQ ID NO: 1448572 - RNA, 22 nt, Human
agagaggccauucuuucccaac

SEQ ID NO: 1448573 - RNA, 20 nt, Human
agaauuuuauacuuucccua

SEQ ID NO: 1448574 - RNA, 18 nt, Human
agaauuuuauacuuuccc

SEQ ID NO: 1448575 - RNA, 19 nt, Human
agacaaaaaacuauaugua

SEQ ID NO: 1448576 - RNA, 21 nt, Human
agaauuuuauacuuucccuac

SEQ ID NO: 1448577 - RNA, 22 nt, Human
agaauuuuauacuuucccuacc

SEQ ID NO: 1448578 - RNA, 17 nt, Human
agacaagccagaacuug

SEQ ID NO: 1448579 - RNA, 17 nt, Human
agacaagccuggccuac

SEQ ID NO: 1448580 - RNA, 16 nt, Human
agacaauugacaacag

SEQ ID NO: 1448581 - RNA, 15 nt, Human
agacaagccagaacu

SEQ ID NO: 1448582 - RNA, 19 nt, Human
agacaaggaaaaaauaaca

SEQ ID NO: 1448583 - RNA, 16 nt, Human
agacuagauggaccug

SEQ ID NO: 1448584 - RNA, 23 nt, Human
agacuagauguaguauuuuuugu

SEQ ID NO: 1448585 - RNA, 19 nt, Human
agacuagauguaguauuuu

SEQ ID NO: 1448586 - RNA, 16 nt, Human
agacuagauguaguau

SEQ ID NO: 1448587 - RNA, 14 nt, Human
agacuagauguagu

SEQ ID NO: 1448588 - RNA, 13 nt, Human
agacuagauguag

SEQ ID NO: 1448589 - RNA, 12 nt, Human
agacuagaugua

SEQ ID NO: 1448590 - RNA, 14 nt, Human
agaccaccccgccu

SEQ ID NO: 1448591 - RNA, 23 nt, Human
agaccaccagggcaucucugggc

SEQ ID NO: 1448592 - RNA, 14 nt, Human
agaccaccagggca

SEQ ID NO: 1448593 - RNA, 11 nt, Human
agaccaccagg

SEQ ID NO: 1448594 - RNA, 17 nt, Human
agacagcuccacccugg

SEQ ID NO: 1448595 - RNA, 19 nt, Human
agacaauugacaacaguua

SEQ ID NO: 1448596 - RNA, 23 nt, Human
agacaauugagguaaguuuuuug

SEQ ID NO: 1448597 - RNA, 24 nt, Human
agaccacgcccguccugccugugg

SEQ ID NO: 1448598 - RNA, 23 nt, Human
agaccacgcccguccugccugug

SEQ ID NO: 1448599 - RNA, 21 nt, Human
agaccacgcccguccugccug

SEQ ID NO: 1448600 - RNA, 20 nt, Human
agaccacgcccguccugccu

SEQ ID NO: 1448601 - RNA, 16 nt, Human
agaccaccccgccugc

SEQ ID NO: 1448602 - RNA, 12 nt, Human
agaccaccucuc

SEQ ID NO: 1448603 - RNA, 19 nt, Human
agaccacgcccguccugcc

SEQ ID NO: 1448604 - RNA, 17 nt, Human
agaccaccucucaauau

SEQ ID NO: 1448605 - RNA, 14 nt, Human
agacaauuuauuau

SEQ ID NO: 1448606 - RNA, 12 nt, Human
agaccauggaca

SEQ ID NO: 1448607 - RNA, 15 nt, Human
agaccacguuucuaa

SEQ ID NO: 1448608 - RNA, 21 nt, Human
agaccauggacacuacaccca

SEQ ID NO: 1448609 - RNA, 22 nt, Human
agaccauggacacuacacccag

SEQ ID NO: 1448610 - RNA, 23 nt, Human
agaccauggacacuacacccagc

SEQ ID NO: 1448611 - RNA, 14 nt, Human
agaccacguuucua

SEQ ID NO: 1448612 - RNA, 14 nt, Human
agaccuuuuuuagg

SEQ ID NO: 1448613 - RNA, 16 nt, Human
agaccuuuuuuaggaa

SEQ ID NO: 1448614 - RNA, 18 nt, Human
agacgaaacauuuguucu

SEQ ID NO: 1448615 - RNA, 21 nt, Human
agcaguggcugguccagggcu

SEQ ID NO: 1448616 - RNA, 19 nt, Human
agcaguggcugguccaggg

SEQ ID NO: 1448617 - RNA, 18 nt, Human
agcaguggcugguccagg

SEQ ID NO: 1448618 - RNA, 17 nt, Human
agcaguggcugguccag

SEQ ID NO: 1448619 - RNA, 16 nt, Human
agcaguggcuggucca

SEQ ID NO: 1448620 - RNA, 13 nt, Human
agcaguggcuggu

SEQ ID NO: 1448621 - RNA, 12 nt, Human
agcaguggcugg

SEQ ID NO: 1448622 - RNA, 11 nt, Human
agcaguggcug

SEQ ID NO: 1448623 - RNA, 22 nt, Human
agcaguggcugguccagggcua

SEQ ID NO: 1448624 - RNA, 19 nt, Human
agcaguggccuuauugcau

SEQ ID NO: 1448625 - RNA, 12 nt, Human
agcaguggccuu

SEQ ID NO: 1448626 - RNA, 22 nt, Human
agcaguggcaggcagaggccca

SEQ ID NO: 1448627 - RNA, 15 nt, Human
agcaguggcaggcag

SEQ ID NO: 1448628 - RNA, 12 nt, Human
agcagugcuuuu

SEQ ID NO: 1448629 - RNA, 19 nt, Human
agcagugauugucuuaaua

SEQ ID NO: 1448630 - RNA, 19 nt, Human
agcagcguuucuaugacac

SEQ ID NO: 1448631 - RNA, 23 nt, Human
agcagccugagcaacucuugauu

SEQ ID NO: 1448632 - RNA, 14 nt, Human
agcagccuggagcc

SEQ ID NO: 1448633 - RNA, 15 nt, Human
agcagccuggagccc

SEQ ID NO: 1448634 - RNA, 16 nt, Human
agcagccuggagcccu

SEQ ID NO: 1448635 - RNA, 19 nt, Human
agcagccuggagcccugga

SEQ ID NO: 1448636 - RNA, 20 nt, Human
agcagccuggagcccuggag

SEQ ID NO: 1448637 - RNA, 19 nt, Human
agcacucgcuagcaguggc

SEQ ID NO: 1448638 - RNA, 20 nt, Human
agcacuagccaaaccucacc

SEQ ID NO: 1448639 - RNA, 19 nt, Human
agcacuagccaaaccucac

SEQ ID NO: 1448640 - RNA, 16 nt, Human
agcacuagccaaaccu

SEQ ID NO: 1448641 - RNA, 13 nt, Human
agcacugccagga

SEQ ID NO: 1448642 - RNA, 12 nt, Human
agcacugccagg

SEQ ID NO: 1448643 - RNA, 14 nt, Human
agcacugccaccag

SEQ ID NO: 1448644 - RNA, 20 nt, Human
agcacagauggccagccccu

SEQ ID NO: 1448645 - RNA, 17 nt, Human
agcacagauggccagcc

SEQ ID NO: 1448646 - RNA, 16 nt, Human
agcacagauggccagc

SEQ ID NO: 1448647 - RNA, 15 nt, Human
agcacagauggccag

SEQ ID NO: 1448648 - RNA, 17 nt, Human
agcacagagagucugga

SEQ ID NO: 1448649 - RNA, 19 nt, Human
agcacagagagucuggaua

SEQ ID NO: 1448650 - RNA, 12 nt, Human
agcacagagagu

SEQ ID NO: 1448651 - RNA, 13 nt, Human
agcaauuucuaau

SEQ ID NO: 1448652 - RNA, 13 nt, Human
agcaauuuaaaug

SEQ ID NO: 1448653 - RNA, 16 nt, Human
agcaauuuaaauguua

SEQ ID NO: 1448654 - RNA, 17 nt, Human
agcaauuuaaauguuau

SEQ ID NO: 1448655 - RNA, 19 nt, Human
agcaauuuaaauguuauga

SEQ ID NO: 1448656 - RNA, 23 nt, Human
agcaucuaaguuauaagacucuc

SEQ ID NO: 1448657 - RNA, 22 nt, Human
agcaucuaaguuauaagacucu

SEQ ID NO: 1448658 - RNA, 20 nt, Human
agcaucuaaguuauaagacu

SEQ ID NO: 1448659 - RNA, 12 nt, Human
agcaucuaaguu

SEQ ID NO: 1448660 - RNA, 23 nt, Human
agcaucggacaagacccccagca

SEQ ID NO: 1448661 - RNA, 22 nt, Human
agcaucggacaagacccccagc

SEQ ID NO: 1448662 - RNA, 16 nt, Human
agcaucuccaagcagc

SEQ ID NO: 1448663 - RNA, 22 nt, Human
agccaagggauggacaucuugu

SEQ ID NO: 1448664 - RNA, 22 nt, Human
agccaagguuuuauaaggcuga

SEQ ID NO: 1448665 - RNA, 23 nt, Human
agccaagggcaacagaucaguaa

SEQ ID NO: 1448666 - RNA, 16 nt, Human
agccaaggggcuucag

SEQ ID NO: 1448667 - RNA, 20 nt, Human
agccaagggauggacaucuu

SEQ ID NO: 1448668 - RNA, 18 nt, Human
agccaagggauggacauc

SEQ ID NO: 1448669 - RNA, 14 nt, Human
agccaagggaugga

SEQ ID NO: 1448670 - RNA, 11 nt, Human
agccaagggau

SEQ ID NO: 1448671 - RNA, 21 nt, Human
agccaagggaaccuguguccg

SEQ ID NO: 1448672 - RNA, 20 nt, Human
agccaagggaaccugugucc

SEQ ID NO: 1448673 - RNA, 19 nt, Human
agccaagggaaccuguguc

SEQ ID NO: 1448674 - RNA, 17 nt, Human
agccaagggaaccugug

SEQ ID NO: 1448675 - RNA, 16 nt, Human
agccaagggaaccugu

SEQ ID NO: 1448676 - RNA, 22 nt, Human
agcaucugggccuuggccugga

SEQ ID NO: 1448677 - RNA, 19 nt, Human
agcaucugggccuuggccu

SEQ ID NO: 1448678 - RNA, 18 nt, Human
agcaucugggccuuggcc

SEQ ID NO: 1448679 - RNA, 13 nt, Human
agcaucugggccu

SEQ ID NO: 1448680 - RNA, 18 nt, Human
agcaucuggcucuaauuc

SEQ ID NO: 1448681 - RNA, 16 nt, Human
agcaucuggcucuaau

SEQ ID NO: 1448682 - RNA, 13 nt, Human
agcaucuggcucu

SEQ ID NO: 1448683 - RNA, 23 nt, Human
agcaucucuaccuucuccccagc

SEQ ID NO: 1448684 - RNA, 22 nt, Human
agcaucucuaccuucuccccag

SEQ ID NO: 1448685 - RNA, 19 nt, Human
agcaucucuaccuucuccc

SEQ ID NO: 1448686 - RNA, 18 nt, Human
agcaucucuaccuucucc

SEQ ID NO: 1448687 - RNA, 17 nt, Human
agcaucucuaccuucuc

SEQ ID NO: 1448688 - RNA, 15 nt, Human
agcaucucuaccuuc

SEQ ID NO: 1448689 - RNA, 14 nt, Human
agcaucucuaccuu

SEQ ID NO: 1448690 - RNA, 17 nt, Human
agcaucuccaagcagcu

SEQ ID NO: 1448691 - RNA, 20 nt, Human
agccaacuaugauuauuaac

SEQ ID NO: 1448692 - RNA, 17 nt, Human
agccaacuaugauuauu

SEQ ID NO: 1448693 - RNA, 17 nt, Human
agccaacuagccccugg

SEQ ID NO: 1448694 - RNA, 16 nt, Human
agccaacuagccccug

SEQ ID NO: 1448695 - RNA, 15 nt, Human
agcaucugucccccu

SEQ ID NO: 1448696 - RNA, 23 nt, Human
agcaucugggccuuggccuggag

SEQ ID NO: 1448697 - RNA, 17 nt, Human
agccaacuauggccugu

SEQ ID NO: 1448698 - RNA, 18 nt, Human
agauucuauaguucuaga

SEQ ID NO: 1448699 - RNA, 16 nt, Human
agauucuauaguucua

SEQ ID NO: 1448700 - RNA, 15 nt, Human
agauucuauaguucu

SEQ ID NO: 1448701 - RNA, 14 nt, Human
agauucuagaugau

SEQ ID NO: 1448702 - RNA, 14 nt, Human
agauucuagaucag

SEQ ID NO: 1448703 - RNA, 12 nt, Human
agauucuagauc

SEQ ID NO: 1448704 - RNA, 11 nt, Human
agauucuagau

SEQ ID NO: 1448705 - RNA, 14 nt, Human
agauucuaaugaug

SEQ ID NO: 1448706 - RNA, 13 nt, Human
agauucuaaugau

SEQ ID NO: 1448707 - RNA, 12 nt, Human
agauucuaacgg

SEQ ID NO: 1448708 - RNA, 10 nt, Human
agauucuaac

SEQ ID NO: 1448709 - RNA, 23 nt, Human
agauucuaaagguccacaggucu

SEQ ID NO: 1448710 - RNA, 13 nt, Human
agauucuaaaggu

SEQ ID NO: 1448711 - RNA, 12 nt, Human
agauucuuuccc

SEQ ID NO: 1448712 - RNA, 21 nt, Human
agauucuauaguucuagacau

SEQ ID NO: 1448713 - RNA, 20 nt, Human
agauucuauaguucuagaca

SEQ ID NO: 1448714 - RNA, 19 nt, Human
agauucuauaguucuagac

SEQ ID NO: 1448715 - RNA, 12 nt, Human
agauucuaaagg

SEQ ID NO: 1448716 - RNA, 21 nt, Human
agauucuaaagauucuauagu

SEQ ID NO: 1448717 - RNA, 18 nt, Human
agauucuaaagauucuau

SEQ ID NO: 1448718 - RNA, 17 nt, Human
agauucuaaagauucua

SEQ ID NO: 1448719 - RNA, 16 nt, Human
agauucuaaagauucu

SEQ ID NO: 1448720 - RNA, 15 nt, Human
agauucuaaagauuc

SEQ ID NO: 1448721 - RNA, 14 nt, Human
agauucuaaagauu

SEQ ID NO: 1448722 - RNA, 16 nt, Human
agauggggucuguaaa

SEQ ID NO: 1448723 - RNA, 18 nt, Human
agauggggucuguaaaau

SEQ ID NO: 1448724 - RNA, 19 nt, Human
agauggggucuguaaaauc

SEQ ID NO: 1448725 - RNA, 17 nt, Human
agaugaauguccugaaa

SEQ ID NO: 1448726 - RNA, 20 nt, Human
agaugaccacuuuuuagaaa

SEQ ID NO: 1448727 - RNA, 16 nt, Human
agaugaaugccgugga

SEQ ID NO: 1448728 - RNA, 19 nt, Human
agaugaaugaagcaaaugu

SEQ ID NO: 1448729 - RNA, 21 nt, Human
agaucugcagggggugugucu

SEQ ID NO: 1448730 - RNA, 23 nt, Human
agaucugauuuguaacccacuga

SEQ ID NO: 1448731 - RNA, 22 nt, Human
agcaaaucaccacaaacuguaa

SEQ ID NO: 1448732 - RNA, 21 nt, Human
agcaaaucaccacaaacugua

SEQ ID NO: 1448733 - RNA, 18 nt, Human
agcaaaucaccacaaacu

SEQ ID NO: 1448734 - RNA, 11 nt, Human
agcaaaucacc

SEQ ID NO: 1448735 - RNA, 22 nt, Human
agcaaaucauuuguuuaaaaag

SEQ ID NO: 1448736 - RNA, 19 nt, Human
agcaaaucauuuguuuaaa

SEQ ID NO: 1448737 - RNA, 23 nt, Human
agcaaaucaccacaaacuguaau

SEQ ID NO: 1448738 - RNA, 17 nt, Human
agcaaaucgaaugaaau

SEQ ID NO: 1448739 - RNA, 15 nt, Human
agcaaaucgaaugaa

SEQ ID NO: 1448740 - RNA, 15 nt, Human
agcaacaauuuauga

SEQ ID NO: 1448741 - RNA, 12 nt, Human
agcaacaauaaa

SEQ ID NO: 1448742 - RNA, 13 nt, Human
agcaacaauaaau

SEQ ID NO: 1448743 - RNA, 18 nt, Human
agcaacaauaaauagaca

SEQ ID NO: 1448744 - RNA, 14 nt, Human
agcaaagcacagag

SEQ ID NO: 1448745 - RNA, 15 nt, Human
agcaaagcacagaga

SEQ ID NO: 1448746 - RNA, 13 nt, Human
agcaaagcacaga

SEQ ID NO: 1448747 - RNA, 12 nt, Human
agcaaagcacag

SEQ ID NO: 1448748 - RNA, 20 nt, Human
agcaaagauaucucaucucu

SEQ ID NO: 1448749 - RNA, 20 nt, Human
agcaaacugcaugcccagag

SEQ ID NO: 1448750 - RNA, 22 nt, Human
agcaaacugcaugcccagagac

SEQ ID NO: 1448751 - RNA, 19 nt, Human
agcaaacugcaugcccaga

SEQ ID NO: 1448752 - RNA, 15 nt, Human
agcaaacugcaugcc

SEQ ID NO: 1448753 - RNA, 17 nt, Human
agcaaacucuuuuccca

SEQ ID NO: 1448754 - RNA, 13 nt, Human
agcaaacucuuuu

SEQ ID NO: 1448755 - RNA, 23 nt, Human
agcaaaauuuuuucucuaggaaa

SEQ ID NO: 1448756 - RNA, 15 nt, Human
agcaaaaucuaccag

SEQ ID NO: 1448757 - RNA, 14 nt, Human
agauugcugaaauu

SEQ ID NO: 1448758 - RNA, 13 nt, Human
agauugcugaaau

SEQ ID NO: 1448759 - RNA, 23 nt, Human
agauugcagaaaauucugugccu

SEQ ID NO: 1448760 - RNA, 21 nt, Human
agauugcagaaaauucugugc

SEQ ID NO: 1448761 - RNA, 20 nt, Human
agauugcagaaaauucugug

SEQ ID NO: 1448762 - RNA, 19 nt, Human
agauugcagaaaauucugu

SEQ ID NO: 1448763 - RNA, 18 nt, Human
agauugcagaaaauucug

SEQ ID NO: 1448764 - RNA, 16 nt, Human
agauugcagaaaauuc

SEQ ID NO: 1448765 - RNA, 16 nt, Human
agauugauuguauugu

SEQ ID NO: 1448766 - RNA, 15 nt, Human
agauugauuguauug

SEQ ID NO: 1448767 - RNA, 14 nt, Human
agauugauuguauu

SEQ ID NO: 1448768 - RNA, 15 nt, Human
agauugacgacaagu

SEQ ID NO: 1448769 - RNA, 17 nt, Human
agauugacgacaagugc

SEQ ID NO: 1448770 - RNA, 18 nt, Human
agauugagcucucugccc

SEQ ID NO: 1448771 - RNA, 17 nt, Human
agauugagcucucugcc

SEQ ID NO: 1448772 - RNA, 15 nt, Human
agauugagagaauuu

SEQ ID NO: 1448773 - RNA, 13 nt, Human
agauugagagaau

SEQ ID NO: 1448774 - RNA, 19 nt, Human
agauugagagaagagacaa

SEQ ID NO: 1448775 - RNA, 18 nt, Human
agauugagagaagagaca

SEQ ID NO: 1448776 - RNA, 17 nt, Human
agauugagauguguuca

SEQ ID NO: 1448777 - RNA, 14 nt, Human
agaguggggguggg

SEQ ID NO: 1448778 - RNA, 18 nt, Human
agagggucugggggcaca

SEQ ID NO: 1448779 - RNA, 16 nt, Human
agauagaaugacaguc

SEQ ID NO: 1448780 - RNA, 15 nt, Human
agauagaaugacagu

SEQ ID NO: 1448781 - RNA, 12 nt, Human
agauagaaugac

SEQ ID NO: 1448782 - RNA, 13 nt, Human
agaguugaaccua

SEQ ID NO: 1448783 - RNA, 12 nt, Human
agaguugaaccu

SEQ ID NO: 1448784 - RNA, 22 nt, Human
agaguucuuuuugaaguauuua

SEQ ID NO: 1448785 - RNA, 21 nt, Human
agaguucuuuuugaaguauuu

SEQ ID NO: 1448786 - RNA, 20 nt, Human
agaguucuuuuugaaguauu

SEQ ID NO: 1448787 - RNA, 14 nt, Human
agauagcugugacu

SEQ ID NO: 1448788 - RNA, 16 nt, Human
agauagcugugacuuc

SEQ ID NO: 1448789 - RNA, 19 nt, Human
agauagcccuguccuggug

SEQ ID NO: 1448790 - RNA, 18 nt, Human
agauagcccuguccuggu

SEQ ID NO: 1448791 - RNA, 20 nt, Human
agauagcccuguccuggugg

SEQ ID NO: 1448792 - RNA, 13 nt, Human
agauauaagugcu

SEQ ID NO: 1448793 - RNA, 15 nt, Human
agauauaagugcugu

SEQ ID NO: 1448794 - RNA, 17 nt, Human
agauagcccuguccugg

SEQ ID NO: 1448795 - RNA, 15 nt, Human
agauagcccuguccu

SEQ ID NO: 1448796 - RNA, 20 nt, Human
agauagauaggucagugcaa

SEQ ID NO: 1448797 - RNA, 18 nt, Human
agauaugaacauauuguu

SEQ ID NO: 1448798 - RNA, 22 nt, Human
agauaucuuggacaaaucacau

SEQ ID NO: 1448799 - RNA, 21 nt, Human
agauaucuuggacaaaucaca

SEQ ID NO: 1448800 - RNA, 19 nt, Human
agauaucuuggacaaauca

SEQ ID NO: 1448801 - RNA, 14 nt, Human
agauauauauucau

SEQ ID NO: 1448802 - RNA, 16 nt, Human
agauauaagugcugua

SEQ ID NO: 1448803 - RNA, 17 nt, Human
agauauaagugcuguau

SEQ ID NO: 1448804 - RNA, 18 nt, Human
agauauaagugcuguaua

SEQ ID NO: 1448805 - RNA, 20 nt, Human
agauauaagugcuguauaaa

SEQ ID NO: 1448806 - RNA, 21 nt, Human
agauauaagugcuguauaaaa

SEQ ID NO: 1448807 - RNA, 22 nt, Human
agauauaagugcuguauaaaau

SEQ ID NO: 1448808 - RNA, 23 nt, Human
agauauaagugcuguauaaaauc

SEQ ID NO: 1448809 - RNA, 16 nt, Human
agauaugauucaaaug

SEQ ID NO: 1448810 - RNA, 15 nt, Human
agauaugauucaaau

SEQ ID NO: 1448811 - RNA, 15 nt, Human
agauaugaaagcuga

SEQ ID NO: 1448812 - RNA, 14 nt, Human
agauaugauucaaa

SEQ ID NO: 1448813 - RNA, 23 nt, Human
agccuuucucucuuuauacagcu

SEQ ID NO: 1448814 - RNA, 15 nt, Human
agccuuucucucuuu

SEQ ID NO: 1448815 - RNA, 23 nt, Human
agccuuuuuuccccagacuuguu

SEQ ID NO: 1448816 - RNA, 23 nt, Human
agcgaaaaaaucagguggcuuuu

SEQ ID NO: 1448817 - RNA, 21 nt, Human
agccuuuuuuccccagacuug

SEQ ID NO: 1448818 - RNA, 20 nt, Human
agccuuuuuuccccagacuu

SEQ ID NO: 1448819 - RNA, 19 nt, Human
agccuuuuuuccccagacu

SEQ ID NO: 1448820 - RNA, 17 nt, Human
agccuuuuuuccccaga

SEQ ID NO: 1448821 - RNA, 16 nt, Human
agccuuuuuuccccag

SEQ ID NO: 1448822 - RNA, 18 nt, Human
agccuuuuuguuucaaug

SEQ ID NO: 1448823 - RNA, 21 nt, Human
agccuuuuuguauaaaauaga

SEQ ID NO: 1448824 - RNA, 17 nt, Human
agccuggccuccugccu

SEQ ID NO: 1448825 - RNA, 16 nt, Human
agccuggccuccugcc

SEQ ID NO: 1448826 - RNA, 15 nt, Human
agccuggccuccugc

SEQ ID NO: 1448827 - RNA, 14 nt, Human
agccuggccuccug

SEQ ID NO: 1448828 - RNA, 13 nt, Human
agccuggccuccu

SEQ ID NO: 1448829 - RNA, 11 nt, Human
agccuggccuc

SEQ ID NO: 1448830 - RNA, 17 nt, Human
agccuggccccaugguc

SEQ ID NO: 1448831 - RNA, 16 nt, Human
agccuggccccauggu

SEQ ID NO: 1448832 - RNA, 22 nt, Human
agccuggccagacacaggcccu

SEQ ID NO: 1448833 - RNA, 21 nt, Human
agccuggccagacacaggccc

SEQ ID NO: 1448834 - RNA, 18 nt, Human
agccuggccagacacagg

SEQ ID NO: 1448835 - RNA, 16 nt, Human
agccuggccagacaca

SEQ ID NO: 1448836 - RNA, 15 nt, Human
agccuggccagacac

SEQ ID NO: 1448837 - RNA, 14 nt, Human
agccuggccagaca

SEQ ID NO: 1448838 - RNA, 20 nt, Human
agccuggccuccugccucua

SEQ ID NO: 1448839 - RNA, 19 nt, Human
agccuggcuauguccuaau

SEQ ID NO: 1448840 - RNA, 19 nt, Human
agccuggccuccugccucu

SEQ ID NO: 1448841 - RNA, 18 nt, Human
agccuggccuccugccuc

SEQ ID NO: 1448842 - RNA, 13 nt, Human
agccuggccagac

SEQ ID NO: 1448843 - RNA, 12 nt, Human
agccuggccaga

SEQ ID NO: 1448844 - RNA, 17 nt, Human
agccuggagcccuggag

SEQ ID NO: 1448845 - RNA, 18 nt, Human
agccuggagcccuggaga

SEQ ID NO: 1448846 - RNA, 22 nt, Human
agccuggaccucugacagcagc

SEQ ID NO: 1448847 - RNA, 24 nt, Human
agccuggaccucugacagcagcau

SEQ ID NO: 1448848 - RNA, 21 nt, Human
agccuggaccucugacagcag

SEQ ID NO: 1448849 - RNA, 19 nt, Human
agccuggaccucugacagc

SEQ ID NO: 1448850 - RNA, 18 nt, Human
agccuggaccucugacag

SEQ ID NO: 1448851 - RNA, 17 nt, Human
agccuggaccucugaca

SEQ ID NO: 1448852 - RNA, 16 nt, Human
agccuggaccucugac

SEQ ID NO: 1448853 - RNA, 15 nt, Human
agccuggaccucuga

SEQ ID NO: 1448854 - RNA, 10 nt, Human
agccuggacc

SEQ ID NO: 1448855 - RNA, 17 nt, Human
agccugcugccugcuuu

SEQ ID NO: 1448856 - RNA, 18 nt, Human
agcuaagggguggggcug

SEQ ID NO: 1448857 - RNA, 19 nt, Human
agcuaagguuuagauaaau

SEQ ID NO: 1448858 - RNA, 19 nt, Human
agcuaagggguggggcugc

SEQ ID NO: 1448859 - RNA, 20 nt, Human
agcuaaggcucuaugagucu

SEQ ID NO: 1448860 - RNA, 18 nt, Human
agcuaaggcucuaugagu

SEQ ID NO: 1448861 - RNA, 15 nt, Human
agcuaaggcucuaug

SEQ ID NO: 1448862 - RNA, 13 nt, Human
agcuaaggcucua

SEQ ID NO: 1448863 - RNA, 10 nt, Human
agcuaaggcu

SEQ ID NO: 1448864 - RNA, 23 nt, Human
agcuaagcucacguccugagaaa

SEQ ID NO: 1448865 - RNA, 18 nt, Human
agcuaagcuaggaaugaa

SEQ ID NO: 1448866 - RNA, 17 nt, Human
agcuaagcuaggaauga

SEQ ID NO: 1448867 - RNA, 17 nt, Human
agcuaagaaccuggaac

SEQ ID NO: 1448868 - RNA, 16 nt, Human
agcuaagaaccuggaa

SEQ ID NO: 1448869 - RNA, 14 nt, Human
agcuaagaaccugg

SEQ ID NO: 1448870 - RNA, 19 nt, Human
agcucacaaggcagcaagg

SEQ ID NO: 1448871 - RNA, 20 nt, Human
agcucacaaggcagcaaggc

SEQ ID NO: 1448872 - RNA, 18 nt, Human
agcucacaaggcagcaag

SEQ ID NO: 1448873 - RNA, 14 nt, Human
agcuacagagaaac

SEQ ID NO: 1448874 - RNA, 13 nt, Human
agcuacagagaaa

SEQ ID NO: 1448875 - RNA, 13 nt, Human
agcuacaaaugca

SEQ ID NO: 1448876 - RNA, 13 nt, Human
agcuaagaaccug

SEQ ID NO: 1448877 - RNA, 12 nt, Human
agcuaagaaccu

SEQ ID NO: 1448878 - RNA, 23 nt, Human
agcuaacagggaaggcaggcagg

SEQ ID NO: 1448879 - RNA, 21 nt, Human
agcuaacagggaaggcaggca

SEQ ID NO: 1448880 - RNA, 20 nt, Human
agcuaacagggaaggcaggc

SEQ ID NO: 1448881 - RNA, 19 nt, Human
agcuaacagggaaggcagg

SEQ ID NO: 1448882 - RNA, 18 nt, Human
agcuaacagggaaggcag

SEQ ID NO: 1448883 - RNA, 16 nt, Human
agcuaacagggaaggc

SEQ ID NO: 1448884 - RNA, 13 nt, Human
agcuaacagggaa

SEQ ID NO: 1448885 - RNA, 20 nt, Human
agcuaaauaccucaaucagu

SEQ ID NO: 1448886 - RNA, 13 nt, Human
agcuaaauccuuu

SEQ ID NO: 1448887 - RNA, 18 nt, Human
agcuaaacggauuccaaa

SEQ ID NO: 1448888 - RNA, 23 nt, Human
agcgauucccucucccaggcccc

SEQ ID NO: 1448889 - RNA, 24 nt, Human
agcgauucuccugccucagccucc

SEQ ID NO: 1448890 - RNA, 19 nt, Human
agcugacuuggcuggugug

SEQ ID NO: 1448891 - RNA, 22 nt, Human
agcugacuuggcugguguggua

SEQ ID NO: 1448892 - RNA, 18 nt, Human
agcugacuuggcuggugu

SEQ ID NO: 1448893 - RNA, 17 nt, Human
agcugacuuggcuggug

SEQ ID NO: 1448894 - RNA, 13 nt, Human
agcuggugcggcu

SEQ ID NO: 1448895 - RNA, 18 nt, Human
agcugguguagcuacaga

SEQ ID NO: 1448896 - RNA, 17 nt, Human
agcugguguagcuacag

SEQ ID NO: 1448897 - RNA, 14 nt, Human
agcugguguagcua

SEQ ID NO: 1448898 - RNA, 13 nt, Human
agcugguguagcu

SEQ ID NO: 1448899 - RNA, 17 nt, Human
agcuggugcggcuggcc

SEQ ID NO: 1448900 - RNA, 19 nt, Human
agcuggugcggcuggccau

SEQ ID NO: 1448901 - RNA, 15 nt, Human
agcugguuagaaaug

SEQ ID NO: 1448902 - RNA, 23 nt, Human
agcugguguagcuacagagaaac

SEQ ID NO: 1448903 - RNA, 22 nt, Human
agcugguguagcuacagagaaa

SEQ ID NO: 1448904 - RNA, 21 nt, Human
agcugguguagcuacagagaa

SEQ ID NO: 1448905 - RNA, 20 nt, Human
agcugguguagcuacagaga

SEQ ID NO: 1448906 - RNA, 19 nt, Human
agcugguguagcuacagag

SEQ ID NO: 1448907 - RNA, 24 nt, Human
agcuccucuccccagcccagagac

SEQ ID NO: 1448908 - RNA, 23 nt, Human
agcuccucuccccagcccagaga

SEQ ID NO: 1448909 - RNA, 22 nt, Human
agcuccucuccccagcccagag

SEQ ID NO: 1448910 - RNA, 21 nt, Human
agcuccucuccccagcccaga

SEQ ID NO: 1448911 - RNA, 20 nt, Human
agcuccucuccccagcccag

SEQ ID NO: 1448912 - RNA, 19 nt, Human
agcuccucuccccagccca

SEQ ID NO: 1448913 - RNA, 18 nt, Human
agcuccucuccccagccc

SEQ ID NO: 1448914 - RNA, 17 nt, Human
agcuccucuccccagcc

SEQ ID NO: 1448915 - RNA, 16 nt, Human
agcuccucuccccagc

SEQ ID NO: 1448916 - RNA, 18 nt, Human
agcucuuguugagccgug

SEQ ID NO: 1448917 - RNA, 21 nt, Human
agcucuugugaggaaagucau

SEQ ID NO: 1448918 - RNA, 12 nt, Human
agcucuugugag

SEQ ID NO: 1448919 - RNA, 13 nt, Human
agcucuugugagg

SEQ ID NO: 1448920 - RNA, 16 nt, Human
agcucuugugaggaaa

SEQ ID NO: 1448921 - RNA, 17 nt, Human
agcucuugugaggaaag

SEQ ID NO: 1448922 - RNA, 15 nt, Human
agcucuuggagcugu

SEQ ID NO: 1448923 - RNA, 13 nt, Human
agcugacucacac

SEQ ID NO: 1448924 - RNA, 23 nt, Human
agcugacuaaacuuuuuuucugu

SEQ ID NO: 1448925 - RNA, 16 nt, Human
agcugacuuggcuggu

SEQ ID NO: 1448926 - RNA, 14 nt, Human
agcugacuuggcug

SEQ ID NO: 1448927 - RNA, 16 nt, Human
aggaagguggauggcc

SEQ ID NO: 1448928 - RNA, 15 nt, Human
aggaagguggauggc

SEQ ID NO: 1448929 - RNA, 20 nt, Human
aggaagaauggugugggaga

SEQ ID NO: 1448930 - RNA, 14 nt, Human
aggaacuuccaggu

SEQ ID NO: 1448931 - RNA, 23 nt, Human
agcuuuuuucucugauacagaaa

SEQ ID NO: 1448932 - RNA, 22 nt, Human
agcuuuuuucucugauacagaa

SEQ ID NO: 1448933 - RNA, 20 nt, Human
agcuuuuuucucugauacag

SEQ ID NO: 1448934 - RNA, 19 nt, Human
agcuuuuuucucugauaca

SEQ ID NO: 1448935 - RNA, 13 nt, Human
aggaaaaacaggu

SEQ ID NO: 1448936 - RNA, 18 nt, Human
aggaaaaaauaacaauga

SEQ ID NO: 1448937 - RNA, 16 nt, Human
agcuguauugucugaa

SEQ ID NO: 1448938 - RNA, 17 nt, Human
agcugguuagaaaugca

SEQ ID NO: 1448939 - RNA, 16 nt, Human
agcugucaaggcucag

SEQ ID NO: 1448940 - RNA, 18 nt, Human
agcuguaugauucccagc

SEQ ID NO: 1448941 - RNA, 17 nt, Human
agcuguaugauucccag

SEQ ID NO: 1448942 - RNA, 14 nt, Human
agggacaugcuuag

SEQ ID NO: 1448943 - RNA, 19 nt, Human
agggacaugcuuagcaguc

SEQ ID NO: 1448944 - RNA, 14 nt, Human
aggcuuacacccac

SEQ ID NO: 1448945 - RNA, 14 nt, Human
aggcuuaaacccau

SEQ ID NO: 1448946 - RNA, 20 nt, Human
aggcuguuaaauacaggaaa

SEQ ID NO: 1448947 - RNA, 23 nt, Human
aggcuguuaaauacaggaaacag

SEQ ID NO: 1448948 - RNA, 22 nt, Human
aggcugcauugaaaagagcuga

SEQ ID NO: 1448949 - RNA, 21 nt, Human
aggcugcauugaaaagagcug

SEQ ID NO: 1448950 - RNA, 20 nt, Human
aggcugcauugaaaagagcu

SEQ ID NO: 1448951 - RNA, 19 nt, Human
aggcuaggguggggagaga

SEQ ID NO: 1448952 - RNA, 16 nt, Human
aggcuaggguggggag

SEQ ID NO: 1448953 - RNA, 15 nt, Human
aggcuagggugggga

SEQ ID NO: 1448954 - RNA, 14 nt, Human
aggcuagggugggg

SEQ ID NO: 1448955 - RNA, 22 nt, Human
aggcucuuagcagcuuccagau

SEQ ID NO: 1448956 - RNA, 19 nt, Human
aggcucuuagcagcuucca

SEQ ID NO: 1448957 - RNA, 15 nt, Human
aggcucugucuggaa

SEQ ID NO: 1448958 - RNA, 23 nt, Human
aggcuagguggguugaaagccaa

SEQ ID NO: 1448959 - RNA, 21 nt, Human
aggcuagguggguugaaagcc

SEQ ID NO: 1448960 - RNA, 22 nt, Human
aggcucuggagcccacuguacu

SEQ ID NO: 1448961 - RNA, 22 nt, Human
agggaugacuaaaauauuuauu

SEQ ID NO: 1448962 - RNA, 15 nt, Human
agggaugacuaaaau

SEQ ID NO: 1448963 - RNA, 16 nt, Human
agggauggacaucuug

SEQ ID NO: 1448964 - RNA, 17 nt, Human
agggauggacaucuugu

SEQ ID NO: 1448965 - RNA, 15 nt, Human
agggauggacaucuu

SEQ ID NO: 1448966 - RNA, 24 nt, Human
agggcucaaucucugggggcugag

SEQ ID NO: 1448967 - RNA, 24 nt, Human
agggcuagugacuugugucccaug

SEQ ID NO: 1448968 - RNA, 22 nt, Human
agggcuagugacuuguguccca

SEQ ID NO: 1448969 - RNA, 23 nt, Human
agggcuacccugagcugaggcag

SEQ ID NO: 1448970 - RNA, 22 nt, Human
agggcuacccugagcugaggca

SEQ ID NO: 1448971 - RNA, 21 nt, Human
agggcuacccugagcugaggc

SEQ ID NO: 1448972 - RNA, 20 nt, Human
agggcuacccugagcugagg

SEQ ID NO: 1448973 - RNA, 18 nt, Human
agggcuacccugagcuga

SEQ ID NO: 1448974 - RNA, 17 nt, Human
agggcuacccugagcug

SEQ ID NO: 1448975 - RNA, 20 nt, Human
agggauucugguuccagggu

SEQ ID NO: 1448976 - RNA, 15 nt, Human
agggcuacccugagc

SEQ ID NO: 1448977 - RNA, 19 nt, Human
agggcguggaaaggggcag

SEQ ID NO: 1448978 - RNA, 16 nt, Human
agggacugaccagcag

SEQ ID NO: 1448979 - RNA, 17 nt, Human
agggacugagaaauuua

SEQ ID NO: 1448980 - RNA, 15 nt, Human
agggacugagaaauu

SEQ ID NO: 1448981 - RNA, 13 nt, Human
agggacugagaaa

SEQ ID NO: 1448982 - RNA, 14 nt, Human
agggacugagaaau

SEQ ID NO: 1448983 - RNA, 18 nt, Human
aggcacuuggcagccuug

SEQ ID NO: 1448984 - RNA, 17 nt, Human
aggcacuuggcagccuu

SEQ ID NO: 1448985 - RNA, 15 nt, Human
aggcacuuggcagcc

SEQ ID NO: 1448986 - RNA, 19 nt, Human
aggcacuugagggggaagg

SEQ ID NO: 1448987 - RNA, 16 nt, Human
aggcagauccaggacu

SEQ ID NO: 1448988 - RNA, 15 nt, Human
aggcagauccaggac

SEQ ID NO: 1448989 - RNA, 11 nt, Human
aggcagaucca

SEQ ID NO: 1448990 - RNA, 22 nt, Human
aggcagaggccugggcugggaa

SEQ ID NO: 1448991 - RNA, 22 nt, Human
aggcagaacucaucuagguaaa

SEQ ID NO: 1448992 - RNA, 15 nt, Human
aggccagggcagagu

SEQ ID NO: 1448993 - RNA, 13 nt, Human
aggccagggcaga

SEQ ID NO: 1448994 - RNA, 21 nt, Human
aggcauucuggaccucugggu

SEQ ID NO: 1448995 - RNA, 20 nt, Human
aggcauucuggaccucuggg

SEQ ID NO: 1448996 - RNA, 16 nt, Human
aggcauucuggaccuc

SEQ ID NO: 1448997 - RNA, 15 nt, Human
aggcauucuggaccu

SEQ ID NO: 1448998 - RNA, 22 nt, Human
aggcauuaaauuuuagcaaaga

SEQ ID NO: 1448999 - RNA, 14 nt, Human
aggcauuaaauuuu

SEQ ID NO: 1449000 - RNA, 19 nt, Human
aggcaucgucaugcacagu

SEQ ID NO: 1449001 - RNA, 23 nt, Human
aggcaucgucaugcacaguauuu

SEQ ID NO: 1449002 - RNA, 13 nt, Human
aggcagccagcca

SEQ ID NO: 1449003 - RNA, 20 nt, Human
aggcagccagcaucugggcc

SEQ ID NO: 1449004 - RNA, 19 nt, Human
aggcaucggggagccggga

SEQ ID NO: 1449005 - RNA, 16 nt, Human
aggcagccagcaucug

SEQ ID NO: 1449006 - RNA, 15 nt, Human
aggcagccagcaucu

SEQ ID NO: 1449007 - RNA, 17 nt, Human
aggcagauccaggacua

SEQ ID NO: 1449008 - RNA, 23 nt, Human
aggcaugugucaccaugcccagc

SEQ ID NO: 1449009 - RNA, 20 nt, Human
aggaugggcaugguguucuc

SEQ ID NO: 1449010 - RNA, 18 nt, Human
aggauggcuuugaaugcg

SEQ ID NO: 1449011 - RNA, 18 nt, Human
aggauggucuuacagcag

SEQ ID NO: 1449012 - RNA, 14 nt, Human
aggaugugauauau

SEQ ID NO: 1449013 - RNA, 19 nt, Human
aggauggucuuacagcagg

SEQ ID NO: 1449014 - RNA, 13 nt, Human
aggauguguuugc

SEQ ID NO: 1449015 - RNA, 21 nt, Human
aggaugugucccaucuaggga

SEQ ID NO: 1449016 - RNA, 20 nt, Human
aggauguggaaaccuccuuc

SEQ ID NO: 1449017 - RNA, 20 nt, Human
aggaugugauuguggaaugg

SEQ ID NO: 1449018 - RNA, 21 nt, Human
aggaugugauauauaagugua

SEQ ID NO: 1449019 - RNA, 18 nt, Human
aggaugugauauauaagu

SEQ ID NO: 1449020 - RNA, 19 nt, Human
aggauguguuugcuuucug

SEQ ID NO: 1449021 - RNA, 18 nt, Human
aggauguguuugcuuucu

SEQ ID NO: 1449022 - RNA, 17 nt, Human
aggauguguuugcuuuc

SEQ ID NO: 1449023 - RNA, 13 nt, Human
aggagggcaggca

SEQ ID NO: 1449024 - RNA, 15 nt, Human
aggagggaggugcuu

SEQ ID NO: 1449025 - RNA, 16 nt, Human
aggagggucggugccu

SEQ ID NO: 1449026 - RNA, 15 nt, Human
aggagggcaggcauc

SEQ ID NO: 1449027 - RNA, 15 nt, Human
aggagggugggaagg

SEQ ID NO: 1449028 - RNA, 14 nt, Human
aggagggugggaag

SEQ ID NO: 1449029 - RNA, 17 nt, Human
aggagggucggugccuu

SEQ ID NO: 1449030 - RNA, 21 nt, Human
aggagggucggugccuucaag

SEQ ID NO: 1449031 - RNA, 15 nt, Human
aggaaguagaaacaa

SEQ ID NO: 1449032 - RNA, 14 nt, Human
aggaaguagaaaca

SEQ ID NO: 1449033 - RNA, 18 nt, Human
aggagacaguucaagaaa

SEQ ID NO: 1449034 - RNA, 20 nt, Human
aggagacagguuagcugcuc

SEQ ID NO: 1449035 - RNA, 19 nt, Human
aggaguaacaauacaaaug

SEQ ID NO: 1449036 - RNA, 22 nt, Human
aggaggugucucaggcugccug

SEQ ID NO: 1449037 - RNA, 23 nt, Human
aggaggugucucaggcugccuga

SEQ ID NO: 1449038 - RNA, 21 nt, Human
aggaggugucucaggcugccu

SEQ ID NO: 1449039 - RNA, 20 nt, Human
aggaggugucucaggcugcc

SEQ ID NO: 1449040 - RNA, 19 nt, Human
aggaggugucucaggcugc

SEQ ID NO: 1449041 - RNA, 15 nt, Human
aggaggugucucagg

SEQ ID NO: 1449042 - RNA, 23 nt, Human
aggagucugagguccugagcacu

SEQ ID NO: 1449043 - RNA, 22 nt, Human
aggagucugagguccugagcac

SEQ ID NO: 1449044 - RNA, 14 nt, Human
aggaguagcugagc

SEQ ID NO: 1449045 - RNA, 13 nt, Human
aggaguagcugag

SEQ ID NO: 1449046 - RNA, 11 nt, Human
aggaguaacaa

SEQ ID NO: 1449047 - RNA, 14 nt, Human
aggaggugccacug

SEQ ID NO: 1449048 - RNA, 14 nt, Human
aggaguuuauguuc

SEQ ID NO: 1449049 - RNA, 23 nt, Human
aggaguuuauguuccauuaaacg

SEQ ID NO: 1449050 - RNA, 18 nt, Human
aggaguuucguuuucaaa

SEQ ID NO: 1449051 - RNA, 14 nt, Human
cacccaacgcucca

SEQ ID NO: 1449052 - RNA, 22 nt, Human
cacccaaagagguauuuaucuu

SEQ ID NO: 1449053 - RNA, 24 nt, Human
caccauuuggcaucccugggccuu

SEQ ID NO: 1449054 - RNA, 23 nt, Human
caccauuuggcaucccugggccu

SEQ ID NO: 1449055 - RNA, 22 nt, Human
caccauuuggcaucccugggcc

SEQ ID NO: 1449056 - RNA, 21 nt, Human
caccauuuggcaucccugggc

SEQ ID NO: 1449057 - RNA, 20 nt, Human
caccauuuggcaucccuggg

SEQ ID NO: 1449058 - RNA, 19 nt, Human
caccauuuggcaucccugg

SEQ ID NO: 1449059 - RNA, 18 nt, Human
caccauuuggcaucccug

SEQ ID NO: 1449060 - RNA, 17 nt, Human
caccauuuggcaaugcc

SEQ ID NO: 1449061 - RNA, 17 nt, Human
caccauuuggauccugu

SEQ ID NO: 1449062 - RNA, 16 nt, Human
caccauugaaggcuua

SEQ ID NO: 1449063 - RNA, 15 nt, Human
caccauugaaggcuu

SEQ ID NO: 1449064 - RNA, 14 nt, Human
caccauugaaggcu

SEQ ID NO: 1449065 - RNA, 13 nt, Human
caccauugaaggc

SEQ ID NO: 1449066 - RNA, 14 nt, Human
caccauucugacuc

SEQ ID NO: 1449067 - RNA, 13 nt, Human
caccauucugacu

SEQ ID NO: 1449068 - RNA, 18 nt, Human
caccauuauaaugaauuu

SEQ ID NO: 1449069 - RNA, 20 nt, Human
caccauuccaagucuccacc

SEQ ID NO: 1449070 - RNA, 13 nt, Human
caccauucagguc

SEQ ID NO: 1449071 - RNA, 22 nt, Human
caccauuauaaugaauuuagug

SEQ ID NO: 1449072 - RNA, 17 nt, Human
caccauuauaaugaauu

SEQ ID NO: 1449073 - RNA, 16 nt, Human
caccauuauaaugaau

SEQ ID NO: 1449074 - RNA, 14 nt, Human
caccauuauaauga

SEQ ID NO: 1449075 - RNA, 20 nt, Human
caccauguuggccaggcuug

SEQ ID NO: 1449076 - RNA, 18 nt, Human
caccagacacccaggacu

SEQ ID NO: 1449077 - RNA, 17 nt, Human
caccagacacccaggac

SEQ ID NO: 1449078 - RNA, 16 nt, Human
caccagacacccagga

SEQ ID NO: 1449079 - RNA, 15 nt, Human
caccagacacccagg

SEQ ID NO: 1449080 - RNA, 22 nt, Human
caccacggaccaaagggagucu

SEQ ID NO: 1449081 - RNA, 20 nt, Human
caccagacacccaggacuua

SEQ ID NO: 1449082 - RNA, 19 nt, Human
caccagacacccaggacuu

SEQ ID NO: 1449083 - RNA, 23 nt, Human
caccaauguuucaagaggagccc

SEQ ID NO: 1449084 - RNA, 23 nt, Human
caccaauguacccaccgggccac

SEQ ID NO: 1449085 - RNA, 22 nt, Human
caccaauguacccaccgggcca

SEQ ID NO: 1449086 - RNA, 17 nt, Human
caccaauguacccaccg

SEQ ID NO: 1449087 - RNA, 22 nt, Human
caccaagugcggguccggcagc

SEQ ID NO: 1449088 - RNA, 23 nt, Human
caccaaguuggaacauccuugga

SEQ ID NO: 1449089 - RNA, 22 nt, Human
caccaaguuggaacauccuugg

SEQ ID NO: 1449090 - RNA, 21 nt, Human
caccaagugcggguccggcag

SEQ ID NO: 1449091 - RNA, 16 nt, Human
caccaagugcgggucc

SEQ ID NO: 1449092 - RNA, 14 nt, Human
caccaagccaaggg

SEQ ID NO: 1449093 - RNA, 13 nt, Human
caccaagcugcug

SEQ ID NO: 1449094 - RNA, 13 nt, Human
caccaagccaagg

SEQ ID NO: 1449095 - RNA, 21 nt, Human
caccaagcaggaaaugaaaau

SEQ ID NO: 1449096 - RNA, 19 nt, Human
caccaagcacagcagccug

SEQ ID NO: 1449097 - RNA, 18 nt, Human
caccaagcacagcagccu

SEQ ID NO: 1449098 - RNA, 17 nt, Human
caccaagcacagcagcc

SEQ ID NO: 1449099 - RNA, 16 nt, Human
caccaagcacagcagc

SEQ ID NO: 1449100 - RNA, 15 nt, Human
caccaagcacagcag

SEQ ID NO: 1449101 - RNA, 14 nt, Human
caccaagcacagca

SEQ ID NO: 1449102 - RNA, 13 nt, Human
caccaagcacagc

SEQ ID NO: 1449103 - RNA, 19 nt, Human
caccaacuccuaguucuag

SEQ ID NO: 1449104 - RNA, 22 nt, Human
caccaacuccuaguucuagaaa

SEQ ID NO: 1449105 - RNA, 18 nt, Human
caccaacuacuaccugua

SEQ ID NO: 1449106 - RNA, 22 nt, Human
caccaugcugcuggggaagaca

SEQ ID NO: 1449107 - RNA, 19 nt, Human
caccaugcugcuggggaag

SEQ ID NO: 1449108 - RNA, 17 nt, Human
caccaugcugcugggga

SEQ ID NO: 1449109 - RNA, 19 nt, Human
caccaugauuccuuuaaca

SEQ ID NO: 1449110 - RNA, 17 nt, Human
caccaugauuccuuuaa

SEQ ID NO: 1449111 - RNA, 15 nt, Human
caccaugauuccuuu

SEQ ID NO: 1449112 - RNA, 20 nt, Human
caccauguugcccaggcugg

SEQ ID NO: 1449113 - RNA, 18 nt, Human
caccauguacauagcuug

SEQ ID NO: 1449114 - RNA, 23 nt, Human
caccaggguugaccccagaggau

SEQ ID NO: 1449115 - RNA, 22 nt, Human
caccaggguugaccccagagga

SEQ ID NO: 1449116 - RNA, 19 nt, Human
caccaggguugaccccaga

SEQ ID NO: 1449117 - RNA, 22 nt, Human
caccaggguccuuuugacacug

SEQ ID NO: 1449118 - RNA, 15 nt, Human
caccagggguuucuc

SEQ ID NO: 1449119 - RNA, 16 nt, Human
caccagggccagccuc

SEQ ID NO: 1449120 - RNA, 17 nt, Human
caccagggccagccucu

SEQ ID NO: 1449121 - RNA, 13 nt, Human
caccagaugcuga

SEQ ID NO: 1449122 - RNA, 13 nt, Human
caccagaucugau

SEQ ID NO: 1449123 - RNA, 14 nt, Human
caccagggccagcc

SEQ ID NO: 1449124 - RNA, 23 nt, Human
caccagggcaucucugggcugga

SEQ ID NO: 1449125 - RNA, 23 nt, Human
caccagaugcugaaaauguccuu

SEQ ID NO: 1449126 - RNA, 23 nt, Human
caccaguguguggcuuucagagc

SEQ ID NO: 1449127 - RNA, 21 nt, Human
caccaguguguggcuuucaga

SEQ ID NO: 1449128 - RNA, 20 nt, Human
caccaguucucauggguggc

SEQ ID NO: 1449129 - RNA, 11 nt, Human
caccaguucuc

SEQ ID NO: 1449130 - RNA, 17 nt, Human
caccauagguagaaugu

SEQ ID NO: 1449131 - RNA, 21 nt, Human
caccauauuaccacagacaua

SEQ ID NO: 1449132 - RNA, 21 nt, Human
caccauauuggccagucuggu

SEQ ID NO: 1449133 - RNA, 19 nt, Human
cacagccaggggagcagag

SEQ ID NO: 1449134 - RNA, 18 nt, Human
cacagccaggggagcaga

SEQ ID NO: 1449135 - RNA, 20 nt, Human
cacagccagcaccuggcauc

SEQ ID NO: 1449136 - RNA, 17 nt, Human
cacagccagcaccuggc

SEQ ID NO: 1449137 - RNA, 16 nt, Human
cacagccagcaccugg

SEQ ID NO: 1449138 - RNA, 15 nt, Human
cacagccagcaccug

SEQ ID NO: 1449139 - RNA, 15 nt, Human
cacagcacagccaac

SEQ ID NO: 1449140 - RNA, 12 nt, Human
cacagcacagcc

SEQ ID NO: 1449141 - RNA, 23 nt, Human
cacagcacaaauuaguuauauau

SEQ ID NO: 1449142 - RNA, 18 nt, Human
cacagcacaaauuaguua

SEQ ID NO: 1449143 - RNA, 16 nt, Human
cacagcacaaauuagu

SEQ ID NO: 1449144 - RNA, 14 nt, Human
cacagcacaaauua

SEQ ID NO: 1449145 - RNA, 18 nt, Human
cacagcaauuccucaggc

SEQ ID NO: 1449146 - RNA, 16 nt, Human
cacagcaauuccucag

SEQ ID NO: 1449147 - RNA, 18 nt, Human
cacagcaaccccaggcug

SEQ ID NO: 1449148 - RNA, 17 nt, Human
cacagcaaccccaggcu

SEQ ID NO: 1449149 - RNA, 14 nt, Human
cacagcaaccccag

SEQ ID NO: 1449150 - RNA, 23 nt, Human
cacaggcauuuccuggguggcua

SEQ ID NO: 1449151 - RNA, 20 nt, Human
cacaggcauuuccugggugg

SEQ ID NO: 1449152 - RNA, 19 nt, Human
cacaggcauuuccugggug

SEQ ID NO: 1449153 - RNA, 18 nt, Human
cacaggcauuuccugggu

SEQ ID NO: 1449154 - RNA, 17 nt, Human
cacaggcauuuccuggg

SEQ ID NO: 1449155 - RNA, 16 nt, Human
cacaggcauuuccugg

SEQ ID NO: 1449156 - RNA, 15 nt, Human
cacaggcauuuccug

SEQ ID NO: 1449157 - RNA, 20 nt, Human
cacaggcaaaauccuugcuu

SEQ ID NO: 1449158 - RNA, 16 nt, Human
cacaggcaaaauccuu

SEQ ID NO: 1449159 - RNA, 22 nt, Human
cacaggcccccuugaguggggu

SEQ ID NO: 1449160 - RNA, 21 nt, Human
cacaggcccccuugagugggg

SEQ ID NO: 1449161 - RNA, 13 nt, Human
cacaggcccccuu

SEQ ID NO: 1449162 - RNA, 12 nt, Human
cacaggcccccu

SEQ ID NO: 1449163 - RNA, 17 nt, Human
cacaggacauuucucua

SEQ ID NO: 1449164 - RNA, 15 nt, Human
cacaggacauuucuc

SEQ ID NO: 1449165 - RNA, 23 nt, Human
cacaggacaugcgguagccagca

SEQ ID NO: 1449166 - RNA, 22 nt, Human
cacaggacaugcgguagccagc

SEQ ID NO: 1449167 - RNA, 20 nt, Human
cacaggacaugcgguagcca

SEQ ID NO: 1449168 - RNA, 14 nt, Human
cacagcccagcccg

SEQ ID NO: 1449169 - RNA, 18 nt, Human
cacaugaauuauuacagu

SEQ ID NO: 1449170 - RNA, 17 nt, Human
cacaugcaaggucauuu

SEQ ID NO: 1449171 - RNA, 19 nt, Human
cacaugcaaggucauuuuu

SEQ ID NO: 1449172 - RNA, 20 nt, Human
cacaugcaaggucauuuuuu

SEQ ID NO: 1449173 - RNA, 21 nt, Human
cacaugccccaucccaugcug

SEQ ID NO: 1449174 - RNA, 14 nt, Human
cacaugccccaucc

SEQ ID NO: 1449175 - RNA, 20 nt, Human
cacaugucaguaccuucaaa

SEQ ID NO: 1449176 - RNA, 21 nt, Human
cacaugucagcaaguccuaag

SEQ ID NO: 1449177 - RNA, 20 nt, Human
cacaugcuucccuuuccuga

SEQ ID NO: 1449178 - RNA, 20 nt, Human
cacaugaaucugcacaucug

SEQ ID NO: 1449179 - RNA, 18 nt, Human
cacaugaaucugcacauc

SEQ ID NO: 1449180 - RNA, 20 nt, Human
cacaugacucgggggugggg

SEQ ID NO: 1449181 - RNA, 22 nt, Human
cacaugaauuauuacaguguuu

SEQ ID NO: 1449182 - RNA, 17 nt, Human
cacagugacuucugaga

SEQ ID NO: 1449183 - RNA, 15 nt, Human
cacagugacuucuga

SEQ ID NO: 1449184 - RNA, 16 nt, Human
cacagugacuucugag

SEQ ID NO: 1449185 - RNA, 20 nt, Human
cacaugaaguccaagcauuu

SEQ ID NO: 1449186 - RNA, 17 nt, Human
cacaugaaguccaagca

SEQ ID NO: 1449187 - RNA, 19 nt, Human
cacacuaaccaagcugagu

SEQ ID NO: 1449188 - RNA, 19 nt, Human
caauguaaauauuuuaaag

SEQ ID NO: 1449189 - RNA, 14 nt, Human
caagugcugugcaa

SEQ ID NO: 1449190 - RNA, 24 nt, Human
caaugauggcaauuuuguaacgaa

SEQ ID NO: 1449191 - RNA, 13 nt, Human
caaugaaaugaau

SEQ ID NO: 1449192 - RNA, 20 nt, Human
caaugaaaacucuuugcugc

SEQ ID NO: 1449193 - RNA, 19 nt, Human
caaugaaaacucuuugcug

SEQ ID NO: 1449194 - RNA, 16 nt, Human
caaugaaaacucuuug

SEQ ID NO: 1449195 - RNA, 15 nt, Human
caaugaaaaaaugua

SEQ ID NO: 1449196 - RNA, 22 nt, Human
caaucuuuaaaccaauugcugc

SEQ ID NO: 1449197 - RNA, 15 nt, Human
caaucuuuaaaccaa

SEQ ID NO: 1449198 - RNA, 18 nt, Human
caaucuugcauguaacgc

SEQ ID NO: 1449199 - RNA, 17 nt, Human
caaucuugcauguaacg

SEQ ID NO: 1449200 - RNA, 13 nt, Human
caaucuugcaugu

SEQ ID NO: 1449201 - RNA, 19 nt, Human
caaugaaaugaauuaaagu

SEQ ID NO: 1449202 - RNA, 11 nt, Human
caaugaaauga

SEQ ID NO: 1449203 - RNA, 15 nt, Human
caauauuaaaucugc

SEQ ID NO: 1449204 - RNA, 13 nt, Human
caagguguccuac

SEQ ID NO: 1449205 - RNA, 14 nt, Human
caauauuaaaucug

SEQ ID NO: 1449206 - RNA, 18 nt, Human
caagugcugaacagugga

SEQ ID NO: 1449207 - RNA, 20 nt, Human
caagugcugaacaguggagg

SEQ ID NO: 1449208 - RNA, 17 nt, Human
caagugcugaacagugg

SEQ ID NO: 1449209 - RNA, 16 nt, Human
caagugcugaacagug

SEQ ID NO: 1449210 - RNA, 14 nt, Human
caagugcugaacag

SEQ ID NO: 1449211 - RNA, 16 nt, Human
caaucuacucaaagca

SEQ ID NO: 1449212 - RNA, 17 nt, Human
caaucuacucaaagcau

SEQ ID NO: 1449213 - RNA, 21 nt, Human
caaucuuccuguuuaaaaaac

SEQ ID NO: 1449214 - RNA, 14 nt, Human
caauauucaauaaa

SEQ ID NO: 1449215 - RNA, 15 nt, Human
caauauucaauaaag

SEQ ID NO: 1449216 - RNA, 16 nt, Human
caauauucaauaaagc

SEQ ID NO: 1449217 - RNA, 17 nt, Human
caauauucaauaaagcu

SEQ ID NO: 1449218 - RNA, 22 nt, Human
cacaaguggguacccccaggac

SEQ ID NO: 1449219 - RNA, 21 nt, Human
cacaaguggguacccccagga

SEQ ID NO: 1449220 - RNA, 19 nt, Human
cacaaguggguacccccag

SEQ ID NO: 1449221 - RNA, 18 nt, Human
cacaaguggguaccccca

SEQ ID NO: 1449222 - RNA, 21 nt, Human
cacaagugcccuccaggcuuu

SEQ ID NO: 1449223 - RNA, 23 nt, Human
cacaagaauggaucacaagaugg

SEQ ID NO: 1449224 - RNA, 14 nt, Human
cacaagaauggauc

SEQ ID NO: 1449225 - RNA, 13 nt, Human
cacaagaauggau

SEQ ID NO: 1449226 - RNA, 23 nt, Human
cacaaauauuuauuuucuuucug

SEQ ID NO: 1449227 - RNA, 21 nt, Human
cacaaauauuuauuuucuuuc

SEQ ID NO: 1449228 - RNA, 13 nt, Human
cacaaauauuuau

SEQ ID NO: 1449229 - RNA, 13 nt, Human
cacaaacuguaaa

SEQ ID NO: 1449230 - RNA, 14 nt, Human
cacaaauuaguuau

SEQ ID NO: 1449231 - RNA, 13 nt, Human
cacaaauuaguua

SEQ ID NO: 1449232 - RNA, 16 nt, Human
cacaaauuaguuauau

SEQ ID NO: 1449233 - RNA, 20 nt, Human
cacaacuuguuuuugguuuu

SEQ ID NO: 1449234 - RNA, 12 nt, Human
cacaacuuguuu

SEQ ID NO: 1449235 - RNA, 13 nt, Human
caauuauguuaaa

SEQ ID NO: 1449236 - RNA, 22 nt, Human
caauuauaguuucugaggcuuu

SEQ ID NO: 1449237 - RNA, 15 nt, Human
caauuauguuaaacu

SEQ ID NO: 1449238 - RNA, 18 nt, Human
caauuauaguuucugagg

SEQ ID NO: 1449239 - RNA, 15 nt, Human
caauuauaguuucug

SEQ ID NO: 1449240 - RNA, 14 nt, Human
caauuauaguuucu

SEQ ID NO: 1449241 - RNA, 21 nt, Human
caauuauaagaggauaugaac

SEQ ID NO: 1449242 - RNA, 21 nt, Human
caauuaguuuccuuuuuaaua

SEQ ID NO: 1449243 - RNA, 18 nt, Human
caauuaguuuccuuuuua

SEQ ID NO: 1449244 - RNA, 17 nt, Human
caauuaguuuccuuuuu

SEQ ID NO: 1449245 - RNA, 14 nt, Human
caauuaguuuccuu

SEQ ID NO: 1449246 - RNA, 13 nt, Human
caauuaguuuccu

SEQ ID NO: 1449247 - RNA, 17 nt, Human
caauguaaauauuuuaa

SEQ ID NO: 1449248 - RNA, 16 nt, Human
caauuagggccuagcc

SEQ ID NO: 1449249 - RNA, 14 nt, Human
caauguaaauauuu

SEQ ID NO: 1449250 - RNA, 23 nt, Human
caaugcaccuaaagaaaaacaaa

SEQ ID NO: 1449251 - RNA, 18 nt, Human
caaugcaccuaaagaaaa

SEQ ID NO: 1449252 - RNA, 17 nt, Human
caaugcaccuaaagaaa

SEQ ID NO: 1449253 - RNA, 15 nt, Human
cacaaaccaugcaaa

SEQ ID NO: 1449254 - RNA, 13 nt, Human
caauuuuuauauu

SEQ ID NO: 1449255 - RNA, 12 nt, Human
cacaaacuguaa

SEQ ID NO: 1449256 - RNA, 20 nt, Human
caauuuucuggaauacauga

SEQ ID NO: 1449257 - RNA, 13 nt, Human
caauucaaaaguu

SEQ ID NO: 1449258 - RNA, 12 nt, Human
caauucaaaaca

SEQ ID NO: 1449259 - RNA, 11 nt, Human
caauuuuguaa

SEQ ID NO: 1449260 - RNA, 12 nt, Human
caauuuuguaac

SEQ ID NO: 1449261 - RNA, 14 nt, Human
cacacacugaugcu

SEQ ID NO: 1449262 - RNA, 18 nt, Human
cacacaaugugucugaga

SEQ ID NO: 1449263 - RNA, 18 nt, Human
cacacaagaagaagggca

SEQ ID NO: 1449264 - RNA, 19 nt, Human
cacacaaggauagaugcug

SEQ ID NO: 1449265 - RNA, 16 nt, Human
cacacaagaagaaggg

SEQ ID NO: 1449266 - RNA, 19 nt, Human
cacacacaaaagggaaccc

SEQ ID NO: 1449267 - RNA, 18 nt, Human
cacaccaggcgcuaauuc

SEQ ID NO: 1449268 - RNA, 14 nt, Human
cacaccaggauaga

SEQ ID NO: 1449269 - RNA, 19 nt, Human
cacacagcaagucaggguu

SEQ ID NO: 1449270 - RNA, 10 nt, Human
cacaccuccu

SEQ ID NO: 1449271 - RNA, 22 nt, Human
cacaccuacuagucaccagaga

SEQ ID NO: 1449272 - RNA, 21 nt, Human
caaagccaggucccucucauu

SEQ ID NO: 1449273 - RNA, 14 nt, Human
caaagaguagaauu

SEQ ID NO: 1449274 - RNA, 16 nt, Human
caaagagguauuuauc

SEQ ID NO: 1449275 - RNA, 16 nt, Human
caaagaguucaagaaa

SEQ ID NO: 1449276 - RNA, 15 nt, Human
caaagaguucaagaa

SEQ ID NO: 1449277 - RNA, 22 nt, Human
caaagacuuaagcccagugcac

SEQ ID NO: 1449278 - RNA, 17 nt, Human
caaagacccuggcuuuc

SEQ ID NO: 1449279 - RNA, 18 nt, Human
caaagacccuggcuuuca

SEQ ID NO: 1449280 - RNA, 16 nt, Human
caaagacccuggcuuu

SEQ ID NO: 1449281 - RNA, 14 nt, Human
caaagacccuggcu

SEQ ID NO: 1449282 - RNA, 23 nt, Human
caaacugggaaccccuuucccac

SEQ ID NO: 1449283 - RNA, 22 nt, Human
caaacugggaaccccuuuccca

SEQ ID NO: 1449284 - RNA, 20 nt, Human
caaacugggaaccccuuucc

SEQ ID NO: 1449285 - RNA, 16 nt, Human
caaacugggaaccccu

SEQ ID NO: 1449286 - RNA, 12 nt, Human
caaagaaauuau

SEQ ID NO: 1449287 - RNA, 13 nt, Human
caaagaaauuaug

SEQ ID NO: 1449288 - RNA, 16 nt, Human
caaagaaaguguauug

SEQ ID NO: 1449289 - RNA, 15 nt, Human
caaagaaauuaugug

SEQ ID NO: 1449290 - RNA, 20 nt, Human
caaacugcaugcccagagac

SEQ ID NO: 1449291 - RNA, 17 nt, Human
caaacugccuaagcccu

SEQ ID NO: 1449292 - RNA, 19 nt, Human
caaacugcaugcccagaga

SEQ ID NO: 1449293 - RNA, 18 nt, Human
caaacugcaugcccagag

SEQ ID NO: 1449294 - RNA, 18 nt, Human
caaacugccuaagcccuc

SEQ ID NO: 1449295 - RNA, 23 nt, Human
caaacugccuaagcccuccgcca

SEQ ID NO: 1449296 - RNA, 16 nt, Human
caaacugcaugcccag

SEQ ID NO: 1449297 - RNA, 14 nt, Human
caaacugcaugccc

SEQ ID NO: 1449298 - RNA, 13 nt, Human
caaacugcaugcc

SEQ ID NO: 1449299 - RNA, 22 nt, Human
caaacugaggaauuucaccugu

SEQ ID NO: 1449300 - RNA, 23 nt, Human
auuuuaaugaagaaaguggaaaa

SEQ ID NO: 1449301 - RNA, 14 nt, Human
auuuuaaucaaauu

SEQ ID NO: 1449302 - RNA, 19 nt, Human
auuuuaauaauguuucaaa

SEQ ID NO: 1449303 - RNA, 18 nt, Human
auuuuaauaauguuucaa

SEQ ID NO: 1449304 - RNA, 18 nt, Human
auuuuaaaguuaguaucu

SEQ ID NO: 1449305 - RNA, 21 nt, Human
auuuuaaaguuaguaucuuuu

SEQ ID NO: 1449306 - RNA, 14 nt, Human
auuuuaaaguuagu

SEQ ID NO: 1449307 - RNA, 13 nt, Human
auuuuaaaguuag

SEQ ID NO: 1449308 - RNA, 12 nt, Human
auuuuaaaguua

SEQ ID NO: 1449309 - RNA, 18 nt, Human
auuuguacuauuuaacug

SEQ ID NO: 1449310 - RNA, 17 nt, Human
auuuguacuauuuaacu

SEQ ID NO: 1449311 - RNA, 22 nt, Human
caaaggggaggcaucagugucc

SEQ ID NO: 1449312 - RNA, 17 nt, Human
caaaggggaccuggaag

SEQ ID NO: 1449313 - RNA, 18 nt, Human
caaagggagucugccagg

SEQ ID NO: 1449314 - RNA, 17 nt, Human
caaagggagucugccag

SEQ ID NO: 1449315 - RNA, 23 nt, Human
caaaggagccugugaacccagga

SEQ ID NO: 1449316 - RNA, 16 nt, Human
caaaggagccugugaa

SEQ ID NO: 1449317 - RNA, 15 nt, Human
caaaggagccuguga

SEQ ID NO: 1449318 - RNA, 14 nt, Human
caaaggagccugug

SEQ ID NO: 1449319 - RNA, 13 nt, Human
caaaggagccugu

SEQ ID NO: 1449320 - RNA, 12 nt, Human
caaaggagccug

SEQ ID NO: 1449321 - RNA, 11 nt, Human
caaaggagccu

SEQ ID NO: 1449322 - RNA, 18 nt, Human
caaagcccccagagccca

SEQ ID NO: 1449323 - RNA, 17 nt, Human
caaagcccccagagccc

SEQ ID NO: 1449324 - RNA, 16 nt, Human
caaagcccccagagcc

SEQ ID NO: 1449325 - RNA, 15 nt, Human
caaagcccccagagc

SEQ ID NO: 1449326 - RNA, 14 nt, Human
caaagcccccagag

SEQ ID NO: 1449327 - RNA, 19 nt, Human
caaagcccccagagcccag

SEQ ID NO: 1449328 - RNA, 22 nt, Human
caaagcccccagagcccaggcu

SEQ ID NO: 1449329 - RNA, 16 nt, Human
caaaggacgcacugag

SEQ ID NO: 1449330 - RNA, 18 nt, Human
caaaggacgcacugagca

SEQ ID NO: 1449331 - RNA, 13 nt, Human
caaaggacgcacu

SEQ ID NO: 1449332 - RNA, 21 nt, Human
caaauauuuagauguaauuuu

SEQ ID NO: 1449333 - RNA, 23 nt, Human
caaaguucuaauaauuucuaaug

SEQ ID NO: 1449334 - RNA, 13 nt, Human
caaauauuccaga

SEQ ID NO: 1449335 - RNA, 17 nt, Human
caaauauuccagagacu

SEQ ID NO: 1449336 - RNA, 14 nt, Human
caaauauuuauuuu

SEQ ID NO: 1449337 - RNA, 12 nt, Human
caaauauuuauu

SEQ ID NO: 1449338 - RNA, 23 nt, Human
caaauauuuagauguaauuuugu

SEQ ID NO: 1449339 - RNA, 22 nt, Human
caaauauuuagauguaauuuug

SEQ ID NO: 1449340 - RNA, 16 nt, Human
caaauauuuauuuucu

SEQ ID NO: 1449341 - RNA, 15 nt, Human
caaauauuuauuuuc

SEQ ID NO: 1449342 - RNA, 20 nt, Human
caaaguucuaauaauuucua

SEQ ID NO: 1449343 - RNA, 18 nt, Human
caaaggggaccuggaagg

SEQ ID NO: 1449344 - RNA, 22 nt, Human
caaaguucuaauaauuucuaau

SEQ ID NO: 1449345 - RNA, 21 nt, Human
caaaguucuaauaauuucuaa

SEQ ID NO: 1449346 - RNA, 20 nt, Human
caaauuaaaaaagauaaaca

SEQ ID NO: 1449347 - RNA, 21 nt, Human
caaauuaaaaaagauaaacac

SEQ ID NO: 1449348 - RNA, 19 nt, Human
caaauuaaaaaagauaaac

SEQ ID NO: 1449349 - RNA, 17 nt, Human
caaauuaaaaaagauaa

SEQ ID NO: 1449350 - RNA, 16 nt, Human
caaauuaaaaaagaua

SEQ ID NO: 1449351 - RNA, 15 nt, Human
caaauuaaaaaagau

SEQ ID NO: 1449352 - RNA, 23 nt, Human
caaauguuuauuaagcaucagaa

SEQ ID NO: 1449353 - RNA, 15 nt, Human
caaauucuucugaac

SEQ ID NO: 1449354 - RNA, 14 nt, Human
caaauucuucugaa

SEQ ID NO: 1449355 - RNA, 21 nt, Human
caaauuggagcuucauggcag

SEQ ID NO: 1449356 - RNA, 17 nt, Human
caaauuguaagcaugca

SEQ ID NO: 1449357 - RNA, 22 nt, Human
caacaguuuuuuaugcuaauca

SEQ ID NO: 1449358 - RNA, 22 nt, Human
caacaguuuuccuaugcuuuga

SEQ ID NO: 1449359 - RNA, 20 nt, Human
caacaguuuuccuaugcuuu

SEQ ID NO: 1449360 - RNA, 13 nt, Human
caacaguuuuccu

SEQ ID NO: 1449361 - RNA, 12 nt, Human
caacaguuuucc

SEQ ID NO: 1449362 - RNA, 20 nt, Human
caacaguuuaaugaagaucu

SEQ ID NO: 1449363 - RNA, 15 nt, Human
caacaguuuaaugaa

SEQ ID NO: 1449364 - RNA, 12 nt, Human
caacaguuuaau

SEQ ID NO: 1449365 - RNA, 16 nt, Human
caacaguuacauaauu

SEQ ID NO: 1449366 - RNA, 15 nt, Human
caaccuaaaacucuu

SEQ ID NO: 1449367 - RNA, 13 nt, Human
caaccuaaaacuc

SEQ ID NO: 1449368 - RNA, 18 nt, Human
caaccucaacugccuacu

SEQ ID NO: 1449369 - RNA, 18 nt, Human
caaccucauccuccuucu

SEQ ID NO: 1449370 - RNA, 18 nt, Human
caaccucaguaauuuaga

SEQ ID NO: 1449371 - RNA, 15 nt, Human
caaccucaguaauuu

SEQ ID NO: 1449372 - RNA, 15 nt, Human
caaccucauccucuc

SEQ ID NO: 1449373 - RNA, 21 nt, Human
caacugucuccuaccucugcu

SEQ ID NO: 1449374 - RNA, 23 nt, Human
caacugucucgaugcaaugaaca

SEQ ID NO: 1449375 - RNA, 21 nt, Human
caacugucucgaugcaaugaa

SEQ ID NO: 1449376 - RNA, 19 nt, Human
caacuggcccuauuuagau

SEQ ID NO: 1449377 - RNA, 23 nt, Human
caacuggcccuauuuagaugaua

SEQ ID NO: 1449378 - RNA, 18 nt, Human
caacuggcccuauuuaga

SEQ ID NO: 1449379 - RNA, 14 nt, Human
caacuggcaggcag

SEQ ID NO: 1449380 - RNA, 12 nt, Human
caacuggcaggc

SEQ ID NO: 1449381 - RNA, 18 nt, Human
caacugaaugaggucagc

SEQ ID NO: 1449382 - RNA, 18 nt, Human
caacucuuuguuauuuga

SEQ ID NO: 1449383 - RNA, 14 nt, Human
caacucuuuguuau

SEQ ID NO: 1449384 - RNA, 13 nt, Human
caacucuuuguua

SEQ ID NO: 1449385 - RNA, 16 nt, Human
caacucuuugagaaac

SEQ ID NO: 1449386 - RNA, 15 nt, Human
caacucuuugagaaa

SEQ ID NO: 1449387 - RNA, 14 nt, Human
caacucuuugagaa

SEQ ID NO: 1449388 - RNA, 13 nt, Human
caacucuuugaga

SEQ ID NO: 1449389 - RNA, 16 nt, Human
caaccugcucuccucu

SEQ ID NO: 1449390 - RNA, 18 nt, Human
caacucuugauuauccau

SEQ ID NO: 1449391 - RNA, 16 nt, Human
caacucuugauuaucc

SEQ ID NO: 1449392 - RNA, 12 nt, Human
caacucuugauu

SEQ ID NO: 1449393 - RNA, 15 nt, Human
caaccugcucuccuc

SEQ ID NO: 1449394 - RNA, 14 nt, Human
caaccuccaccucc

SEQ ID NO: 1449395 - RNA, 21 nt, Human
caaccugccugacauuuggag

SEQ ID NO: 1449396 - RNA, 17 nt, Human
caaccugcaaagaucug

SEQ ID NO: 1449397 - RNA, 20 nt, Human
caaccuccaccuccuggguu

SEQ ID NO: 1449398 - RNA, 20 nt, Human
caaccuccgcauccgggguu

SEQ ID NO: 1449399 - RNA, 21 nt, Human
caagugaccuauaccuguguu

SEQ ID NO: 1449400 - RNA, 17 nt, Human
caagguuuaaagagucu

SEQ ID NO: 1449401 - RNA, 15 nt, Human
caagguucuccaaca

SEQ ID NO: 1449402 - RNA, 13 nt, Human
caagguucuaacc

SEQ ID NO: 1449403 - RNA, 18 nt, Human
caagguucaacuuauuaa

SEQ ID NO: 1449404 - RNA, 21 nt, Human
caagguuuaaagagucuagau

SEQ ID NO: 1449405 - RNA, 22 nt, Human
caagguuuaaagagucuagauu

SEQ ID NO: 1449406 - RNA, 20 nt, Human
caagguuuaaagagucuaga

SEQ ID NO: 1449407 - RNA, 18 nt, Human
caagguuuaaagagucua

SEQ ID NO: 1449408 - RNA, 15 nt, Human
caagguaccauccua

SEQ ID NO: 1449409 - RNA, 16 nt, Human
caagguacucugguga

SEQ ID NO: 1449410 - RNA, 14 nt, Human
caagguacucuggu

SEQ ID NO: 1449411 - RNA, 20 nt, Human
caagguguccuacagaaaaa

SEQ ID NO: 1449412 - RNA, 21 nt, Human
caagguguccuacagaaaaac

SEQ ID NO: 1449413 - RNA, 18 nt, Human
caagguguccuacagaaa

SEQ ID NO: 1449414 - RNA, 17 nt, Human
caagguguccuacagaa

SEQ ID NO: 1449415 - RNA, 16 nt, Human
caagguguccuacaga

SEQ ID NO: 1449416 - RNA, 15 nt, Human
caagguguccuacag

SEQ ID NO: 1449417 - RNA, 13 nt, Human
caaggucauuuuu

SEQ ID NO: 1449418 - RNA, 21 nt, Human
caaggggauuuuuaugucugg

SEQ ID NO: 1449419 - RNA, 18 nt, Human
caaggggaaucagaacuc

SEQ ID NO: 1449420 - RNA, 14 nt, Human
caagggccugaugg

SEQ ID NO: 1449421 - RNA, 17 nt, Human
caagggaggcugcugcu

SEQ ID NO: 1449422 - RNA, 16 nt, Human
caagggaggcugcugc

SEQ ID NO: 1449423 - RNA, 14 nt, Human
caagggaggcugcu

SEQ ID NO: 1449424 - RNA, 18 nt, Human
caagggcauaaauuauug

SEQ ID NO: 1449425 - RNA, 15 nt, Human
caagcuucugagacg

SEQ ID NO: 1449426 - RNA, 24 nt, Human
caagcuucugagacgucaugagga

SEQ ID NO: 1449427 - RNA, 17 nt, Human
caagcuuguccaacccg

SEQ ID NO: 1449428 - RNA, 20 nt, Human
caagcuuaauggcugauaau

SEQ ID NO: 1449429 - RNA, 16 nt, Human
caagcuguuuucuucu

SEQ ID NO: 1449430 - RNA, 14 nt, Human
caagcuguuuucuu

SEQ ID NO: 1449431 - RNA, 17 nt, Human
caagcauucagaagaaa

SEQ ID NO: 1449432 - RNA, 22 nt, Human
caagcauucagaagaaaaagaa

SEQ ID NO: 1449433 - RNA, 16 nt, Human
caagcauucagaagaa

SEQ ID NO: 1449434 - RNA, 22 nt, Human
caagcauggucccacaucccug

SEQ ID NO: 1449435 - RNA, 23 nt, Human
caagcauggucccacaucccugg

SEQ ID NO: 1449436 - RNA, 21 nt, Human
caagcauggcuauuuuauauu

SEQ ID NO: 1449437 - RNA, 18 nt, Human
caagcauggcuauuuuau

SEQ ID NO: 1449438 - RNA, 21 nt, Human
caagcaucuuggggggguggc

SEQ ID NO: 1449439 - RNA, 22 nt, Human
caagcaguugggacuacaggcg

SEQ ID NO: 1449440 - RNA, 21 nt, Human
caagcagucgugccugugucc

SEQ ID NO: 1449441 - RNA, 20 nt, Human
caagcagucgugccuguguc

SEQ ID NO: 1449442 - RNA, 19 nt, Human
caagcagucgugccugugu

SEQ ID NO: 1449443 - RNA, 18 nt, Human
caagcagucgugccugug

SEQ ID NO: 1449444 - RNA, 16 nt, Human
caagcagucgugccug

SEQ ID NO: 1449445 - RNA, 15 nt, Human
caagcagucgugccu

SEQ ID NO: 1449446 - RNA, 23 nt, Human
caagcaggaaaugaaaaugucuu

SEQ ID NO: 1449447 - RNA, 17 nt, Human
caagcaggaaaugaaaa

SEQ ID NO: 1449448 - RNA, 19 nt, Human
caagcccagcccauggaga

SEQ ID NO: 1449449 - RNA, 17 nt, Human
caagcccagcacugcuu

SEQ ID NO: 1449450 - RNA, 20 nt, Human
caagccaucuugagugguca

SEQ ID NO: 1449451 - RNA, 14 nt, Human
caagcauucugucu

SEQ ID NO: 1449452 - RNA, 19 nt, Human
caagcauuuagauguauag

SEQ ID NO: 1449453 - RNA, 16 nt, Human
caagcauuuagaugua

SEQ ID NO: 1449454 - RNA, 13 nt, Human
caagagcccuguc

SEQ ID NO: 1449455 - RNA, 21 nt, Human
caagacuucucuuugccucaa

SEQ ID NO: 1449456 - RNA, 20 nt, Human
caagacuucucuuugccuca

SEQ ID NO: 1449457 - RNA, 23 nt, Human
caagacugcuguggccaggaggu

SEQ ID NO: 1449458 - RNA, 20 nt, Human
caagcagcuuagaguuggcc

SEQ ID NO: 1449459 - RNA, 18 nt, Human
caagcagcuuagaguugg

SEQ ID NO: 1449460 - RNA, 13 nt, Human
caagcagcuuaga

SEQ ID NO: 1449461 - RNA, 22 nt, Human
caagcagcgaccgcccccuccu

SEQ ID NO: 1449462 - RNA, 21 nt, Human
caagcagccugagcaacucuu

SEQ ID NO: 1449463 - RNA, 22 nt, Human
caagacugcuguggccaggagg

SEQ ID NO: 1449464 - RNA, 21 nt, Human
caagacugcuguggccaggag

SEQ ID NO: 1449465 - RNA, 20 nt, Human
caagacugcuguggccagga

SEQ ID NO: 1449466 - RNA, 19 nt, Human
caagacugcuguggccagg

SEQ ID NO: 1449467 - RNA, 12 nt, Human
caagacugcugu

SEQ ID NO: 1449468 - RNA, 21 nt, Human
caagacccuuuuggguuucug

SEQ ID NO: 1449469 - RNA, 17 nt, Human
caagaccucagugccuu

SEQ ID NO: 1449470 - RNA, 20 nt, Human
caacuugagcauguuacuga

SEQ ID NO: 1449471 - RNA, 18 nt, Human
caacuugagcauguuacu

SEQ ID NO: 1449472 - RNA, 19 nt, Human
caacuugagcauguuacug

SEQ ID NO: 1449473 - RNA, 20 nt, Human
caagaaauaaaaggaagcca

SEQ ID NO: 1449474 - RNA, 19 nt, Human
caagaaauaaaaggaagcc

SEQ ID NO: 1449475 - RNA, 13 nt, Human
caagaaauaaaag

SEQ ID NO: 1449476 - RNA, 18 nt, Human
caagaaauaaguuuuugu

SEQ ID NO: 1449477 - RNA, 21 nt, Human
caagaaauaaaaggaagccaa

SEQ ID NO: 1449478 - RNA, 16 nt, Human
caagaccgaucggcgg

SEQ ID NO: 1449479 - RNA, 23 nt, Human
cauuucuauagccaaaaauagcu

SEQ ID NO: 1449480 - RNA, 21 nt, Human
cauuugaaaccccuguaggcc

SEQ ID NO: 1449481 - RNA, 19 nt, Human
cauuugaaaccccuguagg

SEQ ID NO: 1449482 - RNA, 10 nt, Human
cauuugaaug

SEQ ID NO: 1449483 - RNA, 11 nt, Human
cauuugaaugc

SEQ ID NO: 1449484 - RNA, 22 nt, Human
cauuugaaaauuuugauguuuu

SEQ ID NO: 1449485 - RNA, 20 nt, Human
cauuugaaaauuuugauguu

SEQ ID NO: 1449486 - RNA, 14 nt, Human
cauuugcucaugga

SEQ ID NO: 1449487 - RNA, 13 nt, Human
cauuugcucaugg

SEQ ID NO: 1449488 - RNA, 20 nt, Human
cauuuguuugaacugauaaa

SEQ ID NO: 1449489 - RNA, 22 nt, Human
cauuuguuugaacugauaaaga

SEQ ID NO: 1449490 - RNA, 12 nt, Human
cauuugaaugca

SEQ ID NO: 1449491 - RNA, 14 nt, Human
cauuugcauuuguu

SEQ ID NO: 1449492 - RNA, 22 nt, Human
ccaaacaccuuccagcuccugu

SEQ ID NO: 1449493 - RNA, 16 nt, Human
ccaaacaggcucagag

SEQ ID NO: 1449494 - RNA, 17 nt, Human
cauuuuucaauagcaca

SEQ ID NO: 1449495 - RNA, 16 nt, Human
cauuuuuccguaaaaa

SEQ ID NO: 1449496 - RNA, 16 nt, Human
cauuuuucaugauaau

SEQ ID NO: 1449497 - RNA, 23 nt, Human
cauuuuucuuagggaaggauaca

SEQ ID NO: 1449498 - RNA, 12 nt, Human
cauuuuguaaua

SEQ ID NO: 1449499 - RNA, 16 nt, Human
cauuuuguaauaauaa

SEQ ID NO: 1449500 - RNA, 13 nt, Human
cauuuuguaauaa

SEQ ID NO: 1449501 - RNA, 19 nt, Human
cauuuguuuuguuuacaga

SEQ ID NO: 1449502 - RNA, 17 nt, Human
cauuuguuuuguuuaca

SEQ ID NO: 1449503 - RNA, 11 nt, Human
cauuugcugaa

SEQ ID NO: 1449504 - RNA, 19 nt, Human
cauuuuagggguagcauuu

SEQ ID NO: 1449505 - RNA, 12 nt, Human
cauuucuauuaa

SEQ ID NO: 1449506 - RNA, 20 nt, Human
cauuucuagcgcauggccug

SEQ ID NO: 1449507 - RNA, 21 nt, Human
cauuucuaauuauguagcucu

SEQ ID NO: 1449508 - RNA, 23 nt, Human
cauuucuaauuauguagcucuuu

SEQ ID NO: 1449509 - RNA, 20 nt, Human
cauuucuaauuauguagcuc

SEQ ID NO: 1449510 - RNA, 19 nt, Human
cauuucuaauuauguagcu

SEQ ID NO: 1449511 - RNA, 11 nt, Human
cauuucuaauu

SEQ ID NO: 1449512 - RNA, 12 nt, Human
cauuucuaaaau

SEQ ID NO: 1449513 - RNA, 22 nt, Human
cauuuccuggguggcuacucug

SEQ ID NO: 1449514 - RNA, 21 nt, Human
cauuuccuggguggcuacucu

SEQ ID NO: 1449515 - RNA, 20 nt, Human
cauuuccuggguggcuacuc

SEQ ID NO: 1449516 - RNA, 14 nt, Human
cauuuccugggugg

SEQ ID NO: 1449517 - RNA, 12 nt, Human
cauuuccugggu

SEQ ID NO: 1449518 - RNA, 21 nt, Human
cauuuaaaacauuaaaauaua

SEQ ID NO: 1449519 - RNA, 21 nt, Human
cauuuaaaagauacaguuacu

SEQ ID NO: 1449520 - RNA, 12 nt, Human
cauuuaaaagau

SEQ ID NO: 1449521 - RNA, 20 nt, Human
cauuuaaaacauuaaaauau

SEQ ID NO: 1449522 - RNA, 15 nt, Human
cauuuaaaagauaca

SEQ ID NO: 1449523 - RNA, 16 nt, Human
cauuuaaaagauacag

SEQ ID NO: 1449524 - RNA, 22 nt, Human
cauuuccucagacucuaagaaa

SEQ ID NO: 1449525 - RNA, 14 nt, Human
cauuuccucagacu

SEQ ID NO: 1449526 - RNA, 23 nt, Human
cauuuccuaucaccuauuuccau

SEQ ID NO: 1449527 - RNA, 22 nt, Human
cauuuagcuaaacggauuccaa

SEQ ID NO: 1449528 - RNA, 18 nt, Human
cauuuagccuguccuguc

SEQ ID NO: 1449529 - RNA, 17 nt, Human
cauuuagccuguccugu

SEQ ID NO: 1449530 - RNA, 16 nt, Human
cauuuagccuguccug

SEQ ID NO: 1449531 - RNA, 16 nt, Human
cauuuagcauguuguu

SEQ ID NO: 1449532 - RNA, 13 nt, Human
cauuuaauagacu

SEQ ID NO: 1449533 - RNA, 22 nt, Human
cauuuaauggggaggacaaaau

SEQ ID NO: 1449534 - RNA, 24 nt, Human
cauuguagugcuuugagagagaaa

SEQ ID NO: 1449535 - RNA, 20 nt, Human
cauuguagugcuuugagaga

SEQ ID NO: 1449536 - RNA, 18 nt, Human
cauuguagugcuuugaga

SEQ ID NO: 1449537 - RNA, 15 nt, Human
cauuguagugcuuug

SEQ ID NO: 1449538 - RNA, 19 nt, Human
cauuguagcgucuuucuuu

SEQ ID NO: 1449539 - RNA, 18 nt, Human
cauuguagcgucuuucuu

SEQ ID NO: 1449540 - RNA, 14 nt, Human
cauuguagaaaagc

SEQ ID NO: 1449541 - RNA, 15 nt, Human
cauugccaagggcuu

SEQ ID NO: 1449542 - RNA, 17 nt, Human
cauuguuucguaacaca

SEQ ID NO: 1449543 - RNA, 18 nt, Human
cauuguuuagaaagaaua

SEQ ID NO: 1449544 - RNA, 20 nt, Human
cauuguugagcuauugcugu

SEQ ID NO: 1449545 - RNA, 13 nt, Human
cauuguugagcua

SEQ ID NO: 1449546 - RNA, 22 nt, Human
cauugugccaugucaaacaaau

SEQ ID NO: 1449547 - RNA, 17 nt, Human
cauugugcuucuuucuu

SEQ ID NO: 1449548 - RNA, 18 nt, Human
cauugugauuggccugua

SEQ ID NO: 1449549 - RNA, 13 nt, Human
cauugugcuucuu

SEQ ID NO: 1449550 - RNA, 16 nt, Human
cauugugauuggccug

SEQ ID NO: 1449551 - RNA, 14 nt, Human
cauugucuuuuuag

SEQ ID NO: 1449552 - RNA, 20 nt, Human
cauugucuuuuuagaugccc

SEQ ID NO: 1449553 - RNA, 14 nt, Human
cauugucucagagc

SEQ ID NO: 1449554 - RNA, 14 nt, Human
cauuguauauguga

SEQ ID NO: 1449555 - RNA, 21 nt, Human
cauuguccaauccuauguuuu

SEQ ID NO: 1449556 - RNA, 19 nt, Human
cauuguccaauccuauguu

SEQ ID NO: 1449557 - RNA, 15 nt, Human
cauuguaugugguca

SEQ ID NO: 1449558 - RNA, 23 nt, Human
cauuguauucagaguugaugguu

SEQ ID NO: 1449559 - RNA, 22 nt, Human
ccaagacugcuguggccaggag

SEQ ID NO: 1449560 - RNA, 23 nt, Human
ccaagacugcuguggccaggagg

SEQ ID NO: 1449561 - RNA, 21 nt, Human
ccaagacugcuguggccagga

SEQ ID NO: 1449562 - RNA, 18 nt, Human
ccaagacugcuguggcca

SEQ ID NO: 1449563 - RNA, 17 nt, Human
ccaagacugcuguggcc

SEQ ID NO: 1449564 - RNA, 22 nt, Human
ccaagacucuagaguccaaggu

SEQ ID NO: 1449565 - RNA, 18 nt, Human
ccaagaugggcaucuuuu

SEQ ID NO: 1449566 - RNA, 18 nt, Human
ccaagauggcccauccug

SEQ ID NO: 1449567 - RNA, 15 nt, Human
ccaagauggcccauc

SEQ ID NO: 1449568 - RNA, 18 nt, Human
ccaagauacuuaagugcu

SEQ ID NO: 1449569 - RNA, 16 nt, Human
ccaagagucuaaagau

SEQ ID NO: 1449570 - RNA, 15 nt, Human
ccaagagucuaaaga

SEQ ID NO: 1449571 - RNA, 11 nt, Human
ccaagagucua

SEQ ID NO: 1449572 - RNA, 21 nt, Human
ccaagaggcuguucccaccag

SEQ ID NO: 1449573 - RNA, 21 nt, Human
ccaagacucuagaguccaagg

SEQ ID NO: 1449574 - RNA, 15 nt, Human
ccaagacucuagagu

SEQ ID NO: 1449575 - RNA, 14 nt, Human
ccaagacucuagag

SEQ ID NO: 1449576 - RNA, 11 nt, Human
ccaagaaucuu

SEQ ID NO: 1449577 - RNA, 21 nt, Human
ccaagaauccacauuucuaaa

SEQ ID NO: 1449578 - RNA, 19 nt, Human
ccaagaauccacauuucua

SEQ ID NO: 1449579 - RNA, 18 nt, Human
ccaagaauccacauuucu

SEQ ID NO: 1449580 - RNA, 14 nt, Human
ccaacccucagggc

SEQ ID NO: 1449581 - RNA, 13 nt, Human
ccaacccucaggg

SEQ ID NO: 1449582 - RNA, 12 nt, Human
ccaacccucagg

SEQ ID NO: 1449583 - RNA, 15 nt, Human
ccaacccucagggca

SEQ ID NO: 1449584 - RNA, 22 nt, Human
ccaacccgucuggcccaccagg

SEQ ID NO: 1449585 - RNA, 17 nt, Human
ccaacccgaggcccgca

SEQ ID NO: 1449586 - RNA, 15 nt, Human
ccaacccgaggcccg

SEQ ID NO: 1449587 - RNA, 19 nt, Human
ccaacccccgacuucaucc

SEQ ID NO: 1449588 - RNA, 18 nt, Human
ccaacccguggaggcugc

SEQ ID NO: 1449589 - RNA, 17 nt, Human
ccaacccguggaggcug

SEQ ID NO: 1449590 - RNA, 15 nt, Human
ccaacccguggaggc

SEQ ID NO: 1449591 - RNA, 14 nt, Human
ccaacccguggagg

SEQ ID NO: 1449592 - RNA, 21 nt, Human
ccaacccguggaggcugcucg

SEQ ID NO: 1449593 - RNA, 20 nt, Human
ccaacccguggaggcugcuc

SEQ ID NO: 1449594 - RNA, 12 nt, Human
ccaacccuagca

SEQ ID NO: 1449595 - RNA, 15 nt, Human
ccaaagcuuuccugc

SEQ ID NO: 1449596 - RNA, 14 nt, Human
ccaaagcuuuccug

SEQ ID NO: 1449597 - RNA, 13 nt, Human
ccaaagcuuuccu

SEQ ID NO: 1449598 - RNA, 16 nt, Human
ccaaagcuuucaugua

SEQ ID NO: 1449599 - RNA, 17 nt, Human
ccaaagcuucccacggc

SEQ ID NO: 1449600 - RNA, 14 nt, Human
ccaaaggcucccug

SEQ ID NO: 1449601 - RNA, 19 nt, Human
ccaaaggaugugauauaua

SEQ ID NO: 1449602 - RNA, 16 nt, Human
ccaaaggaugugauau

SEQ ID NO: 1449603 - RNA, 14 nt, Human
ccaaaggaggaugg

SEQ ID NO: 1449604 - RNA, 21 nt, Human
ccaaaggacgcacugagcaac

SEQ ID NO: 1449605 - RNA, 19 nt, Human
ccaaaggacgcacugagca

SEQ ID NO: 1449606 - RNA, 18 nt, Human
ccaaaggacgcacugagc

SEQ ID NO: 1449607 - RNA, 17 nt, Human
ccaaaggacagccgccu

SEQ ID NO: 1449608 - RNA, 20 nt, Human
ccaaagcuuuccugccccag

SEQ ID NO: 1449609 - RNA, 19 nt, Human
ccaaagcuuuccugcccca

SEQ ID NO: 1449610 - RNA, 17 nt, Human
ccaaagcuuuccugccc

SEQ ID NO: 1449611 - RNA, 16 nt, Human
ccaaagcuuuccugcc

SEQ ID NO: 1449612 - RNA, 12 nt, Human
ccaaacugccua

SEQ ID NO: 1449613 - RNA, 17 nt, Human
ccaaacugauccaguau

SEQ ID NO: 1449614 - RNA, 18 nt, Human
ccaaacucuucccucucu

SEQ ID NO: 1449615 - RNA, 22 nt, Human
ccaaacugacucuuaagaagac

SEQ ID NO: 1449616 - RNA, 18 nt, Human
ccaacagcuggacccuga

SEQ ID NO: 1449617 - RNA, 22 nt, Human
ccaacagcuggacccugaccag

SEQ ID NO: 1449618 - RNA, 12 nt, Human
ccaacagcugga

SEQ ID NO: 1449619 - RNA, 16 nt, Human
ccaacagcgcccaaag

SEQ ID NO: 1449620 - RNA, 23 nt, Human
ccaacagcgcccaaaggacgcac

SEQ ID NO: 1449621 - RNA, 17 nt, Human
ccaaccauuuccucaga

SEQ ID NO: 1449622 - RNA, 14 nt, Human
ccaaccauuuccuc

SEQ ID NO: 1449623 - RNA, 13 nt, Human
ccaaccauuuccu

SEQ ID NO: 1449624 - RNA, 19 nt, Human
ccaacaaagaacacuaacu

SEQ ID NO: 1449625 - RNA, 20 nt, Human
ccaaauuugauugauuugaa

SEQ ID NO: 1449626 - RNA, 15 nt, Human
ccaaauuugauugau

SEQ ID NO: 1449627 - RNA, 20 nt, Human
ccaaaguacacuguuucaaa

SEQ ID NO: 1449628 - RNA, 18 nt, Human
ccaaaggggaccuggaag

SEQ ID NO: 1449629 - RNA, 19 nt, Human
ccaaaggggaccuggaagg

SEQ ID NO: 1449630 - RNA, 21 nt, Human
ccaaagggagucugccagggc

SEQ ID NO: 1449631 - RNA, 19 nt, Human
ccaaagggagucugccagg

SEQ ID NO: 1449632 - RNA, 18 nt, Human
ccaaagggagucugccag

SEQ ID NO: 1449633 - RNA, 13 nt, Human
ccaaagggagucu

SEQ ID NO: 1449634 - RNA, 15 nt, Human
ccaaaguacacuguu

SEQ ID NO: 1449635 - RNA, 18 nt, Human
ccaaaguacacuguuuca

SEQ ID NO: 1449636 - RNA, 16 nt, Human
ccaacacugccagcau

SEQ ID NO: 1449637 - RNA, 15 nt, Human
ccaacacugccagca

SEQ ID NO: 1449638 - RNA, 14 nt, Human
ccaacacugccagc

SEQ ID NO: 1449639 - RNA, 21 nt, Human
ccaacacgcaccugccucagg

SEQ ID NO: 1449640 - RNA, 20 nt, Human
ccaacacgcaccugccucag

SEQ ID NO: 1449641 - RNA, 13 nt, Human
ccaacacugccag

SEQ ID NO: 1449642 - RNA, 23 nt, Human
ccaacaccaagcacagcagccug

SEQ ID NO: 1449643 - RNA, 22 nt, Human
ccaacaccaagcacagcagccu

SEQ ID NO: 1449644 - RNA, 19 nt, Human
ccaacaccaagcacagcag

SEQ ID NO: 1449645 - RNA, 17 nt, Human
ccaacaccaagcacagc

SEQ ID NO: 1449646 - RNA, 16 nt, Human
ccaacaccaagcacag

SEQ ID NO: 1449647 - RNA, 13 nt, Human
ccaacaccaagca

SEQ ID NO: 1449648 - RNA, 21 nt, Human
ccaacaagaagggacugagag

SEQ ID NO: 1449649 - RNA, 21 nt, Human
ccaacaagauugcuuaauaaa

SEQ ID NO: 1449650 - RNA, 16 nt, Human
ccaagguaccauccua

SEQ ID NO: 1449651 - RNA, 16 nt, Human
ccaaggggcuucaggu

SEQ ID NO: 1449652 - RNA, 22 nt, Human
ccaaggggccugagcaguccuu

SEQ ID NO: 1449653 - RNA, 17 nt, Human
ccaaggggccugagcag

SEQ ID NO: 1449654 - RNA, 16 nt, Human
ccaaggggccugagca

SEQ ID NO: 1449655 - RNA, 15 nt, Human
ccaaggggccugagc

SEQ ID NO: 1449656 - RNA, 14 nt, Human
ccaaggggccugag

SEQ ID NO: 1449657 - RNA, 22 nt, Human
ccaaggggauuuuuaugucugg

SEQ ID NO: 1449658 - RNA, 19 nt, Human
ccaaggggaaucagaacuc

SEQ ID NO: 1449659 - RNA, 21 nt, Human
ccaagggcuuuguuuugcaca

SEQ ID NO: 1449660 - RNA, 13 nt, Human
ccaagggcugccg

SEQ ID NO: 1449661 - RNA, 18 nt, Human
ccaagggaggcugcugcu

SEQ ID NO: 1449662 - RNA, 22 nt, Human
ccaagggaggcugcugcugcuc

SEQ ID NO: 1449663 - RNA, 15 nt, Human
ccaagggaggcugcu

SEQ ID NO: 1449664 - RNA, 13 nt, Human
ccaagggaggcug

SEQ ID NO: 1449665 - RNA, 19 nt, Human
ccaagggaaccuguguccg

SEQ ID NO: 1449666 - RNA, 18 nt, Human
ccaagggaaccugugucc

SEQ ID NO: 1449667 - RNA, 17 nt, Human
ccaagggaaccuguguc

SEQ ID NO: 1449668 - RNA, 16 nt, Human
ccaagggaaccugugu

SEQ ID NO: 1449669 - RNA, 18 nt, Human
ccaagggccgacuaagag

SEQ ID NO: 1449670 - RNA, 19 nt, Human
ccaagggcauaaauuauug

SEQ ID NO: 1449671 - RNA, 18 nt, Human
ccaagggauggacaucuu

SEQ ID NO: 1449672 - RNA, 16 nt, Human
ccaaggcuuucucuac

SEQ ID NO: 1449673 - RNA, 11 nt, Human
ccaaguuccuc

SEQ ID NO: 1449674 - RNA, 13 nt, Human
ccaaguuccucua

SEQ ID NO: 1449675 - RNA, 19 nt, Human
ccaaguccagguccuggug

SEQ ID NO: 1449676 - RNA, 18 nt, Human
ccaaguccagguccuggu

SEQ ID NO: 1449677 - RNA, 17 nt, Human
ccaaguccagguccugg

SEQ ID NO: 1449678 - RNA, 16 nt, Human
ccaaguccagguccug

SEQ ID NO: 1449679 - RNA, 15 nt, Human
ccaaguccagguccu

SEQ ID NO: 1449680 - RNA, 18 nt, Human
ccaauagggcugagcucu

SEQ ID NO: 1449681 - RNA, 21 nt, Human
ccaagguuuuauaaggcugau

SEQ ID NO: 1449682 - RNA, 20 nt, Human
ccaagguuuuauaaggcuga

SEQ ID NO: 1449683 - RNA, 19 nt, Human
ccaagguuuuauaaggcug

SEQ ID NO: 1449684 - RNA, 16 nt, Human
ccaaggucuucuuaau

SEQ ID NO: 1449685 - RNA, 22 nt, Human
ccaaguagaaucucaguugauu

SEQ ID NO: 1449686 - RNA, 20 nt, Human
ccaaguaacugggauuacag

SEQ ID NO: 1449687 - RNA, 20 nt, Human
ccaaguagcugggauuacag

SEQ ID NO: 1449688 - RNA, 20 nt, Human
ccaaguagcugagacuacag

SEQ ID NO: 1449689 - RNA, 19 nt, Human
ccaagccagaggcuggguu

SEQ ID NO: 1449690 - RNA, 17 nt, Human
ccaagccagaggcuggg

SEQ ID NO: 1449691 - RNA, 16 nt, Human
ccaagccagaggcugg

SEQ ID NO: 1449692 - RNA, 23 nt, Human
ccaagccaagggaaccugugucc

SEQ ID NO: 1449693 - RNA, 22 nt, Human
ccaagccaagggaaccuguguc

SEQ ID NO: 1449694 - RNA, 20 nt, Human
ccaagccaagggaaccugug

SEQ ID NO: 1449695 - RNA, 18 nt, Human
ccaagccaagggaaccug

SEQ ID NO: 1449696 - RNA, 15 nt, Human
ccaagcccagcccau

SEQ ID NO: 1449697 - RNA, 22 nt, Human
ccaagccuuggggauucuucca

SEQ ID NO: 1449698 - RNA, 17 nt, Human
ccaagcggugucucucc

SEQ ID NO: 1449699 - RNA, 15 nt, Human
ccaagcggugucucu

SEQ ID NO: 1449700 - RNA, 20 nt, Human
ccaagcuaagcacugccacu

SEQ ID NO: 1449701 - RNA, 17 nt, Human
ccaagcuaagcacugcc

SEQ ID NO: 1449702 - RNA, 17 nt, Human
ccaagcuauucaauucu

SEQ ID NO: 1449703 - RNA, 21 nt, Human
ccaagcaguugggacuacagg

SEQ ID NO: 1449704 - RNA, 20 nt, Human
ccaagcaguugggacuacag

SEQ ID NO: 1449705 - RNA, 22 nt, Human
ccaagcaguugggacuacaggc

SEQ ID NO: 1449706 - RNA, 23 nt, Human
ccaagcaucuuggggggguggcc

SEQ ID NO: 1449707 - RNA, 22 nt, Human
ccaagcaucuuggggggguggc

SEQ ID NO: 1449708 - RNA, 13 nt, Human
ccaagcaucuugg

SEQ ID NO: 1449709 - RNA, 17 nt, Human
ccaagcauuuagaugua

SEQ ID NO: 1449710 - RNA, 17 nt, Human
ccaagauucuagaugau

SEQ ID NO: 1449711 - RNA, 18 nt, Human
ccaagauugagcucucug

SEQ ID NO: 1449712 - RNA, 21 nt, Human
ccaagauuggccugaggcugc

SEQ ID NO: 1449713 - RNA, 16 nt, Human
ccaagauucuagauga

SEQ ID NO: 1449714 - RNA, 15 nt, Human
ccaagauucuagaug

SEQ ID NO: 1449715 - RNA, 14 nt, Human
ccaagauucuagau

SEQ ID NO: 1449716 - RNA, 13 nt, Human
ccaagauucuaga

SEQ ID NO: 1449717 - RNA, 20 nt, Human
ccaagauuccggauccuaag

SEQ ID NO: 1449718 - RNA, 13 nt, Human
ccaagauuccgga

SEQ ID NO: 1449719 - RNA, 22 nt, Human
ccaagaugggcaucuuuuguau

SEQ ID NO: 1449720 - RNA, 12 nt, Human
ccaagcacagca

SEQ ID NO: 1449721 - RNA, 14 nt, Human
ccaagcaaguauua

SEQ ID NO: 1449722 - RNA, 18 nt, Human
ccaagcacagcagccugg

SEQ ID NO: 1449723 - RNA, 17 nt, Human
ccaagcacagcagccug

SEQ ID NO: 1449724 - RNA, 15 nt, Human
ccaagcacagcagcc

SEQ ID NO: 1449725 - RNA, 14 nt, Human
ccaagcacagcagc

SEQ ID NO: 1449726 - RNA, 13 nt, Human
ccaagcacagcag

SEQ ID NO: 1449727 - RNA, 18 nt, Human
ccaagcacuucuuuuucu

SEQ ID NO: 1449728 - RNA, 20 nt, Human
ccaagcaccugggauuacaa

SEQ ID NO: 1449729 - RNA, 13 nt, Human
ccagacacugguu

SEQ ID NO: 1449730 - RNA, 11 nt, Human
ccagacacugg

SEQ ID NO: 1449731 - RNA, 14 nt, Human
ccagacacaggccc

SEQ ID NO: 1449732 - RNA, 12 nt, Human
ccagacacuggu

SEQ ID NO: 1449733 - RNA, 15 nt, Human
ccagacacaggcccu

SEQ ID NO: 1449734 - RNA, 16 nt, Human
ccagaauuuaaaccua

SEQ ID NO: 1449735 - RNA, 16 nt, Human
ccagaagaugacugag

SEQ ID NO: 1449736 - RNA, 21 nt, Human
ccagaagaugacugaggguga

SEQ ID NO: 1449737 - RNA, 13 nt, Human
ccagaagaugacu

SEQ ID NO: 1449738 - RNA, 18 nt, Human
ccagaagugugacuggcu

SEQ ID NO: 1449739 - RNA, 16 nt, Human
ccagaagugugacugg

SEQ ID NO: 1449740 - RNA, 13 nt, Human
ccacuuaaaaugu

SEQ ID NO: 1449741 - RNA, 16 nt, Human
ccacuuaaaaauuaaa

SEQ ID NO: 1449742 - RNA, 21 nt, Human
ccacuuacauuuacaaacuga

SEQ ID NO: 1449743 - RNA, 20 nt, Human
ccacuuaauguauguuacca

SEQ ID NO: 1449744 - RNA, 17 nt, Human
ccacuuaauguauguua

SEQ ID NO: 1449745 - RNA, 15 nt, Human
ccacuuaauguaugu

SEQ ID NO: 1449746 - RNA, 18 nt, Human
ccacuccaucugguagaa

SEQ ID NO: 1449747 - RNA, 17 nt, Human
ccacuccaucugguaga

SEQ ID NO: 1449748 - RNA, 16 nt, Human
ccacuccaucugguag

SEQ ID NO: 1449749 - RNA, 13 nt, Human
ccacuccaucugg

SEQ ID NO: 1449750 - RNA, 15 nt, Human
ccacuuauagccucu

SEQ ID NO: 1449751 - RNA, 17 nt, Human
ccacuucaagugaccac

SEQ ID NO: 1449752 - RNA, 22 nt, Human
ccacuuauuccccauucuuccu

SEQ ID NO: 1449753 - RNA, 16 nt, Human
ccacuuauagccucug

SEQ ID NO: 1449754 - RNA, 15 nt, Human
ccagaaaguaaaggu

SEQ ID NO: 1449755 - RNA, 23 nt, Human
ccagaaagccccacccaggccag

SEQ ID NO: 1449756 - RNA, 22 nt, Human
ccagaaagccccacccaggcca

SEQ ID NO: 1449757 - RNA, 21 nt, Human
ccagaaagcaguugagacaag

SEQ ID NO: 1449758 - RNA, 14 nt, Human
ccacuucagccucc

SEQ ID NO: 1449759 - RNA, 17 nt, Human
ccacucagagacaugca

SEQ ID NO: 1449760 - RNA, 15 nt, Human
ccacucagagacaug

SEQ ID NO: 1449761 - RNA, 13 nt, Human
ccacucagagaca

SEQ ID NO: 1449762 - RNA, 12 nt, Human
ccacucagagac

SEQ ID NO: 1449763 - RNA, 16 nt, Human
ccacuagccucagggg

SEQ ID NO: 1449764 - RNA, 15 nt, Human
ccacuagccucaggg

SEQ ID NO: 1449765 - RNA, 14 nt, Human
ccacuagccucagg

SEQ ID NO: 1449766 - RNA, 16 nt, Human
ccacuacauucuguua

SEQ ID NO: 1449767 - RNA, 17 nt, Human
ccacuacauucuguuaa

SEQ ID NO: 1449768 - RNA, 11 nt, Human
ccacuacauuc

SEQ ID NO: 1449769 - RNA, 15 nt, Human
ccacuacauucuguu

SEQ ID NO: 1449770 - RNA, 14 nt, Human
ccacuacauucugu

SEQ ID NO: 1449771 - RNA, 17 nt, Human
ccacguacugcagccuc

SEQ ID NO: 1449772 - RNA, 16 nt, Human
ccacguacugcagccu

SEQ ID NO: 1449773 - RNA, 13 nt, Human
ccacguacugcag

SEQ ID NO: 1449774 - RNA, 21 nt, Human
ccacgucagcugggacacccc

SEQ ID NO: 1449775 - RNA, 19 nt, Human
ccaccccagggcagccagg

SEQ ID NO: 1449776 - RNA, 20 nt, Human
ccaccccagggcagccaggg

SEQ ID NO: 1449777 - RNA, 18 nt, Human
ccaccccagggcagccag

SEQ ID NO: 1449778 - RNA, 14 nt, Human
ccaccccagggcag

SEQ ID NO: 1449779 - RNA, 17 nt, Human
ccaccccaauccuccca

SEQ ID NO: 1449780 - RNA, 15 nt, Human
ccaccccacccacuu

SEQ ID NO: 1449781 - RNA, 22 nt, Human
ccaccccaaccugcucuccucu

SEQ ID NO: 1449782 - RNA, 13 nt, Human
ccacccccaaggu

SEQ ID NO: 1449783 - RNA, 16 nt, Human
ccaccccauucccgca

SEQ ID NO: 1449784 - RNA, 18 nt, Human
ccaccccauccaguucau

SEQ ID NO: 1449785 - RNA, 12 nt, Human
ccaccccaugcu

SEQ ID NO: 1449786 - RNA, 22 nt, Human
ccaccugucugucugucugucc

SEQ ID NO: 1449787 - RNA, 11 nt, Human
ccaccugucug

SEQ ID NO: 1449788 - RNA, 12 nt, Human
ccaccugucugu

SEQ ID NO: 1449789 - RNA, 14 nt, Human
ccaccugucugucu

SEQ ID NO: 1449790 - RNA, 16 nt, Human
ccaccugucugucugu

SEQ ID NO: 1449791 - RNA, 17 nt, Human
ccacggggacucagccc

SEQ ID NO: 1449792 - RNA, 14 nt, Human
ccacgguguucugu

SEQ ID NO: 1449793 - RNA, 16 nt, Human
ccaccccaaccugcuc

SEQ ID NO: 1449794 - RNA, 17 nt, Human
ccacccaggggcagccc

SEQ ID NO: 1449795 - RNA, 23 nt, Human
ccacccaggggcagccccaggcc

SEQ ID NO: 1449796 - RNA, 14 nt, Human
ccacccaggccagg

SEQ ID NO: 1449797 - RNA, 12 nt, Human
ccacccaggcca

SEQ ID NO: 1449798 - RNA, 21 nt, Human
ccaccauuuggcaucccuggg

SEQ ID NO: 1449799 - RNA, 22 nt, Human
ccaccauuuggcaucccugggc

SEQ ID NO: 1449800 - RNA, 18 nt, Human
ccaccauuuggcaucccu

SEQ ID NO: 1449801 - RNA, 17 nt, Human
ccaccauuuggcauccc

SEQ ID NO: 1449802 - RNA, 16 nt, Human
ccaccauuuggcaucc

SEQ ID NO: 1449803 - RNA, 16 nt, Human
ccaccauggccagcua

SEQ ID NO: 1449804 - RNA, 13 nt, Human
ccacauccuccac

SEQ ID NO: 1449805 - RNA, 22 nt, Human
ccacaucccugggccugcugcu

SEQ ID NO: 1449806 - RNA, 23 nt, Human
ccacaucccugggccugcugcug

SEQ ID NO: 1449807 - RNA, 21 nt, Human
ccacaucccugggccugcugc

SEQ ID NO: 1449808 - RNA, 20 nt, Human
ccacaucccugggccugcug

SEQ ID NO: 1449809 - RNA, 19 nt, Human
ccacaucccugggccugcu

SEQ ID NO: 1449810 - RNA, 18 nt, Human
ccacaucccugggccugc

SEQ ID NO: 1449811 - RNA, 17 nt, Human
ccacaucccugggccug

SEQ ID NO: 1449812 - RNA, 16 nt, Human
ccacaucccugggccu

SEQ ID NO: 1449813 - RNA, 15 nt, Human
ccacaucccugggcc

SEQ ID NO: 1449814 - RNA, 14 nt, Human
ccacaucccugggc

SEQ ID NO: 1449815 - RNA, 13 nt, Human
ccacaucccuggg

SEQ ID NO: 1449816 - RNA, 16 nt, Human
ccacaucccaucgucu

SEQ ID NO: 1449817 - RNA, 22 nt, Human
ccacaucccacucacaacagcu

SEQ ID NO: 1449818 - RNA, 19 nt, Human
ccacagugucaggcacugg

SEQ ID NO: 1449819 - RNA, 14 nt, Human
ccacagugucaggc

SEQ ID NO: 1449820 - RNA, 13 nt, Human
ccacagugucagg

SEQ ID NO: 1449821 - RNA, 20 nt, Human
ccacagugccuaauaauacu

SEQ ID NO: 1449822 - RNA, 19 nt, Human
ccacagucccaucugcuuc

SEQ ID NO: 1449823 - RNA, 17 nt, Human
ccacaguagucuugaug

SEQ ID NO: 1449824 - RNA, 15 nt, Human
ccacaguagucuuga

SEQ ID NO: 1449825 - RNA, 15 nt, Human
ccacaggucuagacu

SEQ ID NO: 1449826 - RNA, 14 nt, Human
ccacaggucuagac

SEQ ID NO: 1449827 - RNA, 21 nt, Human
ccacagggucccacagccacg

SEQ ID NO: 1449828 - RNA, 20 nt, Human
ccacagggucccacagccac

SEQ ID NO: 1449829 - RNA, 19 nt, Human
ccacagggucccacagcca

SEQ ID NO: 1449830 - RNA, 16 nt, Human
ccacagggucccacag

SEQ ID NO: 1449831 - RNA, 19 nt, Human
ccacaggcuucugagcagc

SEQ ID NO: 1449832 - RNA, 14 nt, Human
ccacaggcuucuga

SEQ ID NO: 1449833 - RNA, 20 nt, Human
ccacaggcucaggcaggggc

SEQ ID NO: 1449834 - RNA, 19 nt, Human
ccacaggcucaggcagggg

SEQ ID NO: 1449835 - RNA, 17 nt, Human
ccacaggcucaggcagg

SEQ ID NO: 1449836 - RNA, 21 nt, Human
ccacaggcucaggcaggggcc

SEQ ID NO: 1449837 - RNA, 16 nt, Human
ccacaggcucaggcag

SEQ ID NO: 1449838 - RNA, 15 nt, Human
ccacaggcucaggca

SEQ ID NO: 1449839 - RNA, 18 nt, Human
ccaccaacccucagggca

SEQ ID NO: 1449840 - RNA, 17 nt, Human
ccaccaacccucagggc

SEQ ID NO: 1449841 - RNA, 16 nt, Human
ccaccaacccucaggg

SEQ ID NO: 1449842 - RNA, 15 nt, Human
ccaccaacccucagg

SEQ ID NO: 1449843 - RNA, 14 nt, Human
ccaccaacccucag

SEQ ID NO: 1449844 - RNA, 13 nt, Human
ccaccaacccuca

SEQ ID NO: 1449845 - RNA, 16 nt, Human
ccaccaaaacugcucc

SEQ ID NO: 1449846 - RNA, 15 nt, Human
ccaccaaaacugcuc

SEQ ID NO: 1449847 - RNA, 17 nt, Human
ccaccaagagggacgcc

SEQ ID NO: 1449848 - RNA, 21 nt, Human
ccaccaagagggacgccuggg

SEQ ID NO: 1449849 - RNA, 13 nt, Human
ccacauuuggaau

SEQ ID NO: 1449850 - RNA, 15 nt, Human
ccacauuucuaaaau

SEQ ID NO: 1449851 - RNA, 14 nt, Human
ccacauuucuaaaa

SEQ ID NO: 1449852 - RNA, 17 nt, Human
ccacauuggaagagcag

SEQ ID NO: 1449853 - RNA, 19 nt, Human
ccacauuggaagagcagca

SEQ ID NO: 1449854 - RNA, 14 nt, Human
ccacauuggaagag

SEQ ID NO: 1449855 - RNA, 20 nt, Human
ccacauuaaagaagaccuga

SEQ ID NO: 1449856 - RNA, 16 nt, Human
ccacauuaaagaagac

SEQ ID NO: 1449857 - RNA, 14 nt, Human
ccacauuaaagaag

SEQ ID NO: 1449858 - RNA, 13 nt, Human
ccacauuaaagaa

SEQ ID NO: 1449859 - RNA, 19 nt, Human
ccacauuuggaauacuuuu

SEQ ID NO: 1449860 - RNA, 22 nt, Human
ccacauuuggaauacuuuuugu

SEQ ID NO: 1449861 - RNA, 16 nt, Human
ccacaugggaggcuca

SEQ ID NO: 1449862 - RNA, 17 nt, Human
ccacauggcacagagau

SEQ ID NO: 1449863 - RNA, 15 nt, Human
ccacauggcacagag

SEQ ID NO: 1449864 - RNA, 12 nt, Human
ccacaugcccca

SEQ ID NO: 1449865 - RNA, 14 nt, Human
ccacaugccccauc

SEQ ID NO: 1449866 - RNA, 22 nt, Human
ccacaugccauuuguacugacc

SEQ ID NO: 1449867 - RNA, 20 nt, Human
ccacaugccauuuguacuga

SEQ ID NO: 1449868 - RNA, 22 nt, Human
ccacacagugcucaaggccagc

SEQ ID NO: 1449869 - RNA, 23 nt, Human
ccacacagugcucaaggccagcu

SEQ ID NO: 1449870 - RNA, 20 nt, Human
ccacacagugcucaaggcca

SEQ ID NO: 1449871 - RNA, 16 nt, Human
ccacacagcugccggu

SEQ ID NO: 1449872 - RNA, 12 nt, Human
ccacacagcugc

SEQ ID NO: 1449873 - RNA, 15 nt, Human
ccaauauuaaaucug

SEQ ID NO: 1449874 - RNA, 22 nt, Human
ccaauagggcugagcucucugu

SEQ ID NO: 1449875 - RNA, 18 nt, Human
ccaauauuaaaucugcug

SEQ ID NO: 1449876 - RNA, 20 nt, Human
ccacaccagggccagccucu

SEQ ID NO: 1449877 - RNA, 19 nt, Human
ccacaccagggccagccuc

SEQ ID NO: 1449878 - RNA, 17 nt, Human
ccacaggccgcccugcg

SEQ ID NO: 1449879 - RNA, 16 nt, Human
ccacaggccgcccugc

SEQ ID NO: 1449880 - RNA, 21 nt, Human
ccacaggacauuucucuaaga

SEQ ID NO: 1449881 - RNA, 16 nt, Human
ccacaggacauuucuc

SEQ ID NO: 1449882 - RNA, 23 nt, Human
ccacaggaagccugcaguccugg

SEQ ID NO: 1449883 - RNA, 19 nt, Human
ccacacucagauccuccuc

SEQ ID NO: 1449884 - RNA, 18 nt, Human
ccacacucagauccuccu

SEQ ID NO: 1449885 - RNA, 11 nt, Human
ccacacucaga

SEQ ID NO: 1449886 - RNA, 19 nt, Human
ccacacccuguacuguucu

SEQ ID NO: 1449887 - RNA, 16 nt, Human
ccacacccuguacugu

SEQ ID NO: 1449888 - RNA, 21 nt, Human
ccacacucagauccuccucau

SEQ ID NO: 1449889 - RNA, 14 nt, Human
ccacacucagcaca

SEQ ID NO: 1449890 - RNA, 22 nt, Human
ccacaggaagccugcaguccug

SEQ ID NO: 1449891 - RNA, 19 nt, Human
ccacaggaagccugcaguc

SEQ ID NO: 1449892 - RNA, 15 nt, Human
ccacagcuuuugcaa

SEQ ID NO: 1449893 - RNA, 13 nt, Human
ccacagcuuuugc

SEQ ID NO: 1449894 - RNA, 20 nt, Human
ccacaggaaccacaagacug

SEQ ID NO: 1449895 - RNA, 23 nt, Human
ccaggccaaaggggaccuggaag

SEQ ID NO: 1449896 - RNA, 22 nt, Human
ccaggccaaaggggaccuggaa

SEQ ID NO: 1449897 - RNA, 16 nt, Human
ccaggcauugccaagg

SEQ ID NO: 1449898 - RNA, 18 nt, Human
ccaggcauguggcagggg

SEQ ID NO: 1449899 - RNA, 20 nt, Human
ccaggcauccuccacaauag

SEQ ID NO: 1449900 - RNA, 20 nt, Human
ccaggaggacccagggcucu

SEQ ID NO: 1449901 - RNA, 21 nt, Human
ccaggaggacccagggcucug

SEQ ID NO: 1449902 - RNA, 19 nt, Human
ccaggaggacccagggcuc

SEQ ID NO: 1449903 - RNA, 18 nt, Human
ccaggaggacccagggcu

SEQ ID NO: 1449904 - RNA, 15 nt, Human
ccaggaggacccagg

SEQ ID NO: 1449905 - RNA, 14 nt, Human
ccaggaggacccag

SEQ ID NO: 1449906 - RNA, 13 nt, Human
ccaggacucugca

SEQ ID NO: 1449907 - RNA, 12 nt, Human
ccaggacucugc

SEQ ID NO: 1449908 - RNA, 23 nt, Human
ccaggccccaugaccuccagcuu

SEQ ID NO: 1449909 - RNA, 22 nt, Human
ccaggccccaugaccuccagcu

SEQ ID NO: 1449910 - RNA, 21 nt, Human
ccaggccccaugaccuccagc

SEQ ID NO: 1449911 - RNA, 20 nt, Human
ccaggccccaugaccuccag

SEQ ID NO: 1449912 - RNA, 18 nt, Human
ccaggccccaugaccucc

SEQ ID NO: 1449913 - RNA, 17 nt, Human
ccaggccccaugaccuc

SEQ ID NO: 1449914 - RNA, 16 nt, Human
ccaggccccaugaccu

SEQ ID NO: 1449915 - RNA, 15 nt, Human
ccaggccccaugacc

SEQ ID NO: 1449916 - RNA, 13 nt, Human
ccaggccccauga

SEQ ID NO: 1449917 - RNA, 17 nt, Human
ccaggcuugccugcagg

SEQ ID NO: 1449918 - RNA, 18 nt, Human
ccagggccacgcuccagc

SEQ ID NO: 1449919 - RNA, 19 nt, Human
ccagggccacgcuccagcu

SEQ ID NO: 1449920 - RNA, 16 nt, Human
ccagggccacgcucca

SEQ ID NO: 1449921 - RNA, 14 nt, Human
ccagggccacgcuc

SEQ ID NO: 1449922 - RNA, 19 nt, Human
ccagggcaucucugggcug

SEQ ID NO: 1449923 - RNA, 20 nt, Human
ccagggcaucucugggcugg

SEQ ID NO: 1449924 - RNA, 18 nt, Human
ccagggcaucucugggcu

SEQ ID NO: 1449925 - RNA, 17 nt, Human
ccagggcaucucugggc

SEQ ID NO: 1449926 - RNA, 16 nt, Human
ccagggcaucucuggg

SEQ ID NO: 1449927 - RNA, 15 nt, Human
ccagggcaucucugg

SEQ ID NO: 1449928 - RNA, 14 nt, Human
ccagggcaucucug

SEQ ID NO: 1449929 - RNA, 13 nt, Human
ccagggcaucucu

SEQ ID NO: 1449930 - RNA, 20 nt, Human
ccagggcagccagggagagc

SEQ ID NO: 1449931 - RNA, 19 nt, Human
ccagggcagccagggagag

SEQ ID NO: 1449932 - RNA, 15 nt, Human
ccagggcagccaggg

SEQ ID NO: 1449933 - RNA, 14 nt, Human
ccagggcagccagg

SEQ ID NO: 1449934 - RNA, 13 nt, Human
ccagggcagccag

SEQ ID NO: 1449935 - RNA, 23 nt, Human
ccagggaagcagcagccucgccc

SEQ ID NO: 1449936 - RNA, 18 nt, Human
ccagggaagcagcagccu

SEQ ID NO: 1449937 - RNA, 16 nt, Human
ccagggaagcagcagc

SEQ ID NO: 1449938 - RNA, 14 nt, Human
ccagggaagcagca

SEQ ID NO: 1449939 - RNA, 23 nt, Human
ccaggcuucugcuggggccuggg

SEQ ID NO: 1449940 - RNA, 21 nt, Human
ccaggcugguuucgaacuccu

SEQ ID NO: 1449941 - RNA, 18 nt, Human
ccaggcuugccugcaggc

SEQ ID NO: 1449942 - RNA, 19 nt, Human
ccaggcuuuuuuaucaugu

SEQ ID NO: 1449943 - RNA, 23 nt, Human
ccaggucccucucauuuagccug

SEQ ID NO: 1449944 - RNA, 16 nt, Human
ccaggucccucucauu

SEQ ID NO: 1449945 - RNA, 15 nt, Human
ccaggucccucucau

SEQ ID NO: 1449946 - RNA, 13 nt, Human
ccaggucccucuc

SEQ ID NO: 1449947 - RNA, 12 nt, Human
ccaggucccucu

SEQ ID NO: 1449948 - RNA, 18 nt, Human
ccagguccagcucuggag

SEQ ID NO: 1449949 - RNA, 19 nt, Human
ccagguccagcucuggagg

SEQ ID NO: 1449950 - RNA, 17 nt, Human
ccagguccagcucugga

SEQ ID NO: 1449951 - RNA, 16 nt, Human
ccagguccagcucugg

SEQ ID NO: 1449952 - RNA, 15 nt, Human
ccagguccagcucug

SEQ ID NO: 1449953 - RNA, 14 nt, Human
ccagguccagcucu

SEQ ID NO: 1449954 - RNA, 13 nt, Human
ccagguccagcuc

SEQ ID NO: 1449955 - RNA, 20 nt, Human
ccagguccaaugagcuuucu

SEQ ID NO: 1449956 - RNA, 19 nt, Human
ccagguccaaugagcuuuc

SEQ ID NO: 1449957 - RNA, 18 nt, Human
ccagguccaaugagcuuu

SEQ ID NO: 1449958 - RNA, 17 nt, Human
ccagguccaaugagcuu

SEQ ID NO: 1449959 - RNA, 14 nt, Human
ccagggcuccagcc

SEQ ID NO: 1449960 - RNA, 20 nt, Human
ccaggucacccuuugcugug

SEQ ID NO: 1449961 - RNA, 12 nt, Human
ccagggcuccag

SEQ ID NO: 1449962 - RNA, 17 nt, Human
ccagggcuccagccccu

SEQ ID NO: 1449963 - RNA, 19 nt, Human
ccagggcuagugacuugug

SEQ ID NO: 1449964 - RNA, 16 nt, Human
ccagggcuagugacuu

SEQ ID NO: 1449965 - RNA, 15 nt, Human
ccagggccugucuca

SEQ ID NO: 1449966 - RNA, 23 nt, Human
ccaggugaacaaaguuuaccaga

SEQ ID NO: 1449967 - RNA, 13 nt, Human
ccaggucucccug

SEQ ID NO: 1449968 - RNA, 20 nt, Human
ccaggucucccuggaucaga

SEQ ID NO: 1449969 - RNA, 21 nt, Human
ccagguccugguggggcagcu

SEQ ID NO: 1449970 - RNA, 19 nt, Human
ccagguccugguggggcag

SEQ ID NO: 1449971 - RNA, 15 nt, Human
ccagguccugguggg

SEQ ID NO: 1449972 - RNA, 14 nt, Human
ccagguccuggugg

SEQ ID NO: 1449973 - RNA, 13 nt, Human
ccagguccuggug

SEQ ID NO: 1449974 - RNA, 12 nt, Human
ccagguccuggu

SEQ ID NO: 1449975 - RNA, 20 nt, Human
ccaggugaggucagcacauc

SEQ ID NO: 1449976 - RNA, 19 nt, Human
ccaggugaggucagcacau

SEQ ID NO: 1449977 - RNA, 15 nt, Human
ccaggugaggucagc

SEQ ID NO: 1449978 - RNA, 21 nt, Human
ccagguguuacuguaauuccu

SEQ ID NO: 1449979 - RNA, 17 nt, Human
ccagguguuacuguaau

SEQ ID NO: 1449980 - RNA, 23 nt, Human
ccagguguuaacauuccaagacu

SEQ ID NO: 1449981 - RNA, 20 nt, Human
ccagguguuaacauuccaag

SEQ ID NO: 1449982 - RNA, 19 nt, Human
ccagguguuaacauuccaa

SEQ ID NO: 1449983 - RNA, 22 nt, Human
ccaggugcuacacccuuuucca

SEQ ID NO: 1449984 - RNA, 16 nt, Human
ccaguaacaggcucaa

SEQ ID NO: 1449985 - RNA, 16 nt, Human
ccaguaacucaucugu

SEQ ID NO: 1449986 - RNA, 15 nt, Human
ccaguaacucaucug

SEQ ID NO: 1449987 - RNA, 21 nt, Human
ccaguaacgcgucuuccugag

SEQ ID NO: 1449988 - RNA, 20 nt, Human
ccaguaacgcgucuuccuga

SEQ ID NO: 1449989 - RNA, 19 nt, Human
ccaguaacgcgucuuccug

SEQ ID NO: 1449990 - RNA, 15 nt, Human
ccaguaacaggcuca

SEQ ID NO: 1449991 - RNA, 14 nt, Human
ccaguaacaggcuc

SEQ ID NO: 1449992 - RNA, 22 nt, Human
ccagucuuccugacacuuuaau

SEQ ID NO: 1449993 - RNA, 17 nt, Human
ccagucuuccugacacu

SEQ ID NO: 1449994 - RNA, 16 nt, Human
ccagucuguuccccau

SEQ ID NO: 1449995 - RNA, 18 nt, Human
ccaguaucucuucagucu

SEQ ID NO: 1449996 - RNA, 20 nt, Human
ccaguaucucuucagucucu

SEQ ID NO: 1449997 - RNA, 21 nt, Human
ccagucuguggaucagagaug

SEQ ID NO: 1449998 - RNA, 22 nt, Human
ccaguagaccuuguuacuucug

SEQ ID NO: 1449999 - RNA, 18 nt, Human
ccaguacaccccaccucu

SEQ ID NO: 1450000 - RNA, 20 nt, Human
ccaguaggggcuuauaauaa

SEQ ID NO: 1450001 - RNA, 13 nt, Human
ccaguaucgcuca

SEQ ID NO: 1450002 - RNA, 15 nt, Human
ccaguaucucuucag

SEQ ID NO: 1450003 - RNA, 16 nt, Human
ccaguaucucuucagu

SEQ ID NO: 1450004 - RNA, 22 nt, Human
ccagcugcuccgaggacccagg

SEQ ID NO: 1450005 - RNA, 18 nt, Human
ccagcugggcucugcaau

SEQ ID NO: 1450006 - RNA, 16 nt, Human
ccagcugggcucugca

SEQ ID NO: 1450007 - RNA, 23 nt, Human
ccagcuggaggcaggggcuuccu

SEQ ID NO: 1450008 - RNA, 22 nt, Human
ccagcuggaggcaggggcuucc

SEQ ID NO: 1450009 - RNA, 18 nt, Human
ccagcuggaggcaggggc

SEQ ID NO: 1450010 - RNA, 17 nt, Human
ccagcuggaggcagggg

SEQ ID NO: 1450011 - RNA, 15 nt, Human
ccagcuggaggcagg

SEQ ID NO: 1450012 - RNA, 13 nt, Human
ccagcuggaggca

SEQ ID NO: 1450013 - RNA, 22 nt, Human
ccagcugccuagauucagggaa

SEQ ID NO: 1450014 - RNA, 18 nt, Human
ccagcugccccggccccu

SEQ ID NO: 1450015 - RNA, 19 nt, Human
ccagcugcacugaugcugc

SEQ ID NO: 1450016 - RNA, 18 nt, Human
ccagcugcacugaugcug

SEQ ID NO: 1450017 - RNA, 14 nt, Human
ccagcugcacugau

SEQ ID NO: 1450018 - RNA, 19 nt, Human
ccagcucuggaggggaggg

SEQ ID NO: 1450019 - RNA, 16 nt, Human
ccagagcccagcucca

SEQ ID NO: 1450020 - RNA, 15 nt, Human
ccagagcccagcucc

SEQ ID NO: 1450021 - RNA, 14 nt, Human
ccagagcccagcuc

SEQ ID NO: 1450022 - RNA, 13 nt, Human
ccagagcccagcu

SEQ ID NO: 1450023 - RNA, 12 nt, Human
ccagagcccagc

SEQ ID NO: 1450024 - RNA, 11 nt, Human
ccagagcccag

SEQ ID NO: 1450025 - RNA, 20 nt, Human
ccagagcccacuccaucugg

SEQ ID NO: 1450026 - RNA, 15 nt, Human
ccagagcccacucca

SEQ ID NO: 1450027 - RNA, 15 nt, Human
ccaggaagcuuuggu

SEQ ID NO: 1450028 - RNA, 22 nt, Human
ccaggaagccguccuggcgccu

SEQ ID NO: 1450029 - RNA, 16 nt, Human
ccaggaagccguccug

SEQ ID NO: 1450030 - RNA, 11 nt, Human
ccaggaagccg

SEQ ID NO: 1450031 - RNA, 15 nt, Human
ccaggacaagcaugg

SEQ ID NO: 1450032 - RNA, 22 nt, Human
ccaggaauuucccaggacccug

SEQ ID NO: 1450033 - RNA, 23 nt, Human
ccaggaauuucccaggacccuga

SEQ ID NO: 1450034 - RNA, 21 nt, Human
ccaggaauuucccaggacccu

SEQ ID NO: 1450035 - RNA, 20 nt, Human
ccaggaauuucccaggaccc

SEQ ID NO: 1450036 - RNA, 19 nt, Human
ccaggaauuucccaggacc

SEQ ID NO: 1450037 - RNA, 18 nt, Human
ccaggaauuucccaggac

SEQ ID NO: 1450038 - RNA, 17 nt, Human
ccaggaauuucccagga

SEQ ID NO: 1450039 - RNA, 16 nt, Human
ccaggaauuucccagg

SEQ ID NO: 1450040 - RNA, 14 nt, Human
ccaggaauuuccca

SEQ ID NO: 1450041 - RNA, 20 nt, Human
ccaggaagucucaucugggg

SEQ ID NO: 1450042 - RNA, 15 nt, Human
ccaggaagucucauc

SEQ ID NO: 1450043 - RNA, 14 nt, Human
ccaggaagucucau

SEQ ID NO: 1450044 - RNA, 19 nt, Human
ccagcugggcucugcaauu

SEQ ID NO: 1450045 - RNA, 17 nt, Human
ccagcuggggccaggcu

SEQ ID NO: 1450046 - RNA, 18 nt, Human
ccagcuggggccaggcug

SEQ ID NO: 1450047 - RNA, 19 nt, Human
ccagcuggggccaggcugg

SEQ ID NO: 1450048 - RNA, 20 nt, Human
ccagcuggggccaggcuggg

SEQ ID NO: 1450049 - RNA, 21 nt, Human
ccagcuggggccaggcugggu

SEQ ID NO: 1450050 - RNA, 22 nt, Human
ccagcuggggccaggcuggguc

SEQ ID NO: 1450051 - RNA, 23 nt, Human
ccagcuggggccaggcugggucg

SEQ ID NO: 1450052 - RNA, 21 nt, Human
ccaggacuauauuugggccug

SEQ ID NO: 1450053 - RNA, 20 nt, Human
ccaggacuauauuugggccu

SEQ ID NO: 1450054 - RNA, 12 nt, Human
ccaggaccacag

SEQ ID NO: 1450055 - RNA, 15 nt, Human
ccaggacaggaucca

SEQ ID NO: 1450056 - RNA, 17 nt, Human
ccaggacaggauccagg

SEQ ID NO: 1450057 - RNA, 19 nt, Human
ccaggacaggauccaggcc

SEQ ID NO: 1450058 - RNA, 23 nt, Human
ccaggacaagcauggucccacau

SEQ ID NO: 1450059 - RNA, 20 nt, Human
ccaggacaagcaugguccca

SEQ ID NO: 1450060 - RNA, 17 nt, Human
ccaggacaagcaugguc

SEQ ID NO: 1450061 - RNA, 13 nt, Human
ccaggacaggauc

SEQ ID NO: 1450062 - RNA, 14 nt, Human
ccauucugcuccuu

SEQ ID NO: 1450063 - RNA, 13 nt, Human
ccauucugcuccu

SEQ ID NO: 1450064 - RNA, 14 nt, Human
ccauggagaaagcu

SEQ ID NO: 1450065 - RNA, 13 nt, Human
ccauggagaaagc

SEQ ID NO: 1450066 - RNA, 21 nt, Human
ccauggacucuguccugaagg

SEQ ID NO: 1450067 - RNA, 18 nt, Human
ccauggacucuguccuga

SEQ ID NO: 1450068 - RNA, 16 nt, Human
ccauggacucuguccu

SEQ ID NO: 1450069 - RNA, 15 nt, Human
ccauggacucugucc

SEQ ID NO: 1450070 - RNA, 19 nt, Human
ccauggacaggcuggcucc

SEQ ID NO: 1450071 - RNA, 18 nt, Human
ccauggacaggcuggcuc

SEQ ID NO: 1450072 - RNA, 16 nt, Human
ccauggacaggcuggc

SEQ ID NO: 1450073 - RNA, 22 nt, Human
ccaugcugugcgcccagggcug

SEQ ID NO: 1450074 - RNA, 20 nt, Human
ccaugcugugcgcccagggc

SEQ ID NO: 1450075 - RNA, 19 nt, Human
ccaugcugugcgcccaggg

SEQ ID NO: 1450076 - RNA, 22 nt, Human
cccaaacaccuuccagcuccug

SEQ ID NO: 1450077 - RNA, 21 nt, Human
cccaaacaccuuccagcuccu

SEQ ID NO: 1450078 - RNA, 19 nt, Human
cccaaacaccuuccagcuc

SEQ ID NO: 1450079 - RNA, 16 nt, Human
cccaaacaccuuccag

SEQ ID NO: 1450080 - RNA, 23 nt, Human
cccaaacgcccuuuccuccucag

SEQ ID NO: 1450081 - RNA, 16 nt, Human
cccaaacgcccuuucc

SEQ ID NO: 1450082 - RNA, 21 nt, Human
cccaaagcaagcaagaggccg

SEQ ID NO: 1450083 - RNA, 13 nt, Human
cccaaagcaagca

SEQ ID NO: 1450084 - RNA, 22 nt, Human
cccaaacgcccuuuccuccuca

SEQ ID NO: 1450085 - RNA, 19 nt, Human
ccauucuggaagugacuuu

SEQ ID NO: 1450086 - RNA, 19 nt, Human
ccauucugcuccuucccca

SEQ ID NO: 1450087 - RNA, 16 nt, Human
ccauucugcuccuucc

SEQ ID NO: 1450088 - RNA, 12 nt, Human
ccauucuggaag

SEQ ID NO: 1450089 - RNA, 15 nt, Human
ccauucuggaaguga

SEQ ID NO: 1450090 - RNA, 16 nt, Human
ccaucugggcuccucc

SEQ ID NO: 1450091 - RNA, 12 nt, Human
ccaucugggcuc

SEQ ID NO: 1450092 - RNA, 21 nt, Human
ccaugauggcaacagaucugg

SEQ ID NO: 1450093 - RNA, 19 nt, Human
ccaugauggcaacagaucu

SEQ ID NO: 1450094 - RNA, 16 nt, Human
ccaugauggcaacaga

SEQ ID NO: 1450095 - RNA, 15 nt, Human
ccaugauggcaacag

SEQ ID NO: 1450096 - RNA, 14 nt, Human
ccaugauggcaaca

SEQ ID NO: 1450097 - RNA, 17 nt, Human
ccaugcacugugaagga

SEQ ID NO: 1450098 - RNA, 16 nt, Human
ccaugcacugugaagg

SEQ ID NO: 1450099 - RNA, 15 nt, Human
ccaugcacugugaag

SEQ ID NO: 1450100 - RNA, 13 nt, Human
ccaugcacuguga

SEQ ID NO: 1450101 - RNA, 11 nt, Human
ccaugcacugu

SEQ ID NO: 1450102 - RNA, 21 nt, Human
ccaugcacccucauacacaga

SEQ ID NO: 1450103 - RNA, 23 nt, Human
ccaugauucuauuuauauguaca

SEQ ID NO: 1450104 - RNA, 16 nt, Human
ccaugauguuuagaaa

SEQ ID NO: 1450105 - RNA, 23 nt, Human
ccaugcugcuggggaagacagug

SEQ ID NO: 1450106 - RNA, 22 nt, Human
ccaugcugcuggggaagacagu

SEQ ID NO: 1450107 - RNA, 24 nt, Human
ccaugcuccucuuccccagacgcc

SEQ ID NO: 1450108 - RNA, 17 nt, Human
ccaugcuggccuugcca

SEQ ID NO: 1450109 - RNA, 19 nt, Human
ccaugcugaggccugggcc

SEQ ID NO: 1450110 - RNA, 18 nt, Human
ccaugcugaggccugggc

SEQ ID NO: 1450111 - RNA, 20 nt, Human
ccaugcugaggccugggccg

SEQ ID NO: 1450112 - RNA, 20 nt, Human
ccaugcucaucugcuggucc

SEQ ID NO: 1450113 - RNA, 18 nt, Human
ccaugcucaucugcuggu

SEQ ID NO: 1450114 - RNA, 17 nt, Human
ccaugcucaucugcugg

SEQ ID NO: 1450115 - RNA, 18 nt, Human
ccaugcuccucuucccca

SEQ ID NO: 1450116 - RNA, 16 nt, Human
ccaugcuccucuuccc

SEQ ID NO: 1450117 - RNA, 15 nt, Human
ccaugcuccucuucc

SEQ ID NO: 1450118 - RNA, 13 nt, Human
ccaugcuccucuu

SEQ ID NO: 1450119 - RNA, 20 nt, Human
ccaugcuccucuuccccaga

SEQ ID NO: 1450120 - RNA, 19 nt, Human
ccaugcuccucuuccccag

SEQ ID NO: 1450121 - RNA, 16 nt, Human
ccaugcucaucugcug

SEQ ID NO: 1450122 - RNA, 13 nt, Human
ccaugcucaucug

SEQ ID NO: 1450123 - RNA, 20 nt, Human
ccaugcguguuucugacucu

SEQ ID NO: 1450124 - RNA, 22 nt, Human
ccaugcgcucagggccaugcug

SEQ ID NO: 1450125 - RNA, 16 nt, Human
ccaugcgcucagggcc

SEQ ID NO: 1450126 - RNA, 15 nt, Human
ccaugcgcucagggc

SEQ ID NO: 1450127 - RNA, 13 nt, Human
ccaugcgcucagg

SEQ ID NO: 1450128 - RNA, 22 nt, Human
ccaugcgcccccuccgcccugc

SEQ ID NO: 1450129 - RNA, 21 nt, Human
ccaugcccggcuaauuuuugu

SEQ ID NO: 1450130 - RNA, 20 nt, Human
ccaugcacugugaaggaccc

SEQ ID NO: 1450131 - RNA, 19 nt, Human
ccaugcacugugaaggacc

SEQ ID NO: 1450132 - RNA, 21 nt, Human
ccaugcacugugaaggacccu

SEQ ID NO: 1450133 - RNA, 11 nt, Human
ccaugcagaaa

SEQ ID NO: 1450134 - RNA, 15 nt, Human
ccaugcagaaagcau

SEQ ID NO: 1450135 - RNA, 14 nt, Human
ccaugcagaaagca

SEQ ID NO: 1450136 - RNA, 18 nt, Human
ccauagucuuaacugguc

SEQ ID NO: 1450137 - RNA, 15 nt, Human
ccauagucuuaacug

SEQ ID NO: 1450138 - RNA, 22 nt, Human
ccagugaagagccacugccauu

SEQ ID NO: 1450139 - RNA, 18 nt, Human
ccauauccuuacccuccu

SEQ ID NO: 1450140 - RNA, 21 nt, Human
ccauaucacacacauugcugu

SEQ ID NO: 1450141 - RNA, 21 nt, Human
ccauaguggaucacucaccau

SEQ ID NO: 1450142 - RNA, 16 nt, Human
ccaucaaguugugcca

SEQ ID NO: 1450143 - RNA, 22 nt, Human
ccaucagaaacacccucacacu

SEQ ID NO: 1450144 - RNA, 15 nt, Human
ccaucugcuccugga

SEQ ID NO: 1450145 - RNA, 14 nt, Human
ccaucugcuccugg

SEQ ID NO: 1450146 - RNA, 13 nt, Human
ccaucugcuccug

SEQ ID NO: 1450147 - RNA, 12 nt, Human
ccaucugcuccu

SEQ ID NO: 1450148 - RNA, 11 nt, Human
ccaucugcucc

SEQ ID NO: 1450149 - RNA, 23 nt, Human
ccaucugcgugacaauaaaacau

SEQ ID NO: 1450150 - RNA, 19 nt, Human
ccaucucccuggugcuuau

SEQ ID NO: 1450151 - RNA, 20 nt, Human
ccaucucccuggugcuuaug

SEQ ID NO: 1450152 - RNA, 17 nt, Human
ccaucucccuggugcuu

SEQ ID NO: 1450153 - RNA, 16 nt, Human
ccaucucccuggugcu

SEQ ID NO: 1450154 - RNA, 15 nt, Human
ccaucucccuggugc

SEQ ID NO: 1450155 - RNA, 12 nt, Human
ccaucucccugg

SEQ ID NO: 1450156 - RNA, 17 nt, Human
ccauccaccuuucccaa

SEQ ID NO: 1450157 - RNA, 17 nt, Human
ccauccacaugggagcc

SEQ ID NO: 1450158 - RNA, 15 nt, Human
ccauccaaggccagg

SEQ ID NO: 1450159 - RNA, 16 nt, Human
ccaucaucaugugugu

SEQ ID NO: 1450160 - RNA, 17 nt, Human
ccaucagugcucccuca

SEQ ID NO: 1450161 - RNA, 12 nt, Human
ccaucagugcuc

SEQ ID NO: 1450162 - RNA, 20 nt, Human
ccaucaggguaggcuggagu

SEQ ID NO: 1450163 - RNA, 13 nt, Human
ccaucagccucca

SEQ ID NO: 1450164 - RNA, 23 nt, Human
ccaucagaaacacccucacacug

SEQ ID NO: 1450165 - RNA, 18 nt, Human
cccauuccuucccagagg

SEQ ID NO: 1450166 - RNA, 14 nt, Human
cccauuccugggaa

SEQ ID NO: 1450167 - RNA, 14 nt, Human
cccauggcccugag

SEQ ID NO: 1450168 - RNA, 15 nt, Human
cccauggcauuuuau

SEQ ID NO: 1450169 - RNA, 22 nt, Human
cccauggcagugggaaaaaugu

SEQ ID NO: 1450170 - RNA, 23 nt, Human
cccauggagauugaccuggaugg

SEQ ID NO: 1450171 - RNA, 21 nt, Human
cccauggagauugaccuggau

SEQ ID NO: 1450172 - RNA, 20 nt, Human
cccauggagauugaccugga

SEQ ID NO: 1450173 - RNA, 16 nt, Human
cccagugcacuugcug

SEQ ID NO: 1450174 - RNA, 22 nt, Human
ccccaacuccuuccagcuagug

SEQ ID NO: 1450175 - RNA, 17 nt, Human
ccccaacuccuuccagc

SEQ ID NO: 1450176 - RNA, 16 nt, Human
ccccaacuccuuccag

SEQ ID NO: 1450177 - RNA, 23 nt, Human
ccccaaccauuuccucagacucu

SEQ ID NO: 1450178 - RNA, 16 nt, Human
ccccaacaugcacuga

SEQ ID NO: 1450179 - RNA, 23 nt, Human
ccccaacagcuggacccugacca

SEQ ID NO: 1450180 - RNA, 22 nt, Human
ccccaacagcuggacccugacc

SEQ ID NO: 1450181 - RNA, 21 nt, Human
ccccaacagcuggacccugac

SEQ ID NO: 1450182 - RNA, 14 nt, Human
ccccaacagcugga

SEQ ID NO: 1450183 - RNA, 13 nt, Human
ccccaacagcugg

SEQ ID NO: 1450184 - RNA, 17 nt, Human
ccccaacagcgcccaaa

SEQ ID NO: 1450185 - RNA, 15 nt, Human
ccccaacagcgccca

SEQ ID NO: 1450186 - RNA, 14 nt, Human
ccccaacagcgccc

SEQ ID NO: 1450187 - RNA, 20 nt, Human
ccccaagggaggcugcugcu

SEQ ID NO: 1450188 - RNA, 17 nt, Human
ccccaagcuguuuucuu

SEQ ID NO: 1450189 - RNA, 16 nt, Human
ccccaagcuguuuucu

SEQ ID NO: 1450190 - RNA, 14 nt, Human
ccccaagcuguuuu

SEQ ID NO: 1450191 - RNA, 22 nt, Human
ccccaagauugagcucucugcc

SEQ ID NO: 1450192 - RNA, 18 nt, Human
cccaggcccacugugccu

SEQ ID NO: 1450193 - RNA, 11 nt, Human
cccaggcccac

SEQ ID NO: 1450194 - RNA, 20 nt, Human
cccaggccccaugaccucca

SEQ ID NO: 1450195 - RNA, 17 nt, Human
cccaggccccaugaccu

SEQ ID NO: 1450196 - RNA, 16 nt, Human
cccaggccccaugacc

SEQ ID NO: 1450197 - RNA, 14 nt, Human
cccaggccccauga

SEQ ID NO: 1450198 - RNA, 22 nt, Human
cccaggcccacugugccucaga

SEQ ID NO: 1450199 - RNA, 23 nt, Human
cccaggccaggacucugcagccu

SEQ ID NO: 1450200 - RNA, 22 nt, Human
cccaggccaggacucugcagcc

SEQ ID NO: 1450201 - RNA, 21 nt, Human
cccaggccaggacucugcagc

SEQ ID NO: 1450202 - RNA, 20 nt, Human
cccaggccaggacucugcag

SEQ ID NO: 1450203 - RNA, 19 nt, Human
cccaggccaggacucugca

SEQ ID NO: 1450204 - RNA, 18 nt, Human
cccaggccaggacucugc

SEQ ID NO: 1450205 - RNA, 17 nt, Human
cccaggccaggacucug

SEQ ID NO: 1450206 - RNA, 15 nt, Human
cccaggccaggacuc

SEQ ID NO: 1450207 - RNA, 14 nt, Human
cccaggccaggacu

SEQ ID NO: 1450208 - RNA, 13 nt, Human
cccaggccaggac

SEQ ID NO: 1450209 - RNA, 13 nt, Human
cccaggcacugca

SEQ ID NO: 1450210 - RNA, 21 nt, Human
cccaggcauugccaagggcuu

SEQ ID NO: 1450211 - RNA, 14 nt, Human
cccaggcauugcca

SEQ ID NO: 1450212 - RNA, 17 nt, Human
cccaggcacugggcucc

SEQ ID NO: 1450213 - RNA, 12 nt, Human
cccaggcacugc

SEQ ID NO: 1450214 - RNA, 19 nt, Human
cccaggcaaggcuguggac

SEQ ID NO: 1450215 - RNA, 18 nt, Human
cccaggcaaggcugugga

SEQ ID NO: 1450216 - RNA, 13 nt, Human
cccaggcaaggcu

SEQ ID NO: 1450217 - RNA, 15 nt, Human
cccaggauccccaag

SEQ ID NO: 1450218 - RNA, 13 nt, Human
cccaggagcuccc

SEQ ID NO: 1450219 - RNA, 20 nt, Human
cccaggagcuccccucccca

SEQ ID NO: 1450220 - RNA, 12 nt, Human
cccaggagcucc

SEQ ID NO: 1450221 - RNA, 17 nt, Human
cccaggguccugggagg

SEQ ID NO: 1450222 - RNA, 18 nt, Human
cccaggguccugggagga

SEQ ID NO: 1450223 - RNA, 16 nt, Human
cccaggguccugggag

SEQ ID NO: 1450224 - RNA, 15 nt, Human
cccaggguccuggga

SEQ ID NO: 1450225 - RNA, 23 nt, Human
cccaggggcucccuccgccccca

SEQ ID NO: 1450226 - RNA, 17 nt, Human
cccaggggcucccuccg

SEQ ID NO: 1450227 - RNA, 16 nt, Human
cccaggggcucccucc

SEQ ID NO: 1450228 - RNA, 14 nt, Human
cccaggggcucccu

SEQ ID NO: 1450229 - RNA, 16 nt, Human
cccaggggcagcccca

SEQ ID NO: 1450230 - RNA, 22 nt, Human
cccaggcucguggacugagugg

SEQ ID NO: 1450231 - RNA, 17 nt, Human
cccaggcucguggacug

SEQ ID NO: 1450232 - RNA, 19 nt, Human
cccaggcucggccugcccc

SEQ ID NO: 1450233 - RNA, 17 nt, Human
cccaggcucggccugcc

SEQ ID NO: 1450234 - RNA, 21 nt, Human
cccaggccccaugaccuccag

SEQ ID NO: 1450235 - RNA, 22 nt, Human
cccaggccccaugaccuccagc

SEQ ID NO: 1450236 - RNA, 21 nt, Human
cccaggucucccuggaucaga

SEQ ID NO: 1450237 - RNA, 13 nt, Human
cccagguccucac

SEQ ID NO: 1450238 - RNA, 18 nt, Human
cccagguccagcucugga

SEQ ID NO: 1450239 - RNA, 17 nt, Human
cccagguccagcucugg

SEQ ID NO: 1450240 - RNA, 19 nt, Human
cccagguguuaacauucca

SEQ ID NO: 1450241 - RNA, 22 nt, Human
cccagguguuaacauuccaaga

SEQ ID NO: 1450242 - RNA, 21 nt, Human
cccagguguuaacauuccaag

SEQ ID NO: 1450243 - RNA, 18 nt, Human
cccagguuggagugcagu

SEQ ID NO: 1450244 - RNA, 21 nt, Human
cccagguuggcucugccaguc

SEQ ID NO: 1450245 - RNA, 20 nt, Human
cccagguuggcucugccagu

SEQ ID NO: 1450246 - RNA, 18 nt, Human
cccagguuggcucugcca

SEQ ID NO: 1450247 - RNA, 16 nt, Human
cccagguuggcucugc

SEQ ID NO: 1450248 - RNA, 15 nt, Human
cccagguuggcucug

SEQ ID NO: 1450249 - RNA, 14 nt, Human
cccagguuggcucu

SEQ ID NO: 1450250 - RNA, 19 nt, Human
cccagguuggagugcagug

SEQ ID NO: 1450251 - RNA, 14 nt, Human
cccagugacagcua

SEQ ID NO: 1450252 - RNA, 21 nt, Human
cccagugagcagccuggagcc

SEQ ID NO: 1450253 - RNA, 15 nt, Human
cccagugacagcuag

SEQ ID NO: 1450254 - RNA, 11 nt, Human
cccagucuguc

SEQ ID NO: 1450255 - RNA, 17 nt, Human
cccagucuguuccccau

SEQ ID NO: 1450256 - RNA, 17 nt, Human
cccagucauucugggaa

SEQ ID NO: 1450257 - RNA, 15 nt, Human
cccaguaucucuuca

SEQ ID NO: 1450258 - RNA, 16 nt, Human
cccaguagaccuuguu

SEQ ID NO: 1450259 - RNA, 16 nt, Human
cccaguaucucuucag

SEQ ID NO: 1450260 - RNA, 22 nt, Human
cccagcuccugacacugcugga

SEQ ID NO: 1450261 - RNA, 20 nt, Human
cccagcuccugacacugcug

SEQ ID NO: 1450262 - RNA, 12 nt, Human
cccagcuccuga

SEQ ID NO: 1450263 - RNA, 11 nt, Human
cccagcuccug

SEQ ID NO: 1450264 - RNA, 17 nt, Human
cccagcuccggccuguc

SEQ ID NO: 1450265 - RNA, 13 nt, Human
cccagcucccagg

SEQ ID NO: 1450266 - RNA, 14 nt, Human
cccagcucccagga

SEQ ID NO: 1450267 - RNA, 16 nt, Human
cccagcucccaccucc

SEQ ID NO: 1450268 - RNA, 12 nt, Human
cccagcucccac

SEQ ID NO: 1450269 - RNA, 22 nt, Human
cccagcuacccuuuuucuccag

SEQ ID NO: 1450270 - RNA, 22 nt, Human
cccagcuaagaaccuggaacuu

SEQ ID NO: 1450271 - RNA, 20 nt, Human
cccagcuaagaaccuggaac

SEQ ID NO: 1450272 - RNA, 19 nt, Human
cccagcuaagaaccuggaa

SEQ ID NO: 1450273 - RNA, 18 nt, Human
cccagcuaagaaccugga

SEQ ID NO: 1450274 - RNA, 17 nt, Human
cccagcuaagaaccugg

SEQ ID NO: 1450275 - RNA, 16 nt, Human
cccagcuaagaaccug

SEQ ID NO: 1450276 - RNA, 16 nt, Human
cccagcggcaucaggc

SEQ ID NO: 1450277 - RNA, 14 nt, Human
cccagcggacacac

SEQ ID NO: 1450278 - RNA, 15 nt, Human
cccagcggacacacg

SEQ ID NO: 1450279 - RNA, 21 nt, Human
cccagcgauucccucucccag

SEQ ID NO: 1450280 - RNA, 23 nt, Human
cccagcgauucccucucccaggc

SEQ ID NO: 1450281 - RNA, 14 nt, Human
cccagcgauucccu

SEQ ID NO: 1450282 - RNA, 10 nt, Human
cccagccugg

SEQ ID NO: 1450283 - RNA, 23 nt, Human
cccagccgcuuggcgaugccagc

SEQ ID NO: 1450284 - RNA, 19 nt, Human
cccagccgacccccucucc

SEQ ID NO: 1450285 - RNA, 22 nt, Human
cccagccgacccccucucccug

SEQ ID NO: 1450286 - RNA, 22 nt, Human
cccagagggucugggggcacaa

SEQ ID NO: 1450287 - RNA, 15 nt, Human
cccagagggucuggg

SEQ ID NO: 1450288 - RNA, 23 nt, Human
cccagaggggccugccaccugga

SEQ ID NO: 1450289 - RNA, 21 nt, Human
cccagaggggccugccaccug

SEQ ID NO: 1450290 - RNA, 20 nt, Human
cccagaggggccugccaccu

SEQ ID NO: 1450291 - RNA, 19 nt, Human
cccagaggggccugccacc

SEQ ID NO: 1450292 - RNA, 18 nt, Human
cccagaggggccugccac

SEQ ID NO: 1450293 - RNA, 17 nt, Human
cccagaggggccugcca

SEQ ID NO: 1450294 - RNA, 15 nt, Human
cccagaggggccugc

SEQ ID NO: 1450295 - RNA, 14 nt, Human
cccagaggggccug

SEQ ID NO: 1450296 - RNA, 13 nt, Human
cccagaggggccu

SEQ ID NO: 1450297 - RNA, 12 nt, Human
cccacacucaga

SEQ ID NO: 1450298 - RNA, 21 nt, Human
cccacacucagauccuccuca

SEQ ID NO: 1450299 - RNA, 19 nt, Human
cccaaauuugauugauuug

SEQ ID NO: 1450300 - RNA, 14 nt, Human
cccaaauggcccug

SEQ ID NO: 1450301 - RNA, 13 nt, Human
cccaacacaaaga

SEQ ID NO: 1450302 - RNA, 16 nt, Human
cccaaauuugauugau

SEQ ID NO: 1450303 - RNA, 13 nt, Human
cccaacaccucuu

SEQ ID NO: 1450304 - RNA, 14 nt, Human
cccaauccagugga

SEQ ID NO: 1450305 - RNA, 19 nt, Human
cccaaguucaugcagcugu

SEQ ID NO: 1450306 - RNA, 22 nt, Human
cccaauuucggauuuuuuccaa

SEQ ID NO: 1450307 - RNA, 15 nt, Human
cccaauuucagacuc

SEQ ID NO: 1450308 - RNA, 14 nt, Human
cccaauugcuggag

SEQ ID NO: 1450309 - RNA, 15 nt, Human
cccaauugagaaaaa

SEQ ID NO: 1450310 - RNA, 20 nt, Human
ccguggggccgccgccucuu

SEQ ID NO: 1450311 - RNA, 18 nt, Human
ccgcuuggagcagagggg

SEQ ID NO: 1450312 - RNA, 17 nt, Human
ccgcuuggagcagaggg

SEQ ID NO: 1450313 - RNA, 20 nt, Human
ccgcuuggagcuauuuucca

SEQ ID NO: 1450314 - RNA, 15 nt, Human
ccgcuuggagcagag

SEQ ID NO: 1450315 - RNA, 15 nt, Human
ccgcccugccacuca

SEQ ID NO: 1450316 - RNA, 14 nt, Human
ccgcccugccacuc

SEQ ID NO: 1450317 - RNA, 13 nt, Human
ccgcccugccacu

SEQ ID NO: 1450318 - RNA, 15 nt, Human
ccggcugcagaggcc

SEQ ID NO: 1450319 - RNA, 18 nt, Human
ccggaccagccuggccca

SEQ ID NO: 1450320 - RNA, 16 nt, Human
ccggaccagccuggcc

SEQ ID NO: 1450321 - RNA, 15 nt, Human
ccggaccagccuggc

SEQ ID NO: 1450322 - RNA, 14 nt, Human
ccggaccagccugg

SEQ ID NO: 1450323 - RNA, 13 nt, Human
ccggaccagccug

SEQ ID NO: 1450324 - RNA, 11 nt, Human
ccggaaagaag

SEQ ID NO: 1450325 - RNA, 21 nt, Human
ccgggccacuccuuccugccc

SEQ ID NO: 1450326 - RNA, 20 nt, Human
ccgggccacuccuuccugcc

SEQ ID NO: 1450327 - RNA, 19 nt, Human
ccgggccacuccuuccugc

SEQ ID NO: 1450328 - RNA, 23 nt, Human
ccguuucauuuagucaugugacc

SEQ ID NO: 1450329 - RNA, 17 nt, Human
ccguggggccgccgccu

SEQ ID NO: 1450330 - RNA, 14 nt, Human
ccgugggcucccug

SEQ ID NO: 1450331 - RNA, 15 nt, Human
ccguggcuuugguuu

SEQ ID NO: 1450332 - RNA, 19 nt, Human
ccgugggccccacccucgg

SEQ ID NO: 1450333 - RNA, 22 nt, Human
ccgugggcaauugucugaaaag

SEQ ID NO: 1450334 - RNA, 19 nt, Human
ccguuuugucacuuuuucu

SEQ ID NO: 1450335 - RNA, 14 nt, Human
ccguuuugucacuu

SEQ ID NO: 1450336 - RNA, 18 nt, Human
ccuaaaagaaacccugca

SEQ ID NO: 1450337 - RNA, 17 nt, Human
ccuaauucuaugccugu

SEQ ID NO: 1450338 - RNA, 16 nt, Human
ccuaaagaaaaacaaa

SEQ ID NO: 1450339 - RNA, 19 nt, Human
ccuaaagccucaaaacaaa

SEQ ID NO: 1450340 - RNA, 13 nt, Human
ccuaaagccucaa

SEQ ID NO: 1450341 - RNA, 14 nt, Human
ccuaaaguguauuu

SEQ ID NO: 1450342 - RNA, 22 nt, Human
ccuagagaagacaggcuggaag

SEQ ID NO: 1450343 - RNA, 19 nt, Human
ccuagagaagacaggcugg

SEQ ID NO: 1450344 - RNA, 17 nt, Human
ccuagagaagacaggcu

SEQ ID NO: 1450345 - RNA, 16 nt, Human
ccuaccugugccugac

SEQ ID NO: 1450346 - RNA, 15 nt, Human
ccuaccugugccuga

SEQ ID NO: 1450347 - RNA, 14 nt, Human
ccuaccugugccug

SEQ ID NO: 1450348 - RNA, 13 nt, Human
ccuaccugcccca

SEQ ID NO: 1450349 - RNA, 21 nt, Human
ccuaccccgcagacaccuugg

SEQ ID NO: 1450350 - RNA, 20 nt, Human
ccuaccccgcagacaccuug

SEQ ID NO: 1450351 - RNA, 22 nt, Human
ccuaccccauggugcuaggaag

SEQ ID NO: 1450352 - RNA, 13 nt, Human
ccuaccuccaaag

SEQ ID NO: 1450353 - RNA, 15 nt, Human
ccuacccuaaccaag

SEQ ID NO: 1450354 - RNA, 16 nt, Human
ccuacccuaaccaagu

SEQ ID NO: 1450355 - RNA, 18 nt, Human
ccuacccuaaccaaguuc

SEQ ID NO: 1450356 - RNA, 23 nt, Human
ccucaguagucccugcacaguga

SEQ ID NO: 1450357 - RNA, 17 nt, Human
ccuaucaccuauuucca

SEQ ID NO: 1450358 - RNA, 16 nt, Human
ccuaucaccuauuucc

SEQ ID NO: 1450359 - RNA, 20 nt, Human
ccuaucacccaacgcuccaa

SEQ ID NO: 1450360 - RNA, 24 nt, Human
ccuagagaagacaggcuggaagau

SEQ ID NO: 1450361 - RNA, 12 nt, Human
ccuauggccuca

SEQ ID NO: 1450362 - RNA, 15 nt, Human
ccuauggccucaugu

SEQ ID NO: 1450363 - RNA, 22 nt, Human
ccuauggagagcccugggaccg

SEQ ID NO: 1450364 - RNA, 21 nt, Human
ccuauggagagcccugggacc

SEQ ID NO: 1450365 - RNA, 19 nt, Human
ccuauggagagcccuggga

SEQ ID NO: 1450366 - RNA, 20 nt, Human
ccuaucagaguugcugcaaa

SEQ ID NO: 1450367 - RNA, 23 nt, Human
ccucaaugccaguaacgcgucuu

SEQ ID NO: 1450368 - RNA, 18 nt, Human
ccucaauccagcuauguu

SEQ ID NO: 1450369 - RNA, 13 nt, Human
ccucaauccagcu

SEQ ID NO: 1450370 - RNA, 18 nt, Human
ccuaugucauuucauuuc

SEQ ID NO: 1450371 - RNA, 16 nt, Human
ccucaauuucugaaca

SEQ ID NO: 1450372 - RNA, 22 nt, Human
ccucacaaguggguacccccag

SEQ ID NO: 1450373 - RNA, 21 nt, Human
ccucacaaguggguaccccca

SEQ ID NO: 1450374 - RNA, 15 nt, Human
ccucacaggccccag

SEQ ID NO: 1450375 - RNA, 13 nt, Human
ccucacacacccu

SEQ ID NO: 1450376 - RNA, 23 nt, Human
ccucacacacaaugugucugaga

SEQ ID NO: 1450377 - RNA, 14 nt, Human
ccucaccuccucua

SEQ ID NO: 1450378 - RNA, 21 nt, Human
ccucaccuuggcaccagacac

SEQ ID NO: 1450379 - RNA, 16 nt, Human
ccucaccuuggcacca

SEQ ID NO: 1450380 - RNA, 15 nt, Human
ccucaccuuggcacc

SEQ ID NO: 1450381 - RNA, 15 nt, Human
ccucaccuucugagu

SEQ ID NO: 1450382 - RNA, 15 nt, Human
ccucaccuguagcag

SEQ ID NO: 1450383 - RNA, 17 nt, Human
ccuauggagagcccugg

SEQ ID NO: 1450384 - RNA, 19 nt, Human
ccucacccccagcuuugcu

SEQ ID NO: 1450385 - RNA, 17 nt, Human
ccucacccccagcuuug

SEQ ID NO: 1450386 - RNA, 21 nt, Human
ccucacccaccccugcacagu

SEQ ID NO: 1450387 - RNA, 19 nt, Human
ccucacccaccccugcaca

SEQ ID NO: 1450388 - RNA, 22 nt, Human
ccucacaguauugcucacccag

SEQ ID NO: 1450389 - RNA, 17 nt, Human
ccucacaguauugcuca

SEQ ID NO: 1450390 - RNA, 16 nt, Human
ccucacccaccccugc

SEQ ID NO: 1450391 - RNA, 14 nt, Human
ccccacuggagcag

SEQ ID NO: 1450392 - RNA, 13 nt, Human
ccccacuggagca

SEQ ID NO: 1450393 - RNA, 12 nt, Human
ccccacuggagc

SEQ ID NO: 1450394 - RNA, 24 nt, Human
ccccacuggagcagaaggggagau

SEQ ID NO: 1450395 - RNA, 15 nt, Human
ccccacugaccagaa

SEQ ID NO: 1450396 - RNA, 14 nt, Human
ccccacugaccaga

SEQ ID NO: 1450397 - RNA, 17 nt, Human
ccccacucugcucugau

SEQ ID NO: 1450398 - RNA, 19 nt, Human
ccccacucugcucugaugc

SEQ ID NO: 1450399 - RNA, 16 nt, Human
ccccacucugcucuga

SEQ ID NO: 1450400 - RNA, 15 nt, Human
ccccacucugcucug

SEQ ID NO: 1450401 - RNA, 13 nt, Human
ccccacucugcuc

SEQ ID NO: 1450402 - RNA, 12 nt, Human
ccccacucugcu

SEQ ID NO: 1450403 - RNA, 21 nt, Human
ccccagcuaagaaccuggaac

SEQ ID NO: 1450404 - RNA, 19 nt, Human
ccccagcuaagaaccugga

SEQ ID NO: 1450405 - RNA, 17 nt, Human
ccccagcuaagaaccug

SEQ ID NO: 1450406 - RNA, 11 nt, Human
ccccagccugu

SEQ ID NO: 1450407 - RNA, 20 nt, Human
ccccagccugggccuaugga

SEQ ID NO: 1450408 - RNA, 10 nt, Human
ccccagccug

SEQ ID NO: 1450409 - RNA, 16 nt, Human
ccccagccucuggcau

SEQ ID NO: 1450410 - RNA, 15 nt, Human
ccccagccucuggca

SEQ ID NO: 1450411 - RNA, 14 nt, Human
ccccagccucuggc

SEQ ID NO: 1450412 - RNA, 15 nt, Human
ccccagccucccuga

SEQ ID NO: 1450413 - RNA, 13 nt, Human
ccccagccucccu

SEQ ID NO: 1450414 - RNA, 21 nt, Human
ccccagccgcuuggcgaugcc

SEQ ID NO: 1450415 - RNA, 23 nt, Human
ccccagcugucaucaauuaaagg

SEQ ID NO: 1450416 - RNA, 14 nt, Human
ccccagcucccagg

SEQ ID NO: 1450417 - RNA, 13 nt, Human
ccccagcuccggc

SEQ ID NO: 1450418 - RNA, 11 nt, Human
ccccagcuccg

SEQ ID NO: 1450419 - RNA, 13 nt, Human
ccccagcucccag

SEQ ID NO: 1450420 - RNA, 14 nt, Human
ccccagcucccacc

SEQ ID NO: 1450421 - RNA, 13 nt, Human
ccccagcucccac

SEQ ID NO: 1450422 - RNA, 14 nt, Human
ccccagcucaaugg

SEQ ID NO: 1450423 - RNA, 22 nt, Human
ccccagcuacccuuuuucucca

SEQ ID NO: 1450424 - RNA, 11 nt, Human
ccccagcuacc

SEQ ID NO: 1450425 - RNA, 15 nt, Human
ccccaggaccagcuc

SEQ ID NO: 1450426 - RNA, 13 nt, Human
ccccaggaccagc

SEQ ID NO: 1450427 - RNA, 20 nt, Human
ccccaggaccagaagcuccc

SEQ ID NO: 1450428 - RNA, 18 nt, Human
ccccaggaccagaagcuc

SEQ ID NO: 1450429 - RNA, 14 nt, Human
ccccaggaccagaa

SEQ ID NO: 1450430 - RNA, 13 nt, Human
ccccaggaccaga

SEQ ID NO: 1450431 - RNA, 11 nt, Human
ccccaggacca

SEQ ID NO: 1450432 - RNA, 16 nt, Human
ccccaggaccagcuca

SEQ ID NO: 1450433 - RNA, 19 nt, Human
cccccaagcuguuuucuuc

SEQ ID NO: 1450434 - RNA, 20 nt, Human
cccccaaccauuuccucaga

SEQ ID NO: 1450435 - RNA, 15 nt, Human
ccccgucaagaguga

SEQ ID NO: 1450436 - RNA, 17 nt, Human
cccccuggccuccccca

SEQ ID NO: 1450437 - RNA, 14 nt, Human
cccccugcugccau

SEQ ID NO: 1450438 - RNA, 22 nt, Human
cccccugccccccagccucugg

SEQ ID NO: 1450439 - RNA, 19 nt, Human
cccccucucccugcauggc

SEQ ID NO: 1450440 - RNA, 18 nt, Human
cccccucucccugcaugg

SEQ ID NO: 1450441 - RNA, 13 nt, Human
ccccccuguacac

SEQ ID NO: 1450442 - RNA, 12 nt, Human
ccccccuggccu

SEQ ID NO: 1450443 - RNA, 12 nt, Human
ccccccucuguc

SEQ ID NO: 1450444 - RNA, 17 nt, Human
cccccucucccugcaug

SEQ ID NO: 1450445 - RNA, 15 nt, Human
cccccucucccugca

SEQ ID NO: 1450446 - RNA, 14 nt, Human
cccccucucccugc

SEQ ID NO: 1450447 - RNA, 14 nt, Human
cccccucucccagu

SEQ ID NO: 1450448 - RNA, 14 nt, Human
cccccggcagcagc

SEQ ID NO: 1450449 - RNA, 21 nt, Human
cccccagcccagggcuccugc

SEQ ID NO: 1450450 - RNA, 14 nt, Human
cccccagcccaggg

SEQ ID NO: 1450451 - RNA, 13 nt, Human
cccccagcccagg

SEQ ID NO: 1450452 - RNA, 12 nt, Human
cccccagcacuu

SEQ ID NO: 1450453 - RNA, 18 nt, Human
cccccaagggaggcugcu

SEQ ID NO: 1450454 - RNA, 20 nt, Human
cccccaagggaggcugcugc

SEQ ID NO: 1450455 - RNA, 13 nt, Human
cccccaauccaug

SEQ ID NO: 1450456 - RNA, 18 nt, Human
cccccaagguucuccaac

SEQ ID NO: 1450457 - RNA, 11 nt, Human
cccccagcacu

SEQ ID NO: 1450458 - RNA, 15 nt, Human
cccccaggaccagaa

SEQ ID NO: 1450459 - RNA, 23 nt, Human
cccccagcuuugcuaccaaagca

SEQ ID NO: 1450460 - RNA, 14 nt, Human
cccccaggaccaga

SEQ ID NO: 1450461 - RNA, 22 nt, Human
cccccagcccccuccuggugcc

SEQ ID NO: 1450462 - RNA, 14 nt, Human
ccccccaugcacug

SEQ ID NO: 1450463 - RNA, 14 nt, Human
ccccccagauauca

SEQ ID NO: 1450464 - RNA, 13 nt, Human
ccccccagccucu

SEQ ID NO: 1450465 - RNA, 12 nt, Human
ccccccagccuc

SEQ ID NO: 1450466 - RNA, 21 nt, Human
ccccccagauaucaucuaccu

SEQ ID NO: 1450467 - RNA, 21 nt, Human
ccccccaagggaggcugcugc

SEQ ID NO: 1450468 - RNA, 19 nt, Human
ccccccaagggaggcugcu

SEQ ID NO: 1450469 - RNA, 14 nt, Human
cccccaugcacugu

SEQ ID NO: 1450470 - RNA, 18 nt, Human
cccccaugcacugugaag

SEQ ID NO: 1450471 - RNA, 18 nt, Human
cccccaggguccugggag

SEQ ID NO: 1450472 - RNA, 16 nt, Human
cccccaucauccucug

SEQ ID NO: 1450473 - RNA, 18 nt, Human
cccccaguaucucuucag

SEQ ID NO: 1450474 - RNA, 14 nt, Human
cccuuacaguagga

SEQ ID NO: 1450475 - RNA, 19 nt, Human
cccuguuucagaggcucag

SEQ ID NO: 1450476 - RNA, 16 nt, Human
cccuguuucagaggcu

SEQ ID NO: 1450477 - RNA, 11 nt, Human
cccuguugcua

SEQ ID NO: 1450478 - RNA, 13 nt, Human
cccuguacagugu

SEQ ID NO: 1450479 - RNA, 18 nt, Human
cccuguacacaacucacu

SEQ ID NO: 1450480 - RNA, 11 nt, Human
cccuguaacuu

SEQ ID NO: 1450481 - RNA, 15 nt, Human
cccuguacaguguua

SEQ ID NO: 1450482 - RNA, 18 nt, Human
cccuguacuguucugugu

SEQ ID NO: 1450483 - RNA, 19 nt, Human
cccuguaccuuuugaggag

SEQ ID NO: 1450484 - RNA, 20 nt, Human
cccuguacaguguuaccauc

SEQ ID NO: 1450485 - RNA, 13 nt, Human
ccccuccccucca

SEQ ID NO: 1450486 - RNA, 20 nt, Human
ccccucccccugagauucag

SEQ ID NO: 1450487 - RNA, 14 nt, Human
ccccuagaguccca

SEQ ID NO: 1450488 - RNA, 18 nt, Human
ccccuaagagagcaccug

SEQ ID NO: 1450489 - RNA, 17 nt, Human
ccccuaagagagcaccu

SEQ ID NO: 1450490 - RNA, 23 nt, Human
ccccuaacccuuugugugcucuc

SEQ ID NO: 1450491 - RNA, 22 nt, Human
ccccuaacccuuugugugcucu

SEQ ID NO: 1450492 - RNA, 14 nt, Human
ccccguuucuggug

SEQ ID NO: 1450493 - RNA, 19 nt, Human
ccccuaaagccucaaaaca

SEQ ID NO: 1450494 - RNA, 20 nt, Human
ccccuaaaagaaacccugca

SEQ ID NO: 1450495 - RNA, 13 nt, Human
ccgagaagaacag

SEQ ID NO: 1450496 - RNA, 22 nt, Human
ccgacuuuuguuuaccagagaa

SEQ ID NO: 1450497 - RNA, 15 nt, Human
ccgacuggggcaggg

SEQ ID NO: 1450498 - RNA, 16 nt, Human
cccuuuuucuccagcu

SEQ ID NO: 1450499 - RNA, 15 nt, Human
cccuuuuucuccagc

SEQ ID NO: 1450500 - RNA, 14 nt, Human
cccuuuuucaauga

SEQ ID NO: 1450501 - RNA, 20 nt, Human
cccuuuuggguuucugcccu

SEQ ID NO: 1450502 - RNA, 16 nt, Human
cccuuuuggguuucug

SEQ ID NO: 1450503 - RNA, 13 nt, Human
cccuuuucuguuc

SEQ ID NO: 1450504 - RNA, 12 nt, Human
ccgcccugccac

SEQ ID NO: 1450505 - RNA, 11 nt, Human
ccgcccugcca

SEQ ID NO: 1450506 - RNA, 13 nt, Human
ccgaugcccagag

SEQ ID NO: 1450507 - RNA, 16 nt, Human
ccgaugcccagagaca

SEQ ID NO: 1450508 - RNA, 12 nt, Human
ccgaggcugaga

SEQ ID NO: 1450509 - RNA, 18 nt, Human
ccgagcuccucuuccaug

SEQ ID NO: 1450510 - RNA, 17 nt, Human
ccgagcuccucuuccau

SEQ ID NO: 1450511 - RNA, 16 nt, Human
ccgagcuccucuucca

SEQ ID NO: 1450512 - RNA, 11 nt, Human
ccgagcuccuc

SEQ ID NO: 1450513 - RNA, 20 nt, Human
ccgagcagcugagcagggcc

SEQ ID NO: 1450514 - RNA, 18 nt, Human
ccgagcagcugagcaggg

SEQ ID NO: 1450515 - RNA, 17 nt, Human
ccgagcagcugagcagg

SEQ ID NO: 1450516 - RNA, 16 nt, Human
ccgagcagcugagcag

SEQ ID NO: 1450517 - RNA, 15 nt, Human
ccgagcagcugagca

SEQ ID NO: 1450518 - RNA, 14 nt, Human
ccgagcagcugagc

SEQ ID NO: 1450519 - RNA, 12 nt, Human
ccgagcagcuga

SEQ ID NO: 1450520 - RNA, 23 nt, Human
ccgagcaaccguggcccuuccug

SEQ ID NO: 1450521 - RNA, 21 nt, Human
ccgagcagcugagcagggccg

SEQ ID NO: 1450522 - RNA, 16 nt, Human
ccgagcaggaggccua

SEQ ID NO: 1450523 - RNA, 18 nt, Human
ccgagcaaccguggcccu

SEQ ID NO: 1450524 - RNA, 16 nt, Human
ccgagcaaccguggcc

SEQ ID NO: 1450525 - RNA, 14 nt, Human
ccgagcaaccgugg

SEQ ID NO: 1450526 - RNA, 21 nt, Human
cccuugggccagaaguaccag

SEQ ID NO: 1450527 - RNA, 16 nt, Human
cccuugggccagaagu

SEQ ID NO: 1450528 - RNA, 15 nt, Human
cccuugggccagaag

SEQ ID NO: 1450529 - RNA, 21 nt, Human
cccuuccucccuauuaaccua

SEQ ID NO: 1450530 - RNA, 16 nt, Human
cccuugaugaagaagu

SEQ ID NO: 1450531 - RNA, 23 nt, Human
cccuuugugugcucuccauucug

SEQ ID NO: 1450532 - RNA, 23 nt, Human
cccuuugcugugaggcuguccug

SEQ ID NO: 1450533 - RNA, 17 nt, Human
cccuuugcugcauggca

SEQ ID NO: 1450534 - RNA, 14 nt, Human
cccuuugccuucau

SEQ ID NO: 1450535 - RNA, 17 nt, Human
cccuuugcccagaaaga

SEQ ID NO: 1450536 - RNA, 14 nt, Human
cccuuugagugcag

SEQ ID NO: 1450537 - RNA, 12 nt, Human
cccuuugagugc

SEQ ID NO: 1450538 - RNA, 22 nt, Human
cccuuucuaucguucucucuuu

SEQ ID NO: 1450539 - RNA, 17 nt, Human
cccuuucuagaccaaua

SEQ ID NO: 1450540 - RNA, 16 nt, Human
cccuuucuagaccaau

SEQ ID NO: 1450541 - RNA, 18 nt, Human
cccuuucggauccaggga

SEQ ID NO: 1450542 - RNA, 22 nt, Human
cccuuggggguccuccuccagg

SEQ ID NO: 1450543 - RNA, 21 nt, Human
cccuuggggguccuccuccag

SEQ ID NO: 1450544 - RNA, 12 nt, Human
cccuuggggguc

SEQ ID NO: 1450545 - RNA, 16 nt, Human
cccuugggcucugaug

SEQ ID NO: 1450546 - RNA, 15 nt, Human
cccuugggcucugau

SEQ ID NO: 1450547 - RNA, 14 nt, Human
cccuugggcccaca

SEQ ID NO: 1450548 - RNA, 15 nt, Human
cccuugggcccacac

SEQ ID NO: 1450549 - RNA, 23 nt, Human
cccuuggggguccuccuccaggg

SEQ ID NO: 1450550 - RNA, 17 nt, Human
cccuuuccuccucaggc

SEQ ID NO: 1450551 - RNA, 14 nt, Human
cccuuuccuccuca

SEQ ID NO: 1450552 - RNA, 16 nt, Human
cccuuuccugaguccc

SEQ ID NO: 1450553 - RNA, 21 nt, Human
ccugaauuuuguugcuguuuu

SEQ ID NO: 1450554 - RNA, 14 nt, Human
ccugaugaaaauaa

SEQ ID NO: 1450555 - RNA, 13 nt, Human
ccugaugaaaaua

SEQ ID NO: 1450556 - RNA, 21 nt, Human
ccugaugaaaauaaagaaugg

SEQ ID NO: 1450557 - RNA, 19 nt, Human
ccugaugaaaauaaagaau

SEQ ID NO: 1450558 - RNA, 18 nt, Human
ccugaugaaaauaaagaa

SEQ ID NO: 1450559 - RNA, 17 nt, Human
ccugaugaaaauaaaga

SEQ ID NO: 1450560 - RNA, 15 nt, Human
ccugaugaaaauaaa

SEQ ID NO: 1450561 - RNA, 21 nt, Human
ccugaugggguggaaggcaug

SEQ ID NO: 1450562 - RNA, 21 nt, Human
ccugaugcugacauucaccug

SEQ ID NO: 1450563 - RNA, 13 nt, Human
ccugaugcugaca

SEQ ID NO: 1450564 - RNA, 23 nt, Human
ccugaugcugacauucaccugcc

SEQ ID NO: 1450565 - RNA, 23 nt, Human
ccucugucucgagcgcccugcag

SEQ ID NO: 1450566 - RNA, 21 nt, Human
ccucugucucgagcgcccugc

SEQ ID NO: 1450567 - RNA, 20 nt, Human
ccucugucucgagcgcccug

SEQ ID NO: 1450568 - RNA, 19 nt, Human
ccucugucucgagcgcccu

SEQ ID NO: 1450569 - RNA, 18 nt, Human
ccucugucucgagcgccc

SEQ ID NO: 1450570 - RNA, 15 nt, Human
ccucugucucgagcg

SEQ ID NO: 1450571 - RNA, 21 nt, Human
ccucugucagucacagccacc

SEQ ID NO: 1450572 - RNA, 19 nt, Human
ccucugucagucacagcca

SEQ ID NO: 1450573 - RNA, 18 nt, Human
ccucugucagucacagcc

SEQ ID NO: 1450574 - RNA, 16 nt, Human
ccucugucagucacag

SEQ ID NO: 1450575 - RNA, 15 nt, Human
ccucugucagucaca

SEQ ID NO: 1450576 - RNA, 23 nt, Human
ccucuguauuugaaucagccuac

SEQ ID NO: 1450577 - RNA, 21 nt, Human
ccucuguccaggcacugagau

SEQ ID NO: 1450578 - RNA, 20 nt, Human
ccucuguccaggcacugaga

SEQ ID NO: 1450579 - RNA, 19 nt, Human
ccucuguccaggcacugag

SEQ ID NO: 1450580 - RNA, 15 nt, Human
ccucuguccaggcac

SEQ ID NO: 1450581 - RNA, 21 nt, Human
ccucuggucgcuccugcccac

SEQ ID NO: 1450582 - RNA, 20 nt, Human
ccucuggucgcuccugccca

SEQ ID NO: 1450583 - RNA, 19 nt, Human
ccucuggucgcuccugccc

SEQ ID NO: 1450584 - RNA, 17 nt, Human
ccucuggucgcuccugc

SEQ ID NO: 1450585 - RNA, 16 nt, Human
ccucugugcugugugu

SEQ ID NO: 1450586 - RNA, 13 nt, Human
ccucugugcugug

SEQ ID NO: 1450587 - RNA, 21 nt, Human
ccucugugaccaaugucuuga

SEQ ID NO: 1450588 - RNA, 19 nt, Human
ccucugugaccaaugucuu

SEQ ID NO: 1450589 - RNA, 18 nt, Human
ccucugugaccaaugucu

SEQ ID NO: 1450590 - RNA, 22 nt, Human
ccucugucuugugaaggcaggg

SEQ ID NO: 1450591 - RNA, 16 nt, Human
ccucugucuucuggac

SEQ ID NO: 1450592 - RNA, 15 nt, Human
ccucugucuucugga

SEQ ID NO: 1450593 - RNA, 14 nt, Human
ccucugucuggcaa

SEQ ID NO: 1450594 - RNA, 22 nt, Human
ccucugucuggcaaugccacag

SEQ ID NO: 1450595 - RNA, 22 nt, Human
ccucugucucgagcgcccugca

SEQ ID NO: 1450596 - RNA, 18 nt, Human
ccucuguguauuugcuuu

SEQ ID NO: 1450597 - RNA, 15 nt, Human
ccucugugcugugug

SEQ ID NO: 1450598 - RNA, 16 nt, Human
ccucuguuccuucccu

SEQ ID NO: 1450599 - RNA, 16 nt, Human
ccucuguucaaagcug

SEQ ID NO: 1450600 - RNA, 18 nt, Human
ccucuguucaaagcugcc

SEQ ID NO: 1450601 - RNA, 18 nt, Human
ccucuuaaauaaaccuuu

SEQ ID NO: 1450602 - RNA, 17 nt, Human
ccucuuaaauaaaccuu

SEQ ID NO: 1450603 - RNA, 23 nt, Human
ccucuuagaugcaguucugaaga

SEQ ID NO: 1450604 - RNA, 19 nt, Human
ccucuuuuuucguuuguuu

SEQ ID NO: 1450605 - RNA, 13 nt, Human
ccucuuuuuucgu

SEQ ID NO: 1450606 - RNA, 23 nt, Human
ccucuuuuuccaacuuggcugca

SEQ ID NO: 1450607 - RNA, 17 nt, Human
ccucuuuuccuucccaa

SEQ ID NO: 1450608 - RNA, 17 nt, Human
ccugaaaacacugugca

SEQ ID NO: 1450609 - RNA, 17 nt, Human
ccugaacaagaauugga

SEQ ID NO: 1450610 - RNA, 16 nt, Human
ccugaacaagaauugg

SEQ ID NO: 1450611 - RNA, 15 nt, Human
ccugaacaagaauug

SEQ ID NO: 1450612 - RNA, 13 nt, Human
ccugaacaagaau

SEQ ID NO: 1450613 - RNA, 15 nt, Human
ccugaaauuucagau

SEQ ID NO: 1450614 - RNA, 14 nt, Human
ccugaaauuucaga

SEQ ID NO: 1450615 - RNA, 18 nt, Human
ccugaaauuccaaagucu

SEQ ID NO: 1450616 - RNA, 16 nt, Human
ccugaaauuccaaagu

SEQ ID NO: 1450617 - RNA, 15 nt, Human
ccugaaauuccaaag

SEQ ID NO: 1450618 - RNA, 14 nt, Human
ccugaaauuccaaa

SEQ ID NO: 1450619 - RNA, 21 nt, Human
ccugaaaaaaaaccugagauu

SEQ ID NO: 1450620 - RNA, 22 nt, Human
ccugaaagaggcugaggccugg

SEQ ID NO: 1450621 - RNA, 19 nt, Human
ccugaaagaggcugaggcc

SEQ ID NO: 1450622 - RNA, 15 nt, Human
ccugaaagaggcuga

SEQ ID NO: 1450623 - RNA, 19 nt, Human
ccucuuccuacuggucucu

SEQ ID NO: 1450624 - RNA, 15 nt, Human
ccucuuccuacuggu

SEQ ID NO: 1450625 - RNA, 18 nt, Human
ccucuuccgugacgucac

SEQ ID NO: 1450626 - RNA, 21 nt, Human
ccucuuccuacuggucucucu

SEQ ID NO: 1450627 - RNA, 15 nt, Human
ccugaauucuuuuuc

SEQ ID NO: 1450628 - RNA, 21 nt, Human
ccugaauccaaacuaauccau

SEQ ID NO: 1450629 - RNA, 20 nt, Human
ccugaauccaaacuaaucca

SEQ ID NO: 1450630 - RNA, 17 nt, Human
ccugaauccaaacuaau

SEQ ID NO: 1450631 - RNA, 12 nt, Human
ccugaaguauuu

SEQ ID NO: 1450632 - RNA, 17 nt, Human
ccugaagaaccaguccc

SEQ ID NO: 1450633 - RNA, 22 nt, Human
ccugaagcuaucguaaaauuaa

SEQ ID NO: 1450634 - RNA, 23 nt, Human
ccugaagcuaucguaaaauuaag

SEQ ID NO: 1450635 - RNA, 16 nt, Human
ccugaagaaccagucc

SEQ ID NO: 1450636 - RNA, 13 nt, Human
ccugaagaaccag

SEQ ID NO: 1450637 - RNA, 17 nt, Human
ccugaacugaacaccau

SEQ ID NO: 1450638 - RNA, 17 nt, Human
ccugaaccccagggcug

SEQ ID NO: 1450639 - RNA, 18 nt, Human
ccugaaccccagggcugu

SEQ ID NO: 1450640 - RNA, 16 nt, Human
ccugaaccccagggcu

SEQ ID NO: 1450641 - RNA, 21 nt, Human
ccugaacaagaauuggaagcu

SEQ ID NO: 1450642 - RNA, 20 nt, Human
ccugaacaggauauucucac

SEQ ID NO: 1450643 - RNA, 21 nt, Human
ccucaguagucccugcacagu

SEQ ID NO: 1450644 - RNA, 19 nt, Human
ccucaguagucccugcaca

SEQ ID NO: 1450645 - RNA, 18 nt, Human
ccucaguagucccugcac

SEQ ID NO: 1450646 - RNA, 15 nt, Human
ccucaguagucccug

SEQ ID NO: 1450647 - RNA, 23 nt, Human
ccucaggggucugagcuccagcu

SEQ ID NO: 1450648 - RNA, 22 nt, Human
ccucaggggucugagcuccagc

SEQ ID NO: 1450649 - RNA, 18 nt, Human
ccucaggggucugagcuc

SEQ ID NO: 1450650 - RNA, 16 nt, Human
ccucaggggucugagc

SEQ ID NO: 1450651 - RNA, 13 nt, Human
ccucaggggucug

SEQ ID NO: 1450652 - RNA, 23 nt, Human
ccucagggcuccuugugggccug

SEQ ID NO: 1450653 - RNA, 22 nt, Human
ccucagggcuccuugugggccu

SEQ ID NO: 1450654 - RNA, 16 nt, Human
ccucagggcuccuugu

SEQ ID NO: 1450655 - RNA, 22 nt, Human
ccucagggcaaagccagguccc

SEQ ID NO: 1450656 - RNA, 21 nt, Human
ccucagggcaaagccaggucc

SEQ ID NO: 1450657 - RNA, 17 nt, Human
ccucagggcaaagccag

SEQ ID NO: 1450658 - RNA, 16 nt, Human
ccucagggcaaagcca

SEQ ID NO: 1450659 - RNA, 15 nt, Human
ccucagggcaaagcc

SEQ ID NO: 1450660 - RNA, 14 nt, Human
ccucagggcaaagc

SEQ ID NO: 1450661 - RNA, 18 nt, Human
ccucagccacuugccugu

SEQ ID NO: 1450662 - RNA, 21 nt, Human
ccucagacucuaagaaagaac

SEQ ID NO: 1450663 - RNA, 20 nt, Human
ccucagacucuaagaaagaa

SEQ ID NO: 1450664 - RNA, 19 nt, Human
ccucagacucuaagaaaga

SEQ ID NO: 1450665 - RNA, 15 nt, Human
ccucagacucuaaga

SEQ ID NO: 1450666 - RNA, 22 nt, Human
ccucacuuuuaaugaacaaaug

SEQ ID NO: 1450667 - RNA, 18 nt, Human
ccucacuuuuaaugaaca

SEQ ID NO: 1450668 - RNA, 20 nt, Human
ccucagaaaacaaggaugaa

SEQ ID NO: 1450669 - RNA, 14 nt, Human
ccuccucccucccu

SEQ ID NO: 1450670 - RNA, 13 nt, Human
ccuccucccuccc

SEQ ID NO: 1450671 - RNA, 14 nt, Human
ccuccuccccacuu

SEQ ID NO: 1450672 - RNA, 13 nt, Human
ccuccuccccacu

SEQ ID NO: 1450673 - RNA, 21 nt, Human
ccuccuccccaacuguggggg

SEQ ID NO: 1450674 - RNA, 23 nt, Human
ccucccugagcuagaacccucug

SEQ ID NO: 1450675 - RNA, 22 nt, Human
ccucccugagcuagaacccucu

SEQ ID NO: 1450676 - RNA, 19 nt, Human
ccucccugaagccuuugca

SEQ ID NO: 1450677 - RNA, 15 nt, Human
ccucccucccucucc

SEQ ID NO: 1450678 - RNA, 14 nt, Human
ccucccucccucuc

SEQ ID NO: 1450679 - RNA, 15 nt, Human
ccucccuccccuugc

SEQ ID NO: 1450680 - RNA, 17 nt, Human
ccuccccucuccuuccu

SEQ ID NO: 1450681 - RNA, 22 nt, Human
ccucccuacccuaaccaaguuc

SEQ ID NO: 1450682 - RNA, 17 nt, Human
ccucccucaaccucauc

SEQ ID NO: 1450683 - RNA, 21 nt, Human
ccucccucaaccucauccucu

SEQ ID NO: 1450684 - RNA, 21 nt, Human
ccuccucugcacucccaccug

SEQ ID NO: 1450685 - RNA, 15 nt, Human
ccuccucugcccggg

SEQ ID NO: 1450686 - RNA, 14 nt, Human
ccuccucugcccgg

SEQ ID NO: 1450687 - RNA, 19 nt, Human
ccuccugcagaccacgccc

SEQ ID NO: 1450688 - RNA, 21 nt, Human
ccuccugggcccucucugcuc

SEQ ID NO: 1450689 - RNA, 19 nt, Human
ccuccugccggcuccuugg

SEQ ID NO: 1450690 - RNA, 17 nt, Human
ccuccugggaaugaagc

SEQ ID NO: 1450691 - RNA, 14 nt, Human
ccucucagcccuca

SEQ ID NO: 1450692 - RNA, 13 nt, Human
ccucucagcccuc

SEQ ID NO: 1450693 - RNA, 11 nt, Human
ccucucagccc

SEQ ID NO: 1450694 - RNA, 18 nt, Human
ccucucaggauccaagcu

SEQ ID NO: 1450695 - RNA, 15 nt, Human
ccucucaggauccaa

SEQ ID NO: 1450696 - RNA, 18 nt, Human
ccucucagcuccaggugg

SEQ ID NO: 1450697 - RNA, 16 nt, Human
ccucucagcuccaggu

SEQ ID NO: 1450698 - RNA, 13 nt, Human
ccucucagcucca

SEQ ID NO: 1450699 - RNA, 23 nt, Human
ccucucaggauccaagcuaagca

SEQ ID NO: 1450700 - RNA, 23 nt, Human
ccucuccacucaugugacucuuu

SEQ ID NO: 1450701 - RNA, 23 nt, Human
ccuccuguugggagagggcgcag

SEQ ID NO: 1450702 - RNA, 23 nt, Human
ccucucccaggccccaugaccuc

SEQ ID NO: 1450703 - RNA, 15 nt, Human
ccucucccaggcccc

SEQ ID NO: 1450704 - RNA, 14 nt, Human
ccucucccaggccc

SEQ ID NO: 1450705 - RNA, 13 nt, Human
ccucucccaggcc

SEQ ID NO: 1450706 - RNA, 22 nt, Human
ccucucccaggcaggggcccgc

SEQ ID NO: 1450707 - RNA, 19 nt, Human
ccucucccaggcaggggcc

SEQ ID NO: 1450708 - RNA, 14 nt, Human
ccucucccaggcag

SEQ ID NO: 1450709 - RNA, 21 nt, Human
ccucuccccagcccagagaca

SEQ ID NO: 1450710 - RNA, 20 nt, Human
ccucuccccagcccagagac

SEQ ID NO: 1450711 - RNA, 19 nt, Human
ccucuccccagcccagaga

SEQ ID NO: 1450712 - RNA, 18 nt, Human
ccucuccccagcccagag

SEQ ID NO: 1450713 - RNA, 15 nt, Human
ccucucccaguuguc

SEQ ID NO: 1450714 - RNA, 13 nt, Human
ccucucccaguug

SEQ ID NO: 1450715 - RNA, 12 nt, Human
ccucucccaguu

SEQ ID NO: 1450716 - RNA, 18 nt, Human
ccucucccaggccccaug

SEQ ID NO: 1450717 - RNA, 17 nt, Human
ccucucccaggccccau

SEQ ID NO: 1450718 - RNA, 16 nt, Human
ccucucccaggcccca

SEQ ID NO: 1450719 - RNA, 23 nt, Human
ccucuccccugcccccugcagga

SEQ ID NO: 1450720 - RNA, 15 nt, Human
ccucuccccugccug

SEQ ID NO: 1450721 - RNA, 22 nt, Human
ccucuccccugcccccugcagg

SEQ ID NO: 1450722 - RNA, 21 nt, Human
ccucuccccugcccccugcag

SEQ ID NO: 1450723 - RNA, 20 nt, Human
ccucuccccugcccccugca

SEQ ID NO: 1450724 - RNA, 16 nt, Human
ccucuccccugccccc

SEQ ID NO: 1450725 - RNA, 13 nt, Human
ccucuccccugcc

SEQ ID NO: 1450726 - RNA, 12 nt, Human
ccucuccccugc

SEQ ID NO: 1450727 - RNA, 16 nt, Human
ccucuccccucagccu

SEQ ID NO: 1450728 - RNA, 15 nt, Human
ccucuccccucagcc

SEQ ID NO: 1450729 - RNA, 12 nt, Human
ccucuccccuca

SEQ ID NO: 1450730 - RNA, 18 nt, Human
ccucuccccucagccucu

SEQ ID NO: 1450731 - RNA, 23 nt, Human
ccucuccccagguccagcucugg

SEQ ID NO: 1450732 - RNA, 21 nt, Human
ccucuccccagguccagcucu

SEQ ID NO: 1450733 - RNA, 22 nt, Human
ccucuccccagggaagcagcag

SEQ ID NO: 1450734 - RNA, 12 nt, Human
ccucucuggaga

SEQ ID NO: 1450735 - RNA, 16 nt, Human
ccucucugcucugcgu

SEQ ID NO: 1450736 - RNA, 15 nt, Human
ccucucugcucugcg

SEQ ID NO: 1450737 - RNA, 12 nt, Human
ccucucugcucu

SEQ ID NO: 1450738 - RNA, 12 nt, Human
ccucucuuccuc

SEQ ID NO: 1450739 - RNA, 11 nt, Human
ccucucuuccu

SEQ ID NO: 1450740 - RNA, 23 nt, Human
ccucucuggagaaagggcccugg

SEQ ID NO: 1450741 - RNA, 22 nt, Human
ccucucuggagaaagggcccug

SEQ ID NO: 1450742 - RNA, 13 nt, Human
ccucucuggagaa

SEQ ID NO: 1450743 - RNA, 23 nt, Human
ccucuggcauuagaauuauuuaa

SEQ ID NO: 1450744 - RNA, 21 nt, Human
ccucuggcauuagaauuauuu

SEQ ID NO: 1450745 - RNA, 14 nt, Human
ccucuggagccagc

SEQ ID NO: 1450746 - RNA, 22 nt, Human
ccucuggagggguguggcuccu

SEQ ID NO: 1450747 - RNA, 20 nt, Human
ccucuggagggguguggcuc

SEQ ID NO: 1450748 - RNA, 17 nt, Human
ccucuggaggggugugg

SEQ ID NO: 1450749 - RNA, 16 nt, Human
ccucuggagccagccg

SEQ ID NO: 1450750 - RNA, 22 nt, Human
ccucugcuuucuccuuuaauug

SEQ ID NO: 1450751 - RNA, 19 nt, Human
ccucugcauccucuggagc

SEQ ID NO: 1450752 - RNA, 22 nt, Human
ccucugccaaaggaugugauau

SEQ ID NO: 1450753 - RNA, 20 nt, Human
ccucugccaaaggaugugau

SEQ ID NO: 1450754 - RNA, 20 nt, Human
ccucuggcuuggccacagcc

SEQ ID NO: 1450755 - RNA, 18 nt, Human
ccucuggcuuggccacag

SEQ ID NO: 1450756 - RNA, 16 nt, Human
ccucuggucgcuccug

SEQ ID NO: 1450757 - RNA, 19 nt, Human
ccucugguaaccucuuacu

SEQ ID NO: 1450758 - RNA, 20 nt, Human
ccucugggggguggccaggc

SEQ ID NO: 1450759 - RNA, 19 nt, Human
ccucugggggguggccagg

SEQ ID NO: 1450760 - RNA, 15 nt, Human
ccucugggggguggc

SEQ ID NO: 1450761 - RNA, 16 nt, Human
ccucugggcucugagu

SEQ ID NO: 1450762 - RNA, 14 nt, Human
ccucugggcucuga

SEQ ID NO: 1450763 - RNA, 12 nt, Human
ccucugggcucu

SEQ ID NO: 1450764 - RNA, 23 nt, Human
ccucuggcuuggccacagccagg

SEQ ID NO: 1450765 - RNA, 21 nt, Human
ccucuggcuuggccacagcca

SEQ ID NO: 1450766 - RNA, 21 nt, Human
ccucugcacuacugacaugug

SEQ ID NO: 1450767 - RNA, 20 nt, Human
ccucugcacuacugacaugu

SEQ ID NO: 1450768 - RNA, 19 nt, Human
ccucugcaccuuugcacgu

SEQ ID NO: 1450769 - RNA, 16 nt, Human
ccucugcacucccacc

SEQ ID NO: 1450770 - RNA, 19 nt, Human
ccucugccaaaggauguga

SEQ ID NO: 1450771 - RNA, 18 nt, Human
ccucugcauccucuggag

SEQ ID NO: 1450772 - RNA, 17 nt, Human
ccucugcauccucugga

SEQ ID NO: 1450773 - RNA, 16 nt, Human
ccucugcauccucugg

SEQ ID NO: 1450774 - RNA, 16 nt, Human
ccucugcagucucuau

SEQ ID NO: 1450775 - RNA, 17 nt, Human
ccucugcagucucuaua

SEQ ID NO: 1450776 - RNA, 23 nt, Human
ccucugcagucucuauaccaaua

SEQ ID NO: 1450777 - RNA, 21 nt, Human
ccuucaagcucugagggaaag

SEQ ID NO: 1450778 - RNA, 16 nt, Human
ccuucaagcucugagg

SEQ ID NO: 1450779 - RNA, 15 nt, Human
ccuucaagcucugag

SEQ ID NO: 1450780 - RNA, 14 nt, Human
ccuucaagcucuga

SEQ ID NO: 1450781 - RNA, 13 nt, Human
ccuucaagcucug

SEQ ID NO: 1450782 - RNA, 18 nt, Human
ccuucaagaaaacaggca

SEQ ID NO: 1450783 - RNA, 14 nt, Human
ccuucaacccgaga

SEQ ID NO: 1450784 - RNA, 22 nt, Human
ccuucaacaauucuaaaaugau

SEQ ID NO: 1450785 - RNA, 14 nt, Human
ccuuagaucuggca

SEQ ID NO: 1450786 - RNA, 17 nt, Human
ccuuagacucuuuuccu

SEQ ID NO: 1450787 - RNA, 20 nt, Human
ccuuagacucuuuuccuucc

SEQ ID NO: 1450788 - RNA, 16 nt, Human
ccuuagacucuuuucc

SEQ ID NO: 1450789 - RNA, 18 nt, Human
ccuuauuuucaagaaacu

SEQ ID NO: 1450790 - RNA, 14 nt, Human
ccuuauuuucaaga

SEQ ID NO: 1450791 - RNA, 17 nt, Human
ccuuacuuuuuauauau

SEQ ID NO: 1450792 - RNA, 18 nt, Human
ccuuacuuuuuauauaua

SEQ ID NO: 1450793 - RNA, 15 nt, Human
ccuuacuuuuuauau

SEQ ID NO: 1450794 - RNA, 23 nt, Human
ccuguggccaugacccugccucu

SEQ ID NO: 1450795 - RNA, 21 nt, Human
ccuuacccugccccagcuggg

SEQ ID NO: 1450796 - RNA, 17 nt, Human
ccuuacccuccuuggga

SEQ ID NO: 1450797 - RNA, 17 nt, Human
ccuguggccccacccug

SEQ ID NO: 1450798 - RNA, 16 nt, Human
ccuguggccccacccu

SEQ ID NO: 1450799 - RNA, 15 nt, Human
ccuguggccccaccc

SEQ ID NO: 1450800 - RNA, 22 nt, Human
ccuguggccaugacccugccuc

SEQ ID NO: 1450801 - RNA, 17 nt, Human
ccuguggccaugacccu

SEQ ID NO: 1450802 - RNA, 22 nt, Human
ccuguggccccacccugggccc

SEQ ID NO: 1450803 - RNA, 20 nt, Human
ccuguggccccacccugggc

SEQ ID NO: 1450804 - RNA, 18 nt, Human
ccuguggccccacccugg

SEQ ID NO: 1450805 - RNA, 22 nt, Human
ccugugcuucgggcccuuccca

SEQ ID NO: 1450806 - RNA, 19 nt, Human
ccuguggaacauaaaaagg

SEQ ID NO: 1450807 - RNA, 23 nt, Human
ccuguggaacauaaaaaggacau

SEQ ID NO: 1450808 - RNA, 24 nt, Human
ccuguggaacauaaaaaggacauc

SEQ ID NO: 1450809 - RNA, 23 nt, Human
ccuuccugccccaacuccuucca

SEQ ID NO: 1450810 - RNA, 17 nt, Human
ccuuccugccagccccu

SEQ ID NO: 1450811 - RNA, 16 nt, Human
ccuuccugccagcccc

SEQ ID NO: 1450812 - RNA, 10 nt, Human
ccuucccaaa

SEQ ID NO: 1450813 - RNA, 20 nt, Human
ccuuccucuuuuccuuccca

SEQ ID NO: 1450814 - RNA, 14 nt, Human
ccuuccagaaaaca

SEQ ID NO: 1450815 - RNA, 15 nt, Human
ccuuccacugagggc

SEQ ID NO: 1450816 - RNA, 17 nt, Human
ccuuccacugagggcag

SEQ ID NO: 1450817 - RNA, 18 nt, Human
ccuucaagcucugaggga

SEQ ID NO: 1450818 - RNA, 23 nt, Human
ccuucaguacccucucagcucca

SEQ ID NO: 1450819 - RNA, 20 nt, Human
ccuucaguacccucucagcu

SEQ ID NO: 1450820 - RNA, 19 nt, Human
ccuucaguacccucucagc

SEQ ID NO: 1450821 - RNA, 17 nt, Human
ccuucaguacccucuca

SEQ ID NO: 1450822 - RNA, 20 nt, Human
ccuucauacuugaacguuuu

SEQ ID NO: 1450823 - RNA, 19 nt, Human
ccuucauacuugaacguuu

SEQ ID NO: 1450824 - RNA, 15 nt, Human
ccuucauacuugaac

SEQ ID NO: 1450825 - RNA, 18 nt, Human
ccuucaguuaugauuuuu

SEQ ID NO: 1450826 - RNA, 24 nt, Human
ccuucaguacccucucagcuccag

SEQ ID NO: 1450827 - RNA, 19 nt, Human
ccuucauaucauccacaca

SEQ ID NO: 1450828 - RNA, 18 nt, Human
ccuucauaucauccacac

SEQ ID NO: 1450829 - RNA, 13 nt, Human
ccuucaucuggaa

SEQ ID NO: 1450830 - RNA, 20 nt, Human
ccuucaucuggauuccagag

SEQ ID NO: 1450831 - RNA, 17 nt, Human
ccuuccaaugucuggag

SEQ ID NO: 1450832 - RNA, 14 nt, Human
ccuucaucuggaac

SEQ ID NO: 1450833 - RNA, 14 nt, Human
ccuuccacccaggg

SEQ ID NO: 1450834 - RNA, 13 nt, Human
ccuuccacccagg

SEQ ID NO: 1450835 - RNA, 20 nt, Human
ccuuccaaugucuggagacc

SEQ ID NO: 1450836 - RNA, 21 nt, Human
ccuuccaaugucuggagacca

SEQ ID NO: 1450837 - RNA, 19 nt, Human
ccuuccaaugucuggagac

SEQ ID NO: 1450838 - RNA, 18 nt, Human
ccuuccaaugucuggaga

SEQ ID NO: 1450839 - RNA, 15 nt, Human
ccuuccacccagggg

SEQ ID NO: 1450840 - RNA, 13 nt, Human
ccuuccacccagu

SEQ ID NO: 1450841 - RNA, 19 nt, Human
ccuugaacuuugaccucug

SEQ ID NO: 1450842 - RNA, 17 nt, Human
ccuugaacuuugaccuc

SEQ ID NO: 1450843 - RNA, 19 nt, Human
ccuucuuucuacccugcug

SEQ ID NO: 1450844 - RNA, 13 nt, Human
ccuucuuucuacc

SEQ ID NO: 1450845 - RNA, 16 nt, Human
ccuuccuggacagcug

SEQ ID NO: 1450846 - RNA, 13 nt, Human
ccuuccuggacag

SEQ ID NO: 1450847 - RNA, 15 nt, Human
ccuugacaacuggca

SEQ ID NO: 1450848 - RNA, 17 nt, Human
ccuugaaaaaaaacagu

SEQ ID NO: 1450849 - RNA, 12 nt, Human
ccuugaaugugg

SEQ ID NO: 1450850 - RNA, 14 nt, Human
ccuugacaccugcu

SEQ ID NO: 1450851 - RNA, 21 nt, Human
ccuugacaacuggcaggcagg

SEQ ID NO: 1450852 - RNA, 16 nt, Human
ccuugacaacuggcag

SEQ ID NO: 1450853 - RNA, 23 nt, Human
ccuuggcaccagacacccaggac

SEQ ID NO: 1450854 - RNA, 22 nt, Human
ccuuggcaccagacacccagga

SEQ ID NO: 1450855 - RNA, 21 nt, Human
ccuuggcaccagacacccagg

SEQ ID NO: 1450856 - RNA, 20 nt, Human
ccuuggcaccagacacccag

SEQ ID NO: 1450857 - RNA, 15 nt, Human
ccuuggcaccagaca

SEQ ID NO: 1450858 - RNA, 18 nt, Human
ccuugaucagccccaccc

SEQ ID NO: 1450859 - RNA, 20 nt, Human
ccuugaucagccccacccug

SEQ ID NO: 1450860 - RNA, 14 nt, Human
ccuugaugaagaag

SEQ ID NO: 1450861 - RNA, 22 nt, Human
ccuguauuuguucccaagagca

SEQ ID NO: 1450862 - RNA, 21 nt, Human
ccuguauuuguucccaagagc

SEQ ID NO: 1450863 - RNA, 19 nt, Human
ccuguauuuguucccaaga

SEQ ID NO: 1450864 - RNA, 16 nt, Human
ccuguauuuguuccca

SEQ ID NO: 1450865 - RNA, 19 nt, Human
ccuguauuccugaccuccg

SEQ ID NO: 1450866 - RNA, 23 nt, Human
ccuguauuccugaccuccgccau

SEQ ID NO: 1450867 - RNA, 16 nt, Human
ccuguauucagacaga

SEQ ID NO: 1450868 - RNA, 15 nt, Human
ccuguauucagacag

SEQ ID NO: 1450869 - RNA, 17 nt, Human
ccuguaugucuccagua

SEQ ID NO: 1450870 - RNA, 21 nt, Human
ccuguagauucagguaauaca

SEQ ID NO: 1450871 - RNA, 17 nt, Human
ccuguacuguucugugu

SEQ ID NO: 1450872 - RNA, 17 nt, Human
ccuguacugccugcuug

SEQ ID NO: 1450873 - RNA, 16 nt, Human
ccuguacugccugcuu

SEQ ID NO: 1450874 - RNA, 15 nt, Human
ccuguacugccugcu

SEQ ID NO: 1450875 - RNA, 14 nt, Human
ccuguacugccugc

SEQ ID NO: 1450876 - RNA, 13 nt, Human
ccuguacugccug

SEQ ID NO: 1450877 - RNA, 23 nt, Human
ccuguaccuuuugaggagcccca

SEQ ID NO: 1450878 - RNA, 22 nt, Human
ccuguaccuuuugaggagcccc

SEQ ID NO: 1450879 - RNA, 17 nt, Human
ccuguacacaacucacu

SEQ ID NO: 1450880 - RNA, 15 nt, Human
ccuguagcacuuacu

SEQ ID NO: 1450881 - RNA, 17 nt, Human
ccuguagaguugcugag

SEQ ID NO: 1450882 - RNA, 16 nt, Human
ccuguagaguugcuga

SEQ ID NO: 1450883 - RNA, 14 nt, Human
ccuguagaguugcu

SEQ ID NO: 1450884 - RNA, 13 nt, Human
ccuguagaguugc

SEQ ID NO: 1450885 - RNA, 18 nt, Human
ccuguacuguucuguguc

SEQ ID NO: 1450886 - RNA, 20 nt, Human
ccuguacuguucugugucuu

SEQ ID NO: 1450887 - RNA, 15 nt, Human
ccuggugcuggaggu

SEQ ID NO: 1450888 - RNA, 14 nt, Human
ccuggugcuggagg

SEQ ID NO: 1450889 - RNA, 13 nt, Human
ccuggugcuggag

SEQ ID NO: 1450890 - RNA, 20 nt, Human
ccuggugcugccucuaccug

SEQ ID NO: 1450891 - RNA, 15 nt, Human
ccuggugcugccucu

SEQ ID NO: 1450892 - RNA, 20 nt, Human
ccuggugcuucuccucuccu

SEQ ID NO: 1450893 - RNA, 16 nt, Human
ccuggugcuucuccuc

SEQ ID NO: 1450894 - RNA, 14 nt, Human
ccuggugcuucucc

SEQ ID NO: 1450895 - RNA, 23 nt, Human
ccugugcacaccccacucccaca

SEQ ID NO: 1450896 - RNA, 22 nt, Human
ccugugcacaccccacucccac

SEQ ID NO: 1450897 - RNA, 18 nt, Human
ccugugcacaccccacuc

SEQ ID NO: 1450898 - RNA, 17 nt, Human
ccugugcaaugcauuag

SEQ ID NO: 1450899 - RNA, 15 nt, Human
ccugugccuccucac

SEQ ID NO: 1450900 - RNA, 12 nt, Human
ccugugccuccu

SEQ ID NO: 1450901 - RNA, 13 nt, Human
ccugugcccccag

SEQ ID NO: 1450902 - RNA, 21 nt, Human
ccugugcagccgcugagcgag

SEQ ID NO: 1450903 - RNA, 20 nt, Human
ccugugcagccgcugagcga

SEQ ID NO: 1450904 - RNA, 18 nt, Human
ccugugcagccgcugagc

SEQ ID NO: 1450905 - RNA, 16 nt, Human
ccugugccuccucccu

SEQ ID NO: 1450906 - RNA, 15 nt, Human
ccugugccuccuccc

SEQ ID NO: 1450907 - RNA, 21 nt, Human
ccugugccuccucacccccag

SEQ ID NO: 1450908 - RNA, 20 nt, Human
ccugugccuccucaccccca

SEQ ID NO: 1450909 - RNA, 15 nt, Human
ccuguccagcuccaa

SEQ ID NO: 1450910 - RNA, 14 nt, Human
ccuguccagcucca

SEQ ID NO: 1450911 - RNA, 13 nt, Human
ccuguccagcucc

SEQ ID NO: 1450912 - RNA, 21 nt, Human
ccuguccacaggcuucugagc

SEQ ID NO: 1450913 - RNA, 14 nt, Human
ccuguccacaggcu

SEQ ID NO: 1450914 - RNA, 19 nt, Human
ccuguccaaacugccuaag

SEQ ID NO: 1450915 - RNA, 23 nt, Human
ccuguccaaacugccuaagcccu

SEQ ID NO: 1450916 - RNA, 18 nt, Human
ccuguccacaggcuucug

SEQ ID NO: 1450917 - RNA, 19 nt, Human
ccuguccagcuccaaccug

SEQ ID NO: 1450918 - RNA, 19 nt, Human
ccuguccucuuucagcucc

SEQ ID NO: 1450919 - RNA, 22 nt, Human
ccuguccuccaacaccaagcac

SEQ ID NO: 1450920 - RNA, 21 nt, Human
ccuguccuccaacaccaagca

SEQ ID NO: 1450921 - RNA, 13 nt, Human
ccuguccuccaac

SEQ ID NO: 1450922 - RNA, 13 nt, Human
ccuguccccugcu

SEQ ID NO: 1450923 - RNA, 14 nt, Human
ccuguccccugcua

SEQ ID NO: 1450924 - RNA, 18 nt, Human
ccuguccucuuucagcuc

SEQ ID NO: 1450925 - RNA, 20 nt, Human
ccugugagcccagcuggguc

SEQ ID NO: 1450926 - RNA, 17 nt, Human
ccugugagcccagcugg

SEQ ID NO: 1450927 - RNA, 15 nt, Human
ccugugagcccagcu

SEQ ID NO: 1450928 - RNA, 17 nt, Human
ccuguccucuuucagcu

SEQ ID NO: 1450929 - RNA, 16 nt, Human
ccuguccucuuucagc

SEQ ID NO: 1450930 - RNA, 22 nt, Human
ccugugagcuaggaauuguguu

SEQ ID NO: 1450931 - RNA, 17 nt, Human
ccugcuaaggucuugga

SEQ ID NO: 1450932 - RNA, 19 nt, Human
ccugcuaacggugcucagg

SEQ ID NO: 1450933 - RNA, 18 nt, Human
ccugcuaacggugcucag

SEQ ID NO: 1450934 - RNA, 22 nt, Human
ccugcuccagaccugauccugg

SEQ ID NO: 1450935 - RNA, 16 nt, Human
ccugcuccagaccuga

SEQ ID NO: 1450936 - RNA, 22 nt, Human
ccugauuuaggagaagccagga

SEQ ID NO: 1450937 - RNA, 21 nt, Human
ccugauuuaggagaagccagg

SEQ ID NO: 1450938 - RNA, 20 nt, Human
ccugauuuaggagaagccag

SEQ ID NO: 1450939 - RNA, 19 nt, Human
ccugauuuaggagaagcca

SEQ ID NO: 1450940 - RNA, 18 nt, Human
ccugauuuaggagaagcc

SEQ ID NO: 1450941 - RNA, 16 nt, Human
ccugauuuuuuuuccu

SEQ ID NO: 1450942 - RNA, 15 nt, Human
ccugcuuccugcuug

SEQ ID NO: 1450943 - RNA, 18 nt, Human
ccugcuuccugcuugcca

SEQ ID NO: 1450944 - RNA, 14 nt, Human
ccugcuuccugcuu

SEQ ID NO: 1450945 - RNA, 15 nt, Human
ccugcucccauccug

SEQ ID NO: 1450946 - RNA, 20 nt, Human
ccugcucccauccugugugu

SEQ ID NO: 1450947 - RNA, 16 nt, Human
ccugcuuuuuguguuu

SEQ ID NO: 1450948 - RNA, 14 nt, Human
ccuggaaaccuucc

SEQ ID NO: 1450949 - RNA, 23 nt, Human
ccugcuuggggggugaugagggc

SEQ ID NO: 1450950 - RNA, 22 nt, Human
ccugcuugccaaggcagaggcc

SEQ ID NO: 1450951 - RNA, 23 nt, Human
ccugcuugccaaggcagaggccu

SEQ ID NO: 1450952 - RNA, 21 nt, Human
ccugcuugccaaggcagaggc

SEQ ID NO: 1450953 - RNA, 18 nt, Human
ccugcuugccaaggcaga

SEQ ID NO: 1450954 - RNA, 17 nt, Human
ccugcuugccaaggcag

SEQ ID NO: 1450955 - RNA, 15 nt, Human
ccugcuugccaaggc

SEQ ID NO: 1450956 - RNA, 22 nt, Human
ccugcuugaugggauucuggac

SEQ ID NO: 1450957 - RNA, 21 nt, Human
ccugcuugaugggauucugga

SEQ ID NO: 1450958 - RNA, 17 nt, Human
ccugcuuuaaccacccc

SEQ ID NO: 1450959 - RNA, 19 nt, Human
ccugcuuuaaccaccccau

SEQ ID NO: 1450960 - RNA, 21 nt, Human
ccugcuuuaaccaccccaucu

SEQ ID NO: 1450961 - RNA, 22 nt, Human
ccugggagggacaugcuuagca

SEQ ID NO: 1450962 - RNA, 13 nt, Human
ccugggaggcucu

SEQ ID NO: 1450963 - RNA, 21 nt, Human
ccugggaggcucuggagccca

SEQ ID NO: 1450964 - RNA, 23 nt, Human
ccugggauucaggaaaaggccug

SEQ ID NO: 1450965 - RNA, 13 nt, Human
ccugggcaaagcc

SEQ ID NO: 1450966 - RNA, 18 nt, Human
ccugggauucaggaaaag

SEQ ID NO: 1450967 - RNA, 16 nt, Human
ccugggauucaggaaa

SEQ ID NO: 1450968 - RNA, 13 nt, Human
ccugggauuacag

SEQ ID NO: 1450969 - RNA, 21 nt, Human
ccugggaugagaguuuuggau

SEQ ID NO: 1450970 - RNA, 20 nt, Human
ccuggcccccucccuggaug

SEQ ID NO: 1450971 - RNA, 12 nt, Human
ccuggcccccuc

SEQ ID NO: 1450972 - RNA, 12 nt, Human
ccuggccagugc

SEQ ID NO: 1450973 - RNA, 16 nt, Human
ccuggccagugcccug

SEQ ID NO: 1450974 - RNA, 21 nt, Human
ccuggcucucaccucuagguc

SEQ ID NO: 1450975 - RNA, 16 nt, Human
ccuggcuauguccuaa

SEQ ID NO: 1450976 - RNA, 17 nt, Human
ccuggcucaccuugugc

SEQ ID NO: 1450977 - RNA, 19 nt, Human
ccuggcucucaccucuagg

SEQ ID NO: 1450978 - RNA, 17 nt, Human
ccuggcucucaccucua

SEQ ID NO: 1450979 - RNA, 15 nt, Human
ccuggcgccuggcag

SEQ ID NO: 1450980 - RNA, 13 nt, Human
ccuggcccccucc

SEQ ID NO: 1450981 - RNA, 12 nt, Human
ccuggcggggug

SEQ ID NO: 1450982 - RNA, 20 nt, Human
ccuggacagcugugccucgc

SEQ ID NO: 1450983 - RNA, 22 nt, Human
ccuggagcagaagcagcaacuu

SEQ ID NO: 1450984 - RNA, 17 nt, Human
ccuggagcagccacccc

SEQ ID NO: 1450985 - RNA, 18 nt, Human
ccuggagcagaccacccc

SEQ ID NO: 1450986 - RNA, 21 nt, Human
ccuggagcagaagcagcaacu

SEQ ID NO: 1450987 - RNA, 17 nt, Human
ccuggagcagaagcagc

SEQ ID NO: 1450988 - RNA, 15 nt, Human
ccuggagcagaagca

SEQ ID NO: 1450989 - RNA, 13 nt, Human
ccuggagcagaag

SEQ ID NO: 1450990 - RNA, 16 nt, Human
ccuggagcacaaagac

SEQ ID NO: 1450991 - RNA, 21 nt, Human
ccuggagaugacuugaggccu

SEQ ID NO: 1450992 - RNA, 21 nt, Human
ccuggagauccuccugcagac

SEQ ID NO: 1450993 - RNA, 14 nt, Human
ccuggacuguuuuc

SEQ ID NO: 1450994 - RNA, 24 nt, Human
ccuggacuuaagcaucuggcucua

SEQ ID NO: 1450995 - RNA, 20 nt, Human
ccuggacuuaagcaucuggc

SEQ ID NO: 1450996 - RNA, 19 nt, Human
ccuggacuuggccccugcc

SEQ ID NO: 1450997 - RNA, 19 nt, Human
ccuggaccucugacagcag

SEQ ID NO: 1450998 - RNA, 20 nt, Human
ccuggaccucugacagcagc

SEQ ID NO: 1450999 - RNA, 18 nt, Human
ccuggaccucugacagca

SEQ ID NO: 1451000 - RNA, 17 nt, Human
ccuggaccucugacagc

SEQ ID NO: 1451001 - RNA, 15 nt, Human
ccuggaccucugaca

SEQ ID NO: 1451002 - RNA, 12 nt, Human
ccuggaccucug

SEQ ID NO: 1451003 - RNA, 23 nt, Human
ccuggacccguucaugggggagg

SEQ ID NO: 1451004 - RNA, 22 nt, Human
ccuggacccguucaugggggag

SEQ ID NO: 1451005 - RNA, 17 nt, Human
ccuggacugugugcuca

SEQ ID NO: 1451006 - RNA, 20 nt, Human
ccuggacugugugcucagga

SEQ ID NO: 1451007 - RNA, 15 nt, Human
ccuggaccccugcau

SEQ ID NO: 1451008 - RNA, 14 nt, Human
ccuggaccccugca

SEQ ID NO: 1451009 - RNA, 13 nt, Human
ccuggaccccugc

SEQ ID NO: 1451010 - RNA, 24 nt, Human
ccuggaccccccuuucacaggcag

SEQ ID NO: 1451011 - RNA, 23 nt, Human
ccuggaccccccuuucacaggca

SEQ ID NO: 1451012 - RNA, 18 nt, Human
ccuggaccccccuuucac

SEQ ID NO: 1451013 - RNA, 16 nt, Human
ccuggaccagccucuc

SEQ ID NO: 1451014 - RNA, 15 nt, Human
ccuggaccagccucu

SEQ ID NO: 1451015 - RNA, 14 nt, Human
ccuggaccagccuc

SEQ ID NO: 1451016 - RNA, 24 nt, Human
ccuggacaugaagauucuuuccca

SEQ ID NO: 1451017 - RNA, 23 nt, Human
ccuggacaugaagauucuuuccc

SEQ ID NO: 1451018 - RNA, 21 nt, Human
ccuggacaugaagauucuuuc

SEQ ID NO: 1451019 - RNA, 22 nt, Human
ccuggacagcugugccucgcuc

SEQ ID NO: 1451020 - RNA, 21 nt, Human
ccuggacagcugugccucgcu

SEQ ID NO: 1451021 - RNA, 17 nt, Human
ccuggaaaccuuccacc

SEQ ID NO: 1451022 - RNA, 18 nt, Human
ccuggaaaccuuccaccc

SEQ ID NO: 1451023 - RNA, 20 nt, Human
ccuggaaaccuuccacccag

SEQ ID NO: 1451024 - RNA, 23 nt, Human
cggcuggggucccagcagcugcc

SEQ ID NO: 1451025 - RNA, 18 nt, Human
cggcuggggucccagcag

SEQ ID NO: 1451026 - RNA, 16 nt, Human
cggcuggggucccagc

SEQ ID NO: 1451027 - RNA, 15 nt, Human
cggccuuucuagccu

SEQ ID NO: 1451028 - RNA, 23 nt, Human
cggcugggaggagggcaggcauc

SEQ ID NO: 1451029 - RNA, 22 nt, Human
cggcugggaggagggcaggcau

SEQ ID NO: 1451030 - RNA, 16 nt, Human
cgggagcucaggaacc

SEQ ID NO: 1451031 - RNA, 20 nt, Human
cggcccauccccaggcaccu

SEQ ID NO: 1451032 - RNA, 19 nt, Human
cggcaggggccuggagauc

SEQ ID NO: 1451033 - RNA, 18 nt, Human
cggcaggggccuggagau

SEQ ID NO: 1451034 - RNA, 17 nt, Human
cggcaggggccuggaga

SEQ ID NO: 1451035 - RNA, 15 nt, Human
cggcaggggccugga

SEQ ID NO: 1451036 - RNA, 17 nt, Human
cggccccuccccuccaa

SEQ ID NO: 1451037 - RNA, 14 nt, Human
cggccccucccccu

SEQ ID NO: 1451038 - RNA, 22 nt, Human
cggccugccaggaggacccagg

SEQ ID NO: 1451039 - RNA, 20 nt, Human
cggccugcccccaccccauu

SEQ ID NO: 1451040 - RNA, 15 nt, Human
cggccugccaggagg

SEQ ID NO: 1451041 - RNA, 14 nt, Human
cggccugccaggag

SEQ ID NO: 1451042 - RNA, 13 nt, Human
cggccugccagga

SEQ ID NO: 1451043 - RNA, 15 nt, Human
cggccuguccuccaa

SEQ ID NO: 1451044 - RNA, 12 nt, Human
cggccuguccuc

SEQ ID NO: 1451045 - RNA, 21 nt, Human
cggccuguccuccaacaccaa

SEQ ID NO: 1451046 - RNA, 14 nt, Human
cggcaggggccugg

SEQ ID NO: 1451047 - RNA, 23 nt, Human
cggcagggcgggcagagggcugg

SEQ ID NO: 1451048 - RNA, 22 nt, Human
cggcagggcgggcagagggcug

SEQ ID NO: 1451049 - RNA, 20 nt, Human
cggcagggcgggcagagggc

SEQ ID NO: 1451050 - RNA, 11 nt, Human
cggcaggacac

SEQ ID NO: 1451051 - RNA, 19 nt, Human
cggcacagggucugcucuu

SEQ ID NO: 1451052 - RNA, 18 nt, Human
cggcacagggucugcucu

SEQ ID NO: 1451053 - RNA, 14 nt, Human
cggcacagggucug

SEQ ID NO: 1451054 - RNA, 17 nt, Human
cggauuuuuuccaaaau

SEQ ID NO: 1451055 - RNA, 12 nt, Human
cggcaacaucaa

SEQ ID NO: 1451056 - RNA, 16 nt, Human
cggauuuuuuccaaaa

SEQ ID NO: 1451057 - RNA, 13 nt, Human
cggauuuuuucca

SEQ ID NO: 1451058 - RNA, 24 nt, Human
cggauuccaaagaguagaauugca

SEQ ID NO: 1451059 - RNA, 16 nt, Human
cggacgcccaggaccc

SEQ ID NO: 1451060 - RNA, 13 nt, Human
cggaccagccugg

SEQ ID NO: 1451061 - RNA, 14 nt, Human
cggaccagccuggc

SEQ ID NO: 1451062 - RNA, 17 nt, Human
cggaccagccuggccca

SEQ ID NO: 1451063 - RNA, 15 nt, Human
cggaccccagccauc

SEQ ID NO: 1451064 - RNA, 19 nt, Human
cggauccuaagcaucuaag

SEQ ID NO: 1451065 - RNA, 21 nt, Human
cggacuuagaaaaccagcuca

SEQ ID NO: 1451066 - RNA, 20 nt, Human
cggauccuaagcaucuaagu

SEQ ID NO: 1451067 - RNA, 14 nt, Human
cgcucucuccaggc

SEQ ID NO: 1451068 - RNA, 14 nt, Human
cgcucucaguucuc

SEQ ID NO: 1451069 - RNA, 18 nt, Human
cggaaagaagagcgagag

SEQ ID NO: 1451070 - RNA, 12 nt, Human
cggaaagaagag

SEQ ID NO: 1451071 - RNA, 16 nt, Human
cgcuauuccagcuguc

SEQ ID NO: 1451072 - RNA, 18 nt, Human
cgcuaucugggaagcuau

SEQ ID NO: 1451073 - RNA, 21 nt, Human
cgcuaucucccugccuccugc

SEQ ID NO: 1451074 - RNA, 20 nt, Human
cggacaagacccccagcacu

SEQ ID NO: 1451075 - RNA, 18 nt, Human
cggacaagacccccagca

SEQ ID NO: 1451076 - RNA, 16 nt, Human
cggacaagacccccag

SEQ ID NO: 1451077 - RNA, 22 nt, Human
cggacaaaaccccccagauauc

SEQ ID NO: 1451078 - RNA, 22 nt, Human
cggaauccugucgauuagacug

SEQ ID NO: 1451079 - RNA, 21 nt, Human
cggaauccugucgauuagacu

SEQ ID NO: 1451080 - RNA, 21 nt, Human
cggaagaagagaucaggaaga

SEQ ID NO: 1451081 - RNA, 22 nt, Human
cggaagaagagaucaggaagag

SEQ ID NO: 1451082 - RNA, 14 nt, Human
cgcccccuccucua

SEQ ID NO: 1451083 - RNA, 20 nt, Human
cgcccccuccgcccugccac

SEQ ID NO: 1451084 - RNA, 19 nt, Human
cgcccccuccgcccugcca

SEQ ID NO: 1451085 - RNA, 17 nt, Human
cgcccccuccgcccugc

SEQ ID NO: 1451086 - RNA, 14 nt, Human
cgcccugccacuca

SEQ ID NO: 1451087 - RNA, 11 nt, Human
cgcccugccac

SEQ ID NO: 1451088 - RNA, 20 nt, Human
cgcccugcagacccugcccu

SEQ ID NO: 1451089 - RNA, 16 nt, Human
cgcccugcagacccug

SEQ ID NO: 1451090 - RNA, 15 nt, Human
cgcccugcagacccu

SEQ ID NO: 1451091 - RNA, 12 nt, Human
cgcccugcagac

SEQ ID NO: 1451092 - RNA, 11 nt, Human
cgcccugcaga

SEQ ID NO: 1451093 - RNA, 16 nt, Human
cgcccagcuccugaca

SEQ ID NO: 1451094 - RNA, 14 nt, Human
cgcccaggacccca

SEQ ID NO: 1451095 - RNA, 22 nt, Human
cgcccagcuccugacacugcug

SEQ ID NO: 1451096 - RNA, 15 nt, Human
cgcccagcuccugac

SEQ ID NO: 1451097 - RNA, 17 nt, Human
cgcagacaccuuggaca

SEQ ID NO: 1451098 - RNA, 13 nt, Human
cgcagaaggaagg

SEQ ID NO: 1451099 - RNA, 16 nt, Human
cgcgucuuccugagug

SEQ ID NO: 1451100 - RNA, 14 nt, Human
cgcgucuuccugag

SEQ ID NO: 1451101 - RNA, 13 nt, Human
cgcgucuuccuga

SEQ ID NO: 1451102 - RNA, 12 nt, Human
cgcgucuuccug

SEQ ID NO: 1451103 - RNA, 16 nt, Human
cgcgucuacccuggga

SEQ ID NO: 1451104 - RNA, 17 nt, Human
cgcgucuacccugggau

SEQ ID NO: 1451105 - RNA, 15 nt, Human
cgcgucuacccuggg

SEQ ID NO: 1451106 - RNA, 14 nt, Human
cgcgucuacccugg

SEQ ID NO: 1451107 - RNA, 22 nt, Human
cgcgacuaauuucaaaaugcuu

SEQ ID NO: 1451108 - RNA, 21 nt, Human
cgcccugcagacccugcccuu

SEQ ID NO: 1451109 - RNA, 13 nt, Human
cgcccagcuccug

SEQ ID NO: 1451110 - RNA, 12 nt, Human
cgcccugccacu

SEQ ID NO: 1451111 - RNA, 15 nt, Human
cgcgacuaauuucaa

SEQ ID NO: 1451112 - RNA, 14 nt, Human
cgcgaucucagcuc

SEQ ID NO: 1451113 - RNA, 14 nt, Human
cgcgauguggaacu

SEQ ID NO: 1451114 - RNA, 15 nt, Human
cgcgaucucagcuca

SEQ ID NO: 1451115 - RNA, 20 nt, Human
cgcuagcaguggcaggcaga

SEQ ID NO: 1451116 - RNA, 15 nt, Human
cgcuagcaguggcag

SEQ ID NO: 1451117 - RNA, 14 nt, Human
cgcuagcaguggca

SEQ ID NO: 1451118 - RNA, 18 nt, Human
cgcuagaggaagcagcca

SEQ ID NO: 1451119 - RNA, 20 nt, Human
cgcuacuaugauuuaauuug

SEQ ID NO: 1451120 - RNA, 16 nt, Human
ccuuugcugcauggca

SEQ ID NO: 1451121 - RNA, 23 nt, Human
ccuuugcgcuccuggcccagccu

SEQ ID NO: 1451122 - RNA, 16 nt, Human
ccuuugcccagaaaga

SEQ ID NO: 1451123 - RNA, 13 nt, Human
ccuuugccaggug

SEQ ID NO: 1451124 - RNA, 23 nt, Human
ccuuugcugugaggcuguccugu

SEQ ID NO: 1451125 - RNA, 22 nt, Human
ccuuugcugugaggcuguccug

SEQ ID NO: 1451126 - RNA, 17 nt, Human
ccuuugcugugaggcug

SEQ ID NO: 1451127 - RNA, 13 nt, Human
ccuuugcugugag

SEQ ID NO: 1451128 - RNA, 18 nt, Human
ccuuuggcaggugcagcc

SEQ ID NO: 1451129 - RNA, 15 nt, Human
ccuuuggcagaguuc

SEQ ID NO: 1451130 - RNA, 19 nt, Human
ccuuuggcaggugcagccc

SEQ ID NO: 1451131 - RNA, 20 nt, Human
ccuuuggcaggugcagcccc

SEQ ID NO: 1451132 - RNA, 16 nt, Human
ccuuugaauccucucu

SEQ ID NO: 1451133 - RNA, 14 nt, Human
ccuuugaauccucu

SEQ ID NO: 1451134 - RNA, 12 nt, Human
ccuuucuuuucc

SEQ ID NO: 1451135 - RNA, 19 nt, Human
ccuuucuuuucccccuuug

SEQ ID NO: 1451136 - RNA, 12 nt, Human
ccuuucuuccgg

SEQ ID NO: 1451137 - RNA, 19 nt, Human
ccuuucuuccggccccucc

SEQ ID NO: 1451138 - RNA, 11 nt, Human
ccuuucuuccg

SEQ ID NO: 1451139 - RNA, 21 nt, Human
ccuuugauuaaagacuccagu

SEQ ID NO: 1451140 - RNA, 22 nt, Human
ccuuugagugcaguccugauca

SEQ ID NO: 1451141 - RNA, 19 nt, Human
ccuuugagugcaguccuga

SEQ ID NO: 1451142 - RNA, 20 nt, Human
ccuuugaauccucucucugu

SEQ ID NO: 1451143 - RNA, 14 nt, Human
ccuuugacaaaggu

SEQ ID NO: 1451144 - RNA, 15 nt, Human
ccuuugaccugccuc

SEQ ID NO: 1451145 - RNA, 20 nt, Human
ccuuggcugacaugaagcug

SEQ ID NO: 1451146 - RNA, 15 nt, Human
ccuuggccaugcaga

SEQ ID NO: 1451147 - RNA, 17 nt, Human
ccuuggccaugcagaaa

SEQ ID NO: 1451148 - RNA, 14 nt, Human
ccuuguuuuuuucu

SEQ ID NO: 1451149 - RNA, 12 nt, Human
ccuuuaaaauuu

SEQ ID NO: 1451150 - RNA, 20 nt, Human
ccuuuaaaauuuuuuuagaa

SEQ ID NO: 1451151 - RNA, 21 nt, Human
ccuuuaaaauuuuuuuagaaa

SEQ ID NO: 1451152 - RNA, 19 nt, Human
ccuuguuuggggcaggagu

SEQ ID NO: 1451153 - RNA, 17 nt, Human
ccuuguuuggggcagga

SEQ ID NO: 1451154 - RNA, 16 nt, Human
ccuuguuuggggcagg

SEQ ID NO: 1451155 - RNA, 15 nt, Human
ccuuguuacuucuga

SEQ ID NO: 1451156 - RNA, 21 nt, Human
ccuuuaacaacauguuuccag

SEQ ID NO: 1451157 - RNA, 17 nt, Human
ccuuuaacaacauguuu

SEQ ID NO: 1451158 - RNA, 16 nt, Human
ccuuuaacaacauguu

SEQ ID NO: 1451159 - RNA, 16 nt, Human
ccuuguuuuggacagu

SEQ ID NO: 1451160 - RNA, 23 nt, Human
ccuuucuggauuauucugggggc

SEQ ID NO: 1451161 - RNA, 22 nt, Human
ccuuucucucuuuauacagcug

SEQ ID NO: 1451162 - RNA, 19 nt, Human
ccuuuaacugacaagccau

SEQ ID NO: 1451163 - RNA, 22 nt, Human
ccuuuaacaacauguuuccagc

SEQ ID NO: 1451164 - RNA, 20 nt, Human
ccuuuaacugacaagccauc

SEQ ID NO: 1451165 - RNA, 13 nt, Human
cgaggcugagaau

SEQ ID NO: 1451166 - RNA, 20 nt, Human
cgaggcugagaaucagacug

SEQ ID NO: 1451167 - RNA, 12 nt, Human
cgaggcugagaa

SEQ ID NO: 1451168 - RNA, 22 nt, Human
cgaggaaucugugggucuggga

SEQ ID NO: 1451169 - RNA, 16 nt, Human
cgaggaaucugugggu

SEQ ID NO: 1451170 - RNA, 10 nt, Human
cgagcuccuc

SEQ ID NO: 1451171 - RNA, 21 nt, Human
cgagcgcccugcagacccugc

SEQ ID NO: 1451172 - RNA, 20 nt, Human
cgagcgcccugcagacccug

SEQ ID NO: 1451173 - RNA, 19 nt, Human
cgagcgcccugcagacccu

SEQ ID NO: 1451174 - RNA, 16 nt, Human
cgagcgcccugcagac

SEQ ID NO: 1451175 - RNA, 15 nt, Human
cgagcgcccugcaga

SEQ ID NO: 1451176 - RNA, 15 nt, Human
ccuuuguauucucuc

SEQ ID NO: 1451177 - RNA, 18 nt, Human
ccuuuguauucucuccug

SEQ ID NO: 1451178 - RNA, 20 nt, Human
ccuuuguauucucuccugua

SEQ ID NO: 1451179 - RNA, 12 nt, Human
cgauuguaacuc

SEQ ID NO: 1451180 - RNA, 21 nt, Human
cgauucccucucccaggcccc

SEQ ID NO: 1451181 - RNA, 12 nt, Human
cgauuucuguuu

SEQ ID NO: 1451182 - RNA, 14 nt, Human
cgcaaguucccagu

SEQ ID NO: 1451183 - RNA, 14 nt, Human
cgcaagggccugau

SEQ ID NO: 1451184 - RNA, 12 nt, Human
cgcagaaggaag

SEQ ID NO: 1451185 - RNA, 16 nt, Human
cgauucucuugccuca

SEQ ID NO: 1451186 - RNA, 23 nt, Human
cgauucccucucccaggccccau

SEQ ID NO: 1451187 - RNA, 19 nt, Human
cgauucccucucccaggcc

SEQ ID NO: 1451188 - RNA, 18 nt, Human
cgaucuguaccugagagg

SEQ ID NO: 1451189 - RNA, 20 nt, Human
cgaucuugguucacugcaac

SEQ ID NO: 1451190 - RNA, 14 nt, Human
cgaucucccaccuu

SEQ ID NO: 1451191 - RNA, 13 nt, Human
cgaucucagcuca

SEQ ID NO: 1451192 - RNA, 18 nt, Human
cguggcucagccagcacu

SEQ ID NO: 1451193 - RNA, 15 nt, Human
cguggcucagccagc

SEQ ID NO: 1451194 - RNA, 14 nt, Human
cguggcucagccag

SEQ ID NO: 1451195 - RNA, 20 nt, Human
cguggccuuguucugucacc

SEQ ID NO: 1451196 - RNA, 22 nt, Human
cguggcccuuccuggacagcug

SEQ ID NO: 1451197 - RNA, 23 nt, Human
cguggccucuugagcaguggcug

SEQ ID NO: 1451198 - RNA, 16 nt, Human
cguggccucuugagca

SEQ ID NO: 1451199 - RNA, 15 nt, Human
cguggccucuugagc

SEQ ID NO: 1451200 - RNA, 20 nt, Human
cguggcccuuccuggacagc

SEQ ID NO: 1451201 - RNA, 18 nt, Human
cguggcccuuccuggaca

SEQ ID NO: 1451202 - RNA, 17 nt, Human
cguggcccuuccuggac

SEQ ID NO: 1451203 - RNA, 16 nt, Human
cguggcccuuccugga

SEQ ID NO: 1451204 - RNA, 15 nt, Human
cguggcccuuccugg

SEQ ID NO: 1451205 - RNA, 14 nt, Human
cguggcccuuccug

SEQ ID NO: 1451206 - RNA, 15 nt, Human
cgugccuguguccau

SEQ ID NO: 1451207 - RNA, 14 nt, Human
cgugccugugucca

SEQ ID NO: 1451208 - RNA, 12 nt, Human
cgugccuguguc

SEQ ID NO: 1451209 - RNA, 13 nt, Human
cguggccuuguuc

SEQ ID NO: 1451210 - RNA, 18 nt, Human
cguggcugcugugggaaa

SEQ ID NO: 1451211 - RNA, 21 nt, Human
cguucaugggggagggggcag

SEQ ID NO: 1451212 - RNA, 11 nt, Human
cguuuugucac

SEQ ID NO: 1451213 - RNA, 14 nt, Human
cguuuucuuaaagu

SEQ ID NO: 1451214 - RNA, 20 nt, Human
cguuuugaagcuacugugug

SEQ ID NO: 1451215 - RNA, 13 nt, Human
cguuuugaagcua

SEQ ID NO: 1451216 - RNA, 20 nt, Human
cguuuucuaauugcuuauuu

SEQ ID NO: 1451217 - RNA, 17 nt, Human
cguuuucuaauugcuua

SEQ ID NO: 1451218 - RNA, 15 nt, Human
cguuuucuaauugcu

SEQ ID NO: 1451219 - RNA, 12 nt, Human
cguuuucuaauu

SEQ ID NO: 1451220 - RNA, 17 nt, Human
cguuugaccuuuuaugu

SEQ ID NO: 1451221 - RNA, 14 nt, Human
cguuuccuuuguug

SEQ ID NO: 1451222 - RNA, 22 nt, Human
cguuucuccaccuagacuguaa

SEQ ID NO: 1451223 - RNA, 18 nt, Human
cguuucuccaccuagacu

SEQ ID NO: 1451224 - RNA, 12 nt, Human
cguuuccuaccg

SEQ ID NO: 1451225 - RNA, 20 nt, Human
cguuucuaugacacaugcaa

SEQ ID NO: 1451226 - RNA, 19 nt, Human
cguuucuaaaggcuaccuu

SEQ ID NO: 1451227 - RNA, 21 nt, Human
cguuucuaaaggcuaccuuug

SEQ ID NO: 1451228 - RNA, 12 nt, Human
cguucugugcac

SEQ ID NO: 1451229 - RNA, 13 nt, Human
cguucucucuuug

SEQ ID NO: 1451230 - RNA, 14 nt, Human
cguucugcucauca

SEQ ID NO: 1451231 - RNA, 19 nt, Human
cguucucucuuugcaugga

SEQ ID NO: 1451232 - RNA, 16 nt, Human
cguuccuuucuuuucc

SEQ ID NO: 1451233 - RNA, 23 nt, Human
cguuccuagagaagacaggcugg

SEQ ID NO: 1451234 - RNA, 22 nt, Human
cguuucauuuagucaugugacc

SEQ ID NO: 1451235 - RNA, 22 nt, Human
cguuucagcgacuccguuggcc

SEQ ID NO: 1451236 - RNA, 14 nt, Human
cguuuauuuucaag

SEQ ID NO: 1451237 - RNA, 15 nt, Human
cguuuauuuucaaga

SEQ ID NO: 1451238 - RNA, 14 nt, Human
cguucuuguaauuu

SEQ ID NO: 1451239 - RNA, 13 nt, Human
cguucuuguaauu

SEQ ID NO: 1451240 - RNA, 12 nt, Human
cguucuuguaau

SEQ ID NO: 1451241 - RNA, 15 nt, Human
cguucuuguaauuuu

SEQ ID NO: 1451242 - RNA, 18 nt, Human
cguucuuguaauuuuaca

SEQ ID NO: 1451243 - RNA, 18 nt, Human
cgugaaugggugcccaca

SEQ ID NO: 1451244 - RNA, 18 nt, Human
cgugcacgcacacugucu

SEQ ID NO: 1451245 - RNA, 23 nt, Human
cgugcauaccacuuuuguucuug

SEQ ID NO: 1451246 - RNA, 19 nt, Human
cgugcauaccacuuuuguu

SEQ ID NO: 1451247 - RNA, 14 nt, Human
cgugcauaccacuu

SEQ ID NO: 1451248 - RNA, 18 nt, Human
cgugcauaccacuuuugu

SEQ ID NO: 1451249 - RNA, 12 nt, Human
cgucuggguggc

SEQ ID NO: 1451250 - RNA, 17 nt, Human
cgucuggcccaccaggg

SEQ ID NO: 1451251 - RNA, 15 nt, Human
cgucuggaaguccaa

SEQ ID NO: 1451252 - RNA, 20 nt, Human
cgucucuuuuacccuggccc

SEQ ID NO: 1451253 - RNA, 21 nt, Human
cgucucuuuuacccuggcccc

SEQ ID NO: 1451254 - RNA, 16 nt, Human
cgucucggccuucaca

SEQ ID NO: 1451255 - RNA, 24 nt, Human
cgucucccccaacagcuggacccu

SEQ ID NO: 1451256 - RNA, 15 nt, Human
cgucuacccugggau

SEQ ID NO: 1451257 - RNA, 20 nt, Human
cgucucccccaacagcugga

SEQ ID NO: 1451258 - RNA, 19 nt, Human
cgucucccccaacagcugg

SEQ ID NO: 1451259 - RNA, 15 nt, Human
cgucggucugugccc

SEQ ID NO: 1451260 - RNA, 22 nt, Human
cguagauauuggacaaagaacc

SEQ ID NO: 1451261 - RNA, 23 nt, Human
cguagauauuggacaaagaaccu

SEQ ID NO: 1451262 - RNA, 13 nt, Human
cggugcucagggg

SEQ ID NO: 1451263 - RNA, 17 nt, Human
cggggcaucuggccugg

SEQ ID NO: 1451264 - RNA, 19 nt, Human
cggggcagcccccucacag

SEQ ID NO: 1451265 - RNA, 13 nt, Human
cggggcagccccc

SEQ ID NO: 1451266 - RNA, 14 nt, Human
cggggauguguccu

SEQ ID NO: 1451267 - RNA, 23 nt, Human
cggggauguguccugacacugca

SEQ ID NO: 1451268 - RNA, 15 nt, Human
cggggcaucuggccu

SEQ ID NO: 1451269 - RNA, 21 nt, Human
cguaggcuacagagaagccuu

SEQ ID NO: 1451270 - RNA, 23 nt, Human
cguaggcuacagagaagccuuca

SEQ ID NO: 1451271 - RNA, 20 nt, Human
cguaggcuacagagaagccu

SEQ ID NO: 1451272 - RNA, 19 nt, Human
cguaggcuacagagaagcc

SEQ ID NO: 1451273 - RNA, 17 nt, Human
cguaggcuacagagaag

SEQ ID NO: 1451274 - RNA, 16 nt, Human
cguaggcuacagagaa

SEQ ID NO: 1451275 - RNA, 15 nt, Human
cguaggcuacagaga

SEQ ID NO: 1451276 - RNA, 14 nt, Human
cguaggcuacagag

SEQ ID NO: 1451277 - RNA, 19 nt, Human
cguagcuauccggacagag

SEQ ID NO: 1451278 - RNA, 14 nt, Human
cguagaugauuuca

SEQ ID NO: 1451279 - RNA, 16 nt, Human
cguauaaaagccuguu

SEQ ID NO: 1451280 - RNA, 17 nt, Human
cguauaaaagccuguuu

SEQ ID NO: 1451281 - RNA, 21 nt, Human
cguauaaaagccuguuuaaga

SEQ ID NO: 1451282 - RNA, 22 nt, Human
cguauaaaagccuguuuaagag

SEQ ID NO: 1451283 - RNA, 19 nt, Human
cguccaggagccugugccu

SEQ ID NO: 1451284 - RNA, 22 nt, Human
cgucaugaggagauucugccuu

SEQ ID NO: 1451285 - RNA, 20 nt, Human
cgucaugcacaguauuugua

SEQ ID NO: 1451286 - RNA, 23 nt, Human
cguccaucacguuagcuguccca

SEQ ID NO: 1451287 - RNA, 21 nt, Human
cgucaugaggagauucugccu

SEQ ID NO: 1451288 - RNA, 14 nt, Human
cgucagugcugugc

SEQ ID NO: 1451289 - RNA, 19 nt, Human
cgucagcugggacaccccg

SEQ ID NO: 1451290 - RNA, 23 nt, Human
cguauuuaauagcaaagaauuga

SEQ ID NO: 1451291 - RNA, 21 nt, Human
cguauuuaauagcaaagaauu

SEQ ID NO: 1451292 - RNA, 15 nt, Human
cguauuuaauagcaa

SEQ ID NO: 1451293 - RNA, 19 nt, Human
cguaugucugguucucaau

SEQ ID NO: 1451294 - RNA, 18 nt, Human
cguaugucugguucucaa

SEQ ID NO: 1451295 - RNA, 15 nt, Human
cguaugucugguucu

SEQ ID NO: 1451296 - RNA, 21 nt, Human
cgucaccccuguuucuggcac

SEQ ID NO: 1451297 - RNA, 12 nt, Human
cgucaccucaga

SEQ ID NO: 1451298 - RNA, 18 nt, Human
cgucaccacgacuggcca

SEQ ID NO: 1451299 - RNA, 23 nt, Human
cgucaagagugaauucccucacu

SEQ ID NO: 1451300 - RNA, 22 nt, Human
cgucaagagugaauucccucac

SEQ ID NO: 1451301 - RNA, 21 nt, Human
cgucaaaacagauuguuugca

SEQ ID NO: 1451302 - RNA, 20 nt, Human
cgucaacucauauuuucaug

SEQ ID NO: 1451303 - RNA, 22 nt, Human
cgucaaaacagauuguuugcaa

SEQ ID NO: 1451304 - RNA, 16 nt, Human
cgucaacucauauuuu

SEQ ID NO: 1451305 - RNA, 21 nt, Human
cuccuaguucuucaucccacu

SEQ ID NO: 1451306 - RNA, 23 nt, Human
cuccuaguucuagaaaaacaggc

SEQ ID NO: 1451307 - RNA, 17 nt, Human
cuccuaguucuagaaaa

SEQ ID NO: 1451308 - RNA, 14 nt, Human
cuccuaguucuaga

SEQ ID NO: 1451309 - RNA, 15 nt, Human
cuccuaggcauucug

SEQ ID NO: 1451310 - RNA, 19 nt, Human
cuccuaggcauucuggacc

SEQ ID NO: 1451311 - RNA, 19 nt, Human
cucccuuucuaucguucuc

SEQ ID NO: 1451312 - RNA, 15 nt, Human
cucccuuucacuaaa

SEQ ID NO: 1451313 - RNA, 14 nt, Human
cucccuucuucccu

SEQ ID NO: 1451314 - RNA, 16 nt, Human
cucccuucuacagccu

SEQ ID NO: 1451315 - RNA, 10 nt, Human
cucccugggg

SEQ ID NO: 1451316 - RNA, 11 nt, Human
cucccuggggg

SEQ ID NO: 1451317 - RNA, 19 nt, Human
cucccauccuguguguuaa

SEQ ID NO: 1451318 - RNA, 16 nt, Human
cucccauccugugugu

SEQ ID NO: 1451319 - RNA, 15 nt, Human
cucccauccugugug

SEQ ID NO: 1451320 - RNA, 13 nt, Human
cucccauccugug

SEQ ID NO: 1451321 - RNA, 22 nt, Human
cucccagguguuaacauuccaa

SEQ ID NO: 1451322 - RNA, 21 nt, Human
cucccagguguuaacauucca

SEQ ID NO: 1451323 - RNA, 23 nt, Human
cuccugaccaguugcagucacuc

SEQ ID NO: 1451324 - RNA, 22 nt, Human
cuccugaccaguugcagucacu

SEQ ID NO: 1451325 - RNA, 16 nt, Human
cuccugaccaguugca

SEQ ID NO: 1451326 - RNA, 12 nt, Human
cuccugaccagu

SEQ ID NO: 1451327 - RNA, 18 nt, Human
cuccugacacugcuggag

SEQ ID NO: 1451328 - RNA, 17 nt, Human
cuccugacacugcugga

SEQ ID NO: 1451329 - RNA, 14 nt, Human
cuccugacacugcu

SEQ ID NO: 1451330 - RNA, 22 nt, Human
cuccugacacccuucucccacu

SEQ ID NO: 1451331 - RNA, 20 nt, Human
cuccugacacccuucuccca

SEQ ID NO: 1451332 - RNA, 18 nt, Human
cuccugacacccuucucc

SEQ ID NO: 1451333 - RNA, 17 nt, Human
cuccugacacccuucuc

SEQ ID NO: 1451334 - RNA, 23 nt, Human
cuccugaaaaaaaaccugagauu

SEQ ID NO: 1451335 - RNA, 22 nt, Human
cuccugaaaagguuuaugaaaa

SEQ ID NO: 1451336 - RNA, 21 nt, Human
cuccugaaaaaaaaccugaga

SEQ ID NO: 1451337 - RNA, 20 nt, Human
cuccugagaaaaaagguucc

SEQ ID NO: 1451338 - RNA, 15 nt, Human
cuccugaccucaggc

SEQ ID NO: 1451339 - RNA, 16 nt, Human
cuccugaccucaggca

SEQ ID NO: 1451340 - RNA, 15 nt, Human
cuccugaccucaagu

SEQ ID NO: 1451341 - RNA, 14 nt, Human
cuccugaccucagg

SEQ ID NO: 1451342 - RNA, 16 nt, Human
cuccugaggcuuugga

SEQ ID NO: 1451343 - RNA, 17 nt, Human
cuccugaggcuuuggau

SEQ ID NO: 1451344 - RNA, 19 nt, Human
cuccucuagcugugggggu

SEQ ID NO: 1451345 - RNA, 18 nt, Human
cuccucuagcuguggggg

SEQ ID NO: 1451346 - RNA, 17 nt, Human
cuccucuagcugugggg

SEQ ID NO: 1451347 - RNA, 19 nt, Human
cuccucacuguauccaggu

SEQ ID NO: 1451348 - RNA, 16 nt, Human
cuccucacuguaucca

SEQ ID NO: 1451349 - RNA, 14 nt, Human
cuccucacuguauc

SEQ ID NO: 1451350 - RNA, 16 nt, Human
cuccucccucccucuc

SEQ ID NO: 1451351 - RNA, 19 nt, Human
cucgacaugaaaauucaga

SEQ ID NO: 1451352 - RNA, 14 nt, Human
cucgaaucugugug

SEQ ID NO: 1451353 - RNA, 18 nt, Human
cucgaaucucugugccuu

SEQ ID NO: 1451354 - RNA, 17 nt, Human
cucgaaucucugugccu

SEQ ID NO: 1451355 - RNA, 16 nt, Human
cucgaaucucugugcc

SEQ ID NO: 1451356 - RNA, 15 nt, Human
cucgaaucucugugc

SEQ ID NO: 1451357 - RNA, 14 nt, Human
cucgaaucucugug

SEQ ID NO: 1451358 - RNA, 13 nt, Human
cucgaaucucugu

SEQ ID NO: 1451359 - RNA, 15 nt, Human
cucgccccuggcaga

SEQ ID NO: 1451360 - RNA, 14 nt, Human
cucgccccuggcag

SEQ ID NO: 1451361 - RNA, 14 nt, Human
cucgccccagcagg

SEQ ID NO: 1451362 - RNA, 19 nt, Human
cucgcccauccccuugagg

SEQ ID NO: 1451363 - RNA, 20 nt, Human
cucgauguggucacagcugu

SEQ ID NO: 1451364 - RNA, 22 nt, Human
cucgcauaggaccuuuccacca

SEQ ID NO: 1451365 - RNA, 24 nt, Human
cucgauguggucacagcuguauag

SEQ ID NO: 1451366 - RNA, 19 nt, Human
cucgauguggucacagcug

SEQ ID NO: 1451367 - RNA, 20 nt, Human
cucgccccuggcagagaugc

SEQ ID NO: 1451368 - RNA, 17 nt, Human
cucgccccuggcagaga

SEQ ID NO: 1451369 - RNA, 16 nt, Human
cucgccccuggcagag

SEQ ID NO: 1451370 - RNA, 16 nt, Human
cucgcggcccucagua

SEQ ID NO: 1451371 - RNA, 15 nt, Human
cucgcggcccucagu

SEQ ID NO: 1451372 - RNA, 22 nt, Human
cucgcuagcaguggcaggcaga

SEQ ID NO: 1451373 - RNA, 15 nt, Human
cucggccucccaaag

SEQ ID NO: 1451374 - RNA, 23 nt, Human
cucggcagcccuuccaaacucuu

SEQ ID NO: 1451375 - RNA, 14 nt, Human
cucggaucucuccu

SEQ ID NO: 1451376 - RNA, 13 nt, Human
cucggccugcccc

SEQ ID NO: 1451377 - RNA, 20 nt, Human
cucggccucccaaagugcug

SEQ ID NO: 1451378 - RNA, 18 nt, Human
cucggccucccaaagugc

SEQ ID NO: 1451379 - RNA, 22 nt, Human
cucuaaagucuguugauuaaag

SEQ ID NO: 1451380 - RNA, 17 nt, Human
cucggccuucacaaucu

SEQ ID NO: 1451381 - RNA, 11 nt, Human
cucggccugcc

SEQ ID NO: 1451382 - RNA, 17 nt, Human
cucuaaauucuuucauu

SEQ ID NO: 1451383 - RNA, 13 nt, Human
cucuaaauucuuu

SEQ ID NO: 1451384 - RNA, 14 nt, Human
cucuaacagcccuc

SEQ ID NO: 1451385 - RNA, 14 nt, Human
cucuaacagcacca

SEQ ID NO: 1451386 - RNA, 13 nt, Human
cucuaacagcacc

SEQ ID NO: 1451387 - RNA, 15 nt, Human
cucuaacaguggaca

SEQ ID NO: 1451388 - RNA, 19 nt, Human
cucuaacaguggacaaagu

SEQ ID NO: 1451389 - RNA, 21 nt, Human
cuccuugauuuuagccuucuc

SEQ ID NO: 1451390 - RNA, 22 nt, Human
cuccuugagggcaagagccaca

SEQ ID NO: 1451391 - RNA, 23 nt, Human
cuccuucugagcuccuguccccu

SEQ ID NO: 1451392 - RNA, 20 nt, Human
cuccuucugagcuccugucc

SEQ ID NO: 1451393 - RNA, 19 nt, Human
cuccuucugagcuccuguc

SEQ ID NO: 1451394 - RNA, 18 nt, Human
cuccuucugagcuccugu

SEQ ID NO: 1451395 - RNA, 16 nt, Human
cuccuucugagcuccu

SEQ ID NO: 1451396 - RNA, 14 nt, Human
cuccuucugagcuc

SEQ ID NO: 1451397 - RNA, 13 nt, Human
cuccuucugagcu

SEQ ID NO: 1451398 - RNA, 16 nt, Human
cuccuuccagcuagug

SEQ ID NO: 1451399 - RNA, 19 nt, Human
cuccuucaugacagccucc

SEQ ID NO: 1451400 - RNA, 14 nt, Human
cuccuuagaaaaaa

SEQ ID NO: 1451401 - RNA, 19 nt, Human
cuccugaggauguguccca

SEQ ID NO: 1451402 - RNA, 13 nt, Human
cuccugcccacgg

SEQ ID NO: 1451403 - RNA, 16 nt, Human
cuccuguugggagagg

SEQ ID NO: 1451404 - RNA, 14 nt, Human
cuccuguugggaga

SEQ ID NO: 1451405 - RNA, 13 nt, Human
cuccuguugggag

SEQ ID NO: 1451406 - RNA, 17 nt, Human
cuccugcccacggaguc

SEQ ID NO: 1451407 - RNA, 19 nt, Human
cuccuguuuugcacagcca

SEQ ID NO: 1451408 - RNA, 22 nt, Human
cuccuguugggagagggcgcag

SEQ ID NO: 1451409 - RNA, 24 nt, Human
cuccuguugggagagggcgcaggc

SEQ ID NO: 1451410 - RNA, 13 nt, Human
cuccuuaaggcuc

SEQ ID NO: 1451411 - RNA, 22 nt, Human
cuccuuaaggcucuuuuguaag

SEQ ID NO: 1451412 - RNA, 13 nt, Human
cuccuuagaaaaa

SEQ ID NO: 1451413 - RNA, 17 nt, Human
cuccauucugcuccuuc

SEQ ID NO: 1451414 - RNA, 16 nt, Human
cuccauucugcuccuu

SEQ ID NO: 1451415 - RNA, 15 nt, Human
cuccauucugcuccu

SEQ ID NO: 1451416 - RNA, 14 nt, Human
cuccauucugcucc

SEQ ID NO: 1451417 - RNA, 18 nt, Human
cucccaaggggccugagc

SEQ ID NO: 1451418 - RNA, 22 nt, Human
cucccaaguagcugggauuaca

SEQ ID NO: 1451419 - RNA, 19 nt, Human
cucccaaggggccugagca

SEQ ID NO: 1451420 - RNA, 21 nt, Human
cucccaggccccaugaccucc

SEQ ID NO: 1451421 - RNA, 19 nt, Human
cucccaggccccaugaccu

SEQ ID NO: 1451422 - RNA, 16 nt, Human
cucccaggccccauga

SEQ ID NO: 1451423 - RNA, 15 nt, Human
cucccaggccccaug

SEQ ID NO: 1451424 - RNA, 12 nt, Human
cucccaggcccc

SEQ ID NO: 1451425 - RNA, 17 nt, Human
cuccaggcccaaggcuc

SEQ ID NO: 1451426 - RNA, 16 nt, Human
cuccaggcccaaggcu

SEQ ID NO: 1451427 - RNA, 19 nt, Human
cuccaggcccaaggcuccc

SEQ ID NO: 1451428 - RNA, 12 nt, Human
cuccaggcccaa

SEQ ID NO: 1451429 - RNA, 11 nt, Human
cuccaggccca

SEQ ID NO: 1451430 - RNA, 16 nt, Human
cuccagcuccuuuggg

SEQ ID NO: 1451431 - RNA, 15 nt, Human
cuccagcucccugug

SEQ ID NO: 1451432 - RNA, 13 nt, Human
cuccagcucccug

SEQ ID NO: 1451433 - RNA, 17 nt, Human
cuccagcuccuuugggc

SEQ ID NO: 1451434 - RNA, 22 nt, Human
cuccagcucccugugcccccag

SEQ ID NO: 1451435 - RNA, 21 nt, Human
cuccagcucccugugccccca

SEQ ID NO: 1451436 - RNA, 17 nt, Human
cuccagcucccugugcc

SEQ ID NO: 1451437 - RNA, 21 nt, Human
cuccagccaucaagagacuga

SEQ ID NO: 1451438 - RNA, 20 nt, Human
cuccagccaucaagagacug

SEQ ID NO: 1451439 - RNA, 20 nt, Human
cuccagccugacaucaaaaa

SEQ ID NO: 1451440 - RNA, 13 nt, Human
cuccagccugaca

SEQ ID NO: 1451441 - RNA, 12 nt, Human
cuccagccugac

SEQ ID NO: 1451442 - RNA, 12 nt, Human
cuccagccucag

SEQ ID NO: 1451443 - RNA, 15 nt, Human
cuccagccucagccu

SEQ ID NO: 1451444 - RNA, 17 nt, Human
cuccagccucagccucc

SEQ ID NO: 1451445 - RNA, 14 nt, Human
cuccagccucagcu

SEQ ID NO: 1451446 - RNA, 15 nt, Human
cuccacucugcuucu

SEQ ID NO: 1451447 - RNA, 14 nt, Human
cuccacucugcuuc

SEQ ID NO: 1451448 - RNA, 13 nt, Human
cuccacucugcuu

SEQ ID NO: 1451449 - RNA, 12 nt, Human
cuccacucugcu

SEQ ID NO: 1451450 - RNA, 21 nt, Human
cuccacucugcuucucugacu

SEQ ID NO: 1451451 - RNA, 20 nt, Human
cuccacucugcuucucugac

SEQ ID NO: 1451452 - RNA, 17 nt, Human
cuccacucugcuucucu

SEQ ID NO: 1451453 - RNA, 16 nt, Human
cuccacucugcuucuc

SEQ ID NO: 1451454 - RNA, 14 nt, Human
cuccacucuuucuu

SEQ ID NO: 1451455 - RNA, 19 nt, Human
cuccacagcaaccccaggc

SEQ ID NO: 1451456 - RNA, 16 nt, Human
cuccacagcaacccca

SEQ ID NO: 1451457 - RNA, 15 nt, Human
cuccacacugcacaa

SEQ ID NO: 1451458 - RNA, 14 nt, Human
cuccacacugcaca

SEQ ID NO: 1451459 - RNA, 16 nt, Human
cuccacaccugcggcc

SEQ ID NO: 1451460 - RNA, 15 nt, Human
cuccacaccugcggc

SEQ ID NO: 1451461 - RNA, 13 nt, Human
cuccacaccugcg

SEQ ID NO: 1451462 - RNA, 16 nt, Human
cucauuuagccugucc

SEQ ID NO: 1451463 - RNA, 12 nt, Human
cuccacaccugc

SEQ ID NO: 1451464 - RNA, 14 nt, Human
cucauuuagccugu

SEQ ID NO: 1451465 - RNA, 19 nt, Human
cucauuuaauccucccuuc

SEQ ID NO: 1451466 - RNA, 22 nt, Human
cucauuuaauccucccuuccuc

SEQ ID NO: 1451467 - RNA, 13 nt, Human
cucauuuaauccu

SEQ ID NO: 1451468 - RNA, 19 nt, Human
cucauugucuguguagagu

SEQ ID NO: 1451469 - RNA, 20 nt, Human
cuccacauauuucagugagg

SEQ ID NO: 1451470 - RNA, 15 nt, Human
cuccacagcugccuc

SEQ ID NO: 1451471 - RNA, 17 nt, Human
cucauacacucguauga

SEQ ID NO: 1451472 - RNA, 20 nt, Human
cucauaacuugagaccuaau

SEQ ID NO: 1451473 - RNA, 17 nt, Human
cucauaacuugagaccu

SEQ ID NO: 1451474 - RNA, 14 nt, Human
cucauaacuugaga

SEQ ID NO: 1451475 - RNA, 17 nt, Human
cucauaacggaucagaa

SEQ ID NO: 1451476 - RNA, 19 nt, Human
cucauaacggaucagaaau

SEQ ID NO: 1451477 - RNA, 21 nt, Human
cucauaacggaucagaaauac

SEQ ID NO: 1451478 - RNA, 20 nt, Human
cucaggucccuggggcuagg

SEQ ID NO: 1451479 - RNA, 19 nt, Human
cucaggucacauaaaacuu

SEQ ID NO: 1451480 - RNA, 15 nt, Human
cucagguacuuguaa

SEQ ID NO: 1451481 - RNA, 21 nt, Human
cucaggggucugagcuccagc

SEQ ID NO: 1451482 - RNA, 23 nt, Human
cucagggggcgccugugguucug

SEQ ID NO: 1451483 - RNA, 19 nt, Human
cucagggggcgccuguggu

SEQ ID NO: 1451484 - RNA, 14 nt, Human
cucagggggcgccu

SEQ ID NO: 1451485 - RNA, 19 nt, Human
cuaaaagugggcuugauuc

SEQ ID NO: 1451486 - RNA, 17 nt, Human
cucaggggccugcccag

SEQ ID NO: 1451487 - RNA, 18 nt, Human
cucaggggcccuggagca

SEQ ID NO: 1451488 - RNA, 19 nt, Human
cucaggggcccuggagcag

SEQ ID NO: 1451489 - RNA, 21 nt, Human
cucaggggcccuggagcagcc

SEQ ID NO: 1451490 - RNA, 20 nt, Human
cguuuuuuuuuuguuuguug

SEQ ID NO: 1451491 - RNA, 17 nt, Human
cuaaaagauauaagugc

SEQ ID NO: 1451492 - RNA, 20 nt, Human
cuaaaagauauaagugcugu

SEQ ID NO: 1451493 - RNA, 21 nt, Human
cuaaaagauauaagugcugua

SEQ ID NO: 1451494 - RNA, 15 nt, Human
cguuuuuuucauucc

SEQ ID NO: 1451495 - RNA, 17 nt, Human
cguuuuuuaaauguaua

SEQ ID NO: 1451496 - RNA, 15 nt, Human
cucauuguaaacaaa

SEQ ID NO: 1451497 - RNA, 22 nt, Human
cucauuggaaauuuagcauugu

SEQ ID NO: 1451498 - RNA, 18 nt, Human
cucauuggacccuuccau

SEQ ID NO: 1451499 - RNA, 17 nt, Human
cucauuggacccuucca

SEQ ID NO: 1451500 - RNA, 13 nt, Human
cucauuggacccu

SEQ ID NO: 1451501 - RNA, 20 nt, Human
cucauuggaaauuuagcauu

SEQ ID NO: 1451502 - RNA, 19 nt, Human
cucauuggaaauuuagcau

SEQ ID NO: 1451503 - RNA, 18 nt, Human
cucauuggaaauuuagca

SEQ ID NO: 1451504 - RNA, 16 nt, Human
cucauuggaaauuuag

SEQ ID NO: 1451505 - RNA, 19 nt, Human
cucauugcuuacaagccua

SEQ ID NO: 1451506 - RNA, 22 nt, Human
cucauuauuuauguccaggugu

SEQ ID NO: 1451507 - RNA, 21 nt, Human
cucauuauuuauguccaggug

SEQ ID NO: 1451508 - RNA, 14 nt, Human
cucauuagacugga

SEQ ID NO: 1451509 - RNA, 18 nt, Human
cucaucucagugaagaau

SEQ ID NO: 1451510 - RNA, 11 nt, Human
cucaucucagu

SEQ ID NO: 1451511 - RNA, 17 nt, Human
cucaucuccccaucauu

SEQ ID NO: 1451512 - RNA, 14 nt, Human
cucauccugcaggc

SEQ ID NO: 1451513 - RNA, 21 nt, Human
cucaucuagguaaauuacagu

SEQ ID NO: 1451514 - RNA, 13 nt, Human
cucauccugcagg

SEQ ID NO: 1451515 - RNA, 19 nt, Human
cucauccaucaucaugugu

SEQ ID NO: 1451516 - RNA, 16 nt, Human
cucauccaucaucaug

SEQ ID NO: 1451517 - RNA, 22 nt, Human
cucauccacucuacuaaugccu

SEQ ID NO: 1451518 - RNA, 24 nt, Human
cucauccaccccaucccuccccag

SEQ ID NO: 1451519 - RNA, 19 nt, Human
cucauccaccccaucccuc

SEQ ID NO: 1451520 - RNA, 16 nt, Human
cucauccaccccaucc

SEQ ID NO: 1451521 - RNA, 15 nt, Human
cucauccaccccauc

SEQ ID NO: 1451522 - RNA, 13 nt, Human
cucauccacccca

SEQ ID NO: 1451523 - RNA, 13 nt, Human
cucauauugugau

SEQ ID NO: 1451524 - RNA, 21 nt, Human
cucauauugugauucugccuu

SEQ ID NO: 1451525 - RNA, 19 nt, Human
cucauauugugauucugcc

SEQ ID NO: 1451526 - RNA, 20 nt, Human
cucauccacauacccugacc

SEQ ID NO: 1451527 - RNA, 18 nt, Human
cucauccacauacccuga

SEQ ID NO: 1451528 - RNA, 22 nt, Human
cucauaacucugugaucuugcu

SEQ ID NO: 1451529 - RNA, 23 nt, Human
cucaucauucucugucucaucca

SEQ ID NO: 1451530 - RNA, 13 nt, Human
cucaucaacugaa

SEQ ID NO: 1451531 - RNA, 14 nt, Human
cucauauuuucaug

SEQ ID NO: 1451532 - RNA, 22 nt, Human
cucugaggcgccccaacccgug

SEQ ID NO: 1451533 - RNA, 23 nt, Human
cucugaggcgccccaacccgugg

SEQ ID NO: 1451534 - RNA, 21 nt, Human
cucugaggcgccccaacccgu

SEQ ID NO: 1451535 - RNA, 19 nt, Human
cucugaggcgccccaaccc

SEQ ID NO: 1451536 - RNA, 12 nt, Human
cucugaggcgcc

SEQ ID NO: 1451537 - RNA, 10 nt, Human
cucugaggcg

SEQ ID NO: 1451538 - RNA, 21 nt, Human
cucugaggccagccuggccuc

SEQ ID NO: 1451539 - RNA, 20 nt, Human
cucugaggccagccuggccu

SEQ ID NO: 1451540 - RNA, 19 nt, Human
cucugaggccagccuggcc

SEQ ID NO: 1451541 - RNA, 18 nt, Human
cucugaggccagccuggc

SEQ ID NO: 1451542 - RNA, 17 nt, Human
cucugaggccagccugg

SEQ ID NO: 1451543 - RNA, 16 nt, Human
cucugaggccagccug

SEQ ID NO: 1451544 - RNA, 15 nt, Human
cucugaggccagccu

SEQ ID NO: 1451545 - RNA, 14 nt, Human
cucugaggccagcc

SEQ ID NO: 1451546 - RNA, 13 nt, Human
cucugaggccagc

SEQ ID NO: 1451547 - RNA, 19 nt, Human
cucugagcugucaacgaga

SEQ ID NO: 1451548 - RNA, 15 nt, Human
cucugagcugucaac

SEQ ID NO: 1451549 - RNA, 15 nt, Human
cucugagcugugcag

SEQ ID NO: 1451550 - RNA, 13 nt, Human
cucugagcuguca

SEQ ID NO: 1451551 - RNA, 11 nt, Human
cucugagcugu

SEQ ID NO: 1451552 - RNA, 13 nt, Human
cucugagcgccuc

SEQ ID NO: 1451553 - RNA, 13 nt, Human
cucugagcaguga

SEQ ID NO: 1451554 - RNA, 22 nt, Human
cucugagagucuagauucucug

SEQ ID NO: 1451555 - RNA, 19 nt, Human
cucugagagucuagauucu

SEQ ID NO: 1451556 - RNA, 23 nt, Human
cucugagacuccagaccugaggc

SEQ ID NO: 1451557 - RNA, 18 nt, Human
cucugagagucuagauuc

SEQ ID NO: 1451558 - RNA, 22 nt, Human
cucucugcucugcgugucaccu

SEQ ID NO: 1451559 - RNA, 14 nt, Human
cucucugcucugcg

SEQ ID NO: 1451560 - RNA, 12 nt, Human
cucucugcucug

SEQ ID NO: 1451561 - RNA, 17 nt, Human
cucucugcccuugauca

SEQ ID NO: 1451562 - RNA, 21 nt, Human
cucugacuucugccuggagac

SEQ ID NO: 1451563 - RNA, 19 nt, Human
cucugacuucugccuggag

SEQ ID NO: 1451564 - RNA, 18 nt, Human
cucugacuucugccugga

SEQ ID NO: 1451565 - RNA, 17 nt, Human
cucugacuucugccugg

SEQ ID NO: 1451566 - RNA, 16 nt, Human
cucugacuucugccug

SEQ ID NO: 1451567 - RNA, 15 nt, Human
cucugacuucugccu

SEQ ID NO: 1451568 - RNA, 14 nt, Human
cucugacuucugcc

SEQ ID NO: 1451569 - RNA, 13 nt, Human
cucugacuucugc

SEQ ID NO: 1451570 - RNA, 10 nt, Human
cucugagaac

SEQ ID NO: 1451571 - RNA, 15 nt, Human
cucugagacuccaga

SEQ ID NO: 1451572 - RNA, 14 nt, Human
cucugagacuccag

SEQ ID NO: 1451573 - RNA, 23 nt, Human
cucugagaauuguugagauacuu

SEQ ID NO: 1451574 - RNA, 20 nt, Human
cucugagaauuguugagaua

SEQ ID NO: 1451575 - RNA, 19 nt, Human
cucugauuuucaaagcuuu

SEQ ID NO: 1451576 - RNA, 18 nt, Human
cucugauuuucaaagcuu

SEQ ID NO: 1451577 - RNA, 15 nt, Human
cucugauuuucaaag

SEQ ID NO: 1451578 - RNA, 20 nt, Human
cucugaugcaucagaaaggg

SEQ ID NO: 1451579 - RNA, 15 nt, Human
cucugaugcaucaga

SEQ ID NO: 1451580 - RNA, 18 nt, Human
cucugaugcagcuuauac

SEQ ID NO: 1451581 - RNA, 14 nt, Human
cucugaugcagcuu

SEQ ID NO: 1451582 - RNA, 13 nt, Human
cucugaugcagcu

SEQ ID NO: 1451583 - RNA, 23 nt, Human
cucugaugaaaaauugcugacug

SEQ ID NO: 1451584 - RNA, 20 nt, Human
cucugauuuucaaagcuuuu

SEQ ID NO: 1451585 - RNA, 22 nt, Human
cucugauuuucaaagcuuuuuc

SEQ ID NO: 1451586 - RNA, 22 nt, Human
cucugaucccucuacagagcuu

SEQ ID NO: 1451587 - RNA, 21 nt, Human
cucugaucccucuacagagcu

SEQ ID NO: 1451588 - RNA, 12 nt, Human
cucugaucccuc

SEQ ID NO: 1451589 - RNA, 22 nt, Human
cucugaugaaaaauugcugacu

SEQ ID NO: 1451590 - RNA, 14 nt, Human
cucugaugaaaaau

SEQ ID NO: 1451591 - RNA, 20 nt, Human
cucugaggggcuaccaggaa

SEQ ID NO: 1451592 - RNA, 21 nt, Human
cucugaggggcuaccaggaaa

SEQ ID NO: 1451593 - RNA, 17 nt, Human
cucugcaauuccccucu

SEQ ID NO: 1451594 - RNA, 16 nt, Human
cucugcaauuccccuc

SEQ ID NO: 1451595 - RNA, 15 nt, Human
cucugcaauuccccu

SEQ ID NO: 1451596 - RNA, 21 nt, Human
cucugcaauuccccucugcug

SEQ ID NO: 1451597 - RNA, 20 nt, Human
cucugcaauuccccucugcu

SEQ ID NO: 1451598 - RNA, 19 nt, Human
cucugcaauuccccucugc

SEQ ID NO: 1451599 - RNA, 18 nt, Human
cucugcaauuccccucug

SEQ ID NO: 1451600 - RNA, 22 nt, Human
cucugcagucucuauaccaaua

SEQ ID NO: 1451601 - RNA, 23 nt, Human
cucugcaggucccuaauaaagcu

SEQ ID NO: 1451602 - RNA, 23 nt, Human
cucugcaauuccccucugcugcu

SEQ ID NO: 1451603 - RNA, 22 nt, Human
cucugcaauuccccucugcugc

SEQ ID NO: 1451604 - RNA, 15 nt, Human
cucugcagucccagc

SEQ ID NO: 1451605 - RNA, 14 nt, Human
cucugcagucucua

SEQ ID NO: 1451606 - RNA, 14 nt, Human
cucugcccaggcac

SEQ ID NO: 1451607 - RNA, 19 nt, Human
cucugcccaggcacugcua

SEQ ID NO: 1451608 - RNA, 21 nt, Human
cucugcccuugaucagcccca

SEQ ID NO: 1451609 - RNA, 14 nt, Human
cucuggaauuugaa

SEQ ID NO: 1451610 - RNA, 15 nt, Human
cucuggacagcccca

SEQ ID NO: 1451611 - RNA, 18 nt, Human
cucuggacagccccaccc

SEQ ID NO: 1451612 - RNA, 21 nt, Human
cucuggagaaagggcccuggg

SEQ ID NO: 1451613 - RNA, 15 nt, Human
cucuggagcauuucu

SEQ ID NO: 1451614 - RNA, 14 nt, Human
cucuggagcauuuc

SEQ ID NO: 1451615 - RNA, 12 nt, Human
cucuggagccca

SEQ ID NO: 1451616 - RNA, 13 nt, Human
cucucgcacaccu

SEQ ID NO: 1451617 - RNA, 15 nt, Human
cucucgcacaccucu

SEQ ID NO: 1451618 - RNA, 11 nt, Human
cucuccccagc

SEQ ID NO: 1451619 - RNA, 22 nt, Human
cucuccuguaccucuugagccu

SEQ ID NO: 1451620 - RNA, 17 nt, Human
cucuccuguaccucuug

SEQ ID NO: 1451621 - RNA, 18 nt, Human
cucuccuguaccucuuga

SEQ ID NO: 1451622 - RNA, 21 nt, Human
cucuccccacgagggcuggcu

SEQ ID NO: 1451623 - RNA, 19 nt, Human
cucuccccacgagggcugg

SEQ ID NO: 1451624 - RNA, 18 nt, Human
cucuccccacgagggcug

SEQ ID NO: 1451625 - RNA, 13 nt, Human
cucuccuguaccu

SEQ ID NO: 1451626 - RNA, 14 nt, Human
cucuccuguaccuc

SEQ ID NO: 1451627 - RNA, 15 nt, Human
cucuccuguaccucu

SEQ ID NO: 1451628 - RNA, 16 nt, Human
cucucuacagucucgu

SEQ ID NO: 1451629 - RNA, 18 nt, Human
cucucuacagucucgucu

SEQ ID NO: 1451630 - RNA, 14 nt, Human
cucucuacagucuc

SEQ ID NO: 1451631 - RNA, 19 nt, Human
cucucuacaaacucccacu

SEQ ID NO: 1451632 - RNA, 19 nt, Human
cucucggguugugugucug

SEQ ID NO: 1451633 - RNA, 18 nt, Human
cucucggcuccccaugug

SEQ ID NO: 1451634 - RNA, 17 nt, Human
cucucggcuccccaugu

SEQ ID NO: 1451635 - RNA, 16 nt, Human
cucucggcuccccaug

SEQ ID NO: 1451636 - RNA, 15 nt, Human
cucucggcuccccau

SEQ ID NO: 1451637 - RNA, 14 nt, Human
cucucggcucccca

SEQ ID NO: 1451638 - RNA, 12 nt, Human
cucucugcaggu

SEQ ID NO: 1451639 - RNA, 13 nt, Human
cucucugcagguc

SEQ ID NO: 1451640 - RNA, 14 nt, Human
cucucugcaggucc

SEQ ID NO: 1451641 - RNA, 16 nt, Human
cucucugcaggucccu

SEQ ID NO: 1451642 - RNA, 17 nt, Human
cucucugcaggucccua

SEQ ID NO: 1451643 - RNA, 19 nt, Human
cucucugcaggucccuaau

SEQ ID NO: 1451644 - RNA, 22 nt, Human
cucucugcaggucccuaauaaa

SEQ ID NO: 1451645 - RNA, 12 nt, Human
cucucccaguug

SEQ ID NO: 1451646 - RNA, 16 nt, Human
cucucccaggccccau

SEQ ID NO: 1451647 - RNA, 14 nt, Human
cucucccaggcccc

SEQ ID NO: 1451648 - RNA, 13 nt, Human
cucucccaggccc

SEQ ID NO: 1451649 - RNA, 12 nt, Human
cucucccaggcc

SEQ ID NO: 1451650 - RNA, 14 nt, Human
cucucccaggcagg

SEQ ID NO: 1451651 - RNA, 13 nt, Human
cucucccaggcag

SEQ ID NO: 1451652 - RNA, 21 nt, Human
cucucccacccucuuccuacu

SEQ ID NO: 1451653 - RNA, 19 nt, Human
cucucccacccucuuccua

SEQ ID NO: 1451654 - RNA, 17 nt, Human
cucucccacccucuucc

SEQ ID NO: 1451655 - RNA, 16 nt, Human
cucucccacccucuuc

SEQ ID NO: 1451656 - RNA, 14 nt, Human
cucucccacccucu

SEQ ID NO: 1451657 - RNA, 13 nt, Human
cucucccacccuc

SEQ ID NO: 1451658 - RNA, 14 nt, Human
cucucccaacucuu

SEQ ID NO: 1451659 - RNA, 21 nt, Human
cucucccaggccccaugaccu

SEQ ID NO: 1451660 - RNA, 19 nt, Human
cucucccaggccccaugac

SEQ ID NO: 1451661 - RNA, 24 nt, Human
cucucccaggccccaugaccucca

SEQ ID NO: 1451662 - RNA, 18 nt, Human
cucuccagcugacuaaac

SEQ ID NO: 1451663 - RNA, 19 nt, Human
cucuccacuuucagcuguc

SEQ ID NO: 1451664 - RNA, 21 nt, Human
cucuccacuuucagcugucuu

SEQ ID NO: 1451665 - RNA, 18 nt, Human
cucuccacuuucagcugu

SEQ ID NO: 1451666 - RNA, 17 nt, Human
cucuccacuuucagcug

SEQ ID NO: 1451667 - RNA, 16 nt, Human
cucuccacuuucagcu

SEQ ID NO: 1451668 - RNA, 15 nt, Human
cucuccacuuucagc

SEQ ID NO: 1451669 - RNA, 14 nt, Human
cucuccacuuucag

SEQ ID NO: 1451670 - RNA, 23 nt, Human
cucuccaggcaggucugaagcuc

SEQ ID NO: 1451671 - RNA, 21 nt, Human
cucuccauucugcuccuuccc

SEQ ID NO: 1451672 - RNA, 20 nt, Human
cucuccauucugcuccuucc

SEQ ID NO: 1451673 - RNA, 19 nt, Human
cucuccauucugcuccuuc

SEQ ID NO: 1451674 - RNA, 17 nt, Human
cucuccauucugcuccu

SEQ ID NO: 1451675 - RNA, 16 nt, Human
cucuccauucugcucc

SEQ ID NO: 1451676 - RNA, 15 nt, Human
cucuccauucugcuc

SEQ ID NO: 1451677 - RNA, 12 nt, Human
cucuccauucug

SEQ ID NO: 1451678 - RNA, 13 nt, Human
cucucccaacucu

SEQ ID NO: 1451679 - RNA, 13 nt, Human
cucucccaaaaaa

SEQ ID NO: 1451680 - RNA, 14 nt, Human
cucuaagguugggc

SEQ ID NO: 1451681 - RNA, 19 nt, Human
cucuaauauggcaaccauu

SEQ ID NO: 1451682 - RNA, 15 nt, Human
cucuaauacauucca

SEQ ID NO: 1451683 - RNA, 16 nt, Human
cucuaauucacagugc

SEQ ID NO: 1451684 - RNA, 15 nt, Human
cucuaauucacagug

SEQ ID NO: 1451685 - RNA, 17 nt, Human
cucucagucucugagca

SEQ ID NO: 1451686 - RNA, 16 nt, Human
cucucagucucugagc

SEQ ID NO: 1451687 - RNA, 15 nt, Human
cucucagucucugag

SEQ ID NO: 1451688 - RNA, 14 nt, Human
cucucagucucuga

SEQ ID NO: 1451689 - RNA, 13 nt, Human
cucucagucucug

SEQ ID NO: 1451690 - RNA, 18 nt, Human
cucucaggugaaaggaaa

SEQ ID NO: 1451691 - RNA, 19 nt, Human
cucucagggccaggccucu

SEQ ID NO: 1451692 - RNA, 18 nt, Human
cucucagggccaggccuc

SEQ ID NO: 1451693 - RNA, 15 nt, Human
cucucagggccaggc

SEQ ID NO: 1451694 - RNA, 17 nt, Human
cucuaauucacagugcu

SEQ ID NO: 1451695 - RNA, 19 nt, Human
cucuccacucaugugacuc

SEQ ID NO: 1451696 - RNA, 23 nt, Human
cucuccacacagugcucaaggcc

SEQ ID NO: 1451697 - RNA, 22 nt, Human
cucuccacacagugcucaaggc

SEQ ID NO: 1451698 - RNA, 17 nt, Human
cucuccacagcugccuc

SEQ ID NO: 1451699 - RNA, 14 nt, Human
cucucaugaaccuc

SEQ ID NO: 1451700 - RNA, 13 nt, Human
cucucaugaaccu

SEQ ID NO: 1451701 - RNA, 18 nt, Human
cucucaucaacugaauga

SEQ ID NO: 1451702 - RNA, 17 nt, Human
cucucaucaacugaaug

SEQ ID NO: 1451703 - RNA, 18 nt, Human
cucucagucucugagcag

SEQ ID NO: 1451704 - RNA, 15 nt, Human
cucucaguugcagcc

SEQ ID NO: 1451705 - RNA, 19 nt, Human
cucucaguugcagcccugc

SEQ ID NO: 1451706 - RNA, 22 nt, Human
cucucaguugcagcccugcugc

SEQ ID NO: 1451707 - RNA, 16 nt, Human
cucucaucaacugaau

SEQ ID NO: 1451708 - RNA, 15 nt, Human
cucucauacccuccc

SEQ ID NO: 1451709 - RNA, 21 nt, Human
cucuuggggaguuuagggugg

SEQ ID NO: 1451710 - RNA, 19 nt, Human
cucuuggcuggacccagcc

SEQ ID NO: 1451711 - RNA, 21 nt, Human
cucuugggaacugaacucacu

SEQ ID NO: 1451712 - RNA, 20 nt, Human
cucuuggcuggacccagcca

SEQ ID NO: 1451713 - RNA, 17 nt, Human
cucuuggcuggacccag

SEQ ID NO: 1451714 - RNA, 16 nt, Human
cucuuggcuggaccca

SEQ ID NO: 1451715 - RNA, 15 nt, Human
cucuuggcuggaccc

SEQ ID NO: 1451716 - RNA, 14 nt, Human
cucuuggcuggacc

SEQ ID NO: 1451717 - RNA, 12 nt, Human
cucuuggcugga

SEQ ID NO: 1451718 - RNA, 16 nt, Human
cucuuggccugaucag

SEQ ID NO: 1451719 - RNA, 15 nt, Human
cucuuggagcuguga

SEQ ID NO: 1451720 - RNA, 19 nt, Human
cucuugaccaggcugccuc

SEQ ID NO: 1451721 - RNA, 15 nt, Human
cucuugaccaggcug

SEQ ID NO: 1451722 - RNA, 14 nt, Human
cucuugaccaggcu

SEQ ID NO: 1451723 - RNA, 22 nt, Human
cucuugagcaguggcuggucca

SEQ ID NO: 1451724 - RNA, 18 nt, Human
cucuugagcaguggcugg

SEQ ID NO: 1451725 - RNA, 15 nt, Human
cucuugagcaguggc

SEQ ID NO: 1451726 - RNA, 14 nt, Human
cucuuucuguauau

SEQ ID NO: 1451727 - RNA, 13 nt, Human
cucuuucuguaua

SEQ ID NO: 1451728 - RNA, 11 nt, Human
cucuuucugua

SEQ ID NO: 1451729 - RNA, 18 nt, Human
cucuuucucugccaguga

SEQ ID NO: 1451730 - RNA, 17 nt, Human
cucuuucucugccagug

SEQ ID NO: 1451731 - RNA, 16 nt, Human
cucuuucucugccagu

SEQ ID NO: 1451732 - RNA, 15 nt, Human
cucuuucucugccag

SEQ ID NO: 1451733 - RNA, 13 nt, Human
cucuuucucugcc

SEQ ID NO: 1451734 - RNA, 12 nt, Human
cucuuucucugc

SEQ ID NO: 1451735 - RNA, 21 nt, Human
cucuuguauaagauccuagau

SEQ ID NO: 1451736 - RNA, 20 nt, Human
cucuuguauaagauccuaga

SEQ ID NO: 1451737 - RNA, 20 nt, Human
cucuugugaggaaagucauu

SEQ ID NO: 1451738 - RNA, 21 nt, Human
cucuuguaauccgaaucucuu

SEQ ID NO: 1451739 - RNA, 12 nt, Human
cucuuucagcuc

SEQ ID NO: 1451740 - RNA, 11 nt, Human
cucuuucagcu

SEQ ID NO: 1451741 - RNA, 22 nt, Human
cucuuucaagcagucgugccug

SEQ ID NO: 1451742 - RNA, 12 nt, Human
cucuuucaaaac

SEQ ID NO: 1451743 - RNA, 18 nt, Human
cucuuuccaugacaucaa

SEQ ID NO: 1451744 - RNA, 15 nt, Human
cucuuucagcuccug

SEQ ID NO: 1451745 - RNA, 14 nt, Human
cucuuucagcuccu

SEQ ID NO: 1451746 - RNA, 13 nt, Human
cucuuucagcucc

SEQ ID NO: 1451747 - RNA, 15 nt, Human
cucuguuccuucccu

SEQ ID NO: 1451748 - RNA, 23 nt, Human
cucuggagccagccgagcaggag

SEQ ID NO: 1451749 - RNA, 21 nt, Human
cucuggagccagccgagcagg

SEQ ID NO: 1451750 - RNA, 15 nt, Human
cucuggagcccacug

SEQ ID NO: 1451751 - RNA, 15 nt, Human
cucuggagccagccg

SEQ ID NO: 1451752 - RNA, 13 nt, Human
cucuggagccagc

SEQ ID NO: 1451753 - RNA, 19 nt, Human
cucuggagcccacuguacu

SEQ ID NO: 1451754 - RNA, 21 nt, Human
cucuguucuuccucagccagc

SEQ ID NO: 1451755 - RNA, 20 nt, Human
cucuguugcaagugcaauaa

SEQ ID NO: 1451756 - RNA, 22 nt, Human
cucuguucuuccucagccagcc

SEQ ID NO: 1451757 - RNA, 20 nt, Human
cucuguucuuccucagccag

SEQ ID NO: 1451758 - RNA, 19 nt, Human
cucuguucuuccucagcca

SEQ ID NO: 1451759 - RNA, 18 nt, Human
cucuguucuuccucagcc

SEQ ID NO: 1451760 - RNA, 15 nt, Human
cucuguucuuccuca

SEQ ID NO: 1451761 - RNA, 13 nt, Human
cucuguucuuccu

SEQ ID NO: 1451762 - RNA, 22 nt, Human
cucuguuccuucccugugccuc

SEQ ID NO: 1451763 - RNA, 13 nt, Human
cucuuaagaagac

SEQ ID NO: 1451764 - RNA, 23 nt, Human
cucuucuggggcaggcugggcca

SEQ ID NO: 1451765 - RNA, 21 nt, Human
cucuucuggggcaggcugggc

SEQ ID NO: 1451766 - RNA, 19 nt, Human
cucuucuggggcaggcugg

SEQ ID NO: 1451767 - RNA, 15 nt, Human
cucuucugggccuga

SEQ ID NO: 1451768 - RNA, 22 nt, Human
cucuucugggagggcagcaggg

SEQ ID NO: 1451769 - RNA, 21 nt, Human
cucuucugggagggcagcagg

SEQ ID NO: 1451770 - RNA, 22 nt, Human
cucuucucuccagcugacuaaa

SEQ ID NO: 1451771 - RNA, 19 nt, Human
cucuucucuccagcugacu

SEQ ID NO: 1451772 - RNA, 15 nt, Human
cucuucucuccagcu

SEQ ID NO: 1451773 - RNA, 14 nt, Human
cucuucucuccagc

SEQ ID NO: 1451774 - RNA, 13 nt, Human
cucuucucuccag

SEQ ID NO: 1451775 - RNA, 23 nt, Human
cucuuccagucuuccugacacuu

SEQ ID NO: 1451776 - RNA, 22 nt, Human
cucuuccagucuuccugacacu

SEQ ID NO: 1451777 - RNA, 19 nt, Human
cucuuccagucuuccugac

SEQ ID NO: 1451778 - RNA, 13 nt, Human
cucuucagucucu

SEQ ID NO: 1451779 - RNA, 15 nt, Human
cugacauucugauuc

SEQ ID NO: 1451780 - RNA, 23 nt, Human
cugacauucaccugccccaacuc

SEQ ID NO: 1451781 - RNA, 17 nt, Human
cugacauucaccugccc

SEQ ID NO: 1451782 - RNA, 16 nt, Human
cugacauucaccugcc

SEQ ID NO: 1451783 - RNA, 12 nt, Human
cugaccagcagc

SEQ ID NO: 1451784 - RNA, 13 nt, Human
cugaccagaacua

SEQ ID NO: 1451785 - RNA, 23 nt, Human
cugaccacucagagacaugcaga

SEQ ID NO: 1451786 - RNA, 22 nt, Human
cugaccacucagagacaugcag

SEQ ID NO: 1451787 - RNA, 17 nt, Human
cugaccacucagagaca

SEQ ID NO: 1451788 - RNA, 15 nt, Human
cugaccaugcucauc

SEQ ID NO: 1451789 - RNA, 16 nt, Human
cugaccacucagagac

SEQ ID NO: 1451790 - RNA, 15 nt, Human
cugaccacucagaga

SEQ ID NO: 1451791 - RNA, 14 nt, Human
cugaccacucagag

SEQ ID NO: 1451792 - RNA, 13 nt, Human
cugaccacucaga

SEQ ID NO: 1451793 - RNA, 22 nt, Human
cugaccaccuuuguuucucccc

SEQ ID NO: 1451794 - RNA, 18 nt, Human
cugaccacagcacagcca

SEQ ID NO: 1451795 - RNA, 15 nt, Human
cugaccacagcacag

SEQ ID NO: 1451796 - RNA, 14 nt, Human
cugaccacagcaca

SEQ ID NO: 1451797 - RNA, 12 nt, Human
cugaccacagca

SEQ ID NO: 1451798 - RNA, 20 nt, Human
cugaauccaaacuaauccau

SEQ ID NO: 1451799 - RNA, 19 nt, Human
cugaauccaaacuaaucca

SEQ ID NO: 1451800 - RNA, 21 nt, Human
cugaauauugccauuaugcuu

SEQ ID NO: 1451801 - RNA, 17 nt, Human
cugaauauacagcaggu

SEQ ID NO: 1451802 - RNA, 21 nt, Human
cugaauaggcgaucacaacgu

SEQ ID NO: 1451803 - RNA, 23 nt, Human
cugaauaggcgaucacaacgugc

SEQ ID NO: 1451804 - RNA, 15 nt, Human
cugaauagcagaagg

SEQ ID NO: 1451805 - RNA, 18 nt, Human
cugaauaggcgaucacaa

SEQ ID NO: 1451806 - RNA, 15 nt, Human
cugaauagauaugaa

SEQ ID NO: 1451807 - RNA, 22 nt, Human
cugaauaccacucuguaauugc

SEQ ID NO: 1451808 - RNA, 17 nt, Human
cugaauacccuuuucug

SEQ ID NO: 1451809 - RNA, 22 nt, Human
cugaaucugcuaccaaaacagu

SEQ ID NO: 1451810 - RNA, 17 nt, Human
cugaaucugcuaccaaa

SEQ ID NO: 1451811 - RNA, 15 nt, Human
cugaaucugcuacca

SEQ ID NO: 1451812 - RNA, 13 nt, Human
cugacagaggggg

SEQ ID NO: 1451813 - RNA, 23 nt, Human
cugaauuuaaauagcuuuuuucu

SEQ ID NO: 1451814 - RNA, 13 nt, Human
cugaauuucccuc

SEQ ID NO: 1451815 - RNA, 18 nt, Human
cugaauuuaaauagcuuu

SEQ ID NO: 1451816 - RNA, 14 nt, Human
cugaauuuaaauag

SEQ ID NO: 1451817 - RNA, 18 nt, Human
cugaacuugcauugugau

SEQ ID NO: 1451818 - RNA, 17 nt, Human
cugaacuugcauuguga

SEQ ID NO: 1451819 - RNA, 23 nt, Human
cugaaccuauuucuuaaacacuu

SEQ ID NO: 1451820 - RNA, 18 nt, Human
cucuuuggcuccccugua

SEQ ID NO: 1451821 - RNA, 21 nt, Human
cucuuuggcgaccuccuuuca

SEQ ID NO: 1451822 - RNA, 16 nt, Human
cugaagguuguggccu

SEQ ID NO: 1451823 - RNA, 17 nt, Human
cugaagguuguggccuu

SEQ ID NO: 1451824 - RNA, 23 nt, Human
cugaauaccacucuguaauugca

SEQ ID NO: 1451825 - RNA, 21 nt, Human
cugaauaccacucuguaauug

SEQ ID NO: 1451826 - RNA, 20 nt, Human
cugaauaccacucuguaauu

SEQ ID NO: 1451827 - RNA, 19 nt, Human
cugaauaccacucuguaau

SEQ ID NO: 1451828 - RNA, 18 nt, Human
cugaauaccacucuguaa

SEQ ID NO: 1451829 - RNA, 17 nt, Human
cugaauaccacucugua

SEQ ID NO: 1451830 - RNA, 15 nt, Human
cugaauaccacucug

SEQ ID NO: 1451831 - RNA, 21 nt, Human
cugaauaaauuguacagccgg

SEQ ID NO: 1451832 - RNA, 22 nt, Human
cugaauaaauuguacagccggc

SEQ ID NO: 1451833 - RNA, 16 nt, Human
cugaagugcuuagugu

SEQ ID NO: 1451834 - RNA, 21 nt, Human
cugaagugagcacagccuagg

SEQ ID NO: 1451835 - RNA, 19 nt, Human
cugaagugagcacagccua

SEQ ID NO: 1451836 - RNA, 18 nt, Human
cugaagugagcacagccu

SEQ ID NO: 1451837 - RNA, 22 nt, Human
cugcagaaccggagagccagcu

SEQ ID NO: 1451838 - RNA, 21 nt, Human
cugcagaaccggagagccagc

SEQ ID NO: 1451839 - RNA, 19 nt, Human
cugcagaaccggagagcca

SEQ ID NO: 1451840 - RNA, 16 nt, Human
cugcagaaccggagag

SEQ ID NO: 1451841 - RNA, 18 nt, Human
cugcagacuucccagcua

SEQ ID NO: 1451842 - RNA, 16 nt, Human
cugcacuuacuugcuu

SEQ ID NO: 1451843 - RNA, 15 nt, Human
cugcacuuacuugcu

SEQ ID NO: 1451844 - RNA, 21 nt, Human
cugcagccccacccagaugcc

SEQ ID NO: 1451845 - RNA, 15 nt, Human
cugcaggcugagugc

SEQ ID NO: 1451846 - RNA, 16 nt, Human
cugcaggcugagugca

SEQ ID NO: 1451847 - RNA, 21 nt, Human
cugcaggcccuggccuccccu

SEQ ID NO: 1451848 - RNA, 14 nt, Human
cugcaggcugagug

SEQ ID NO: 1451849 - RNA, 22 nt, Human
cugcagggaaaauuauuugcau

SEQ ID NO: 1451850 - RNA, 12 nt, Human
cugcagggaaaa

SEQ ID NO: 1451851 - RNA, 23 nt, Human
cugcagggaaaauuauuugcaua

SEQ ID NO: 1451852 - RNA, 21 nt, Human
cugcaccaugcugcuggggaa

SEQ ID NO: 1451853 - RNA, 23 nt, Human
cugcaccaugcugcuggggaaga

SEQ ID NO: 1451854 - RNA, 20 nt, Human
cugcaccaugcugcugggga

SEQ ID NO: 1451855 - RNA, 19 nt, Human
cugcaccaugcugcugggg

SEQ ID NO: 1451856 - RNA, 22 nt, Human
cugcacagugacuucugagauc

SEQ ID NO: 1451857 - RNA, 21 nt, Human
cugcacauuaaggagaaaucu

SEQ ID NO: 1451858 - RNA, 16 nt, Human
cugcacagugacuucu

SEQ ID NO: 1451859 - RNA, 14 nt, Human
cugcacagugacuu

SEQ ID NO: 1451860 - RNA, 21 nt, Human
cugcacagugacuucugagau

SEQ ID NO: 1451861 - RNA, 20 nt, Human
cugcacagugacuucugaga

SEQ ID NO: 1451862 - RNA, 19 nt, Human
cugcacagugacuucugag

SEQ ID NO: 1451863 - RNA, 18 nt, Human
cugcacagugacuucuga

SEQ ID NO: 1451864 - RNA, 24 nt, Human
cugcaauucaaaaguuccaagagu

SEQ ID NO: 1451865 - RNA, 20 nt, Human
cugcaauuccccucugcugc

SEQ ID NO: 1451866 - RNA, 17 nt, Human
cugcaauuccccucugc

SEQ ID NO: 1451867 - RNA, 16 nt, Human
cugcaauuccccucug

SEQ ID NO: 1451868 - RNA, 15 nt, Human
cugcaauuccccucu

SEQ ID NO: 1451869 - RNA, 22 nt, Human
cugcaauucaaaaguuccaaga

SEQ ID NO: 1451870 - RNA, 21 nt, Human
cugcaauucaaaaguuccaag

SEQ ID NO: 1451871 - RNA, 18 nt, Human
cugcaauucaaaaguucc

SEQ ID NO: 1451872 - RNA, 14 nt, Human
cugcaauucaaaag

SEQ ID NO: 1451873 - RNA, 22 nt, Human
cugcaauuggcaccgaagccca

SEQ ID NO: 1451874 - RNA, 20 nt, Human
cugcaaaccugaccccugcu

SEQ ID NO: 1451875 - RNA, 18 nt, Human
cugcaaaccugaccccug

SEQ ID NO: 1451876 - RNA, 22 nt, Human
cugcaaacaccaacauguuggg

SEQ ID NO: 1451877 - RNA, 18 nt, Human
cugcaaaaggacucucag

SEQ ID NO: 1451878 - RNA, 17 nt, Human
cugagugggaagcccau

SEQ ID NO: 1451879 - RNA, 15 nt, Human
cugagugggaagccc

SEQ ID NO: 1451880 - RNA, 13 nt, Human
cugagugggaagc

SEQ ID NO: 1451881 - RNA, 18 nt, Human
cugaguggcaggggacag

SEQ ID NO: 1451882 - RNA, 16 nt, Human
cugaguggcaggggac

SEQ ID NO: 1451883 - RNA, 13 nt, Human
cugaguggcaggg

SEQ ID NO: 1451884 - RNA, 17 nt, Human
cugagugcuugcuuuuc

SEQ ID NO: 1451885 - RNA, 23 nt, Human
cugauaaaaccauguagaaaauu

SEQ ID NO: 1451886 - RNA, 19 nt, Human
cugauaaaaccauguagaa

SEQ ID NO: 1451887 - RNA, 21 nt, Human
cugaguuuuguguuuguugua

SEQ ID NO: 1451888 - RNA, 20 nt, Human
cugaguuuuguguuuguugu

SEQ ID NO: 1451889 - RNA, 19 nt, Human
cugaguuuuguguuuguug

SEQ ID NO: 1451890 - RNA, 17 nt, Human
cugaguuuuguguuugu

SEQ ID NO: 1451891 - RNA, 13 nt, Human
cugauaaagauga

SEQ ID NO: 1451892 - RNA, 14 nt, Human
cugaguuuuguguu

SEQ ID NO: 1451893 - RNA, 13 nt, Human
cugaguuuugugu

SEQ ID NO: 1451894 - RNA, 22 nt, Human
cugaguuuuccauggcaggaag

SEQ ID NO: 1451895 - RNA, 20 nt, Human
cugaguuuuccauggcagga

SEQ ID NO: 1451896 - RNA, 19 nt, Human
cugaguuuuccauggcagg

SEQ ID NO: 1451897 - RNA, 18 nt, Human
cugaguuuuccauggcag

SEQ ID NO: 1451898 - RNA, 21 nt, Human
cugagugggaagcccauccug

SEQ ID NO: 1451899 - RNA, 21 nt, Human
cugagugacucuauauagcug

SEQ ID NO: 1451900 - RNA, 11 nt, Human
cugagugacuc

SEQ ID NO: 1451901 - RNA, 21 nt, Human
cugagggaaaggccagcacuc

SEQ ID NO: 1451902 - RNA, 20 nt, Human
cugagggaaaggccagcacu

SEQ ID NO: 1451903 - RNA, 18 nt, Human
cugagggaaaggccagca

SEQ ID NO: 1451904 - RNA, 17 nt, Human
cugagggaaaggccagc

SEQ ID NO: 1451905 - RNA, 21 nt, Human
cugaggcuuuggauuugacau

SEQ ID NO: 1451906 - RNA, 18 nt, Human
cugaggcuuuggauuuga

SEQ ID NO: 1451907 - RNA, 17 nt, Human
cugaggcuuuggauuug

SEQ ID NO: 1451908 - RNA, 15 nt, Human
cugaggcuuuggauu

SEQ ID NO: 1451909 - RNA, 14 nt, Human
cugaggcuuuggau

SEQ ID NO: 1451910 - RNA, 21 nt, Human
cugacccagugcccccacuga

SEQ ID NO: 1451911 - RNA, 20 nt, Human
cugacccagugcccccacug

SEQ ID NO: 1451912 - RNA, 23 nt, Human
cugacccagugcccccacugacc

SEQ ID NO: 1451913 - RNA, 18 nt, Human
cugacccagugcccccac

SEQ ID NO: 1451914 - RNA, 13 nt, Human
cugacccagugcc

SEQ ID NO: 1451915 - RNA, 12 nt, Human
cugacccagugc

SEQ ID NO: 1451916 - RNA, 10 nt, Human
cugacccagu

SEQ ID NO: 1451917 - RNA, 22 nt, Human
cugaccaugcucaucugcuggu

SEQ ID NO: 1451918 - RNA, 21 nt, Human
cugaccaugcucaucugcugg

SEQ ID NO: 1451919 - RNA, 20 nt, Human
cugaccaugcucaucugcug

SEQ ID NO: 1451920 - RNA, 22 nt, Human
cugagggcaguucgcagccacc

SEQ ID NO: 1451921 - RNA, 21 nt, Human
cugagggcaguucgcagccac

SEQ ID NO: 1451922 - RNA, 19 nt, Human
cugagggcaguucgcagcc

SEQ ID NO: 1451923 - RNA, 12 nt, Human
cugagggcaguu

SEQ ID NO: 1451924 - RNA, 16 nt, Human
cugagggcagucgaua

SEQ ID NO: 1451925 - RNA, 21 nt, Human
cugagucgugaccugcuaggc

SEQ ID NO: 1451926 - RNA, 20 nt, Human
cugagucgugaccugcuagg

SEQ ID NO: 1451927 - RNA, 17 nt, Human
cugagucgugaccugcu

SEQ ID NO: 1451928 - RNA, 23 nt, Human
cugagucguacagaaagcugccu

SEQ ID NO: 1451929 - RNA, 21 nt, Human
cugagucguacagaaagcugc

SEQ ID NO: 1451930 - RNA, 20 nt, Human
cugagucguacagaaagcug

SEQ ID NO: 1451931 - RNA, 19 nt, Human
cugagucguacagaaagcu

SEQ ID NO: 1451932 - RNA, 18 nt, Human
cugagucguacagaaagc

SEQ ID NO: 1451933 - RNA, 17 nt, Human
cugagucguacagaaag

SEQ ID NO: 1451934 - RNA, 13 nt, Human
cugagucccaucc

SEQ ID NO: 1451935 - RNA, 15 nt, Human
cugauuaaaugacac

SEQ ID NO: 1451936 - RNA, 16 nt, Human
cugauuaaaugacacu

SEQ ID NO: 1451937 - RNA, 21 nt, Human
cugauuaaaaugcuuccuccc

SEQ ID NO: 1451938 - RNA, 12 nt, Human
cugauguugugu

SEQ ID NO: 1451939 - RNA, 19 nt, Human
cugauucgaaugacacugu

SEQ ID NO: 1451940 - RNA, 17 nt, Human
cugauucgaaugacacu

SEQ ID NO: 1451941 - RNA, 21 nt, Human
cugauucacaucucauuuuuc

SEQ ID NO: 1451942 - RNA, 17 nt, Human
cugauucacaucucauu

SEQ ID NO: 1451943 - RNA, 16 nt, Human
cugaucgccuucccca

SEQ ID NO: 1451944 - RNA, 15 nt, Human
cugaucgccuucccc

SEQ ID NO: 1451945 - RNA, 13 nt, Human
cugaucgccuucc

SEQ ID NO: 1451946 - RNA, 21 nt, Human
cugaucccagagagcccgagg

SEQ ID NO: 1451947 - RNA, 21 nt, Human
cugauccuggaggcccaguuc

SEQ ID NO: 1451948 - RNA, 13 nt, Human
cugaucccucuac

SEQ ID NO: 1451949 - RNA, 19 nt, Human
cugauccuggaggcccagu

SEQ ID NO: 1451950 - RNA, 12 nt, Human
cugaucccucua

SEQ ID NO: 1451951 - RNA, 20 nt, Human
cugaucccagagagcccgag

SEQ ID NO: 1451952 - RNA, 18 nt, Human
cugaucccagagagcccg

SEQ ID NO: 1451953 - RNA, 21 nt, Human
cugaugucuccuaagcaccug

SEQ ID NO: 1451954 - RNA, 18 nt, Human
cugaugucuccuaagcac

SEQ ID NO: 1451955 - RNA, 15 nt, Human
cugaugucuccuaag

SEQ ID NO: 1451956 - RNA, 13 nt, Human
cugaugucuccua

SEQ ID NO: 1451957 - RNA, 22 nt, Human
cugaugucaauuucuguguugc

SEQ ID NO: 1451958 - RNA, 20 nt, Human
cugaugucaauuucuguguu

SEQ ID NO: 1451959 - RNA, 19 nt, Human
cugaugucaauuucugugu

SEQ ID NO: 1451960 - RNA, 18 nt, Human
cugaugucaauuucugug

SEQ ID NO: 1451961 - RNA, 13 nt, Human
cugaucucguuuu

SEQ ID NO: 1451962 - RNA, 23 nt, Human
cugauaggguuugugacagggcg

SEQ ID NO: 1451963 - RNA, 20 nt, Human
cugauaggguuugugacagg

SEQ ID NO: 1451964 - RNA, 19 nt, Human
cugauaggguuugugacag

SEQ ID NO: 1451965 - RNA, 18 nt, Human
cugauaaaagauggccau

SEQ ID NO: 1451966 - RNA, 21 nt, Human
cugauaaagaugagugagcau

SEQ ID NO: 1451967 - RNA, 20 nt, Human
cugauacuuugacaguguuu

SEQ ID NO: 1451968 - RNA, 22 nt, Human
cugaucagugggccuccaagga

SEQ ID NO: 1451969 - RNA, 15 nt, Human
cugaucccagagagc

SEQ ID NO: 1451970 - RNA, 13 nt, Human
cugcucugagaau

SEQ ID NO: 1451971 - RNA, 12 nt, Human
cugcucugagaa

SEQ ID NO: 1451972 - RNA, 19 nt, Human
cugcucugaacacgaagcu

SEQ ID NO: 1451973 - RNA, 16 nt, Human
cugcucugaacacgaa

SEQ ID NO: 1451974 - RNA, 13 nt, Human
cugcucggggugc

SEQ ID NO: 1451975 - RNA, 14 nt, Human
cugcucgcucccug

SEQ ID NO: 1451976 - RNA, 23 nt, Human
cugcuccuuccccaucguugccc

SEQ ID NO: 1451977 - RNA, 15 nt, Human
cugcuccuuccccau

SEQ ID NO: 1451978 - RNA, 14 nt, Human
cugcuccuucccca

SEQ ID NO: 1451979 - RNA, 14 nt, Human
cugcucccucagac

SEQ ID NO: 1451980 - RNA, 13 nt, Human
cugcucccucaga

SEQ ID NO: 1451981 - RNA, 12 nt, Human
cugcucccucag

SEQ ID NO: 1451982 - RNA, 19 nt, Human
cugcuccccuaaagccuca

SEQ ID NO: 1451983 - RNA, 14 nt, Human
cugcuccagacagg

SEQ ID NO: 1451984 - RNA, 22 nt, Human
cugcuccagaccugauccugga

SEQ ID NO: 1451985 - RNA, 21 nt, Human
cugcuccagaccugauccugg

SEQ ID NO: 1451986 - RNA, 18 nt, Human
cugcuaacggugcucagg

SEQ ID NO: 1451987 - RNA, 19 nt, Human
cugcuaacggugcucaggg

SEQ ID NO: 1451988 - RNA, 15 nt, Human
cugcuccagaccuga

SEQ ID NO: 1451989 - RNA, 14 nt, Human
cugcuccagaccug

SEQ ID NO: 1451990 - RNA, 13 nt, Human
cugcuccagaccu

SEQ ID NO: 1451991 - RNA, 16 nt, Human
cugcuaaggucuugga

SEQ ID NO: 1451992 - RNA, 23 nt, Human
cugcuaaauaaaauuuguugcau

SEQ ID NO: 1451993 - RNA, 15 nt, Human
cugcuaaauaaaauu

SEQ ID NO: 1451994 - RNA, 12 nt, Human
cugcuaaauaaa

SEQ ID NO: 1451995 - RNA, 22 nt, Human
cugcgugggugugugcguguuu

SEQ ID NO: 1451996 - RNA, 19 nt, Human
cugcgugucaccugugcuu

SEQ ID NO: 1451997 - RNA, 22 nt, Human
cugcgguagaugggagggaggc

SEQ ID NO: 1451998 - RNA, 21 nt, Human
cugcggguggggcuuggggcu

SEQ ID NO: 1451999 - RNA, 13 nt, Human
cugcggguggggc

SEQ ID NO: 1452000 - RNA, 15 nt, Human
cugccuuaucuugca

SEQ ID NO: 1452001 - RNA, 23 nt, Human
cugccuuagucucaguuugugug

SEQ ID NO: 1452002 - RNA, 20 nt, Human
cugccuuagucucaguuugu

SEQ ID NO: 1452003 - RNA, 16 nt, Human
cugccuuagucucagu

SEQ ID NO: 1452004 - RNA, 15 nt, Human
cugccuucaccuuca

SEQ ID NO: 1452005 - RNA, 21 nt, Human
cugccuuauucagggaaggag

SEQ ID NO: 1452006 - RNA, 20 nt, Human
cugccuuauucagggaagga

SEQ ID NO: 1452007 - RNA, 19 nt, Human
cugccuuauucagggaagg

SEQ ID NO: 1452008 - RNA, 18 nt, Human
cugccuuauucagggaag

SEQ ID NO: 1452009 - RNA, 17 nt, Human
cugccuuaucuugcacc

SEQ ID NO: 1452010 - RNA, 23 nt, Human
cugccucaggaggcaggaccuuc

SEQ ID NO: 1452011 - RNA, 22 nt, Human
cugccucaggaggcaggaccuu

SEQ ID NO: 1452012 - RNA, 14 nt, Human
cugccucaggacug

SEQ ID NO: 1452013 - RNA, 13 nt, Human
cugccucaggacu

SEQ ID NO: 1452014 - RNA, 12 nt, Human
cugccucaggac

SEQ ID NO: 1452015 - RNA, 20 nt, Human
cugccugagucgugaccugc

SEQ ID NO: 1452016 - RNA, 21 nt, Human
cugccugagucgugaccugcu

SEQ ID NO: 1452017 - RNA, 19 nt, Human
cugccugagucgugaccug

SEQ ID NO: 1452018 - RNA, 23 nt, Human
cugccugacauuuggaguguucc

SEQ ID NO: 1452019 - RNA, 20 nt, Human
cugccugacauuuggagugu

SEQ ID NO: 1452020 - RNA, 19 nt, Human
cugccucuuaaauaaaccu

SEQ ID NO: 1452021 - RNA, 18 nt, Human
cugccucuucccucuucc

SEQ ID NO: 1452022 - RNA, 19 nt, Human
cugccucuucccucuuccu

SEQ ID NO: 1452023 - RNA, 12 nt, Human
cugccucucugc

SEQ ID NO: 1452024 - RNA, 13 nt, Human
cugccucucugca

SEQ ID NO: 1452025 - RNA, 14 nt, Human
cugccucucuagga

SEQ ID NO: 1452026 - RNA, 21 nt, Human
cugccucucgcuccucaaccc

SEQ ID NO: 1452027 - RNA, 14 nt, Human
cugccucucugcag

SEQ ID NO: 1452028 - RNA, 23 nt, Human
cugccaggagggacaaaggagcc

SEQ ID NO: 1452029 - RNA, 22 nt, Human
cugccaggagggacaaaggagc

SEQ ID NO: 1452030 - RNA, 21 nt, Human
cugccaggagggacaaaggag

SEQ ID NO: 1452031 - RNA, 20 nt, Human
cugccaggagggacaaagga

SEQ ID NO: 1452032 - RNA, 18 nt, Human
cugccaggagggacaaag

SEQ ID NO: 1452033 - RNA, 13 nt, Human
cugccaggaggga

SEQ ID NO: 1452034 - RNA, 23 nt, Human
cugccaggaggacccagggcucu

SEQ ID NO: 1452035 - RNA, 22 nt, Human
cugccaggaggacccagggcuc

SEQ ID NO: 1452036 - RNA, 21 nt, Human
cugccaggaggacccagggcu

SEQ ID NO: 1452037 - RNA, 19 nt, Human
cugccaggaggacccaggg

SEQ ID NO: 1452038 - RNA, 18 nt, Human
cugccaggaggacccagg

SEQ ID NO: 1452039 - RNA, 16 nt, Human
cugccaggaggaccca

SEQ ID NO: 1452040 - RNA, 11 nt, Human
cugccaggagg

SEQ ID NO: 1452041 - RNA, 15 nt, Human
cugccaggagcuuug

SEQ ID NO: 1452042 - RNA, 20 nt, Human
cugccaggagcacggcucug

SEQ ID NO: 1452043 - RNA, 16 nt, Human
cugccaggagacaggu

SEQ ID NO: 1452044 - RNA, 16 nt, Human
cugccagccccugcca

SEQ ID NO: 1452045 - RNA, 14 nt, Human
cugccagccccugc

SEQ ID NO: 1452046 - RNA, 12 nt, Human
cugccagccccu

SEQ ID NO: 1452047 - RNA, 23 nt, Human
cugccaccaggccaccuccccag

SEQ ID NO: 1452048 - RNA, 18 nt, Human
cugccaccaggccaccuc

SEQ ID NO: 1452049 - RNA, 17 nt, Human
cugccaccaggccaccu

SEQ ID NO: 1452050 - RNA, 15 nt, Human
cugccaccaggccac

SEQ ID NO: 1452051 - RNA, 14 nt, Human
cugccaccaggcca

SEQ ID NO: 1452052 - RNA, 13 nt, Human
cugccaccaggcc

SEQ ID NO: 1452053 - RNA, 23 nt, Human
cugccacagccuccccugccagg

SEQ ID NO: 1452054 - RNA, 22 nt, Human
cugccacagccuccccugccag

SEQ ID NO: 1452055 - RNA, 21 nt, Human
cugccacagccuccccugcca

SEQ ID NO: 1452056 - RNA, 20 nt, Human
cugccagcauuucccuuccu

SEQ ID NO: 1452057 - RNA, 19 nt, Human
cugcccagugcacuugcug

SEQ ID NO: 1452058 - RNA, 16 nt, Human
cugcccagugcacuug

SEQ ID NO: 1452059 - RNA, 20 nt, Human
cugcccaggcacugcuaggc

SEQ ID NO: 1452060 - RNA, 16 nt, Human
cugcccaggcacugca

SEQ ID NO: 1452061 - RNA, 15 nt, Human
cugcccaggcacugc

SEQ ID NO: 1452062 - RNA, 23 nt, Human
cugcccaaagcagcacuuauaaa

SEQ ID NO: 1452063 - RNA, 13 nt, Human
cugcccaaagcag

SEQ ID NO: 1452064 - RNA, 20 nt, Human
cugcccaacccuucccucac

SEQ ID NO: 1452065 - RNA, 17 nt, Human
cugcccaacccuucccu

SEQ ID NO: 1452066 - RNA, 14 nt, Human
cugcccaggcacug

SEQ ID NO: 1452067 - RNA, 23 nt, Human
cugcccuccugugcucagcccug

SEQ ID NO: 1452068 - RNA, 22 nt, Human
cugcccuccugugcucagcccu

SEQ ID NO: 1452069 - RNA, 21 nt, Human
cugcccuccugugcucagccc

SEQ ID NO: 1452070 - RNA, 20 nt, Human
cugcccuccugugcucagcc

SEQ ID NO: 1452071 - RNA, 19 nt, Human
cugcccuccugugcucagc

SEQ ID NO: 1452072 - RNA, 16 nt, Human
cugcccuccugugcuc

SEQ ID NO: 1452073 - RNA, 12 nt, Human
cugcccuccugu

SEQ ID NO: 1452074 - RNA, 18 nt, Human
cugcccgggagcucagga

SEQ ID NO: 1452075 - RNA, 21 nt, Human
cugcccagugcacuugcugga

SEQ ID NO: 1452076 - RNA, 13 nt, Human
cugcccugcccac

SEQ ID NO: 1452077 - RNA, 17 nt, Human
cugcccucugcauccuc

SEQ ID NO: 1452078 - RNA, 20 nt, Human
cugcccucugcauccucugg

SEQ ID NO: 1452079 - RNA, 11 nt, Human
cugcccugcca

SEQ ID NO: 1452080 - RNA, 13 nt, Human
cugcccugccacc

SEQ ID NO: 1452081 - RNA, 14 nt, Human
cugcccugccaccu

SEQ ID NO: 1452082 - RNA, 15 nt, Human
cugcccugccaccug

SEQ ID NO: 1452083 - RNA, 16 nt, Human
cugcccugccaccugu

SEQ ID NO: 1452084 - RNA, 17 nt, Human
cugcccugccaccuguc

SEQ ID NO: 1452085 - RNA, 18 nt, Human
cugcccugccaccugucu

SEQ ID NO: 1452086 - RNA, 20 nt, Human
cugcccugccaccugucugu

SEQ ID NO: 1452087 - RNA, 21 nt, Human
cugcccugccaccugucuguc

SEQ ID NO: 1452088 - RNA, 11 nt, Human
cugcccugccc

SEQ ID NO: 1452089 - RNA, 20 nt, Human
cugguucucaauuccaacag

SEQ ID NO: 1452090 - RNA, 16 nt, Human
cugguucucaauucca

SEQ ID NO: 1452091 - RNA, 15 nt, Human
cuggugguauuuuca

SEQ ID NO: 1452092 - RNA, 23 nt, Human
cugguggucuguuggcaggcugg

SEQ ID NO: 1452093 - RNA, 22 nt, Human
cugguggucuguuggcaggcug

SEQ ID NO: 1452094 - RNA, 20 nt, Human
cugguggucuguuggcaggc

SEQ ID NO: 1452095 - RNA, 18 nt, Human
cugguggucuguuggcag

SEQ ID NO: 1452096 - RNA, 16 nt, Human
cuggugguauuuucaa

SEQ ID NO: 1452097 - RNA, 21 nt, Human
cuggugggugccuaggccugg

SEQ ID NO: 1452098 - RNA, 18 nt, Human
cuggugggugccuaggcc

SEQ ID NO: 1452099 - RNA, 17 nt, Human
cugguggggcagcuccu

SEQ ID NO: 1452100 - RNA, 20 nt, Human
cugguggggcagcuccucug

SEQ ID NO: 1452101 - RNA, 16 nt, Human
cugguggggcagcucc

SEQ ID NO: 1452102 - RNA, 15 nt, Human
cugguggggcagcuc

SEQ ID NO: 1452103 - RNA, 14 nt, Human
cugguggggcagcu

SEQ ID NO: 1452104 - RNA, 22 nt, Human
cugguggggauaggccagccgc

SEQ ID NO: 1452105 - RNA, 21 nt, Human
cugguggggauaggccagccg

SEQ ID NO: 1452106 - RNA, 13 nt, Human
cuggugggccaac

SEQ ID NO: 1452107 - RNA, 20 nt, Human
cugguggccccguuucuggu

SEQ ID NO: 1452108 - RNA, 22 nt, Human
cugguggccccguuucuggugg

SEQ ID NO: 1452109 - RNA, 21 nt, Human
cugguggccccguuucuggug

SEQ ID NO: 1452110 - RNA, 21 nt, Human
cuggugcuucuccucuccuag

SEQ ID NO: 1452111 - RNA, 19 nt, Human
cuggugcuuaugcucuuaa

SEQ ID NO: 1452112 - RNA, 17 nt, Human
cuggugcuuaugcucuu

SEQ ID NO: 1452113 - RNA, 14 nt, Human
cuggugcuggaggu

SEQ ID NO: 1452114 - RNA, 19 nt, Human
cuggucucaaacuccugac

SEQ ID NO: 1452115 - RNA, 23 nt, Human
cuggucgcuccugcccacggagu

SEQ ID NO: 1452116 - RNA, 18 nt, Human
cuggucgcuccugcccac

SEQ ID NO: 1452117 - RNA, 16 nt, Human
cuggucgcuccugccc

SEQ ID NO: 1452118 - RNA, 15 nt, Human
cuggucgcuccugcc

SEQ ID NO: 1452119 - RNA, 14 nt, Human
cuggucgcuccugc

SEQ ID NO: 1452120 - RNA, 13 nt, Human
cuggucgcuccug

SEQ ID NO: 1452121 - RNA, 22 nt, Human
cugguccuuuuuggucgaggag

SEQ ID NO: 1452122 - RNA, 15 nt, Human
cugguccuuuuuggu

SEQ ID NO: 1452123 - RNA, 16 nt, Human
cugguccuuucuuccg

SEQ ID NO: 1452124 - RNA, 20 nt, Human
cuggucccggggccagcacu

SEQ ID NO: 1452125 - RNA, 19 nt, Human
cuggucccggggccagcac

SEQ ID NO: 1452126 - RNA, 17 nt, Human
cugguccccuccuuccc

SEQ ID NO: 1452127 - RNA, 14 nt, Human
cugguccccuccuu

SEQ ID NO: 1452128 - RNA, 18 nt, Human
cuggguugcagacaggaa

SEQ ID NO: 1452129 - RNA, 14 nt, Human
cugguccagggcua

SEQ ID NO: 1452130 - RNA, 13 nt, Human
cugguccagggcu

SEQ ID NO: 1452131 - RNA, 17 nt, Human
cuggguugccuuuauuu

SEQ ID NO: 1452132 - RNA, 15 nt, Human
cuggguugcagacag

SEQ ID NO: 1452133 - RNA, 15 nt, Human
cugggguggccacca

SEQ ID NO: 1452134 - RNA, 19 nt, Human
cuggguaggaaagaggaag

SEQ ID NO: 1452135 - RNA, 12 nt, Human
cugggcucagug

SEQ ID NO: 1452136 - RNA, 14 nt, Human
cugggcgcuggucc

SEQ ID NO: 1452137 - RNA, 17 nt, Human
cugggccuugggcuccg

SEQ ID NO: 1452138 - RNA, 15 nt, Human
cugggccuugggcuc

SEQ ID NO: 1452139 - RNA, 14 nt, Human
cugggccuugggcu

SEQ ID NO: 1452140 - RNA, 20 nt, Human
cugggccuuggccuggagca

SEQ ID NO: 1452141 - RNA, 19 nt, Human
cugggccuuggccuggagc

SEQ ID NO: 1452142 - RNA, 18 nt, Human
cugggccuuggccuggag

SEQ ID NO: 1452143 - RNA, 17 nt, Human
cugggccuuggccugga

SEQ ID NO: 1452144 - RNA, 16 nt, Human
cugggccuuggccugg

SEQ ID NO: 1452145 - RNA, 11 nt, Human
cugggccuugg

SEQ ID NO: 1452146 - RNA, 19 nt, Human
cugggccccugccucucug

SEQ ID NO: 1452147 - RNA, 18 nt, Human
cuggggugggcaguuuuu

SEQ ID NO: 1452148 - RNA, 16 nt, Human
cuggggugggcaguuu

SEQ ID NO: 1452149 - RNA, 16 nt, Human
cugggguggccaccag

SEQ ID NO: 1452150 - RNA, 17 nt, Human
cuggguagcgggggagg

SEQ ID NO: 1452151 - RNA, 14 nt, Human
cuggguaggaaaga

SEQ ID NO: 1452152 - RNA, 15 nt, Human
cuggguaggaaagag

SEQ ID NO: 1452153 - RNA, 17 nt, Human
cuggguaggaaagagga

SEQ ID NO: 1452154 - RNA, 18 nt, Human
cugggaaauauucccuag

SEQ ID NO: 1452155 - RNA, 16 nt, Human
cugggaaauauucccu

SEQ ID NO: 1452156 - RNA, 14 nt, Human
cugggaaaugagau

SEQ ID NO: 1452157 - RNA, 21 nt, Human
cuggcuucccauccccagcga

SEQ ID NO: 1452158 - RNA, 22 nt, Human
cuggcuucccauccccagcgau

SEQ ID NO: 1452159 - RNA, 20 nt, Human
cuggcuucccauccccagcg

SEQ ID NO: 1452160 - RNA, 18 nt, Human
cuggcuucccauccccag

SEQ ID NO: 1452161 - RNA, 19 nt, Human
cuggcuucuggccaggaag

SEQ ID NO: 1452162 - RNA, 17 nt, Human
cuggcuucuggccagga

SEQ ID NO: 1452163 - RNA, 13 nt, Human
cuggcuucuggcc

SEQ ID NO: 1452164 - RNA, 12 nt, Human
cuggcuucuggc

SEQ ID NO: 1452165 - RNA, 16 nt, Human
cuggcuucccaucccc

SEQ ID NO: 1452166 - RNA, 12 nt, Human
cuggcuguuuga

SEQ ID NO: 1452167 - RNA, 20 nt, Human
cuggcugcugaucgccuucc

SEQ ID NO: 1452168 - RNA, 21 nt, Human
cuggcugcugaucgccuuccc

SEQ ID NO: 1452169 - RNA, 23 nt, Human
cuggcucuugauaccccccucug

SEQ ID NO: 1452170 - RNA, 22 nt, Human
cuggcucuugauaccccccucu

SEQ ID NO: 1452171 - RNA, 21 nt, Human
cuggcucuugauaccccccuc

SEQ ID NO: 1452172 - RNA, 20 nt, Human
cuggcucuugauaccccccu

SEQ ID NO: 1452173 - RNA, 19 nt, Human
cugggcaaugauggcaauu

SEQ ID NO: 1452174 - RNA, 15 nt, Human
cugggauagaggggu

SEQ ID NO: 1452175 - RNA, 21 nt, Human
cugggauuacaggcgugagcc

SEQ ID NO: 1452176 - RNA, 23 nt, Human
cugggaguugaucgccuuuccca

SEQ ID NO: 1452177 - RNA, 17 nt, Human
cugggaggcuccccuuc

SEQ ID NO: 1452178 - RNA, 22 nt, Human
cugggagggcagcagggcuacc

SEQ ID NO: 1452179 - RNA, 12 nt, Human
cugggccccugc

SEQ ID NO: 1452180 - RNA, 16 nt, Human
cugggccccugccucu

SEQ ID NO: 1452181 - RNA, 17 nt, Human
cugggccccugccucuc

SEQ ID NO: 1452182 - RNA, 20 nt, Human
cugggagggcagcagggcua

SEQ ID NO: 1452183 - RNA, 19 nt, Human
cugggagggcagcagggcu

SEQ ID NO: 1452184 - RNA, 17 nt, Human
cugggagggcagcaggg

SEQ ID NO: 1452185 - RNA, 15 nt, Human
cugggagggcagcag

SEQ ID NO: 1452186 - RNA, 13 nt, Human
cugggagggcagc

SEQ ID NO: 1452187 - RNA, 11 nt, Human
cugggagggca

SEQ ID NO: 1452188 - RNA, 22 nt, Human
cugggagggacaugcuuagcag

SEQ ID NO: 1452189 - RNA, 16 nt, Human
cugggaggcuccccuu

SEQ ID NO: 1452190 - RNA, 17 nt, Human
cugggaggcucuggagc

SEQ ID NO: 1452191 - RNA, 15 nt, Human
cugggaggcucugga

SEQ ID NO: 1452192 - RNA, 16 nt, Human
cugggaggcucuggag

SEQ ID NO: 1452193 - RNA, 17 nt, Human
cugggaacucaucuggu

SEQ ID NO: 1452194 - RNA, 18 nt, Human
cugggaaccccuuuccca

SEQ ID NO: 1452195 - RNA, 17 nt, Human
cugggaaccccuuuccc

SEQ ID NO: 1452196 - RNA, 19 nt, Human
cugggaaccccuuucccac

SEQ ID NO: 1452197 - RNA, 21 nt, Human
cugggaacagugugcaaggca

SEQ ID NO: 1452198 - RNA, 16 nt, Human
cugggaaggcuacuuc

SEQ ID NO: 1452199 - RNA, 23 nt, Human
cugggagcuccacucugcuucuc

SEQ ID NO: 1452200 - RNA, 23 nt, Human
cugggaaggcuacuucggggcug

SEQ ID NO: 1452201 - RNA, 16 nt, Human
cugggagcuuuuguag

SEQ ID NO: 1452202 - RNA, 16 nt, Human
cuggacagcugugccu

SEQ ID NO: 1452203 - RNA, 15 nt, Human
cuggacagcugugcc

SEQ ID NO: 1452204 - RNA, 14 nt, Human
cuggacagcugugc

SEQ ID NO: 1452205 - RNA, 13 nt, Human
cuggacagcugug

SEQ ID NO: 1452206 - RNA, 19 nt, Human
cuggacagccccacccugg

SEQ ID NO: 1452207 - RNA, 18 nt, Human
cuggacagccccacccug

SEQ ID NO: 1452208 - RNA, 16 nt, Human
cuggacagccccaccc

SEQ ID NO: 1452209 - RNA, 15 nt, Human
cuggacagccccacc

SEQ ID NO: 1452210 - RNA, 14 nt, Human
cuggacagccccac

SEQ ID NO: 1452211 - RNA, 13 nt, Human
cuggacagcccca

SEQ ID NO: 1452212 - RNA, 18 nt, Human
cuggacacucagaccuga

SEQ ID NO: 1452213 - RNA, 21 nt, Human
cuggaauguaaucaauguuuc

SEQ ID NO: 1452214 - RNA, 15 nt, Human
cuggaauacaugaaa

SEQ ID NO: 1452215 - RNA, 14 nt, Human
cuggaauaaguuca

SEQ ID NO: 1452216 - RNA, 20 nt, Human
cuggaauguaaucaauguuu

SEQ ID NO: 1452217 - RNA, 15 nt, Human
cuggaauguaaucaa

SEQ ID NO: 1452218 - RNA, 14 nt, Human
cuggaauguaauca

SEQ ID NO: 1452219 - RNA, 22 nt, Human
cugcuuuucccuuugugaguca

SEQ ID NO: 1452220 - RNA, 21 nt, Human
cuggaagugcuaauuuugaaa

SEQ ID NO: 1452221 - RNA, 22 nt, Human
cuggaagcauuuguuucuacuu

SEQ ID NO: 1452222 - RNA, 23 nt, Human
cuggaauaauccuaaacauauga

SEQ ID NO: 1452223 - RNA, 19 nt, Human
cugcuuuucccuuugugag

SEQ ID NO: 1452224 - RNA, 18 nt, Human
cugcuuuucccuuuguga

SEQ ID NO: 1452225 - RNA, 14 nt, Human
cugcuuucuccuuu

SEQ ID NO: 1452226 - RNA, 15 nt, Human
cugcuuucuguucca

SEQ ID NO: 1452227 - RNA, 13 nt, Human
cugcuuucuguuc

SEQ ID NO: 1452228 - RNA, 11 nt, Human
cugcuuucugu

SEQ ID NO: 1452229 - RNA, 21 nt, Human
cugcucuuucucugccaguga

SEQ ID NO: 1452230 - RNA, 20 nt, Human
cugcucuuucucugccagug

SEQ ID NO: 1452231 - RNA, 19 nt, Human
cugcucuuucucugccagu

SEQ ID NO: 1452232 - RNA, 18 nt, Human
cugcucuuucucugccag

SEQ ID NO: 1452233 - RNA, 17 nt, Human
cugcucuuucucugcca

SEQ ID NO: 1452234 - RNA, 16 nt, Human
cugcucuuucucugcc

SEQ ID NO: 1452235 - RNA, 15 nt, Human
cugcucuuucucugc

SEQ ID NO: 1452236 - RNA, 14 nt, Human
cugcucuuucucug

SEQ ID NO: 1452237 - RNA, 23 nt, Human
cugcucuuggcuggacccagcca

SEQ ID NO: 1452238 - RNA, 22 nt, Human
cugcucugagaauuguugagau

SEQ ID NO: 1452239 - RNA, 22 nt, Human
cugcucuuucucugccagugac

SEQ ID NO: 1452240 - RNA, 13 nt, Human
cuggagcagaagg

SEQ ID NO: 1452241 - RNA, 12 nt, Human
cuggagcagcca

SEQ ID NO: 1452242 - RNA, 13 nt, Human
cuggagcagccac

SEQ ID NO: 1452243 - RNA, 14 nt, Human
cuggagcagccacc

SEQ ID NO: 1452244 - RNA, 17 nt, Human
cuggagcagccacccca

SEQ ID NO: 1452245 - RNA, 22 nt, Human
cuggagcagaccaccccgccug

SEQ ID NO: 1452246 - RNA, 18 nt, Human
cuggagcagaccaccccg

SEQ ID NO: 1452247 - RNA, 15 nt, Human
cuggagcagaccacc

SEQ ID NO: 1452248 - RNA, 13 nt, Human
cuggagcagacca

SEQ ID NO: 1452249 - RNA, 17 nt, Human
cuggagcagaagcagca

SEQ ID NO: 1452250 - RNA, 16 nt, Human
cuggagcagaagcagc

SEQ ID NO: 1452251 - RNA, 23 nt, Human
cuggagcacaauaaauggcugua

SEQ ID NO: 1452252 - RNA, 12 nt, Human
cuggagaggccc

SEQ ID NO: 1452253 - RNA, 20 nt, Human
cuggagagcauagggucugg

SEQ ID NO: 1452254 - RNA, 14 nt, Human
cuggagagaacagg

SEQ ID NO: 1452255 - RNA, 16 nt, Human
cuggagagaacagguu

SEQ ID NO: 1452256 - RNA, 21 nt, Human
cuggagacuuagggcaccagg

SEQ ID NO: 1452257 - RNA, 12 nt, Human
cuggaccagccu

SEQ ID NO: 1452258 - RNA, 15 nt, Human
cuggaccacugggca

SEQ ID NO: 1452259 - RNA, 14 nt, Human
cuggaccacugggc

SEQ ID NO: 1452260 - RNA, 23 nt, Human
cuggacaugaagauucuuuccca

SEQ ID NO: 1452261 - RNA, 20 nt, Human
cuggacagcugugccucgcu

SEQ ID NO: 1452262 - RNA, 19 nt, Human
cuggacagcugugccucgc

SEQ ID NO: 1452263 - RNA, 18 nt, Human
cuggacagcugugccucg

SEQ ID NO: 1452264 - RNA, 17 nt, Human
cuggacagcugugccuc

SEQ ID NO: 1452265 - RNA, 14 nt, Human
cuggacagcuugug

SEQ ID NO: 1452266 - RNA, 12 nt, Human
cuggacagcuug

SEQ ID NO: 1452267 - RNA, 21 nt, Human
cuggaggaccugagccugccg

SEQ ID NO: 1452268 - RNA, 22 nt, Human
cuggaggaccugagccugccga

SEQ ID NO: 1452269 - RNA, 20 nt, Human
cuggaggaccugagccugcc

SEQ ID NO: 1452270 - RNA, 19 nt, Human
cuggaggaccugagccugc

SEQ ID NO: 1452271 - RNA, 18 nt, Human
cuggaggaccugagccug

SEQ ID NO: 1452272 - RNA, 17 nt, Human
cuggaggaccugagccu

SEQ ID NO: 1452273 - RNA, 16 nt, Human
cuggaggaccugagcc

SEQ ID NO: 1452274 - RNA, 15 nt, Human
cuggaggaccugagc

SEQ ID NO: 1452275 - RNA, 14 nt, Human
cuggaggaccugag

SEQ ID NO: 1452276 - RNA, 12 nt, Human
cuggaggaccug

SEQ ID NO: 1452277 - RNA, 22 nt, Human
cuggagcuagaauuugauaugu

SEQ ID NO: 1452278 - RNA, 17 nt, Human
cuggagcuagaauuuga

SEQ ID NO: 1452279 - RNA, 16 nt, Human
cuggagcuagaauuug

SEQ ID NO: 1452280 - RNA, 21 nt, Human
cuggagcccacuguacuugcu

SEQ ID NO: 1452281 - RNA, 14 nt, Human
cuggagcauuucuc

SEQ ID NO: 1452282 - RNA, 14 nt, Human
cuggagccagccga

SEQ ID NO: 1452283 - RNA, 22 nt, Human
cuggagccagccgagcaggagg

SEQ ID NO: 1452284 - RNA, 12 nt, Human
cuggagccagcc

SEQ ID NO: 1452285 - RNA, 13 nt, Human
cuggagcccacug

SEQ ID NO: 1452286 - RNA, 15 nt, Human
cuggagcccacugua

SEQ ID NO: 1452287 - RNA, 16 nt, Human
cuggagcccacuguac

SEQ ID NO: 1452288 - RNA, 17 nt, Human
cuggagcccacuguacu

SEQ ID NO: 1452289 - RNA, 20 nt, Human
cuggagcccacuguacuugc

SEQ ID NO: 1452290 - RNA, 15 nt, Human
cuggccucugcuuuc

SEQ ID NO: 1452291 - RNA, 15 nt, Human
cuggccuccugccuc

SEQ ID NO: 1452292 - RNA, 16 nt, Human
cuggccuccugccucu

SEQ ID NO: 1452293 - RNA, 14 nt, Human
cuggccuccugccu

SEQ ID NO: 1452294 - RNA, 13 nt, Human
cuggccuccugcc

SEQ ID NO: 1452295 - RNA, 17 nt, Human
cuggccucccccacuuu

SEQ ID NO: 1452296 - RNA, 21 nt, Human
cuggccuccccugccaccagg

SEQ ID NO: 1452297 - RNA, 18 nt, Human
cuggccuccccugccacc

SEQ ID NO: 1452298 - RNA, 17 nt, Human
cuggccuccccugccac

SEQ ID NO: 1452299 - RNA, 16 nt, Human
cuggccuccccugcca

SEQ ID NO: 1452300 - RNA, 15 nt, Human
cuggccucccccacu

SEQ ID NO: 1452301 - RNA, 14 nt, Human
cuggccucccccac

SEQ ID NO: 1452302 - RNA, 21 nt, Human
cuggccucaaagcaagcauuc

SEQ ID NO: 1452303 - RNA, 16 nt, Human
cuggccucaaagcaag

SEQ ID NO: 1452304 - RNA, 23 nt, Human
cuggccuagcauacguacacauu

SEQ ID NO: 1452305 - RNA, 11 nt, Human
cuggcccaggg

SEQ ID NO: 1452306 - RNA, 12 nt, Human
cuggcccagggc

SEQ ID NO: 1452307 - RNA, 15 nt, Human
cuggcccagggccca

SEQ ID NO: 1452308 - RNA, 14 nt, Human
cuggcccagggccc

SEQ ID NO: 1452309 - RNA, 13 nt, Human
cuggcccagggcc

SEQ ID NO: 1452310 - RNA, 17 nt, Human
cuggccuagcauacgua

SEQ ID NO: 1452311 - RNA, 15 nt, Human
cuggcccagccuuug

SEQ ID NO: 1452312 - RNA, 21 nt, Human
cuggcccagccuuuguucccc

SEQ ID NO: 1452313 - RNA, 13 nt, Human
cuggcccagccuu

SEQ ID NO: 1452314 - RNA, 16 nt, Human
cuggcccaccccaccc

SEQ ID NO: 1452315 - RNA, 14 nt, Human
cuggcccaccccac

SEQ ID NO: 1452316 - RNA, 17 nt, Human
cuggccauggagaaagc

SEQ ID NO: 1452317 - RNA, 14 nt, Human
cuggcccaccaggg

SEQ ID NO: 1452318 - RNA, 13 nt, Human
cuggcccaccagg

SEQ ID NO: 1452319 - RNA, 20 nt, Human
cuggccauggccugcaaacu

SEQ ID NO: 1452320 - RNA, 22 nt, Human
cuggccauggccugcaaacugg

SEQ ID NO: 1452321 - RNA, 16 nt, Human
cuggccauggccugca

SEQ ID NO: 1452322 - RNA, 15 nt, Human
cuggccauggccugc

SEQ ID NO: 1452323 - RNA, 14 nt, Human
cuggccauggccug

SEQ ID NO: 1452324 - RNA, 13 nt, Human
cuggccauggccu

SEQ ID NO: 1452325 - RNA, 23 nt, Human
cuggccauggagaaagcugacuu

SEQ ID NO: 1452326 - RNA, 21 nt, Human
cuggccauggagaaagcugac

SEQ ID NO: 1452327 - RNA, 20 nt, Human
cuggccauggagaaagcuga

SEQ ID NO: 1452328 - RNA, 19 nt, Human
cuggccauggagaaagcug

SEQ ID NO: 1452329 - RNA, 18 nt, Human
cuggccauggagaaagcu

SEQ ID NO: 1452330 - RNA, 17 nt, Human
cuggccaagcugaggug

SEQ ID NO: 1452331 - RNA, 16 nt, Human
cuggccaagcugaggu

SEQ ID NO: 1452332 - RNA, 15 nt, Human
cuggccaagcugagg

SEQ ID NO: 1452333 - RNA, 14 nt, Human
cuggccaagcugag

SEQ ID NO: 1452334 - RNA, 13 nt, Human
cuggccaagcuga

SEQ ID NO: 1452335 - RNA, 22 nt, Human
cuggcauuagaauuauuuaaac

SEQ ID NO: 1452336 - RNA, 20 nt, Human
cuggcauuagaauuauuuaa

SEQ ID NO: 1452337 - RNA, 16 nt, Human
cuggaggcaccuggug

SEQ ID NO: 1452338 - RNA, 21 nt, Human
cuggaggagcccaggccagga

SEQ ID NO: 1452339 - RNA, 19 nt, Human
cuggaggagcccaggccag

SEQ ID NO: 1452340 - RNA, 16 nt, Human
cuggaggagcccaggc

SEQ ID NO: 1452341 - RNA, 15 nt, Human
cuggaggagcccagg

SEQ ID NO: 1452342 - RNA, 14 nt, Human
cuggaggagcccag

SEQ ID NO: 1452343 - RNA, 13 nt, Human
cuggaggagccca

SEQ ID NO: 1452344 - RNA, 12 nt, Human
cuggaggagccc

SEQ ID NO: 1452345 - RNA, 13 nt, Human
cuggauggggcag

SEQ ID NO: 1452346 - RNA, 15 nt, Human
cuggauguaccacca

SEQ ID NO: 1452347 - RNA, 24 nt, Human
cuggauggggcaggccaccuggcu

SEQ ID NO: 1452348 - RNA, 17 nt, Human
cuggauggggcaggcca

SEQ ID NO: 1452349 - RNA, 15 nt, Human
cuggauggggcaggc

SEQ ID NO: 1452350 - RNA, 13 nt, Human
cuggauuaaacuu

SEQ ID NO: 1452351 - RNA, 23 nt, Human
cuggauuaaacuuaaucuaaaug

SEQ ID NO: 1452352 - RNA, 17 nt, Human
cuggauuauauuaugaa

SEQ ID NO: 1452353 - RNA, 16 nt, Human
cuggauuauucugggg

SEQ ID NO: 1452354 - RNA, 21 nt, Human
cuggauuccagagcacugcuc

SEQ ID NO: 1452355 - RNA, 20 nt, Human
cuggauuccccaucucaggc

SEQ ID NO: 1452356 - RNA, 13 nt, Human
cuggauuccagag

SEQ ID NO: 1452357 - RNA, 14 nt, Human
cuggcacagccugg

SEQ ID NO: 1452358 - RNA, 21 nt, Human
cuggcaaugccacagcccugu

SEQ ID NO: 1452359 - RNA, 20 nt, Human
cuggcaaugccacagcccug

SEQ ID NO: 1452360 - RNA, 19 nt, Human
cuggcaaugccacagcccu

SEQ ID NO: 1452361 - RNA, 15 nt, Human
cuggcaaugccacag

SEQ ID NO: 1452362 - RNA, 12 nt, Human
cuggcaaugcca

SEQ ID NO: 1452363 - RNA, 21 nt, Human
cuggauuccccaucucaggcc

SEQ ID NO: 1452364 - RNA, 22 nt, Human
cuggauugaucggagccuccuc

SEQ ID NO: 1452365 - RNA, 15 nt, Human
cuuuguuggagucaa

SEQ ID NO: 1452366 - RNA, 17 nt, Human
cuuuguguagcuuugcu

SEQ ID NO: 1452367 - RNA, 23 nt, Human
cuuuguuuugcacacuuugccau

SEQ ID NO: 1452368 - RNA, 19 nt, Human
cuuuguuuugcacacuuug

SEQ ID NO: 1452369 - RNA, 16 nt, Human
cuuuguuuuauuuuca

SEQ ID NO: 1452370 - RNA, 15 nt, Human
cuuuguuuuauuuuc

SEQ ID NO: 1452371 - RNA, 18 nt, Human
cuuuguuuugugucucuu

SEQ ID NO: 1452372 - RNA, 17 nt, Human
cuuuguuuugugucucu

SEQ ID NO: 1452373 - RNA, 14 nt, Human
cuuuguuuuguguc

SEQ ID NO: 1452374 - RNA, 16 nt, Human
cuuuucuuaaaccuuc

SEQ ID NO: 1452375 - RNA, 15 nt, Human
cuuuucuuaaaccuu

SEQ ID NO: 1452376 - RNA, 17 nt, Human
cuuuucuguucuaguuu

SEQ ID NO: 1452377 - RNA, 16 nt, Human
cuuuucuguucuaguu

SEQ ID NO: 1452378 - RNA, 20 nt, Human
cuuuuucaaugaauuuuaua

SEQ ID NO: 1452379 - RNA, 15 nt, Human
cuuuuuauuugcaug

SEQ ID NO: 1452380 - RNA, 14 nt, Human
cuuuuuauuugcau

SEQ ID NO: 1452381 - RNA, 13 nt, Human
cuuuuuauuugca

SEQ ID NO: 1452382 - RNA, 16 nt, Human
cuuuuuauuucugcau

SEQ ID NO: 1452383 - RNA, 13 nt, Human
cuuuuuauuucug

SEQ ID NO: 1452384 - RNA, 19 nt, Human
cuuuuuaaaaauagacacu

SEQ ID NO: 1452385 - RNA, 13 nt, Human
cuuuuguuuauuu

SEQ ID NO: 1452386 - RNA, 16 nt, Human
cuuuuguuuccuuuuu

SEQ ID NO: 1452387 - RNA, 17 nt, Human
cuuuugacaaaggcaag

SEQ ID NO: 1452388 - RNA, 22 nt, Human
cuuuuguucuugguuuguaaau

SEQ ID NO: 1452389 - RNA, 16 nt, Human
cuuuuugaaguauuua

SEQ ID NO: 1452390 - RNA, 20 nt, Human
cuuuuugaggcaaaagaagg

SEQ ID NO: 1452391 - RNA, 15 nt, Human
cuuuuugaggcaaaa

SEQ ID NO: 1452392 - RNA, 14 nt, Human
cuuuuugaggcaaa

SEQ ID NO: 1452393 - RNA, 12 nt, Human
cuuuuugcagcu

SEQ ID NO: 1452394 - RNA, 13 nt, Human
cuuuuugcuuucg

SEQ ID NO: 1452395 - RNA, 13 nt, Human
cuuuuugcagcuu

SEQ ID NO: 1452396 - RNA, 14 nt, Human
cuuuuugcagcuuu

SEQ ID NO: 1452397 - RNA, 18 nt, Human
cuuuuuuaaaugaagaaa

SEQ ID NO: 1452398 - RNA, 20 nt, Human
gaaaagguucuuacugcuug

SEQ ID NO: 1452399 - RNA, 23 nt, Human
gaaaagguagaggagucacguua

SEQ ID NO: 1452400 - RNA, 21 nt, Human
gaaaagggagauucagacugu

SEQ ID NO: 1452401 - RNA, 15 nt, Human
gaaaaccuuucuuca

SEQ ID NO: 1452402 - RNA, 11 nt, Human
gaaaaccuuuc

SEQ ID NO: 1452403 - RNA, 14 nt, Human
gaaaacaaggaagu

SEQ ID NO: 1452404 - RNA, 13 nt, Human
gaaaacauuccau

SEQ ID NO: 1452405 - RNA, 19 nt, Human
gaaaacaugcuacacacug

SEQ ID NO: 1452406 - RNA, 21 nt, Human
gaaaacccuugggccagaagu

SEQ ID NO: 1452407 - RNA, 22 nt, Human
gaaaacccuugggccagaagua

SEQ ID NO: 1452408 - RNA, 20 nt, Human
gaaaacccuugggccagaag

SEQ ID NO: 1452409 - RNA, 17 nt, Human
gaaaacccuugggccag

SEQ ID NO: 1452410 - RNA, 20 nt, Human
gaaaacccccaaaccagaua

SEQ ID NO: 1452411 - RNA, 17 nt, Human
gaaaacauuccauccuu

SEQ ID NO: 1452412 - RNA, 13 nt, Human
gaaaaguauguuc

SEQ ID NO: 1452413 - RNA, 20 nt, Human
gaaaaguauauugauaaccu

SEQ ID NO: 1452414 - RNA, 20 nt, Human
gaaaaguauguuagugcaaa

SEQ ID NO: 1452415 - RNA, 23 nt, Human
gaaaagguuuaugaaaaagaaga

SEQ ID NO: 1452416 - RNA, 22 nt, Human
gaaaagguuuaugaaaaagaag

SEQ ID NO: 1452417 - RNA, 17 nt, Human
gaaaagguuuaugaaaa

SEQ ID NO: 1452418 - RNA, 14 nt, Human
gaaaaguauguuag

SEQ ID NO: 1452419 - RNA, 19 nt, Human
gaaaaguauguucuaaccu

SEQ ID NO: 1452420 - RNA, 15 nt, Human
gaaaaguauguucua

SEQ ID NO: 1452421 - RNA, 19 nt, Human
gaaaauaacaauaaaagac

SEQ ID NO: 1452422 - RNA, 21 nt, Human
gaaaaauugcugacuguagcu

SEQ ID NO: 1452423 - RNA, 22 nt, Human
gaaaaauugcugacuguagcuu

SEQ ID NO: 1452424 - RNA, 16 nt, Human
gaaaaauuccacucaa

SEQ ID NO: 1452425 - RNA, 16 nt, Human
gaaaaauauguaccaa

SEQ ID NO: 1452426 - RNA, 19 nt, Human
gaaaaauauauacuaaaca

SEQ ID NO: 1452427 - RNA, 16 nt, Human
cuuuuuuagaguugau

SEQ ID NO: 1452428 - RNA, 12 nt, Human
gaaaacaaggaa

SEQ ID NO: 1452429 - RNA, 13 nt, Human
gaaaacaaaacug

SEQ ID NO: 1452430 - RNA, 14 nt, Human
gaaaacaaggauga

SEQ ID NO: 1452431 - RNA, 18 nt, Human
gaaaacaugcuacacacu

SEQ ID NO: 1452432 - RNA, 21 nt, Human
cuuugaccuaaauuauuuacu

SEQ ID NO: 1452433 - RNA, 13 nt, Human
cuuugaccucugc

SEQ ID NO: 1452434 - RNA, 20 nt, Human
cuuugaaagguuagagaaua

SEQ ID NO: 1452435 - RNA, 19 nt, Human
cuuugacaaagguaaauca

SEQ ID NO: 1452436 - RNA, 22 nt, Human
cuuugcauggauuucuuugaaa

SEQ ID NO: 1452437 - RNA, 17 nt, Human
cuuugcauggauuucuu

SEQ ID NO: 1452438 - RNA, 15 nt, Human
cuuugcauggauuuc

SEQ ID NO: 1452439 - RNA, 16 nt, Human
cuuugcaucucaguau

SEQ ID NO: 1452440 - RNA, 22 nt, Human
cuuugcaucucaguaugaauua

SEQ ID NO: 1452441 - RNA, 14 nt, Human
cuuugcauuuugga

SEQ ID NO: 1452442 - RNA, 16 nt, Human
cuuugccacccucaug

SEQ ID NO: 1452443 - RNA, 17 nt, Human
cuuugccacccucaugc

SEQ ID NO: 1452444 - RNA, 12 nt, Human
cuuugcuucauu

SEQ ID NO: 1452445 - RNA, 18 nt, Human
cuuugccacccucaugcu

SEQ ID NO: 1452446 - RNA, 21 nt, Human
cuuugcuuuaauauaaaugca

SEQ ID NO: 1452447 - RNA, 19 nt, Human
cuuugcuuuaauauaaaug

SEQ ID NO: 1452448 - RNA, 18 nt, Human
cuuugcuuuaauauaaau

SEQ ID NO: 1452449 - RNA, 17 nt, Human
cuuugcuuuaauauaaa

SEQ ID NO: 1452450 - RNA, 16 nt, Human
cuuugcuuuaauauaa

SEQ ID NO: 1452451 - RNA, 19 nt, Human
cuuugcuugcuuugaagua

SEQ ID NO: 1452452 - RNA, 18 nt, Human
cuuugcuugcuuugaagu

SEQ ID NO: 1452453 - RNA, 13 nt, Human
cuuugcuugcuuu

SEQ ID NO: 1452454 - RNA, 12 nt, Human
cuuugcuugcuu

SEQ ID NO: 1452455 - RNA, 23 nt, Human
cuuugcuucauucaagucagcuc

SEQ ID NO: 1452456 - RNA, 18 nt, Human
cuuuguguagcuuugcuc

SEQ ID NO: 1452457 - RNA, 16 nt, Human
cuuuguguagcuuugc

SEQ ID NO: 1452458 - RNA, 23 nt, Human
cuuugugauucaaucuguaaacu

SEQ ID NO: 1452459 - RNA, 22 nt, Human
cuuugugauucaaucuguaaac

SEQ ID NO: 1452460 - RNA, 13 nt, Human
cuuugugagucaa

SEQ ID NO: 1452461 - RNA, 19 nt, Human
cuuugugagucaauacaua

SEQ ID NO: 1452462 - RNA, 12 nt, Human
cuuugugauuuu

SEQ ID NO: 1452463 - RNA, 21 nt, Human
cuuugggccagacaugccaca

SEQ ID NO: 1452464 - RNA, 13 nt, Human
cuuugggccagac

SEQ ID NO: 1452465 - RNA, 12 nt, Human
cuuugggccaga

SEQ ID NO: 1452466 - RNA, 17 nt, Human
cuuuggauuugacauug

SEQ ID NO: 1452467 - RNA, 16 nt, Human
cuuuggauuugacauu

SEQ ID NO: 1452468 - RNA, 15 nt, Human
cuuuggauuugacau

SEQ ID NO: 1452469 - RNA, 13 nt, Human
cuuuggauuugac

SEQ ID NO: 1452470 - RNA, 13 nt, Human
cuuuggcaggugc

SEQ ID NO: 1452471 - RNA, 14 nt, Human
cuuuggcagaguuc

SEQ ID NO: 1452472 - RNA, 24 nt, Human
cuuuggcaggugcagcccccacug

SEQ ID NO: 1452473 - RNA, 15 nt, Human
cuuuaggcauuaaau

SEQ ID NO: 1452474 - RNA, 23 nt, Human
cuuuaggcauuaaauuuuagcaa

SEQ ID NO: 1452475 - RNA, 15 nt, Human
cuuuaggagcagugg

SEQ ID NO: 1452476 - RNA, 20 nt, Human
cuuuagaguuagacuguugg

SEQ ID NO: 1452477 - RNA, 17 nt, Human
cuuuagaguuagacugu

SEQ ID NO: 1452478 - RNA, 22 nt, Human
cuuuagagaaguauacauaagu

SEQ ID NO: 1452479 - RNA, 14 nt, Human
cuuuagaguuagac

SEQ ID NO: 1452480 - RNA, 19 nt, Human
cuuuagagaaguauacaua

SEQ ID NO: 1452481 - RNA, 18 nt, Human
cuuucugaucaaggccuu

SEQ ID NO: 1452482 - RNA, 17 nt, Human
cuuucugaucaaggccu

SEQ ID NO: 1452483 - RNA, 16 nt, Human
cuuucugaucaaggcc

SEQ ID NO: 1452484 - RNA, 15 nt, Human
cuuucugaucaaggc

SEQ ID NO: 1452485 - RNA, 14 nt, Human
cuuucugaauugca

SEQ ID NO: 1452486 - RNA, 17 nt, Human
cuuucugaauugcacau

SEQ ID NO: 1452487 - RNA, 23 nt, Human
cuuucugaacagcugguguagcu

SEQ ID NO: 1452488 - RNA, 21 nt, Human
cuuucugaacagcugguguag

SEQ ID NO: 1452489 - RNA, 20 nt, Human
cuuucugaacagcuggugua

SEQ ID NO: 1452490 - RNA, 19 nt, Human
cuuucugaacagcuggugu

SEQ ID NO: 1452491 - RNA, 18 nt, Human
cuuucugaacagcuggug

SEQ ID NO: 1452492 - RNA, 17 nt, Human
cuuucugaacagcuggu

SEQ ID NO: 1452493 - RNA, 16 nt, Human
cuuucugaacagcugg

SEQ ID NO: 1452494 - RNA, 15 nt, Human
cuuucugaacagcug

SEQ ID NO: 1452495 - RNA, 14 nt, Human
cuuucugaacagcu

SEQ ID NO: 1452496 - RNA, 13 nt, Human
cuuucugaacagc

SEQ ID NO: 1452497 - RNA, 20 nt, Human
cuuucucuuuuccucuacca

SEQ ID NO: 1452498 - RNA, 13 nt, Human
cuuuccucgccug

SEQ ID NO: 1452499 - RNA, 22 nt, Human
cuuuccuccucaggcacacagc

SEQ ID NO: 1452500 - RNA, 20 nt, Human
cuuucuguauauacuuuuuu

SEQ ID NO: 1452501 - RNA, 19 nt, Human
cuuucuguauauacuuuuu

SEQ ID NO: 1452502 - RNA, 15 nt, Human
cuuucugccuggagu

SEQ ID NO: 1452503 - RNA, 14 nt, Human
cuuucugccuggag

SEQ ID NO: 1452504 - RNA, 12 nt, Human
cuuucugccugg

SEQ ID NO: 1452505 - RNA, 11 nt, Human
cuuucugccug

SEQ ID NO: 1452506 - RNA, 20 nt, Human
cuuucugaucaaggccuuau

SEQ ID NO: 1452507 - RNA, 20 nt, Human
cuuucuguuccaaauucagu

SEQ ID NO: 1452508 - RNA, 16 nt, Human
cuuucuguuccaaauu

SEQ ID NO: 1452509 - RNA, 15 nt, Human
cuuucuguuccaaau

SEQ ID NO: 1452510 - RNA, 14 nt, Human
cuuucuguuccaaa

SEQ ID NO: 1452511 - RNA, 13 nt, Human
cuuucuguuccaa

SEQ ID NO: 1452512 - RNA, 12 nt, Human
cuuucuguucca

SEQ ID NO: 1452513 - RNA, 22 nt, Human
cuuucuguuccaaauucaguuu

SEQ ID NO: 1452514 - RNA, 18 nt, Human
cuuucugucuucuacaga

SEQ ID NO: 1452515 - RNA, 17 nt, Human
cuuucuuuaaaguucuu

SEQ ID NO: 1452516 - RNA, 19 nt, Human
cuuucuuuuuuggccaucu

SEQ ID NO: 1452517 - RNA, 18 nt, Human
cuuucuuuuuuggccauc

SEQ ID NO: 1452518 - RNA, 16 nt, Human
cuuucuuuuuugauau

SEQ ID NO: 1452519 - RNA, 15 nt, Human
cuuucuuuuuugaua

SEQ ID NO: 1452520 - RNA, 22 nt, Human
cuuucuuuuuguagcuggggcu

SEQ ID NO: 1452521 - RNA, 21 nt, Human
cuuucuuuuuguagcuggggc

SEQ ID NO: 1452522 - RNA, 16 nt, Human
cuuucuuuuuguagcu

SEQ ID NO: 1452523 - RNA, 17 nt, Human
cuuugaaaaaaaauaaa

SEQ ID NO: 1452524 - RNA, 23 nt, Human
cuuucuuuuuuggccaucugcuc

SEQ ID NO: 1452525 - RNA, 13 nt, Human
cuuugaaacagaa

SEQ ID NO: 1452526 - RNA, 15 nt, Human
cuuugaaaaaaaaua

SEQ ID NO: 1452527 - RNA, 17 nt, Human
cuuugacaaagguaaau

SEQ ID NO: 1452528 - RNA, 23 nt, Human
cuuuagaaucccagcccccugac

SEQ ID NO: 1452529 - RNA, 21 nt, Human
cuuuagaaucccagcccccug

SEQ ID NO: 1452530 - RNA, 19 nt, Human
cuuuaccuuuuuuauacau

SEQ ID NO: 1452531 - RNA, 20 nt, Human
cuuuaccuuuuuuauacaua

SEQ ID NO: 1452532 - RNA, 17 nt, Human
cuuuaccuuuuuuauac

SEQ ID NO: 1452533 - RNA, 22 nt, Human
cuuguuuacaugcuuauuccau

SEQ ID NO: 1452534 - RNA, 16 nt, Human
cuuguuuacaugcuua

SEQ ID NO: 1452535 - RNA, 14 nt, Human
cuuguuuacaugcu

SEQ ID NO: 1452536 - RNA, 18 nt, Human
cuuguugagccgugggca

SEQ ID NO: 1452537 - RNA, 13 nt, Human
cuuguugagccgu

SEQ ID NO: 1452538 - RNA, 19 nt, Human
cuuguugagccgugggcaa

SEQ ID NO: 1452539 - RNA, 14 nt, Human
cuuguuuggggcag

SEQ ID NO: 1452540 - RNA, 17 nt, Human
cuuguuugcuucaacug

SEQ ID NO: 1452541 - RNA, 12 nt, Human
cuuguuucaauu

SEQ ID NO: 1452542 - RNA, 21 nt, Human
cuuguuuacaugcuuauucca

SEQ ID NO: 1452543 - RNA, 18 nt, Human
cuuguuuacaugcuuauu

SEQ ID NO: 1452544 - RNA, 17 nt, Human
cuuguuuacaugcuuau

SEQ ID NO: 1452545 - RNA, 22 nt, Human
cuuguuucaauuccaccugcaa

SEQ ID NO: 1452546 - RNA, 13 nt, Human
cuuguuucauauu

SEQ ID NO: 1452547 - RNA, 16 nt, Human
cuuguccuagcacaga

SEQ ID NO: 1452548 - RNA, 21 nt, Human
cuuguagcuccuccccuggag

SEQ ID NO: 1452549 - RNA, 23 nt, Human
cuuguagcuccuccccuggaggg

SEQ ID NO: 1452550 - RNA, 19 nt, Human
cuuguagcuccuccccugg

SEQ ID NO: 1452551 - RNA, 18 nt, Human
cuuguagcuccuccccug

SEQ ID NO: 1452552 - RNA, 16 nt, Human
cuuguagcuccucccc

SEQ ID NO: 1452553 - RNA, 14 nt, Human
cuuguagcuccucc

SEQ ID NO: 1452554 - RNA, 13 nt, Human
cuuguagcuccuc

SEQ ID NO: 1452555 - RNA, 21 nt, Human
cuuguagcccuuuccaagcuu

SEQ ID NO: 1452556 - RNA, 21 nt, Human
cuuguagccagccggggcgag

SEQ ID NO: 1452557 - RNA, 16 nt, Human
cuuguagccagccggg

SEQ ID NO: 1452558 - RNA, 15 nt, Human
cuuguagccagccgg

SEQ ID NO: 1452559 - RNA, 14 nt, Human
cuuguagccagccg

SEQ ID NO: 1452560 - RNA, 13 nt, Human
cuuguagccagcc

SEQ ID NO: 1452561 - RNA, 15 nt, Human
cuuguccuuucccuu

SEQ ID NO: 1452562 - RNA, 14 nt, Human
cuuguccuuucccu

SEQ ID NO: 1452563 - RNA, 19 nt, Human
cuuguccuuagccuggacc

SEQ ID NO: 1452564 - RNA, 18 nt, Human
cuuguccuuagccuggac

SEQ ID NO: 1452565 - RNA, 17 nt, Human
cuuguccuuagccugga

SEQ ID NO: 1452566 - RNA, 16 nt, Human
cuuguccuuagccugg

SEQ ID NO: 1452567 - RNA, 14 nt, Human
cuuguccuuagccu

SEQ ID NO: 1452568 - RNA, 17 nt, Human
cuuguccuagcacagau

SEQ ID NO: 1452569 - RNA, 20 nt, Human
cuuguccuagcacagauggc

SEQ ID NO: 1452570 - RNA, 14 nt, Human
cuuguggggccugg

SEQ ID NO: 1452571 - RNA, 20 nt, Human
cuuguccuuagccuggaccu

SEQ ID NO: 1452572 - RNA, 22 nt, Human
cuugucgccccucccucccaga

SEQ ID NO: 1452573 - RNA, 17 nt, Human
cuuguggggccugggag

SEQ ID NO: 1452574 - RNA, 18 nt, Human
cuuguggggccugggagg

SEQ ID NO: 1452575 - RNA, 16 nt, Human
cuuguggggccuggga

SEQ ID NO: 1452576 - RNA, 15 nt, Human
cuuguggggccuggg

SEQ ID NO: 1452577 - RNA, 17 nt, Human
cuuguuacuucugaggu

SEQ ID NO: 1452578 - RNA, 15 nt, Human
cuuguuacuucugag

SEQ ID NO: 1452579 - RNA, 14 nt, Human
cuuguuacuucuga

SEQ ID NO: 1452580 - RNA, 13 nt, Human
cuuguucugucac

SEQ ID NO: 1452581 - RNA, 18 nt, Human
cuuggagaagucucagcu

SEQ ID NO: 1452582 - RNA, 17 nt, Human
cuuggagaagucucagc

SEQ ID NO: 1452583 - RNA, 19 nt, Human
cuuggagaagucucagcua

SEQ ID NO: 1452584 - RNA, 14 nt, Human
cuuggacaaaucac

SEQ ID NO: 1452585 - RNA, 15 nt, Human
cuuggacacgcucag

SEQ ID NO: 1452586 - RNA, 19 nt, Human
cuugggcccuuugagugca

SEQ ID NO: 1452587 - RNA, 17 nt, Human
cuugggcccuuugagug

SEQ ID NO: 1452588 - RNA, 16 nt, Human
cuugggcccuuugagu

SEQ ID NO: 1452589 - RNA, 14 nt, Human
cuugggcccuuuga

SEQ ID NO: 1452590 - RNA, 16 nt, Human
cuugggcccacaccuc

SEQ ID NO: 1452591 - RNA, 18 nt, Human
cuugggcccacaccuccu

SEQ ID NO: 1452592 - RNA, 15 nt, Human
cuugggcccacaccu

SEQ ID NO: 1452593 - RNA, 23 nt, Human
cuugggccagaaguaccagacua

SEQ ID NO: 1452594 - RNA, 15 nt, Human
cuugggccagaagua

SEQ ID NO: 1452595 - RNA, 21 nt, Human
cuugggcacccccagccuggg

SEQ ID NO: 1452596 - RNA, 13 nt, Human
cuugggcagagcu

SEQ ID NO: 1452597 - RNA, 22 nt, Human
cuugggcacccccagccugggc

SEQ ID NO: 1452598 - RNA, 20 nt, Human
cuugggcacccccagccugg

SEQ ID NO: 1452599 - RNA, 19 nt, Human
cuugggcacccccagccug

SEQ ID NO: 1452600 - RNA, 18 nt, Human
cuugggcacccccagccu

SEQ ID NO: 1452601 - RNA, 17 nt, Human
cuugggcacccccagcc

SEQ ID NO: 1452602 - RNA, 13 nt, Human
cuugggcaccccc

SEQ ID NO: 1452603 - RNA, 17 nt, Human
cuugggauuugcugugu

SEQ ID NO: 1452604 - RNA, 13 nt, Human
cuuguacaaaaua

SEQ ID NO: 1452605 - RNA, 22 nt, Human
cuuguaauuuuuuuaauuuaca

SEQ ID NO: 1452606 - RNA, 22 nt, Human
cuuguaauuuuacacgcuuuug

SEQ ID NO: 1452607 - RNA, 18 nt, Human
cuuguaauuauggaguca

SEQ ID NO: 1452608 - RNA, 23 nt, Human
cuuguaauucuaaaugaauguuu

SEQ ID NO: 1452609 - RNA, 16 nt, Human
cuuguaauucuaaaug

SEQ ID NO: 1452610 - RNA, 12 nt, Human
cuuguacaaaau

SEQ ID NO: 1452611 - RNA, 15 nt, Human
cuuguaauucuaaau

SEQ ID NO: 1452612 - RNA, 13 nt, Human
cuuguaauucuaa

SEQ ID NO: 1452613 - RNA, 14 nt, Human
cuuguaauuaugga

SEQ ID NO: 1452614 - RNA, 11 nt, Human
cuuguaauuau

SEQ ID NO: 1452615 - RNA, 10 nt, Human
cuuguaauua

SEQ ID NO: 1452616 - RNA, 20 nt, Human
cuugguuuguaaauuaacuu

SEQ ID NO: 1452617 - RNA, 14 nt, Human
cuugguuuguaaau

SEQ ID NO: 1452618 - RNA, 15 nt, Human
cuugguuuguaaauu

SEQ ID NO: 1452619 - RNA, 15 nt, Human
cuugguuugccuucc

SEQ ID NO: 1452620 - RNA, 15 nt, Human
cuugguugucuggca

SEQ ID NO: 1452621 - RNA, 19 nt, Human
cuugguugguaggguggga

SEQ ID NO: 1452622 - RNA, 16 nt, Human
cuuggggcuggagagg

SEQ ID NO: 1452623 - RNA, 18 nt, Human
cuuggggcucacacaccu

SEQ ID NO: 1452624 - RNA, 18 nt, Human
cuuggggcugaugcaguu

SEQ ID NO: 1452625 - RNA, 13 nt, Human
cuugggcucugau

SEQ ID NO: 1452626 - RNA, 21 nt, Human
cuugggcuccgugugggagac

SEQ ID NO: 1452627 - RNA, 21 nt, Human
cuugggcucccuguaaccucu

SEQ ID NO: 1452628 - RNA, 13 nt, Human
cuugggcucccug

SEQ ID NO: 1452629 - RNA, 23 nt, Human
cuugggcucagggaccauggcuu

SEQ ID NO: 1452630 - RNA, 17 nt, Human
cuugggccuaggcugca

SEQ ID NO: 1452631 - RNA, 18 nt, Human
cuugggcucugaugaaaa

SEQ ID NO: 1452632 - RNA, 17 nt, Human
cuugggcucugaugaaa

SEQ ID NO: 1452633 - RNA, 16 nt, Human
cuugggcucugaugaa

SEQ ID NO: 1452634 - RNA, 16 nt, Human
cuuggggcugaugcag

SEQ ID NO: 1452635 - RNA, 23 nt, Human
cuugcaccccaaagcuuuccugc

SEQ ID NO: 1452636 - RNA, 22 nt, Human
cuugcaccccaaagcuuuccug

SEQ ID NO: 1452637 - RNA, 23 nt, Human
cuugcacagucacugcucuucag

SEQ ID NO: 1452638 - RNA, 19 nt, Human
cuugcacagucacugcucu

SEQ ID NO: 1452639 - RNA, 15 nt, Human
cuugcacagucacug

SEQ ID NO: 1452640 - RNA, 20 nt, Human
cuugagggggaaggauucug

SEQ ID NO: 1452641 - RNA, 22 nt, Human
cuugcagcucuccccuucucug

SEQ ID NO: 1452642 - RNA, 13 nt, Human
cuugagggggaag

SEQ ID NO: 1452643 - RNA, 19 nt, Human
cuugaggggaccaggagug

SEQ ID NO: 1452644 - RNA, 22 nt, Human
cuugagaaauauggacacuuaa

SEQ ID NO: 1452645 - RNA, 18 nt, Human
cuugagaaaccccucgau

SEQ ID NO: 1452646 - RNA, 19 nt, Human
cuucugggagggcagcagg

SEQ ID NO: 1452647 - RNA, 15 nt, Human
cuucugggagggcag

SEQ ID NO: 1452648 - RNA, 17 nt, Human
cuucuggccaggaagcu

SEQ ID NO: 1452649 - RNA, 15 nt, Human
cuucuggccaggaag

SEQ ID NO: 1452650 - RNA, 13 nt, Human
cuucuggccagga

SEQ ID NO: 1452651 - RNA, 22 nt, Human
cuucuggccaggaagcuuuggu

SEQ ID NO: 1452652 - RNA, 12 nt, Human
cuucuggccagg

SEQ ID NO: 1452653 - RNA, 21 nt, Human
cuugaggggaccaggaguggg

SEQ ID NO: 1452654 - RNA, 18 nt, Human
cuugaggggaccaggagu

SEQ ID NO: 1452655 - RNA, 17 nt, Human
cuugaggggaccaggag

SEQ ID NO: 1452656 - RNA, 16 nt, Human
cuugaggggaccagga

SEQ ID NO: 1452657 - RNA, 15 nt, Human
cuugaggggaccagg

SEQ ID NO: 1452658 - RNA, 23 nt, Human
cuugaggggaagcuagucuuuug

SEQ ID NO: 1452659 - RNA, 21 nt, Human
cuugaggggaagcuagucuuu

SEQ ID NO: 1452660 - RNA, 19 nt, Human
cuugaggggaagcuagucu

SEQ ID NO: 1452661 - RNA, 17 nt, Human
cuugccaaggcagaggc

SEQ ID NO: 1452662 - RNA, 14 nt, Human
cuugccaaggcaga

SEQ ID NO: 1452663 - RNA, 13 nt, Human
cuugccaaauuua

SEQ ID NO: 1452664 - RNA, 19 nt, Human
cuugccaaggcagaggccu

SEQ ID NO: 1452665 - RNA, 20 nt, Human
cuugccaaggcagaggccug

SEQ ID NO: 1452666 - RNA, 13 nt, Human
cuugccacacccc

SEQ ID NO: 1452667 - RNA, 19 nt, Human
cuugccacaccccccaccc

SEQ ID NO: 1452668 - RNA, 23 nt, Human
cuugccacaccccccaccccuag

SEQ ID NO: 1452669 - RNA, 13 nt, Human
cuugccacacucu

SEQ ID NO: 1452670 - RNA, 17 nt, Human
cuugcucuugaugccug

SEQ ID NO: 1452671 - RNA, 18 nt, Human
cuugcucuugaugccugg

SEQ ID NO: 1452672 - RNA, 19 nt, Human
cuugcucuugaugccuggc

SEQ ID NO: 1452673 - RNA, 19 nt, Human
cuugcuucuuucuagaaag

SEQ ID NO: 1452674 - RNA, 18 nt, Human
cuugcuucuuucuagaaa

SEQ ID NO: 1452675 - RNA, 15 nt, Human
cuugcuucuuucuag

SEQ ID NO: 1452676 - RNA, 14 nt, Human
cuugcuucuuucua

SEQ ID NO: 1452677 - RNA, 17 nt, Human
cuugcuucccuaaucua

SEQ ID NO: 1452678 - RNA, 13 nt, Human
cuugcuucccuaa

SEQ ID NO: 1452679 - RNA, 21 nt, Human
cuugcugcaagcacagcccuu

SEQ ID NO: 1452680 - RNA, 20 nt, Human
cuugcugcaagcacagcccu

SEQ ID NO: 1452681 - RNA, 20 nt, Human
cuugcuugauuguauggugg

SEQ ID NO: 1452682 - RNA, 14 nt, Human
cuuacuuggaacug

SEQ ID NO: 1452683 - RNA, 19 nt, Human
cuuacuuggaacugaaggg

SEQ ID NO: 1452684 - RNA, 14 nt, Human
cuuacuucucacua

SEQ ID NO: 1452685 - RNA, 18 nt, Human
cuuacuuauuaucuucag

SEQ ID NO: 1452686 - RNA, 23 nt, Human
cuuacuuaaacccagcucccuuc

SEQ ID NO: 1452687 - RNA, 16 nt, Human
cuuacuccugugggag

SEQ ID NO: 1452688 - RNA, 14 nt, Human
cuuacuccuguggg

SEQ ID NO: 1452689 - RNA, 13 nt, Human
cuuacuccugugg

SEQ ID NO: 1452690 - RNA, 12 nt, Human
cuuacuccugug

SEQ ID NO: 1452691 - RNA, 15 nt, Human
cuuacucccaggcac

SEQ ID NO: 1452692 - RNA, 15 nt, Human
cuuacuccuguggga

SEQ ID NO: 1452693 - RNA, 16 nt, Human
cuuacuguacaugaaa

SEQ ID NO: 1452694 - RNA, 20 nt, Human
cuuaccuuuuuauuugcaug

SEQ ID NO: 1452695 - RNA, 23 nt, Human
cuuacgaauacuuuugcccuuug

SEQ ID NO: 1452696 - RNA, 19 nt, Human
cuuaccuuuuuauuugcau

SEQ ID NO: 1452697 - RNA, 21 nt, Human
cuuaauguauguuaccaaaaa

SEQ ID NO: 1452698 - RNA, 22 nt, Human
cuuaauggcugauaauuuuaaa

SEQ ID NO: 1452699 - RNA, 20 nt, Human
cuuaauggcugauaauuuua

SEQ ID NO: 1452700 - RNA, 16 nt, Human
cuuaauggcugauaau

SEQ ID NO: 1452701 - RNA, 14 nt, Human
cuuaauguauguua

SEQ ID NO: 1452702 - RNA, 17 nt, Human
cuuaauguauguuacca

SEQ ID NO: 1452703 - RNA, 15 nt, Human
cuuagaaauuuauuu

SEQ ID NO: 1452704 - RNA, 14 nt, Human
cuuacuuuuuauau

SEQ ID NO: 1452705 - RNA, 17 nt, Human
cuuacuuuuuauauaua

SEQ ID NO: 1452706 - RNA, 16 nt, Human
cuuacuuuuuauauau

SEQ ID NO: 1452707 - RNA, 14 nt, Human
cuuagaaauuuauu

SEQ ID NO: 1452708 - RNA, 17 nt, Human
cuuagaguuggccauau

SEQ ID NO: 1452709 - RNA, 16 nt, Human
cuuagaucuggcaugu

SEQ ID NO: 1452710 - RNA, 15 nt, Human
cuuagaucuggcaug

SEQ ID NO: 1452711 - RNA, 20 nt, Human
cuuagaugcaguucugaaga

SEQ ID NO: 1452712 - RNA, 19 nt, Human
cuuagaugcaguucugaag

SEQ ID NO: 1452713 - RNA, 14 nt, Human
cuuaugaaaagaau

SEQ ID NO: 1452714 - RNA, 13 nt, Human
cuuaugaaaagaa

SEQ ID NO: 1452715 - RNA, 11 nt, Human
cuuaugaaaag

SEQ ID NO: 1452716 - RNA, 22 nt, Human
cuuaucugaucagaacaaaugu

SEQ ID NO: 1452717 - RNA, 23 nt, Human
cuuaugauagcaaauggccucau

SEQ ID NO: 1452718 - RNA, 22 nt, Human
cuuaugacaucacuuguacaaa

SEQ ID NO: 1452719 - RNA, 21 nt, Human
cuuaugacaucacuuguacaa

SEQ ID NO: 1452720 - RNA, 21 nt, Human
cuuaugaaaagaauuguuggg

SEQ ID NO: 1452721 - RNA, 18 nt, Human
cuuaugaaaagaauuguu

SEQ ID NO: 1452722 - RNA, 19 nt, Human
cuuauuuucaagaaacuga

SEQ ID NO: 1452723 - RNA, 18 nt, Human
cuuauuuucaagaaacug

SEQ ID NO: 1452724 - RNA, 15 nt, Human
cuuauuuucaagaaa

SEQ ID NO: 1452725 - RNA, 14 nt, Human
cuuauuuucaagaa

SEQ ID NO: 1452726 - RNA, 12 nt, Human
cuuauuuucaag

SEQ ID NO: 1452727 - RNA, 21 nt, Human
cuuagaucuggcauguuagcc

SEQ ID NO: 1452728 - RNA, 21 nt, Human
cuuaggguuaugauuaaguaa

SEQ ID NO: 1452729 - RNA, 13 nt, Human
cuuauaauuuaaa

SEQ ID NO: 1452730 - RNA, 14 nt, Human
cuuauaauaaagga

SEQ ID NO: 1452731 - RNA, 16 nt, Human
cuuauaauaaaggacu

SEQ ID NO: 1452732 - RNA, 20 nt, Human
cuuauaauaaaggacuguaa

SEQ ID NO: 1452733 - RNA, 22 nt, Human
cuuauaauucuuucaauacaga

SEQ ID NO: 1452734 - RNA, 17 nt, Human
cuuauaauaaaggacug

SEQ ID NO: 1452735 - RNA, 14 nt, Human
cuuauaauuuaaaa

SEQ ID NO: 1452736 - RNA, 16 nt, Human
cuuauaguucuaggca

SEQ ID NO: 1452737 - RNA, 15 nt, Human
cuuauaguucuaggc

SEQ ID NO: 1452738 - RNA, 14 nt, Human
cuuauaguucuagg

SEQ ID NO: 1452739 - RNA, 21 nt, Human
cuuauaguuacuguguaauua

SEQ ID NO: 1452740 - RNA, 19 nt, Human
cuuauaguuacuguguaau

SEQ ID NO: 1452741 - RNA, 18 nt, Human
cuuauaguuacuguguaa

SEQ ID NO: 1452742 - RNA, 16 nt, Human
cuuauaguuacugugu

SEQ ID NO: 1452743 - RNA, 15 nt, Human
cuuauaguuacugug

SEQ ID NO: 1452744 - RNA, 21 nt, Human
cuuauaauuguucucagaauc

SEQ ID NO: 1452745 - RNA, 14 nt, Human
cuuauaauuguucu

SEQ ID NO: 1452746 - RNA, 13 nt, Human
cuuauaguacaug

SEQ ID NO: 1452747 - RNA, 17 nt, Human
cuuauaguacaugauaa

SEQ ID NO: 1452748 - RNA, 14 nt, Human
cuuauaguuacugu

SEQ ID NO: 1452749 - RNA, 19 nt, Human
cuuauaguacaugauaaau

SEQ ID NO: 1452750 - RNA, 22 nt, Human
cuuaaucagguccucagagaau

SEQ ID NO: 1452751 - RNA, 20 nt, Human
cuuaaucagguccucagaga

SEQ ID NO: 1452752 - RNA, 21 nt, Human
cuuaaucagauagauauuccu

SEQ ID NO: 1452753 - RNA, 21 nt, Human
cuuaaguuaguuccacugaga

SEQ ID NO: 1452754 - RNA, 19 nt, Human
cuuaaguuaguuccacuga

SEQ ID NO: 1452755 - RNA, 14 nt, Human
cuuaaucuaaaugg

SEQ ID NO: 1452756 - RNA, 16 nt, Human
cuuaaucuaaauggaa

SEQ ID NO: 1452757 - RNA, 16 nt, Human
cuuaagugcugcaauu

SEQ ID NO: 1452758 - RNA, 17 nt, Human
cuuaagucagaacagca

SEQ ID NO: 1452759 - RNA, 18 nt, Human
cuuaagucagaacagcag

SEQ ID NO: 1452760 - RNA, 22 nt, Human
cuuaagcccagugcacugaaag

SEQ ID NO: 1452761 - RNA, 19 nt, Human
cuuaagcccagugcacuga

SEQ ID NO: 1452762 - RNA, 23 nt, Human
cuuaagcaucuggcucuaauuca

SEQ ID NO: 1452763 - RNA, 18 nt, Human
cuuaagcaucuggcucua

SEQ ID NO: 1452764 - RNA, 17 nt, Human
cuuaagcaucuggcucu

SEQ ID NO: 1452765 - RNA, 15 nt, Human
cuuaagcaucuggcu

SEQ ID NO: 1452766 - RNA, 22 nt, Human
cuuaacuucuugcuucuuucua

SEQ ID NO: 1452767 - RNA, 21 nt, Human
cuuaacuucuugcuucuuucu

SEQ ID NO: 1452768 - RNA, 18 nt, Human
cuuaacuucuugcuucuu

SEQ ID NO: 1452769 - RNA, 15 nt, Human
cuuaacuucuugcuu

SEQ ID NO: 1452770 - RNA, 14 nt, Human
cuuaacuucuugcu

SEQ ID NO: 1452771 - RNA, 21 nt, Human
cuuaagaagacugcauuauau

SEQ ID NO: 1452772 - RNA, 16 nt, Human
cuuaacuggucuccuu

SEQ ID NO: 1452773 - RNA, 16 nt, Human
cuuaacuggagcccca

SEQ ID NO: 1452774 - RNA, 12 nt, Human
cuuaacuucaca

SEQ ID NO: 1452775 - RNA, 14 nt, Human
cuuaacuucacaua

SEQ ID NO: 1452776 - RNA, 15 nt, Human
cuuaacuucacauau

SEQ ID NO: 1452777 - RNA, 16 nt, Human
cuuaacuucacauauu

SEQ ID NO: 1452778 - RNA, 17 nt, Human
cuuaacuucacauauug

SEQ ID NO: 1452779 - RNA, 22 nt, Human
cuuaacuucacauauugauuuc

SEQ ID NO: 1452780 - RNA, 20 nt, Human
cuuaacggaccaaagcaaga

SEQ ID NO: 1452781 - RNA, 17 nt, Human
cuuaacggaccaaagca

SEQ ID NO: 1452782 - RNA, 16 nt, Human
cuuaacggaccaaagc

SEQ ID NO: 1452783 - RNA, 16 nt, Human
cuuaaauguuauuauc

SEQ ID NO: 1452784 - RNA, 22 nt, Human
cuuaaaugcaaccauuugaaac

SEQ ID NO: 1452785 - RNA, 14 nt, Human
cuguuuuuuuguua

SEQ ID NO: 1452786 - RNA, 20 nt, Human
cugguucuuguguuggcugu

SEQ ID NO: 1452787 - RNA, 17 nt, Human
cugguucucaauuccaa

SEQ ID NO: 1452788 - RNA, 20 nt, Human
cuguuuaguagcagugauug

SEQ ID NO: 1452789 - RNA, 14 nt, Human
cuguuuagauaaua

SEQ ID NO: 1452790 - RNA, 14 nt, Human
cuguuuagaacaca

SEQ ID NO: 1452791 - RNA, 13 nt, Human
cuguuuagaacac

SEQ ID NO: 1452792 - RNA, 17 nt, Human
cuguuuacugcaagguu

SEQ ID NO: 1452793 - RNA, 15 nt, Human
cuguuuacugcaagg

SEQ ID NO: 1452794 - RNA, 12 nt, Human
cuguuuagauaa

SEQ ID NO: 1452795 - RNA, 16 nt, Human
cuguuuauuaaucuua

SEQ ID NO: 1452796 - RNA, 14 nt, Human
cuguuuauuaaucu

SEQ ID NO: 1452797 - RNA, 22 nt, Human
cuguuuauuaaaguacaaccau

SEQ ID NO: 1452798 - RNA, 17 nt, Human
cuguuuccuagcugugu

SEQ ID NO: 1452799 - RNA, 16 nt, Human
cuguuucccaggccca

SEQ ID NO: 1452800 - RNA, 18 nt, Human
cuguuuauuaaucuuagu

SEQ ID NO: 1452801 - RNA, 16 nt, Human
cuguuuccuagcugug

SEQ ID NO: 1452802 - RNA, 22 nt, Human
cuguuuuucggacaguuuauuu

SEQ ID NO: 1452803 - RNA, 17 nt, Human
cuguuuuucuaacuggg

SEQ ID NO: 1452804 - RNA, 20 nt, Human
cuguuuuucggacaguuuau

SEQ ID NO: 1452805 - RNA, 17 nt, Human
cuguuuuucggacaguu

SEQ ID NO: 1452806 - RNA, 15 nt, Human
cuguuuuucggacag

SEQ ID NO: 1452807 - RNA, 23 nt, Human
cuguuuuguuucgcucuuugaga

SEQ ID NO: 1452808 - RNA, 16 nt, Human
cuguuuuguuucgcuc

SEQ ID NO: 1452809 - RNA, 22 nt, Human
cuguuuuguugacauucugaau

SEQ ID NO: 1452810 - RNA, 21 nt, Human
cuguuuuguugacauucugaa

SEQ ID NO: 1452811 - RNA, 20 nt, Human
cuguuuuguugacauucuga

SEQ ID NO: 1452812 - RNA, 19 nt, Human
cuguuuuguugacauucug

SEQ ID NO: 1452813 - RNA, 17 nt, Human
cuguuuuguugacauuc

SEQ ID NO: 1452814 - RNA, 16 nt, Human
cuguuuuguugacauu

SEQ ID NO: 1452815 - RNA, 14 nt, Human
cuguuuuguugaca

SEQ ID NO: 1452816 - RNA, 13 nt, Human
cuguuuuguugac

SEQ ID NO: 1452817 - RNA, 19 nt, Human
cuguuuuguuauauaauuu

SEQ ID NO: 1452818 - RNA, 20 nt, Human
cuguuuuguuauauaauuua

SEQ ID NO: 1452819 - RNA, 18 nt, Human
cuguuuuguuauauaauu

SEQ ID NO: 1452820 - RNA, 17 nt, Human
cuguuuuguuauauaau

SEQ ID NO: 1452821 - RNA, 13 nt, Human
cuguuuuguuaua

SEQ ID NO: 1452822 - RNA, 17 nt, Human
cuguuuugaaggcaaaa

SEQ ID NO: 1452823 - RNA, 18 nt, Human
cuguuuucuucuauucca

SEQ ID NO: 1452824 - RNA, 12 nt, Human
cuguuuucuucu

SEQ ID NO: 1452825 - RNA, 19 nt, Human
cuguuuuauaauuuuguga

SEQ ID NO: 1452826 - RNA, 21 nt, Human
cuucccagaggggccugccac

SEQ ID NO: 1452827 - RNA, 16 nt, Human
cuucccagcuaggaag

SEQ ID NO: 1452828 - RNA, 22 nt, Human
cuucccagaggggccugccacc

SEQ ID NO: 1452829 - RNA, 19 nt, Human
cuucccagaggggccugcc

SEQ ID NO: 1452830 - RNA, 18 nt, Human
cuucccagaggggccugc

SEQ ID NO: 1452831 - RNA, 22 nt, Human
cuuccagucuuccugacacuuu

SEQ ID NO: 1452832 - RNA, 22 nt, Human
cuuccagguguuacuguaauuc

SEQ ID NO: 1452833 - RNA, 20 nt, Human
cuuccagguguuacuguaau

SEQ ID NO: 1452834 - RNA, 19 nt, Human
cuuccagguguuacuguaa

SEQ ID NO: 1452835 - RNA, 16 nt, Human
cuuccagguguuacug

SEQ ID NO: 1452836 - RNA, 14 nt, Human
cuuccagcuccugu

SEQ ID NO: 1452837 - RNA, 21 nt, Human
cuuccagucuuccugacacuu

SEQ ID NO: 1452838 - RNA, 20 nt, Human
cuuccagucuuccugacacu

SEQ ID NO: 1452839 - RNA, 13 nt, Human
cuuccaccacaga

SEQ ID NO: 1452840 - RNA, 23 nt, Human
cuuccaccaaguuggaacauccu

SEQ ID NO: 1452841 - RNA, 23 nt, Human
cuuccacagggucccacagccac

SEQ ID NO: 1452842 - RNA, 22 nt, Human
cuuccacagggucccacagcca

SEQ ID NO: 1452843 - RNA, 19 nt, Human
cuuccacagggucccacag

SEQ ID NO: 1452844 - RNA, 15 nt, Human
cuuccagcuccugua

SEQ ID NO: 1452845 - RNA, 13 nt, Human
cuuccagcuccug

SEQ ID NO: 1452846 - RNA, 12 nt, Human
cuuccagcuccu

SEQ ID NO: 1452847 - RNA, 22 nt, Human
cuuccagcuagugacccacaug

SEQ ID NO: 1452848 - RNA, 18 nt, Human
cuuccagcuagugaccca

SEQ ID NO: 1452849 - RNA, 16 nt, Human
cuuccagcuagugacc

SEQ ID NO: 1452850 - RNA, 14 nt, Human
cuucccucucugga

SEQ ID NO: 1452851 - RNA, 17 nt, Human
cuucccucaccuuggca

SEQ ID NO: 1452852 - RNA, 17 nt, Human
cuuccuaccaagucaaa

SEQ ID NO: 1452853 - RNA, 19 nt, Human
cuuccuaccaagucaaacu

SEQ ID NO: 1452854 - RNA, 17 nt, Human
cuuccggccccuccccu

SEQ ID NO: 1452855 - RNA, 13 nt, Human
cuuccggccccuc

SEQ ID NO: 1452856 - RNA, 23 nt, Human
cuuccgcuuggagcuauuuucca

SEQ ID NO: 1452857 - RNA, 22 nt, Human
cuuccgcuuggagcuauuuucc

SEQ ID NO: 1452858 - RNA, 17 nt, Human
cuuccgccacuggggcu

SEQ ID NO: 1452859 - RNA, 22 nt, Human
cuuccgccacuggggcucagag

SEQ ID NO: 1452860 - RNA, 16 nt, Human
cuuccgccacuggggc

SEQ ID NO: 1452861 - RNA, 15 nt, Human
cuuccgccacugggg

SEQ ID NO: 1452862 - RNA, 14 nt, Human
cuuccgccacuggg

SEQ ID NO: 1452863 - RNA, 16 nt, Human
cuucccuuuucuguuc

SEQ ID NO: 1452864 - RNA, 16 nt, Human
cuucccucucuggaga

SEQ ID NO: 1452865 - RNA, 14 nt, Human
cuucccuuuucugu

SEQ ID NO: 1452866 - RNA, 16 nt, Human
cuuccaaauccccuaa

SEQ ID NO: 1452867 - RNA, 18 nt, Human
cuucauuugggaugcuac

SEQ ID NO: 1452868 - RNA, 20 nt, Human
cuuccaaauccccuaagcag

SEQ ID NO: 1452869 - RNA, 19 nt, Human
cuuccaaauccccuaagca

SEQ ID NO: 1452870 - RNA, 16 nt, Human
cuuccaaugucuggag

SEQ ID NO: 1452871 - RNA, 18 nt, Human
cuuccacagggucccaca

SEQ ID NO: 1452872 - RNA, 15 nt, Human
cuuccacaggguccc

SEQ ID NO: 1452873 - RNA, 13 nt, Human
cuuccacaggguc

SEQ ID NO: 1452874 - RNA, 15 nt, Human
cuuccaaugucugga

SEQ ID NO: 1452875 - RNA, 14 nt, Human
cuucauuuccuccg

SEQ ID NO: 1452876 - RNA, 14 nt, Human
cuucagcucugaaa

SEQ ID NO: 1452877 - RNA, 13 nt, Human
cuucagcucugaa

SEQ ID NO: 1452878 - RNA, 22 nt, Human
cuucaggcccccgccuuggccu

SEQ ID NO: 1452879 - RNA, 17 nt, Human
cuuauuuuugacagugu

SEQ ID NO: 1452880 - RNA, 15 nt, Human
cuucagccaggagcu

SEQ ID NO: 1452881 - RNA, 17 nt, Human
cuucagccaggagcugg

SEQ ID NO: 1452882 - RNA, 18 nt, Human
cuucagcgguuuauauaa

SEQ ID NO: 1452883 - RNA, 18 nt, Human
cuucagccaggagcuggg

SEQ ID NO: 1452884 - RNA, 19 nt, Human
cuucagccaggagcugggc

SEQ ID NO: 1452885 - RNA, 15 nt, Human
cuucuggacugguuu

SEQ ID NO: 1452886 - RNA, 18 nt, Human
cuucugcucagcucuggg

SEQ ID NO: 1452887 - RNA, 16 nt, Human
cuucugcucagcucug

SEQ ID NO: 1452888 - RNA, 15 nt, Human
cuucugcucagcucu

SEQ ID NO: 1452889 - RNA, 14 nt, Human
cuucugcucagcuc

SEQ ID NO: 1452890 - RNA, 16 nt, Human
cuucugccuucucaug

SEQ ID NO: 1452891 - RNA, 14 nt, Human
cuucugccuucuca

SEQ ID NO: 1452892 - RNA, 21 nt, Human
cuucugccuuagucucaguuu

SEQ ID NO: 1452893 - RNA, 20 nt, Human
cuucugccuuagucucaguu

SEQ ID NO: 1452894 - RNA, 19 nt, Human
cuucugccuuagucucagu

SEQ ID NO: 1452895 - RNA, 21 nt, Human
cuucucguccucguuuguguu

SEQ ID NO: 1452896 - RNA, 19 nt, Human
cuucuccccagcucccagg

SEQ ID NO: 1452897 - RNA, 20 nt, Human
cuucuccccagcucccagga

SEQ ID NO: 1452898 - RNA, 18 nt, Human
cuucuccccagcucccag

SEQ ID NO: 1452899 - RNA, 17 nt, Human
cuucuccccagcuccca

SEQ ID NO: 1452900 - RNA, 17 nt, Human
cuucucccaggcaaggc

SEQ ID NO: 1452901 - RNA, 15 nt, Human
cuucucccaggcaag

SEQ ID NO: 1452902 - RNA, 14 nt, Human
cuucucccaggcaa

SEQ ID NO: 1452903 - RNA, 19 nt, Human
cuucucccacucuccuagg

SEQ ID NO: 1452904 - RNA, 20 nt, Human
cuucucccacucuccuaggc

SEQ ID NO: 1452905 - RNA, 17 nt, Human
cuucucccacucuccua

SEQ ID NO: 1452906 - RNA, 16 nt, Human
cuucucccacucuccu

SEQ ID NO: 1452907 - RNA, 15 nt, Human
cuucucccacucucc

SEQ ID NO: 1452908 - RNA, 13 nt, Human
cuucucccacucu

SEQ ID NO: 1452909 - RNA, 12 nt, Human
cuucucccacuc

SEQ ID NO: 1452910 - RNA, 20 nt, Human
cuucucccaggcaaggcugu

SEQ ID NO: 1452911 - RNA, 21 nt, Human
cuucucccaggcaaggcugug

SEQ ID NO: 1452912 - RNA, 19 nt, Human
cuucucccaggcaaggcug

SEQ ID NO: 1452913 - RNA, 18 nt, Human
cuucucccaggcaaggcu

SEQ ID NO: 1452914 - RNA, 20 nt, Human
cuucucauuuuuuaaaaaag

SEQ ID NO: 1452915 - RNA, 14 nt, Human
cuucuccauccaca

SEQ ID NO: 1452916 - RNA, 16 nt, Human
cuucuccauccacaug

SEQ ID NO: 1452917 - RNA, 17 nt, Human
cuucuccauggcccugc

SEQ ID NO: 1452918 - RNA, 15 nt, Human
cuucucccaauucau

SEQ ID NO: 1452919 - RNA, 19 nt, Human
cuucuccauggcccugcca

SEQ ID NO: 1452920 - RNA, 15 nt, Human
cuucgggcugugccc

SEQ ID NO: 1452921 - RNA, 14 nt, Human
cuucgggcugugcc

SEQ ID NO: 1452922 - RNA, 17 nt, Human
cuucgggcccuucccac

SEQ ID NO: 1452923 - RNA, 16 nt, Human
cuucgggcccuuccca

SEQ ID NO: 1452924 - RNA, 16 nt, Human
cuucgaguucccaggg

SEQ ID NO: 1452925 - RNA, 22 nt, Human
cuucuaaacuuccccaucuucu

SEQ ID NO: 1452926 - RNA, 19 nt, Human
cuucuaaacuuccccaucu

SEQ ID NO: 1452927 - RNA, 18 nt, Human
cuucuaaacuuccccauc

SEQ ID NO: 1452928 - RNA, 19 nt, Human
cuucuaaacccaauccaaa

SEQ ID NO: 1452929 - RNA, 18 nt, Human
cuucguuuauuuucaaga

SEQ ID NO: 1452930 - RNA, 16 nt, Human
cuucguuuauuuucaa

SEQ ID NO: 1452931 - RNA, 15 nt, Human
cuucguuuauuuuca

SEQ ID NO: 1452932 - RNA, 23 nt, Human
cuucucaggacacaggccugugu

SEQ ID NO: 1452933 - RNA, 22 nt, Human
cuucucaggacacaggccugug

SEQ ID NO: 1452934 - RNA, 21 nt, Human
cuucucaggacacaggccugu

SEQ ID NO: 1452935 - RNA, 20 nt, Human
cuucucaggacacaggccug

SEQ ID NO: 1452936 - RNA, 19 nt, Human
cuucucaggacacaggccu

SEQ ID NO: 1452937 - RNA, 18 nt, Human
cuucucaggacacaggcc

SEQ ID NO: 1452938 - RNA, 17 nt, Human
cuucucaggacacaggc

SEQ ID NO: 1452939 - RNA, 14 nt, Human
cuucucagauuucu

SEQ ID NO: 1452940 - RNA, 19 nt, Human
cuucucagauuucugagga

SEQ ID NO: 1452941 - RNA, 22 nt, Human
cuucucagauuucugaggaaau

SEQ ID NO: 1452942 - RNA, 17 nt, Human
cuucgacacuguucuua

SEQ ID NO: 1452943 - RNA, 16 nt, Human
cuucgacacuguucuu

SEQ ID NO: 1452944 - RNA, 15 nt, Human
cuuccuuuugaggga

SEQ ID NO: 1452945 - RNA, 17 nt, Human
cuuccuugcuuaaggua

SEQ ID NO: 1452946 - RNA, 22 nt, Human
cuuccuugaagaacugcaggcc

SEQ ID NO: 1452947 - RNA, 21 nt, Human
cuuccuugaagaacugcaggc

SEQ ID NO: 1452948 - RNA, 15 nt, Human
cuuccuaccuauccc

SEQ ID NO: 1452949 - RNA, 14 nt, Human
cuuccuuccucucc

SEQ ID NO: 1452950 - RNA, 16 nt, Human
cuuccuucccugcugu

SEQ ID NO: 1452951 - RNA, 22 nt, Human
gacuaaacuuuuuuucuguacc

SEQ ID NO: 1452952 - RNA, 20 nt, Human
gacuaaacuuuuuuucugua

SEQ ID NO: 1452953 - RNA, 19 nt, Human
gacuaaacuuuuuuucugu

SEQ ID NO: 1452954 - RNA, 18 nt, Human
gacuaaacuuuuuuucug

SEQ ID NO: 1452955 - RNA, 23 nt, Human
gacuaaccauguguuauguuuuc

SEQ ID NO: 1452956 - RNA, 22 nt, Human
gacuaacacucagaagccuggg

SEQ ID NO: 1452957 - RNA, 21 nt, Human
gacuaacacucagaagccugg

SEQ ID NO: 1452958 - RNA, 19 nt, Human
gacuaacacucagaagccu

SEQ ID NO: 1452959 - RNA, 16 nt, Human
gacuaacacucagaag

SEQ ID NO: 1452960 - RNA, 14 nt, Human
gacuaacacucaga

SEQ ID NO: 1452961 - RNA, 23 nt, Human
gacuaacuagacaccaaaguucu

SEQ ID NO: 1452962 - RNA, 21 nt, Human
gacuaacuagacaccaaaguu

SEQ ID NO: 1452963 - RNA, 23 nt, Human
gacuaacacucagaagccugggg

SEQ ID NO: 1452964 - RNA, 22 nt, Human
gacuaaucuuauucauuuucuc

SEQ ID NO: 1452965 - RNA, 15 nt, Human
gacuaaucuuauuca

SEQ ID NO: 1452966 - RNA, 22 nt, Human
gacuaauagaaaaguauguucu

SEQ ID NO: 1452967 - RNA, 12 nt, Human
gacuaagccagc

SEQ ID NO: 1452968 - RNA, 18 nt, Human
gacuaagccagcaccgga

SEQ ID NO: 1452969 - RNA, 23 nt, Human
gacuaagagaaguuguaaaguau

SEQ ID NO: 1452970 - RNA, 16 nt, Human
gacuaagagaaguugu

SEQ ID NO: 1452971 - RNA, 22 nt, Human
gacguuuuauaagcaucauuau

SEQ ID NO: 1452972 - RNA, 12 nt, Human
gacuaaaagaua

SEQ ID NO: 1452973 - RNA, 13 nt, Human
gacuaaaagauau

SEQ ID NO: 1452974 - RNA, 16 nt, Human
gacguuuuauaagcau

SEQ ID NO: 1452975 - RNA, 23 nt, Human
gacuaaaagauauaagugcugua

SEQ ID NO: 1452976 - RNA, 21 nt, Human
gacuaaaagauauaagugcug

SEQ ID NO: 1452977 - RNA, 22 nt, Human
gacuaaaagauauaagugcugu

SEQ ID NO: 1452978 - RNA, 17 nt, Human
gacuaaaagauauaagu

SEQ ID NO: 1452979 - RNA, 18 nt, Human
gacuaaaagauauaagug

SEQ ID NO: 1452980 - RNA, 19 nt, Human
gacuaaaagauauaagugc

SEQ ID NO: 1452981 - RNA, 20 nt, Human
gacuaaaagauauaagugcu

SEQ ID NO: 1452982 - RNA, 16 nt, Human
gacguggcucagccag

SEQ ID NO: 1452983 - RNA, 15 nt, Human
gacguggcucagcca

SEQ ID NO: 1452984 - RNA, 14 nt, Human
gacguggcucagcc

SEQ ID NO: 1452985 - RNA, 12 nt, Human
gacguggcucag

SEQ ID NO: 1452986 - RNA, 22 nt, Human
gacgugaccggacuuuucugca

SEQ ID NO: 1452987 - RNA, 17 nt, Human
gacgucuggguggcccu

SEQ ID NO: 1452988 - RNA, 18 nt, Human
gacggaaggguaaacaau

SEQ ID NO: 1452989 - RNA, 16 nt, Human
gaccuucgggcugugc

SEQ ID NO: 1452990 - RNA, 23 nt, Human
gaccuuccucauccaccccaucc

SEQ ID NO: 1452991 - RNA, 22 nt, Human
gaccuuccucauccaccccauc

SEQ ID NO: 1452992 - RNA, 14 nt, Human
gaccuuccucaucc

SEQ ID NO: 1452993 - RNA, 12 nt, Human
gaccuuccucau

SEQ ID NO: 1452994 - RNA, 19 nt, Human
gaccuucgggcugugcccg

SEQ ID NO: 1452995 - RNA, 18 nt, Human
gaccuucgggcugugccc

SEQ ID NO: 1452996 - RNA, 14 nt, Human
gaccuuaaaugcaa

SEQ ID NO: 1452997 - RNA, 19 nt, Human
gaccuguuagcagacaggc

SEQ ID NO: 1452998 - RNA, 18 nt, Human
gaccuguuagcagacagg

SEQ ID NO: 1452999 - RNA, 17 nt, Human
gaccuguuagcagacag

SEQ ID NO: 1453000 - RNA, 23 nt, Human
gaccugugagcccagcuggguca

SEQ ID NO: 1453001 - RNA, 14 nt, Human
gaccugugcacacc

SEQ ID NO: 1453002 - RNA, 19 nt, Human
gaccugugagcccagcugg

SEQ ID NO: 1453003 - RNA, 16 nt, Human
gaccugugagcccagc

SEQ ID NO: 1453004 - RNA, 15 nt, Human
gaccugugagcccag

SEQ ID NO: 1453005 - RNA, 12 nt, Human
gaccuguaauca

SEQ ID NO: 1453006 - RNA, 22 nt, Human
gaccuggugcugccucuaccug

SEQ ID NO: 1453007 - RNA, 17 nt, Human
gaccuggugcugccucu

SEQ ID NO: 1453008 - RNA, 23 nt, Human
gaccugguacccuccuggcucuu

SEQ ID NO: 1453009 - RNA, 21 nt, Human
gaccugguacccuccuggcuc

SEQ ID NO: 1453010 - RNA, 19 nt, Human
gaccugguacccuccuggc

SEQ ID NO: 1453011 - RNA, 17 nt, Human
gaccugguacccuccug

SEQ ID NO: 1453012 - RNA, 16 nt, Human
gaccuggcagcucugg

SEQ ID NO: 1453013 - RNA, 15 nt, Human
gaccuggcagcucug

SEQ ID NO: 1453014 - RNA, 10 nt, Human
gaccuggcag

SEQ ID NO: 1453015 - RNA, 21 nt, Human
gacccuugacaccugcugaga

SEQ ID NO: 1453016 - RNA, 21 nt, Human
gacccugccucucccaggcag

SEQ ID NO: 1453017 - RNA, 23 nt, Human
gacccugccucucccaggcaggg

SEQ ID NO: 1453018 - RNA, 16 nt, Human
gacccugccucuccca

SEQ ID NO: 1453019 - RNA, 13 nt, Human
gacccugccucuc

SEQ ID NO: 1453020 - RNA, 12 nt, Human
gacccugccucu

SEQ ID NO: 1453021 - RNA, 23 nt, Human
gacccugcccuuguuuggggcag

SEQ ID NO: 1453022 - RNA, 15 nt, Human
gacccugcccuuguu

SEQ ID NO: 1453023 - RNA, 13 nt, Human
gacccugcccuug

SEQ ID NO: 1453024 - RNA, 17 nt, Human
gacugagugggaagccc

SEQ ID NO: 1453025 - RNA, 16 nt, Human
gacugagugggaagcc

SEQ ID NO: 1453026 - RNA, 18 nt, Human
gacugaguacguugugca

SEQ ID NO: 1453027 - RNA, 14 nt, Human
gacugaccagcagc

SEQ ID NO: 1453028 - RNA, 13 nt, Human
gacugagaaauuu

SEQ ID NO: 1453029 - RNA, 20 nt, Human
gacugccaagacugcugugg

SEQ ID NO: 1453030 - RNA, 19 nt, Human
gacugccaagacugcugug

SEQ ID NO: 1453031 - RNA, 16 nt, Human
gacugaugucuccuaa

SEQ ID NO: 1453032 - RNA, 15 nt, Human
gacugaugucuccua

SEQ ID NO: 1453033 - RNA, 14 nt, Human
gacugaugucuccu

SEQ ID NO: 1453034 - RNA, 22 nt, Human
gacugagugggaagcccauccu

SEQ ID NO: 1453035 - RNA, 22 nt, Human
gacugaugucuccuaagcaccu

SEQ ID NO: 1453036 - RNA, 16 nt, Human
gacugauuucagagug

SEQ ID NO: 1453037 - RNA, 14 nt, Human
gacugauuucagag

SEQ ID NO: 1453038 - RNA, 18 nt, Human
gacugaugucuccuaagc

SEQ ID NO: 1453039 - RNA, 17 nt, Human
gacugaugucuccuaag

SEQ ID NO: 1453040 - RNA, 14 nt, Human
gacuacaggcguga

SEQ ID NO: 1453041 - RNA, 16 nt, Human
gacuaauggcaugaga

SEQ ID NO: 1453042 - RNA, 14 nt, Human
gacuaauggcauga

SEQ ID NO: 1453043 - RNA, 20 nt, Human
gacuaauggcaugagaaaua

SEQ ID NO: 1453044 - RNA, 16 nt, Human
gacucuaagaaagaac

SEQ ID NO: 1453045 - RNA, 15 nt, Human
gacucuaagaaagaa

SEQ ID NO: 1453046 - RNA, 14 nt, Human
gacucuaagaaaga

SEQ ID NO: 1453047 - RNA, 15 nt, Human
gacucuaaagucugu

SEQ ID NO: 1453048 - RNA, 15 nt, Human
gacugaccagcagcu

SEQ ID NO: 1453049 - RNA, 13 nt, Human
gacugaccagcag

SEQ ID NO: 1453050 - RNA, 21 nt, Human
gacugacaguuuacagacgcu

SEQ ID NO: 1453051 - RNA, 11 nt, Human
gacugagaaau

SEQ ID NO: 1453052 - RNA, 21 nt, Human
gacuuagaaaaccagcucagc

SEQ ID NO: 1453053 - RNA, 23 nt, Human
gacuuagaaaaccagcucagcac

SEQ ID NO: 1453054 - RNA, 15 nt, Human
gacuuacucuaagau

SEQ ID NO: 1453055 - RNA, 14 nt, Human
gacuuacucuaaga

SEQ ID NO: 1453056 - RNA, 12 nt, Human
gacuuacucuaa

SEQ ID NO: 1453057 - RNA, 19 nt, Human
gacuuacaugauucauuuu

SEQ ID NO: 1453058 - RNA, 18 nt, Human
gacuuacuguacaugaaa

SEQ ID NO: 1453059 - RNA, 23 nt, Human
gacuuacuguacaugaaaacaca

SEQ ID NO: 1453060 - RNA, 18 nt, Human
gacuuacaugauucauuu

SEQ ID NO: 1453061 - RNA, 16 nt, Human
gacuuacaugauucau

SEQ ID NO: 1453062 - RNA, 15 nt, Human
gacuuacaugauuca

SEQ ID NO: 1453063 - RNA, 14 nt, Human
gacuuacaugauuc

SEQ ID NO: 1453064 - RNA, 12 nt, Human
gacuuacuguac

SEQ ID NO: 1453065 - RNA, 15 nt, Human
gacuuacuguacaug

SEQ ID NO: 1453066 - RNA, 16 nt, Human
gacuuacuguacauga

SEQ ID NO: 1453067 - RNA, 21 nt, Human
gacuucaagcauggcuauuuu

SEQ ID NO: 1453068 - RNA, 17 nt, Human
gacuuagggcaccaggg

SEQ ID NO: 1453069 - RNA, 16 nt, Human
gacuuagggcaccagg

SEQ ID NO: 1453070 - RNA, 16 nt, Human
gacuuauaguacauga

SEQ ID NO: 1453071 - RNA, 17 nt, Human
gacuuauaguacaugau

SEQ ID NO: 1453072 - RNA, 18 nt, Human
gacuuauaguacaugaua

SEQ ID NO: 1453073 - RNA, 23 nt, Human
gacuggcuuuuauuaaugcacuu

SEQ ID NO: 1453074 - RNA, 22 nt, Human
gacuggcuuuuauuaaugcacu

SEQ ID NO: 1453075 - RNA, 21 nt, Human
gacuggcuuuuauuaaugcac

SEQ ID NO: 1453076 - RNA, 20 nt, Human
gacuggcuuuuauuaaugca

SEQ ID NO: 1453077 - RNA, 10 nt, Human
gacuggcuuu

SEQ ID NO: 1453078 - RNA, 20 nt, Human
gacugggaccaggcaccagg

SEQ ID NO: 1453079 - RNA, 18 nt, Human
gacugggaccaggcacca

SEQ ID NO: 1453080 - RNA, 16 nt, Human
gacugggaccaggcac

SEQ ID NO: 1453081 - RNA, 20 nt, Human
gacugggagcccccagccug

SEQ ID NO: 1453082 - RNA, 19 nt, Human
gacugggagcccccagccu

SEQ ID NO: 1453083 - RNA, 18 nt, Human
gacugggagcccccagcc

SEQ ID NO: 1453084 - RNA, 17 nt, Human
gacugggagcccccagc

SEQ ID NO: 1453085 - RNA, 21 nt, Human
gacugggagcccccagccugu

SEQ ID NO: 1453086 - RNA, 18 nt, Human
gacuggcggggggcccau

SEQ ID NO: 1453087 - RNA, 12 nt, Human
gacuggccaggg

SEQ ID NO: 1453088 - RNA, 15 nt, Human
gacuggccagggcca

SEQ ID NO: 1453089 - RNA, 24 nt, Human
gacuggcauacuauguggauguga

SEQ ID NO: 1453090 - RNA, 23 nt, Human
gacuggcauacuauguggaugug

SEQ ID NO: 1453091 - RNA, 22 nt, Human
gacuggcauacuauguggaugu

SEQ ID NO: 1453092 - RNA, 17 nt, Human
gacuggauguaccacca

SEQ ID NO: 1453093 - RNA, 22 nt, Human
gacuggauaguccgucucugcu

SEQ ID NO: 1453094 - RNA, 18 nt, Human
gacugcuaaauaaaauuu

SEQ ID NO: 1453095 - RNA, 17 nt, Human
gacugcuaaauaaaauu

SEQ ID NO: 1453096 - RNA, 14 nt, Human
gacugcuaaauaaa

SEQ ID NO: 1453097 - RNA, 17 nt, Human
gacugccauauuaaauu

SEQ ID NO: 1453098 - RNA, 15 nt, Human
gacugcggaggaagg

SEQ ID NO: 1453099 - RNA, 12 nt, Human
gacugcuaaaua

SEQ ID NO: 1453100 - RNA, 23 nt, Human
gacugcggaggaaggaggaccca

SEQ ID NO: 1453101 - RNA, 17 nt, Human
gacuggauaguccgucu

SEQ ID NO: 1453102 - RNA, 18 nt, Human
gacaggauguuugcucag

SEQ ID NO: 1453103 - RNA, 20 nt, Human
gacaggauguguuugcuuuc

SEQ ID NO: 1453104 - RNA, 19 nt, Human
gacaggauguguuugcuuu

SEQ ID NO: 1453105 - RNA, 19 nt, Human
gacagcagcaucucuaccu

SEQ ID NO: 1453106 - RNA, 16 nt, Human
gacagcagcaucucua

SEQ ID NO: 1453107 - RNA, 14 nt, Human
gacagcagcaucuc

SEQ ID NO: 1453108 - RNA, 18 nt, Human
gacagcaaccuguagagu

SEQ ID NO: 1453109 - RNA, 19 nt, Human
gacagaugccuccuuccuc

SEQ ID NO: 1453110 - RNA, 23 nt, Human
gacaggaugguucccuugaugaa

SEQ ID NO: 1453111 - RNA, 18 nt, Human
gacaggauguguuugcuu

SEQ ID NO: 1453112 - RNA, 14 nt, Human
gacaggauguguuu

SEQ ID NO: 1453113 - RNA, 20 nt, Human
gacauaaaguugauaaagau

SEQ ID NO: 1453114 - RNA, 19 nt, Human
gacauaaaguugauaaaga

SEQ ID NO: 1453115 - RNA, 17 nt, Human
gacauaaaguugauaaa

SEQ ID NO: 1453116 - RNA, 21 nt, Human
gacauaaaggaaaagacacau

SEQ ID NO: 1453117 - RNA, 17 nt, Human
gacauaaaggaaaagac

SEQ ID NO: 1453118 - RNA, 15 nt, Human
gacauaaaggaaaag

SEQ ID NO: 1453119 - RNA, 14 nt, Human
gacauaaaggaaaa

SEQ ID NO: 1453120 - RNA, 21 nt, Human
gacaguuuaccaguugccuuu

SEQ ID NO: 1453121 - RNA, 16 nt, Human
gacaguuuauuuguug

SEQ ID NO: 1453122 - RNA, 19 nt, Human
gacaguuuaccaguugccu

SEQ ID NO: 1453123 - RNA, 23 nt, Human
gacaguuuaccaguugccuuuua

SEQ ID NO: 1453124 - RNA, 15 nt, Human
gacaucacuuguaca

SEQ ID NO: 1453125 - RNA, 17 nt, Human
gacauaaccacugcuuc

SEQ ID NO: 1453126 - RNA, 22 nt, Human
gacauaaaguugauaaagauuu

SEQ ID NO: 1453127 - RNA, 21 nt, Human
gacaguuccagaagugugacu

SEQ ID NO: 1453128 - RNA, 17 nt, Human
gacaguucauauguacc

SEQ ID NO: 1453129 - RNA, 15 nt, Human
gacaguucauaugua

SEQ ID NO: 1453130 - RNA, 14 nt, Human
gacaguucaagaaa

SEQ ID NO: 1453131 - RNA, 17 nt, Human
gacagggcggggguggc

SEQ ID NO: 1453132 - RNA, 16 nt, Human
gacagggcgggggugg

SEQ ID NO: 1453133 - RNA, 18 nt, Human
gacagggcggggguggcg

SEQ ID NO: 1453134 - RNA, 16 nt, Human
gacaggcaaauaaaag

SEQ ID NO: 1453135 - RNA, 14 nt, Human
gacagaugccuccu

SEQ ID NO: 1453136 - RNA, 13 nt, Human
gacagaggcccuc

SEQ ID NO: 1453137 - RNA, 19 nt, Human
gacagaggccccagccucc

SEQ ID NO: 1453138 - RNA, 18 nt, Human
gacagaggccccagccuc

SEQ ID NO: 1453139 - RNA, 13 nt, Human
gacagaggcccca

SEQ ID NO: 1453140 - RNA, 21 nt, Human
gacagacaggcucuuagcagc

SEQ ID NO: 1453141 - RNA, 15 nt, Human
gacagacaggcucuu

SEQ ID NO: 1453142 - RNA, 14 nt, Human
gacagacaggcucu

SEQ ID NO: 1453143 - RNA, 18 nt, Human
gacacuagcccaaugaaa

SEQ ID NO: 1453144 - RNA, 17 nt, Human
gacagagcccugugagg

SEQ ID NO: 1453145 - RNA, 16 nt, Human
gacagagcccugugag

SEQ ID NO: 1453146 - RNA, 21 nt, Human
gacagagccccacccucagau

SEQ ID NO: 1453147 - RNA, 23 nt, Human
gacagagcgugagcugagcaggc

SEQ ID NO: 1453148 - RNA, 17 nt, Human
gaauuucccacauaccc

SEQ ID NO: 1453149 - RNA, 21 nt, Human
gaauuucaccuguaaaccuga

SEQ ID NO: 1453150 - RNA, 17 nt, Human
gaauuucaccuguaaac

SEQ ID NO: 1453151 - RNA, 12 nt, Human
gaauuucaccug

SEQ ID NO: 1453152 - RNA, 17 nt, Human
gaauuucccaggacccu

SEQ ID NO: 1453153 - RNA, 16 nt, Human
gaauuucccaggaccc

SEQ ID NO: 1453154 - RNA, 15 nt, Human
gaauuucccaggacc

SEQ ID NO: 1453155 - RNA, 14 nt, Human
gaauuucccaggac

SEQ ID NO: 1453156 - RNA, 22 nt, Human
gaauuucccaggacccugaagg

SEQ ID NO: 1453157 - RNA, 16 nt, Human
gaauuucacugucuuu

SEQ ID NO: 1453158 - RNA, 14 nt, Human
gacacgcacggcag

SEQ ID NO: 1453159 - RNA, 19 nt, Human
gacacgcacggcagccaca

SEQ ID NO: 1453160 - RNA, 20 nt, Human
gacacgcacggcagccacag

SEQ ID NO: 1453161 - RNA, 21 nt, Human
gacacgcacggcagccacagc

SEQ ID NO: 1453162 - RNA, 22 nt, Human
gacacgcacggcagccacagcu

SEQ ID NO: 1453163 - RNA, 22 nt, Human
gacacgggccuguccacaggcu

SEQ ID NO: 1453164 - RNA, 21 nt, Human
gacacgggccuguccacaggc

SEQ ID NO: 1453165 - RNA, 20 nt, Human
gacacgggccuguccacagg

SEQ ID NO: 1453166 - RNA, 19 nt, Human
gacacgggccuguccacag

SEQ ID NO: 1453167 - RNA, 18 nt, Human
gacacgggccuguccaca

SEQ ID NO: 1453168 - RNA, 15 nt, Human
gacacgggccugucc

SEQ ID NO: 1453169 - RNA, 14 nt, Human
gacacuacacccag

SEQ ID NO: 1453170 - RNA, 15 nt, Human
gacacuacacccagc

SEQ ID NO: 1453171 - RNA, 16 nt, Human
gacacuacacccagca

SEQ ID NO: 1453172 - RNA, 17 nt, Human
gacacuacacccagcaa

SEQ ID NO: 1453173 - RNA, 18 nt, Human
gacacuacacccagcaau

SEQ ID NO: 1453174 - RNA, 19 nt, Human
gacacuacacccagcaaua

SEQ ID NO: 1453175 - RNA, 20 nt, Human
gacacuacacccagcaauag

SEQ ID NO: 1453176 - RNA, 22 nt, Human
gaccagcagacagagccaggag

SEQ ID NO: 1453177 - RNA, 23 nt, Human
gaccagcagacagagccaggaga

SEQ ID NO: 1453178 - RNA, 20 nt, Human
gaccagcagacagagccagg

SEQ ID NO: 1453179 - RNA, 19 nt, Human
gaccagcagacagagccag

SEQ ID NO: 1453180 - RNA, 18 nt, Human
gaccagcagacagagcca

SEQ ID NO: 1453181 - RNA, 15 nt, Human
gaccagcagacagag

SEQ ID NO: 1453182 - RNA, 21 nt, Human
gaccacucagagacaugcaga

SEQ ID NO: 1453183 - RNA, 19 nt, Human
gaccacucagagacaugca

SEQ ID NO: 1453184 - RNA, 14 nt, Human
gaccacucagagac

SEQ ID NO: 1453185 - RNA, 13 nt, Human
gaccacucagaga

SEQ ID NO: 1453186 - RNA, 23 nt, Human
gaccaccagggcaucucugggcu

SEQ ID NO: 1453187 - RNA, 22 nt, Human
gaccaccagggcaucucugggc

SEQ ID NO: 1453188 - RNA, 21 nt, Human
gaccaccagggcaucucuggg

SEQ ID NO: 1453189 - RNA, 20 nt, Human
gaccaccagggcaucucugg

SEQ ID NO: 1453190 - RNA, 19 nt, Human
gaccaccagggcaucucug

SEQ ID NO: 1453191 - RNA, 13 nt, Human
gaccaccagggca

SEQ ID NO: 1453192 - RNA, 13 nt, Human
gaccacaugcccc

SEQ ID NO: 1453193 - RNA, 16 nt, Human
gaccacaggcucaggc

SEQ ID NO: 1453194 - RNA, 18 nt, Human
gaccacaggcucaggcag

SEQ ID NO: 1453195 - RNA, 13 nt, Human
gaccacaggcuca

SEQ ID NO: 1453196 - RNA, 16 nt, Human
gaccacagcacagcca

SEQ ID NO: 1453197 - RNA, 15 nt, Human
gaccacagcacagcc

SEQ ID NO: 1453198 - RNA, 14 nt, Human
gaccacagcacagc

SEQ ID NO: 1453199 - RNA, 12 nt, Human
gaccacagcaca

SEQ ID NO: 1453200 - RNA, 16 nt, Human
gaccacacccuguacu

SEQ ID NO: 1453201 - RNA, 14 nt, Human
gaccacaacaugag

SEQ ID NO: 1453202 - RNA, 12 nt, Human
gaccaauaaaga

SEQ ID NO: 1453203 - RNA, 15 nt, Human
gaccaagcaucuugg

SEQ ID NO: 1453204 - RNA, 20 nt, Human
gaccaagcaucuuggggggg

SEQ ID NO: 1453205 - RNA, 23 nt, Human
gacauccauguuccgagaagaac

SEQ ID NO: 1453206 - RNA, 22 nt, Human
gacaucacuuguacaaaauaaa

SEQ ID NO: 1453207 - RNA, 16 nt, Human
gacaucacuuguacaa

SEQ ID NO: 1453208 - RNA, 16 nt, Human
gacaucagguuuuucc

SEQ ID NO: 1453209 - RNA, 14 nt, Human
gacaucagcaaaca

SEQ ID NO: 1453210 - RNA, 13 nt, Human
gacauccagcaga

SEQ ID NO: 1453211 - RNA, 13 nt, Human
gacauccaggagg

SEQ ID NO: 1453212 - RNA, 22 nt, Human
gacauccagcagauuuccagcc

SEQ ID NO: 1453213 - RNA, 15 nt, Human
gacccagccaggccc

SEQ ID NO: 1453214 - RNA, 14 nt, Human
gacccagccaggcc

SEQ ID NO: 1453215 - RNA, 22 nt, Human
gaccagccgugagcauguuugg

SEQ ID NO: 1453216 - RNA, 18 nt, Human
gaccagccgugagcaugu

SEQ ID NO: 1453217 - RNA, 12 nt, Human
gaccagcagccc

SEQ ID NO: 1453218 - RNA, 16 nt, Human
gaccagcagccccaca

SEQ ID NO: 1453219 - RNA, 20 nt, Human
gacccagugcccccacugac

SEQ ID NO: 1453220 - RNA, 17 nt, Human
gacccagugcccccacu

SEQ ID NO: 1453221 - RNA, 16 nt, Human
gacccagugcccccac

SEQ ID NO: 1453222 - RNA, 15 nt, Human
gacccagugccccca

SEQ ID NO: 1453223 - RNA, 17 nt, Human
gacccagcccucauccc

SEQ ID NO: 1453224 - RNA, 16 nt, Human
gacccagcccucaucc

SEQ ID NO: 1453225 - RNA, 22 nt, Human
gacccagccaggcccagccgac

SEQ ID NO: 1453226 - RNA, 19 nt, Human
gacccagccaggcccagcc

SEQ ID NO: 1453227 - RNA, 17 nt, Human
gacccagccaggcccag

SEQ ID NO: 1453228 - RNA, 23 nt, Human
gacccaugaguuggggucuggca

SEQ ID NO: 1453229 - RNA, 17 nt, Human
gacccccucucccugca

SEQ ID NO: 1453230 - RNA, 20 nt, Human
gaccccccuuucacaggcag

SEQ ID NO: 1453231 - RNA, 23 nt, Human
gaccccaaacaccuuccagcucc

SEQ ID NO: 1453232 - RNA, 15 nt, Human
gaccccaccagccuc

SEQ ID NO: 1453233 - RNA, 15 nt, Human
gacccauuccuuccc

SEQ ID NO: 1453234 - RNA, 16 nt, Human
gacccauuccuuccca

SEQ ID NO: 1453235 - RNA, 14 nt, Human
gacccauuccuucc

SEQ ID NO: 1453236 - RNA, 22 nt, Human
gaccccccuuucacaggcagcc

SEQ ID NO: 1453237 - RNA, 19 nt, Human
gaccccccuuucacaggca

SEQ ID NO: 1453238 - RNA, 15 nt, Human
gaccccccuuucaca

SEQ ID NO: 1453239 - RNA, 23 nt, Human
gacccccagcuccggccuguccu

SEQ ID NO: 1453240 - RNA, 17 nt, Human
gacccccagcuccggcc

SEQ ID NO: 1453241 - RNA, 13 nt, Human
gacccccagcucc

SEQ ID NO: 1453242 - RNA, 12 nt, Human
gaccccagagga

SEQ ID NO: 1453243 - RNA, 15 nt, Human
gaccccagccaucca

SEQ ID NO: 1453244 - RNA, 17 nt, Human
gaauucggugugcacca

SEQ ID NO: 1453245 - RNA, 20 nt, Human
gaauucccucacucgucucc

SEQ ID NO: 1453246 - RNA, 21 nt, Human
gaauucccucacucgucuccc

SEQ ID NO: 1453247 - RNA, 14 nt, Human
gaauucccucacuc

SEQ ID NO: 1453248 - RNA, 13 nt, Human
gaauucccucacu

SEQ ID NO: 1453249 - RNA, 12 nt, Human
gaauucccucac

SEQ ID NO: 1453250 - RNA, 17 nt, Human
gaauucucuaguuugau

SEQ ID NO: 1453251 - RNA, 13 nt, Human
gaauucagacauc

SEQ ID NO: 1453252 - RNA, 19 nt, Human
gaauugaguguuuaaaguu

SEQ ID NO: 1453253 - RNA, 16 nt, Human
gaauugaguaauggug

SEQ ID NO: 1453254 - RNA, 14 nt, Human
gaauugaguaaugg

SEQ ID NO: 1453255 - RNA, 19 nt, Human
gaauucuugguugaggaaa

SEQ ID NO: 1453256 - RNA, 20 nt, Human
gaauucuugguugaggaaac

SEQ ID NO: 1453257 - RNA, 19 nt, Human
gaauucuuuaaaauuacaa

SEQ ID NO: 1453258 - RNA, 19 nt, Human
gaauucucuaguuugauua

SEQ ID NO: 1453259 - RNA, 16 nt, Human
gaauuuaauaaucugu

SEQ ID NO: 1453260 - RNA, 17 nt, Human
gaauugauuugcauuga

SEQ ID NO: 1453261 - RNA, 15 nt, Human
gaauugauuugcauu

SEQ ID NO: 1453262 - RNA, 14 nt, Human
gaauugauuugcau

SEQ ID NO: 1453263 - RNA, 13 nt, Human
gaauugauuugca

SEQ ID NO: 1453264 - RNA, 12 nt, Human
gaauugauuugc

SEQ ID NO: 1453265 - RNA, 15 nt, Human
gaauugaguguuuaa

SEQ ID NO: 1453266 - RNA, 18 nt, Human
gaauugauuugcauugaa

SEQ ID NO: 1453267 - RNA, 22 nt, Human
gaauuguugagauacuuuacua

SEQ ID NO: 1453268 - RNA, 16 nt, Human
gaauugugguuuauau

SEQ ID NO: 1453269 - RNA, 22 nt, Human
gaauugugguuuauauauuuaa

SEQ ID NO: 1453270 - RNA, 22 nt, Human
gaauuuaaauagcuuuuuucuc

SEQ ID NO: 1453271 - RNA, 15 nt, Human
gaauuguguuuauaa

SEQ ID NO: 1453272 - RNA, 23 nt, Human
gaauuguguuuauaauuuuaaau

SEQ ID NO: 1453273 - RNA, 14 nt, Human
gaauguaaauuugu

SEQ ID NO: 1453274 - RNA, 17 nt, Human
gaauguaaauuuguacu

SEQ ID NO: 1453275 - RNA, 15 nt, Human
gaauguaaagcuugu

SEQ ID NO: 1453276 - RNA, 20 nt, Human
gaauguaaagcuugucugau

SEQ ID NO: 1453277 - RNA, 21 nt, Human
gaauggauuuuucuuuaacug

SEQ ID NO: 1453278 - RNA, 17 nt, Human
gaauggaucacaagaug

SEQ ID NO: 1453279 - RNA, 19 nt, Human
gaauggaucacaagaugga

SEQ ID NO: 1453280 - RNA, 14 nt, Human
gaauggaucacaag

SEQ ID NO: 1453281 - RNA, 15 nt, Human
gaauggaaagcuuca

SEQ ID NO: 1453282 - RNA, 15 nt, Human
gaauggaggggcaga

SEQ ID NO: 1453283 - RNA, 16 nt, Human
gaauggaggggcagag

SEQ ID NO: 1453284 - RNA, 20 nt, Human
gaauggaggggcagagccag

SEQ ID NO: 1453285 - RNA, 21 nt, Human
gaauggaggggcagagccagg

SEQ ID NO: 1453286 - RNA, 22 nt, Human
gaauggaggggcagagccagga

SEQ ID NO: 1453287 - RNA, 16 nt, Human
gaaugggugcccacag

SEQ ID NO: 1453288 - RNA, 21 nt, Human
gaauggugugggagagggaug

SEQ ID NO: 1453289 - RNA, 23 nt, Human
gaaucuuuagagaaguauacaua

SEQ ID NO: 1453290 - RNA, 22 nt, Human
gaaucuuuagagaaguauacau

SEQ ID NO: 1453291 - RNA, 19 nt, Human
gaaucaagggucaggccuu

SEQ ID NO: 1453292 - RNA, 19 nt, Human
gaaucuuuaaaagaugcuu

SEQ ID NO: 1453293 - RNA, 11 nt, Human
gaaucaauaau

SEQ ID NO: 1453294 - RNA, 17 nt, Human
gaaucaagggucaggcc

SEQ ID NO: 1453295 - RNA, 16 nt, Human
gaaucaagggucaggc

SEQ ID NO: 1453296 - RNA, 21 nt, Human
gaaugccacugccuucgcuuc

SEQ ID NO: 1453297 - RNA, 14 nt, Human
gaaugccguggauu

SEQ ID NO: 1453298 - RNA, 22 nt, Human
gaaugccacugccuucgcuucu

SEQ ID NO: 1453299 - RNA, 14 nt, Human
gaaugcauuuuguu

SEQ ID NO: 1453300 - RNA, 19 nt, Human
gaaugaagauacugaaaua

SEQ ID NO: 1453301 - RNA, 21 nt, Human
gaaugaagauacugaaauaaa

SEQ ID NO: 1453302 - RNA, 18 nt, Human
gaaugaagauacugaaau

SEQ ID NO: 1453303 - RNA, 17 nt, Human
gaaugaagauacugaaa

SEQ ID NO: 1453304 - RNA, 13 nt, Human
gaaguuuuacauu

SEQ ID NO: 1453305 - RNA, 19 nt, Human
gaaguuugaauguuaaaua

SEQ ID NO: 1453306 - RNA, 20 nt, Human
gaaguuugaauguuaaauaa

SEQ ID NO: 1453307 - RNA, 13 nt, Human
gaaguuugaaugu

SEQ ID NO: 1453308 - RNA, 14 nt, Human
gaaguuugaauguu

SEQ ID NO: 1453309 - RNA, 16 nt, Human
gaaguuugaauguuaa

SEQ ID NO: 1453310 - RNA, 17 nt, Human
gaaguuugaauguuaaa

SEQ ID NO: 1453311 - RNA, 21 nt, Human
gaauaaucacgcuuuccugaa

SEQ ID NO: 1453312 - RNA, 20 nt, Human
gaauaaucacgcuuuccuga

SEQ ID NO: 1453313 - RNA, 19 nt, Human
gaauaaucacgcuuuccug

SEQ ID NO: 1453314 - RNA, 18 nt, Human
gaauaaucacgcuuuccu

SEQ ID NO: 1453315 - RNA, 20 nt, Human
gaauaauccuaaacauauga

SEQ ID NO: 1453316 - RNA, 17 nt, Human
gaaucaacauuucucaa

SEQ ID NO: 1453317 - RNA, 14 nt, Human
gaaucaaacauuuu

SEQ ID NO: 1453318 - RNA, 23 nt, Human
gaauauuuuguuuugugcagaga

SEQ ID NO: 1453319 - RNA, 22 nt, Human
gaauauuuguuauguagauaac

SEQ ID NO: 1453320 - RNA, 18 nt, Human
gaauauuugaaucuuguc

SEQ ID NO: 1453321 - RNA, 22 nt, Human
gaauauuugaaucuugucucaa

SEQ ID NO: 1453322 - RNA, 22 nt, Human
gaauaggcgaucacaacgugca

SEQ ID NO: 1453323 - RNA, 23 nt, Human
gaauaggcgaucacaacgugcau

SEQ ID NO: 1453324 - RNA, 14 nt, Human
gaauauuugaaucu

SEQ ID NO: 1453325 - RNA, 16 nt, Human
gaauauuugaaucuug

SEQ ID NO: 1453326 - RNA, 23 nt, Human
gaauaccacucuguaauugcaaa

SEQ ID NO: 1453327 - RNA, 16 nt, Human
gaauaccacucuguaa

SEQ ID NO: 1453328 - RNA, 15 nt, Human
gaauaccacucugua

SEQ ID NO: 1453329 - RNA, 12 nt, Human
gaauacccuuuu

SEQ ID NO: 1453330 - RNA, 21 nt, Human
gaauaccacucuguaauugca

SEQ ID NO: 1453331 - RNA, 19 nt, Human
gaauaccacucuguaauug

SEQ ID NO: 1453332 - RNA, 17 nt, Human
gaauaccacucuguaau

SEQ ID NO: 1453333 - RNA, 13 nt, Human
gaauaccugcuca

SEQ ID NO: 1453334 - RNA, 22 nt, Human
gaauagcuuuaaugauaugcuu

SEQ ID NO: 1453335 - RNA, 16 nt, Human
gaauaggcgaucacaa

SEQ ID NO: 1453336 - RNA, 13 nt, Human
gaauacugaacau

SEQ ID NO: 1453337 - RNA, 20 nt, Human
gaauacucuuauaucuauau

SEQ ID NO: 1453338 - RNA, 22 nt, Human
gaagcuaacagggaaggcaggc

SEQ ID NO: 1453339 - RNA, 21 nt, Human
gaagcuaacagggaaggcagg

SEQ ID NO: 1453340 - RNA, 20 nt, Human
gaagcuaacagggaaggcag

SEQ ID NO: 1453341 - RNA, 19 nt, Human
gaagcuaacagggaaggca

SEQ ID NO: 1453342 - RNA, 18 nt, Human
gaagcuaacagggaaggc

SEQ ID NO: 1453343 - RNA, 17 nt, Human
gaagcuaacagggaagg

SEQ ID NO: 1453344 - RNA, 16 nt, Human
gaagcuaacagggaag

SEQ ID NO: 1453345 - RNA, 15 nt, Human
gaagcuaacagggaa

SEQ ID NO: 1453346 - RNA, 14 nt, Human
gaagcuaacaggga

SEQ ID NO: 1453347 - RNA, 20 nt, Human
gaagcguuguccucagcccc

SEQ ID NO: 1453348 - RNA, 19 nt, Human
gaagcguuguccucagccc

SEQ ID NO: 1453349 - RNA, 13 nt, Human
gaagcguuguccu

SEQ ID NO: 1453350 - RNA, 20 nt, Human
gaaguagaaacaaaauacaa

SEQ ID NO: 1453351 - RNA, 14 nt, Human
gaaguaccagacua

SEQ ID NO: 1453352 - RNA, 13 nt, Human
gaaguaccagacu

SEQ ID NO: 1453353 - RNA, 21 nt, Human
gaaggugcugacggccaggga

SEQ ID NO: 1453354 - RNA, 19 nt, Human
gaaggugcugacggccagg

SEQ ID NO: 1453355 - RNA, 18 nt, Human
gaaggugcugacggccag

SEQ ID NO: 1453356 - RNA, 22 nt, Human
gaagguggauggccccagcaca

SEQ ID NO: 1453357 - RNA, 22 nt, Human
gaaguaauaugcacacauuuuu

SEQ ID NO: 1453358 - RNA, 18 nt, Human
gaagucaucuugcuacca

SEQ ID NO: 1453359 - RNA, 15 nt, Human
gaagucaucuugcua

SEQ ID NO: 1453360 - RNA, 18 nt, Human
gaagucauaccaaugaaa

SEQ ID NO: 1453361 - RNA, 14 nt, Human
gaaguauaaagaau

SEQ ID NO: 1453362 - RNA, 14 nt, Human
gaaguauaccugau

SEQ ID NO: 1453363 - RNA, 13 nt, Human
gaaguaggaagua

SEQ ID NO: 1453364 - RNA, 19 nt, Human
gaagucucaucuggggagc

SEQ ID NO: 1453365 - RNA, 24 nt, Human
gaagucucaucuggggagcaggca

SEQ ID NO: 1453366 - RNA, 18 nt, Human
gaagucucaucuggggag

SEQ ID NO: 1453367 - RNA, 13 nt, Human
gaagucucagcua

SEQ ID NO: 1453368 - RNA, 22 nt, Human
gaaguccaagcauuuagaugua

SEQ ID NO: 1453369 - RNA, 12 nt, Human
gaaguccaagca

SEQ ID NO: 1453370 - RNA, 12 nt, Human
gaaguuugaaug

SEQ ID NO: 1453371 - RNA, 16 nt, Human
gaacgaaaaugaaagc

SEQ ID NO: 1453372 - RNA, 20 nt, Human
gaaccuuugugcccuaucac

SEQ ID NO: 1453373 - RNA, 19 nt, Human
gaaccuuugugcccuauca

SEQ ID NO: 1453374 - RNA, 17 nt, Human
gaaccuuugugcccuau

SEQ ID NO: 1453375 - RNA, 18 nt, Human
gaacguuuucuaauugcu

SEQ ID NO: 1453376 - RNA, 20 nt, Human
gaacguuuucuaauugcuua

SEQ ID NO: 1453377 - RNA, 16 nt, Human
gaacguuuucuaauug

SEQ ID NO: 1453378 - RNA, 15 nt, Human
gaacguuuucuaauu

SEQ ID NO: 1453379 - RNA, 14 nt, Human
gaacguuuucuaau

SEQ ID NO: 1453380 - RNA, 21 nt, Human
gaacucagauccagggacaga

SEQ ID NO: 1453381 - RNA, 19 nt, Human
gaacucagauccagggaca

SEQ ID NO: 1453382 - RNA, 18 nt, Human
gaacucagauccagggac

SEQ ID NO: 1453383 - RNA, 16 nt, Human
gaacucagauccaggg

SEQ ID NO: 1453384 - RNA, 15 nt, Human
gaacucagauccagg

SEQ ID NO: 1453385 - RNA, 14 nt, Human
gaacucagauccag

SEQ ID NO: 1453386 - RNA, 13 nt, Human
gaacucagaucca

SEQ ID NO: 1453387 - RNA, 21 nt, Human
gaacuagaguuuagcuggaaa

SEQ ID NO: 1453388 - RNA, 19 nt, Human
gaacuaccuugguuccccc

SEQ ID NO: 1453389 - RNA, 21 nt, Human
gaacuaaagugcugcacucaa

SEQ ID NO: 1453390 - RNA, 19 nt, Human
gaacuagaauuugauuauu

SEQ ID NO: 1453391 - RNA, 20 nt, Human
gaacuaccuugguuccccca

SEQ ID NO: 1453392 - RNA, 14 nt, Human
gaacuacugaggau

SEQ ID NO: 1453393 - RNA, 21 nt, Human
gaaccucagccuggccagaca

SEQ ID NO: 1453394 - RNA, 19 nt, Human
gaaccucagccuggccaga

SEQ ID NO: 1453395 - RNA, 18 nt, Human
gaaccucagccuggccag

SEQ ID NO: 1453396 - RNA, 17 nt, Human
gaaccucagccuggcca

SEQ ID NO: 1453397 - RNA, 15 nt, Human
gaaccucagccuggc

SEQ ID NO: 1453398 - RNA, 14 nt, Human
gaaccucagccugg

SEQ ID NO: 1453399 - RNA, 13 nt, Human
gaaccucagccug

SEQ ID NO: 1453400 - RNA, 12 nt, Human
gaaccucagccu

SEQ ID NO: 1453401 - RNA, 15 nt, Human
gaacauugguucuuu

SEQ ID NO: 1453402 - RNA, 22 nt, Human
gaacauuggaauguucucagau

SEQ ID NO: 1453403 - RNA, 21 nt, Human
gaacauuggaauguucucaga

SEQ ID NO: 1453404 - RNA, 12 nt, Human
gaacauuggaau

SEQ ID NO: 1453405 - RNA, 14 nt, Human
gaacaucccuccug

SEQ ID NO: 1453406 - RNA, 11 nt, Human
gaaauuucaga

SEQ ID NO: 1453407 - RNA, 18 nt, Human
gaaauuucacauagccca

SEQ ID NO: 1453408 - RNA, 23 nt, Human
gaaauuuauuuccuaguucugua

SEQ ID NO: 1453409 - RNA, 19 nt, Human
gaaauuguauauuguaauu

SEQ ID NO: 1453410 - RNA, 13 nt, Human
gaaauuguauauu

SEQ ID NO: 1453411 - RNA, 22 nt, Human
gaaauuuauuuccuaguucugu

SEQ ID NO: 1453412 - RNA, 18 nt, Human
gaaauuguauuacaaauc

SEQ ID NO: 1453413 - RNA, 16 nt, Human
gaaauuuauaaacuuu

SEQ ID NO: 1453414 - RNA, 17 nt, Human
gaaauuuauaaacuuuu

SEQ ID NO: 1453415 - RNA, 19 nt, Human
gaaaauaggcaggaagccc

SEQ ID NO: 1453416 - RNA, 17 nt, Human
gaaaauaggcaggaagc

SEQ ID NO: 1453417 - RNA, 15 nt, Human
gaaaauaaagaaugg

SEQ ID NO: 1453418 - RNA, 16 nt, Human
gaaaauaaagaaugga

SEQ ID NO: 1453419 - RNA, 13 nt, Human
gaaaauaaagaau

SEQ ID NO: 1453420 - RNA, 12 nt, Human
gaaaauaaagaa

SEQ ID NO: 1453421 - RNA, 16 nt, Human
gaaaauauaaccagcc

SEQ ID NO: 1453422 - RNA, 16 nt, Human
gaaauuguauuacaaa

SEQ ID NO: 1453423 - RNA, 20 nt, Human
gaacagcagacucagcucug

SEQ ID NO: 1453424 - RNA, 21 nt, Human
gaacagcagacucagcucuga

SEQ ID NO: 1453425 - RNA, 18 nt, Human
gaacagauaaucccugua

SEQ ID NO: 1453426 - RNA, 17 nt, Human
gaacagauaaucccugu

SEQ ID NO: 1453427 - RNA, 18 nt, Human
gaacacucuuuugcuuua

SEQ ID NO: 1453428 - RNA, 16 nt, Human
gaacacucuuuugcuu

SEQ ID NO: 1453429 - RNA, 23 nt, Human
gaaauuucagauucccagagcaa

SEQ ID NO: 1453430 - RNA, 21 nt, Human
gaaauuucagauucccagagc

SEQ ID NO: 1453431 - RNA, 19 nt, Human
gaacauccaaaaucuugau

SEQ ID NO: 1453432 - RNA, 14 nt, Human
gaacaucacagcuu

SEQ ID NO: 1453433 - RNA, 18 nt, Human
gaacauauuguugaaagg

SEQ ID NO: 1453434 - RNA, 12 nt, Human
gaacauauuguu

SEQ ID NO: 1453435 - RNA, 16 nt, Human
gaacauagacagaaga

SEQ ID NO: 1453436 - RNA, 22 nt, Human
gaacauaccccuuacaaaugaa

SEQ ID NO: 1453437 - RNA, 13 nt, Human
gaacagcuggugu

SEQ ID NO: 1453438 - RNA, 14 nt, Human
gaacagcuggugua

SEQ ID NO: 1453439 - RNA, 12 nt, Human
gaacagcuggug

SEQ ID NO: 1453440 - RNA, 22 nt, Human
gaacagugugcaaggcagccgu

SEQ ID NO: 1453441 - RNA, 21 nt, Human
gaacagugugcaaggcagccg

SEQ ID NO: 1453442 - RNA, 17 nt, Human
gaacagugugcaaggca

SEQ ID NO: 1453443 - RNA, 24 nt, Human
gaacagugugcaaggcagccgugg

SEQ ID NO: 1453444 - RNA, 14 nt, Human
gaacauaaaaagga

SEQ ID NO: 1453445 - RNA, 16 nt, Human
gaacauaaaaaggaca

SEQ ID NO: 1453446 - RNA, 18 nt, Human
gaacauaaaaaggacauc

SEQ ID NO: 1453447 - RNA, 22 nt, Human
gaacauaaaaaggacaucagca

SEQ ID NO: 1453448 - RNA, 15 nt, Human
gaagcccucccaggu

SEQ ID NO: 1453449 - RNA, 13 nt, Human
gaagcccucccag

SEQ ID NO: 1453450 - RNA, 21 nt, Human
gaagcccggcuccuggucacc

SEQ ID NO: 1453451 - RNA, 19 nt, Human
gaagcccggcuccugguca

SEQ ID NO: 1453452 - RNA, 18 nt, Human
gaagcccggcuccugguc

SEQ ID NO: 1453453 - RNA, 17 nt, Human
gaagcccggcuccuggu

SEQ ID NO: 1453454 - RNA, 16 nt, Human
gaagcccggcuccugg

SEQ ID NO: 1453455 - RNA, 15 nt, Human
gaagcccggcuccug

SEQ ID NO: 1453456 - RNA, 14 nt, Human
gaagcccggcuccu

SEQ ID NO: 1453457 - RNA, 19 nt, Human
gaagcccauccugaccagc

SEQ ID NO: 1453458 - RNA, 22 nt, Human
gaagcccccagcuaagaaccug

SEQ ID NO: 1453459 - RNA, 21 nt, Human
gaagcccccagcuaagaaccu

SEQ ID NO: 1453460 - RNA, 17 nt, Human
gaagcccccagcuaaga

SEQ ID NO: 1453461 - RNA, 14 nt, Human
gaagcccccagcua

SEQ ID NO: 1453462 - RNA, 20 nt, Human
gaagcccccaccgugggcag

SEQ ID NO: 1453463 - RNA, 21 nt, Human
gaagcccauccugaccagcug

SEQ ID NO: 1453464 - RNA, 17 nt, Human
gaagcccauccugacca

SEQ ID NO: 1453465 - RNA, 16 nt, Human
gaagcccauccugacc

SEQ ID NO: 1453466 - RNA, 20 nt, Human
gaagccaauucagacaggca

SEQ ID NO: 1453467 - RNA, 18 nt, Human
gaagccaauucagacagg

SEQ ID NO: 1453468 - RNA, 20 nt, Human
gaagcauuguaaaauaauuc

SEQ ID NO: 1453469 - RNA, 17 nt, Human
gaagcauuguaaaauaa

SEQ ID NO: 1453470 - RNA, 13 nt, Human
gaagcauuguaaa

SEQ ID NO: 1453471 - RNA, 18 nt, Human
gaagcauucucauuggaa

SEQ ID NO: 1453472 - RNA, 21 nt, Human
gaagcauucucauuggaaauu

SEQ ID NO: 1453473 - RNA, 16 nt, Human
gaagcauucucauugg

SEQ ID NO: 1453474 - RNA, 20 nt, Human
gaagagguuuuaaagcuucc

SEQ ID NO: 1453475 - RNA, 16 nt, Human
gaagauagcugugacu

SEQ ID NO: 1453476 - RNA, 23 nt, Human
gaagaguaagucaaccugccuga

SEQ ID NO: 1453477 - RNA, 15 nt, Human
gaagauacugaaaua

SEQ ID NO: 1453478 - RNA, 21 nt, Human
gaacucaucuagguaaauuac

SEQ ID NO: 1453479 - RNA, 23 nt, Human
gaacuuugaccucugcagcaaua

SEQ ID NO: 1453480 - RNA, 20 nt, Human
gaacucaucuagguaaauua

SEQ ID NO: 1453481 - RNA, 22 nt, Human
gaagaaccaguccccccacccu

SEQ ID NO: 1453482 - RNA, 19 nt, Human
gaagaaccaguccccccac

SEQ ID NO: 1453483 - RNA, 16 nt, Human
gaacuuuuuauugauu

SEQ ID NO: 1453484 - RNA, 22 nt, Human
gaacucaucuagguaaauuaca

SEQ ID NO: 1453485 - RNA, 19 nt, Human
gaacuuugcugagccugua

SEQ ID NO: 1453486 - RNA, 17 nt, Human
gaagacuggaagcuaau

SEQ ID NO: 1453487 - RNA, 16 nt, Human
gaagacuggaagcuaa

SEQ ID NO: 1453488 - RNA, 15 nt, Human
gaagacuggaagcua

SEQ ID NO: 1453489 - RNA, 19 nt, Human
gaagaacugcaggcccugg

SEQ ID NO: 1453490 - RNA, 15 nt, Human
gaagaacugcaggcc

SEQ ID NO: 1453491 - RNA, 14 nt, Human
gaagaacugcaggc

SEQ ID NO: 1453492 - RNA, 13 nt, Human
gaagaacugcagg

SEQ ID NO: 1453493 - RNA, 19 nt, Human
gaagacugcauuauauuua

SEQ ID NO: 1453494 - RNA, 12 nt, Human
gaagaacugaaa

SEQ ID NO: 1453495 - RNA, 12 nt, Human
gaagagaaggag

SEQ ID NO: 1453496 - RNA, 13 nt, Human
gaagagaaggagc

SEQ ID NO: 1453497 - RNA, 14 nt, Human
gaagagaaggagca

SEQ ID NO: 1453498 - RNA, 15 nt, Human
gaagagaaggagcag

SEQ ID NO: 1453499 - RNA, 20 nt, Human
gaagaggccuguuuggccuc

SEQ ID NO: 1453500 - RNA, 18 nt, Human
gaagaggaggggaagagg

SEQ ID NO: 1453501 - RNA, 23 nt, Human
gaagagcaggacuccaggcccaa

SEQ ID NO: 1453502 - RNA, 22 nt, Human
gaagagcaggacuccaggccca

SEQ ID NO: 1453503 - RNA, 18 nt, Human
gaagagcaggacuccagg

SEQ ID NO: 1453504 - RNA, 23 nt, Human
gaagagcagcaccuccucagccu

SEQ ID NO: 1453505 - RNA, 12 nt, Human
gaagagcagccc

SEQ ID NO: 1453506 - RNA, 18 nt, Human
gaagagcagcaccuccuc

SEQ ID NO: 1453507 - RNA, 14 nt, Human
gaagagcagcaccu

SEQ ID NO: 1453508 - RNA, 20 nt, Human
gaagagagccugcaggaucu

SEQ ID NO: 1453509 - RNA, 17 nt, Human
gaagagaucaggaagag

SEQ ID NO: 1453510 - RNA, 16 nt, Human
gaagagaucaggaaga

SEQ ID NO: 1453511 - RNA, 20 nt, Human
gcaaaugucaugcugccuua

SEQ ID NO: 1453512 - RNA, 15 nt, Human
gcaacucuugauuau

SEQ ID NO: 1453513 - RNA, 14 nt, Human
gcaaauggccucau

SEQ ID NO: 1453514 - RNA, 12 nt, Human
gcaaaucuugaa

SEQ ID NO: 1453515 - RNA, 12 nt, Human
gcaaaugugaau

SEQ ID NO: 1453516 - RNA, 23 nt, Human
gcaaauguaguauggccuguguc

SEQ ID NO: 1453517 - RNA, 19 nt, Human
gcaaaugucaugcugccuu

SEQ ID NO: 1453518 - RNA, 18 nt, Human
gcaaaugucaugcugccu

SEQ ID NO: 1453519 - RNA, 23 nt, Human
gcaaaugugaaucauuuuaccuu

SEQ ID NO: 1453520 - RNA, 15 nt, Human
gcaaagugguucccu

SEQ ID NO: 1453521 - RNA, 17 nt, Human
gcaaauaacaaaugcca

SEQ ID NO: 1453522 - RNA, 19 nt, Human
gcaaauaacaaaugccaaa

SEQ ID NO: 1453523 - RNA, 12 nt, Human
gcaaauaaaagu

SEQ ID NO: 1453524 - RNA, 22 nt, Human
gcaaagacuauucccuucuaac

SEQ ID NO: 1453525 - RNA, 21 nt, Human
gcaaagacuauucccuucuaa

SEQ ID NO: 1453526 - RNA, 14 nt, Human
gcaaagaauugacu

SEQ ID NO: 1453527 - RNA, 22 nt, Human
gcaaacugggaaccccuuuccc

SEQ ID NO: 1453528 - RNA, 20 nt, Human
gcaaacugggaaccccuuuc

SEQ ID NO: 1453529 - RNA, 20 nt, Human
gcaaacuuuauuuuguguuu

SEQ ID NO: 1453530 - RNA, 22 nt, Human
gauuuguuuuuaaacuguacag

SEQ ID NO: 1453531 - RNA, 23 nt, Human
gauuuguuuuuaaacuguacagu

SEQ ID NO: 1453532 - RNA, 21 nt, Human
gauuuguuuuuaaacuguaca

SEQ ID NO: 1453533 - RNA, 18 nt, Human
gauuuguuuuuaaacugu

SEQ ID NO: 1453534 - RNA, 21 nt, Human
gcaaaccugaccccugcucag

SEQ ID NO: 1453535 - RNA, 19 nt, Human
gcaaaccugaccccugcuc

SEQ ID NO: 1453536 - RNA, 19 nt, Human
gcaaacccaucaacaaaaa

SEQ ID NO: 1453537 - RNA, 16 nt, Human
gcaaacugcaugccca

SEQ ID NO: 1453538 - RNA, 15 nt, Human
gcaaacugcaugccc

SEQ ID NO: 1453539 - RNA, 14 nt, Human
gcaaacugcaugcc

SEQ ID NO: 1453540 - RNA, 13 nt, Human
gcaaacugcaugc

SEQ ID NO: 1453541 - RNA, 23 nt, Human
gcaaacucuuuggucguuuuuuu

SEQ ID NO: 1453542 - RNA, 22 nt, Human
gcaaacucuuuggucguuuuuu

SEQ ID NO: 1453543 - RNA, 20 nt, Human
gcaaacucuuuggucguuuu

SEQ ID NO: 1453544 - RNA, 10 nt, Human
gcaaacucuu

SEQ ID NO: 1453545 - RNA, 23 nt, Human
gcaaacugggaaccccuuuccca

SEQ ID NO: 1453546 - RNA, 17 nt, Human
gcaaacugggaaccccu

SEQ ID NO: 1453547 - RNA, 19 nt, Human
gcaaacugcaugcccagag

SEQ ID NO: 1453548 - RNA, 22 nt, Human
gcaaacugcaugcccagagacc

SEQ ID NO: 1453549 - RNA, 18 nt, Human
gcaaacuuuauuuugugu

SEQ ID NO: 1453550 - RNA, 23 nt, Human
gcaagcaagaggccguggcugcu

SEQ ID NO: 1453551 - RNA, 15 nt, Human
gcaagcacagcccuu

SEQ ID NO: 1453552 - RNA, 20 nt, Human
gcaagcaauccuagguaggg

SEQ ID NO: 1453553 - RNA, 15 nt, Human
gcaagcaagaggccg

SEQ ID NO: 1453554 - RNA, 14 nt, Human
gcaagcaagaggcc

SEQ ID NO: 1453555 - RNA, 22 nt, Human
gcaacuuguccuagcacagaug

SEQ ID NO: 1453556 - RNA, 20 nt, Human
gcaacuuguccuagcacaga

SEQ ID NO: 1453557 - RNA, 19 nt, Human
gcaacuuguccuagcacag

SEQ ID NO: 1453558 - RNA, 21 nt, Human
gcaacuuguccuagcacagau

SEQ ID NO: 1453559 - RNA, 22 nt, Human
gcaacuuuguauaaaagggacu

SEQ ID NO: 1453560 - RNA, 23 nt, Human
gcaagauggggagugagaggcug

SEQ ID NO: 1453561 - RNA, 16 nt, Human
gcaaggaaaaacaggu

SEQ ID NO: 1453562 - RNA, 23 nt, Human
gcaagcuuaauggcugauaauuu

SEQ ID NO: 1453563 - RNA, 17 nt, Human
gcaagcuggcggcuggg

SEQ ID NO: 1453564 - RNA, 19 nt, Human
gcaagcugauuaaaugaca

SEQ ID NO: 1453565 - RNA, 17 nt, Human
gcaagcugauuaaauga

SEQ ID NO: 1453566 - RNA, 17 nt, Human
gcaagcauucagaagaa

SEQ ID NO: 1453567 - RNA, 14 nt, Human
gcaaugaacacuua

SEQ ID NO: 1453568 - RNA, 18 nt, Human
gcaagguccggcccaucc

SEQ ID NO: 1453569 - RNA, 20 nt, Human
gcaauccucccacuucagcc

SEQ ID NO: 1453570 - RNA, 23 nt, Human
gcaauccucccacuucagccucc

SEQ ID NO: 1453571 - RNA, 15 nt, Human
gauucagggaaagug

SEQ ID NO: 1453572 - RNA, 16 nt, Human
gauucauaguaacuuc

SEQ ID NO: 1453573 - RNA, 22 nt, Human
gauucaguuuucauuugguuca

SEQ ID NO: 1453574 - RNA, 15 nt, Human
gauucaguuuucauu

SEQ ID NO: 1453575 - RNA, 20 nt, Human
gauucaguguuaaaugugau

SEQ ID NO: 1453576 - RNA, 22 nt, Human
gauucagggaaagugggacagc

SEQ ID NO: 1453577 - RNA, 23 nt, Human
gauucaggaaaaggccuggggug

SEQ ID NO: 1453578 - RNA, 22 nt, Human
gauucaggaaaaggccuggggu

SEQ ID NO: 1453579 - RNA, 21 nt, Human
gauucaggaaaaggccugggg

SEQ ID NO: 1453580 - RNA, 20 nt, Human
gauucaggaaaaggccuggg

SEQ ID NO: 1453581 - RNA, 19 nt, Human
gauucaggaaaaggccugg

SEQ ID NO: 1453582 - RNA, 18 nt, Human
gauucaggaaaaggccug

SEQ ID NO: 1453583 - RNA, 17 nt, Human
gauucaggaaaaggccu

SEQ ID NO: 1453584 - RNA, 19 nt, Human
gauucauuuuaacaucuga

SEQ ID NO: 1453585 - RNA, 21 nt, Human
gauucaugccaauuagcaauu

SEQ ID NO: 1453586 - RNA, 23 nt, Human
gauuccaaagaguagaauugcau

SEQ ID NO: 1453587 - RNA, 19 nt, Human
gauuccaaagaguagaauu

SEQ ID NO: 1453588 - RNA, 18 nt, Human
gauuccaaagaguagaau

SEQ ID NO: 1453589 - RNA, 23 nt, Human
gauuacaaaucagaagucaucuu

SEQ ID NO: 1453590 - RNA, 21 nt, Human
gauuacaaaucagaagucauc

SEQ ID NO: 1453591 - RNA, 20 nt, Human
gauuacaaaucagaagucau

SEQ ID NO: 1453592 - RNA, 19 nt, Human
gauuacaaaucagaaguca

SEQ ID NO: 1453593 - RNA, 17 nt, Human
gauuacaaaucagaagu

SEQ ID NO: 1453594 - RNA, 16 nt, Human
gauuacaaaucagaag

SEQ ID NO: 1453595 - RNA, 20 nt, Human
gauguucuaaggcucugaga

SEQ ID NO: 1453596 - RNA, 19 nt, Human
gauguucuaagucuuucca

SEQ ID NO: 1453597 - RNA, 19 nt, Human
gauguucuaaggcucugag

SEQ ID NO: 1453598 - RNA, 18 nt, Human
gauguucuaaggcucuga

SEQ ID NO: 1453599 - RNA, 16 nt, Human
gauguucuaaggcucu

SEQ ID NO: 1453600 - RNA, 14 nt, Human
gauguucuaaggcu

SEQ ID NO: 1453601 - RNA, 13 nt, Human
gauguucuaaggc

SEQ ID NO: 1453602 - RNA, 22 nt, Human
gauguucuauuuuuuguuuugu

SEQ ID NO: 1453603 - RNA, 15 nt, Human
gauguucucuaucau

SEQ ID NO: 1453604 - RNA, 19 nt, Human
gauguucucuaucauuuaa

SEQ ID NO: 1453605 - RNA, 21 nt, Human
gauguucucuaucauuuaaua

SEQ ID NO: 1453606 - RNA, 22 nt, Human
gaugcagugcucgcuguugcug

SEQ ID NO: 1453607 - RNA, 23 nt, Human
gauguuuauucuucuagaguuca

SEQ ID NO: 1453608 - RNA, 21 nt, Human
gauguuuauucuucuagaguu

SEQ ID NO: 1453609 - RNA, 19 nt, Human
gauguuuauucuucuagag

SEQ ID NO: 1453610 - RNA, 18 nt, Human
gauguucuggauaccauu

SEQ ID NO: 1453611 - RNA, 14 nt, Human
gauuaaguaaugau

SEQ ID NO: 1453612 - RNA, 21 nt, Human
gauguuuuaaggaugcuugua

SEQ ID NO: 1453613 - RNA, 22 nt, Human
gauuaaguaaugauaacuggaa

SEQ ID NO: 1453614 - RNA, 21 nt, Human
gauugcugccccaucagugcu

SEQ ID NO: 1453615 - RNA, 20 nt, Human
gauuggccuguagaguugcu

SEQ ID NO: 1453616 - RNA, 23 nt, Human
gauuggccuguagaguugcugag

SEQ ID NO: 1453617 - RNA, 16 nt, Human
gauuggccuguagagu

SEQ ID NO: 1453618 - RNA, 11 nt, Human
gauuggccugu

SEQ ID NO: 1453619 - RNA, 20 nt, Human
gauugcugccccaucagugc

SEQ ID NO: 1453620 - RNA, 16 nt, Human
gauugcugccccauca

SEQ ID NO: 1453621 - RNA, 16 nt, Human
gauuuguuuuuaaacu

SEQ ID NO: 1453622 - RNA, 18 nt, Human
gauuugaagaacauguga

SEQ ID NO: 1453623 - RNA, 14 nt, Human
gauuucuuugaaaa

SEQ ID NO: 1453624 - RNA, 17 nt, Human
gauuucuuugaaaaaaa

SEQ ID NO: 1453625 - RNA, 21 nt, Human
gauuucauuucaacuguuugc

SEQ ID NO: 1453626 - RNA, 20 nt, Human
gauuucaugcuaucucugug

SEQ ID NO: 1453627 - RNA, 18 nt, Human
gauuucaugcuaucucug

SEQ ID NO: 1453628 - RNA, 16 nt, Human
gauuucaugcuaucuc

SEQ ID NO: 1453629 - RNA, 13 nt, Human
gauuucaugauuu

SEQ ID NO: 1453630 - RNA, 20 nt, Human
gauuucauuucaacuguuug

SEQ ID NO: 1453631 - RNA, 22 nt, Human
gauuucuguuuagauaauacac

SEQ ID NO: 1453632 - RNA, 18 nt, Human
gauuuaaaagccugcuca

SEQ ID NO: 1453633 - RNA, 16 nt, Human
gauuuaaaagccugcu

SEQ ID NO: 1453634 - RNA, 11 nt, Human
gauuguuugca

SEQ ID NO: 1453635 - RNA, 15 nt, Human
gauuguuccugcuuu

SEQ ID NO: 1453636 - RNA, 16 nt, Human
gauuguuacagaagcu

SEQ ID NO: 1453637 - RNA, 16 nt, Human
gauugggaauccgccc

SEQ ID NO: 1453638 - RNA, 24 nt, Human
gaucccuguguugucucuagagca

SEQ ID NO: 1453639 - RNA, 21 nt, Human
gaucccuguguugucucuaga

SEQ ID NO: 1453640 - RNA, 20 nt, Human
gaucccuguguugucucuag

SEQ ID NO: 1453641 - RNA, 19 nt, Human
gaucccuguguugucucua

SEQ ID NO: 1453642 - RNA, 18 nt, Human
gaucccuguguugucucu

SEQ ID NO: 1453643 - RNA, 14 nt, Human
gaucccuguguugu

SEQ ID NO: 1453644 - RNA, 23 nt, Human
gaucccucuacagagcuucccug

SEQ ID NO: 1453645 - RNA, 23 nt, Human
gaucccucccccccaugcacugu

SEQ ID NO: 1453646 - RNA, 21 nt, Human
gaucccucccccccaugcacu

SEQ ID NO: 1453647 - RNA, 19 nt, Human
gaucccucccccccaugca

SEQ ID NO: 1453648 - RNA, 13 nt, Human
gaucccucccccc

SEQ ID NO: 1453649 - RNA, 18 nt, Human
gaucccucaucugucccu

SEQ ID NO: 1453650 - RNA, 14 nt, Human
gaucccucaucugu

SEQ ID NO: 1453651 - RNA, 17 nt, Human
gaucauaaggcuucaaa

SEQ ID NO: 1453652 - RNA, 13 nt, Human
gaucauaaggcuu

SEQ ID NO: 1453653 - RNA, 19 nt, Human
gauccuaagcaucuaaguu

SEQ ID NO: 1453654 - RNA, 16 nt, Human
gauccuaagcaucuaa

SEQ ID NO: 1453655 - RNA, 14 nt, Human
gauccggaaagaag

SEQ ID NO: 1453656 - RNA, 20 nt, Human
gauccgacugcuuuggaccu

SEQ ID NO: 1453657 - RNA, 18 nt, Human
gauccgacugcuuuggac

SEQ ID NO: 1453658 - RNA, 17 nt, Human
gauccgacugcuuugga

SEQ ID NO: 1453659 - RNA, 14 nt, Human
gauccgacugcuuu

SEQ ID NO: 1453660 - RNA, 15 nt, Human
gauccuagauccuaa

SEQ ID NO: 1453661 - RNA, 21 nt, Human
gauccuccugcagaccacgcc

SEQ ID NO: 1453662 - RNA, 16 nt, Human
gauccuccugcagacc

SEQ ID NO: 1453663 - RNA, 15 nt, Human
gauccuccugcagac

SEQ ID NO: 1453664 - RNA, 12 nt, Human
gauccuccucau

SEQ ID NO: 1453665 - RNA, 22 nt, Human
gauccuccugcagaccacgccc

SEQ ID NO: 1453666 - RNA, 18 nt, Human
gaucuaaauaaaaugcua

SEQ ID NO: 1453667 - RNA, 20 nt, Human
gauccuguauucagacagau

SEQ ID NO: 1453668 - RNA, 17 nt, Human
gauccuggaggcccagu

SEQ ID NO: 1453669 - RNA, 16 nt, Human
gauccuggaggcccag

SEQ ID NO: 1453670 - RNA, 15 nt, Human
gauccuggaggccca

SEQ ID NO: 1453671 - RNA, 12 nt, Human
gauccuggaggc

SEQ ID NO: 1453672 - RNA, 14 nt, Human
gauccuggaaauca

SEQ ID NO: 1453673 - RNA, 20 nt, Human
gaucuacuucuguaauugug

SEQ ID NO: 1453674 - RNA, 17 nt, Human
gaugacccuuuucauga

SEQ ID NO: 1453675 - RNA, 15 nt, Human
gaugacccuuuucau

SEQ ID NO: 1453676 - RNA, 14 nt, Human
gaugaccacuuuuu

SEQ ID NO: 1453677 - RNA, 16 nt, Human
gaugaaugccguggau

SEQ ID NO: 1453678 - RNA, 15 nt, Human
gaugaaugccgugga

SEQ ID NO: 1453679 - RNA, 13 nt, Human
gaugaaugagaau

SEQ ID NO: 1453680 - RNA, 23 nt, Human
gaugaaguuuuacauuguugagc

SEQ ID NO: 1453681 - RNA, 22 nt, Human
gaugaaguuuuacauuguugag

SEQ ID NO: 1453682 - RNA, 14 nt, Human
gaucuguccucagc

SEQ ID NO: 1453683 - RNA, 18 nt, Human
gaucuguccucagccuug

SEQ ID NO: 1453684 - RNA, 17 nt, Human
gaucuguccucagccuu

SEQ ID NO: 1453685 - RNA, 16 nt, Human
gaucuguccucagccu

SEQ ID NO: 1453686 - RNA, 15 nt, Human
gaucuguccucagcc

SEQ ID NO: 1453687 - RNA, 15 nt, Human
gaugcagggcaguca

SEQ ID NO: 1453688 - RNA, 14 nt, Human
gaugcagggcaguc

SEQ ID NO: 1453689 - RNA, 14 nt, Human
gaugcagcuuauac

SEQ ID NO: 1453690 - RNA, 15 nt, Human
gaugcagcuuauacg

SEQ ID NO: 1453691 - RNA, 14 nt, Human
gaugcagcucaaga

SEQ ID NO: 1453692 - RNA, 22 nt, Human
gaugcacuuugcuuuaauauaa

SEQ ID NO: 1453693 - RNA, 23 nt, Human
gaugcacuuugcuuuaauauaaa

SEQ ID NO: 1453694 - RNA, 21 nt, Human
gaugcacuuugcuuuaauaua

SEQ ID NO: 1453695 - RNA, 22 nt, Human
gaugcacuucaaauucaaauaa

SEQ ID NO: 1453696 - RNA, 15 nt, Human
gaugcacuucaaauu

SEQ ID NO: 1453697 - RNA, 17 nt, Human
gauauauaaguguacau

SEQ ID NO: 1453698 - RNA, 15 nt, Human
gauauauaaguguac

SEQ ID NO: 1453699 - RNA, 24 nt, Human
gauauaguuuuacuuuuaaacugu

SEQ ID NO: 1453700 - RNA, 21 nt, Human
gauauaguuuuacuuuuaaac

SEQ ID NO: 1453701 - RNA, 19 nt, Human
gauauaguuuuacuuuuaa

SEQ ID NO: 1453702 - RNA, 21 nt, Human
gauauaucaugagugaauaaa

SEQ ID NO: 1453703 - RNA, 23 nt, Human
gauaguuuucauccauaacugaa

SEQ ID NO: 1453704 - RNA, 22 nt, Human
gauaguuuucauccauaacuga

SEQ ID NO: 1453705 - RNA, 14 nt, Human
gauaguuuucaucc

SEQ ID NO: 1453706 - RNA, 14 nt, Human
gauaauuauaauau

SEQ ID NO: 1453707 - RNA, 14 nt, Human
gauaauagauucuc

SEQ ID NO: 1453708 - RNA, 13 nt, Human
gauaauagauucu

SEQ ID NO: 1453709 - RNA, 12 nt, Human
gauaauagauuc

SEQ ID NO: 1453710 - RNA, 12 nt, Human
gauaauuuuaaa

SEQ ID NO: 1453711 - RNA, 18 nt, Human
gauaauuuuaaauucucu

SEQ ID NO: 1453712 - RNA, 19 nt, Human
gauaggaagaaagaagaca

SEQ ID NO: 1453713 - RNA, 17 nt, Human
gauacaaaagcauguga

SEQ ID NO: 1453714 - RNA, 16 nt, Human
gauacaaaagcaugug

SEQ ID NO: 1453715 - RNA, 13 nt, Human
gauaggccagccg

SEQ ID NO: 1453716 - RNA, 17 nt, Human
gauaggucagugcaaau

SEQ ID NO: 1453717 - RNA, 17 nt, Human
gaucagcguggccuugu

SEQ ID NO: 1453718 - RNA, 16 nt, Human
gaucagcguggccuug

SEQ ID NO: 1453719 - RNA, 15 nt, Human
gaucagcguggccuu

SEQ ID NO: 1453720 - RNA, 13 nt, Human
gaucagcguggcc

SEQ ID NO: 1453721 - RNA, 23 nt, Human
gaucagcuuauugucuagugaaa

SEQ ID NO: 1453722 - RNA, 12 nt, Human
gaucaggaagag

SEQ ID NO: 1453723 - RNA, 15 nt, Human
gaucaggaagagaag

SEQ ID NO: 1453724 - RNA, 16 nt, Human
gaucaggaagagaagg

SEQ ID NO: 1453725 - RNA, 18 nt, Human
gaucaggaagagaaggag

SEQ ID NO: 1453726 - RNA, 17 nt, Human
gaucaggaagagaagga

SEQ ID NO: 1453727 - RNA, 14 nt, Human
gauaucucaucucu

SEQ ID NO: 1453728 - RNA, 13 nt, Human
gauaucucaucuc

SEQ ID NO: 1453729 - RNA, 23 nt, Human
gauaucgacuuguuuuugcacau

SEQ ID NO: 1453730 - RNA, 20 nt, Human
gauauaucaugagugaauaa

SEQ ID NO: 1453731 - RNA, 16 nt, Human
gauaucaugcaaauuu

SEQ ID NO: 1453732 - RNA, 23 nt, Human
gaucaccgacugaaaauauuguu

SEQ ID NO: 1453733 - RNA, 19 nt, Human
gaucacagcuucagccagg

SEQ ID NO: 1453734 - RNA, 21 nt, Human
gaucacagcuucagccaggag

SEQ ID NO: 1453735 - RNA, 14 nt, Human
gauaaagagacagu

SEQ ID NO: 1453736 - RNA, 22 nt, Human
gauaaacacaagauugguguuu

SEQ ID NO: 1453737 - RNA, 15 nt, Human
gauaaacacaagauu

SEQ ID NO: 1453738 - RNA, 14 nt, Human
gauaaacacaagau

SEQ ID NO: 1453739 - RNA, 16 nt, Human
gauaaaagauggccau

SEQ ID NO: 1453740 - RNA, 22 nt, Human
gaguucucccuguacaguguua

SEQ ID NO: 1453741 - RNA, 16 nt, Human
gaguucucccuguaca

SEQ ID NO: 1453742 - RNA, 13 nt, Human
gauaaaagauggc

SEQ ID NO: 1453743 - RNA, 16 nt, Human
gauaaccuugaaaaaa

SEQ ID NO: 1453744 - RNA, 14 nt, Human
gauaauacaccacu

SEQ ID NO: 1453745 - RNA, 12 nt, Human
gauaauacacca

SEQ ID NO: 1453746 - RNA, 23 nt, Human
gauaauacaccacuacauucugu

SEQ ID NO: 1453747 - RNA, 24 nt, Human
gauaauacaccacuacauucuguu

SEQ ID NO: 1453748 - RNA, 24 nt, Human
gacuucaucucccaccuagcagca

SEQ ID NO: 1453749 - RNA, 18 nt, Human
gacuucccagcuaggaag

SEQ ID NO: 1453750 - RNA, 13 nt, Human
gacuucccagcua

SEQ ID NO: 1453751 - RNA, 12 nt, Human
gacuucccagcu

SEQ ID NO: 1453752 - RNA, 12 nt, Human
gacuucauccca

SEQ ID NO: 1453753 - RNA, 18 nt, Human
gacuucccacggcuccuc

SEQ ID NO: 1453754 - RNA, 22 nt, Human
gacuuccuguccagcuccaacc

SEQ ID NO: 1453755 - RNA, 21 nt, Human
gacuuccuguccagcuccaac

SEQ ID NO: 1453756 - RNA, 20 nt, Human
gacuuccuguccagcuccaa

SEQ ID NO: 1453757 - RNA, 19 nt, Human
gacuuccuguccagcucca

SEQ ID NO: 1453758 - RNA, 18 nt, Human
gacuuccuguccagcucc

SEQ ID NO: 1453759 - RNA, 13 nt, Human
gacuucccugugu

SEQ ID NO: 1453760 - RNA, 21 nt, Human
gaguucagaguccuuaaaaug

SEQ ID NO: 1453761 - RNA, 13 nt, Human
gaguguucccuau

SEQ ID NO: 1453762 - RNA, 19 nt, Human
gaguguuccccuuccacug

SEQ ID NO: 1453763 - RNA, 21 nt, Human
gccaaagaaccaaagaagaaa

SEQ ID NO: 1453764 - RNA, 23 nt, Human
gccaaacaaaaagguucucaggu

SEQ ID NO: 1453765 - RNA, 23 nt, Human
gccaaaacaauguuuaaaccuuu

SEQ ID NO: 1453766 - RNA, 16 nt, Human
gcauuuuguuugguau

SEQ ID NO: 1453767 - RNA, 12 nt, Human
gcauuuuguaau

SEQ ID NO: 1453768 - RNA, 22 nt, Human
gcauuuuguaaguugaagcaaa

SEQ ID NO: 1453769 - RNA, 23 nt, Human
gcauuuuggagaguuuccugaaa

SEQ ID NO: 1453770 - RNA, 22 nt, Human
gcauuuuggagaguuuccugaa

SEQ ID NO: 1453771 - RNA, 16 nt, Human
gcauugccaagggcuu

SEQ ID NO: 1453772 - RNA, 14 nt, Human
gcauugccaagggc

SEQ ID NO: 1453773 - RNA, 20 nt, Human
gcauucucauuggaaauuua

SEQ ID NO: 1453774 - RNA, 18 nt, Human
gcauucucauuggaaauu

SEQ ID NO: 1453775 - RNA, 13 nt, Human
gcauucuaguacu

SEQ ID NO: 1453776 - RNA, 20 nt, Human
gcauucccagguaggccaag

SEQ ID NO: 1453777 - RNA, 21 nt, Human
gcauucccagguaggccaagg

SEQ ID NO: 1453778 - RNA, 18 nt, Human
gcauuggauauuuuuuac

SEQ ID NO: 1453779 - RNA, 21 nt, Human
gcauuuggugguuucagaaau

SEQ ID NO: 1453780 - RNA, 12 nt, Human
gcauuggauauu

SEQ ID NO: 1453781 - RNA, 16 nt, Human
gcauuggaacuggagg

SEQ ID NO: 1453782 - RNA, 19 nt, Human
gcauuggaacuggaggcag

SEQ ID NO: 1453783 - RNA, 17 nt, Human
gcauuuguuuuguuuac

SEQ ID NO: 1453784 - RNA, 18 nt, Human
gcauuuggguccaggagg

SEQ ID NO: 1453785 - RNA, 17 nt, Human
gcauuuggguccaggag

SEQ ID NO: 1453786 - RNA, 16 nt, Human
gcauuuggguccagga

SEQ ID NO: 1453787 - RNA, 15 nt, Human
gcauuuggguccagg

SEQ ID NO: 1453788 - RNA, 16 nt, Human
gcauuuuacuguacag

SEQ ID NO: 1453789 - RNA, 17 nt, Human
gcauuuuacuguacaga

SEQ ID NO: 1453790 - RNA, 15 nt, Human
gcaugaauuugugaa

SEQ ID NO: 1453791 - RNA, 19 nt, Human
gcaugcccagagacccagc

SEQ ID NO: 1453792 - RNA, 18 nt, Human
gcaugcccagagacccag

SEQ ID NO: 1453793 - RNA, 12 nt, Human
gcaugcccagag

SEQ ID NO: 1453794 - RNA, 12 nt, Human
gcaugcaguguu

SEQ ID NO: 1453795 - RNA, 23 nt, Human
gcaugcacuguucccccugugca

SEQ ID NO: 1453796 - RNA, 22 nt, Human
gcaugcacuguucccccugugc

SEQ ID NO: 1453797 - RNA, 21 nt, Human
gcaugcacuguucccccugug

SEQ ID NO: 1453798 - RNA, 17 nt, Human
gcaugcacuguuccccc

SEQ ID NO: 1453799 - RNA, 16 nt, Human
gcaugcacuguucccc

SEQ ID NO: 1453800 - RNA, 22 nt, Human
gcaugaauuuguaaugucuuga

SEQ ID NO: 1453801 - RNA, 15 nt, Human
gcaugaauuuguaau

SEQ ID NO: 1453802 - RNA, 17 nt, Human
gcaugaauuugugaagg

SEQ ID NO: 1453803 - RNA, 17 nt, Human
gcaugcuggugagccaa

SEQ ID NO: 1453804 - RNA, 20 nt, Human
gcaugcccagagacccagcg

SEQ ID NO: 1453805 - RNA, 15 nt, Human
gcaugccuucaaauc

SEQ ID NO: 1453806 - RNA, 17 nt, Human
gcauguugucuaagaaa

SEQ ID NO: 1453807 - RNA, 17 nt, Human
gcauguuugugauugac

SEQ ID NO: 1453808 - RNA, 21 nt, Human
gcauggacaauggaccggaga

SEQ ID NO: 1453809 - RNA, 18 nt, Human
gcauggacaauggaccgg

SEQ ID NO: 1453810 - RNA, 14 nt, Human
gcauggacaaugga

SEQ ID NO: 1453811 - RNA, 16 nt, Human
gcauggaacacuucga

SEQ ID NO: 1453812 - RNA, 23 nt, Human
gcauggaaauuuaaagcagguuc

SEQ ID NO: 1453813 - RNA, 19 nt, Human
gcauggaaauuuaaagcag

SEQ ID NO: 1453814 - RNA, 17 nt, Human
gcauggaaauuuaaagc

SEQ ID NO: 1453815 - RNA, 11 nt, Human
gcauggaaauu

SEQ ID NO: 1453816 - RNA, 23 nt, Human
gcauggaaauucccuucaucugg

SEQ ID NO: 1453817 - RNA, 15 nt, Human
gcauuagaauuauuu

SEQ ID NO: 1453818 - RNA, 17 nt, Human
gcauuacugcaugcacu

SEQ ID NO: 1453819 - RNA, 14 nt, Human
gcauuacugcaugc

SEQ ID NO: 1453820 - RNA, 16 nt, Human
gcauguuuagacuuua

SEQ ID NO: 1453821 - RNA, 22 nt, Human
gcauguuuagacuuuaacauaa

SEQ ID NO: 1453822 - RNA, 13 nt, Human
gcauucccaggua

SEQ ID NO: 1453823 - RNA, 12 nt, Human
gcauucccaggu

SEQ ID NO: 1453824 - RNA, 19 nt, Human
gcauuccagccccucuggu

SEQ ID NO: 1453825 - RNA, 16 nt, Human
gcauuccagccccucu

SEQ ID NO: 1453826 - RNA, 15 nt, Human
gcauuccagccccuc

SEQ ID NO: 1453827 - RNA, 12 nt, Human
gcauuccagccc

SEQ ID NO: 1453828 - RNA, 18 nt, Human
gcauuagggaugccuccu

SEQ ID NO: 1453829 - RNA, 18 nt, Human
gcauuagaauuauuuaaa

SEQ ID NO: 1453830 - RNA, 17 nt, Human
gcauuagaauuauuuaa

SEQ ID NO: 1453831 - RNA, 15 nt, Human
gcauuauaaaaagaa

SEQ ID NO: 1453832 - RNA, 23 nt, Human
gcauauuauuuuauguugcauag

SEQ ID NO: 1453833 - RNA, 21 nt, Human
gcauauguugaauacuuuuua

SEQ ID NO: 1453834 - RNA, 20 nt, Human
gcauauguugaauacuuuuu

SEQ ID NO: 1453835 - RNA, 19 nt, Human
gcauauguugaauacuuuu

SEQ ID NO: 1453836 - RNA, 18 nt, Human
gcauauguugaauacuuu

SEQ ID NO: 1453837 - RNA, 18 nt, Human
gcauauuauuuuauguug

SEQ ID NO: 1453838 - RNA, 17 nt, Human
gcauauguugaauacuu

SEQ ID NO: 1453839 - RNA, 14 nt, Human
gcauauguugaaua

SEQ ID NO: 1453840 - RNA, 12 nt, Human
gcauauguugaa

SEQ ID NO: 1453841 - RNA, 19 nt, Human
gcauauuuauaaaaauaaa

SEQ ID NO: 1453842 - RNA, 20 nt, Human
gcaguucgcagccacccuga

SEQ ID NO: 1453843 - RNA, 19 nt, Human
gcaguucgcagccacccug

SEQ ID NO: 1453844 - RNA, 18 nt, Human
gcaguucgcagccacccu

SEQ ID NO: 1453845 - RNA, 17 nt, Human
gcaguucgcagccaccc

SEQ ID NO: 1453846 - RNA, 16 nt, Human
gcaguucgcagccacc

SEQ ID NO: 1453847 - RNA, 15 nt, Human
gcaguucgcagccac

SEQ ID NO: 1453848 - RNA, 17 nt, Human
gcaguucgacucugugc

SEQ ID NO: 1453849 - RNA, 16 nt, Human
gcaguuauauuuugca

SEQ ID NO: 1453850 - RNA, 13 nt, Human
gcaguuauauuuu

SEQ ID NO: 1453851 - RNA, 11 nt, Human
gcaguuauauu

SEQ ID NO: 1453852 - RNA, 18 nt, Human
gcaguuaccauuaaacca

SEQ ID NO: 1453853 - RNA, 19 nt, Human
gcaguuaccauuaaaccau

SEQ ID NO: 1453854 - RNA, 15 nt, Human
gcaguuaccauuaaa

SEQ ID NO: 1453855 - RNA, 14 nt, Human
gcaguuaccauuaa

SEQ ID NO: 1453856 - RNA, 18 nt, Human
gcagugggaggguaccag

SEQ ID NO: 1453857 - RNA, 21 nt, Human
gcagugugaggccagggcaga

SEQ ID NO: 1453858 - RNA, 19 nt, Human
gcagugugaggccagggca

SEQ ID NO: 1453859 - RNA, 21 nt, Human
gcauaggaguuuggaggaagu

SEQ ID NO: 1453860 - RNA, 18 nt, Human
gcauaggaguuuggagga

SEQ ID NO: 1453861 - RNA, 22 nt, Human
gcauagcuacuaaaaucaguga

SEQ ID NO: 1453862 - RNA, 19 nt, Human
gcauaggaccuuuccacca

SEQ ID NO: 1453863 - RNA, 15 nt, Human
gcauagcucuggggu

SEQ ID NO: 1453864 - RNA, 14 nt, Human
gcauagcucugggg

SEQ ID NO: 1453865 - RNA, 20 nt, Human
gcauaggugauccauguaac

SEQ ID NO: 1453866 - RNA, 19 nt, Human
gcauaggugauccauguaa

SEQ ID NO: 1453867 - RNA, 16 nt, Human
gcauauagauuguccu

SEQ ID NO: 1453868 - RNA, 22 nt, Human
gcaguucgcagccacccugagg

SEQ ID NO: 1453869 - RNA, 23 nt, Human
gcaguucgcagccacccugagga

SEQ ID NO: 1453870 - RNA, 14 nt, Human
gcaguucugaagaa

SEQ ID NO: 1453871 - RNA, 13 nt, Human
gcaguucugaaga

SEQ ID NO: 1453872 - RNA, 15 nt, Human
gcaggggcuuccugg

SEQ ID NO: 1453873 - RNA, 14 nt, Human
gcaggggcuuccug

SEQ ID NO: 1453874 - RNA, 13 nt, Human
gcaggggcuuccu

SEQ ID NO: 1453875 - RNA, 22 nt, Human
gcagggcgggcagagggcugga

SEQ ID NO: 1453876 - RNA, 23 nt, Human
gcagggcuacccugagcugaggc

SEQ ID NO: 1453877 - RNA, 22 nt, Human
gcagggcuacccugagcugagg

SEQ ID NO: 1453878 - RNA, 21 nt, Human
gcagggcuacccugagcugag

SEQ ID NO: 1453879 - RNA, 20 nt, Human
gcagggcuacccugagcuga

SEQ ID NO: 1453880 - RNA, 17 nt, Human
gcagggcuacccugagc

SEQ ID NO: 1453881 - RNA, 21 nt, Human
gcagggcgggcagagggcugg

SEQ ID NO: 1453882 - RNA, 20 nt, Human
gcagggcgggcagagggcug

SEQ ID NO: 1453883 - RNA, 18 nt, Human
gcagggcgggcagagggc

SEQ ID NO: 1453884 - RNA, 17 nt, Human
gcagggcgggcagaggg

SEQ ID NO: 1453885 - RNA, 22 nt, Human
gcaggcucccagggacaccugg

SEQ ID NO: 1453886 - RNA, 14 nt, Human
gcaggcucccaggg

SEQ ID NO: 1453887 - RNA, 21 nt, Human
gcaggauuggggaagagagcc

SEQ ID NO: 1453888 - RNA, 20 nt, Human
gcaggauuggggaagagagc

SEQ ID NO: 1453889 - RNA, 22 nt, Human
gcaggauugaaaauguccagga

SEQ ID NO: 1453890 - RNA, 14 nt, Human
gcaggauugaaaau

SEQ ID NO: 1453891 - RNA, 21 nt, Human
gcaggaucucaccaggcagcc

SEQ ID NO: 1453892 - RNA, 22 nt, Human
gcaggaucucaccaggcagccu

SEQ ID NO: 1453893 - RNA, 20 nt, Human
gcaggaucucaccaggcagc

SEQ ID NO: 1453894 - RNA, 19 nt, Human
gcaggaucucaccaggcag

SEQ ID NO: 1453895 - RNA, 18 nt, Human
gcaggaucucaccaggca

SEQ ID NO: 1453896 - RNA, 17 nt, Human
gcaggaucucaccaggc

SEQ ID NO: 1453897 - RNA, 18 nt, Human
gcagguggccaaguuccu

SEQ ID NO: 1453898 - RNA, 21 nt, Human
gcagguggggagacugggcug

SEQ ID NO: 1453899 - RNA, 17 nt, Human
gcagguggggagacugg

SEQ ID NO: 1453900 - RNA, 21 nt, Human
gcagguggccaaguuccucua

SEQ ID NO: 1453901 - RNA, 21 nt, Human
gcagguggaucuauuucaugu

SEQ ID NO: 1453902 - RNA, 20 nt, Human
gcagguggaucuauuucaug

SEQ ID NO: 1453903 - RNA, 19 nt, Human
gcagguggaucuauuucau

SEQ ID NO: 1453904 - RNA, 13 nt, Human
gcagguggaucua

SEQ ID NO: 1453905 - RNA, 17 nt, Human
gcaggugcuggucccgg

SEQ ID NO: 1453906 - RNA, 17 nt, Human
gcagugcucgcuguugc

SEQ ID NO: 1453907 - RNA, 18 nt, Human
gcagugcucgcuguugcu

SEQ ID NO: 1453908 - RNA, 19 nt, Human
gcagugcucgcuguugcug

SEQ ID NO: 1453909 - RNA, 21 nt, Human
gcagugcucgcuguugcugaa

SEQ ID NO: 1453910 - RNA, 12 nt, Human
gcaggucccuaa

SEQ ID NO: 1453911 - RNA, 13 nt, Human
gcaggucccuaau

SEQ ID NO: 1453912 - RNA, 22 nt, Human
gcagggggcugcugcugggcuc

SEQ ID NO: 1453913 - RNA, 17 nt, Human
gcagggggcugcugcug

SEQ ID NO: 1453914 - RNA, 16 nt, Human
gcagggggcugcugcu

SEQ ID NO: 1453915 - RNA, 15 nt, Human
gcagggggcugcugc

SEQ ID NO: 1453916 - RNA, 14 nt, Human
gcagggggcugcug

SEQ ID NO: 1453917 - RNA, 18 nt, Human
gcaggggcuuccuggugc

SEQ ID NO: 1453918 - RNA, 22 nt, Human
gcaggggcuuccuggugcugga

SEQ ID NO: 1453919 - RNA, 10 nt, Human
gcaggucccu

SEQ ID NO: 1453920 - RNA, 11 nt, Human
gcaggucccua

SEQ ID NO: 1453921 - RNA, 23 nt, Human
gcacugucccuugccucaaugcc

SEQ ID NO: 1453922 - RNA, 18 nt, Human
gcacugucccuugccuca

SEQ ID NO: 1453923 - RNA, 17 nt, Human
gcacugucccuugccuc

SEQ ID NO: 1453924 - RNA, 16 nt, Human
gcagaagcagcaacuu

SEQ ID NO: 1453925 - RNA, 19 nt, Human
gcacuguaguucuaagacu

SEQ ID NO: 1453926 - RNA, 18 nt, Human
gcacuguaguucuaagac

SEQ ID NO: 1453927 - RNA, 17 nt, Human
gcacuguaguucuaaga

SEQ ID NO: 1453928 - RNA, 16 nt, Human
gcacuguaguucuaag

SEQ ID NO: 1453929 - RNA, 23 nt, Human
gcacuggggagcccgucucagug

SEQ ID NO: 1453930 - RNA, 22 nt, Human
gcacuggggagcccgucucagu

SEQ ID NO: 1453931 - RNA, 19 nt, Human
gcacuggggagcccgucuc

SEQ ID NO: 1453932 - RNA, 18 nt, Human
gcacuggggagcccgucu

SEQ ID NO: 1453933 - RNA, 15 nt, Human
gcacuggggagcccg

SEQ ID NO: 1453934 - RNA, 18 nt, Human
gcacugauguuguguuuu

SEQ ID NO: 1453935 - RNA, 20 nt, Human
gcacugauguuguguuuuua

SEQ ID NO: 1453936 - RNA, 17 nt, Human
gcacugauguuguguuu

SEQ ID NO: 1453937 - RNA, 22 nt, Human
gcacugaugcugccccucaucu

SEQ ID NO: 1453938 - RNA, 19 nt, Human
gcacugaugcugccccuca

SEQ ID NO: 1453939 - RNA, 18 nt, Human
gcacugaugcugccccuc

SEQ ID NO: 1453940 - RNA, 16 nt, Human
gcaccugccucaggac

SEQ ID NO: 1453941 - RNA, 15 nt, Human
gcaccugccucagga

SEQ ID NO: 1453942 - RNA, 14 nt, Human
gcaccugccucagg

SEQ ID NO: 1453943 - RNA, 13 nt, Human
gcaccugccucag

SEQ ID NO: 1453944 - RNA, 12 nt, Human
gcaccugccuca

SEQ ID NO: 1453945 - RNA, 21 nt, Human
gcaccugcccuaccugcccca

SEQ ID NO: 1453946 - RNA, 23 nt, Human
gcaccugcugucuggguggcuca

SEQ ID NO: 1453947 - RNA, 12 nt, Human
gcaccugcuguc

SEQ ID NO: 1453948 - RNA, 19 nt, Human
gcacuaacguugagccccu

SEQ ID NO: 1453949 - RNA, 15 nt, Human
gcaccugcugucugg

SEQ ID NO: 1453950 - RNA, 21 nt, Human
gcacuagccaaaccucaccaa

SEQ ID NO: 1453951 - RNA, 20 nt, Human
gcacuagccaaaccucacca

SEQ ID NO: 1453952 - RNA, 18 nt, Human
gcacuagccaaaccucac

SEQ ID NO: 1453953 - RNA, 17 nt, Human
gcacuagccaaaccuca

SEQ ID NO: 1453954 - RNA, 15 nt, Human
gcacuagccaaaccu

SEQ ID NO: 1453955 - RNA, 13 nt, Human
gcacugaugcugc

SEQ ID NO: 1453956 - RNA, 18 nt, Human
gcacuacugacauguggg

SEQ ID NO: 1453957 - RNA, 17 nt, Human
gcacuacugacaugugg

SEQ ID NO: 1453958 - RNA, 20 nt, Human
gcacuaacguugagccccug

SEQ ID NO: 1453959 - RNA, 20 nt, Human
gcaccccaaagcuuuccugc

SEQ ID NO: 1453960 - RNA, 17 nt, Human
gcaccccaaagcuuucc

SEQ ID NO: 1453961 - RNA, 21 nt, Human
gcacccaucugucugccaacc

SEQ ID NO: 1453962 - RNA, 19 nt, Human
gcaccaccaugccaggcua

SEQ ID NO: 1453963 - RNA, 18 nt, Human
gcaccaccaagccaaggg

SEQ ID NO: 1453964 - RNA, 13 nt, Human
gcacaugucuuaa

SEQ ID NO: 1453965 - RNA, 15 nt, Human
gcacaugucuuaaug

SEQ ID NO: 1453966 - RNA, 17 nt, Human
gcacaugucuuaaugaa

SEQ ID NO: 1453967 - RNA, 20 nt, Human
gcacaugucuuaaugaaguu

SEQ ID NO: 1453968 - RNA, 21 nt, Human
gcacaugucuuaaugaaguuu

SEQ ID NO: 1453969 - RNA, 22 nt, Human
gcacaugucuuaaugaaguuug

SEQ ID NO: 1453970 - RNA, 15 nt, Human
gcacaggcuaauuuu

SEQ ID NO: 1453971 - RNA, 16 nt, Human
gcacaggcuaauuuuu

SEQ ID NO: 1453972 - RNA, 14 nt, Human
gcacaggcccccuu

SEQ ID NO: 1453973 - RNA, 23 nt, Human
gcacaggagggggucguggagag

SEQ ID NO: 1453974 - RNA, 20 nt, Human
gcacaggaguguccucuucc

SEQ ID NO: 1453975 - RNA, 22 nt, Human
gcacaggagggggucguggaga

SEQ ID NO: 1453976 - RNA, 21 nt, Human
gcacaggagggggucguggag

SEQ ID NO: 1453977 - RNA, 12 nt, Human
gcacaggagggg

SEQ ID NO: 1453978 - RNA, 20 nt, Human
gcacaggagcuaccugugug

SEQ ID NO: 1453979 - RNA, 21 nt, Human
gcacaggagcuaccugugugg

SEQ ID NO: 1453980 - RNA, 16 nt, Human
gcacaggagcuaccug

SEQ ID NO: 1453981 - RNA, 15 nt, Human
gcacaggagcuaccu

SEQ ID NO: 1453982 - RNA, 12 nt, Human
gcacaggagcua

SEQ ID NO: 1453983 - RNA, 19 nt, Human
gcacagcuuagauuucaua

SEQ ID NO: 1453984 - RNA, 22 nt, Human
gcacaggacaugcgguagccag

SEQ ID NO: 1453985 - RNA, 21 nt, Human
gcacaggacaugcgguagcca

SEQ ID NO: 1453986 - RNA, 17 nt, Human
gcacagcuuagauuuca

SEQ ID NO: 1453987 - RNA, 16 nt, Human
gcacagcuuagauuuc

SEQ ID NO: 1453988 - RNA, 15 nt, Human
gcacagcuuagauuu

SEQ ID NO: 1453989 - RNA, 16 nt, Human
gcacagcuaugaaggc

SEQ ID NO: 1453990 - RNA, 13 nt, Human
gcacagcuaugaa

SEQ ID NO: 1453991 - RNA, 15 nt, Human
gcacagcuaauucua

SEQ ID NO: 1453992 - RNA, 19 nt, Human
gcacagccuggcuguggcc

SEQ ID NO: 1453993 - RNA, 12 nt, Human
gcacagccuggc

SEQ ID NO: 1453994 - RNA, 20 nt, Human
gcacagccucuuagaugcag

SEQ ID NO: 1453995 - RNA, 20 nt, Human
gcagaguuacaguucugugg

SEQ ID NO: 1453996 - RNA, 18 nt, Human
gcagaguuacaguucugu

SEQ ID NO: 1453997 - RNA, 17 nt, Human
gcagaguuacaguucug

SEQ ID NO: 1453998 - RNA, 13 nt, Human
gcagaagcagcaa

SEQ ID NO: 1453999 - RNA, 21 nt, Human
gcagaguuacaguucuguggu

SEQ ID NO: 1454000 - RNA, 17 nt, Human
gcagcaccugcccuacc

SEQ ID NO: 1454001 - RNA, 14 nt, Human
gcagcaccugcccu

SEQ ID NO: 1454002 - RNA, 13 nt, Human
gcagcaccugccc

SEQ ID NO: 1454003 - RNA, 20 nt, Human
gcagcaccuccucagccuga

SEQ ID NO: 1454004 - RNA, 19 nt, Human
gcagcaccuccucagccug

SEQ ID NO: 1454005 - RNA, 18 nt, Human
gcagcaccuccucagccu

SEQ ID NO: 1454006 - RNA, 17 nt, Human
gcagcaccuccucagcc

SEQ ID NO: 1454007 - RNA, 16 nt, Human
gcagcaccuccucagc

SEQ ID NO: 1454008 - RNA, 15 nt, Human
gcagcaccuccucag

SEQ ID NO: 1454009 - RNA, 19 nt, Human
gcagcaccguucugugcac

SEQ ID NO: 1454010 - RNA, 18 nt, Human
gcagcaccguucugugca

SEQ ID NO: 1454011 - RNA, 17 nt, Human
gcagcaccguucugugc

SEQ ID NO: 1454012 - RNA, 15 nt, Human
gcagcacaggagggc

SEQ ID NO: 1454013 - RNA, 15 nt, Human
gcagcacagcugaga

SEQ ID NO: 1454014 - RNA, 21 nt, Human
gcagcaaggcccgagcagcug

SEQ ID NO: 1454015 - RNA, 22 nt, Human
gcagcaaggcccgagcagcuga

SEQ ID NO: 1454016 - RNA, 17 nt, Human
gcagcaaggcccgagca

SEQ ID NO: 1454017 - RNA, 16 nt, Human
gcagcaaggcccgagc

SEQ ID NO: 1454018 - RNA, 22 nt, Human
gcagcaacuuguccuagcacag

SEQ ID NO: 1454019 - RNA, 12 nt, Human
gcagcaauaaag

SEQ ID NO: 1454020 - RNA, 19 nt, Human
gcagcaacuuguccuagca

SEQ ID NO: 1454021 - RNA, 18 nt, Human
gcagcaacuuguccuagc

SEQ ID NO: 1454022 - RNA, 16 nt, Human
gcagcaacuuguccua

SEQ ID NO: 1454023 - RNA, 15 nt, Human
gcagcaacuuguccu

SEQ ID NO: 1454024 - RNA, 11 nt, Human
gcagcaacaau

SEQ ID NO: 1454025 - RNA, 16 nt, Human
gcagcaacaauaaaua

SEQ ID NO: 1454026 - RNA, 14 nt, Human
gcagcgaccgcccc

SEQ ID NO: 1454027 - RNA, 12 nt, Human
gcagccuggagc

SEQ ID NO: 1454028 - RNA, 13 nt, Human
gcagccuggagcc

SEQ ID NO: 1454029 - RNA, 15 nt, Human
gcagccuggagcccu

SEQ ID NO: 1454030 - RNA, 19 nt, Human
gcagccuggagcccuggag

SEQ ID NO: 1454031 - RNA, 23 nt, Human
gcagccugcgccaccgcccagag

SEQ ID NO: 1454032 - RNA, 14 nt, Human
gcagcagggguugg

SEQ ID NO: 1454033 - RNA, 13 nt, Human
gcagcagggguug

SEQ ID NO: 1454034 - RNA, 20 nt, Human
gcagcagggcuacccugagc

SEQ ID NO: 1454035 - RNA, 19 nt, Human
gcagcagggcuacccugag

SEQ ID NO: 1454036 - RNA, 17 nt, Human
gcagcagggcuacccug

SEQ ID NO: 1454037 - RNA, 12 nt, Human
gcagcagggcua

SEQ ID NO: 1454038 - RNA, 20 nt, Human
gcaggaccuucgggcugugc

SEQ ID NO: 1454039 - RNA, 14 nt, Human
gcagcgccaggcug

SEQ ID NO: 1454040 - RNA, 13 nt, Human
gcagcgccaggcu

SEQ ID NO: 1454041 - RNA, 12 nt, Human
gcagcgagccug

SEQ ID NO: 1454042 - RNA, 15 nt, Human
gcagcgagccugcua

SEQ ID NO: 1454043 - RNA, 22 nt, Human
gcagcgaccgcccccuccucua

SEQ ID NO: 1454044 - RNA, 18 nt, Human
gcagcgaccgcccccucc

SEQ ID NO: 1454045 - RNA, 17 nt, Human
gcagcgaccgcccccuc

SEQ ID NO: 1454046 - RNA, 16 nt, Human
gcagcgaccgcccccu

SEQ ID NO: 1454047 - RNA, 21 nt, Human
gcaggagcggcagauggggag

SEQ ID NO: 1454048 - RNA, 15 nt, Human
gcaggagggaggugc

SEQ ID NO: 1454049 - RNA, 21 nt, Human
gcaggaguagcugagcucaca

SEQ ID NO: 1454050 - RNA, 19 nt, Human
gcaggaguagcugagcuca

SEQ ID NO: 1454051 - RNA, 18 nt, Human
gcaggaguagcugagcuc

SEQ ID NO: 1454052 - RNA, 17 nt, Human
gcaggaguagcugagcu

SEQ ID NO: 1454053 - RNA, 16 nt, Human
gcaggaguagcugagc

SEQ ID NO: 1454054 - RNA, 15 nt, Human
gcaggaguagcugag

SEQ ID NO: 1454055 - RNA, 14 nt, Human
gcaggaguagcuga

SEQ ID NO: 1454056 - RNA, 18 nt, Human
gcaggaggggggagggaa

SEQ ID NO: 1454057 - RNA, 15 nt, Human
gcaggaggggggagg

SEQ ID NO: 1454058 - RNA, 14 nt, Human
gcaggaggggggag

SEQ ID NO: 1454059 - RNA, 20 nt, Human
gcaggaguuucguuuucaaa

SEQ ID NO: 1454060 - RNA, 21 nt, Human
gcaggaguuucguuuucaaaa

SEQ ID NO: 1454061 - RNA, 17 nt, Human
gccagagaacccagccc

SEQ ID NO: 1454062 - RNA, 18 nt, Human
gccagagaacccagccca

SEQ ID NO: 1454063 - RNA, 20 nt, Human
gccacugaggggggauccag

SEQ ID NO: 1454064 - RNA, 18 nt, Human
gccagagccuggggcucu

SEQ ID NO: 1454065 - RNA, 17 nt, Human
gccagagccuggggcuc

SEQ ID NO: 1454066 - RNA, 16 nt, Human
gccagagccuggggcu

SEQ ID NO: 1454067 - RNA, 19 nt, Human
gccagagccuggggcucua

SEQ ID NO: 1454068 - RNA, 22 nt, Human
gccagagcuacccgcagaguuc

SEQ ID NO: 1454069 - RNA, 15 nt, Human
gccagagccuggggc

SEQ ID NO: 1454070 - RNA, 14 nt, Human
gccagagccugggg

SEQ ID NO: 1454071 - RNA, 13 nt, Human
gccagagccuggg

SEQ ID NO: 1454072 - RNA, 12 nt, Human
gccagagccugg

SEQ ID NO: 1454073 - RNA, 24 nt, Human
gccagagcccacuccaucugguag

SEQ ID NO: 1454074 - RNA, 23 nt, Human
gccagagcccacuccaucuggua

SEQ ID NO: 1454075 - RNA, 20 nt, Human
gccagagcccacuccaucug

SEQ ID NO: 1454076 - RNA, 23 nt, Human
gccagagauccaaaagaagcccc

SEQ ID NO: 1454077 - RNA, 16 nt, Human
gccagagcccacucca

SEQ ID NO: 1454078 - RNA, 15 nt, Human
gccagagcccacucc

SEQ ID NO: 1454079 - RNA, 14 nt, Human
gccagagccagggg

SEQ ID NO: 1454080 - RNA, 12 nt, Human
gccagagccagg

SEQ ID NO: 1454081 - RNA, 22 nt, Human
gccagagccaaggggcuucagg

SEQ ID NO: 1454082 - RNA, 23 nt, Human
gccacucacuaggcccccacuug

SEQ ID NO: 1454083 - RNA, 19 nt, Human
gccacucacuaggccccca

SEQ ID NO: 1454084 - RNA, 18 nt, Human
gccacucacuaggccccc

SEQ ID NO: 1454085 - RNA, 15 nt, Human
gccacucacuaggcc

SEQ ID NO: 1454086 - RNA, 14 nt, Human
gccacucacuaggc

SEQ ID NO: 1454087 - RNA, 23 nt, Human
gccacuaaccuugccugguacag

SEQ ID NO: 1454088 - RNA, 22 nt, Human
gccacuaaccuugccugguaca

SEQ ID NO: 1454089 - RNA, 19 nt, Human
gccacuaaccuugccuggu

SEQ ID NO: 1454090 - RNA, 22 nt, Human
gccacguuggagaagcccgugu

SEQ ID NO: 1454091 - RNA, 23 nt, Human
gccacguguuugugcuguggugu

SEQ ID NO: 1454092 - RNA, 21 nt, Human
gccacguguuuagaccuagau

SEQ ID NO: 1454093 - RNA, 23 nt, Human
gccaaauuaaaaaagauaaacac

SEQ ID NO: 1454094 - RNA, 22 nt, Human
gccaaauuaaaaaagauaaaca

SEQ ID NO: 1454095 - RNA, 21 nt, Human
gccaaauuaaaaaagauaaac

SEQ ID NO: 1454096 - RNA, 18 nt, Human
gccaaauuaaaaaagaua

SEQ ID NO: 1454097 - RNA, 16 nt, Human
gccaaauuaaaaaaga

SEQ ID NO: 1454098 - RNA, 14 nt, Human
gccaaauuaaaaaa

SEQ ID NO: 1454099 - RNA, 12 nt, Human
gccaaauuaaaa

SEQ ID NO: 1454100 - RNA, 19 nt, Human
gccaaaggggaccuggaag

SEQ ID NO: 1454101 - RNA, 17 nt, Human
gccaaauauguccuggg

SEQ ID NO: 1454102 - RNA, 15 nt, Human
gccaaauauguccug

SEQ ID NO: 1454103 - RNA, 20 nt, Human
gccaaaggggaccuggaagg

SEQ ID NO: 1454104 - RNA, 18 nt, Human
gccaaaggggaccuggaa

SEQ ID NO: 1454105 - RNA, 18 nt, Human
gccaaaggaugugauaua

SEQ ID NO: 1454106 - RNA, 17 nt, Human
gccaaaggaugugauau

SEQ ID NO: 1454107 - RNA, 16 nt, Human
gccaaaggaugugaua

SEQ ID NO: 1454108 - RNA, 17 nt, Human
gccagcuuguuuacaug

SEQ ID NO: 1454109 - RNA, 16 nt, Human
gccagcuuguuuacau

SEQ ID NO: 1454110 - RNA, 15 nt, Human
gccagcuuguuuaca

SEQ ID NO: 1454111 - RNA, 14 nt, Human
gccagcuuguuuac

SEQ ID NO: 1454112 - RNA, 20 nt, Human
gccagcugugguuuucuuuu

SEQ ID NO: 1454113 - RNA, 15 nt, Human
gccagcuggaggcag

SEQ ID NO: 1454114 - RNA, 17 nt, Human
gccagcuggaggcaggg

SEQ ID NO: 1454115 - RNA, 14 nt, Human
gccagcuggaggca

SEQ ID NO: 1454116 - RNA, 15 nt, Human
gccagcucuguauca

SEQ ID NO: 1454117 - RNA, 13 nt, Human
gccagcucuguau

SEQ ID NO: 1454118 - RNA, 23 nt, Human
gccagcuacuuccuccuccccac

SEQ ID NO: 1454119 - RNA, 22 nt, Human
gccagcuaagggguggggcugc

SEQ ID NO: 1454120 - RNA, 16 nt, Human
gccagcuaaggggugg

SEQ ID NO: 1454121 - RNA, 15 nt, Human
gccagcuaaggggug

SEQ ID NO: 1454122 - RNA, 22 nt, Human
gccagcgucggucugugccccu

SEQ ID NO: 1454123 - RNA, 21 nt, Human
gccagcgucggucugugcccc

SEQ ID NO: 1454124 - RNA, 20 nt, Human
gccagcgucggucugugccc

SEQ ID NO: 1454125 - RNA, 19 nt, Human
gccagcgucggucugugcc

SEQ ID NO: 1454126 - RNA, 18 nt, Human
gccagcgucggucugugc

SEQ ID NO: 1454127 - RNA, 22 nt, Human
gccagcguccuccucugugacc

SEQ ID NO: 1454128 - RNA, 19 nt, Human
gccagcguccuccucugug

SEQ ID NO: 1454129 - RNA, 13 nt, Human
gccagcguccucc

SEQ ID NO: 1454130 - RNA, 12 nt, Human
gccagcguccuc

SEQ ID NO: 1454131 - RNA, 20 nt, Human
gccagcgagcgcccagcucc

SEQ ID NO: 1454132 - RNA, 22 nt, Human
gccagcgagcgcccagcuccug

SEQ ID NO: 1454133 - RNA, 17 nt, Human
gccagcccugccuggag

SEQ ID NO: 1454134 - RNA, 16 nt, Human
gccagcccugccugga

SEQ ID NO: 1454135 - RNA, 15 nt, Human
gccagcccugccugg

SEQ ID NO: 1454136 - RNA, 14 nt, Human
gccagcccugccug

SEQ ID NO: 1454137 - RNA, 13 nt, Human
gccagcccugccu

SEQ ID NO: 1454138 - RNA, 10 nt, Human
gccagcccug

SEQ ID NO: 1454139 - RNA, 20 nt, Human
gccagccccuuagacagagg

SEQ ID NO: 1454140 - RNA, 22 nt, Human
gccagccccuuagacagaggcc

SEQ ID NO: 1454141 - RNA, 19 nt, Human
gccagccccuuagacagag

SEQ ID NO: 1454142 - RNA, 14 nt, Human
gccagccccugcca

SEQ ID NO: 1454143 - RNA, 20 nt, Human
gccagccccuggccccagga

SEQ ID NO: 1454144 - RNA, 19 nt, Human
gccagccccuggccccagg

SEQ ID NO: 1454145 - RNA, 14 nt, Human
gccagccccuggcc

SEQ ID NO: 1454146 - RNA, 23 nt, Human
gccagcccugccuggaggaccug

SEQ ID NO: 1454147 - RNA, 20 nt, Human
gccagcccugccuggaggac

SEQ ID NO: 1454148 - RNA, 19 nt, Human
gccagcccugccuggagga

SEQ ID NO: 1454149 - RNA, 18 nt, Human
gccagcccugccuggagg

SEQ ID NO: 1454150 - RNA, 10 nt, Human
gccagccccu

SEQ ID NO: 1454151 - RNA, 17 nt, Human
gccaucccgucuucucc

SEQ ID NO: 1454152 - RNA, 14 nt, Human
gccagugacagaca

SEQ ID NO: 1454153 - RNA, 14 nt, Human
gccaguccuguccu

SEQ ID NO: 1454154 - RNA, 13 nt, Human
gccaggucccucu

SEQ ID NO: 1454155 - RNA, 18 nt, Human
gccaggugaggucagcac

SEQ ID NO: 1454156 - RNA, 13 nt, Human
gccagugacagac

SEQ ID NO: 1454157 - RNA, 20 nt, Human
gccagucuguggaucagaga

SEQ ID NO: 1454158 - RNA, 13 nt, Human
gccagucugugga

SEQ ID NO: 1454159 - RNA, 12 nt, Human
gccagucugugg

SEQ ID NO: 1454160 - RNA, 21 nt, Human
gccaggugacugucuggggag

SEQ ID NO: 1454161 - RNA, 14 nt, Human
gccaggucccucuc

SEQ ID NO: 1454162 - RNA, 22 nt, Human
gccaggucacccuuugcuguga

SEQ ID NO: 1454163 - RNA, 15 nt, Human
gccagguccagagag

SEQ ID NO: 1454164 - RNA, 21 nt, Human
gccaggucacccuuugcugug

SEQ ID NO: 1454165 - RNA, 14 nt, Human
gccagcuuuucaaa

SEQ ID NO: 1454166 - RNA, 15 nt, Human
gccagcuuucccugc

SEQ ID NO: 1454167 - RNA, 23 nt, Human
gccagcuuguuuacaugcuuauu

SEQ ID NO: 1454168 - RNA, 20 nt, Human
gccagcuuguuuacaugcuu

SEQ ID NO: 1454169 - RNA, 23 nt, Human
gccagggccccucuccccaggga

SEQ ID NO: 1454170 - RNA, 22 nt, Human
gccagggccccucuccccaggg

SEQ ID NO: 1454171 - RNA, 20 nt, Human
gccagggccccucuccccag

SEQ ID NO: 1454172 - RNA, 19 nt, Human
gccagggccccucucccca

SEQ ID NO: 1454173 - RNA, 18 nt, Human
gccagggccccucucccc

SEQ ID NO: 1454174 - RNA, 17 nt, Human
gccagggccccucuccc

SEQ ID NO: 1454175 - RNA, 16 nt, Human
gccagggccccucucc

SEQ ID NO: 1454176 - RNA, 19 nt, Human
gccaggaagaucccccaga

SEQ ID NO: 1454177 - RNA, 21 nt, Human
gccauggagaaagcugacuug

SEQ ID NO: 1454178 - RNA, 22 nt, Human
gccauggagaaagcugacuugg

SEQ ID NO: 1454179 - RNA, 20 nt, Human
gccauggagaaagcugacuu

SEQ ID NO: 1454180 - RNA, 17 nt, Human
gccauggagaaagcuga

SEQ ID NO: 1454181 - RNA, 16 nt, Human
gccauggagaaagcug

SEQ ID NO: 1454182 - RNA, 15 nt, Human
gccauggagaaagcu

SEQ ID NO: 1454183 - RNA, 14 nt, Human
gccauggagaaagc

SEQ ID NO: 1454184 - RNA, 22 nt, Human
gccauggacucuguccugaagg

SEQ ID NO: 1454185 - RNA, 21 nt, Human
gccauggacucuguccugaag

SEQ ID NO: 1454186 - RNA, 20 nt, Human
gccauggacucuguccugaa

SEQ ID NO: 1454187 - RNA, 23 nt, Human
gccauggccugcaaacugggaac

SEQ ID NO: 1454188 - RNA, 21 nt, Human
gccauggccugcaaacuggga

SEQ ID NO: 1454189 - RNA, 18 nt, Human
gccauggccugcaaacug

SEQ ID NO: 1454190 - RNA, 17 nt, Human
gccauggccugcaaacu

SEQ ID NO: 1454191 - RNA, 14 nt, Human
gccauuuguacuga

SEQ ID NO: 1454192 - RNA, 15 nt, Human
gccauuugcuuuuuc

SEQ ID NO: 1454193 - RNA, 11 nt, Human
gccauuugaga

SEQ ID NO: 1454194 - RNA, 20 nt, Human
gcccacccccggcagcagcc

SEQ ID NO: 1454195 - RNA, 16 nt, Human
gcccacccccggcagc

SEQ ID NO: 1454196 - RNA, 19 nt, Human
gcccaaaggacgcacugag

SEQ ID NO: 1454197 - RNA, 21 nt, Human
gcccaaaggacgcacugagca

SEQ ID NO: 1454198 - RNA, 16 nt, Human
gcccaaaggacgcacu

SEQ ID NO: 1454199 - RNA, 15 nt, Human
gcccaaaggacgcac

SEQ ID NO: 1454200 - RNA, 21 nt, Human
gcccacaccuccuucccucuc

SEQ ID NO: 1454201 - RNA, 13 nt, Human
gcccacaccuccu

SEQ ID NO: 1454202 - RNA, 16 nt, Human
gcccacagcuguauga

SEQ ID NO: 1454203 - RNA, 14 nt, Human
gcccacagcaggcc

SEQ ID NO: 1454204 - RNA, 13 nt, Human
gccccgugaggca

SEQ ID NO: 1454205 - RNA, 13 nt, Human
gccccgcccucau

SEQ ID NO: 1454206 - RNA, 15 nt, Human
gccccgcccugcccc

SEQ ID NO: 1454207 - RNA, 13 nt, Human
gccccgcguggaa

SEQ ID NO: 1454208 - RNA, 21 nt, Human
gccccucaucucucugcccaa

SEQ ID NO: 1454209 - RNA, 21 nt, Human
gccccuagcgcuaucucccug

SEQ ID NO: 1454210 - RNA, 23 nt, Human
gccccuggcugggacguggcuca

SEQ ID NO: 1454211 - RNA, 16 nt, Human
gccccuggcugggacg

SEQ ID NO: 1454212 - RNA, 14 nt, Human
gccccuggcuggga

SEQ ID NO: 1454213 - RNA, 12 nt, Human
gccccuggcugg

SEQ ID NO: 1454214 - RNA, 14 nt, Human
gccccuggccccag

SEQ ID NO: 1454215 - RNA, 13 nt, Human
gccccuggcccca

SEQ ID NO: 1454216 - RNA, 22 nt, Human
gcccgcucuacaucuucugccu

SEQ ID NO: 1454217 - RNA, 21 nt, Human
gccccuuccgccacuggggcu

SEQ ID NO: 1454218 - RNA, 19 nt, Human
gccccuuccgccacugggg

SEQ ID NO: 1454219 - RNA, 17 nt, Human
gccccuuccgccacugg

SEQ ID NO: 1454220 - RNA, 15 nt, Human
gccccuuccgccacu

SEQ ID NO: 1454221 - RNA, 14 nt, Human
gccccuuccgccac

SEQ ID NO: 1454222 - RNA, 17 nt, Human
gcccuccuuccuaaauu

SEQ ID NO: 1454223 - RNA, 23 nt, Human
gcccuccugugcucagcccugag

SEQ ID NO: 1454224 - RNA, 22 nt, Human
gcccuccugugcucagcccuga

SEQ ID NO: 1454225 - RNA, 21 nt, Human
gcccuccugugcucagcccug

SEQ ID NO: 1454226 - RNA, 20 nt, Human
gcccuccugugcucagcccu

SEQ ID NO: 1454227 - RNA, 19 nt, Human
gcccuccugugcucagccc

SEQ ID NO: 1454228 - RNA, 18 nt, Human
gcccuccugugcucagcc

SEQ ID NO: 1454229 - RNA, 17 nt, Human
gcccuccugugcucagc

SEQ ID NO: 1454230 - RNA, 12 nt, Human
gcccuccugugc

SEQ ID NO: 1454231 - RNA, 16 nt, Human
gcccuccucugcacuc

SEQ ID NO: 1454232 - RNA, 19 nt, Human
gcccggacgcccaggaccc

SEQ ID NO: 1454233 - RNA, 21 nt, Human
gcccggacgcccaggacccca

SEQ ID NO: 1454234 - RNA, 14 nt, Human
gcccaguuaaucuu

SEQ ID NO: 1454235 - RNA, 19 nt, Human
gcccagugcacuugcugga

SEQ ID NO: 1454236 - RNA, 15 nt, Human
gcccagugcacugaa

SEQ ID NO: 1454237 - RNA, 22 nt, Human
gcccagugcacuugcuggaaga

SEQ ID NO: 1454238 - RNA, 18 nt, Human
gcccauccccaggcaccu

SEQ ID NO: 1454239 - RNA, 21 nt, Human
gcccaguuggagacugucugg

SEQ ID NO: 1454240 - RNA, 15 nt, Human
gcccaguuaaucuug

SEQ ID NO: 1454241 - RNA, 19 nt, Human
gcccaguucacccugauuu

SEQ ID NO: 1454242 - RNA, 17 nt, Human
gcccaguagaccuuguu

SEQ ID NO: 1454243 - RNA, 15 nt, Human
gcccaguagaccuug

SEQ ID NO: 1454244 - RNA, 23 nt, Human
gcccagggcccagagcccagcuc

SEQ ID NO: 1454245 - RNA, 21 nt, Human
gcccagggcccagagcccagc

SEQ ID NO: 1454246 - RNA, 20 nt, Human
gcccagggcccagagcccag

SEQ ID NO: 1454247 - RNA, 19 nt, Human
gcccagggcccagagccca

SEQ ID NO: 1454248 - RNA, 18 nt, Human
gcccagggcccagagccc

SEQ ID NO: 1454249 - RNA, 17 nt, Human
gcccagggcccagagcc

SEQ ID NO: 1454250 - RNA, 16 nt, Human
gcccagggcccagagc

SEQ ID NO: 1454251 - RNA, 15 nt, Human
gcccagggcccagag

SEQ ID NO: 1454252 - RNA, 14 nt, Human
gcccagggcccaga

SEQ ID NO: 1454253 - RNA, 13 nt, Human
gcccagcucugaa

SEQ ID NO: 1454254 - RNA, 23 nt, Human
gcccagcuccugacacugcugga

SEQ ID NO: 1454255 - RNA, 14 nt, Human
gcccagcuccugac

SEQ ID NO: 1454256 - RNA, 12 nt, Human
gcccagcuccug

SEQ ID NO: 1454257 - RNA, 15 nt, Human
gcccagcuccaaggg

SEQ ID NO: 1454258 - RNA, 12 nt, Human
gcccagcuccaa

SEQ ID NO: 1454259 - RNA, 19 nt, Human
gcccaggcucggccugccc

SEQ ID NO: 1454260 - RNA, 18 nt, Human
gcccaggcucggccugcc

SEQ ID NO: 1454261 - RNA, 18 nt, Human
gcccaggcugccgucccc

SEQ ID NO: 1454262 - RNA, 16 nt, Human
gcccaggcugccgucc

SEQ ID NO: 1454263 - RNA, 13 nt, Human
gcccaggcugccg

SEQ ID NO: 1454264 - RNA, 12 nt, Human
gcccaggcugcc

SEQ ID NO: 1454265 - RNA, 20 nt, Human
gcccaggcucggccugcccc

SEQ ID NO: 1454266 - RNA, 17 nt, Human
gccccaugaccuccagc

SEQ ID NO: 1454267 - RNA, 18 nt, Human
gccccaugaccuccagcu

SEQ ID NO: 1454268 - RNA, 16 nt, Human
gccccaugaccuccag

SEQ ID NO: 1454269 - RNA, 15 nt, Human
gccccaugaccucca

SEQ ID NO: 1454270 - RNA, 14 nt, Human
gccccaugaccucc

SEQ ID NO: 1454271 - RNA, 22 nt, Human
gccccaggaccuggcugccaua

SEQ ID NO: 1454272 - RNA, 21 nt, Human
gccccaggaccuggcugccau

SEQ ID NO: 1454273 - RNA, 20 nt, Human
gccccaggaccuggcugcca

SEQ ID NO: 1454274 - RNA, 24 nt, Human
gccccaggaccagcucaggacaga

SEQ ID NO: 1454275 - RNA, 23 nt, Human
gccccaggaccagcucaggacag

SEQ ID NO: 1454276 - RNA, 22 nt, Human
gccccaggaccagcucaggaca

SEQ ID NO: 1454277 - RNA, 19 nt, Human
gccccaggaccagcucagg

SEQ ID NO: 1454278 - RNA, 18 nt, Human
gccccaggaccagcucag

SEQ ID NO: 1454279 - RNA, 17 nt, Human
gccccaggaccagcuca

SEQ ID NO: 1454280 - RNA, 16 nt, Human
gccccaggaccagcuc

SEQ ID NO: 1454281 - RNA, 15 nt, Human
gccccaggaccagcu

SEQ ID NO: 1454282 - RNA, 14 nt, Human
gccccaggaccagc

SEQ ID NO: 1454283 - RNA, 12 nt, Human
gccccaggacca

SEQ ID NO: 1454284 - RNA, 11 nt, Human
gccccaggacc

SEQ ID NO: 1454285 - RNA, 22 nt, Human
gccccaggaaaggcccagccac

SEQ ID NO: 1454286 - RNA, 15 nt, Human
gccccaggaaaggcc

SEQ ID NO: 1454287 - RNA, 21 nt, Human
gccccagccucccugaagccu

SEQ ID NO: 1454288 - RNA, 18 nt, Human
gccccagccucccugaag

SEQ ID NO: 1454289 - RNA, 16 nt, Human
gccccagccucccuga

SEQ ID NO: 1454290 - RNA, 22 nt, Human
gccccagcccagccccacuccu

SEQ ID NO: 1454291 - RNA, 19 nt, Human
gccccagcccagccccacu

SEQ ID NO: 1454292 - RNA, 14 nt, Human
gccccagcccagcc

SEQ ID NO: 1454293 - RNA, 23 nt, Human
gccccagcccagccccacuccuc

SEQ ID NO: 1454294 - RNA, 22 nt, Human
gcccauggagauugaccuggau

SEQ ID NO: 1454295 - RNA, 21 nt, Human
gcccauggagauugaccugga

SEQ ID NO: 1454296 - RNA, 13 nt, Human
gcccauggagauu

SEQ ID NO: 1454297 - RNA, 23 nt, Human
gcccauggacaggcuggcuccag

SEQ ID NO: 1454298 - RNA, 21 nt, Human
gcccauggacaggcuggcucc

SEQ ID NO: 1454299 - RNA, 20 nt, Human
gcccauggacaggcuggcuc

SEQ ID NO: 1454300 - RNA, 19 nt, Human
gcccauggacaggcuggcu

SEQ ID NO: 1454301 - RNA, 19 nt, Human
gcccauccuguggucacug

SEQ ID NO: 1454302 - RNA, 18 nt, Human
gcccauccugaccagcug

SEQ ID NO: 1454303 - RNA, 16 nt, Human
gcccauccugaccagc

SEQ ID NO: 1454304 - RNA, 15 nt, Human
gcccauccugaccag

SEQ ID NO: 1454305 - RNA, 14 nt, Human
gcccauccugacca

SEQ ID NO: 1454306 - RNA, 22 nt, Human
gcccauccccuugaggucucag

SEQ ID NO: 1454307 - RNA, 14 nt, Human
gcccauccccuuga

SEQ ID NO: 1454308 - RNA, 22 nt, Human
gcccaucugggggccucuucug

SEQ ID NO: 1454309 - RNA, 23 nt, Human
gccuguccacaggcuucugagca

SEQ ID NO: 1454310 - RNA, 18 nt, Human
gccuguccacaggcuucu

SEQ ID NO: 1454311 - RNA, 15 nt, Human
gccuguccacaggcu

SEQ ID NO: 1454312 - RNA, 21 nt, Human
gccugucagauccaggagcuc

SEQ ID NO: 1454313 - RNA, 15 nt, Human
gccugucagauccag

SEQ ID NO: 1454314 - RNA, 22 nt, Human
gccugucagauccaggagcucc

SEQ ID NO: 1454315 - RNA, 20 nt, Human
gccugucagauccaggagcu

SEQ ID NO: 1454316 - RNA, 19 nt, Human
gccugucagauccaggagc

SEQ ID NO: 1454317 - RNA, 18 nt, Human
gccugucagauccaggag

SEQ ID NO: 1454318 - RNA, 13 nt, Human
gccuguaaacuuu

SEQ ID NO: 1454319 - RNA, 19 nt, Human
gccuguaacaagccagauu

SEQ ID NO: 1454320 - RNA, 21 nt, Human
gccugguuaaauaaggcaggg

SEQ ID NO: 1454321 - RNA, 14 nt, Human
gccugguuagaggc

SEQ ID NO: 1454322 - RNA, 21 nt, Human
gccuggagaugacuugaggcc

SEQ ID NO: 1454323 - RNA, 12 nt, Human
gccuggagcccu

SEQ ID NO: 1454324 - RNA, 16 nt, Human
gccuggagauccuccu

SEQ ID NO: 1454325 - RNA, 23 nt, Human
gccuggagacuuagggcaccagg

SEQ ID NO: 1454326 - RNA, 19 nt, Human
gccuggagacuuagggcac

SEQ ID NO: 1454327 - RNA, 17 nt, Human
gccuggagacuuagggc

SEQ ID NO: 1454328 - RNA, 18 nt, Human
gccuggacuuuccugcaa

SEQ ID NO: 1454329 - RNA, 17 nt, Human
gccuggacuuuccugca

SEQ ID NO: 1454330 - RNA, 16 nt, Human
gccuggacuuuccugc

SEQ ID NO: 1454331 - RNA, 15 nt, Human
gccuggacuuuccug

SEQ ID NO: 1454332 - RNA, 14 nt, Human
gccuggacuuuccu

SEQ ID NO: 1454333 - RNA, 23 nt, Human
gccuggaccucugacagcagcau

SEQ ID NO: 1454334 - RNA, 22 nt, Human
gccuggaccucugacagcagca

SEQ ID NO: 1454335 - RNA, 21 nt, Human
gccuggaccucugacagcagc

SEQ ID NO: 1454336 - RNA, 15 nt, Human
gccuggagcacaaag

SEQ ID NO: 1454337 - RNA, 14 nt, Human
gccuggagaugacu

SEQ ID NO: 1454338 - RNA, 22 nt, Human
gccuggagauccuccugcagac

SEQ ID NO: 1454339 - RNA, 20 nt, Human
gccuggagauccuccugcag

SEQ ID NO: 1454340 - RNA, 19 nt, Human
gccuggagauccuccugca

SEQ ID NO: 1454341 - RNA, 18 nt, Human
gccuggagauccuccugc

SEQ ID NO: 1454342 - RNA, 17 nt, Human
gccuggagauccuccug

SEQ ID NO: 1454343 - RNA, 15 nt, Human
gccuggagcccugga

SEQ ID NO: 1454344 - RNA, 16 nt, Human
gccuggagcccuggag

SEQ ID NO: 1454345 - RNA, 17 nt, Human
gccuggagcccuggaga

SEQ ID NO: 1454346 - RNA, 14 nt, Human
gccuguccugccug

SEQ ID NO: 1454347 - RNA, 13 nt, Human
gccuguccugccu

SEQ ID NO: 1454348 - RNA, 12 nt, Human
gccuguccugcc

SEQ ID NO: 1454349 - RNA, 20 nt, Human
gccuguccugaccugucuca

SEQ ID NO: 1454350 - RNA, 22 nt, Human
gccuguccuccaacaccaagca

SEQ ID NO: 1454351 - RNA, 20 nt, Human
gccuguccacaggcuucuga

SEQ ID NO: 1454352 - RNA, 20 nt, Human
gccugucccacccccacccc

SEQ ID NO: 1454353 - RNA, 15 nt, Human
gccuuagucucaguu

SEQ ID NO: 1454354 - RNA, 19 nt, Human
gccuuaggaagagccuucc

SEQ ID NO: 1454355 - RNA, 18 nt, Human
gccuuagucucaguuugu

SEQ ID NO: 1454356 - RNA, 22 nt, Human
gccuuagucucaguuugugugu

SEQ ID NO: 1454357 - RNA, 22 nt, Human
gccuucaagcucugagggaaag

SEQ ID NO: 1454358 - RNA, 16 nt, Human
gccuucaagcucugag

SEQ ID NO: 1454359 - RNA, 15 nt, Human
gccuucaagcucuga

SEQ ID NO: 1454360 - RNA, 14 nt, Human
gccuucaagcucug

SEQ ID NO: 1454361 - RNA, 11 nt, Human
gccuucaagcu

SEQ ID NO: 1454362 - RNA, 22 nt, Human
gccuucaagaaaacaggcacug

SEQ ID NO: 1454363 - RNA, 20 nt, Human
gccuucaagaaaacaggcac

SEQ ID NO: 1454364 - RNA, 18 nt, Human
gccuuauucagggaagga

SEQ ID NO: 1454365 - RNA, 16 nt, Human
gccuuauucagggaag

SEQ ID NO: 1454366 - RNA, 19 nt, Human
gccuuauuagagugucuuu

SEQ ID NO: 1454367 - RNA, 22 nt, Human
gccuuauuggaaagcagucccc

SEQ ID NO: 1454368 - RNA, 13 nt, Human
gccuucaaaucaa

SEQ ID NO: 1454369 - RNA, 23 nt, Human
gccuucagacagagaggacugua

SEQ ID NO: 1454370 - RNA, 22 nt, Human
gccuucacaaucugucaguucu

SEQ ID NO: 1454371 - RNA, 17 nt, Human
gccuucacaaucuguca

SEQ ID NO: 1454372 - RNA, 19 nt, Human
gccuucaagcucugaggga

SEQ ID NO: 1454373 - RNA, 12 nt, Human
gccuuccccacc

SEQ ID NO: 1454374 - RNA, 22 nt, Human
gccuuccccacccaccaacccu

SEQ ID NO: 1454375 - RNA, 17 nt, Human
gccuucgcuucuugccu

SEQ ID NO: 1454376 - RNA, 20 nt, Human
gccuuccccuuauccucccu

SEQ ID NO: 1454377 - RNA, 22 nt, Human
gccuuccccuuauccucccugu

SEQ ID NO: 1454378 - RNA, 21 nt, Human
gccuugggcuccgugugggag

SEQ ID NO: 1454379 - RNA, 22 nt, Human
gccuugggcuccgugugggaga

SEQ ID NO: 1454380 - RNA, 20 nt, Human
gccuugggcuccguguggga

SEQ ID NO: 1454381 - RNA, 18 nt, Human
gccuugggcuccgugugg

SEQ ID NO: 1454382 - RNA, 17 nt, Human
gccuugggcuccgugug

SEQ ID NO: 1454383 - RNA, 20 nt, Human
gccuuggcugacaugaagcu

SEQ ID NO: 1454384 - RNA, 22 nt, Human
gccuucgcuucuugccucugug

SEQ ID NO: 1454385 - RNA, 21 nt, Human
gccuucgcuucuugccucugu

SEQ ID NO: 1454386 - RNA, 20 nt, Human
gccuucgcuucuugccucug

SEQ ID NO: 1454387 - RNA, 18 nt, Human
gccuuggggcugaugcag

SEQ ID NO: 1454388 - RNA, 21 nt, Human
gccuuuaaaauuuuuuuagaa

SEQ ID NO: 1454389 - RNA, 20 nt, Human
gccuuuguuccccacuggag

SEQ ID NO: 1454390 - RNA, 19 nt, Human
gccuuuguuccccacugga

SEQ ID NO: 1454391 - RNA, 18 nt, Human
gccuuuguuccccacugg

SEQ ID NO: 1454392 - RNA, 14 nt, Human
gccuuucaggaucu

SEQ ID NO: 1454393 - RNA, 17 nt, Human
gccuuucaggaucuauu

SEQ ID NO: 1454394 - RNA, 14 nt, Human
gccuuuauuuguua

SEQ ID NO: 1454395 - RNA, 23 nt, Human
gccuuuauuuuuggcguggcuga

SEQ ID NO: 1454396 - RNA, 20 nt, Human
gccuuuauuuccacugugca

SEQ ID NO: 1454397 - RNA, 19 nt, Human
gccuuuauuuccacugugc

SEQ ID NO: 1454398 - RNA, 22 nt, Human
gccuuuauuguguuugucauua

SEQ ID NO: 1454399 - RNA, 23 nt, Human
gccuuuauuguguuugucauuag

SEQ ID NO: 1454400 - RNA, 21 nt, Human
gccuuuauuaaaaacugagug

SEQ ID NO: 1454401 - RNA, 13 nt, Human
gccuuuauugugu

SEQ ID NO: 1454402 - RNA, 14 nt, Human
gccuuuauuguguu

SEQ ID NO: 1454403 - RNA, 20 nt, Human
gccuuuauuguguuugucau

SEQ ID NO: 1454404 - RNA, 18 nt, Human
gccuuuugcaaccaggaa

SEQ ID NO: 1454405 - RNA, 20 nt, Human
gccuuuucccucuuuggcuc

SEQ ID NO: 1454406 - RNA, 13 nt, Human
gccuuuucccucu

SEQ ID NO: 1454407 - RNA, 22 nt, Human
gccuuuguuccccacuggagca

SEQ ID NO: 1454408 - RNA, 21 nt, Human
gccuuuguuccccacuggagc

SEQ ID NO: 1454409 - RNA, 23 nt, Human
gccuuuguuccccacuggagcag

SEQ ID NO: 1454410 - RNA, 22 nt, Human
gccuuuuaucccaaaguuguug

SEQ ID NO: 1454411 - RNA, 22 nt, Human
gcgaccuuccucauccacccca

SEQ ID NO: 1454412 - RNA, 15 nt, Human
gcgaccuuccucauc

SEQ ID NO: 1454413 - RNA, 10 nt, Human
gcgaccuccu

SEQ ID NO: 1454414 - RNA, 15 nt, Human
gcgaccgcccccucc

SEQ ID NO: 1454415 - RNA, 14 nt, Human
gcgaccgcccccuc

SEQ ID NO: 1454416 - RNA, 13 nt, Human
gcgaccgcccccu

SEQ ID NO: 1454417 - RNA, 16 nt, Human
gcguccuccucuguga

SEQ ID NO: 1454418 - RNA, 15 nt, Human
gcguccuccucugug

SEQ ID NO: 1454419 - RNA, 14 nt, Human
gcguccuccucugu

SEQ ID NO: 1454420 - RNA, 19 nt, Human
gcguccugucggagcccug

SEQ ID NO: 1454421 - RNA, 14 nt, Human
gcggggaggaggaa

SEQ ID NO: 1454422 - RNA, 20 nt, Human
gcggaacaaggagucagaca

SEQ ID NO: 1454423 - RNA, 23 nt, Human
gcgcugucaggauugcgagagau

SEQ ID NO: 1454424 - RNA, 17 nt, Human
gcgcugguccuuucuuc

SEQ ID NO: 1454425 - RNA, 19 nt, Human
gcgcccagggcugggagga

SEQ ID NO: 1454426 - RNA, 13 nt, Human
gcgcccagggcug

SEQ ID NO: 1454427 - RNA, 15 nt, Human
gcgcccagcuccuga

SEQ ID NO: 1454428 - RNA, 14 nt, Human
gcgcccagcuccug

SEQ ID NO: 1454429 - RNA, 22 nt, Human
gcgccaggcugaccacagcaca

SEQ ID NO: 1454430 - RNA, 20 nt, Human
gcgccaggcugaccacagca

SEQ ID NO: 1454431 - RNA, 15 nt, Human
gcgccaggcugacca

SEQ ID NO: 1454432 - RNA, 22 nt, Human
gcgccaggauggaacacggcca

SEQ ID NO: 1454433 - RNA, 21 nt, Human
gcgccaggauggaacacggcc

SEQ ID NO: 1454434 - RNA, 14 nt, Human
gcgacuuucugccu

SEQ ID NO: 1454435 - RNA, 12 nt, Human
gcgacuuucugc

SEQ ID NO: 1454436 - RNA, 20 nt, Human
gcgacuccguuggccacucc

SEQ ID NO: 1454437 - RNA, 19 nt, Human
gcgacuccguuggccacuc

SEQ ID NO: 1454438 - RNA, 18 nt, Human
gcgacuccguuggccacu

SEQ ID NO: 1454439 - RNA, 23 nt, Human
gcgacuaauuucaaaaugcuuuu

SEQ ID NO: 1454440 - RNA, 21 nt, Human
gcgacuaauuucaaaaugcuu

SEQ ID NO: 1454441 - RNA, 13 nt, Human
gcgacuaauuuca

SEQ ID NO: 1454442 - RNA, 23 nt, Human
gcgaccuuccucauccaccccau

SEQ ID NO: 1454443 - RNA, 21 nt, Human
gcgacguuagucgugagcucu

SEQ ID NO: 1454444 - RNA, 22 nt, Human
gcgacguuagucgugagcucuu

SEQ ID NO: 1454445 - RNA, 20 nt, Human
gcgcuccuggcccagccuuu

SEQ ID NO: 1454446 - RNA, 19 nt, Human
gcgcuccuggcccagccuu

SEQ ID NO: 1454447 - RNA, 18 nt, Human
gcgcuccuggcccagccu

SEQ ID NO: 1454448 - RNA, 18 nt, Human
gcgccuccaacccuagca

SEQ ID NO: 1454449 - RNA, 23 nt, Human
gcuagacacaugaagguaaauaa

SEQ ID NO: 1454450 - RNA, 22 nt, Human
gcuagacacaugaagguaaaua

SEQ ID NO: 1454451 - RNA, 22 nt, Human
gcuacccuuuuucuccagcugg

SEQ ID NO: 1454452 - RNA, 21 nt, Human
gcuacccuuuuucuccagcug

SEQ ID NO: 1454453 - RNA, 20 nt, Human
gcuacccuuuuucuccagcu

SEQ ID NO: 1454454 - RNA, 19 nt, Human
gcuacccuuuuucuccagc

SEQ ID NO: 1454455 - RNA, 18 nt, Human
gcuacccuuuuucuccag

SEQ ID NO: 1454456 - RNA, 19 nt, Human
gcuagagcuccucccucuc

SEQ ID NO: 1454457 - RNA, 16 nt, Human
gcuagagcuccucccu

SEQ ID NO: 1454458 - RNA, 15 nt, Human
gcuagagcuccuccc

SEQ ID NO: 1454459 - RNA, 13 nt, Human
gcuagagcuccuc

SEQ ID NO: 1454460 - RNA, 16 nt, Human
gcuacccuuuuucucc

SEQ ID NO: 1454461 - RNA, 19 nt, Human
gcuacccugagcugaggca

SEQ ID NO: 1454462 - RNA, 20 nt, Human
gcuacccugagcugaggcag

SEQ ID NO: 1454463 - RNA, 16 nt, Human
gcuacccugagcugag

SEQ ID NO: 1454464 - RNA, 14 nt, Human
gcuacccugagcug

SEQ ID NO: 1454465 - RNA, 12 nt, Human
gcuacccugagc

SEQ ID NO: 1454466 - RNA, 22 nt, Human
gcuaccaguauuuagaagccaa

SEQ ID NO: 1454467 - RNA, 21 nt, Human
gcuaccaguauuuagaagcca

SEQ ID NO: 1454468 - RNA, 19 nt, Human
gcuaccaguauuuagaagc

SEQ ID NO: 1454469 - RNA, 18 nt, Human
gcuaccaguauuuagaag

SEQ ID NO: 1454470 - RNA, 20 nt, Human
gcuaccaaagcaccuuagcu

SEQ ID NO: 1454471 - RNA, 14 nt, Human
gcuaccaaaacagu

SEQ ID NO: 1454472 - RNA, 13 nt, Human
gcuacauaauuua

SEQ ID NO: 1454473 - RNA, 12 nt, Human
gcuacagagaag

SEQ ID NO: 1454474 - RNA, 22 nt, Human
gcuacagagaaaccagcuuccu

SEQ ID NO: 1454475 - RNA, 21 nt, Human
gcuacagagaaaccagcuucc

SEQ ID NO: 1454476 - RNA, 20 nt, Human
gcuacagagaaaccagcuuc

SEQ ID NO: 1454477 - RNA, 19 nt, Human
gcuacagagaaaccagcuu

SEQ ID NO: 1454478 - RNA, 17 nt, Human
gcuacagagaaaccagc

SEQ ID NO: 1454479 - RNA, 21 nt, Human
gcuaccaccagcuguguccaa

SEQ ID NO: 1454480 - RNA, 20 nt, Human
gcuaccaccagcugugucca

SEQ ID NO: 1454481 - RNA, 16 nt, Human
gcuaccaccagcugug

SEQ ID NO: 1454482 - RNA, 15 nt, Human
gcuaccaccagcugu

SEQ ID NO: 1454483 - RNA, 14 nt, Human
gcuaccaccagcug

SEQ ID NO: 1454484 - RNA, 13 nt, Human
gcuaccaccagcu

SEQ ID NO: 1454485 - RNA, 12 nt, Human
gcuaccaccagc

SEQ ID NO: 1454486 - RNA, 15 nt, Human
gcuaccaguauuuag

SEQ ID NO: 1454487 - RNA, 14 nt, Human
gcuaccaguauuua

SEQ ID NO: 1454488 - RNA, 13 nt, Human
gcuaccaguauuu

SEQ ID NO: 1454489 - RNA, 13 nt, Human
gcuaccaggaaag

SEQ ID NO: 1454490 - RNA, 22 nt, Human
gcguccugucggagcccugucu

SEQ ID NO: 1454491 - RNA, 17 nt, Human
gcuaagaaccuggaacu

SEQ ID NO: 1454492 - RNA, 16 nt, Human
gcuaagaaccuggaac

SEQ ID NO: 1454493 - RNA, 23 nt, Human
gcuaagaaccuggaacuugggga

SEQ ID NO: 1454494 - RNA, 17 nt, Human
gcuacacccuuuuccag

SEQ ID NO: 1454495 - RNA, 21 nt, Human
gcuacaccacucuggcagcca

SEQ ID NO: 1454496 - RNA, 20 nt, Human
gcuacaccacucuggcagcc

SEQ ID NO: 1454497 - RNA, 19 nt, Human
gcuacaccacucuggcagc

SEQ ID NO: 1454498 - RNA, 18 nt, Human
gcuacaccacucuggcag

SEQ ID NO: 1454499 - RNA, 17 nt, Human
gcuacaccacucuggca

SEQ ID NO: 1454500 - RNA, 16 nt, Human
gcuacaccacucuggc

SEQ ID NO: 1454501 - RNA, 23 nt, Human
gcuacaccuauuaucccagcugc

SEQ ID NO: 1454502 - RNA, 19 nt, Human
gcuacacccuuuuccagcu

SEQ ID NO: 1454503 - RNA, 16 nt, Human
gcuacagagaaaccag

SEQ ID NO: 1454504 - RNA, 15 nt, Human
gcuacagagaaacca

SEQ ID NO: 1454505 - RNA, 13 nt, Human
gcuacagagaaac

SEQ ID NO: 1454506 - RNA, 12 nt, Human
gcuacagagaaa

SEQ ID NO: 1454507 - RNA, 11 nt, Human
gcuacagagaa

SEQ ID NO: 1454508 - RNA, 22 nt, Human
gcuacaccacucuggcagccac

SEQ ID NO: 1454509 - RNA, 16 nt, Human
gcuacagaagaaacug

SEQ ID NO: 1454510 - RNA, 15 nt, Human
gccugagcccaggga

SEQ ID NO: 1454511 - RNA, 14 nt, Human
gccugagcccaggg

SEQ ID NO: 1454512 - RNA, 13 nt, Human
gccugagcccagg

SEQ ID NO: 1454513 - RNA, 12 nt, Human
gccugagcccag

SEQ ID NO: 1454514 - RNA, 23 nt, Human
gccugagcaguccuuggccugcu

SEQ ID NO: 1454515 - RNA, 19 nt, Human
gccugagcaguccuuggcc

SEQ ID NO: 1454516 - RNA, 18 nt, Human
gccugagcaguccuuggc

SEQ ID NO: 1454517 - RNA, 16 nt, Human
gccugagcaguccuug

SEQ ID NO: 1454518 - RNA, 18 nt, Human
gccugagcaacucuugau

SEQ ID NO: 1454519 - RNA, 20 nt, Human
gccugagcccagggaggccg

SEQ ID NO: 1454520 - RNA, 19 nt, Human
gccugagcccagggaggcc

SEQ ID NO: 1454521 - RNA, 18 nt, Human
gccugagcccagggaggc

SEQ ID NO: 1454522 - RNA, 17 nt, Human
gccugagcccagggagg

SEQ ID NO: 1454523 - RNA, 16 nt, Human
gccugagcccagggag

SEQ ID NO: 1454524 - RNA, 20 nt, Human
gccuggaccucugacagcag

SEQ ID NO: 1454525 - RNA, 18 nt, Human
gccuggaccucugacagc

SEQ ID NO: 1454526 - RNA, 15 nt, Human
gccuggaccucugac

SEQ ID NO: 1454527 - RNA, 13 nt, Human
gccuggaccucug

SEQ ID NO: 1454528 - RNA, 23 nt, Human
gccugcugcugagaaccuggccu

SEQ ID NO: 1454529 - RNA, 22 nt, Human
gccugcugcugagaaccuggcc

SEQ ID NO: 1454530 - RNA, 17 nt, Human
gccugaacuccugccau

SEQ ID NO: 1454531 - RNA, 19 nt, Human
gccugaaccccagggcugu

SEQ ID NO: 1454532 - RNA, 14 nt, Human
gccugaacccaaga

SEQ ID NO: 1454533 - RNA, 23 nt, Human
gccugaaagaggcugaggccugg

SEQ ID NO: 1454534 - RNA, 20 nt, Human
gccucccccacuuucuuucu

SEQ ID NO: 1454535 - RNA, 11 nt, Human
gccucccccac

SEQ ID NO: 1454536 - RNA, 22 nt, Human
gccucccauccagggcccccau

SEQ ID NO: 1454537 - RNA, 15 nt, Human
gccucccauccaggg

SEQ ID NO: 1454538 - RNA, 14 nt, Human
gccucccauguuca

SEQ ID NO: 1454539 - RNA, 16 nt, Human
gccucccuccugcccc

SEQ ID NO: 1454540 - RNA, 21 nt, Human
gccuccccuuaaaggggagac

SEQ ID NO: 1454541 - RNA, 13 nt, Human
gccucccccacuu

SEQ ID NO: 1454542 - RNA, 13 nt, Human
gccucccugagcu

SEQ ID NO: 1454543 - RNA, 12 nt, Human
gccucccugagc

SEQ ID NO: 1454544 - RNA, 16 nt, Human
gccucccuggucccuu

SEQ ID NO: 1454545 - RNA, 18 nt, Human
gccucccugaagccuuug

SEQ ID NO: 1454546 - RNA, 13 nt, Human
gccucccugaagc

SEQ ID NO: 1454547 - RNA, 15 nt, Human
gccucccucugcugu

SEQ ID NO: 1454548 - RNA, 18 nt, Human
gccucuccccagguccag

SEQ ID NO: 1454549 - RNA, 17 nt, Human
gccucucccaggcaggg

SEQ ID NO: 1454550 - RNA, 15 nt, Human
gccucucccaggcag

SEQ ID NO: 1454551 - RNA, 14 nt, Human
gccucucccaggca

SEQ ID NO: 1454552 - RNA, 17 nt, Human
gccucuccccugccugc

SEQ ID NO: 1454553 - RNA, 18 nt, Human
gccucuccccugccugcc

SEQ ID NO: 1454554 - RNA, 16 nt, Human
gccucuccccugccug

SEQ ID NO: 1454555 - RNA, 20 nt, Human
gccucucccaggcaggggcc

SEQ ID NO: 1454556 - RNA, 23 nt, Human
gccucuccccagguccagcucug

SEQ ID NO: 1454557 - RNA, 22 nt, Human
gccucuccccagguccagcucu

SEQ ID NO: 1454558 - RNA, 20 nt, Human
gccucuccccagguccagcu

SEQ ID NO: 1454559 - RNA, 10 nt, Human
gccucucugc

SEQ ID NO: 1454560 - RNA, 14 nt, Human
gccucucugcaggu

SEQ ID NO: 1454561 - RNA, 16 nt, Human
gccucucugcaggucc

SEQ ID NO: 1454562 - RNA, 17 nt, Human
gccucucugcagguccc

SEQ ID NO: 1454563 - RNA, 18 nt, Human
gccucucugcaggucccu

SEQ ID NO: 1454564 - RNA, 22 nt, Human
gccgugacgucuggguggcccu

SEQ ID NO: 1454565 - RNA, 18 nt, Human
gccgugacgucugggugg

SEQ ID NO: 1454566 - RNA, 14 nt, Human
gccgugacgucugg

SEQ ID NO: 1454567 - RNA, 16 nt, Human
gccgugaaugggugcc

SEQ ID NO: 1454568 - RNA, 23 nt, Human
gccgucuccaggggcugcuuccu

SEQ ID NO: 1454569 - RNA, 21 nt, Human
gccgucuccaggggcugcuuc

SEQ ID NO: 1454570 - RNA, 16 nt, Human
gccgucuccaggggcu

SEQ ID NO: 1454571 - RNA, 14 nt, Human
gccgucuccagggg

SEQ ID NO: 1454572 - RNA, 23 nt, Human
gccggguguccccaacagcgccc

SEQ ID NO: 1454573 - RNA, 20 nt, Human
gccguggcugcugugggaaa

SEQ ID NO: 1454574 - RNA, 16 nt, Human
gccguggcugcugugg

SEQ ID NO: 1454575 - RNA, 23 nt, Human
gccguggauugcacguggccucu

SEQ ID NO: 1454576 - RNA, 22 nt, Human
gccguggauugcacguggccuc

SEQ ID NO: 1454577 - RNA, 21 nt, Human
gccguggauugcacguggccu

SEQ ID NO: 1454578 - RNA, 23 nt, Human
gccuaaaagugggcuugauucug

SEQ ID NO: 1454579 - RNA, 22 nt, Human
gccucaauuucugaacaccaua

SEQ ID NO: 1454580 - RNA, 14 nt, Human
gccucaaugccagu

SEQ ID NO: 1454581 - RNA, 21 nt, Human
gccuaagaggcugcccuccug

SEQ ID NO: 1454582 - RNA, 13 nt, Human
gccuaagaggcug

SEQ ID NO: 1454583 - RNA, 12 nt, Human
gccuaagaggcu

SEQ ID NO: 1454584 - RNA, 22 nt, Human
gccuaaaagugggcuugauucu

SEQ ID NO: 1454585 - RNA, 22 nt, Human
gccucaaagcaagcauucagaa

SEQ ID NO: 1454586 - RNA, 20 nt, Human
gccucaaauaaaaagugcuu

SEQ ID NO: 1454587 - RNA, 17 nt, Human
gccucaaaggcccgcuc

SEQ ID NO: 1454588 - RNA, 15 nt, Human
gccucaaaggcccgc

SEQ ID NO: 1454589 - RNA, 20 nt, Human
gccuauugcuagagcuccuc

SEQ ID NO: 1454590 - RNA, 23 nt, Human
gccuauugcuagagcuccucccu

SEQ ID NO: 1454591 - RNA, 19 nt, Human
gccuauugcuagagcuccu

SEQ ID NO: 1454592 - RNA, 18 nt, Human
gccuauugcuagagcucc

SEQ ID NO: 1454593 - RNA, 17 nt, Human
gccuauugcuagagcuc

SEQ ID NO: 1454594 - RNA, 20 nt, Human
gccuaagaggcugcccuccu

SEQ ID NO: 1454595 - RNA, 17 nt, Human
gccuauuuuaauaaaca

SEQ ID NO: 1454596 - RNA, 22 nt, Human
gccggggugggguggcugcagc

SEQ ID NO: 1454597 - RNA, 21 nt, Human
gccgggucugccucuucuggg

SEQ ID NO: 1454598 - RNA, 14 nt, Human
gccgggucugccuc

SEQ ID NO: 1454599 - RNA, 23 nt, Human
gccggggugggguggcugcagcc

SEQ ID NO: 1454600 - RNA, 20 nt, Human
gccggggugggguggcugca

SEQ ID NO: 1454601 - RNA, 19 nt, Human
gccggggugggguggcugc

SEQ ID NO: 1454602 - RNA, 17 nt, Human
gccggggcgaguggcac

SEQ ID NO: 1454603 - RNA, 15 nt, Human
gccggggcagccccc

SEQ ID NO: 1454604 - RNA, 23 nt, Human
gccggggaacuggccaagcugag

SEQ ID NO: 1454605 - RNA, 19 nt, Human
gccgggagccugacccuca

SEQ ID NO: 1454606 - RNA, 14 nt, Human
gccgggagccugac

SEQ ID NO: 1454607 - RNA, 13 nt, Human
gccgggagccuga

SEQ ID NO: 1454608 - RNA, 14 nt, Human
gccgaugcccagag

SEQ ID NO: 1454609 - RNA, 22 nt, Human
gccgauauacucuagaugaagu

SEQ ID NO: 1454610 - RNA, 17 nt, Human
gccgauauacucuagau

SEQ ID NO: 1454611 - RNA, 18 nt, Human
gccgaguccaagcuggga

SEQ ID NO: 1454612 - RNA, 15 nt, Human
gccgaguccaagcug

SEQ ID NO: 1454613 - RNA, 14 nt, Human
gccgaguccaagcu

SEQ ID NO: 1454614 - RNA, 17 nt, Human
gcccuugaguccccauu

SEQ ID NO: 1454615 - RNA, 16 nt, Human
gcccuucuuucuaccc

SEQ ID NO: 1454616 - RNA, 13 nt, Human
gcccuucuuucua

SEQ ID NO: 1454617 - RNA, 12 nt, Human
gcccuucuuucu

SEQ ID NO: 1454618 - RNA, 18 nt, Human
gccgacgcuugcacgacc

SEQ ID NO: 1454619 - RNA, 21 nt, Human
gccgagaguccaucagccucc

SEQ ID NO: 1454620 - RNA, 17 nt, Human
gcccucugggcucugag

SEQ ID NO: 1454621 - RNA, 18 nt, Human
gcccucugggcucugagu

SEQ ID NO: 1454622 - RNA, 16 nt, Human
gcccucugggcucuga

SEQ ID NO: 1454623 - RNA, 15 nt, Human
gcccucugggcucug

SEQ ID NO: 1454624 - RNA, 14 nt, Human
gcccucugggcucu

SEQ ID NO: 1454625 - RNA, 13 nt, Human
gcccucugggcuc

SEQ ID NO: 1454626 - RNA, 12 nt, Human
gcccucugggcu

SEQ ID NO: 1454627 - RNA, 11 nt, Human
gcccucugggc

SEQ ID NO: 1454628 - RNA, 18 nt, Human
gcccuuccuggacagcug

SEQ ID NO: 1454629 - RNA, 17 nt, Human
gcccuuccuggacagcu

SEQ ID NO: 1454630 - RNA, 16 nt, Human
gcccuuccuggacagc

SEQ ID NO: 1454631 - RNA, 15 nt, Human
gcccuuccuggacag

SEQ ID NO: 1454632 - RNA, 14 nt, Human
gcccuuccuggaca

SEQ ID NO: 1454633 - RNA, 13 nt, Human
gcccuuccuggac

SEQ ID NO: 1454634 - RNA, 12 nt, Human
gcccuuccugga

SEQ ID NO: 1454635 - RNA, 22 nt, Human
gcccuuccuggacagcugugcc

SEQ ID NO: 1454636 - RNA, 21 nt, Human
gcccuuccuggacagcugugc

SEQ ID NO: 1454637 - RNA, 20 nt, Human
gcccuuccuggacagcugug

SEQ ID NO: 1454638 - RNA, 19 nt, Human
gcccuuccuggacagcugu

SEQ ID NO: 1454639 - RNA, 23 nt, Human
gcccuuccuggacagcugugccu

SEQ ID NO: 1454640 - RNA, 20 nt, Human
gcccuucuauacccacccag

SEQ ID NO: 1454641 - RNA, 19 nt, Human
gcccuucuuuccacagaag

SEQ ID NO: 1454642 - RNA, 21 nt, Human
gcccuucuauacccacccaga

SEQ ID NO: 1454643 - RNA, 22 nt, Human
gcccuucuauacccacccagaa

SEQ ID NO: 1454644 - RNA, 22 nt, Human
gcuggccucccaaaugagccau

SEQ ID NO: 1454645 - RNA, 21 nt, Human
gcuggccucccaaaugagcca

SEQ ID NO: 1454646 - RNA, 21 nt, Human
gcuggccucacccaccccugc

SEQ ID NO: 1454647 - RNA, 16 nt, Human
gcuggccucugcgagu

SEQ ID NO: 1454648 - RNA, 15 nt, Human
gcuggccucugcgag

SEQ ID NO: 1454649 - RNA, 14 nt, Human
gcuggccucugcga

SEQ ID NO: 1454650 - RNA, 13 nt, Human
gcuggccucugcg

SEQ ID NO: 1454651 - RNA, 12 nt, Human
gcuggccucugc

SEQ ID NO: 1454652 - RNA, 23 nt, Human
gcugggacaccccgacuuuuguu

SEQ ID NO: 1454653 - RNA, 20 nt, Human
gcugggacguggcucagcca

SEQ ID NO: 1454654 - RNA, 19 nt, Human
gcugggacguggcucagcc

SEQ ID NO: 1454655 - RNA, 17 nt, Human
gcugggacguggcucag

SEQ ID NO: 1454656 - RNA, 23 nt, Human
gcugggacucagccuucagacag

SEQ ID NO: 1454657 - RNA, 22 nt, Human
gcugggacucagccuucagaca

SEQ ID NO: 1454658 - RNA, 19 nt, Human
gcugggacucagccuucag

SEQ ID NO: 1454659 - RNA, 16 nt, Human
gcugggacucagccuu

SEQ ID NO: 1454660 - RNA, 15 nt, Human
gcugggacucagccu

SEQ ID NO: 1454661 - RNA, 14 nt, Human
gcugggacucagcc

SEQ ID NO: 1454662 - RNA, 12 nt, Human
gcugggacucag

SEQ ID NO: 1454663 - RNA, 14 nt, Human
gcugggacuacagg

SEQ ID NO: 1454664 - RNA, 22 nt, Human
gcugggacguggcucagccagc

SEQ ID NO: 1454665 - RNA, 21 nt, Human
gcugggacguggcucagccag

SEQ ID NO: 1454666 - RNA, 20 nt, Human
gcuggcccagggcccagagc

SEQ ID NO: 1454667 - RNA, 19 nt, Human
gcuggcccagggcccagag

SEQ ID NO: 1454668 - RNA, 18 nt, Human
gcuggcccagggcccaga

SEQ ID NO: 1454669 - RNA, 21 nt, Human
gcuggcccagggcccagagcc

SEQ ID NO: 1454670 - RNA, 17 nt, Human
gcuggcccagggcccag

SEQ ID NO: 1454671 - RNA, 16 nt, Human
gcuggcccagggccca

SEQ ID NO: 1454672 - RNA, 15 nt, Human
gcuggcccagggccc

SEQ ID NO: 1454673 - RNA, 13 nt, Human
gcuggcccagggc

SEQ ID NO: 1454674 - RNA, 21 nt, Human
gcuggcaacacagaggcagcc

SEQ ID NO: 1454675 - RNA, 19 nt, Human
gcuggcaacacagaggcag

SEQ ID NO: 1454676 - RNA, 14 nt, Human
gcuggcaacacaga

SEQ ID NO: 1454677 - RNA, 15 nt, Human
gcuggaugagcuccc

SEQ ID NO: 1454678 - RNA, 23 nt, Human
gcuggaugagcucccacaagccu

SEQ ID NO: 1454679 - RNA, 14 nt, Human
gcuggaugagcucc

SEQ ID NO: 1454680 - RNA, 13 nt, Human
gcuggaugagcuc

SEQ ID NO: 1454681 - RNA, 20 nt, Human
gcuggaugagaauuugagug

SEQ ID NO: 1454682 - RNA, 23 nt, Human
gcugcuucucccaggcaaggcug

SEQ ID NO: 1454683 - RNA, 16 nt, Human
gcugcuuccuccugga

SEQ ID NO: 1454684 - RNA, 15 nt, Human
gcugcuuccuccugg

SEQ ID NO: 1454685 - RNA, 14 nt, Human
gcugcuuccuccug

SEQ ID NO: 1454686 - RNA, 13 nt, Human
gcugcuuccuccu

SEQ ID NO: 1454687 - RNA, 13 nt, Human
gcugcuuccagug

SEQ ID NO: 1454688 - RNA, 22 nt, Human
gcugcuucucccaggcaaggcu

SEQ ID NO: 1454689 - RNA, 21 nt, Human
gcugcuucucccaggcaaggc

SEQ ID NO: 1454690 - RNA, 19 nt, Human
gcugcuucucccaggcaag

SEQ ID NO: 1454691 - RNA, 18 nt, Human
gcugcuucucccaggcaa

SEQ ID NO: 1454692 - RNA, 19 nt, Human
gcugcuucccugaagcucc

SEQ ID NO: 1454693 - RNA, 17 nt, Human
gcugcuuccuccuggaa

SEQ ID NO: 1454694 - RNA, 22 nt, Human
gcugcugugugcuuuuuuugug

SEQ ID NO: 1454695 - RNA, 21 nt, Human
gcugcugugugcuuuuuuugu

SEQ ID NO: 1454696 - RNA, 19 nt, Human
gcugcuagagugacucacu

SEQ ID NO: 1454697 - RNA, 20 nt, Human
gcugcuguggccaucaaccu

SEQ ID NO: 1454698 - RNA, 20 nt, Human
gcugcuagagugacucacua

SEQ ID NO: 1454699 - RNA, 13 nt, Human
gcugcuagaguga

SEQ ID NO: 1454700 - RNA, 14 nt, Human
gcugcgcacugugu

SEQ ID NO: 1454701 - RNA, 20 nt, Human
gcugccuuuggacuuguccc

SEQ ID NO: 1454702 - RNA, 15 nt, Human
gcugccuuuggacuu

SEQ ID NO: 1454703 - RNA, 18 nt, Human
gcugcccuguaccccagc

SEQ ID NO: 1454704 - RNA, 17 nt, Human
gcuagagcuccucccuc

SEQ ID NO: 1454705 - RNA, 18 nt, Human
gcuagaggaagcagccaa

SEQ ID NO: 1454706 - RNA, 18 nt, Human
gcuagauguauguacuuc

SEQ ID NO: 1454707 - RNA, 12 nt, Human
gcuagcaaauag

SEQ ID NO: 1454708 - RNA, 16 nt, Human
gcuagcaaauaguaau

SEQ ID NO: 1454709 - RNA, 22 nt, Human
gcuguguccaaaaccgccagcu

SEQ ID NO: 1454710 - RNA, 18 nt, Human
gcuguguaagauuuguuu

SEQ ID NO: 1454711 - RNA, 23 nt, Human
gcuguguaagauuuguuuuuaaa

SEQ ID NO: 1454712 - RNA, 16 nt, Human
gcuguguaagauuugu

SEQ ID NO: 1454713 - RNA, 22 nt, Human
gcugugguuuucuuuugccaug

SEQ ID NO: 1454714 - RNA, 23 nt, Human
gcugugguuuucuuuugccauga

SEQ ID NO: 1454715 - RNA, 15 nt, Human
gcugugguuuucuuu

SEQ ID NO: 1454716 - RNA, 14 nt, Human
gcugugguuuucuu

SEQ ID NO: 1454717 - RNA, 13 nt, Human
gcugugguuuucu

SEQ ID NO: 1454718 - RNA, 21 nt, Human
gcugucuuaaacuaaaugugc

SEQ ID NO: 1454719 - RNA, 23 nt, Human
gcugucuguuguauucauugugg

SEQ ID NO: 1454720 - RNA, 23 nt, Human
gcugucugggugcuacuggggaa

SEQ ID NO: 1454721 - RNA, 22 nt, Human
gcugucugggugcuacugggga

SEQ ID NO: 1454722 - RNA, 20 nt, Human
gcugucugggugcuacuggg

SEQ ID NO: 1454723 - RNA, 17 nt, Human
gcugucugggugcuacu

SEQ ID NO: 1454724 - RNA, 18 nt, Human
gcugucugaggcuaggug

SEQ ID NO: 1454725 - RNA, 16 nt, Human
gcugucccucccccuu

SEQ ID NO: 1454726 - RNA, 15 nt, Human
gcugucccucccccu

SEQ ID NO: 1454727 - RNA, 17 nt, Human
gcugucacaaccaagaa

SEQ ID NO: 1454728 - RNA, 13 nt, Human
gcugucacaggcg

SEQ ID NO: 1454729 - RNA, 22 nt, Human
gcugguguuaacagaagggagg

SEQ ID NO: 1454730 - RNA, 14 nt, Human
gcugucaaggcuca

SEQ ID NO: 1454731 - RNA, 14 nt, Human
gcugguuagaaaug

SEQ ID NO: 1454732 - RNA, 22 nt, Human
gcuguauuuuaaaagaaugauu

SEQ ID NO: 1454733 - RNA, 21 nt, Human
gcugguguuaacagaagggag

SEQ ID NO: 1454734 - RNA, 18 nt, Human
gcugguguuaacagaagg

SEQ ID NO: 1454735 - RNA, 17 nt, Human
gcugguguuaacagaag

SEQ ID NO: 1454736 - RNA, 16 nt, Human
gcugguguuaacagaa

SEQ ID NO: 1454737 - RNA, 14 nt, Human
gcugguguuaacag

SEQ ID NO: 1454738 - RNA, 13 nt, Human
gcugguguuaaca

SEQ ID NO: 1454739 - RNA, 23 nt, Human
gcuggugugguacagagaagcca

SEQ ID NO: 1454740 - RNA, 22 nt, Human
gcuggugugguacagagaagcc

SEQ ID NO: 1454741 - RNA, 21 nt, Human
gcuggugugguacagagaagc

SEQ ID NO: 1454742 - RNA, 20 nt, Human
gcuggugugguacagagaag

SEQ ID NO: 1454743 - RNA, 19 nt, Human
gcuggugugguacagagaa

SEQ ID NO: 1454744 - RNA, 18 nt, Human
gcuggugugguacagaga

SEQ ID NO: 1454745 - RNA, 17 nt, Human
gcuggugugguacagag

SEQ ID NO: 1454746 - RNA, 15 nt, Human
gcuggugugguacag

SEQ ID NO: 1454747 - RNA, 18 nt, Human
gcuggugggugccuaggc

SEQ ID NO: 1454748 - RNA, 20 nt, Human
gcuggugcggcuggccaugg

SEQ ID NO: 1454749 - RNA, 18 nt, Human
gcuggugcggcuggccau

SEQ ID NO: 1454750 - RNA, 15 nt, Human
gcuggugcggcuggc

SEQ ID NO: 1454751 - RNA, 23 nt, Human
gcugggagaggcagcccaggaag

SEQ ID NO: 1454752 - RNA, 22 nt, Human
gcugggagcuccacucugcuuc

SEQ ID NO: 1454753 - RNA, 21 nt, Human
gcugggagcuccacucugcuu

SEQ ID NO: 1454754 - RNA, 20 nt, Human
gcugggagcuccacucugcu

SEQ ID NO: 1454755 - RNA, 19 nt, Human
gcugggaggagggcaggca

SEQ ID NO: 1454756 - RNA, 15 nt, Human
gcugggaggaaggac

SEQ ID NO: 1454757 - RNA, 22 nt, Human
gcugggaggaaggacuucccug

SEQ ID NO: 1454758 - RNA, 17 nt, Human
gcugggaggagggcagg

SEQ ID NO: 1454759 - RNA, 18 nt, Human
gcugggagcuccacucug

SEQ ID NO: 1454760 - RNA, 16 nt, Human
gcugggagcuccacuc

SEQ ID NO: 1454761 - RNA, 14 nt, Human
gcugggagcuccac

SEQ ID NO: 1454762 - RNA, 13 nt, Human
gcugggagcucca

SEQ ID NO: 1454763 - RNA, 15 nt, Human
gcugggagaggcagc

SEQ ID NO: 1454764 - RNA, 14 nt, Human
gcugggagaggcag

SEQ ID NO: 1454765 - RNA, 20 nt, Human
gcuggggugcagggaugugg

SEQ ID NO: 1454766 - RNA, 15 nt, Human
gcuggggugcaggga

SEQ ID NO: 1454767 - RNA, 13 nt, Human
gcuggggugcagg

SEQ ID NO: 1454768 - RNA, 12 nt, Human
gcuggggugcag

SEQ ID NO: 1454769 - RNA, 19 nt, Human
gcuggggucccagcagcug

SEQ ID NO: 1454770 - RNA, 17 nt, Human
gcuggggucccagcagc

SEQ ID NO: 1454771 - RNA, 16 nt, Human
gcuggggucccagcag

SEQ ID NO: 1454772 - RNA, 14 nt, Human
gcuggggucccagc

SEQ ID NO: 1454773 - RNA, 16 nt, Human
gcuggggccugggaca

SEQ ID NO: 1454774 - RNA, 15 nt, Human
gcuggggccugggac

SEQ ID NO: 1454775 - RNA, 13 nt, Human
gcuggggccuggg

SEQ ID NO: 1454776 - RNA, 12 nt, Human
gcuggggccugg

SEQ ID NO: 1454777 - RNA, 16 nt, Human
gcuggggccaggcugg

SEQ ID NO: 1454778 - RNA, 19 nt, Human
gcuggggccaggcuggguc

SEQ ID NO: 1454779 - RNA, 17 nt, Human
gcuucuggccaggaagc

SEQ ID NO: 1454780 - RNA, 16 nt, Human
gcuucuggccaggaag

SEQ ID NO: 1454781 - RNA, 18 nt, Human
gcuucuggccaggaagcu

SEQ ID NO: 1454782 - RNA, 15 nt, Human
gcuucuggccaggaa

SEQ ID NO: 1454783 - RNA, 22 nt, Human
gcuucucugacuucugccugga

SEQ ID NO: 1454784 - RNA, 21 nt, Human
gcuucucugacuucugccugg

SEQ ID NO: 1454785 - RNA, 20 nt, Human
gcuucucugacuucugccug

SEQ ID NO: 1454786 - RNA, 18 nt, Human
gcuucucugacuucugcc

SEQ ID NO: 1454787 - RNA, 17 nt, Human
gcuucucugacuucugc

SEQ ID NO: 1454788 - RNA, 14 nt, Human
gcuucucugacuuc

SEQ ID NO: 1454789 - RNA, 13 nt, Human
gcuucucugacuu

SEQ ID NO: 1454790 - RNA, 16 nt, Human
gcuucucucuguggga

SEQ ID NO: 1454791 - RNA, 14 nt, Human
gcuucucucugugg

SEQ ID NO: 1454792 - RNA, 20 nt, Human
gcuucuaguucugccaggag

SEQ ID NO: 1454793 - RNA, 19 nt, Human
gcuucuaguucugccagga

SEQ ID NO: 1454794 - RNA, 21 nt, Human
gcuucuaguucugccaggaga

SEQ ID NO: 1454795 - RNA, 13 nt, Human
gcuucuccucucc

SEQ ID NO: 1454796 - RNA, 18 nt, Human
gcuucuaguucugccagg

SEQ ID NO: 1454797 - RNA, 20 nt, Human
gcuugccaaggcagaggccu

SEQ ID NO: 1454798 - RNA, 15 nt, Human
gcuugccaaggcaga

SEQ ID NO: 1454799 - RNA, 14 nt, Human
gcuugauucugcag

SEQ ID NO: 1454800 - RNA, 22 nt, Human
gcuugaugggauucuggacagg

SEQ ID NO: 1454801 - RNA, 20 nt, Human
gcuugaugggauucuggaca

SEQ ID NO: 1454802 - RNA, 19 nt, Human
gcuugaugggauucuggac

SEQ ID NO: 1454803 - RNA, 14 nt, Human
gcuugauuuuugcc

SEQ ID NO: 1454804 - RNA, 20 nt, Human
gcuugauagaaaugccaagc

SEQ ID NO: 1454805 - RNA, 18 nt, Human
gcuugccaaggcagaggc

SEQ ID NO: 1454806 - RNA, 21 nt, Human
gcuugcccuaagcagaaagug

SEQ ID NO: 1454807 - RNA, 20 nt, Human
gcuugcccuaagcagaaagu

SEQ ID NO: 1454808 - RNA, 19 nt, Human
gcuugcccuaagcagaaag

SEQ ID NO: 1454809 - RNA, 16 nt, Human
gcuugcccuaagcaga

SEQ ID NO: 1454810 - RNA, 19 nt, Human
gcuuuaauauaaaugcaaa

SEQ ID NO: 1454811 - RNA, 17 nt, Human
gcuuuaauauaaaugca

SEQ ID NO: 1454812 - RNA, 21 nt, Human
gcuuuaauauaaaugcaaaua

SEQ ID NO: 1454813 - RNA, 16 nt, Human
gcuuuaauauaaaugc

SEQ ID NO: 1454814 - RNA, 15 nt, Human
gcuuuaauauaaaug

SEQ ID NO: 1454815 - RNA, 14 nt, Human
gcuuuaauauaaau

SEQ ID NO: 1454816 - RNA, 13 nt, Human
gcuuuaauauaaa

SEQ ID NO: 1454817 - RNA, 12 nt, Human
gcuuuaauauaa

SEQ ID NO: 1454818 - RNA, 17 nt, Human
gcuuggccacagccagg

SEQ ID NO: 1454819 - RNA, 18 nt, Human
gcuuggccacagccaggg

SEQ ID NO: 1454820 - RNA, 15 nt, Human
gcuuggagcugagca

SEQ ID NO: 1454821 - RNA, 14 nt, Human
gcuuggagcugagc

SEQ ID NO: 1454822 - RNA, 18 nt, Human
gcuuggagcagaggggcu

SEQ ID NO: 1454823 - RNA, 23 nt, Human
gcuugcccuaagcagaaagugcc

SEQ ID NO: 1454824 - RNA, 21 nt, Human
gcuuuaugauaauagauucuc

SEQ ID NO: 1454825 - RNA, 20 nt, Human
gcuuuaugauaauagauucu

SEQ ID NO: 1454826 - RNA, 20 nt, Human
gcuuuauccucuuuagaguu

SEQ ID NO: 1454827 - RNA, 15 nt, Human
gcuuuauccucuuua

SEQ ID NO: 1454828 - RNA, 16 nt, Human
gcuuuauccucuuuag

SEQ ID NO: 1454829 - RNA, 17 nt, Human
gcuuuauccucuuuaga

SEQ ID NO: 1454830 - RNA, 19 nt, Human
gcuuuauccucuuuagagu

SEQ ID NO: 1454831 - RNA, 19 nt, Human
gcuuuacuccguaacagau

SEQ ID NO: 1454832 - RNA, 17 nt, Human
gcuuuauuccagaaugc

SEQ ID NO: 1454833 - RNA, 17 nt, Human
gcuuuggauuugacauu

SEQ ID NO: 1454834 - RNA, 17 nt, Human
gcuuuggaccuaaucca

SEQ ID NO: 1454835 - RNA, 22 nt, Human
gcuuuggaccuaaauggccuca

SEQ ID NO: 1454836 - RNA, 19 nt, Human
ggaaaaaguggguuuuuua

SEQ ID NO: 1454837 - RNA, 17 nt, Human
ggaaaaacuuuggaacc

SEQ ID NO: 1454838 - RNA, 23 nt, Human
ggaaaaagcaaguucgucuguug

SEQ ID NO: 1454839 - RNA, 19 nt, Human
ggaaaaacuuuggaaccag

SEQ ID NO: 1454840 - RNA, 20 nt, Human
ggaaaacuccaccuucccac

SEQ ID NO: 1454841 - RNA, 22 nt, Human
ggaaaaccagacuacuugggag

SEQ ID NO: 1454842 - RNA, 12 nt, Human
ggaaaaccagac

SEQ ID NO: 1454843 - RNA, 19 nt, Human
gcuuuuaacagagucugaa

SEQ ID NO: 1454844 - RNA, 14 nt, Human
gcuuuuaaaagauu

SEQ ID NO: 1454845 - RNA, 20 nt, Human
ggaaaaaauaacaaugaaag

SEQ ID NO: 1454846 - RNA, 19 nt, Human
ggaaaguacacucugcugu

SEQ ID NO: 1454847 - RNA, 20 nt, Human
ggaaaggugugagacuggga

SEQ ID NO: 1454848 - RNA, 16 nt, Human
ggaaagucauuggcuu

SEQ ID NO: 1454849 - RNA, 21 nt, Human
ggaaagucauuggcuuuaucc

SEQ ID NO: 1454850 - RNA, 16 nt, Human
ggaaaggugguguuuc

SEQ ID NO: 1454851 - RNA, 20 nt, Human
ggaaaggggucggcugacca

SEQ ID NO: 1454852 - RNA, 19 nt, Human
ggaaaauaggcaggaagcc

SEQ ID NO: 1454853 - RNA, 16 nt, Human
ggaaaauaauacugcu

SEQ ID NO: 1454854 - RNA, 13 nt, Human
ggaaaagacacau

SEQ ID NO: 1454855 - RNA, 17 nt, Human
ggaaaagacacauuuuu

SEQ ID NO: 1454856 - RNA, 22 nt, Human
ggaaaucaaaagggccaaagaa

SEQ ID NO: 1454857 - RNA, 18 nt, Human
ggaaauauuuauuuuaau

SEQ ID NO: 1454858 - RNA, 17 nt, Human
ggaaauauuuauuuuaa

SEQ ID NO: 1454859 - RNA, 15 nt, Human
ggaaauauuuauuuu

SEQ ID NO: 1454860 - RNA, 13 nt, Human
ggaaauauuuauu

SEQ ID NO: 1454861 - RNA, 23 nt, Human
ggaaaguggccaagaagcagugg

SEQ ID NO: 1454862 - RNA, 19 nt, Human
ggaaagugcugucuuaaac

SEQ ID NO: 1454863 - RNA, 12 nt, Human
ggaaauauuuau

SEQ ID NO: 1454864 - RNA, 13 nt, Human
ggaaccucagccu

SEQ ID NO: 1454865 - RNA, 12 nt, Human
ggaaccucagcc

SEQ ID NO: 1454866 - RNA, 24 nt, Human
ggaacccuuacaguaggagcccag

SEQ ID NO: 1454867 - RNA, 20 nt, Human
ggaaccgaggcagggaagga

SEQ ID NO: 1454868 - RNA, 16 nt, Human
ggaaccgaggcaggga

SEQ ID NO: 1454869 - RNA, 15 nt, Human
ggaaccgaggcaggg

SEQ ID NO: 1454870 - RNA, 23 nt, Human
ggaacccugcccacucccaggac

SEQ ID NO: 1454871 - RNA, 19 nt, Human
ggaaccccuuucccacccc

SEQ ID NO: 1454872 - RNA, 17 nt, Human
ggaaccccuuucccacc

SEQ ID NO: 1454873 - RNA, 16 nt, Human
ggaaccccuuucccac

SEQ ID NO: 1454874 - RNA, 14 nt, Human
ggaaccccuuuccc

SEQ ID NO: 1454875 - RNA, 13 nt, Human
ggaaccccuuucc

SEQ ID NO: 1454876 - RNA, 17 nt, Human
ggaacucaucugguuga

SEQ ID NO: 1454877 - RNA, 20 nt, Human
ggaacucagauccagggaca

SEQ ID NO: 1454878 - RNA, 19 nt, Human
ggaacucagauccagggac

SEQ ID NO: 1454879 - RNA, 17 nt, Human
ggaacucagauccaggg

SEQ ID NO: 1454880 - RNA, 16 nt, Human
ggaacucagauccagg

SEQ ID NO: 1454881 - RNA, 15 nt, Human
ggaacucagauccag

SEQ ID NO: 1454882 - RNA, 13 nt, Human
ggaacucagaucc

SEQ ID NO: 1454883 - RNA, 23 nt, Human
ggaaccucagccuggccagacac

SEQ ID NO: 1454884 - RNA, 21 nt, Human
ggaaccucagccuggccagac

SEQ ID NO: 1454885 - RNA, 20 nt, Human
ggaaccucagccuggccaga

SEQ ID NO: 1454886 - RNA, 19 nt, Human
ggaaccucagccuggccag

SEQ ID NO: 1454887 - RNA, 16 nt, Human
ggaaccucagccuggc

SEQ ID NO: 1454888 - RNA, 15 nt, Human
ggaaccucagccugg

SEQ ID NO: 1454889 - RNA, 14 nt, Human
ggaaccucagccug

SEQ ID NO: 1454890 - RNA, 22 nt, Human
ggaaccucagccuggccagaca

SEQ ID NO: 1454891 - RNA, 19 nt, Human
ggaagcauuuguuucuacu

SEQ ID NO: 1454892 - RNA, 14 nt, Human
ggaagccaaagagu

SEQ ID NO: 1454893 - RNA, 22 nt, Human
ggaagccaaaauguaggcuuag

SEQ ID NO: 1454894 - RNA, 22 nt, Human
ggaagcauuguaaaauaauucu

SEQ ID NO: 1454895 - RNA, 14 nt, Human
ggaagcagcagccu

SEQ ID NO: 1454896 - RNA, 13 nt, Human
ggaagcagcagcc

SEQ ID NO: 1454897 - RNA, 12 nt, Human
ggaagcagcagc

SEQ ID NO: 1454898 - RNA, 18 nt, Human
ggaagcagcagccucgcc

SEQ ID NO: 1454899 - RNA, 15 nt, Human
ggaagcagcagccuc

SEQ ID NO: 1454900 - RNA, 18 nt, Human
ggaagcagaaauccaagc

SEQ ID NO: 1454901 - RNA, 22 nt, Human
ggaagauggggaccagcagccc

SEQ ID NO: 1454902 - RNA, 18 nt, Human
ggaagauggggaccagca

SEQ ID NO: 1454903 - RNA, 22 nt, Human
ggaagauccugcggguggggcu

SEQ ID NO: 1454904 - RNA, 12 nt, Human
ggaagauccugc

SEQ ID NO: 1454905 - RNA, 18 nt, Human
ggaagaucccccagaaaa

SEQ ID NO: 1454906 - RNA, 22 nt, Human
ggaagaucccccagaaaagaaa

SEQ ID NO: 1454907 - RNA, 16 nt, Human
ggaagagcaggacucc

SEQ ID NO: 1454908 - RNA, 23 nt, Human
ggaagagcaggacuccaggccca

SEQ ID NO: 1454909 - RNA, 13 nt, Human
ggaagagcaggac

SEQ ID NO: 1454910 - RNA, 22 nt, Human
ggaagagcagcaccuccucagc

SEQ ID NO: 1454911 - RNA, 17 nt, Human
ggaagagcagcaccucc

SEQ ID NO: 1454912 - RNA, 17 nt, Human
ggaacucgugucuggca

SEQ ID NO: 1454913 - RNA, 15 nt, Human
ggaagagggacagau

SEQ ID NO: 1454914 - RNA, 13 nt, Human
ggaagaggccugu

SEQ ID NO: 1454915 - RNA, 20 nt, Human
ggaagagccuuccacccagg

SEQ ID NO: 1454916 - RNA, 19 nt, Human
ggaagagccuuccacccag

SEQ ID NO: 1454917 - RNA, 17 nt, Human
ggaagagccuuccaccc

SEQ ID NO: 1454918 - RNA, 23 nt, Human
ggaagaggccuguuuggccucuc

SEQ ID NO: 1454919 - RNA, 14 nt, Human
ggaagauagcugug

SEQ ID NO: 1454920 - RNA, 14 nt, Human
ggaagaucccccag

SEQ ID NO: 1454921 - RNA, 14 nt, Human
ggagagggaaugug

SEQ ID NO: 1454922 - RNA, 19 nt, Human
ggagagggaaugugaaauu

SEQ ID NO: 1454923 - RNA, 22 nt, Human
ggagagcuaggagcaaagccug

SEQ ID NO: 1454924 - RNA, 21 nt, Human
ggagagcuaggagcaaagccu

SEQ ID NO: 1454925 - RNA, 15 nt, Human
ggagagcuaggagca

SEQ ID NO: 1454926 - RNA, 14 nt, Human
ggagagcuaggagc

SEQ ID NO: 1454927 - RNA, 13 nt, Human
ggagagcuaggag

SEQ ID NO: 1454928 - RNA, 12 nt, Human
ggagagcuagga

SEQ ID NO: 1454929 - RNA, 17 nt, Human
ggagaccucagaaguaa

SEQ ID NO: 1454930 - RNA, 21 nt, Human
ggagaccggccugccaggagg

SEQ ID NO: 1454931 - RNA, 20 nt, Human
ggagaccggccugccaggag

SEQ ID NO: 1454932 - RNA, 19 nt, Human
ggagaccggccugccagga

SEQ ID NO: 1454933 - RNA, 22 nt, Human
ggagaccggccugccaggagga

SEQ ID NO: 1454934 - RNA, 17 nt, Human
ggagaccggccugccag

SEQ ID NO: 1454935 - RNA, 14 nt, Human
ggacugucgcugcu

SEQ ID NO: 1454936 - RNA, 20 nt, Human
ggacugucgcugcuucgugg

SEQ ID NO: 1454937 - RNA, 15 nt, Human
ggacugucauagaaa

SEQ ID NO: 1454938 - RNA, 18 nt, Human
ggacuguaaguugggcuu

SEQ ID NO: 1454939 - RNA, 20 nt, Human
ggacuguagggagggcggca

SEQ ID NO: 1454940 - RNA, 18 nt, Human
ggacuguagggagggcgg

SEQ ID NO: 1454941 - RNA, 21 nt, Human
ggacuguaaguugggcuugcu

SEQ ID NO: 1454942 - RNA, 22 nt, Human
ggacugggagcccccagccugu

SEQ ID NO: 1454943 - RNA, 23 nt, Human
ggacugggagcccccagccuguc

SEQ ID NO: 1454944 - RNA, 19 nt, Human
ggacugcuaaauaaaauuu

SEQ ID NO: 1454945 - RNA, 18 nt, Human
ggacugcuaaauaaaauu

SEQ ID NO: 1454946 - RNA, 15 nt, Human
ggacugcggaggaag

SEQ ID NO: 1454947 - RNA, 16 nt, Human
ggacugcggaggaagg

SEQ ID NO: 1454948 - RNA, 13 nt, Human
ggagauucugccu

SEQ ID NO: 1454949 - RNA, 23 nt, Human
ggagauucucauaacuugagacc

SEQ ID NO: 1454950 - RNA, 22 nt, Human
ggagauucucauaacuugagac

SEQ ID NO: 1454951 - RNA, 14 nt, Human
ggagauucagacug

SEQ ID NO: 1454952 - RNA, 19 nt, Human
ggagauggaggaaagugau

SEQ ID NO: 1454953 - RNA, 15 nt, Human
ggagauugaccugga

SEQ ID NO: 1454954 - RNA, 20 nt, Human
ggagauuuacaacuggggga

SEQ ID NO: 1454955 - RNA, 21 nt, Human
ggagagggggcuggugggugc

SEQ ID NO: 1454956 - RNA, 15 nt, Human
ggagaugcuccuugg

SEQ ID NO: 1454957 - RNA, 18 nt, Human
ggagagggggcugguggg

SEQ ID NO: 1454958 - RNA, 14 nt, Human
ggagagggggcugg

SEQ ID NO: 1454959 - RNA, 13 nt, Human
ggagagggcgcag

SEQ ID NO: 1454960 - RNA, 21 nt, Human
ggagccccuucugcucagcuc

SEQ ID NO: 1454961 - RNA, 19 nt, Human
ggagccccuucugcucagc

SEQ ID NO: 1454962 - RNA, 18 nt, Human
ggagccccuucugcucag

SEQ ID NO: 1454963 - RNA, 24 nt, Human
ggagcaaagccuguucauggcaga

SEQ ID NO: 1454964 - RNA, 23 nt, Human
ggagcaaagccuguucauggcag

SEQ ID NO: 1454965 - RNA, 22 nt, Human
ggagcaaagccuguucauggca

SEQ ID NO: 1454966 - RNA, 15 nt, Human
ggagcaaagccuguu

SEQ ID NO: 1454967 - RNA, 14 nt, Human
ggagcaaagccugu

SEQ ID NO: 1454968 - RNA, 13 nt, Human
ggagcaaagccug

SEQ ID NO: 1454969 - RNA, 23 nt, Human
ggagcaaacugcaugcccagaga

SEQ ID NO: 1454970 - RNA, 22 nt, Human
ggagcaaacugcaugcccagag

SEQ ID NO: 1454971 - RNA, 21 nt, Human
ggagcaaacugcaugcccaga

SEQ ID NO: 1454972 - RNA, 20 nt, Human
ggagcaaacugcaugcccag

SEQ ID NO: 1454973 - RNA, 19 nt, Human
ggagcaaacugcaugccca

SEQ ID NO: 1454974 - RNA, 16 nt, Human
ggagcccgucucagug

SEQ ID NO: 1454975 - RNA, 12 nt, Human
ggagcccuggga

SEQ ID NO: 1454976 - RNA, 13 nt, Human
ggagcccugggag

SEQ ID NO: 1454977 - RNA, 13 nt, Human
ggacucugcagcc

SEQ ID NO: 1454978 - RNA, 21 nt, Human
ggacucucagucucugagcag

SEQ ID NO: 1454979 - RNA, 20 nt, Human
ggacucucagucucugagca

SEQ ID NO: 1454980 - RNA, 18 nt, Human
ggacucucagucucugag

SEQ ID NO: 1454981 - RNA, 17 nt, Human
ggacucucagucucuga

SEQ ID NO: 1454982 - RNA, 13 nt, Human
ggacucuaaaguc

SEQ ID NO: 1454983 - RNA, 16 nt, Human
ggacuccugaaaaaaa

SEQ ID NO: 1454984 - RNA, 16 nt, Human
ggacugaugucuccua

SEQ ID NO: 1454985 - RNA, 15 nt, Human
ggacugaugucuccu

SEQ ID NO: 1454986 - RNA, 18 nt, Human
ggacugagugggaagccc

SEQ ID NO: 1454987 - RNA, 17 nt, Human
ggacugagugggaagcc

SEQ ID NO: 1454988 - RNA, 22 nt, Human
ggacucuguccugaaggccuga

SEQ ID NO: 1454989 - RNA, 23 nt, Human
ggacucuguccugaaggccugag

SEQ ID NO: 1454990 - RNA, 21 nt, Human
ggacucuguccugaaggccug

SEQ ID NO: 1454991 - RNA, 16 nt, Human
ggacucuguccugaag

SEQ ID NO: 1454992 - RNA, 14 nt, Human
ggacucuguccuga

SEQ ID NO: 1454993 - RNA, 12 nt, Human
ggacucuguccu

SEQ ID NO: 1454994 - RNA, 18 nt, Human
ggacucuggugccuccag

SEQ ID NO: 1454995 - RNA, 17 nt, Human
ggacucuggugccucca

SEQ ID NO: 1454996 - RNA, 17 nt, Human
ggacucugcagccucag

SEQ ID NO: 1454997 - RNA, 15 nt, Human
ggacucugcagccuc

SEQ ID NO: 1454998 - RNA, 14 nt, Human
ggacucugcagccu

SEQ ID NO: 1454999 - RNA, 14 nt, Human
ggaccuggcugcca

SEQ ID NO: 1455000 - RNA, 14 nt, Human
ggaccuggaaggga

SEQ ID NO: 1455001 - RNA, 13 nt, Human
ggaccugccugca

SEQ ID NO: 1455002 - RNA, 20 nt, Human
ggaccugagccugccgagca

SEQ ID NO: 1455003 - RNA, 23 nt, Human
ggaccugagccugccgagcaacc

SEQ ID NO: 1455004 - RNA, 19 nt, Human
ggaccugagccugccgagc

SEQ ID NO: 1455005 - RNA, 17 nt, Human
ggaccugagccugccga

SEQ ID NO: 1455006 - RNA, 16 nt, Human
ggaccugagccugccg

SEQ ID NO: 1455007 - RNA, 15 nt, Human
ggaccugagccugcc

SEQ ID NO: 1455008 - RNA, 14 nt, Human
ggaccugagccugc

SEQ ID NO: 1455009 - RNA, 13 nt, Human
ggaccugagccug

SEQ ID NO: 1455010 - RNA, 12 nt, Human
ggaccugagccu

SEQ ID NO: 1455011 - RNA, 19 nt, Human
ggaccugaaauuccaaagu

SEQ ID NO: 1455012 - RNA, 17 nt, Human
ggaccugguacccuccu

SEQ ID NO: 1455013 - RNA, 17 nt, Human
ggaccuggugcugccuc

SEQ ID NO: 1455014 - RNA, 11 nt, Human
ggacuccugaa

SEQ ID NO: 1455015 - RNA, 17 nt, Human
ggaccuucgggcugugc

SEQ ID NO: 1455016 - RNA, 18 nt, Human
ggaaggagcugccuggac

SEQ ID NO: 1455017 - RNA, 17 nt, Human
ggaaggagcugccugga

SEQ ID NO: 1455018 - RNA, 15 nt, Human
ggaaggagcugccug

SEQ ID NO: 1455019 - RNA, 14 nt, Human
ggaaggagcugccu

SEQ ID NO: 1455020 - RNA, 13 nt, Human
ggaaggagcugcc

SEQ ID NO: 1455021 - RNA, 12 nt, Human
ggaaggagcugc

SEQ ID NO: 1455022 - RNA, 20 nt, Human
ggaaggagcugccuggaccc

SEQ ID NO: 1455023 - RNA, 19 nt, Human
ggaaggagcugccuggacc

SEQ ID NO: 1455024 - RNA, 16 nt, Human
ggaaggaggacccagg

SEQ ID NO: 1455025 - RNA, 13 nt, Human
ggaaggaggagcc

SEQ ID NO: 1455026 - RNA, 22 nt, Human
ggaaggagcugccuggacccgu

SEQ ID NO: 1455027 - RNA, 19 nt, Human
ggaaggaggacccaggaca

SEQ ID NO: 1455028 - RNA, 16 nt, Human
ggaaggaggagccugu

SEQ ID NO: 1455029 - RNA, 17 nt, Human
ggaaggaggagccuguc

SEQ ID NO: 1455030 - RNA, 18 nt, Human
ggaccagcucaggacaga

SEQ ID NO: 1455031 - RNA, 16 nt, Human
ggaccagcucaggaca

SEQ ID NO: 1455032 - RNA, 17 nt, Human
ggaaggaucccaugagc

SEQ ID NO: 1455033 - RNA, 22 nt, Human
ggaccagcucaggacagaugcc

SEQ ID NO: 1455034 - RNA, 19 nt, Human
ggaccagcucaggacagau

SEQ ID NO: 1455035 - RNA, 15 nt, Human
ggaccagcuuuuccc

SEQ ID NO: 1455036 - RNA, 17 nt, Human
ggaccagcuuuucccaa

SEQ ID NO: 1455037 - RNA, 22 nt, Human
ggaccagcuuuucccaaaagcc

SEQ ID NO: 1455038 - RNA, 16 nt, Human
ggaccucugacagcag

SEQ ID NO: 1455039 - RNA, 17 nt, Human
ggaccucugacagcagc

SEQ ID NO: 1455040 - RNA, 13 nt, Human
ggaccucugacag

SEQ ID NO: 1455041 - RNA, 12 nt, Human
ggaccucugaca

SEQ ID NO: 1455042 - RNA, 22 nt, Human
ggacccaugaguuggggucugg

SEQ ID NO: 1455043 - RNA, 13 nt, Human
ggacccagggcuc

SEQ ID NO: 1455044 - RNA, 21 nt, Human
ggacccagaggaaggggccag

SEQ ID NO: 1455045 - RNA, 21 nt, Human
ggaccaggaguggguggggag

SEQ ID NO: 1455046 - RNA, 20 nt, Human
ggaccaggagugggugggga

SEQ ID NO: 1455047 - RNA, 11 nt, Human
ggaccaggagu

SEQ ID NO: 1455048 - RNA, 20 nt, Human
ggacccagccaggcccagcc

SEQ ID NO: 1455049 - RNA, 15 nt, Human
ggacccagccaggcc

SEQ ID NO: 1455050 - RNA, 12 nt, Human
ggacccagccag

SEQ ID NO: 1455051 - RNA, 13 nt, Human
ggacccagcuaau

SEQ ID NO: 1455052 - RNA, 16 nt, Human
ggacccagccaggccc

SEQ ID NO: 1455053 - RNA, 10 nt, Human
ggacccagga

SEQ ID NO: 1455054 - RNA, 13 nt, Human
ggacccaggacag

SEQ ID NO: 1455055 - RNA, 21 nt, Human
ggauagaugcuggcccagggc

SEQ ID NO: 1455056 - RNA, 20 nt, Human
ggauagaugcuggcccaggg

SEQ ID NO: 1455057 - RNA, 19 nt, Human
ggauagaugcuggcccagg

SEQ ID NO: 1455058 - RNA, 15 nt, Human
ggagugaguggcccu

SEQ ID NO: 1455059 - RNA, 16 nt, Human
ggaucagaacaggagc

SEQ ID NO: 1455060 - RNA, 14 nt, Human
ggaucagaaauaca

SEQ ID NO: 1455061 - RNA, 16 nt, Human
ggaucagaaauacaga

SEQ ID NO: 1455062 - RNA, 20 nt, Human
ggagucugccagggccccuc

SEQ ID NO: 1455063 - RNA, 12 nt, Human
ggagucuugcuc

SEQ ID NO: 1455064 - RNA, 22 nt, Human
ggagucugccagggccccucuc

SEQ ID NO: 1455065 - RNA, 16 nt, Human
ggagucugccagggcc

SEQ ID NO: 1455066 - RNA, 15 nt, Human
ggagucugccagggc

SEQ ID NO: 1455067 - RNA, 14 nt, Human
ggagucugccaggg

SEQ ID NO: 1455068 - RNA, 13 nt, Human
ggagucugccagg

SEQ ID NO: 1455069 - RNA, 21 nt, Human
ggagucugccacccaggaucc

SEQ ID NO: 1455070 - RNA, 20 nt, Human
ggagucugccacccaggauc

SEQ ID NO: 1455071 - RNA, 17 nt, Human
ggagucugccacccagg

SEQ ID NO: 1455072 - RNA, 23 nt, Human
ggagucugagguccugagcacug

SEQ ID NO: 1455073 - RNA, 21 nt, Human
ggagucugagguccugagcac

SEQ ID NO: 1455074 - RNA, 20 nt, Human
ggagucugagguccugagca

SEQ ID NO: 1455075 - RNA, 19 nt, Human
ggagucugagguccugagc

SEQ ID NO: 1455076 - RNA, 18 nt, Human
ggagucugagguccugag

SEQ ID NO: 1455077 - RNA, 16 nt, Human
ggagucugagguccug

SEQ ID NO: 1455078 - RNA, 13 nt, Human
ggagucugagguc

SEQ ID NO: 1455079 - RNA, 24 nt, Human
ggagucguggggugugcugggagc

SEQ ID NO: 1455080 - RNA, 22 nt, Human
ggagucguggggugugcuggga

SEQ ID NO: 1455081 - RNA, 16 nt, Human
ggaguccacuuuguuu

SEQ ID NO: 1455082 - RNA, 16 nt, Human
ggaggggaagaggccu

SEQ ID NO: 1455083 - RNA, 22 nt, Human
ggagggcugucaucugugcacu

SEQ ID NO: 1455084 - RNA, 18 nt, Human
ggagggcucugaggcgcc

SEQ ID NO: 1455085 - RNA, 21 nt, Human
ggagggcucugaggcgcccca

SEQ ID NO: 1455086 - RNA, 16 nt, Human
ggagggcucugaggcg

SEQ ID NO: 1455087 - RNA, 15 nt, Human
ggagggcucugaggc

SEQ ID NO: 1455088 - RNA, 14 nt, Human
ggagggcucugagg

SEQ ID NO: 1455089 - RNA, 13 nt, Human
ggagggcucugag

SEQ ID NO: 1455090 - RNA, 12 nt, Human
ggagggcucuga

SEQ ID NO: 1455091 - RNA, 19 nt, Human
ggagggcagagcuggugcg

SEQ ID NO: 1455092 - RNA, 17 nt, Human
ggagggcagagcuggug

SEQ ID NO: 1455093 - RNA, 16 nt, Human
ggagggcagagcuggu

SEQ ID NO: 1455094 - RNA, 14 nt, Human
ggagggcagagcug

SEQ ID NO: 1455095 - RNA, 10 nt, Human
ggagggcaga

SEQ ID NO: 1455096 - RNA, 16 nt, Human
ggagggaggcucaggu

SEQ ID NO: 1455097 - RNA, 15 nt, Human
ggagggaggcucagg

SEQ ID NO: 1455098 - RNA, 22 nt, Human
ggagggagagucucccagggag

SEQ ID NO: 1455099 - RNA, 17 nt, Human
ggagggcagcagggcua

SEQ ID NO: 1455100 - RNA, 16 nt, Human
ggagggcagcagggcu

SEQ ID NO: 1455101 - RNA, 15 nt, Human
ggagggcagcagggc

SEQ ID NO: 1455102 - RNA, 13 nt, Human
ggagggcagcagg

SEQ ID NO: 1455103 - RNA, 14 nt, Human
ggagggcaggcauc

SEQ ID NO: 1455104 - RNA, 13 nt, Human
ggagggcaggcau

SEQ ID NO: 1455105 - RNA, 22 nt, Human
ggagggacaaguggacucaggg

SEQ ID NO: 1455106 - RNA, 22 nt, Human
ggagggacaaaggagccuguga

SEQ ID NO: 1455107 - RNA, 21 nt, Human
ggagggacaaaggagccugug

SEQ ID NO: 1455108 - RNA, 20 nt, Human
ggagggacaaaggagccugu

SEQ ID NO: 1455109 - RNA, 19 nt, Human
ggagggacaaaggagccug

SEQ ID NO: 1455110 - RNA, 18 nt, Human
ggagggacaaaggagccu

SEQ ID NO: 1455111 - RNA, 17 nt, Human
ggagggacaaaggagcc

SEQ ID NO: 1455112 - RNA, 21 nt, Human
ggagggaagggagccaaggga

SEQ ID NO: 1455113 - RNA, 23 nt, Human
ggagggaagggagccaagggaug

SEQ ID NO: 1455114 - RNA, 18 nt, Human
ggagggaagggagccaag

SEQ ID NO: 1455115 - RNA, 17 nt, Human
ggagggaagggagccaa

SEQ ID NO: 1455116 - RNA, 13 nt, Human
ggaggagaaugag

SEQ ID NO: 1455117 - RNA, 22 nt, Human
ggaggagagacacuggugggga

SEQ ID NO: 1455118 - RNA, 17 nt, Human
ggagcccuggagacccc

SEQ ID NO: 1455119 - RNA, 21 nt, Human
ggagccgaggccuaccccgca

SEQ ID NO: 1455120 - RNA, 16 nt, Human
ggagccgggagccuga

SEQ ID NO: 1455121 - RNA, 19 nt, Human
ggaggagggucggugccuu

SEQ ID NO: 1455122 - RNA, 20 nt, Human
ggaggagggcaggcaucggg

SEQ ID NO: 1455123 - RNA, 15 nt, Human
ggaggagggcaggca

SEQ ID NO: 1455124 - RNA, 14 nt, Human
ggaggagggcaggc

SEQ ID NO: 1455125 - RNA, 15 nt, Human
ggaggaggaaauccc

SEQ ID NO: 1455126 - RNA, 16 nt, Human
ggaggagccuguccug

SEQ ID NO: 1455127 - RNA, 15 nt, Human
ggaggagccuguccu

SEQ ID NO: 1455128 - RNA, 13 nt, Human
ggaggagccuguc

SEQ ID NO: 1455129 - RNA, 12 nt, Human
ggaggagccugu

SEQ ID NO: 1455130 - RNA, 20 nt, Human
ggaggagcccaggccaggac

SEQ ID NO: 1455131 - RNA, 13 nt, Human
ggaggagcccagg

SEQ ID NO: 1455132 - RNA, 12 nt, Human
ggaggagcccag

SEQ ID NO: 1455133 - RNA, 13 nt, Human
ggaggaggagggu

SEQ ID NO: 1455134 - RNA, 21 nt, Human
ggaggagccuguccugccugu

SEQ ID NO: 1455135 - RNA, 17 nt, Human
ggaggaggcagagaaga

SEQ ID NO: 1455136 - RNA, 18 nt, Human
ggaggaggcagagaagaa

SEQ ID NO: 1455137 - RNA, 23 nt, Human
ggcagguaugaucggcaggacac

SEQ ID NO: 1455138 - RNA, 23 nt, Human
ggcaggaagcccaauugcuggag

SEQ ID NO: 1455139 - RNA, 14 nt, Human
ggcagcuuuuaaaa

SEQ ID NO: 1455140 - RNA, 15 nt, Human
ggcagcuuuuaaaag

SEQ ID NO: 1455141 - RNA, 12 nt, Human
ggcagcagccag

SEQ ID NO: 1455142 - RNA, 13 nt, Human
ggcagcuuuuaaa

SEQ ID NO: 1455143 - RNA, 21 nt, Human
ggcagguaugaucggcaggac

SEQ ID NO: 1455144 - RNA, 11 nt, Human
ggcagcagcca

SEQ ID NO: 1455145 - RNA, 18 nt, Human
ggcagaggccugggcugg

SEQ ID NO: 1455146 - RNA, 22 nt, Human
ggcagaggccugggcugggaaa

SEQ ID NO: 1455147 - RNA, 17 nt, Human
ggcagaggccugggcug

SEQ ID NO: 1455148 - RNA, 14 nt, Human
ggcagaggccuggg

SEQ ID NO: 1455149 - RNA, 13 nt, Human
ggcagaggccugg

SEQ ID NO: 1455150 - RNA, 22 nt, Human
ggcagaggcccaggcugccguc

SEQ ID NO: 1455151 - RNA, 21 nt, Human
ggcagaggcccaggcugccgu

SEQ ID NO: 1455152 - RNA, 19 nt, Human
ggcagaggcccaggcugcc

SEQ ID NO: 1455153 - RNA, 17 nt, Human
ggcagaggcccaggcug

SEQ ID NO: 1455154 - RNA, 16 nt, Human
ggcagaggcccaggcu

SEQ ID NO: 1455155 - RNA, 14 nt, Human
ggcagaggcccagg

SEQ ID NO: 1455156 - RNA, 15 nt, Human
ggcagaggcaguacc

SEQ ID NO: 1455157 - RNA, 20 nt, Human
ggcagaggaccaggcuguag

SEQ ID NO: 1455158 - RNA, 18 nt, Human
ggcagagcuggugcggcu

SEQ ID NO: 1455159 - RNA, 23 nt, Human
ggcagcaaggcccgagcagcuga

SEQ ID NO: 1455160 - RNA, 16 nt, Human
ggcagcaauuuaaaug

SEQ ID NO: 1455161 - RNA, 16 nt, Human
ggcagcaaggcccgag

SEQ ID NO: 1455162 - RNA, 13 nt, Human
ggcagcaaggccc

SEQ ID NO: 1455163 - RNA, 12 nt, Human
ggcagcaaggcc

SEQ ID NO: 1455164 - RNA, 17 nt, Human
ggcagcaacaauaaaua

SEQ ID NO: 1455165 - RNA, 22 nt, Human
ggcagcaacaauaaauagacac

SEQ ID NO: 1455166 - RNA, 20 nt, Human
ggcagcaaggcccgagcagc

SEQ ID NO: 1455167 - RNA, 19 nt, Human
ggcagcaaggcccgagcag

SEQ ID NO: 1455168 - RNA, 18 nt, Human
ggcagcaaggcccgagca

SEQ ID NO: 1455169 - RNA, 17 nt, Human
ggcagcaaggcccgagc

SEQ ID NO: 1455170 - RNA, 22 nt, Human
ggcagcaaggcccgagcagcug

SEQ ID NO: 1455171 - RNA, 21 nt, Human
ggcagcaaggcccgagcagcu

SEQ ID NO: 1455172 - RNA, 15 nt, Human
ggcagcaauuuaaau

SEQ ID NO: 1455173 - RNA, 16 nt, Human
ggcagauccaggacua

SEQ ID NO: 1455174 - RNA, 14 nt, Human
ggcagauccaggac

SEQ ID NO: 1455175 - RNA, 14 nt, Human
ggcagauguaggag

SEQ ID NO: 1455176 - RNA, 15 nt, Human
ggcagauggggagac

SEQ ID NO: 1455177 - RNA, 20 nt, Human
ggcagauguaggagggacug

SEQ ID NO: 1455178 - RNA, 17 nt, Human
ggcagauguaggaggga

SEQ ID NO: 1455179 - RNA, 16 nt, Human
ggcagauguaggaggg

SEQ ID NO: 1455180 - RNA, 15 nt, Human
ggcagcaacaauaaa

SEQ ID NO: 1455181 - RNA, 22 nt, Human
ggcaccugggcccuggggccug

SEQ ID NO: 1455182 - RNA, 16 nt, Human
ggcaccugggcccugg

SEQ ID NO: 1455183 - RNA, 13 nt, Human
ggcaccugggccc

SEQ ID NO: 1455184 - RNA, 19 nt, Human
ggcaccucacaggccccag

SEQ ID NO: 1455185 - RNA, 16 nt, Human
ggcaccucacaggccc

SEQ ID NO: 1455186 - RNA, 21 nt, Human
ggcaccuacacucaccugcac

SEQ ID NO: 1455187 - RNA, 22 nt, Human
ggcaccuaauccaggcagaucc

SEQ ID NO: 1455188 - RNA, 15 nt, Human
ggcagagcuggugcg

SEQ ID NO: 1455189 - RNA, 14 nt, Human
ggcagagcuggugc

SEQ ID NO: 1455190 - RNA, 13 nt, Human
ggcagagcuggug

SEQ ID NO: 1455191 - RNA, 12 nt, Human
ggcagagcuggu

SEQ ID NO: 1455192 - RNA, 19 nt, Human
ggcaccugggcccuggggc

SEQ ID NO: 1455193 - RNA, 17 nt, Human
ggcaccugggcccuggg

SEQ ID NO: 1455194 - RNA, 19 nt, Human
ggcaccuaauccaggcaga

SEQ ID NO: 1455195 - RNA, 18 nt, Human
ggcaccuaauccaggcag

SEQ ID NO: 1455196 - RNA, 17 nt, Human
ggcaccuaauccaggca

SEQ ID NO: 1455197 - RNA, 19 nt, Human
ggcacccccugcagcuugu

SEQ ID NO: 1455198 - RNA, 18 nt, Human
ggcacccccugcagcuug

SEQ ID NO: 1455199 - RNA, 16 nt, Human
ggcacccccugcagcu

SEQ ID NO: 1455200 - RNA, 16 nt, Human
ggcaaggcuguggacc

SEQ ID NO: 1455201 - RNA, 16 nt, Human
ggcaacgcacaaaaca

SEQ ID NO: 1455202 - RNA, 20 nt, Human
ggaucccaugagcuccuuaa

SEQ ID NO: 1455203 - RNA, 17 nt, Human
ggauccaaacugaucca

SEQ ID NO: 1455204 - RNA, 18 nt, Human
ggaucagggguaggaaug

SEQ ID NO: 1455205 - RNA, 13 nt, Human
ggauccagggagg

SEQ ID NO: 1455206 - RNA, 17 nt, Human
ggaucccaugagcuccu

SEQ ID NO: 1455207 - RNA, 19 nt, Human
ggaucagcguggccuuguu

SEQ ID NO: 1455208 - RNA, 17 nt, Human
ggaucagcguggccuug

SEQ ID NO: 1455209 - RNA, 16 nt, Human
ggaucagcguggccuu

SEQ ID NO: 1455210 - RNA, 15 nt, Human
ggaucagcguggccu

SEQ ID NO: 1455211 - RNA, 13 nt, Human
ggaucagcguggc

SEQ ID NO: 1455212 - RNA, 12 nt, Human
ggaucagaauag

SEQ ID NO: 1455213 - RNA, 18 nt, Human
ggaucagcguggccuugu

SEQ ID NO: 1455214 - RNA, 21 nt, Human
ggaucaguuaacuauugcauu

SEQ ID NO: 1455215 - RNA, 14 nt, Human
ggccccucugaccu

SEQ ID NO: 1455216 - RNA, 23 nt, Human
ggccccucucccuugggcucuga

SEQ ID NO: 1455217 - RNA, 12 nt, Human
ggccccucuccc

SEQ ID NO: 1455218 - RNA, 20 nt, Human
ggccccucucagcccucaca

SEQ ID NO: 1455219 - RNA, 16 nt, Human
ggccccucucagcccu

SEQ ID NO: 1455220 - RNA, 15 nt, Human
ggccccucucagccc

SEQ ID NO: 1455221 - RNA, 14 nt, Human
ggccccucucagcc

SEQ ID NO: 1455222 - RNA, 13 nt, Human
ggccccucucagc

SEQ ID NO: 1455223 - RNA, 12 nt, Human
ggccccucucag

SEQ ID NO: 1455224 - RNA, 22 nt, Human
ggccccucacccugccuuaucu

SEQ ID NO: 1455225 - RNA, 17 nt, Human
ggccccuccccuccaaa

SEQ ID NO: 1455226 - RNA, 14 nt, Human
ggccccuccccucc

SEQ ID NO: 1455227 - RNA, 16 nt, Human
ggccccucccccugag

SEQ ID NO: 1455228 - RNA, 19 nt, Human
ggccccucacccugccuua

SEQ ID NO: 1455229 - RNA, 18 nt, Human
ggccccguuucugguggu

SEQ ID NO: 1455230 - RNA, 17 nt, Human
ggcccccucccuggaug

SEQ ID NO: 1455231 - RNA, 16 nt, Human
ggcccccucccuggau

SEQ ID NO: 1455232 - RNA, 13 nt, Human
ggcccccucccug

SEQ ID NO: 1455233 - RNA, 23 nt, Human
ggcccccgccuuggccuguguuc

SEQ ID NO: 1455234 - RNA, 19 nt, Human
ggcccccgccuuggccugu

SEQ ID NO: 1455235 - RNA, 21 nt, Human
ggccccccugguccccuccuu

SEQ ID NO: 1455236 - RNA, 15 nt, Human
ggccccccugguccc

SEQ ID NO: 1455237 - RNA, 14 nt, Human
ggcccccccagcug

SEQ ID NO: 1455238 - RNA, 15 nt, Human
ggcccccaucucaug

SEQ ID NO: 1455239 - RNA, 21 nt, Human
ggcccccaucucaugccccug

SEQ ID NO: 1455240 - RNA, 14 nt, Human
ggcccccaucucau

SEQ ID NO: 1455241 - RNA, 19 nt, Human
ggcccccaucauccucugg

SEQ ID NO: 1455242 - RNA, 23 nt, Human
ggcccccagcccagggcuccugc

SEQ ID NO: 1455243 - RNA, 20 nt, Human
ggcccccagcccagggcucc

SEQ ID NO: 1455244 - RNA, 18 nt, Human
ggcccccagcccagggcu

SEQ ID NO: 1455245 - RNA, 17 nt, Human
ggcccccagcccagggc

SEQ ID NO: 1455246 - RNA, 14 nt, Human
ggcccccagcccag

SEQ ID NO: 1455247 - RNA, 18 nt, Human
ggcccccacuugccucuu

SEQ ID NO: 1455248 - RNA, 16 nt, Human
ggcccccacuugccuc

SEQ ID NO: 1455249 - RNA, 15 nt, Human
ggcccccacuugccu

SEQ ID NO: 1455250 - RNA, 17 nt, Human
ggcccccaccuggcuca

SEQ ID NO: 1455251 - RNA, 16 nt, Human
ggcccccaccuggcuc

SEQ ID NO: 1455252 - RNA, 15 nt, Human
ggccauggccugcaa

SEQ ID NO: 1455253 - RNA, 14 nt, Human
ggccauggccugca

SEQ ID NO: 1455254 - RNA, 13 nt, Human
ggccauggccugc

SEQ ID NO: 1455255 - RNA, 20 nt, Human
ggcagucugagagaggccau

SEQ ID NO: 1455256 - RNA, 19 nt, Human
ggcagucugaauuuuuaaa

SEQ ID NO: 1455257 - RNA, 19 nt, Human
ggcauuagaauuauuuaaa

SEQ ID NO: 1455258 - RNA, 17 nt, Human
ggcauuagaauuauuua

SEQ ID NO: 1455259 - RNA, 20 nt, Human
ggcauuagaauuauuuaaac

SEQ ID NO: 1455260 - RNA, 21 nt, Human
ggcagugagggagggcuguca

SEQ ID NO: 1455261 - RNA, 16 nt, Human
ggcagugagggagggc

SEQ ID NO: 1455262 - RNA, 15 nt, Human
ggccacacagcugcc

SEQ ID NO: 1455263 - RNA, 16 nt, Human
ggccacacagcugccg

SEQ ID NO: 1455264 - RNA, 14 nt, Human
ggccacacagcugc

SEQ ID NO: 1455265 - RNA, 13 nt, Human
ggccacacagcug

SEQ ID NO: 1455266 - RNA, 12 nt, Human
ggccacacagcu

SEQ ID NO: 1455267 - RNA, 22 nt, Human
ggccaaugcaccuaaagaaaaa

SEQ ID NO: 1455268 - RNA, 13 nt, Human
ggccaaguuccuc

SEQ ID NO: 1455269 - RNA, 15 nt, Human
ggccaaguuccucua

SEQ ID NO: 1455270 - RNA, 14 nt, Human
ggccaggaggugcc

SEQ ID NO: 1455271 - RNA, 14 nt, Human
ggccacgcuccagc

SEQ ID NO: 1455272 - RNA, 22 nt, Human
ggccaccuggcucucaccucua

SEQ ID NO: 1455273 - RNA, 17 nt, Human
ggccaccuggcucucac

SEQ ID NO: 1455274 - RNA, 16 nt, Human
ggccaccuggcucuca

SEQ ID NO: 1455275 - RNA, 18 nt, Human
ggccaggcugggucgccc

SEQ ID NO: 1455276 - RNA, 22 nt, Human
ggccaggcugggucgcccugga

SEQ ID NO: 1455277 - RNA, 13 nt, Human
ggccaggaggugc

SEQ ID NO: 1455278 - RNA, 19 nt, Human
ggccaggcauguggcaggg

SEQ ID NO: 1455279 - RNA, 20 nt, Human
ggccaggcaggagcccuucu

SEQ ID NO: 1455280 - RNA, 18 nt, Human
ggcugcagaggccagagg

SEQ ID NO: 1455281 - RNA, 16 nt, Human
ggcugcagaggccaga

SEQ ID NO: 1455282 - RNA, 13 nt, Human
ggcugcagaggcc

SEQ ID NO: 1455283 - RNA, 14 nt, Human
ggcugauuucuagg

SEQ ID NO: 1455284 - RNA, 19 nt, Human
ggcugcagaggccagaggc

SEQ ID NO: 1455285 - RNA, 14 nt, Human
ggcugcagccucag

SEQ ID NO: 1455286 - RNA, 15 nt, Human
ggcugauggaguaaa

SEQ ID NO: 1455287 - RNA, 15 nt, Human
ggcugauaauuuuaa

SEQ ID NO: 1455288 - RNA, 24 nt, Human
ggcugaugucaauuucuguguugc

SEQ ID NO: 1455289 - RNA, 22 nt, Human
ggcugaugucaauuucuguguu

SEQ ID NO: 1455290 - RNA, 18 nt, Human
ggcugaugucaauuucug

SEQ ID NO: 1455291 - RNA, 22 nt, Human
ggcugagggcaguucgcagcca

SEQ ID NO: 1455292 - RNA, 21 nt, Human
ggcugagggcaguucgcagcc

SEQ ID NO: 1455293 - RNA, 13 nt, Human
ggcugagggcagu

SEQ ID NO: 1455294 - RNA, 16 nt, Human
ggcugagggagccugg

SEQ ID NO: 1455295 - RNA, 20 nt, Human
ggcugagcucucugugggcu

SEQ ID NO: 1455296 - RNA, 15 nt, Human
ggcugagcucucugu

SEQ ID NO: 1455297 - RNA, 15 nt, Human
ggcugagauaugaac

SEQ ID NO: 1455298 - RNA, 13 nt, Human
ggccccugccucu

SEQ ID NO: 1455299 - RNA, 20 nt, Human
ggccccugccaccuccugcc

SEQ ID NO: 1455300 - RNA, 13 nt, Human
ggcucuggagccc

SEQ ID NO: 1455301 - RNA, 14 nt, Human
ggcucuggagccca

SEQ ID NO: 1455302 - RNA, 18 nt, Human
ggcugcuuccuccuggaa

SEQ ID NO: 1455303 - RNA, 17 nt, Human
ggcugcuuccuccugga

SEQ ID NO: 1455304 - RNA, 16 nt, Human
ggcugcuuccuccugg

SEQ ID NO: 1455305 - RNA, 15 nt, Human
ggcugcuuccuccug

SEQ ID NO: 1455306 - RNA, 19 nt, Human
ggcugcuuccuccuggaaa

SEQ ID NO: 1455307 - RNA, 13 nt, Human
ggcugcuuccucc

SEQ ID NO: 1455308 - RNA, 19 nt, Human
ggcugcuucccugaagcuc

SEQ ID NO: 1455309 - RNA, 18 nt, Human
ggcugcuucccugaagcu

SEQ ID NO: 1455310 - RNA, 19 nt, Human
ggcuggaagauccugcggg

SEQ ID NO: 1455311 - RNA, 22 nt, Human
ggcuggaagauccugcgggugg

SEQ ID NO: 1455312 - RNA, 15 nt, Human
ggcuggaagauccug

SEQ ID NO: 1455313 - RNA, 18 nt, Human
ggcuggaagauagcugug

SEQ ID NO: 1455314 - RNA, 23 nt, Human
ggcuggacccagccaggcccagc

SEQ ID NO: 1455315 - RNA, 20 nt, Human
ggcuggacccagccaggccc

SEQ ID NO: 1455316 - RNA, 19 nt, Human
ggcuggacccagccaggcc

SEQ ID NO: 1455317 - RNA, 15 nt, Human
ggcuggacccagcca

SEQ ID NO: 1455318 - RNA, 14 nt, Human
ggcuggacccagcc

SEQ ID NO: 1455319 - RNA, 12 nt, Human
ggcuggacccag

SEQ ID NO: 1455320 - RNA, 11 nt, Human
ggcugggccau

SEQ ID NO: 1455321 - RNA, 21 nt, Human
ggcuggacccagccaggccca

SEQ ID NO: 1455322 - RNA, 20 nt, Human
ggcugcagccucaggacugg

SEQ ID NO: 1455323 - RNA, 19 nt, Human
ggcugcagccucaggacug

SEQ ID NO: 1455324 - RNA, 22 nt, Human
ggcugcagccucaggacuggga

SEQ ID NO: 1455325 - RNA, 18 nt, Human
ggcugcagccucaggacu

SEQ ID NO: 1455326 - RNA, 17 nt, Human
ggcugcagccucaggac

SEQ ID NO: 1455327 - RNA, 16 nt, Human
ggcugcagccucagga

SEQ ID NO: 1455328 - RNA, 15 nt, Human
ggcugcagccucagg

SEQ ID NO: 1455329 - RNA, 17 nt, Human
ggcugcugugggaaaug

SEQ ID NO: 1455330 - RNA, 18 nt, Human
ggcugcugcugggcucag

SEQ ID NO: 1455331 - RNA, 20 nt, Human
ggcugcugcugggcucagug

SEQ ID NO: 1455332 - RNA, 19 nt, Human
ggcugcugaucgccuuccc

SEQ ID NO: 1455333 - RNA, 21 nt, Human
ggcugcugaucgccuucccca

SEQ ID NO: 1455334 - RNA, 16 nt, Human
ggcugcugcugggcuc

SEQ ID NO: 1455335 - RNA, 14 nt, Human
ggcugcugcugggc

SEQ ID NO: 1455336 - RNA, 23 nt, Human
ggcugcugcugcucuuggcugga

SEQ ID NO: 1455337 - RNA, 22 nt, Human
ggcugcugcugcucuuggcugg

SEQ ID NO: 1455338 - RNA, 11 nt, Human
ggcugcugcug

SEQ ID NO: 1455339 - RNA, 15 nt, Human
ggcugcugcuacaau

SEQ ID NO: 1455340 - RNA, 23 nt, Human
ggcuuaaacccauauuguaaaac

SEQ ID NO: 1455341 - RNA, 21 nt, Human
ggcugggccauguccaaagag

SEQ ID NO: 1455342 - RNA, 20 nt, Human
ggcugggccauguccaaaga

SEQ ID NO: 1455343 - RNA, 17 nt, Human
ggcugggccauguccaa

SEQ ID NO: 1455344 - RNA, 18 nt, Human
ggcuuauaucuggccucu

SEQ ID NO: 1455345 - RNA, 17 nt, Human
ggcuuauaauucuuuca

SEQ ID NO: 1455346 - RNA, 16 nt, Human
ggcuuauaauucuuuc

SEQ ID NO: 1455347 - RNA, 22 nt, Human
ggcuuaguuuguguguugucuc

SEQ ID NO: 1455348 - RNA, 20 nt, Human
ggcuugagcccccgcgccca

SEQ ID NO: 1455349 - RNA, 21 nt, Human
ggcuugagaaauauggacacu

SEQ ID NO: 1455350 - RNA, 14 nt, Human
ggcuuaccuggccc

SEQ ID NO: 1455351 - RNA, 20 nt, Human
ggcuuaccuggcccaucagg

SEQ ID NO: 1455352 - RNA, 13 nt, Human
ggcuuacacccac

SEQ ID NO: 1455353 - RNA, 20 nt, Human
ggcuuucauuuucucucagg

SEQ ID NO: 1455354 - RNA, 19 nt, Human
ggcuuucauuuucucucag

SEQ ID NO: 1455355 - RNA, 22 nt, Human
ggcuuuaugauaauagauucuc

SEQ ID NO: 1455356 - RNA, 20 nt, Human
ggcuuuaugauaauagauuc

SEQ ID NO: 1455357 - RNA, 10 nt, Human
ggcuuuugug

SEQ ID NO: 1455358 - RNA, 18 nt, Human
ggcuuguggggccuggga

SEQ ID NO: 1455359 - RNA, 14 nt, Human
ggcuuuauccucuu

SEQ ID NO: 1455360 - RNA, 15 nt, Human
ggcuuuauccucuuu

SEQ ID NO: 1455361 - RNA, 18 nt, Human
ggcuuuauccucuuuaga

SEQ ID NO: 1455362 - RNA, 20 nt, Human
ggcuuuauccucuuuagagu

SEQ ID NO: 1455363 - RNA, 21 nt, Human
ggcuuuauccucuuuagaguu

SEQ ID NO: 1455364 - RNA, 16 nt, Human
ggcuuguggggccugg

SEQ ID NO: 1455365 - RNA, 14 nt, Human
ggcuuguggggccu

SEQ ID NO: 1455366 - RNA, 22 nt, Human
ggcuuggggcucacacaccugu

SEQ ID NO: 1455367 - RNA, 22 nt, Human
ggcuugaguuuaaauuguaaua

SEQ ID NO: 1455368 - RNA, 15 nt, Human
gggacaaaggagccu

SEQ ID NO: 1455369 - RNA, 18 nt, Human
gggacaaaggagccugug

SEQ ID NO: 1455370 - RNA, 17 nt, Human
gggacaaaggagccugu

SEQ ID NO: 1455371 - RNA, 16 nt, Human
gggacaaaggagccug

SEQ ID NO: 1455372 - RNA, 14 nt, Human
gggaauggcagcag

SEQ ID NO: 1455373 - RNA, 19 nt, Human
gggacaaguggacucaggg

SEQ ID NO: 1455374 - RNA, 18 nt, Human
gggacaaguggacucagg

SEQ ID NO: 1455375 - RNA, 19 nt, Human
gggacaacugcucccaccu

SEQ ID NO: 1455376 - RNA, 20 nt, Human
gggaccuagggaggcauggu

SEQ ID NO: 1455377 - RNA, 22 nt, Human
gggaccgcuacaccacucuggc

SEQ ID NO: 1455378 - RNA, 21 nt, Human
gggaccgcuacaccacucugg

SEQ ID NO: 1455379 - RNA, 20 nt, Human
gggaccggcggaccccagcc

SEQ ID NO: 1455380 - RNA, 19 nt, Human
gggaccuagggaggcaugg

SEQ ID NO: 1455381 - RNA, 20 nt, Human
gggacguggcucagccagca

SEQ ID NO: 1455382 - RNA, 22 nt, Human
gggacguggcucagccagcacu

SEQ ID NO: 1455383 - RNA, 22 nt, Human
gggacguucgugguccugcgcu

SEQ ID NO: 1455384 - RNA, 16 nt, Human
gggaagggccugccca

SEQ ID NO: 1455385 - RNA, 21 nt, Human
gggaaggugggguccuggagc

SEQ ID NO: 1455386 - RNA, 13 nt, Human
gggaaugaagaua

SEQ ID NO: 1455387 - RNA, 21 nt, Human
gggaagggagccaagggaugg

SEQ ID NO: 1455388 - RNA, 22 nt, Human
gggaagggagccaagggaugga

SEQ ID NO: 1455389 - RNA, 16 nt, Human
gggaagggagccaagg

SEQ ID NO: 1455390 - RNA, 14 nt, Human
gggaagggagccaa

SEQ ID NO: 1455391 - RNA, 14 nt, Human
gggaagggacacac

SEQ ID NO: 1455392 - RNA, 22 nt, Human
gggaaggcuacuucggggcugg

SEQ ID NO: 1455393 - RNA, 21 nt, Human
gggaaggcuacuucggggcug

SEQ ID NO: 1455394 - RNA, 21 nt, Human
gggaaggcaggcagggcucuc

SEQ ID NO: 1455395 - RNA, 15 nt, Human
gggaaggcaggcagg

SEQ ID NO: 1455396 - RNA, 14 nt, Human
gggaaggcaggcag

SEQ ID NO: 1455397 - RNA, 22 nt, Human
gggaaggauucugcuggccucu

SEQ ID NO: 1455398 - RNA, 21 nt, Human
gggaaggauucugcuggccuc

SEQ ID NO: 1455399 - RNA, 15 nt, Human
gggaaggaucccaug

SEQ ID NO: 1455400 - RNA, 14 nt, Human
ggcuuuugugcauu

SEQ ID NO: 1455401 - RNA, 21 nt, Human
gggaaggauacaaaagcaugu

SEQ ID NO: 1455402 - RNA, 23 nt, Human
gggaaggauacaaaagcauguga

SEQ ID NO: 1455403 - RNA, 19 nt, Human
gggcagucugagagaggcc

SEQ ID NO: 1455404 - RNA, 18 nt, Human
gggcagucugagagaggc

SEQ ID NO: 1455405 - RNA, 20 nt, Human
gggcaguaccugagggucug

SEQ ID NO: 1455406 - RNA, 15 nt, Human
gggcaguaccugagg

SEQ ID NO: 1455407 - RNA, 17 nt, Human
gggcagucugagagagg

SEQ ID NO: 1455408 - RNA, 14 nt, Human
gggcagggugaccc

SEQ ID NO: 1455409 - RNA, 19 nt, Human
gggcacccccagccugggc

SEQ ID NO: 1455410 - RNA, 18 nt, Human
gggcacaggagcuaccug

SEQ ID NO: 1455411 - RNA, 21 nt, Human
gggcacaggagcuaccugugu

SEQ ID NO: 1455412 - RNA, 17 nt, Human
gggcacaggagcuaccu

SEQ ID NO: 1455413 - RNA, 15 nt, Human
gggcacaggagcuac

SEQ ID NO: 1455414 - RNA, 14 nt, Human
gggcacaggagcua

SEQ ID NO: 1455415 - RNA, 13 nt, Human
gggcacaggagcu

SEQ ID NO: 1455416 - RNA, 12 nt, Human
gggcacaggagc

SEQ ID NO: 1455417 - RNA, 16 nt, Human
gggcacaagacugacg

SEQ ID NO: 1455418 - RNA, 23 nt, Human
gggcacaagacugacgccagggu

SEQ ID NO: 1455419 - RNA, 20 nt, Human
gggcaccagggguuucucgc

SEQ ID NO: 1455420 - RNA, 18 nt, Human
gggcaccagggguuucuc

SEQ ID NO: 1455421 - RNA, 21 nt, Human
gggcacccccagccugggccu

SEQ ID NO: 1455422 - RNA, 18 nt, Human
gggcacccccagccuggg

SEQ ID NO: 1455423 - RNA, 17 nt, Human
gggcacccccagccugg

SEQ ID NO: 1455424 - RNA, 16 nt, Human
gggcacccccagccug

SEQ ID NO: 1455425 - RNA, 14 nt, Human
gggcacccccagcc

SEQ ID NO: 1455426 - RNA, 12 nt, Human
gggaguguuccc

SEQ ID NO: 1455427 - RNA, 23 nt, Human
gggaguuaagaccuggcagcucu

SEQ ID NO: 1455428 - RNA, 20 nt, Human
gggaguuaagaccuggcagc

SEQ ID NO: 1455429 - RNA, 17 nt, Human
gggaguuaagaccuggc

SEQ ID NO: 1455430 - RNA, 16 nt, Human
gggaguuuaggguggg

SEQ ID NO: 1455431 - RNA, 16 nt, Human
gggaguuaagaccugg

SEQ ID NO: 1455432 - RNA, 15 nt, Human
gggaguuaagaccug

SEQ ID NO: 1455433 - RNA, 13 nt, Human
gggagugugugcc

SEQ ID NO: 1455434 - RNA, 23 nt, Human
gggagugacucaagaagugaaga

SEQ ID NO: 1455435 - RNA, 14 nt, Human
gggagguggcuggg

SEQ ID NO: 1455436 - RNA, 23 nt, Human
gggaggugcuucuaguucugcca

SEQ ID NO: 1455437 - RNA, 15 nt, Human
gggacugaccagcag

SEQ ID NO: 1455438 - RNA, 18 nt, Human
gggaggugagaccaccuc

SEQ ID NO: 1455439 - RNA, 18 nt, Human
gggacuagccuggcuugg

SEQ ID NO: 1455440 - RNA, 20 nt, Human
gggacuacaggcgugagcca

SEQ ID NO: 1455441 - RNA, 19 nt, Human
gggacuacaggcgugagcc

SEQ ID NO: 1455442 - RNA, 17 nt, Human
gggacuaaaugcccugc

SEQ ID NO: 1455443 - RNA, 22 nt, Human
gggacucagccuucagacagag

SEQ ID NO: 1455444 - RNA, 12 nt, Human
gggacucagccc

SEQ ID NO: 1455445 - RNA, 13 nt, Human
gggacugagaaau

SEQ ID NO: 1455446 - RNA, 15 nt, Human
gggauaggccagccg

SEQ ID NO: 1455447 - RNA, 18 nt, Human
gggaucagggguaggaau

SEQ ID NO: 1455448 - RNA, 17 nt, Human
gggauccgacugcuuug

SEQ ID NO: 1455449 - RNA, 20 nt, Human
gggaucccucccccccaugc

SEQ ID NO: 1455450 - RNA, 13 nt, Human
gggcaagaggaau

SEQ ID NO: 1455451 - RNA, 20 nt, Human
gggcaauuaauuccuucagc

SEQ ID NO: 1455452 - RNA, 14 nt, Human
gggcaauugucuga

SEQ ID NO: 1455453 - RNA, 21 nt, Human
gggcaauuaauuccuucagca

SEQ ID NO: 1455454 - RNA, 14 nt, Human
gggcaucucugggc

SEQ ID NO: 1455455 - RNA, 23 nt, Human
gggcaguucgcagccacccugag

SEQ ID NO: 1455456 - RNA, 14 nt, Human
gggcauaaauuauu

SEQ ID NO: 1455457 - RNA, 22 nt, Human
gggcaguucgcagccacccuga

SEQ ID NO: 1455458 - RNA, 21 nt, Human
gggcaguucgcagccacccug

SEQ ID NO: 1455459 - RNA, 20 nt, Human
gggcaguucgcagccacccu

SEQ ID NO: 1455460 - RNA, 19 nt, Human
gggcaguucgcagccaccc

SEQ ID NO: 1455461 - RNA, 17 nt, Human
gggcaguucgcagccac

SEQ ID NO: 1455462 - RNA, 16 nt, Human
gggcaguucgcagcca

SEQ ID NO: 1455463 - RNA, 17 nt, Human
gggcaguaccugagggu

SEQ ID NO: 1455464 - RNA, 17 nt, Human
gggcagucauuauccag

SEQ ID NO: 1455465 - RNA, 21 nt, Human
gggcagucugagagaggccau

SEQ ID NO: 1455466 - RNA, 20 nt, Human
gggcagucugagagaggcca

SEQ ID NO: 1455467 - RNA, 19 nt, Human
gggcaugguguucuccugc

SEQ ID NO: 1455468 - RNA, 21 nt, Human
gggcaugguguucuccugcug

SEQ ID NO: 1455469 - RNA, 22 nt, Human
gggcaugagggguuccuccccu

SEQ ID NO: 1455470 - RNA, 21 nt, Human
gggcaucuggccuggccagug

SEQ ID NO: 1455471 - RNA, 17 nt, Human
gggcaucucugggcugg

SEQ ID NO: 1455472 - RNA, 22 nt, Human
gggcaucucugggcuggaugag

SEQ ID NO: 1455473 - RNA, 16 nt, Human
gggcaucucugggcug

SEQ ID NO: 1455474 - RNA, 15 nt, Human
gggcaucucugggcu

SEQ ID NO: 1455475 - RNA, 20 nt, Human
gggcccagagcccagcucca

SEQ ID NO: 1455476 - RNA, 19 nt, Human
gggcccagagcccagcucc

SEQ ID NO: 1455477 - RNA, 17 nt, Human
gggcccagagcccagcu

SEQ ID NO: 1455478 - RNA, 16 nt, Human
gggcccagagcccagc

SEQ ID NO: 1455479 - RNA, 15 nt, Human
gggcccagagcccag

SEQ ID NO: 1455480 - RNA, 13 nt, Human
gggcccagagccc

SEQ ID NO: 1455481 - RNA, 12 nt, Human
gggcccagagcc

SEQ ID NO: 1455482 - RNA, 11 nt, Human
gggcccagagc

SEQ ID NO: 1455483 - RNA, 20 nt, Human
gggccacuccuuccugcccc

SEQ ID NO: 1455484 - RNA, 21 nt, Human
gggccacuccuuccugcccca

SEQ ID NO: 1455485 - RNA, 19 nt, Human
gggccacuccuuccugccc

SEQ ID NO: 1455486 - RNA, 17 nt, Human
gggccacuccuuccugc

SEQ ID NO: 1455487 - RNA, 16 nt, Human
gggccacuccuuccug

SEQ ID NO: 1455488 - RNA, 12 nt, Human
gggccacuccuu

SEQ ID NO: 1455489 - RNA, 13 nt, Human
gggcccacaccuc

SEQ ID NO: 1455490 - RNA, 18 nt, Human
gggcccacaccuccuucc

SEQ ID NO: 1455491 - RNA, 17 nt, Human
gggccacgcuccagcug

SEQ ID NO: 1455492 - RNA, 16 nt, Human
gggccacgcuccagcu

SEQ ID NO: 1455493 - RNA, 19 nt, Human
gggccacaugggaggcuca

SEQ ID NO: 1455494 - RNA, 13 nt, Human
gggccaagcccag

SEQ ID NO: 1455495 - RNA, 16 nt, Human
gggccaaggaccugag

SEQ ID NO: 1455496 - RNA, 15 nt, Human
gggccaaggaccuga

SEQ ID NO: 1455497 - RNA, 14 nt, Human
gggccaaggaccug

SEQ ID NO: 1455498 - RNA, 13 nt, Human
gggccaaggaccu

SEQ ID NO: 1455499 - RNA, 15 nt, Human
gggccugggcaggag

SEQ ID NO: 1455500 - RNA, 13 nt, Human
gggccugggcagg

SEQ ID NO: 1455501 - RNA, 12 nt, Human
gggccugggagg

SEQ ID NO: 1455502 - RNA, 23 nt, Human
gggccuggcuggcugagggcagu

SEQ ID NO: 1455503 - RNA, 22 nt, Human
gggccuggcuggcugagggcag

SEQ ID NO: 1455504 - RNA, 21 nt, Human
gggccuggcuggcugagggca

SEQ ID NO: 1455505 - RNA, 12 nt, Human
gggccugggcag

SEQ ID NO: 1455506 - RNA, 20 nt, Human
gggccuggcuggcugagggc

SEQ ID NO: 1455507 - RNA, 18 nt, Human
gggccuggcuggcugagg

SEQ ID NO: 1455508 - RNA, 17 nt, Human
gggccuggcuggcugag

SEQ ID NO: 1455509 - RNA, 16 nt, Human
gggccuggcuggcuga

SEQ ID NO: 1455510 - RNA, 15 nt, Human
gggccuggcuggcug

SEQ ID NO: 1455511 - RNA, 14 nt, Human
gggccuggcuggcu

SEQ ID NO: 1455512 - RNA, 13 nt, Human
gggccuggcuggc

SEQ ID NO: 1455513 - RNA, 18 nt, Human
gggcccugggccugccuc

SEQ ID NO: 1455514 - RNA, 14 nt, Human
gggcccugggcugg

SEQ ID NO: 1455515 - RNA, 15 nt, Human
gggcccugggcugga

SEQ ID NO: 1455516 - RNA, 13 nt, Human
gggcccugggcug

SEQ ID NO: 1455517 - RNA, 17 nt, Human
gggcccugggccugccu

SEQ ID NO: 1455518 - RNA, 11 nt, Human
gggcccuggag

SEQ ID NO: 1455519 - RNA, 13 nt, Human
gggcccuggagca

SEQ ID NO: 1455520 - RNA, 15 nt, Human
gggcccuggagcagc

SEQ ID NO: 1455521 - RNA, 21 nt, Human
gggcccuggagcagccacccc

SEQ ID NO: 1455522 - RNA, 22 nt, Human
gggcccgcgauguggaacugcu

SEQ ID NO: 1455523 - RNA, 22 nt, Human
gggccccugccucucugcaggu

SEQ ID NO: 1455524 - RNA, 19 nt, Human
gggccccucacccugccuu

SEQ ID NO: 1455525 - RNA, 17 nt, Human
gggccccucacccugcc

SEQ ID NO: 1455526 - RNA, 14 nt, Human
gggcccccaucuca

SEQ ID NO: 1455527 - RNA, 21 nt, Human
gggccccucuccccagggaag

SEQ ID NO: 1455528 - RNA, 12 nt, Human
gggccccucucc

SEQ ID NO: 1455529 - RNA, 17 nt, Human
gggccccucucagcccu

SEQ ID NO: 1455530 - RNA, 16 nt, Human
gggccccucucagccc

SEQ ID NO: 1455531 - RNA, 15 nt, Human
gggccccucucagcc

SEQ ID NO: 1455532 - RNA, 14 nt, Human
gggccccucucagc

SEQ ID NO: 1455533 - RNA, 13 nt, Human
gggccccucuccc

SEQ ID NO: 1455534 - RNA, 13 nt, Human
gggccccugccuc

SEQ ID NO: 1455535 - RNA, 15 nt, Human
gggccccugccucuc

SEQ ID NO: 1455536 - RNA, 17 nt, Human
gggccccugccucucug

SEQ ID NO: 1455537 - RNA, 18 nt, Human
gggccccugccucucugc

SEQ ID NO: 1455538 - RNA, 19 nt, Human
gggccccugccucucugca

SEQ ID NO: 1455539 - RNA, 21 nt, Human
gggccccugccucucugcagg

SEQ ID NO: 1455540 - RNA, 13 nt, Human
ggucaggccuuug

SEQ ID NO: 1455541 - RNA, 20 nt, Human
ggucaggccuuugagcucag

SEQ ID NO: 1455542 - RNA, 12 nt, Human
ggucaggccuuu

SEQ ID NO: 1455543 - RNA, 11 nt, Human
ggucaggccuu

SEQ ID NO: 1455544 - RNA, 13 nt, Human
ggucaggcagggu

SEQ ID NO: 1455545 - RNA, 16 nt, Human
ggucaacaguuuuccu

SEQ ID NO: 1455546 - RNA, 18 nt, Human
ggucaaaauagugccacu

SEQ ID NO: 1455547 - RNA, 12 nt, Human
gguauuuucaau

SEQ ID NO: 1455548 - RNA, 21 nt, Human
ggucacagcggagguguggag

SEQ ID NO: 1455549 - RNA, 23 nt, Human
ggucaacuugagcauguuacuga

SEQ ID NO: 1455550 - RNA, 22 nt, Human
ggucaacuugagcauguuacug

SEQ ID NO: 1455551 - RNA, 22 nt, Human
ggucaacaguuuuccuaugcuu

SEQ ID NO: 1455552 - RNA, 12 nt, Human
ggucacagcugu

SEQ ID NO: 1455553 - RNA, 20 nt, Human
ggucaccuaggaagccucag

SEQ ID NO: 1455554 - RNA, 20 nt, Human
ggucacguuuggugcuucuc

SEQ ID NO: 1455555 - RNA, 16 nt, Human
gguacuugucauuucg

SEQ ID NO: 1455556 - RNA, 19 nt, Human
gguacuucuugaaggugcu

SEQ ID NO: 1455557 - RNA, 16 nt, Human
gguacuucuugaaggu

SEQ ID NO: 1455558 - RNA, 15 nt, Human
gguacuucuugaagg

SEQ ID NO: 1455559 - RNA, 21 nt, Human
gguaccagcagaaagguuagu

SEQ ID NO: 1455560 - RNA, 15 nt, Human
gguagaagggaaagc

SEQ ID NO: 1455561 - RNA, 21 nt, Human
gguagccagcacacagggcag

SEQ ID NO: 1455562 - RNA, 20 nt, Human
gguauuguauuuauucaaua

SEQ ID NO: 1455563 - RNA, 22 nt, Human
gguauuguauuuauucaauaaa

SEQ ID NO: 1455564 - RNA, 23 nt, Human
gguauuguauuuauucaauaaag

SEQ ID NO: 1455565 - RNA, 16 nt, Human
gguagccagcacacag

SEQ ID NO: 1455566 - RNA, 13 nt, Human
gguagccagcaca

SEQ ID NO: 1455567 - RNA, 18 nt, Human
gguagcauuuguguugaa

SEQ ID NO: 1455568 - RNA, 19 nt, Human
gggugcuacuggggaaacu

SEQ ID NO: 1455569 - RNA, 16 nt, Human
gggugcuacuggggaa

SEQ ID NO: 1455570 - RNA, 15 nt, Human
gggugcuacugggga

SEQ ID NO: 1455571 - RNA, 24 nt, Human
gggugccuaggccugggcagugga

SEQ ID NO: 1455572 - RNA, 23 nt, Human
gggugcaguaucaugcccugugc

SEQ ID NO: 1455573 - RNA, 19 nt, Human
gggugcacaggaggggguc

SEQ ID NO: 1455574 - RNA, 16 nt, Human
gggugcacaggagggg

SEQ ID NO: 1455575 - RNA, 14 nt, Human
gggugcacaggagg

SEQ ID NO: 1455576 - RNA, 13 nt, Human
gggugcacaggag

SEQ ID NO: 1455577 - RNA, 23 nt, Human
gggugaugagggcagcagccagc

SEQ ID NO: 1455578 - RNA, 21 nt, Human
gggugaugagggcagcagcca

SEQ ID NO: 1455579 - RNA, 19 nt, Human
gggugaugagggcagcagc

SEQ ID NO: 1455580 - RNA, 18 nt, Human
gggugaugagggcagcag

SEQ ID NO: 1455581 - RNA, 17 nt, Human
gggugaugagggcagca

SEQ ID NO: 1455582 - RNA, 14 nt, Human
gggugaugagggca

SEQ ID NO: 1455583 - RNA, 23 nt, Human
gggugaguuggcuuaccuggccc

SEQ ID NO: 1455584 - RNA, 17 nt, Human
gggugagggucccaugu

SEQ ID NO: 1455585 - RNA, 15 nt, Human
gggugaggagcuggg

SEQ ID NO: 1455586 - RNA, 14 nt, Human
gggugaggagcugg

SEQ ID NO: 1455587 - RNA, 20 nt, Human
gggugacccggcacccccug

SEQ ID NO: 1455588 - RNA, 21 nt, Human
gggucuguagguugcacacuu

SEQ ID NO: 1455589 - RNA, 21 nt, Human
gggucuguaaaaucuuucuuu

SEQ ID NO: 1455590 - RNA, 15 nt, Human
gggucuguaaaaucu

SEQ ID NO: 1455591 - RNA, 16 nt, Human
gggucuguaaaaucuu

SEQ ID NO: 1455592 - RNA, 17 nt, Human
gggucuguaaaaucuuu

SEQ ID NO: 1455593 - RNA, 20 nt, Human
gggucuguaaaaucuuucuu

SEQ ID NO: 1455594 - RNA, 20 nt, Human
gggugaacaaagcagccacg

SEQ ID NO: 1455595 - RNA, 20 nt, Human
gggucuguagguugcacacu

SEQ ID NO: 1455596 - RNA, 17 nt, Human
gggugaagugaagacaa

SEQ ID NO: 1455597 - RNA, 22 nt, Human
gguaccagaugcagcucaagag

SEQ ID NO: 1455598 - RNA, 21 nt, Human
ggguuggagcaguagcuggag

SEQ ID NO: 1455599 - RNA, 20 nt, Human
ggguucaccugggcugaggc

SEQ ID NO: 1455600 - RNA, 13 nt, Human
ggguuaucucugu

SEQ ID NO: 1455601 - RNA, 16 nt, Human
ggguuaagaagacuuu

SEQ ID NO: 1455602 - RNA, 17 nt, Human
gggugcugggccccugc

SEQ ID NO: 1455603 - RNA, 18 nt, Human
gggugcugggccccugcc

SEQ ID NO: 1455604 - RNA, 16 nt, Human
gggcuuguggggccug

SEQ ID NO: 1455605 - RNA, 18 nt, Human
gggcuuguggggccuggg

SEQ ID NO: 1455606 - RNA, 17 nt, Human
gggccugggcuccugga

SEQ ID NO: 1455607 - RNA, 18 nt, Human
gggccugggcuccuggac

SEQ ID NO: 1455608 - RNA, 16 nt, Human
gggccugggcuccugg

SEQ ID NO: 1455609 - RNA, 15 nt, Human
gggccugggcuccug

SEQ ID NO: 1455610 - RNA, 12 nt, Human
gggccugggcuc

SEQ ID NO: 1455611 - RNA, 17 nt, Human
gggccugggcaggaggg

SEQ ID NO: 1455612 - RNA, 16 nt, Human
gggccugggcaggagg

SEQ ID NO: 1455613 - RNA, 22 nt, Human
gggcuuugauguuccuuccagu

SEQ ID NO: 1455614 - RNA, 14 nt, Human
ggggagggauucug

SEQ ID NO: 1455615 - RNA, 18 nt, Human
ggggagggaagggagcca

SEQ ID NO: 1455616 - RNA, 17 nt, Human
ggggagggaagggagcc

SEQ ID NO: 1455617 - RNA, 14 nt, Human
ggggagggaaggga

SEQ ID NO: 1455618 - RNA, 14 nt, Human
gggcuuuuuucuuu

SEQ ID NO: 1455619 - RNA, 20 nt, Human
ggggagggaagggagccaag

SEQ ID NO: 1455620 - RNA, 15 nt, Human
ggggagggauucugg

SEQ ID NO: 1455621 - RNA, 13 nt, Human
ggggaggguaggc

SEQ ID NO: 1455622 - RNA, 15 nt, Human
ggggagggggauccg

SEQ ID NO: 1455623 - RNA, 20 nt, Human
ggggauucuuccaucugauu

SEQ ID NO: 1455624 - RNA, 17 nt, Human
ggggaggguaggcagga

SEQ ID NO: 1455625 - RNA, 13 nt, Human
ggggauguguccu

SEQ ID NO: 1455626 - RNA, 16 nt, Human
ggggcgcggcugggag

SEQ ID NO: 1455627 - RNA, 15 nt, Human
ggggcgcggcuggga

SEQ ID NO: 1455628 - RNA, 19 nt, Human
ggggcagucugagagaggc

SEQ ID NO: 1455629 - RNA, 15 nt, Human
ggggcagucugagag

SEQ ID NO: 1455630 - RNA, 18 nt, Human
ggggcagucugagagagg

SEQ ID NO: 1455631 - RNA, 22 nt, Human
ggggcacaagacugacgccagg

SEQ ID NO: 1455632 - RNA, 14 nt, Human
ggggcacaagacug

SEQ ID NO: 1455633 - RNA, 23 nt, Human
ggggcucuaacgccugagcccag

SEQ ID NO: 1455634 - RNA, 22 nt, Human
ggggcucuaacgccugagccca

SEQ ID NO: 1455635 - RNA, 21 nt, Human
ggggcucuaacgccugagccc

SEQ ID NO: 1455636 - RNA, 20 nt, Human
ggggcucuaacgccugagcc

SEQ ID NO: 1455637 - RNA, 18 nt, Human
ggggcucuaacgccugag

SEQ ID NO: 1455638 - RNA, 17 nt, Human
ggggcucuaacgccuga

SEQ ID NO: 1455639 - RNA, 19 nt, Human
ggggcucccuccgccccca

SEQ ID NO: 1455640 - RNA, 16 nt, Human
ggggcucccuccgccc

SEQ ID NO: 1455641 - RNA, 14 nt, Human
ggggcuaauuuaac

SEQ ID NO: 1455642 - RNA, 11 nt, Human
ggggcucagag

SEQ ID NO: 1455643 - RNA, 14 nt, Human
ggggcuaccaggaa

SEQ ID NO: 1455644 - RNA, 21 nt, Human
gggucugggggcacaagacug

SEQ ID NO: 1455645 - RNA, 18 nt, Human
gggucuggcugguguuaa

SEQ ID NO: 1455646 - RNA, 15 nt, Human
gggucuggcuggugu

SEQ ID NO: 1455647 - RNA, 13 nt, Human
gggucuguaaaau

SEQ ID NO: 1455648 - RNA, 14 nt, Human
gggucuguaaaauc

SEQ ID NO: 1455649 - RNA, 14 nt, Human
gggucuggcuggug

SEQ ID NO: 1455650 - RNA, 13 nt, Human
gggucuggcuggu

SEQ ID NO: 1455651 - RNA, 12 nt, Human
gggucuggcugg

SEQ ID NO: 1455652 - RNA, 22 nt, Human
gggucuggcagccucccaucca

SEQ ID NO: 1455653 - RNA, 22 nt, Human
gggucuggaguugaucuggaac

SEQ ID NO: 1455654 - RNA, 20 nt, Human
gggucuggaguugaucugga

SEQ ID NO: 1455655 - RNA, 22 nt, Human
gggucugcucuuucucugccag

SEQ ID NO: 1455656 - RNA, 21 nt, Human
gggucugcucuuucucugcca

SEQ ID NO: 1455657 - RNA, 20 nt, Human
gggucugcucuuucucugcc

SEQ ID NO: 1455658 - RNA, 19 nt, Human
gggucugcucuuucucugc

SEQ ID NO: 1455659 - RNA, 23 nt, Human
gggucugcucccaaggggccuga

SEQ ID NO: 1455660 - RNA, 21 nt, Human
gggucugcucccaaggggccu

SEQ ID NO: 1455661 - RNA, 17 nt, Human
gggucugagcuccagcu

SEQ ID NO: 1455662 - RNA, 16 nt, Human
gggucugagcuccagc

SEQ ID NO: 1455663 - RNA, 15 nt, Human
gggguuaucucugug

SEQ ID NO: 1455664 - RNA, 14 nt, Human
gggguggugucaga

SEQ ID NO: 1455665 - RNA, 19 nt, Human
gggguguggcuccuuccca

SEQ ID NO: 1455666 - RNA, 11 nt, Human
ggguaaacaau

SEQ ID NO: 1455667 - RNA, 15 nt, Human
ggguaaaauacuuuu

SEQ ID NO: 1455668 - RNA, 21 nt, Human
ggguaaaauacuuuuacucug

SEQ ID NO: 1455669 - RNA, 21 nt, Human
ggguaaacccucacaucagag

SEQ ID NO: 1455670 - RNA, 17 nt, Human
ggguaaucccugcuuuu

SEQ ID NO: 1455671 - RNA, 21 nt, Human
gggggacuuacaugauucauu

SEQ ID NO: 1455672 - RNA, 15 nt, Human
gggggagagggcugc

SEQ ID NO: 1455673 - RNA, 15 nt, Human
ggggcugaggagcag

SEQ ID NO: 1455674 - RNA, 22 nt, Human
gggggagccccuucugcucagc

SEQ ID NO: 1455675 - RNA, 18 nt, Human
ggggugcugggccccugc

SEQ ID NO: 1455676 - RNA, 18 nt, Human
gggguggcugcagccuca

SEQ ID NO: 1455677 - RNA, 13 nt, Human
gggguggccaggc

SEQ ID NO: 1455678 - RNA, 13 nt, Human
ggggugggcuggu

SEQ ID NO: 1455679 - RNA, 15 nt, Human
gggguggguauaaaa

SEQ ID NO: 1455680 - RNA, 20 nt, Human
gggguggggggggugcuggg

SEQ ID NO: 1455681 - RNA, 21 nt, Human
ggugcugacuucaucucccac

SEQ ID NO: 1455682 - RNA, 12 nt, Human
ggugcucugucu

SEQ ID NO: 1455683 - RNA, 20 nt, Human
ggugcugacggccagggaga

SEQ ID NO: 1455684 - RNA, 17 nt, Human
ggugcugacggccaggg

SEQ ID NO: 1455685 - RNA, 16 nt, Human
ggugcugacggccagg

SEQ ID NO: 1455686 - RNA, 15 nt, Human
ggugcugacggccag

SEQ ID NO: 1455687 - RNA, 14 nt, Human
ggugcuaggaagag

SEQ ID NO: 1455688 - RNA, 23 nt, Human
gguggcuacucugugccagagcc

SEQ ID NO: 1455689 - RNA, 19 nt, Human
gguggcuacucugugccag

SEQ ID NO: 1455690 - RNA, 18 nt, Human
gguggcuacucugugcca

SEQ ID NO: 1455691 - RNA, 16 nt, Human
gguggcuacucugugc

SEQ ID NO: 1455692 - RNA, 14 nt, Human
gguggcuacucugu

SEQ ID NO: 1455693 - RNA, 15 nt, Human
gguggccaugcuccu

SEQ ID NO: 1455694 - RNA, 13 nt, Human
gguggccaggccg

SEQ ID NO: 1455695 - RNA, 16 nt, Human
gguggccaggccggga

SEQ ID NO: 1455696 - RNA, 12 nt, Human
gguggccaggcc

SEQ ID NO: 1455697 - RNA, 11 nt, Human
gguggccaggc

SEQ ID NO: 1455698 - RNA, 21 nt, Human
ggugcuacuggggaaacuggc

SEQ ID NO: 1455699 - RNA, 18 nt, Human
ggugcuacuggggaaacu

SEQ ID NO: 1455700 - RNA, 14 nt, Human
ggugcuacugggga

SEQ ID NO: 1455701 - RNA, 18 nt, Human
ggugcgagugcgugaaua

SEQ ID NO: 1455702 - RNA, 23 nt, Human
ggugcuacacccuuuuccagcug

SEQ ID NO: 1455703 - RNA, 22 nt, Human
ggugcuacacccuuuuccagcu

SEQ ID NO: 1455704 - RNA, 17 nt, Human
ggugccuuuauuuccac

SEQ ID NO: 1455705 - RNA, 17 nt, Human
ggugccugucccacccc

SEQ ID NO: 1455706 - RNA, 13 nt, Human
ggugccuguccca

SEQ ID NO: 1455707 - RNA, 14 nt, Human
ggugagaccaccuc

SEQ ID NO: 1455708 - RNA, 15 nt, Human
ggugagaaauuuaaa

SEQ ID NO: 1455709 - RNA, 15 nt, Human
ggugagaccaccucu

SEQ ID NO: 1455710 - RNA, 15 nt, Human
ggucucacccuggag

SEQ ID NO: 1455711 - RNA, 17 nt, Human
ggucucaaacuccugac

SEQ ID NO: 1455712 - RNA, 22 nt, Human
ggucuccagaaagccccaccca

SEQ ID NO: 1455713 - RNA, 11 nt, Human
ggucucagccc

SEQ ID NO: 1455714 - RNA, 21 nt, Human
ggucucaccggcucucaccug

SEQ ID NO: 1455715 - RNA, 19 nt, Human
ggucucaccggcucucacc

SEQ ID NO: 1455716 - RNA, 21 nt, Human
ggucucacccuggaggcaccu

SEQ ID NO: 1455717 - RNA, 20 nt, Human
ggucucacccuggaggcacc

SEQ ID NO: 1455718 - RNA, 16 nt, Human
ggucucacccuggagg

SEQ ID NO: 1455719 - RNA, 19 nt, Human
ggucucucucucucuacaa

SEQ ID NO: 1455720 - RNA, 20 nt, Human
ggucucuucugaauaaagca

SEQ ID NO: 1455721 - RNA, 21 nt, Human
ggucucuucugaauaaagcaa

SEQ ID NO: 1455722 - RNA, 22 nt, Human
ggucucuucugaauaaagcaau

SEQ ID NO: 1455723 - RNA, 18 nt, Human
ggugacaucggaaaaaua

SEQ ID NO: 1455724 - RNA, 18 nt, Human
ggugacaucagguuuuuc

SEQ ID NO: 1455725 - RNA, 20 nt, Human
ggucugcucuuucucugcca

SEQ ID NO: 1455726 - RNA, 19 nt, Human
ggucugcucuuucucugcc

SEQ ID NO: 1455727 - RNA, 22 nt, Human
ggucugcucuuucucugccagu

SEQ ID NO: 1455728 - RNA, 18 nt, Human
ggucugcucuuucucugc

SEQ ID NO: 1455729 - RNA, 16 nt, Human
ggucugcucuuucucu

SEQ ID NO: 1455730 - RNA, 22 nt, Human
ggucugcucccaaggggccuga

SEQ ID NO: 1455731 - RNA, 23 nt, Human
ggucugcucccaaggggccugag

SEQ ID NO: 1455732 - RNA, 20 nt, Human
ggucugcucccaaggggccu

SEQ ID NO: 1455733 - RNA, 14 nt, Human
ggucugcucccaag

SEQ ID NO: 1455734 - RNA, 12 nt, Human
ggucugcuccca

SEQ ID NO: 1455735 - RNA, 23 nt, Human
ggucugcccucugcauccucugg

SEQ ID NO: 1455736 - RNA, 23 nt, Human
ggucugccucuucugggagggca

SEQ ID NO: 1455737 - RNA, 16 nt, Human
ggugaccccagggcac

SEQ ID NO: 1455738 - RNA, 15 nt, Human
ggugaccccagggca

SEQ ID NO: 1455739 - RNA, 14 nt, Human
ggugaccccagggc

SEQ ID NO: 1455740 - RNA, 13 nt, Human
ggugaccccaggg

SEQ ID NO: 1455741 - RNA, 17 nt, Human
ggugacaucggaaaaau

SEQ ID NO: 1455742 - RNA, 21 nt, Human
ggugacugucuggggagcggg

SEQ ID NO: 1455743 - RNA, 14 nt, Human
ggugacugucuggg

SEQ ID NO: 1455744 - RNA, 21 nt, Human
ggugagaaccuggguugcaga

SEQ ID NO: 1455745 - RNA, 13 nt, Human
ggugagaaauuua

SEQ ID NO: 1455746 - RNA, 10 nt, Human
gguucuuguu

SEQ ID NO: 1455747 - RNA, 21 nt, Human
gguucuugaggggaccaggag

SEQ ID NO: 1455748 - RNA, 22 nt, Human
gguucuugaggggaccaggagu

SEQ ID NO: 1455749 - RNA, 20 nt, Human
gguucuugaggggaccagga

SEQ ID NO: 1455750 - RNA, 19 nt, Human
gguucuugaggggaccagg

SEQ ID NO: 1455751 - RNA, 14 nt, Human
gguucuuguuggug

SEQ ID NO: 1455752 - RNA, 11 nt, Human
gguugaggaaa

SEQ ID NO: 1455753 - RNA, 18 nt, Human
gguucuuucauuugcuuu

SEQ ID NO: 1455754 - RNA, 15 nt, Human
gguugacuuuaccca

SEQ ID NO: 1455755 - RNA, 22 nt, Human
gguucacaaacuucauuucaga

SEQ ID NO: 1455756 - RNA, 21 nt, Human
gguucaaagauauuuugcuuu

SEQ ID NO: 1455757 - RNA, 23 nt, Human
gguuauuuugauguaaagauguu

SEQ ID NO: 1455758 - RNA, 13 nt, Human
gguucaaagauau

SEQ ID NO: 1455759 - RNA, 20 nt, Human
gguguuuuguucaccauuau

SEQ ID NO: 1455760 - RNA, 21 nt, Human
gguguccuacagaaaaaccuu

SEQ ID NO: 1455761 - RNA, 18 nt, Human
gguguccuacagaaaaac

SEQ ID NO: 1455762 - RNA, 16 nt, Human
gguguccuacagaaaa

SEQ ID NO: 1455763 - RNA, 15 nt, Human
gguguccuacagaaa

SEQ ID NO: 1455764 - RNA, 14 nt, Human
gguguccuacagaa

SEQ ID NO: 1455765 - RNA, 21 nt, Human
gguguccugcaccggggccug

SEQ ID NO: 1455766 - RNA, 23 nt, Human
gguuauagacagucguucccagu

SEQ ID NO: 1455767 - RNA, 14 nt, Human
gguuaucucugugu

SEQ ID NO: 1455768 - RNA, 23 nt, Human
gguuagaccuacagggggucugg

SEQ ID NO: 1455769 - RNA, 22 nt, Human
gguuagaccuacagggggucug

SEQ ID NO: 1455770 - RNA, 20 nt, Human
gguuagaccuacaggggguc

SEQ ID NO: 1455771 - RNA, 15 nt, Human
gguuagaccuacagg

SEQ ID NO: 1455772 - RNA, 14 nt, Human
gguuagaccuacag

SEQ ID NO: 1455773 - RNA, 13 nt, Human
gguuagaccuaca

SEQ ID NO: 1455774 - RNA, 16 nt, Human
gguuagggaaaacauu

SEQ ID NO: 1455775 - RNA, 23 nt, Human
gguggugucagacccuggaggcc

SEQ ID NO: 1455776 - RNA, 14 nt, Human
ggugguggccuggu

SEQ ID NO: 1455777 - RNA, 15 nt, Human
ggugguggcucggga

SEQ ID NO: 1455778 - RNA, 22 nt, Human
gguggucuguuggcaggcuggc

SEQ ID NO: 1455779 - RNA, 21 nt, Human
gguggucuguuggcaggcugg

SEQ ID NO: 1455780 - RNA, 16 nt, Human
gguggucuguuggcag

SEQ ID NO: 1455781 - RNA, 14 nt, Human
gguggucccugggu

SEQ ID NO: 1455782 - RNA, 13 nt, Human
ggugguauuuuca

SEQ ID NO: 1455783 - RNA, 20 nt, Human
ggugguauuuucaauagcca

SEQ ID NO: 1455784 - RNA, 16 nt, Human
ggugguacccucugga

SEQ ID NO: 1455785 - RNA, 19 nt, Human
ggugggugccuaggccugg

SEQ ID NO: 1455786 - RNA, 20 nt, Human
gguggguccaugggcagagc

SEQ ID NO: 1455787 - RNA, 17 nt, Human
gguggguccaugggcag

SEQ ID NO: 1455788 - RNA, 14 nt, Human
gguggguccauggg

SEQ ID NO: 1455789 - RNA, 10 nt, Human
ggugggucca

SEQ ID NO: 1455790 - RNA, 11 nt, Human
gguggggugga

SEQ ID NO: 1455791 - RNA, 14 nt, Human
gguggguauaaaag

SEQ ID NO: 1455792 - RNA, 22 nt, Human
gguggcuacucugugccagagc

SEQ ID NO: 1455793 - RNA, 16 nt, Human
gguggcugcagccuca

SEQ ID NO: 1455794 - RNA, 15 nt, Human
gguggcugcagccuc

SEQ ID NO: 1455795 - RNA, 14 nt, Human
gguggcugcagccu

SEQ ID NO: 1455796 - RNA, 23 nt, Human
ggugggguccuggagcagaccac

SEQ ID NO: 1455797 - RNA, 14 nt, Human
ggugggguccugga

SEQ ID NO: 1455798 - RNA, 16 nt, Human
gguguagcuacagaga

SEQ ID NO: 1455799 - RNA, 15 nt, Human
gguguagcuacagag

SEQ ID NO: 1455800 - RNA, 22 nt, Human
gguguagaacacuaauucauaa

SEQ ID NO: 1455801 - RNA, 15 nt, Human
ggugguuuucuguuc

SEQ ID NO: 1455802 - RNA, 18 nt, Human
ggugguuuucuguucuuu

SEQ ID NO: 1455803 - RNA, 17 nt, Human
ggugguuucagaaaugu

SEQ ID NO: 1455804 - RNA, 18 nt, Human
ggugguuucagaaaugug

SEQ ID NO: 1455805 - RNA, 12 nt, Human
gguguccuacag

SEQ ID NO: 1455806 - RNA, 20 nt, Human
gguguccccaacagcgccca

SEQ ID NO: 1455807 - RNA, 19 nt, Human
gguguccccaacagcgccc

SEQ ID NO: 1455808 - RNA, 15 nt, Human
gguguccccaacagc

SEQ ID NO: 1455809 - RNA, 13 nt, Human
gguguccccaaca

SEQ ID NO: 1455810 - RNA, 23 nt, Human
ggugucagacccuggaggcccca

SEQ ID NO: 1455811 - RNA, 18 nt, Human
ggugucagacccuggagg

SEQ ID NO: 1455812 - RNA, 22 nt, Human
gguguagcuacagagaaaccag

SEQ ID NO: 1455813 - RNA, 18 nt, Human
gguguagcuacagagaaa

SEQ ID NO: 1455814 - RNA, 17 nt, Human
gguguagcuacagagaa

SEQ ID NO: 1455815 - RNA, 23 nt, Human
uacuguugcacguguguuuuucu

SEQ ID NO: 1455816 - RNA, 16 nt, Human
uacuguugcacgugug

SEQ ID NO: 1455817 - RNA, 15 nt, Human
uacuguugcacgugu

SEQ ID NO: 1455818 - RNA, 14 nt, Human
uacuguugcacgug

SEQ ID NO: 1455819 - RNA, 13 nt, Human
uacuguugcacgu

SEQ ID NO: 1455820 - RNA, 16 nt, Human
uacuguucugugucuu

SEQ ID NO: 1455821 - RNA, 17 nt, Human
uacuguucugugucuuu

SEQ ID NO: 1455822 - RNA, 14 nt, Human
uacuguucuguguc

SEQ ID NO: 1455823 - RNA, 21 nt, Human
uacuguucuaaagcucugaca

SEQ ID NO: 1455824 - RNA, 19 nt, Human
uacuguucuaaagcucuga

SEQ ID NO: 1455825 - RNA, 18 nt, Human
uacuguucuaaagcucug

SEQ ID NO: 1455826 - RNA, 17 nt, Human
uacuguucuaaagcucu

SEQ ID NO: 1455827 - RNA, 15 nt, Human
uacuguucuaaagcu

SEQ ID NO: 1455828 - RNA, 14 nt, Human
uacuguucuaaagc

SEQ ID NO: 1455829 - RNA, 13 nt, Human
uacuguucuaaag

SEQ ID NO: 1455830 - RNA, 12 nt, Human
uacuguucuaaa

SEQ ID NO: 1455831 - RNA, 21 nt, Human
uacugugugugugaaugaaca

SEQ ID NO: 1455832 - RNA, 19 nt, Human
uacugugugugugaaugaa

SEQ ID NO: 1455833 - RNA, 18 nt, Human
uacugugugugugaauga

SEQ ID NO: 1455834 - RNA, 17 nt, Human
uacugugugugugaaug

SEQ ID NO: 1455835 - RNA, 14 nt, Human
uacuguguguguga

SEQ ID NO: 1455836 - RNA, 14 nt, Human
uacuguguaauuag

SEQ ID NO: 1455837 - RNA, 13 nt, Human
uacuguguaauua

SEQ ID NO: 1455838 - RNA, 15 nt, Human
uacugcauacuuuuu

SEQ ID NO: 1455839 - RNA, 13 nt, Human
uacugcauacuuu

SEQ ID NO: 1455840 - RNA, 22 nt, Human
uacugcauacuuuuuaaaugua

SEQ ID NO: 1455841 - RNA, 21 nt, Human
uacugcauacuuuuuaaaugu

SEQ ID NO: 1455842 - RNA, 18 nt, Human
uacugcauacuuuuuaaa

SEQ ID NO: 1455843 - RNA, 17 nt, Human
uacugcauacuuuuuaa

SEQ ID NO: 1455844 - RNA, 23 nt, Human
uacuguauuuuguauuguuucaa

SEQ ID NO: 1455845 - RNA, 17 nt, Human
uacuguauuuuguauug

SEQ ID NO: 1455846 - RNA, 21 nt, Human
uacuguaucaugacaaagacu

SEQ ID NO: 1455847 - RNA, 15 nt, Human
uacuuguaaauauaa

SEQ ID NO: 1455848 - RNA, 14 nt, Human
uacuuguaaauaua

SEQ ID NO: 1455849 - RNA, 16 nt, Human
uacuuguaaauauaaa

SEQ ID NO: 1455850 - RNA, 13 nt, Human
uacuuguaaauau

SEQ ID NO: 1455851 - RNA, 23 nt, Human
uacuugggagaccuguaaucaua

SEQ ID NO: 1455852 - RNA, 21 nt, Human
uacuugggagaccuguaauca

SEQ ID NO: 1455853 - RNA, 14 nt, Human
uacuuggauuuagu

SEQ ID NO: 1455854 - RNA, 22 nt, Human
uacuugaagggccagagccagg

SEQ ID NO: 1455855 - RNA, 21 nt, Human
uacuugaagggccagagccag

SEQ ID NO: 1455856 - RNA, 19 nt, Human
uacuuacaugcauuacugc

SEQ ID NO: 1455857 - RNA, 23 nt, Human
uacuuacaugcauuacugcaugc

SEQ ID NO: 1455858 - RNA, 15 nt, Human
uacuuaauccaaugg

SEQ ID NO: 1455859 - RNA, 12 nt, Human
uacuugaaugaa

SEQ ID NO: 1455860 - RNA, 14 nt, Human
uacuugaaugaaaa

SEQ ID NO: 1455861 - RNA, 14 nt, Human
uacuugaccuccua

SEQ ID NO: 1455862 - RNA, 17 nt, Human
uacuugcucagguacuu

SEQ ID NO: 1455863 - RNA, 16 nt, Human
uacuugcucagguacu

SEQ ID NO: 1455864 - RNA, 23 nt, Human
uacuugccuuauuagagugucuu

SEQ ID NO: 1455865 - RNA, 21 nt, Human
uacuugcucuugaugccuggc

SEQ ID NO: 1455866 - RNA, 22 nt, Human
uagaacaugguuaccaugucuu

SEQ ID NO: 1455867 - RNA, 22 nt, Human
uagaacagggaaaauaggcagg

SEQ ID NO: 1455868 - RNA, 19 nt, Human
uagaacacuaauucauaau

SEQ ID NO: 1455869 - RNA, 18 nt, Human
uagaacacuaauucauaa

SEQ ID NO: 1455870 - RNA, 16 nt, Human
uagaacacuaauucau

SEQ ID NO: 1455871 - RNA, 15 nt, Human
uagaacacuaauuca

SEQ ID NO: 1455872 - RNA, 20 nt, Human
uagaacacuaauucauaauc

SEQ ID NO: 1455873 - RNA, 15 nt, Human
uagaacacaggcaaa

SEQ ID NO: 1455874 - RNA, 17 nt, Human
uagaacacacacacuua

SEQ ID NO: 1455875 - RNA, 12 nt, Human
uagaacacacac

SEQ ID NO: 1455876 - RNA, 13 nt, Human
uagaacaaggcug

SEQ ID NO: 1455877 - RNA, 18 nt, Human
uagaaauuaccuguggau

SEQ ID NO: 1455878 - RNA, 16 nt, Human
uagaaauuaccugugg

SEQ ID NO: 1455879 - RNA, 19 nt, Human
uagaaauuacacccaaaga

SEQ ID NO: 1455880 - RNA, 23 nt, Human
uagaaauuuauuuccuaguucug

SEQ ID NO: 1455881 - RNA, 16 nt, Human
uagaaaucauuuugca

SEQ ID NO: 1455882 - RNA, 19 nt, Human
uagaaauguaacuuuugua

SEQ ID NO: 1455883 - RNA, 23 nt, Human
uagaaaugguuguauuagauguu

SEQ ID NO: 1455884 - RNA, 16 nt, Human
uagaaaugguuguauu

SEQ ID NO: 1455885 - RNA, 17 nt, Human
uagaaaugguuguauua

SEQ ID NO: 1455886 - RNA, 19 nt, Human
uagaaaugguuguauuaga

SEQ ID NO: 1455887 - RNA, 20 nt, Human
uagaaaugguuguauuagau

SEQ ID NO: 1455888 - RNA, 17 nt, Human
uagaaaucauuuugcaa

SEQ ID NO: 1455889 - RNA, 13 nt, Human
uagaaaucauuuu

SEQ ID NO: 1455890 - RNA, 20 nt, Human
uagaaauauuuuaaaaucag

SEQ ID NO: 1455891 - RNA, 15 nt, Human
uagaaaugguuguau

SEQ ID NO: 1455892 - RNA, 11 nt, Human
uagaaaucaua

SEQ ID NO: 1455893 - RNA, 19 nt, Human
uagaaauauuuuaaaauca

SEQ ID NO: 1455894 - RNA, 16 nt, Human
uagaaauauuuuaaaa

SEQ ID NO: 1455895 - RNA, 15 nt, Human
uagaaauauuuuaaa

SEQ ID NO: 1455896 - RNA, 14 nt, Human
uagaaauauuuuaa

SEQ ID NO: 1455897 - RNA, 13 nt, Human
uagaaagcauuug

SEQ ID NO: 1455898 - RNA, 14 nt, Human
uagaaagcauuuga

SEQ ID NO: 1455899 - RNA, 18 nt, Human
uagaaagagauacagagg

SEQ ID NO: 1455900 - RNA, 17 nt, Human
uagaaagagauacagag

SEQ ID NO: 1455901 - RNA, 16 nt, Human
uagaaagagaaacagu

SEQ ID NO: 1455902 - RNA, 17 nt, Human
uagaaagaccaggccaa

SEQ ID NO: 1455903 - RNA, 15 nt, Human
uagaaagaccaggcc

SEQ ID NO: 1455904 - RNA, 15 nt, Human
uagaaacuuccaaau

SEQ ID NO: 1455905 - RNA, 15 nt, Human
uagaaagaagaugaa

SEQ ID NO: 1455906 - RNA, 20 nt, Human
uacuuuauguuacuacaugc

SEQ ID NO: 1455907 - RNA, 17 nt, Human
uacuuuauguuacuaca

SEQ ID NO: 1455908 - RNA, 23 nt, Human
uacuuuauaacuaacauguccug

SEQ ID NO: 1455909 - RNA, 20 nt, Human
uacuuuauaacuaacauguc

SEQ ID NO: 1455910 - RNA, 19 nt, Human
uacuuuauaacuaacaugu

SEQ ID NO: 1455911 - RNA, 21 nt, Human
uacuuuagaagccugcauaau

SEQ ID NO: 1455912 - RNA, 17 nt, Human
uacuuuagaagccugca

SEQ ID NO: 1455913 - RNA, 20 nt, Human
uagaaauaaaggaugugauu

SEQ ID NO: 1455914 - RNA, 19 nt, Human
uagaaauaaaggaugugau

SEQ ID NO: 1455915 - RNA, 16 nt, Human
uagaaauaaagcaucu

SEQ ID NO: 1455916 - RNA, 11 nt, Human
uagaaagcuau

SEQ ID NO: 1455917 - RNA, 13 nt, Human
uagaaaggccuuu

SEQ ID NO: 1455918 - RNA, 14 nt, Human
uagaaaggccuuua

SEQ ID NO: 1455919 - RNA, 15 nt, Human
uagaaaggccuuuaa

SEQ ID NO: 1455920 - RNA, 16 nt, Human
uagaaaggccuuuaaa

SEQ ID NO: 1455921 - RNA, 15 nt, Human
uagaaagcauuugaa

SEQ ID NO: 1455922 - RNA, 16 nt, Human
uagaaagcauuugaau

SEQ ID NO: 1455923 - RNA, 17 nt, Human
uagaaagcauuugaaug

SEQ ID NO: 1455924 - RNA, 18 nt, Human
uagaaagcauuugaaugc

SEQ ID NO: 1455925 - RNA, 19 nt, Human
uagaaagcauuugaaugca

SEQ ID NO: 1455926 - RNA, 20 nt, Human
uagaaagcauuugaaugcau

SEQ ID NO: 1455927 - RNA, 21 nt, Human
uagaaagcauuugaaugcauu

SEQ ID NO: 1455928 - RNA, 22 nt, Human
uagaaagcauuugaaugcauuu

SEQ ID NO: 1455929 - RNA, 23 nt, Human
uacucagauaagguaaaaugcca

SEQ ID NO: 1455930 - RNA, 16 nt, Human
uacucagauaagguaa

SEQ ID NO: 1455931 - RNA, 17 nt, Human
uacucacuuuucccacu

SEQ ID NO: 1455932 - RNA, 22 nt, Human
uacucagaauucucuaguuuga

SEQ ID NO: 1455933 - RNA, 18 nt, Human
uacucacuuuucccacuc

SEQ ID NO: 1455934 - RNA, 16 nt, Human
uacucagaauucucua

SEQ ID NO: 1455935 - RNA, 16 nt, Human
uacucacuuuucccac

SEQ ID NO: 1455936 - RNA, 20 nt, Human
uacuaccuugaaaauaagaa

SEQ ID NO: 1455937 - RNA, 16 nt, Human
uacuaccuugaaaaua

SEQ ID NO: 1455938 - RNA, 14 nt, Human
uacuaccuugaaaa

SEQ ID NO: 1455939 - RNA, 13 nt, Human
uacuaccuugaaa

SEQ ID NO: 1455940 - RNA, 14 nt, Human
uacuaccuguaaug

SEQ ID NO: 1455941 - RNA, 13 nt, Human
uacuacaugcacu

SEQ ID NO: 1455942 - RNA, 16 nt, Human
uacugauauauuuuac

SEQ ID NO: 1455943 - RNA, 14 nt, Human
uacugauauauuuu

SEQ ID NO: 1455944 - RNA, 23 nt, Human
uacugagccuuguaauucuaaau

SEQ ID NO: 1455945 - RNA, 19 nt, Human
uacugagccuuguaauucu

SEQ ID NO: 1455946 - RNA, 18 nt, Human
uacugagccuuguaauuc

SEQ ID NO: 1455947 - RNA, 15 nt, Human
uacugagccuuguaa

SEQ ID NO: 1455948 - RNA, 21 nt, Human
uacuccugugggagccucgca

SEQ ID NO: 1455949 - RNA, 20 nt, Human
uacuccugugggagccucgc

SEQ ID NO: 1455950 - RNA, 18 nt, Human
uacuccugugggagccuc

SEQ ID NO: 1455951 - RNA, 17 nt, Human
uacuccugugggagccu

SEQ ID NO: 1455952 - RNA, 12 nt, Human
uacuccuguggg

SEQ ID NO: 1455953 - RNA, 11 nt, Human
uacuccugugg

SEQ ID NO: 1455954 - RNA, 15 nt, Human
uacuccccuccuuga

SEQ ID NO: 1455955 - RNA, 20 nt, Human
uacuaauagaauaaaggcag

SEQ ID NO: 1455956 - RNA, 22 nt, Human
uacuaauaaacuaauaauugca

SEQ ID NO: 1455957 - RNA, 20 nt, Human
uacuaauaaacuaauaauug

SEQ ID NO: 1455958 - RNA, 23 nt, Human
uacuaauagaauaaaggcaguuu

SEQ ID NO: 1455959 - RNA, 20 nt, Human
uacuaauagacaauuuauua

SEQ ID NO: 1455960 - RNA, 16 nt, Human
uacuaauaaacuaaua

SEQ ID NO: 1455961 - RNA, 14 nt, Human
uacuaauaaacuaa

SEQ ID NO: 1455962 - RNA, 15 nt, Human
uacuaauagacaauu

SEQ ID NO: 1455963 - RNA, 17 nt, Human
uacuaauagacaauuua

SEQ ID NO: 1455964 - RNA, 23 nt, Human
uacgacaguacacugucagcagg

SEQ ID NO: 1455965 - RNA, 18 nt, Human
uacuaaccagcagaaaug

SEQ ID NO: 1455966 - RNA, 19 nt, Human
uacuaaccagcagaaaugc

SEQ ID NO: 1455967 - RNA, 14 nt, Human
uacgaauacuuuug

SEQ ID NO: 1455968 - RNA, 22 nt, Human
uaccuuuuuuauacauaaacaa

SEQ ID NO: 1455969 - RNA, 17 nt, Human
uaccuugcaucucacag

SEQ ID NO: 1455970 - RNA, 22 nt, Human
uaccuugaaaauaagaauagaa

SEQ ID NO: 1455971 - RNA, 23 nt, Human
uaccuucuccccagcucccagga

SEQ ID NO: 1455972 - RNA, 19 nt, Human
uacccaugucuacacagau

SEQ ID NO: 1455973 - RNA, 22 nt, Human
uaccuucuccccagcucccagg

SEQ ID NO: 1455974 - RNA, 19 nt, Human
uaccuucuccccagcuccc

SEQ ID NO: 1455975 - RNA, 13 nt, Human
uaccuucucccca

SEQ ID NO: 1455976 - RNA, 24 nt, Human
uacccaguuucuaaacuggagacu

SEQ ID NO: 1455977 - RNA, 23 nt, Human
uacccaguuucuaaacuggagac

SEQ ID NO: 1455978 - RNA, 22 nt, Human
uacccaguuucuaaacuggaga

SEQ ID NO: 1455979 - RNA, 22 nt, Human
uacccaguaacucaucugucac

SEQ ID NO: 1455980 - RNA, 19 nt, Human
uacccaguaacucaucugu

SEQ ID NO: 1455981 - RNA, 12 nt, Human
uaccuuucauac

SEQ ID NO: 1455982 - RNA, 18 nt, Human
uaccuuuuuuauacauaa

SEQ ID NO: 1455983 - RNA, 19 nt, Human
uaccuuuuuuauacauaaa

SEQ ID NO: 1455984 - RNA, 20 nt, Human
uaccuuuuuuauacauaaac

SEQ ID NO: 1455985 - RNA, 20 nt, Human
uaccuuguauacuguaggca

SEQ ID NO: 1455986 - RNA, 16 nt, Human
uaccuuguauacugua

SEQ ID NO: 1455987 - RNA, 14 nt, Human
uaccuuguauacug

SEQ ID NO: 1455988 - RNA, 22 nt, Human
uaccuugguucccccacugauc

SEQ ID NO: 1455989 - RNA, 13 nt, Human
uaccuugguuccc

SEQ ID NO: 1455990 - RNA, 19 nt, Human
uaccuuugacaaagguaaa

SEQ ID NO: 1455991 - RNA, 20 nt, Human
uaccuuuguauucucuccug

SEQ ID NO: 1455992 - RNA, 16 nt, Human
uacaugagaaggaacu

SEQ ID NO: 1455993 - RNA, 18 nt, Human
uacaugagaacaaacaga

SEQ ID NO: 1455994 - RNA, 17 nt, Human
uacaugagaacaaacag

SEQ ID NO: 1455995 - RNA, 21 nt, Human
uacaugacauuuauuuuucau

SEQ ID NO: 1455996 - RNA, 16 nt, Human
uacaugacauuuauuu

SEQ ID NO: 1455997 - RNA, 22 nt, Human
uacaugaaguauuuuuucagua

SEQ ID NO: 1455998 - RNA, 18 nt, Human
uacaugaauugcauuuua

SEQ ID NO: 1455999 - RNA, 21 nt, Human
uacaugaaguauuuuuucagu

SEQ ID NO: 1456000 - RNA, 15 nt, Human
uacaugaaguauuuu

SEQ ID NO: 1456001 - RNA, 13 nt, Human
uacaugaaguauu

SEQ ID NO: 1456002 - RNA, 17 nt, Human
uacaucuucugccuuag

SEQ ID NO: 1456003 - RNA, 14 nt, Human
uacaucuucugccu

SEQ ID NO: 1456004 - RNA, 23 nt, Human
uacaucuauuuuggauuguauau

SEQ ID NO: 1456005 - RNA, 22 nt, Human
uacaucuauuuuggauuguaua

SEQ ID NO: 1456006 - RNA, 20 nt, Human
uacaucuauuuuggauugua

SEQ ID NO: 1456007 - RNA, 19 nt, Human
uacaucuauuuuggauugu

SEQ ID NO: 1456008 - RNA, 18 nt, Human
uacaucuauuuuggauug

SEQ ID NO: 1456009 - RNA, 23 nt, Human
uacaguguuuauccuuucauaua

SEQ ID NO: 1456010 - RNA, 15 nt, Human
uacaguguuuauccu

SEQ ID NO: 1456011 - RNA, 23 nt, Human
uacaguuacucagaauucucuag

SEQ ID NO: 1456012 - RNA, 23 nt, Human
uacagugucuuuuuuuguauagu

SEQ ID NO: 1456013 - RNA, 12 nt, Human
uacaguguuacc

SEQ ID NO: 1456014 - RNA, 21 nt, Human
uacagugucuuuuuuuguaua

SEQ ID NO: 1456015 - RNA, 14 nt, Human
uacagugucuuuuu

SEQ ID NO: 1456016 - RNA, 19 nt, Human
uacaguuacucagaauucu

SEQ ID NO: 1456017 - RNA, 19 nt, Human
uacaguuaucuaaguuaau

SEQ ID NO: 1456018 - RNA, 21 nt, Human
uacaguuagggcuccuauuca

SEQ ID NO: 1456019 - RNA, 18 nt, Human
uacaguuccuagguauaa

SEQ ID NO: 1456020 - RNA, 12 nt, Human
uaccaaccuguu

SEQ ID NO: 1456021 - RNA, 17 nt, Human
uaccaaagaugaaugaa

SEQ ID NO: 1456022 - RNA, 12 nt, Human
uaccaaagcaca

SEQ ID NO: 1456023 - RNA, 21 nt, Human
uacauuugggaguuuuuauga

SEQ ID NO: 1456024 - RNA, 15 nt, Human
uacauuuucuaagaa

SEQ ID NO: 1456025 - RNA, 20 nt, Human
uacauuuucuaagaaacauu

SEQ ID NO: 1456026 - RNA, 19 nt, Human
uacauuuucuaagaaacau

SEQ ID NO: 1456027 - RNA, 14 nt, Human
uacaugauucauuu

SEQ ID NO: 1456028 - RNA, 15 nt, Human
uacaugauucauuuu

SEQ ID NO: 1456029 - RNA, 23 nt, Human
uacaugaggacucuauucuuuaa

SEQ ID NO: 1456030 - RNA, 22 nt, Human
uacaugaggacucuauucuuua

SEQ ID NO: 1456031 - RNA, 21 nt, Human
uacaugaggacucuauucuuu

SEQ ID NO: 1456032 - RNA, 14 nt, Human
uacaugaggacucu

SEQ ID NO: 1456033 - RNA, 13 nt, Human
uacaugaggacuc

SEQ ID NO: 1456034 - RNA, 11 nt, Human
uacauuugugu

SEQ ID NO: 1456035 - RNA, 17 nt, Human
uacauuuguauaaaaua

SEQ ID NO: 1456036 - RNA, 19 nt, Human
uacauuugggaguuuuuau

SEQ ID NO: 1456037 - RNA, 16 nt, Human
uacauuuguauaaaau

SEQ ID NO: 1456038 - RNA, 15 nt, Human
uaccauuugccuccc

SEQ ID NO: 1456039 - RNA, 16 nt, Human
uaccauuucagagagg

SEQ ID NO: 1456040 - RNA, 15 nt, Human
uaccauuucagagag

SEQ ID NO: 1456041 - RNA, 12 nt, Human
uaccauuucaga

SEQ ID NO: 1456042 - RNA, 16 nt, Human
uaccauuuucugguuc

SEQ ID NO: 1456043 - RNA, 15 nt, Human
uaccauuuucugguu

SEQ ID NO: 1456044 - RNA, 18 nt, Human
uaccauuuuaaaguuagu

SEQ ID NO: 1456045 - RNA, 17 nt, Human
uaccauuuacauguuuu

SEQ ID NO: 1456046 - RNA, 13 nt, Human
uaccauuuacaug

SEQ ID NO: 1456047 - RNA, 18 nt, Human
uaccaccagcugugucca

SEQ ID NO: 1456048 - RNA, 14 nt, Human
uaccaccagcugug

SEQ ID NO: 1456049 - RNA, 13 nt, Human
uaccaccagcugu

SEQ ID NO: 1456050 - RNA, 18 nt, Human
uaccaccagucugacugu

SEQ ID NO: 1456051 - RNA, 23 nt, Human
uaccacaggaaccacaagacugc

SEQ ID NO: 1456052 - RNA, 17 nt, Human
uaccaaugaaaaaaugu

SEQ ID NO: 1456053 - RNA, 15 nt, Human
uaccaaugaaaaaau

SEQ ID NO: 1456054 - RNA, 13 nt, Human
uaccaaugaaaaa

SEQ ID NO: 1456055 - RNA, 22 nt, Human
uaccaaucauuuuaauuauuau

SEQ ID NO: 1456056 - RNA, 20 nt, Human
uaccaaucauuuuaauuauu

SEQ ID NO: 1456057 - RNA, 19 nt, Human
uaccaaucauuuuaauuau

SEQ ID NO: 1456058 - RNA, 15 nt, Human
uaccaaucauuuuaa

SEQ ID NO: 1456059 - RNA, 18 nt, Human
uaccacaaugcagugccu

SEQ ID NO: 1456060 - RNA, 13 nt, Human
uaccacagacaua

SEQ ID NO: 1456061 - RNA, 14 nt, Human
uaccaagucaaacu

SEQ ID NO: 1456062 - RNA, 18 nt, Human
uaccaaggucuucuuaau

SEQ ID NO: 1456063 - RNA, 12 nt, Human
uaccaauaaagu

SEQ ID NO: 1456064 - RNA, 13 nt, Human
uaccaauaaagug

SEQ ID NO: 1456065 - RNA, 17 nt, Human
uaccaauaaagugaccc

SEQ ID NO: 1456066 - RNA, 14 nt, Human
uaccaauaaaguga

SEQ ID NO: 1456067 - RNA, 22 nt, Human
uacccaccgggccacuccuucc

SEQ ID NO: 1456068 - RNA, 20 nt, Human
uacccaccgggccacuccuu

SEQ ID NO: 1456069 - RNA, 12 nt, Human
uacccacccaga

SEQ ID NO: 1456070 - RNA, 15 nt, Human
uacccaaacugcuuu

SEQ ID NO: 1456071 - RNA, 14 nt, Human
uacccaaacugcuu

SEQ ID NO: 1456072 - RNA, 15 nt, Human
uacccaaauuaagag

SEQ ID NO: 1456073 - RNA, 20 nt, Human
uacacugucagcagggacug

SEQ ID NO: 1456074 - RNA, 14 nt, Human
uacacuguuucaaa

SEQ ID NO: 1456075 - RNA, 15 nt, Human
uacacagcucuagac

SEQ ID NO: 1456076 - RNA, 17 nt, Human
uacacagcaccagaaug

SEQ ID NO: 1456077 - RNA, 22 nt, Human
uacacagaucacagcuucagcc

SEQ ID NO: 1456078 - RNA, 22 nt, Human
uacacacugcauguuugugauu

SEQ ID NO: 1456079 - RNA, 14 nt, Human
uacacaauaagcaa

SEQ ID NO: 1456080 - RNA, 18 nt, Human
uacacaauagaauuauaa

SEQ ID NO: 1456081 - RNA, 16 nt, Human
uacacaauagaauuau

SEQ ID NO: 1456082 - RNA, 15 nt, Human
uacacaauaagcaaa

SEQ ID NO: 1456083 - RNA, 14 nt, Human
uaauuuuguaucuu

SEQ ID NO: 1456084 - RNA, 19 nt, Human
uaauuuuguaauguaucaa

SEQ ID NO: 1456085 - RNA, 12 nt, Human
uaauuuuguaau

SEQ ID NO: 1456086 - RNA, 13 nt, Human
uaauuuugugaag

SEQ ID NO: 1456087 - RNA, 13 nt, Human
uaauuuuggauuu

SEQ ID NO: 1456088 - RNA, 22 nt, Human
uaauuuugaagugcuguuuauu

SEQ ID NO: 1456089 - RNA, 18 nt, Human
uaauuuugaagugcuguu

SEQ ID NO: 1456090 - RNA, 12 nt, Human
uaauuuucuacc

SEQ ID NO: 1456091 - RNA, 13 nt, Human
uaauuuugaaaaa

SEQ ID NO: 1456092 - RNA, 17 nt, Human
uaauuuugaaaaacugc

SEQ ID NO: 1456093 - RNA, 24 nt, Human
uacaagaugaaggagaggcaacau

SEQ ID NO: 1456094 - RNA, 22 nt, Human
uacaagacugccauauuaaauu

SEQ ID NO: 1456095 - RNA, 23 nt, Human
uacaagagaaaaagcagaggcca

SEQ ID NO: 1456096 - RNA, 20 nt, Human
uacaagacugccauauuaaa

SEQ ID NO: 1456097 - RNA, 19 nt, Human
uacaagacugccauauuaa

SEQ ID NO: 1456098 - RNA, 16 nt, Human
uacaagacugccauau

SEQ ID NO: 1456099 - RNA, 19 nt, Human
uacaagaagcauuuuguaa

SEQ ID NO: 1456100 - RNA, 21 nt, Human
uacaagaagcauuuuguaagu

SEQ ID NO: 1456101 - RNA, 22 nt, Human
uacacaacucacuccuuuuaaa

SEQ ID NO: 1456102 - RNA, 15 nt, Human
uacacaacucacucc

SEQ ID NO: 1456103 - RNA, 14 nt, Human
uacacaacucacuc

SEQ ID NO: 1456104 - RNA, 13 nt, Human
uacacaacucacu

SEQ ID NO: 1456105 - RNA, 21 nt, Human
uacaauuuuuuuuauuaguau

SEQ ID NO: 1456106 - RNA, 19 nt, Human
uacaauuuuuuuuauuagu

SEQ ID NO: 1456107 - RNA, 18 nt, Human
uacaauuuuuuuuauuag

SEQ ID NO: 1456108 - RNA, 23 nt, Human
uacaauuuuuuaucaugcauguc

SEQ ID NO: 1456109 - RNA, 17 nt, Human
uacaauuuuuuaucaug

SEQ ID NO: 1456110 - RNA, 15 nt, Human
uacagccucagaaac

SEQ ID NO: 1456111 - RNA, 13 nt, Human
uacagugucuuuu

SEQ ID NO: 1456112 - RNA, 12 nt, Human
uacagugucuuu

SEQ ID NO: 1456113 - RNA, 13 nt, Human
uacaggaacuuca

SEQ ID NO: 1456114 - RNA, 21 nt, Human
uacaggaaacaguugcaugua

SEQ ID NO: 1456115 - RNA, 15 nt, Human
uacaggaaacaguug

SEQ ID NO: 1456116 - RNA, 13 nt, Human
uacagaaagcugc

SEQ ID NO: 1456117 - RNA, 16 nt, Human
uacagaaaaaccuugg

SEQ ID NO: 1456118 - RNA, 22 nt, Human
uacagaaaaguugaauuuuaca

SEQ ID NO: 1456119 - RNA, 20 nt, Human
uacagaaaaaccuuggguua

SEQ ID NO: 1456120 - RNA, 15 nt, Human
uacagaaaaaccuug

SEQ ID NO: 1456121 - RNA, 18 nt, Human
uacagaaaaguugaauuu

SEQ ID NO: 1456122 - RNA, 17 nt, Human
uacacuguuucaaacuu

SEQ ID NO: 1456123 - RNA, 18 nt, Human
uacacuguuucaaacuuu

SEQ ID NO: 1456124 - RNA, 19 nt, Human
uacacuguuucaaacuuua

SEQ ID NO: 1456125 - RNA, 16 nt, Human
uacagcacccuguggu

SEQ ID NO: 1456126 - RNA, 15 nt, Human
uacagaauuacugua

SEQ ID NO: 1456127 - RNA, 23 nt, Human
uacagaauuacuguaacugauua

SEQ ID NO: 1456128 - RNA, 13 nt, Human
uacagaauuuuau

SEQ ID NO: 1456129 - RNA, 20 nt, Human
uacagaaauuuaauucagaa

SEQ ID NO: 1456130 - RNA, 19 nt, Human
uacagaaauuuaauucaga

SEQ ID NO: 1456131 - RNA, 14 nt, Human
uacagaaagcugcc

SEQ ID NO: 1456132 - RNA, 19 nt, Human
uacagaacucuuucaaaac

SEQ ID NO: 1456133 - RNA, 17 nt, Human
uacagaacucuuucaaa

SEQ ID NO: 1456134 - RNA, 16 nt, Human
uacagaacucuuucaa

SEQ ID NO: 1456135 - RNA, 11 nt, Human
uacagaacuac

SEQ ID NO: 1456136 - RNA, 19 nt, Human
uacagaacuucagaaagac

SEQ ID NO: 1456137 - RNA, 18 nt, Human
uacagaacuucagaaaga

SEQ ID NO: 1456138 - RNA, 15 nt, Human
uacagaacuucagaa

SEQ ID NO: 1456139 - RNA, 14 nt, Human
uacagaagaaacug

SEQ ID NO: 1456140 - RNA, 23 nt, Human
uaucaucaguguagaaccuaauu

SEQ ID NO: 1456141 - RNA, 11 nt, Human
uaucagugcuu

SEQ ID NO: 1456142 - RNA, 13 nt, Human
uaucagugcuucc

SEQ ID NO: 1456143 - RNA, 22 nt, Human
uaucaucuaccuagauuuaaua

SEQ ID NO: 1456144 - RNA, 17 nt, Human
uaucaucuaccuagauu

SEQ ID NO: 1456145 - RNA, 16 nt, Human
uaucaucuaccuagau

SEQ ID NO: 1456146 - RNA, 17 nt, Human
uaucauccacacaugaa

SEQ ID NO: 1456147 - RNA, 15 nt, Human
uaucauccacacaug

SEQ ID NO: 1456148 - RNA, 14 nt, Human
uaucauccacacau

SEQ ID NO: 1456149 - RNA, 17 nt, Human
uaucaugacaaagacug

SEQ ID NO: 1456150 - RNA, 16 nt, Human
uaucaugacaaagacu

SEQ ID NO: 1456151 - RNA, 21 nt, Human
uaucaggacccagaggaaggg

SEQ ID NO: 1456152 - RNA, 20 nt, Human
uaucaggacccagaggaagg

SEQ ID NO: 1456153 - RNA, 19 nt, Human
uaucaggcaaauuugcauu

SEQ ID NO: 1456154 - RNA, 17 nt, Human
uaucgcugggaaaugag

SEQ ID NO: 1456155 - RNA, 20 nt, Human
uaucgcaccacuguguauuu

SEQ ID NO: 1456156 - RNA, 23 nt, Human
uaucgacuuguuuuugcacaugu

SEQ ID NO: 1456157 - RNA, 19 nt, Human
uaucgucacugcuuaacuu

SEQ ID NO: 1456158 - RNA, 18 nt, Human
uaucguuuucuuaaagug

SEQ ID NO: 1456159 - RNA, 12 nt, Human
uaucucuucagu

SEQ ID NO: 1456160 - RNA, 13 nt, Human
uaucucuucaguc

SEQ ID NO: 1456161 - RNA, 14 nt, Human
uaucucuucagucu

SEQ ID NO: 1456162 - RNA, 22 nt, Human
uaucuaaauauggacugcucag

SEQ ID NO: 1456163 - RNA, 16 nt, Human
uaucucuucagucucu

SEQ ID NO: 1456164 - RNA, 22 nt, Human
uauccuguuugaggaaagcaag

SEQ ID NO: 1456165 - RNA, 21 nt, Human
uauccuguuugaggaaagcaa

SEQ ID NO: 1456166 - RNA, 17 nt, Human
uaucaugugaaaucauu

SEQ ID NO: 1456167 - RNA, 22 nt, Human
uaucaugugaaaucauucauuu

SEQ ID NO: 1456168 - RNA, 13 nt, Human
uauauaauugcca

SEQ ID NO: 1456169 - RNA, 14 nt, Human
uauauaauugccaa

SEQ ID NO: 1456170 - RNA, 16 nt, Human
uauauaaucaucaagu

SEQ ID NO: 1456171 - RNA, 23 nt, Human
uauauaaguguacauaugugcug

SEQ ID NO: 1456172 - RNA, 19 nt, Human
uauauaaguguacauaugu

SEQ ID NO: 1456173 - RNA, 22 nt, Human
uauacuuguggacuaaaagaua

SEQ ID NO: 1456174 - RNA, 23 nt, Human
uauacuuguggacuaaaagauau

SEQ ID NO: 1456175 - RNA, 22 nt, Human
uauacuuguaauuauggaguca

SEQ ID NO: 1456176 - RNA, 17 nt, Human
uauacuuguggacuaaa

SEQ ID NO: 1456177 - RNA, 21 nt, Human
uauacuuguggacuaaaagau

SEQ ID NO: 1456178 - RNA, 18 nt, Human
uauacuuguaauuaugga

SEQ ID NO: 1456179 - RNA, 16 nt, Human
uauacuuguaauuaug

SEQ ID NO: 1456180 - RNA, 15 nt, Human
uauacuuguaauuau

SEQ ID NO: 1456181 - RNA, 14 nt, Human
uauacuuguaauua

SEQ ID NO: 1456182 - RNA, 13 nt, Human
uauacuuguaauu

SEQ ID NO: 1456183 - RNA, 14 nt, Human
uauacuugaaugaa

SEQ ID NO: 1456184 - RNA, 16 nt, Human
uauacuugaaugaaaa

SEQ ID NO: 1456185 - RNA, 21 nt, Human
uauacucucaccauuuggauc

SEQ ID NO: 1456186 - RNA, 21 nt, Human
uauauaccaaagcacauuuua

SEQ ID NO: 1456187 - RNA, 16 nt, Human
uauauaccaaagcaca

SEQ ID NO: 1456188 - RNA, 13 nt, Human
uauaugauggggg

SEQ ID NO: 1456189 - RNA, 19 nt, Human
uauaugaggacuugugucu

SEQ ID NO: 1456190 - RNA, 21 nt, Human
uauaugcacuuauaauuuucc

SEQ ID NO: 1456191 - RNA, 23 nt, Human
uauauuuauuacuguaagaaaau

SEQ ID NO: 1456192 - RNA, 21 nt, Human
uauauggggaugguaguuuuu

SEQ ID NO: 1456193 - RNA, 20 nt, Human
uauauggggaugguaguuuu

SEQ ID NO: 1456194 - RNA, 22 nt, Human
uauauguacccucugaaauaca

SEQ ID NO: 1456195 - RNA, 19 nt, Human
uauauguacccucugaaau

SEQ ID NO: 1456196 - RNA, 18 nt, Human
uauauguacccucugaaa

SEQ ID NO: 1456197 - RNA, 12 nt, Human
uauauguacagu

SEQ ID NO: 1456198 - RNA, 12 nt, Human
uauauguacaug

SEQ ID NO: 1456199 - RNA, 19 nt, Human
uauauguaccguaggcuuu

SEQ ID NO: 1456200 - RNA, 20 nt, Human
uauauuugaaauauugacuu

SEQ ID NO: 1456201 - RNA, 14 nt, Human
uauauuugaaauau

SEQ ID NO: 1456202 - RNA, 13 nt, Human
uauauuugaaaua

SEQ ID NO: 1456203 - RNA, 13 nt, Human
uauauuuuaagaa

SEQ ID NO: 1456204 - RNA, 23 nt, Human
uauauuucuauuuuauuaugaag

SEQ ID NO: 1456205 - RNA, 13 nt, Human
uauauuuuaagac

SEQ ID NO: 1456206 - RNA, 16 nt, Human
uauauuuuacaauuuu

SEQ ID NO: 1456207 - RNA, 14 nt, Human
uauauuuuaagacg

SEQ ID NO: 1456208 - RNA, 15 nt, Human
uauaauucaccuucu

SEQ ID NO: 1456209 - RNA, 16 nt, Human
uauaccuaacugaaua

SEQ ID NO: 1456210 - RNA, 12 nt, Human
uauaccugauuu

SEQ ID NO: 1456211 - RNA, 12 nt, Human
uauaccucacuu

SEQ ID NO: 1456212 - RNA, 15 nt, Human
uauacccacccagaa

SEQ ID NO: 1456213 - RNA, 16 nt, Human
uauaauucucauuaaa

SEQ ID NO: 1456214 - RNA, 15 nt, Human
uauaauucucauuaa

SEQ ID NO: 1456215 - RNA, 22 nt, Human
uauacccacccagaaugagaca

SEQ ID NO: 1456216 - RNA, 22 nt, Human
uauacucuuucuguauauacuu

SEQ ID NO: 1456217 - RNA, 19 nt, Human
uauacucuuucuguauaua

SEQ ID NO: 1456218 - RNA, 17 nt, Human
uauacucuuucuguaua

SEQ ID NO: 1456219 - RNA, 16 nt, Human
uauacucuuucuguau

SEQ ID NO: 1456220 - RNA, 18 nt, Human
uauacucuagaugaaguu

SEQ ID NO: 1456221 - RNA, 21 nt, Human
uauacuauuaaaaagguuuac

SEQ ID NO: 1456222 - RNA, 20 nt, Human
uauaccugauuuuuuuuccu

SEQ ID NO: 1456223 - RNA, 17 nt, Human
uauacuauaguaccagu

SEQ ID NO: 1456224 - RNA, 19 nt, Human
uauacuauuaaaaagguuu

SEQ ID NO: 1456225 - RNA, 16 nt, Human
uauacuauauuuaugg

SEQ ID NO: 1456226 - RNA, 20 nt, Human
uauacuauaguaccaguagg

SEQ ID NO: 1456227 - RNA, 16 nt, Human
uauaaugaauuuagug

SEQ ID NO: 1456228 - RNA, 18 nt, Human
uauaacaaugcuguauuu

SEQ ID NO: 1456229 - RNA, 14 nt, Human
uaguuuuacuuuua

SEQ ID NO: 1456230 - RNA, 19 nt, Human
uaguuuguguguugucucu

SEQ ID NO: 1456231 - RNA, 11 nt, Human
uaguuuggaua

SEQ ID NO: 1456232 - RNA, 21 nt, Human
uaguuugauuauucaguguca

SEQ ID NO: 1456233 - RNA, 19 nt, Human
uauaaauauauuauuacuu

SEQ ID NO: 1456234 - RNA, 15 nt, Human
uauaaauauauuuaa

SEQ ID NO: 1456235 - RNA, 15 nt, Human
uauaaauauauuauu

SEQ ID NO: 1456236 - RNA, 19 nt, Human
uauaaauauauauucuauu

SEQ ID NO: 1456237 - RNA, 22 nt, Human
uaguuuuacuuuuaaacugugu

SEQ ID NO: 1456238 - RNA, 20 nt, Human
uaguuuuacuuuuaaacugu

SEQ ID NO: 1456239 - RNA, 15 nt, Human
uaguuuuauaugcuu

SEQ ID NO: 1456240 - RNA, 13 nt, Human
uaguuuccuuuuu

SEQ ID NO: 1456241 - RNA, 20 nt, Human
uaguuucauauaaaguauca

SEQ ID NO: 1456242 - RNA, 19 nt, Human
uaguuucauauaaaguauc

SEQ ID NO: 1456243 - RNA, 21 nt, Human
uaguuucaguagauugcagaa

SEQ ID NO: 1456244 - RNA, 15 nt, Human
uaguuguguuucaac

SEQ ID NO: 1456245 - RNA, 12 nt, Human
uaguugugucug

SEQ ID NO: 1456246 - RNA, 17 nt, Human
uaguugucuuuccuggc

SEQ ID NO: 1456247 - RNA, 13 nt, Human
uaguuucugaggc

SEQ ID NO: 1456248 - RNA, 23 nt, Human
uaguuugauuaaauucuugcaaa

SEQ ID NO: 1456249 - RNA, 23 nt, Human
uaguggauuacugccauucacuu

SEQ ID NO: 1456250 - RNA, 17 nt, Human
uaguggauuacugccau

SEQ ID NO: 1456251 - RNA, 19 nt, Human
uaguguaugauuacuggcc

SEQ ID NO: 1456252 - RNA, 15 nt, Human
uaguguaugauuacu

SEQ ID NO: 1456253 - RNA, 18 nt, Human
uaguuguaaaccaaguga

SEQ ID NO: 1456254 - RNA, 15 nt, Human
uaguggaaaaggcac

SEQ ID NO: 1456255 - RNA, 15 nt, Human
uagugcuuugagaga

SEQ ID NO: 1456256 - RNA, 12 nt, Human
uagugcuuugag

SEQ ID NO: 1456257 - RNA, 22 nt, Human
uagugcugcugugugcuuuuuu

SEQ ID NO: 1456258 - RNA, 15 nt, Human
uagugcuacaggguc

SEQ ID NO: 1456259 - RNA, 17 nt, Human
uagugcuacagggucca

SEQ ID NO: 1456260 - RNA, 22 nt, Human
uagugauuuuuaugccaccuga

SEQ ID NO: 1456261 - RNA, 14 nt, Human
uagugcuaagugug

SEQ ID NO: 1456262 - RNA, 15 nt, Human
uagugcuaaguguga

SEQ ID NO: 1456263 - RNA, 17 nt, Human
uagugcuaagugugaac

SEQ ID NO: 1456264 - RNA, 18 nt, Human
uagugcuaagugugaacu

SEQ ID NO: 1456265 - RNA, 19 nt, Human
uagugcuaagugugaacug

SEQ ID NO: 1456266 - RNA, 21 nt, Human
uagugauuuuuaugccaccug

SEQ ID NO: 1456267 - RNA, 20 nt, Human
uagugauuuuuaugccaccu

SEQ ID NO: 1456268 - RNA, 22 nt, Human
uaggcggggcuugccuucuggu

SEQ ID NO: 1456269 - RNA, 19 nt, Human
uaggcggggcuugccuucu

SEQ ID NO: 1456270 - RNA, 23 nt, Human
uaggcgaucacaacgugcauugu

SEQ ID NO: 1456271 - RNA, 23 nt, Human
uaggccuugcggcuccucaggga

SEQ ID NO: 1456272 - RNA, 24 nt, Human
uaggccuugcggcuccucagggac

SEQ ID NO: 1456273 - RNA, 13 nt, Human
uaggcgaucacaa

SEQ ID NO: 1456274 - RNA, 17 nt, Human
uaggcuacagagaagcc

SEQ ID NO: 1456275 - RNA, 16 nt, Human
uaggcuacagagaagc

SEQ ID NO: 1456276 - RNA, 15 nt, Human
uaggcuacagagaag

SEQ ID NO: 1456277 - RNA, 14 nt, Human
uaggcuacagagaa

SEQ ID NO: 1456278 - RNA, 13 nt, Human
uaggcuacagaga

SEQ ID NO: 1456279 - RNA, 12 nt, Human
uaggcuacagag

SEQ ID NO: 1456280 - RNA, 21 nt, Human
uaggcuacagagaagccuuca

SEQ ID NO: 1456281 - RNA, 20 nt, Human
uaggcuacagagaagccuuc

SEQ ID NO: 1456282 - RNA, 19 nt, Human
uaggcuacagagaagccuu

SEQ ID NO: 1456283 - RNA, 18 nt, Human
uaggcuacagagaagccu

SEQ ID NO: 1456284 - RNA, 13 nt, Human
uaggcuagggugg

SEQ ID NO: 1456285 - RNA, 19 nt, Human
uagucaaugacaugaauuu

SEQ ID NO: 1456286 - RNA, 18 nt, Human
uagucaaugacaugaauu

SEQ ID NO: 1456287 - RNA, 21 nt, Human
uagucaaucaagucuguuuac

SEQ ID NO: 1456288 - RNA, 19 nt, Human
uagucaaucaagucuguuu

SEQ ID NO: 1456289 - RNA, 18 nt, Human
uagucaaucaagucuguu

SEQ ID NO: 1456290 - RNA, 15 nt, Human
uagucaaucaagucu

SEQ ID NO: 1456291 - RNA, 15 nt, Human
uaggcuagggugggg

SEQ ID NO: 1456292 - RNA, 18 nt, Human
uagucaaauugugugaaa

SEQ ID NO: 1456293 - RNA, 16 nt, Human
uagccucugucuggca

SEQ ID NO: 1456294 - RNA, 15 nt, Human
uagccugaguagaaa

SEQ ID NO: 1456295 - RNA, 22 nt, Human
uagccucaggggucugagcucc

SEQ ID NO: 1456296 - RNA, 12 nt, Human
uagccucagggg

SEQ ID NO: 1456297 - RNA, 18 nt, Human
uagccucacuuuuaauga

SEQ ID NO: 1456298 - RNA, 23 nt, Human
uagccucacuuuuaaugaacaaa

SEQ ID NO: 1456299 - RNA, 19 nt, Human
uagccucaauuucugaaca

SEQ ID NO: 1456300 - RNA, 17 nt, Human
uagcccuguccuggugg

SEQ ID NO: 1456301 - RNA, 22 nt, Human
uagcccuguccuggugguauuu

SEQ ID NO: 1456302 - RNA, 15 nt, Human
uagcccuguccuggu

SEQ ID NO: 1456303 - RNA, 14 nt, Human
uagcccuguccugg

SEQ ID NO: 1456304 - RNA, 13 nt, Human
uagcccuguccug

SEQ ID NO: 1456305 - RNA, 20 nt, Human
uagcccuccuuuuuccaaca

SEQ ID NO: 1456306 - RNA, 18 nt, Human
uagcccuccuuuuuccaa

SEQ ID NO: 1456307 - RNA, 17 nt, Human
uagccccagugacagcu

SEQ ID NO: 1456308 - RNA, 13 nt, Human
uagccccagugac

SEQ ID NO: 1456309 - RNA, 21 nt, Human
uagcccacuuacauuuacaaa

SEQ ID NO: 1456310 - RNA, 18 nt, Human
uagcccaaugaaaugaau

SEQ ID NO: 1456311 - RNA, 18 nt, Human
uagcaguggcaggcagag

SEQ ID NO: 1456312 - RNA, 16 nt, Human
uagcaguggcaggcag

SEQ ID NO: 1456313 - RNA, 15 nt, Human
uagcaguggcaggca

SEQ ID NO: 1456314 - RNA, 16 nt, Human
uagcaguccccuuccc

SEQ ID NO: 1456315 - RNA, 24 nt, Human
uagcaguggcaggcagaggcccag

SEQ ID NO: 1456316 - RNA, 16 nt, Human
uagcauacguacacau

SEQ ID NO: 1456317 - RNA, 15 nt, Human
uagcuccuccccugg

SEQ ID NO: 1456318 - RNA, 11 nt, Human
uagcuccuccc

SEQ ID NO: 1456319 - RNA, 22 nt, Human
uagcucauucuccuuguguuac

SEQ ID NO: 1456320 - RNA, 16 nt, Human
uagcuccuguggcccc

SEQ ID NO: 1456321 - RNA, 14 nt, Human
uagcuccuguggcc

SEQ ID NO: 1456322 - RNA, 13 nt, Human
uagcuccuguggc

SEQ ID NO: 1456323 - RNA, 12 nt, Human
uagcuccugugg

SEQ ID NO: 1456324 - RNA, 22 nt, Human
uagcuccuguggccccacccug

SEQ ID NO: 1456325 - RNA, 20 nt, Human
uagcuccuguggccccaccc

SEQ ID NO: 1456326 - RNA, 12 nt, Human
uagcuccucccc

SEQ ID NO: 1456327 - RNA, 13 nt, Human
uagcucugagaac

SEQ ID NO: 1456328 - RNA, 11 nt, Human
uagcucugaga

SEQ ID NO: 1456329 - RNA, 13 nt, Human
uagcucuuuguca

SEQ ID NO: 1456330 - RNA, 23 nt, Human
uagcucuuguugagccgugggca

SEQ ID NO: 1456331 - RNA, 12 nt, Human
uagcucugagaa

SEQ ID NO: 1456332 - RNA, 23 nt, Human
uagcucuggggugggcaguuuuu

SEQ ID NO: 1456333 - RNA, 22 nt, Human
uagcucuggggugggcaguuuu

SEQ ID NO: 1456334 - RNA, 11 nt, Human
uagcucugggg

SEQ ID NO: 1456335 - RNA, 21 nt, Human
uaggaaauguuuuuaauaaaa

SEQ ID NO: 1456336 - RNA, 23 nt, Human
uaggaaauggcuuugugauucaa

SEQ ID NO: 1456337 - RNA, 22 nt, Human
uaggaaauggcuuugugauuca

SEQ ID NO: 1456338 - RNA, 15 nt, Human
uagcugggauuacag

SEQ ID NO: 1456339 - RNA, 21 nt, Human
uaggaacuuaaauaaugugaa

SEQ ID NO: 1456340 - RNA, 14 nt, Human
uaggaagccucaga

SEQ ID NO: 1456341 - RNA, 21 nt, Human
uaggaagagccuuccacccag

SEQ ID NO: 1456342 - RNA, 18 nt, Human
uaggaagagcaggacucc

SEQ ID NO: 1456343 - RNA, 19 nt, Human
uaggaagaaagaagacaaa

SEQ ID NO: 1456344 - RNA, 17 nt, Human
uaggaagaaagaagaca

SEQ ID NO: 1456345 - RNA, 12 nt, Human
uaggaagaaaga

SEQ ID NO: 1456346 - RNA, 16 nt, Human
uaggccagagcccacu

SEQ ID NO: 1456347 - RNA, 14 nt, Human
uaggccagagccca

SEQ ID NO: 1456348 - RNA, 22 nt, Human
uaggccaagguguccuacagaa

SEQ ID NO: 1456349 - RNA, 23 nt, Human
uaggccaagguguccuacagaaa

SEQ ID NO: 1456350 - RNA, 21 nt, Human
uaggccaagguguccuacaga

SEQ ID NO: 1456351 - RNA, 18 nt, Human
uaggccaagguguccuac

SEQ ID NO: 1456352 - RNA, 19 nt, Human
uaggccucaggugaaacuc

SEQ ID NO: 1456353 - RNA, 21 nt, Human
uaggccuugcggcuccucagg

SEQ ID NO: 1456354 - RNA, 23 nt, Human
uaggccagcaagcggggaugucc

SEQ ID NO: 1456355 - RNA, 22 nt, Human
uaggccagccgcgcaucagacu

SEQ ID NO: 1456356 - RNA, 13 nt, Human
uaggccagcaagc

SEQ ID NO: 1456357 - RNA, 17 nt, Human
uaggccagagcccacuc

SEQ ID NO: 1456358 - RNA, 16 nt, Human
uaggaaguaaauuaua

SEQ ID NO: 1456359 - RNA, 17 nt, Human
uaggaaguugacuuaua

SEQ ID NO: 1456360 - RNA, 14 nt, Human
uaggaauuguguuu

SEQ ID NO: 1456361 - RNA, 22 nt, Human
uaggaaguugacuuauaguaca

SEQ ID NO: 1456362 - RNA, 16 nt, Human
uaggaauuguguuuau

SEQ ID NO: 1456363 - RNA, 18 nt, Human
uagagacuggaacacuag

SEQ ID NO: 1456364 - RNA, 14 nt, Human
uagagacuggaaca

SEQ ID NO: 1456365 - RNA, 19 nt, Human
uagagguucaaagauauuu

SEQ ID NO: 1456366 - RNA, 16 nt, Human
uagagguucaaagaua

SEQ ID NO: 1456367 - RNA, 21 nt, Human
uagagguucaaagauauuuug

SEQ ID NO: 1456368 - RNA, 20 nt, Human
uagagucccagguuggcucu

SEQ ID NO: 1456369 - RNA, 12 nt, Human
uagaguugcuga

SEQ ID NO: 1456370 - RNA, 16 nt, Human
uagaguccaagguuua

SEQ ID NO: 1456371 - RNA, 13 nt, Human
uagaguccaaggu

SEQ ID NO: 1456372 - RNA, 17 nt, Human
uagaguagaagucucuu

SEQ ID NO: 1456373 - RNA, 21 nt, Human
uagauaaaacaucuuugaaau

SEQ ID NO: 1456374 - RNA, 20 nt, Human
uagauaaaacaucuuugaaa

SEQ ID NO: 1456375 - RNA, 19 nt, Human
uagauaaaacaucuuugaa

SEQ ID NO: 1456376 - RNA, 18 nt, Human
uagaguuuuuaaacauca

SEQ ID NO: 1456377 - RNA, 16 nt, Human
uagaguugcugagagg

SEQ ID NO: 1456378 - RNA, 14 nt, Human
uagaguuggccaua

SEQ ID NO: 1456379 - RNA, 14 nt, Human
uagaguugcugaga

SEQ ID NO: 1456380 - RNA, 13 nt, Human
uagaguugcugag

SEQ ID NO: 1456381 - RNA, 18 nt, Human
uagaguuuagcuggaaaa

SEQ ID NO: 1456382 - RNA, 17 nt, Human
uagaguuuagcuggaaa

SEQ ID NO: 1456383 - RNA, 21 nt, Human
uagacucuuuuccuucccuuu

SEQ ID NO: 1456384 - RNA, 16 nt, Human
uagaccuccagcuguu

SEQ ID NO: 1456385 - RNA, 15 nt, Human
uagaccuacaggggg

SEQ ID NO: 1456386 - RNA, 13 nt, Human
uagaccuacaggg

SEQ ID NO: 1456387 - RNA, 12 nt, Human
uagaccuacagg

SEQ ID NO: 1456388 - RNA, 23 nt, Human
uagaaccuaauucaauucaaagc

SEQ ID NO: 1456389 - RNA, 15 nt, Human
uagaaccuaauucaa

SEQ ID NO: 1456390 - RNA, 21 nt, Human
uagaacccucuguuccuuccc

SEQ ID NO: 1456391 - RNA, 22 nt, Human
uagaacccucuguuccuucccu

SEQ ID NO: 1456392 - RNA, 21 nt, Human
uagacuuuaacauaagcuauu

SEQ ID NO: 1456393 - RNA, 14 nt, Human
uagacuuuaacaua

SEQ ID NO: 1456394 - RNA, 16 nt, Human
uagacuuggauucuuu

SEQ ID NO: 1456395 - RNA, 20 nt, Human
uagacuuggauucuuuccau

SEQ ID NO: 1456396 - RNA, 16 nt, Human
uagacuggacagcuug

SEQ ID NO: 1456397 - RNA, 13 nt, Human
uagagaagacagg

SEQ ID NO: 1456398 - RNA, 18 nt, Human
uagacuggacagcuugug

SEQ ID NO: 1456399 - RNA, 14 nt, Human
uagacuggacagcu

SEQ ID NO: 1456400 - RNA, 19 nt, Human
uagacuggaacuugaacug

SEQ ID NO: 1456401 - RNA, 11 nt, Human
uagcagacagg

SEQ ID NO: 1456402 - RNA, 23 nt, Human
uagcagaagguugcaccuccccc

SEQ ID NO: 1456403 - RNA, 13 nt, Human
uagauuuaauaua

SEQ ID NO: 1456404 - RNA, 20 nt, Human
uagauuguccuuuugcaaag

SEQ ID NO: 1456405 - RNA, 23 nt, Human
uagauuuaauauaaaguuuuaua

SEQ ID NO: 1456406 - RNA, 23 nt, Human
uagauuguccuuuugcaaagaaa

SEQ ID NO: 1456407 - RNA, 18 nt, Human
uagauuguccuuuugcaa

SEQ ID NO: 1456408 - RNA, 12 nt, Human
uagauugcagaa

SEQ ID NO: 1456409 - RNA, 23 nt, Human
uagauugcagaaaauucugugcc

SEQ ID NO: 1456410 - RNA, 23 nt, Human
uagauugauuguauuguugaaaa

SEQ ID NO: 1456411 - RNA, 16 nt, Human
uagauugauuguauug

SEQ ID NO: 1456412 - RNA, 14 nt, Human
uagauugauuguau

SEQ ID NO: 1456413 - RNA, 23 nt, Human
uagauucucuuguauaagauccu

SEQ ID NO: 1456414 - RNA, 23 nt, Human
uagauucucugugucuaagauuc

SEQ ID NO: 1456415 - RNA, 22 nt, Human
uagauucucugugucuaagauu

SEQ ID NO: 1456416 - RNA, 21 nt, Human
uagauucucugugucuaagau

SEQ ID NO: 1456417 - RNA, 20 nt, Human
uagauucucugugucuaaga

SEQ ID NO: 1456418 - RNA, 19 nt, Human
uagauucucugugucuaag

SEQ ID NO: 1456419 - RNA, 23 nt, Human
uagauucucuggcuguaaggcuc

SEQ ID NO: 1456420 - RNA, 22 nt, Human
uagauucucuggcuguaaggcu

SEQ ID NO: 1456421 - RNA, 18 nt, Human
uagauucuaaagauucua

SEQ ID NO: 1456422 - RNA, 17 nt, Human
uagauucuaaagauucu

SEQ ID NO: 1456423 - RNA, 15 nt, Human
uagauucuaaagauu

SEQ ID NO: 1456424 - RNA, 21 nt, Human
uagauguuuauucuucuagag

SEQ ID NO: 1456425 - RNA, 20 nt, Human
uagauguuuauucuucuaga

SEQ ID NO: 1456426 - RNA, 23 nt, Human
uagauguucucuaucauuuaaua

SEQ ID NO: 1456427 - RNA, 16 nt, Human
uagauuuaauauaaag

SEQ ID NO: 1456428 - RNA, 20 nt, Human
uagcagcaccguucugugca

SEQ ID NO: 1456429 - RNA, 19 nt, Human
uagcagcaccguucugugc

SEQ ID NO: 1456430 - RNA, 15 nt, Human
uagcagacaguguuu

SEQ ID NO: 1456431 - RNA, 19 nt, Human
uagcagacaggccccguga

SEQ ID NO: 1456432 - RNA, 13 nt, Human
uagcagacaggcc

SEQ ID NO: 1456433 - RNA, 22 nt, Human
uagaugggggaaagcaaagcac

SEQ ID NO: 1456434 - RNA, 21 nt, Human
uagaugggagggaggcucagg

SEQ ID NO: 1456435 - RNA, 16 nt, Human
uagauguaauuuugug

SEQ ID NO: 1456436 - RNA, 22 nt, Human
uagauacccuacgcuguccaga

SEQ ID NO: 1456437 - RNA, 23 nt, Human
uagauaaaacaucuuugaaauua

SEQ ID NO: 1456438 - RNA, 23 nt, Human
uagauaacaagaccucagugccu

SEQ ID NO: 1456439 - RNA, 18 nt, Human
uagauaauacaccacuac

SEQ ID NO: 1456440 - RNA, 21 nt, Human
uagauguucuaagucuuucca

SEQ ID NO: 1456441 - RNA, 14 nt, Human
uagauguucucuau

SEQ ID NO: 1456442 - RNA, 18 nt, Human
uagauguuccaguaaucu

SEQ ID NO: 1456443 - RNA, 18 nt, Human
uagauguucucuaucauu

SEQ ID NO: 1456444 - RNA, 19 nt, Human
uagauguucucuaucauuu

SEQ ID NO: 1456445 - RNA, 21 nt, Human
uagauguucucuaucauuuaa

SEQ ID NO: 1456446 - RNA, 22 nt, Human
uagauguucucuaucauuuaau

SEQ ID NO: 1456447 - RNA, 13 nt, Human
uagaugucuuuuc

SEQ ID NO: 1456448 - RNA, 20 nt, Human
uagaugucuuuucccauuua

SEQ ID NO: 1456449 - RNA, 20 nt, Human
uagauguauguacuucaugc

SEQ ID NO: 1456450 - RNA, 16 nt, Human
uagauguauaacuagg

SEQ ID NO: 1456451 - RNA, 17 nt, Human
uagauguaguauuuuuu

SEQ ID NO: 1456452 - RNA, 15 nt, Human
uagauguaguauuuu

SEQ ID NO: 1456453 - RNA, 16 nt, Human
uagauguauguacuuc

SEQ ID NO: 1456454 - RNA, 23 nt, Human
uaagauccuagauccuaaggguc

SEQ ID NO: 1456455 - RNA, 13 nt, Human
uaagauaauuaua

SEQ ID NO: 1456456 - RNA, 12 nt, Human
uaagauaauuau

SEQ ID NO: 1456457 - RNA, 14 nt, Human
uaagagugcugggc

SEQ ID NO: 1456458 - RNA, 18 nt, Human
uaagaguccaagaaucca

SEQ ID NO: 1456459 - RNA, 21 nt, Human
uaagaguagaaacugcaggga

SEQ ID NO: 1456460 - RNA, 18 nt, Human
uaagagguguuauuugga

SEQ ID NO: 1456461 - RNA, 20 nt, Human
uaagaggcugcccuccugug

SEQ ID NO: 1456462 - RNA, 17 nt, Human
uaagaggcugcccuccu

SEQ ID NO: 1456463 - RNA, 13 nt, Human
uaagaaauagaau

SEQ ID NO: 1456464 - RNA, 15 nt, Human
uaagaaauacagacu

SEQ ID NO: 1456465 - RNA, 22 nt, Human
uaagaaaggaagcauuguaaaa

SEQ ID NO: 1456466 - RNA, 23 nt, Human
uaagaaaggaagcauuguaaaau

SEQ ID NO: 1456467 - RNA, 21 nt, Human
uaagaaaggaagcauuguaaa

SEQ ID NO: 1456468 - RNA, 20 nt, Human
uaagaaaggaagcauuguaa

SEQ ID NO: 1456469 - RNA, 18 nt, Human
uaagaaaggaagcauugu

SEQ ID NO: 1456470 - RNA, 15 nt, Human
uaagaaaggaagcau

SEQ ID NO: 1456471 - RNA, 17 nt, Human
uaagaaagccugaguac

SEQ ID NO: 1456472 - RNA, 15 nt, Human
uaagaaagccugagu

SEQ ID NO: 1456473 - RNA, 14 nt, Human
uaagaaagccugag

SEQ ID NO: 1456474 - RNA, 13 nt, Human
uaagaaagccuga

SEQ ID NO: 1456475 - RNA, 21 nt, Human
uaacuuuuauaaacuuuaccu

SEQ ID NO: 1456476 - RNA, 22 nt, Human
uaacuuuuauaaacuuuaccuu

SEQ ID NO: 1456477 - RNA, 16 nt, Human
uaagaggcugcccucc

SEQ ID NO: 1456478 - RNA, 22 nt, Human
uaagagcucaggaugagggaaa

SEQ ID NO: 1456479 - RNA, 15 nt, Human
uaagagcucaggaug

SEQ ID NO: 1456480 - RNA, 14 nt, Human
uaagagcucaggau

SEQ ID NO: 1456481 - RNA, 12 nt, Human
uaagagcucagg

SEQ ID NO: 1456482 - RNA, 20 nt, Human
uaagagcaaaagaauggcag

SEQ ID NO: 1456483 - RNA, 22 nt, Human
uaagagcaaaagaauggcagaa

SEQ ID NO: 1456484 - RNA, 23 nt, Human
uaagaagcacgugguaaaacacu

SEQ ID NO: 1456485 - RNA, 21 nt, Human
uaagaagaaugcuuaaucaga

SEQ ID NO: 1456486 - RNA, 17 nt, Human
uaagagagucuauuuac

SEQ ID NO: 1456487 - RNA, 22 nt, Human
uaagccagcaccggaccagccu

SEQ ID NO: 1456488 - RNA, 23 nt, Human
uaagccagcaccggaccagccug

SEQ ID NO: 1456489 - RNA, 17 nt, Human
uaagccagcaccggacc

SEQ ID NO: 1456490 - RNA, 20 nt, Human
uaagccacuuaaaauguuca

SEQ ID NO: 1456491 - RNA, 19 nt, Human
uaaggaugcuuguacauaa

SEQ ID NO: 1456492 - RNA, 19 nt, Human
uaaggauggagccagcucu

SEQ ID NO: 1456493 - RNA, 20 nt, Human
uaaggauggagccagcucug

SEQ ID NO: 1456494 - RNA, 15 nt, Human
uaaggcaaucauggu

SEQ ID NO: 1456495 - RNA, 20 nt, Human
uaaggaugcuuguacauaau

SEQ ID NO: 1456496 - RNA, 21 nt, Human
uaaggaugcuuguacauaaug

SEQ ID NO: 1456497 - RNA, 22 nt, Human
uaaggaugcuuguacauaaugc

SEQ ID NO: 1456498 - RNA, 23 nt, Human
uaaggaugcuuguacauaaugcg

SEQ ID NO: 1456499 - RNA, 17 nt, Human
uaagaucuauagccucu

SEQ ID NO: 1456500 - RNA, 20 nt, Human
uaagaucuuagauucucugu

SEQ ID NO: 1456501 - RNA, 17 nt, Human
uaagaucuuagauucuc

SEQ ID NO: 1456502 - RNA, 16 nt, Human
uaagaucuuagauucu

SEQ ID NO: 1456503 - RNA, 14 nt, Human
uaagaucuuagauu

SEQ ID NO: 1456504 - RNA, 18 nt, Human
uaagaucuuuuauuuugc

SEQ ID NO: 1456505 - RNA, 14 nt, Human
uaagcaucuaaguu

SEQ ID NO: 1456506 - RNA, 22 nt, Human
uaagcaucauuauuuauguauu

SEQ ID NO: 1456507 - RNA, 23 nt, Human
uaagcaucauuauuuauguauug

SEQ ID NO: 1456508 - RNA, 21 nt, Human
uaagcaucauuauuuauguau

SEQ ID NO: 1456509 - RNA, 20 nt, Human
uaagcaucauuauuuaugua

SEQ ID NO: 1456510 - RNA, 19 nt, Human
uaagcaucauuauuuaugu

SEQ ID NO: 1456511 - RNA, 14 nt, Human
uaagcaucauuauu

SEQ ID NO: 1456512 - RNA, 18 nt, Human
uaagcaucuggcucuaau

SEQ ID NO: 1456513 - RNA, 15 nt, Human
uaagcaugcacaaau

SEQ ID NO: 1456514 - RNA, 16 nt, Human
uaagccaaaacaaugu

SEQ ID NO: 1456515 - RNA, 19 nt, Human
uaagccacuuaaaauguuc

SEQ ID NO: 1456516 - RNA, 17 nt, Human
uaagccacuuaaaaugu

SEQ ID NO: 1456517 - RNA, 22 nt, Human
uaagcauugaauggcuauguuu

SEQ ID NO: 1456518 - RNA, 20 nt, Human
uaagcauuccaacuaucuca

SEQ ID NO: 1456519 - RNA, 18 nt, Human
uaagcauuccaacuaucu

SEQ ID NO: 1456520 - RNA, 16 nt, Human
uaagcauuccaacuau

SEQ ID NO: 1456521 - RNA, 18 nt, Human
uaaccucaucuucuucac

SEQ ID NO: 1456522 - RNA, 14 nt, Human
uaaccucaucuucu

SEQ ID NO: 1456523 - RNA, 20 nt, Human
uaaccuaugauauuuucugu

SEQ ID NO: 1456524 - RNA, 23 nt, Human
uaaccgagaucaguauuuaacua

SEQ ID NO: 1456525 - RNA, 14 nt, Human
uaacucaucuguca

SEQ ID NO: 1456526 - RNA, 16 nt, Human
uaacucauuagacugg

SEQ ID NO: 1456527 - RNA, 12 nt, Human
uaacucauuaga

SEQ ID NO: 1456528 - RNA, 15 nt, Human
uaacucaucugucac

SEQ ID NO: 1456529 - RNA, 17 nt, Human
uaacugggggaaaagau

SEQ ID NO: 1456530 - RNA, 15 nt, Human
uaacugccuagaaac

SEQ ID NO: 1456531 - RNA, 16 nt, Human
uaacugccuagaaaca

SEQ ID NO: 1456532 - RNA, 14 nt, Human
uaacugccuagaaa

SEQ ID NO: 1456533 - RNA, 17 nt, Human
uaacugccguaauuuaa

SEQ ID NO: 1456534 - RNA, 21 nt, Human
uaacugcccaaagcagcacuu

SEQ ID NO: 1456535 - RNA, 17 nt, Human
uaacugcccaaagcagc

SEQ ID NO: 1456536 - RNA, 11 nt, Human
uaacugccagg

SEQ ID NO: 1456537 - RNA, 14 nt, Human
uaacugcauacacu

SEQ ID NO: 1456538 - RNA, 18 nt, Human
uaacuguaaaugugacau

SEQ ID NO: 1456539 - RNA, 23 nt, Human
uaacuguaaagauguuuauuuca

SEQ ID NO: 1456540 - RNA, 15 nt, Human
uaacuguaaagaugu

SEQ ID NO: 1456541 - RNA, 20 nt, Human
uaacuggguaaugaaacaaa

SEQ ID NO: 1456542 - RNA, 19 nt, Human
uaacuggguaaugaaacaa

SEQ ID NO: 1456543 - RNA, 17 nt, Human
uaacuggguaaugaaac

SEQ ID NO: 1456544 - RNA, 14 nt, Human
uaacuguauuugaa

SEQ ID NO: 1456545 - RNA, 22 nt, Human
uaacuguauuugaaauaagaau

SEQ ID NO: 1456546 - RNA, 12 nt, Human
uaacuguauuug

SEQ ID NO: 1456547 - RNA, 20 nt, Human
uaacuuuuauaaacuuuacc

SEQ ID NO: 1456548 - RNA, 21 nt, Human
uaacaggcucaaacaaugaca

SEQ ID NO: 1456549 - RNA, 15 nt, Human
uaacaggccaaagag

SEQ ID NO: 1456550 - RNA, 19 nt, Human
uaacaggcucaaacaauga

SEQ ID NO: 1456551 - RNA, 14 nt, Human
uaacagggaaggca

SEQ ID NO: 1456552 - RNA, 17 nt, Human
uaacagggaaggcaggc

SEQ ID NO: 1456553 - RNA, 16 nt, Human
uaacagggaaggcagg

SEQ ID NO: 1456554 - RNA, 20 nt, Human
uaaccaagcugaguuuccua

SEQ ID NO: 1456555 - RNA, 16 nt, Human
uaaccaagcugaguuu

SEQ ID NO: 1456556 - RNA, 21 nt, Human
uaaccaagagauaacuguaaa

SEQ ID NO: 1456557 - RNA, 22 nt, Human
uaacauuccaagacucuagagu

SEQ ID NO: 1456558 - RNA, 10 nt, Human
uaacauuccu

SEQ ID NO: 1456559 - RNA, 18 nt, Human
uaacauuccaagacucua

SEQ ID NO: 1456560 - RNA, 13 nt, Human
uaacauuccaaga

SEQ ID NO: 1456561 - RNA, 12 nt, Human
uaacauuccaag

SEQ ID NO: 1456562 - RNA, 21 nt, Human
uaacauucaggaauucuugga

SEQ ID NO: 1456563 - RNA, 22 nt, Human
uaacauuaucuaguucauugaa

SEQ ID NO: 1456564 - RNA, 19 nt, Human
uaaccaagcugaguuuccu

SEQ ID NO: 1456565 - RNA, 11 nt, Human
uaaccaaguuc

SEQ ID NO: 1456566 - RNA, 12 nt, Human
uaaccaaguucc

SEQ ID NO: 1456567 - RNA, 14 nt, Human
uaaccagcagaaau

SEQ ID NO: 1456568 - RNA, 11 nt, Human
uaaccacccca

SEQ ID NO: 1456569 - RNA, 16 nt, Human
uaaccaccccaucugc

SEQ ID NO: 1456570 - RNA, 22 nt, Human
uaaccgagaucaguauuuaacu

SEQ ID NO: 1456571 - RNA, 21 nt, Human
uaacccuuugugugcucucca

SEQ ID NO: 1456572 - RNA, 19 nt, Human
uaacccuuugugugcucuc

SEQ ID NO: 1456573 - RNA, 17 nt, Human
uaacccuuugugugcuc

SEQ ID NO: 1456574 - RNA, 17 nt, Human
uaaccaggggccaugaa

SEQ ID NO: 1456575 - RNA, 16 nt, Human
uaaccagcagaaaugc

SEQ ID NO: 1456576 - RNA, 19 nt, Human
uaaccagcagaaaugccuu

SEQ ID NO: 1456577 - RNA, 20 nt, Human
uaacagcccuccucugcacu

SEQ ID NO: 1456578 - RNA, 18 nt, Human
uaacagcccuccucugca

SEQ ID NO: 1456579 - RNA, 17 nt, Human
uaacagcccuccucugc

SEQ ID NO: 1456580 - RNA, 11 nt, Human
uaacagcccuc

SEQ ID NO: 1456581 - RNA, 15 nt, Human
uaacagcaccaaauc

SEQ ID NO: 1456582 - RNA, 19 nt, Human
uaacagaagggagggcaga

SEQ ID NO: 1456583 - RNA, 22 nt, Human
uaacagaaauuguauauuguaa

SEQ ID NO: 1456584 - RNA, 17 nt, Human
uaacagaaauuguauau

SEQ ID NO: 1456585 - RNA, 15 nt, Human
uaacagaaauuguau

SEQ ID NO: 1456586 - RNA, 14 nt, Human
uaacagaaauugua

SEQ ID NO: 1456587 - RNA, 13 nt, Human
uaacagaaauugu

SEQ ID NO: 1456588 - RNA, 14 nt, Human
uaacagaaauguac

SEQ ID NO: 1456589 - RNA, 15 nt, Human
uaacagaaauguaca

SEQ ID NO: 1456590 - RNA, 20 nt, Human
uaacacacuaccgaaugugu

SEQ ID NO: 1456591 - RNA, 21 nt, Human
uaacacagcauuguauaugug

SEQ ID NO: 1456592 - RNA, 23 nt, Human
uaacacacuaccgaaugugucuu

SEQ ID NO: 1456593 - RNA, 22 nt, Human
uaacacacuaccgaaugugucu

SEQ ID NO: 1456594 - RNA, 21 nt, Human
uaacacacuaccgaauguguc

SEQ ID NO: 1456595 - RNA, 13 nt, Human
uaacagaaaugua

SEQ ID NO: 1456596 - RNA, 20 nt, Human
uaacaauuguguagccuuuu

SEQ ID NO: 1456597 - RNA, 23 nt, Human
uaacaauuguguagccuuuuugu

SEQ ID NO: 1456598 - RNA, 19 nt, Human
uaacaauuguguagccuuu

SEQ ID NO: 1456599 - RNA, 18 nt, Human
uaacaauuguguagccuu

SEQ ID NO: 1456600 - RNA, 14 nt, Human
uaacaauuguguag

SEQ ID NO: 1456601 - RNA, 14 nt, Human
uaacaauuccucua

SEQ ID NO: 1456602 - RNA, 13 nt, Human
uaacaauuccucu

SEQ ID NO: 1456603 - RNA, 20 nt, Human
uaacaauuaggcagacucuu

SEQ ID NO: 1456604 - RNA, 16 nt, Human
uaacaauuaggcagac

SEQ ID NO: 1456605 - RNA, 17 nt, Human
uaaauuguacagccggc

SEQ ID NO: 1456606 - RNA, 13 nt, Human
uaaauuguauauu

SEQ ID NO: 1456607 - RNA, 21 nt, Human
uaaauuggcauggaaauuuaa

SEQ ID NO: 1456608 - RNA, 14 nt, Human
uaaauuguauauuc

SEQ ID NO: 1456609 - RNA, 17 nt, Human
uaaauuguauauucacu

SEQ ID NO: 1456610 - RNA, 18 nt, Human
uaaauuguauauucacuu

SEQ ID NO: 1456611 - RNA, 19 nt, Human
uaaauuguauauucacuuu

SEQ ID NO: 1456612 - RNA, 22 nt, Human
uaaauuuaguauuuuguuucag

SEQ ID NO: 1456613 - RNA, 14 nt, Human
uaaauuuaguauuu

SEQ ID NO: 1456614 - RNA, 22 nt, Human
uaaauugauuuuuauaaauacu

SEQ ID NO: 1456615 - RNA, 21 nt, Human
uaaauugauuuuuauaaauac

SEQ ID NO: 1456616 - RNA, 13 nt, Human
uaaauugauuuuu

SEQ ID NO: 1456617 - RNA, 16 nt, Human
uaaauugauguugcug

SEQ ID NO: 1456618 - RNA, 20 nt, Human
uaaauuggcauggaaauuua

SEQ ID NO: 1456619 - RNA, 17 nt, Human
uaaauuggcauggaaau

SEQ ID NO: 1456620 - RNA, 13 nt, Human
uaaauuggaaagc

SEQ ID NO: 1456621 - RNA, 18 nt, Human
uaaucuuauaauuguucu

SEQ ID NO: 1456622 - RNA, 15 nt, Human
uaaucuuauaauugu

SEQ ID NO: 1456623 - RNA, 18 nt, Human
uaaucuuaguguaugauu

SEQ ID NO: 1456624 - RNA, 15 nt, Human
uaaucuuaguguaug

SEQ ID NO: 1456625 - RNA, 13 nt, Human
uaaucuuagugua

SEQ ID NO: 1456626 - RNA, 23 nt, Human
uaaucugaauaaaguguaacaau

SEQ ID NO: 1456627 - RNA, 22 nt, Human
uaaucugaauaaaguguaacaa

SEQ ID NO: 1456628 - RNA, 21 nt, Human
uaaucugaauaaaguguaaca

SEQ ID NO: 1456629 - RNA, 20 nt, Human
uaaucugaauaaaguguaac

SEQ ID NO: 1456630 - RNA, 17 nt, Human
uaaucugaauaaagugu

SEQ ID NO: 1456631 - RNA, 13 nt, Human
uaaucugaauaaa

SEQ ID NO: 1456632 - RNA, 17 nt, Human
uaaucucuguaaagcua

SEQ ID NO: 1456633 - RNA, 18 nt, Human
uaaucucuguaaagcuaa

SEQ ID NO: 1456634 - RNA, 11 nt, Human
uaaucuaaaug

SEQ ID NO: 1456635 - RNA, 12 nt, Human
uaaucuaaaugg

SEQ ID NO: 1456636 - RNA, 14 nt, Human
uaaugcacuuucua

SEQ ID NO: 1456637 - RNA, 13 nt, Human
uaaugcacuuucu

SEQ ID NO: 1456638 - RNA, 12 nt, Human
uaaugcacuuuc

SEQ ID NO: 1456639 - RNA, 15 nt, Human
uaaugauaugcuugu

SEQ ID NO: 1456640 - RNA, 16 nt, Human
uaaugauaugcuugua

SEQ ID NO: 1456641 - RNA, 22 nt, Human
uaaucuuauaauuguucucaga

SEQ ID NO: 1456642 - RNA, 22 nt, Human
uaaucuuauucauuuucucuaa

SEQ ID NO: 1456643 - RNA, 21 nt, Human
uaaucuuauucauuuucucua

SEQ ID NO: 1456644 - RNA, 15 nt, Human
uaaucuuauuuagga

SEQ ID NO: 1456645 - RNA, 15 nt, Human
uaaucuucaauaguu

SEQ ID NO: 1456646 - RNA, 19 nt, Human
uaauauauauuaucuuuuc

SEQ ID NO: 1456647 - RNA, 18 nt, Human
uaauauauauuaucuuuu

SEQ ID NO: 1456648 - RNA, 16 nt, Human
uaauauauauuaucuu

SEQ ID NO: 1456649 - RNA, 16 nt, Human
uaauauacuauauuua

SEQ ID NO: 1456650 - RNA, 13 nt, Human
uaauauacuugug

SEQ ID NO: 1456651 - RNA, 15 nt, Human
uaauauacuugugga

SEQ ID NO: 1456652 - RNA, 17 nt, Human
uaauauacuuguggacu

SEQ ID NO: 1456653 - RNA, 21 nt, Human
uaauauacuuguggacuaaaa

SEQ ID NO: 1456654 - RNA, 13 nt, Human
uaauauauuuucu

SEQ ID NO: 1456655 - RNA, 17 nt, Human
uaauauauuuaaaaaua

SEQ ID NO: 1456656 - RNA, 14 nt, Human
uaauauauuuaaaa

SEQ ID NO: 1456657 - RNA, 21 nt, Human
uaauauauuuucuguuuucuu

SEQ ID NO: 1456658 - RNA, 17 nt, Human
uaauauauuuucuguuu

SEQ ID NO: 1456659 - RNA, 20 nt, Human
uaauauguucuuuuaaauga

SEQ ID NO: 1456660 - RNA, 14 nt, Human
uaaggcucuagauc

SEQ ID NO: 1456661 - RNA, 12 nt, Human
uaaggcucuaga

SEQ ID NO: 1456662 - RNA, 15 nt, Human
uaagugcuguauaaa

SEQ ID NO: 1456663 - RNA, 17 nt, Human
uaagugcuguauaaaau

SEQ ID NO: 1456664 - RNA, 18 nt, Human
uaagugcuguauaaaauc

SEQ ID NO: 1456665 - RNA, 19 nt, Human
uaagugcuguauaaaauca

SEQ ID NO: 1456666 - RNA, 20 nt, Human
uaagugcuguauaaaaucag

SEQ ID NO: 1456667 - RNA, 22 nt, Human
uaagugcuguauaaaaucagcc

SEQ ID NO: 1456668 - RNA, 16 nt, Human
uaaggccugugggggg

SEQ ID NO: 1456669 - RNA, 21 nt, Human
uaaggccuaggauucuaaaau

SEQ ID NO: 1456670 - RNA, 20 nt, Human
uaaggccuaggauucuaaaa

SEQ ID NO: 1456671 - RNA, 19 nt, Human
uaaggccuaggauucuaaa

SEQ ID NO: 1456672 - RNA, 18 nt, Human
uaaggccuaggauucuaa

SEQ ID NO: 1456673 - RNA, 16 nt, Human
uaaggccuaggauucu

SEQ ID NO: 1456674 - RNA, 19 nt, Human
uaaggccauuauuguacuu

SEQ ID NO: 1456675 - RNA, 17 nt, Human
uaauaaacuuuaauaua

SEQ ID NO: 1456676 - RNA, 23 nt, Human
uaagugcuguauaaaaucagcca

SEQ ID NO: 1456677 - RNA, 19 nt, Human
uaauaaauguacauuaauu

SEQ ID NO: 1456678 - RNA, 17 nt, Human
uaauaaauguacauuaa

SEQ ID NO: 1456679 - RNA, 11 nt, Human
uaauaaagcug

SEQ ID NO: 1456680 - RNA, 22 nt, Human
uaauauaaaugcaaauaacaaa

SEQ ID NO: 1456681 - RNA, 16 nt, Human
uaauauaaaugcaaau

SEQ ID NO: 1456682 - RNA, 14 nt, Human
uaauauaaaugcaa

SEQ ID NO: 1456683 - RNA, 13 nt, Human
uaauauaaaugca

SEQ ID NO: 1456684 - RNA, 12 nt, Human
uaauauaaaugc

SEQ ID NO: 1456685 - RNA, 22 nt, Human
uaauauaaaguuuuauauauua

SEQ ID NO: 1456686 - RNA, 20 nt, Human
uaauauaaaguuuuauauau

SEQ ID NO: 1456687 - RNA, 15 nt, Human
uaauauaaaguuuua

SEQ ID NO: 1456688 - RNA, 21 nt, Human
uaauauaaaguaguccuguga

SEQ ID NO: 1456689 - RNA, 12 nt, Human
uaauaguuccug

SEQ ID NO: 1456690 - RNA, 21 nt, Human
uaauauaaaaagcuuccauga

SEQ ID NO: 1456691 - RNA, 13 nt, Human
uaauaguuccugc

SEQ ID NO: 1456692 - RNA, 14 nt, Human
uaauacaccacuac

SEQ ID NO: 1456693 - RNA, 15 nt, Human
uaauacaaacuauau

SEQ ID NO: 1456694 - RNA, 14 nt, Human
uaauacaaaggcuu

SEQ ID NO: 1456695 - RNA, 14 nt, Human
uaauacaaacuaau

SEQ ID NO: 1456696 - RNA, 16 nt, Human
uaauaauuuuuuaauu

SEQ ID NO: 1456697 - RNA, 20 nt, Human
uaauaauuuuuaagaaauaa

SEQ ID NO: 1456698 - RNA, 16 nt, Human
uaauaauaaagaauag

SEQ ID NO: 1456699 - RNA, 13 nt, Human
uaauaauauacuu

SEQ ID NO: 1456700 - RNA, 14 nt, Human
uaauaauauacuug

SEQ ID NO: 1456701 - RNA, 21 nt, Human
uaauaagguuuuaauuuagua

SEQ ID NO: 1456702 - RNA, 16 nt, Human
uaauaagguuuuaauu

SEQ ID NO: 1456703 - RNA, 14 nt, Human
uaauaagguuuuaa

SEQ ID NO: 1456704 - RNA, 13 nt, Human
uaauaagguuuua

SEQ ID NO: 1456705 - RNA, 15 nt, Human
uaauaauguuucaaa

SEQ ID NO: 1456706 - RNA, 16 nt, Human
uaauaauauacuugug

SEQ ID NO: 1456707 - RNA, 19 nt, Human
uaauaauauacuuguggac

SEQ ID NO: 1456708 - RNA, 22 nt, Human
uaauaauauacuuguggacuaa

SEQ ID NO: 1456709 - RNA, 16 nt, Human
uaauaauuucuaaugu

SEQ ID NO: 1456710 - RNA, 14 nt, Human
uaauaauuucuaau

SEQ ID NO: 1456711 - RNA, 13 nt, Human
uaauaauuucuaa

SEQ ID NO: 1456712 - RNA, 22 nt, Human
uaauaauuuagacuucaagcau

SEQ ID NO: 1456713 - RNA, 21 nt, Human
uaauaauauacuuguggacua

SEQ ID NO: 1456714 - RNA, 17 nt, Human
uaauuuuccuaauaaag

SEQ ID NO: 1456715 - RNA, 23 nt, Human
uaauuuuaguuuuucauuaaaua

SEQ ID NO: 1456716 - RNA, 21 nt, Human
uaauuuuaguuuuucauuaaa

SEQ ID NO: 1456717 - RNA, 19 nt, Human
uaauuuuaguuuuucauua

SEQ ID NO: 1456718 - RNA, 16 nt, Human
uaauuuuaguuuuuca

SEQ ID NO: 1456719 - RNA, 14 nt, Human
uaauuuuaguuuuu

SEQ ID NO: 1456720 - RNA, 21 nt, Human
uaauuuuacacgcuuuuguga

SEQ ID NO: 1456721 - RNA, 20 nt, Human
uaauuuuacacgcuuuugug

SEQ ID NO: 1456722 - RNA, 19 nt, Human
uaauuuuacacgcuuuugu

SEQ ID NO: 1456723 - RNA, 18 nt, Human
uaauuuuacacgcuuuug

SEQ ID NO: 1456724 - RNA, 13 nt, Human
uaauuuuaaauuc

SEQ ID NO: 1456725 - RNA, 14 nt, Human
uaauuuuaaacaaa

SEQ ID NO: 1456726 - RNA, 17 nt, Human
uaauuuguuuuggauau

SEQ ID NO: 1456727 - RNA, 19 nt, Human
uaauuugugauacaaugcu

SEQ ID NO: 1456728 - RNA, 22 nt, Human
uaauuugugauacaaugcugug

SEQ ID NO: 1456729 - RNA, 23 nt, Human
uaauuuguaguguuggagaagaa

SEQ ID NO: 1456730 - RNA, 14 nt, Human
uaauuugugauaca

SEQ ID NO: 1456731 - RNA, 15 nt, Human
uaauuugugauacaa

SEQ ID NO: 1456732 - RNA, 18 nt, Human
uaauuugugauacaaugc

SEQ ID NO: 1456733 - RNA, 21 nt, Human
uaauuguuguucuguuaacug

SEQ ID NO: 1456734 - RNA, 23 nt, Human
uaauuguuguucuguuaacugaa

SEQ ID NO: 1456735 - RNA, 17 nt, Human
uaauuugguuuucacau

SEQ ID NO: 1456736 - RNA, 15 nt, Human
uaauuugguuuucac

SEQ ID NO: 1456737 - RNA, 18 nt, Human
uaauuugguuuucacauu

SEQ ID NO: 1456738 - RNA, 20 nt, Human
uaauuuguaguguuggagaa

SEQ ID NO: 1456739 - RNA, 22 nt, Human
uaauugugauuagacagaacac

SEQ ID NO: 1456740 - RNA, 23 nt, Human
uaauugugauuagacagaacacc

SEQ ID NO: 1456741 - RNA, 23 nt, Human
uaauuguacuaaagccaaacaua

SEQ ID NO: 1456742 - RNA, 22 nt, Human
uaauuguacuaaagccaaacau

SEQ ID NO: 1456743 - RNA, 18 nt, Human
uaauuguacuaaagccaa

SEQ ID NO: 1456744 - RNA, 22 nt, Human
uaauuguaaaguaaaagcuaua

SEQ ID NO: 1456745 - RNA, 20 nt, Human
uaauuguuguucuguuaacu

SEQ ID NO: 1456746 - RNA, 19 nt, Human
uaauuguuguucuguuaac

SEQ ID NO: 1456747 - RNA, 18 nt, Human
uaauuguuguucuguuaa

SEQ ID NO: 1456748 - RNA, 17 nt, Human
uaauuguuguucuguua

SEQ ID NO: 1456749 - RNA, 16 nt, Human
uaauuguuguucuguu

SEQ ID NO: 1456750 - RNA, 15 nt, Human
uaauuguuguucugu

SEQ ID NO: 1456751 - RNA, 14 nt, Human
uaauuguuguucug

SEQ ID NO: 1456752 - RNA, 16 nt, Human
uaauuguugcuaaucu

SEQ ID NO: 1456753 - RNA, 16 nt, Human
uaauuguucucagaau

SEQ ID NO: 1456754 - RNA, 17 nt, Human
uaauuguucucagaauc

SEQ ID NO: 1456755 - RNA, 14 nt, Human
uaauuguguggauu

SEQ ID NO: 1456756 - RNA, 20 nt, Human
uaauuguguggauucuuuaa

SEQ ID NO: 1456757 - RNA, 21 nt, Human
uaauugcuuauuuauuguauu

SEQ ID NO: 1456758 - RNA, 20 nt, Human
uaauugcuuauuuauuguau

SEQ ID NO: 1456759 - RNA, 13 nt, Human
uaauugcuuauuu

SEQ ID NO: 1456760 - RNA, 12 nt, Human
uaauugccaugu

SEQ ID NO: 1456761 - RNA, 11 nt, Human
uaauugccaug

SEQ ID NO: 1456762 - RNA, 23 nt, Human
uaauugccaccucuaacagcacc

SEQ ID NO: 1456763 - RNA, 18 nt, Human
uaauugccaccucuaaca

SEQ ID NO: 1456764 - RNA, 14 nt, Human
uaauugccaccucu

SEQ ID NO: 1456765 - RNA, 23 nt, Human
uaauugccaaaaagugaaauaau

SEQ ID NO: 1456766 - RNA, 22 nt, Human
uaauugccaaaaagugaaauaa

SEQ ID NO: 1456767 - RNA, 17 nt, Human
uaauugcauugacuuuc

SEQ ID NO: 1456768 - RNA, 18 nt, Human
uaauugggccagcuuuuc

SEQ ID NO: 1456769 - RNA, 18 nt, Human
uaauugguccgaucuuug

SEQ ID NO: 1456770 - RNA, 21 nt, Human
uaauugggccagcuuuucaaa

SEQ ID NO: 1456771 - RNA, 23 nt, Human
uaauuggauuuccuaauacuguc

SEQ ID NO: 1456772 - RNA, 17 nt, Human
uaauuggauuuccuaau

SEQ ID NO: 1456773 - RNA, 16 nt, Human
uaauuggauuuccuaa

SEQ ID NO: 1456774 - RNA, 15 nt, Human
uaauuggauuuccua

SEQ ID NO: 1456775 - RNA, 22 nt, Human
uaauugcuuauuuauuguauuc

SEQ ID NO: 1456776 - RNA, 22 nt, Human
uaauuggaaaggcagcucuaaa

SEQ ID NO: 1456777 - RNA, 20 nt, Human
uaauucuucaccuuaggaau

SEQ ID NO: 1456778 - RNA, 21 nt, Human
uaauucuuucaauacagauau

SEQ ID NO: 1456779 - RNA, 20 nt, Human
uaauucuuucaauacagaua

SEQ ID NO: 1456780 - RNA, 18 nt, Human
uaauucuuucaauacaga

SEQ ID NO: 1456781 - RNA, 12 nt, Human
uaauucuuucaa

SEQ ID NO: 1456782 - RNA, 18 nt, Human
uaauucucauuaaaagaa

SEQ ID NO: 1456783 - RNA, 16 nt, Human
uaauuaccuacucugg

SEQ ID NO: 1456784 - RNA, 21 nt, Human
uaauuaccaaccuguuaccua

SEQ ID NO: 1456785 - RNA, 17 nt, Human
uaauuaccaaccuguua

SEQ ID NO: 1456786 - RNA, 16 nt, Human
uaauuaccaaccuguu

SEQ ID NO: 1456787 - RNA, 14 nt, Human
uaauuaauuguaau

SEQ ID NO: 1456788 - RNA, 21 nt, Human
uaauuaauugggccagcuuuu

SEQ ID NO: 1456789 - RNA, 17 nt, Human
uaauucugaguuuugug

SEQ ID NO: 1456790 - RNA, 14 nt, Human
uaauucucauuaaa

SEQ ID NO: 1456791 - RNA, 18 nt, Human
uaauucuuagcucauucu

SEQ ID NO: 1456792 - RNA, 21 nt, Human
uaaugccuuacucuucuugaa

SEQ ID NO: 1456793 - RNA, 15 nt, Human
uaaugccuuacucuu

SEQ ID NO: 1456794 - RNA, 18 nt, Human
uaaugccucuucauucuu

SEQ ID NO: 1456795 - RNA, 12 nt, Human
uaaugcccagac

SEQ ID NO: 1456796 - RNA, 19 nt, Human
uaaugcauucuucucuguu

SEQ ID NO: 1456797 - RNA, 18 nt, Human
uaaugcauucuucucugu

SEQ ID NO: 1456798 - RNA, 14 nt, Human
uaaugcgugcauac

SEQ ID NO: 1456799 - RNA, 15 nt, Human
uaauguuucaaacau

SEQ ID NO: 1456800 - RNA, 15 nt, Human
uaauguuuaaaacau

SEQ ID NO: 1456801 - RNA, 14 nt, Human
uaauguuucaaaca

SEQ ID NO: 1456802 - RNA, 19 nt, Human
uaauuaaaagcaaaucauu

SEQ ID NO: 1456803 - RNA, 18 nt, Human
uaauuaaaagcaaaucau

SEQ ID NO: 1456804 - RNA, 18 nt, Human
uaaaguuuuauauauuau

SEQ ID NO: 1456805 - RNA, 17 nt, Human
uaaaguuuuauauauua

SEQ ID NO: 1456806 - RNA, 14 nt, Human
uaaaguuuuauaua

SEQ ID NO: 1456807 - RNA, 14 nt, Human
uaaaguuuguugaa

SEQ ID NO: 1456808 - RNA, 17 nt, Human
uaaauaaaaagaaaggc

SEQ ID NO: 1456809 - RNA, 16 nt, Human
uaaauaaaaagaaagg

SEQ ID NO: 1456810 - RNA, 19 nt, Human
uaaaguuuuauauauuaua

SEQ ID NO: 1456811 - RNA, 23 nt, Human
uaaaguuuuauauauuauaugga

SEQ ID NO: 1456812 - RNA, 17 nt, Human
uaaauaaaaauaauccu

SEQ ID NO: 1456813 - RNA, 16 nt, Human
uaaaggcaaaggcaau

SEQ ID NO: 1456814 - RNA, 19 nt, Human
uaaaggaguuuauguucca

SEQ ID NO: 1456815 - RNA, 22 nt, Human
uaaaggaugugauuguggaaug

SEQ ID NO: 1456816 - RNA, 16 nt, Human
uaaaggaugugauugu

SEQ ID NO: 1456817 - RNA, 21 nt, Human
uaaaguguauuuuuuuacuaa

SEQ ID NO: 1456818 - RNA, 22 nt, Human
uaaaguguauuuuuuuacuaau

SEQ ID NO: 1456819 - RNA, 23 nt, Human
uaaaguguauuuuuuuacuaaua

SEQ ID NO: 1456820 - RNA, 23 nt, Human
uaaagcuaaaauaaagaaauaga

SEQ ID NO: 1456821 - RNA, 22 nt, Human
uaaagcuaaaauaaagaaauag

SEQ ID NO: 1456822 - RNA, 15 nt, Human
uaaagcuaaaauaaa

SEQ ID NO: 1456823 - RNA, 21 nt, Human
uaaagcguuugcacagaucaa

SEQ ID NO: 1456824 - RNA, 15 nt, Human
uaaagcguuugcaca

SEQ ID NO: 1456825 - RNA, 13 nt, Human
uaaagcauuuaga

SEQ ID NO: 1456826 - RNA, 19 nt, Human
uaaagcauuuagaaaacuu

SEQ ID NO: 1456827 - RNA, 20 nt, Human
uaaagcauuuaaccccccug

SEQ ID NO: 1456828 - RNA, 11 nt, Human
uaaagcauuua

SEQ ID NO: 1456829 - RNA, 17 nt, Human
uaaaggaguuuauguuc

SEQ ID NO: 1456830 - RNA, 16 nt, Human
uaaaggaguuuauguu

SEQ ID NO: 1456831 - RNA, 15 nt, Human
uaaaggaguuuaugu

SEQ ID NO: 1456832 - RNA, 14 nt, Human
uaaagcucugacau

SEQ ID NO: 1456833 - RNA, 12 nt, Human
uaaaggacugua

SEQ ID NO: 1456834 - RNA, 14 nt, Human
uaaaggacuguaau

SEQ ID NO: 1456835 - RNA, 17 nt, Human
uaaagcaguauuuuucu

SEQ ID NO: 1456836 - RNA, 14 nt, Human
uaaagcaguauuuu

SEQ ID NO: 1456837 - RNA, 13 nt, Human
uaaagcaguauuu

SEQ ID NO: 1456838 - RNA, 18 nt, Human
uaaacuuuuuuucuguac

SEQ ID NO: 1456839 - RNA, 16 nt, Human
uaaacuuuuuuucugu

SEQ ID NO: 1456840 - RNA, 17 nt, Human
uaaacuuuuuguucugg

SEQ ID NO: 1456841 - RNA, 12 nt, Human
uaaacuuuuugu

SEQ ID NO: 1456842 - RNA, 16 nt, Human
uaaacuuuuaauucau

SEQ ID NO: 1456843 - RNA, 15 nt, Human
uaaacuuuaucacuu

SEQ ID NO: 1456844 - RNA, 17 nt, Human
uaaacuuuuaauucauu

SEQ ID NO: 1456845 - RNA, 15 nt, Human
uaaacuuuuaauuca

SEQ ID NO: 1456846 - RNA, 20 nt, Human
uaaacuuuuuucuuacuguc

SEQ ID NO: 1456847 - RNA, 15 nt, Human
uaaauauuuuaaaga

SEQ ID NO: 1456848 - RNA, 14 nt, Human
uaaauauuuuaaag

SEQ ID NO: 1456849 - RNA, 18 nt, Human
uaaauauuuuaaagaauu

SEQ ID NO: 1456850 - RNA, 23 nt, Human
uaaauauggacugcucaggaaac

SEQ ID NO: 1456851 - RNA, 21 nt, Human
uaaauauggacugcucaggaa

SEQ ID NO: 1456852 - RNA, 19 nt, Human
uaaauauggacugcucagg

SEQ ID NO: 1456853 - RNA, 17 nt, Human
uaaauauggacugcuca

SEQ ID NO: 1456854 - RNA, 18 nt, Human
uaaaucacgcuuuuugaa

SEQ ID NO: 1456855 - RNA, 16 nt, Human
uaaaucacgcuuuuug

SEQ ID NO: 1456856 - RNA, 17 nt, Human
uaaauauuuuaaagaau

SEQ ID NO: 1456857 - RNA, 13 nt, Human
uaaaucaauaaag

SEQ ID NO: 1456858 - RNA, 20 nt, Human
uaaaucagacuaugaaguuu

SEQ ID NO: 1456859 - RNA, 18 nt, Human
uaaaucaguaagaggugu

SEQ ID NO: 1456860 - RNA, 22 nt, Human
uaaaucacgcuuuuugaaaaag

SEQ ID NO: 1456861 - RNA, 21 nt, Human
uaaaucacgcuuuuugaaaaa

SEQ ID NO: 1456862 - RNA, 19 nt, Human
uaaaucacgcuuuuugaaa

SEQ ID NO: 1456863 - RNA, 17 nt, Human
uaaaucaguaagaggug

SEQ ID NO: 1456864 - RNA, 20 nt, Human
uaaauauaucuaccccagac

SEQ ID NO: 1456865 - RNA, 18 nt, Human
uaaauauaucuaccccag

SEQ ID NO: 1456866 - RNA, 14 nt, Human
uaaauauaucuacc

SEQ ID NO: 1456867 - RNA, 13 nt, Human
uaaauaaacccuu

SEQ ID NO: 1456868 - RNA, 20 nt, Human
uaaauaaaauuuguugcaua

SEQ ID NO: 1456869 - RNA, 14 nt, Human
uaaauaaaauuugu

SEQ ID NO: 1456870 - RNA, 13 nt, Human
uaaauaaaauuug

SEQ ID NO: 1456871 - RNA, 23 nt, Human
uaaauaaaaugcuagguucuacc

SEQ ID NO: 1456872 - RNA, 22 nt, Human
uaaauaaaaugcuagguucuac

SEQ ID NO: 1456873 - RNA, 21 nt, Human
uaaauaaaaugcuagguucua

SEQ ID NO: 1456874 - RNA, 20 nt, Human
uaaauaaaaugcuagguucu

SEQ ID NO: 1456875 - RNA, 17 nt, Human
uaaauaaaaugcuaggu

SEQ ID NO: 1456876 - RNA, 22 nt, Human
uaaauauauuuaagauaauuau

SEQ ID NO: 1456877 - RNA, 17 nt, Human
uaaauauauuuaagaua

SEQ ID NO: 1456878 - RNA, 22 nt, Human
uaaauauauuauuacuuguaaa

SEQ ID NO: 1456879 - RNA, 21 nt, Human
uaaauauauuauuacuuguaa

SEQ ID NO: 1456880 - RNA, 20 nt, Human
uaaauauauuauuacuugua

SEQ ID NO: 1456881 - RNA, 18 nt, Human
uaaauauauuauuacuug

SEQ ID NO: 1456882 - RNA, 17 nt, Human
uaaauauauuauuacuu

SEQ ID NO: 1456883 - RNA, 15 nt, Human
uaaauauauuauuac

SEQ ID NO: 1456884 - RNA, 14 nt, Human
uaaauauauuauua

SEQ ID NO: 1456885 - RNA, 13 nt, Human
uaaauauauuauu

SEQ ID NO: 1456886 - RNA, 18 nt, Human
uaaauauaugcuaagucu

SEQ ID NO: 1456887 - RNA, 23 nt, Human
uaaauauauuauuacuuguaaau

SEQ ID NO: 1456888 - RNA, 16 nt, Human
uaaauauauuuuaaga

SEQ ID NO: 1456889 - RNA, 22 nt, Human
uaaauauauuuuaagacgaaac

SEQ ID NO: 1456890 - RNA, 23 nt, Human
uaaacagugagccugaauuuugu

SEQ ID NO: 1456891 - RNA, 20 nt, Human
uaaacagugagccugaauuu

SEQ ID NO: 1456892 - RNA, 23 nt, Human
uaaacuggagacugugugugccc

SEQ ID NO: 1456893 - RNA, 14 nt, Human
uaaacuggagacug

SEQ ID NO: 1456894 - RNA, 13 nt, Human
uaaacuggagacu

SEQ ID NO: 1456895 - RNA, 12 nt, Human
uaaacuggagac

SEQ ID NO: 1456896 - RNA, 16 nt, Human
uaaacuuuaucacuua

SEQ ID NO: 1456897 - RNA, 22 nt, Human
uaaacuuuaccuuuuuuauaca

SEQ ID NO: 1456898 - RNA, 17 nt, Human
uaaacuguacagugucu

SEQ ID NO: 1456899 - RNA, 15 nt, Human
uaaacuguacagugu

SEQ ID NO: 1456900 - RNA, 14 nt, Human
uaaacuguacagug

SEQ ID NO: 1456901 - RNA, 13 nt, Human
uaaacuguacagu

SEQ ID NO: 1456902 - RNA, 12 nt, Human
uaaacuguacag

SEQ ID NO: 1456903 - RNA, 16 nt, Human
uaaacuggagacugug

SEQ ID NO: 1456904 - RNA, 16 nt, Human
uaaacuuuaccuuuuu

SEQ ID NO: 1456905 - RNA, 14 nt, Human
uaaacuuaaucuaa

SEQ ID NO: 1456906 - RNA, 18 nt, Human
uaaacuuaaucuaaaugg

SEQ ID NO: 1456907 - RNA, 19 nt, Human
uaaacuuaaucuaaaugga

SEQ ID NO: 1456908 - RNA, 20 nt, Human
uaaaaugcuagguucuaccu

SEQ ID NO: 1456909 - RNA, 17 nt, Human
uaaaaugcuagguucua

SEQ ID NO: 1456910 - RNA, 16 nt, Human
uaaaaugcuagguucu

SEQ ID NO: 1456911 - RNA, 14 nt, Human
uaaaaugcuagguu

SEQ ID NO: 1456912 - RNA, 16 nt, Human
uaaaaugauuguagua

SEQ ID NO: 1456913 - RNA, 13 nt, Human
uaaacaagaaaaa

SEQ ID NO: 1456914 - RNA, 18 nt, Human
uaaacaagaccacguuuc

SEQ ID NO: 1456915 - RNA, 23 nt, Human
uaaacaaguauuuguuaauuuag

SEQ ID NO: 1456916 - RNA, 18 nt, Human
uaaacaauaucagacuuu

SEQ ID NO: 1456917 - RNA, 18 nt, Human
uaaacaaguauuuguuaa

SEQ ID NO: 1456918 - RNA, 13 nt, Human
uaaacaaguauuu

SEQ ID NO: 1456919 - RNA, 20 nt, Human
uaaacaagaaaaauaaagaa

SEQ ID NO: 1456920 - RNA, 21 nt, Human
uaaacaagaaaaauaaagaaa

SEQ ID NO: 1456921 - RNA, 19 nt, Human
uaaacaagaaaaauaaaga

SEQ ID NO: 1456922 - RNA, 18 nt, Human
uaaacaagaaaaauaaag

SEQ ID NO: 1456923 - RNA, 17 nt, Human
uaaacaagaaaaauaaa

SEQ ID NO: 1456924 - RNA, 14 nt, Human
uaaacaagaaaaau

SEQ ID NO: 1456925 - RNA, 19 nt, Human
uaaacaagaccacguuucu

SEQ ID NO: 1456926 - RNA, 16 nt, Human
uaaacacuugcaaccu

SEQ ID NO: 1456927 - RNA, 20 nt, Human
uaaacacaagauugguguuu

SEQ ID NO: 1456928 - RNA, 14 nt, Human
uaaacacagacagg

SEQ ID NO: 1456929 - RNA, 22 nt, Human
uaaacacaagauugguguuuuu

SEQ ID NO: 1456930 - RNA, 22 nt, Human
uaaacaaguauuuguuaauuua

SEQ ID NO: 1456931 - RNA, 21 nt, Human
uaaacacucuugaaaaaugca

SEQ ID NO: 1456932 - RNA, 15 nt, Human
uaaaagaugcuuuua

SEQ ID NO: 1456933 - RNA, 14 nt, Human
uaaaagaugcuuuu

SEQ ID NO: 1456934 - RNA, 12 nt, Human
uaaaagaugcuu

SEQ ID NO: 1456935 - RNA, 17 nt, Human
uaaaagaugaaagagca

SEQ ID NO: 1456936 - RNA, 18 nt, Human
uaaaagauggggucugua

SEQ ID NO: 1456937 - RNA, 19 nt, Human
uaaaagauggggucuguaa

SEQ ID NO: 1456938 - RNA, 20 nt, Human
uaaaagauggggucuguaaa

SEQ ID NO: 1456939 - RNA, 21 nt, Human
uaaaagauggggucuguaaaa

SEQ ID NO: 1456940 - RNA, 22 nt, Human
uaaaagauggggucuguaaaau

SEQ ID NO: 1456941 - RNA, 13 nt, Human
uaaaagaugaaag

SEQ ID NO: 1456942 - RNA, 22 nt, Human
uaaaagauauaagugcuguaua

SEQ ID NO: 1456943 - RNA, 23 nt, Human
uaaaaauggcaggggguggaauu

SEQ ID NO: 1456944 - RNA, 16 nt, Human
uaaaaaugauuucagu

SEQ ID NO: 1456945 - RNA, 15 nt, Human
uaaaaaugaucuaaa

SEQ ID NO: 1456946 - RNA, 22 nt, Human
uaaaaauggaaacuauauugac

SEQ ID NO: 1456947 - RNA, 14 nt, Human
uaaaagccugcuca

SEQ ID NO: 1456948 - RNA, 12 nt, Human
uaaaagccugcu

SEQ ID NO: 1456949 - RNA, 18 nt, Human
uaaaagcauuuuguaaua

SEQ ID NO: 1456950 - RNA, 17 nt, Human
uaaaagcauuuuguaau

SEQ ID NO: 1456951 - RNA, 16 nt, Human
uaaaagcauuuuguaa

SEQ ID NO: 1456952 - RNA, 15 nt, Human
uaaaagcauuuugua

SEQ ID NO: 1456953 - RNA, 14 nt, Human
uaaaagcauuuugu

SEQ ID NO: 1456954 - RNA, 17 nt, Human
uaaaagggacugagaaa

SEQ ID NO: 1456955 - RNA, 19 nt, Human
uaaaagggacugagaaauu

SEQ ID NO: 1456956 - RNA, 20 nt, Human
uaaaagggacugagaaauuu

SEQ ID NO: 1456957 - RNA, 21 nt, Human
uaaaagggacugagaaauuua

SEQ ID NO: 1456958 - RNA, 15 nt, Human
uaaaauccucaaucc

SEQ ID NO: 1456959 - RNA, 21 nt, Human
uaaaaucagccaauuauguua

SEQ ID NO: 1456960 - RNA, 22 nt, Human
uaaaaucagccaauuauguuaa

SEQ ID NO: 1456961 - RNA, 23 nt, Human
uaaaaucagccaauuauguuaaa

SEQ ID NO: 1456962 - RNA, 19 nt, Human
uaaaauccauacauuugug

SEQ ID NO: 1456963 - RNA, 20 nt, Human
uaaaauauuuugaaucaaua

SEQ ID NO: 1456964 - RNA, 13 nt, Human
uaaaaucagccaa

SEQ ID NO: 1456965 - RNA, 14 nt, Human
uaaaaucagccaau

SEQ ID NO: 1456966 - RNA, 15 nt, Human
uaaaaucagccaauu

SEQ ID NO: 1456967 - RNA, 17 nt, Human
uaaaaucagccaauuau

SEQ ID NO: 1456968 - RNA, 16 nt, Human
uaaaauauuuugaauc

SEQ ID NO: 1456969 - RNA, 14 nt, Human
uaaaauauuuugaa

SEQ ID NO: 1456970 - RNA, 13 nt, Human
uaaaauauuuauu

SEQ ID NO: 1456971 - RNA, 22 nt, Human
uaaaaucuugucauguguauaa

SEQ ID NO: 1456972 - RNA, 21 nt, Human
uaaaaucuugucauguguaua

SEQ ID NO: 1456973 - RNA, 18 nt, Human
uaaaaucuuucuuucuua

SEQ ID NO: 1456974 - RNA, 20 nt, Human
uaaaaucuugucauguguau

SEQ ID NO: 1456975 - RNA, 19 nt, Human
uaaaaucuuucuuucuuag

SEQ ID NO: 1456976 - RNA, 20 nt, Human
uaaaaucuuucuuucuuaga

SEQ ID NO: 1456977 - RNA, 21 nt, Human
uaaaaucuuucuuucuuagaa

SEQ ID NO: 1456978 - RNA, 22 nt, Human
uaaaaucuuucuuucuuagaaa

SEQ ID NO: 1456979 - RNA, 14 nt, Human
uaaaaugacaauca

SEQ ID NO: 1456980 - RNA, 23 nt, Human
uaaaaucuugucauguguauaaa

SEQ ID NO: 1456981 - RNA, 13 nt, Human
uaaaaugagaaau

SEQ ID NO: 1456982 - RNA, 19 nt, Human
uaaaaugacaaucaugugu

SEQ ID NO: 1456983 - RNA, 18 nt, Human
uaaaaugacaaucaugug

SEQ ID NO: 1456984 - RNA, 17 nt, Human
uaaaaugacaaucaugu

SEQ ID NO: 1456985 - RNA, 21 nt, Human
uaaaaugacaaucaugugugu

SEQ ID NO: 1456986 - RNA, 15 nt, Human
uaaaaugagaaaucu

SEQ ID NO: 1456987 - RNA, 16 nt, Human
uaaaaugagaaaucua

SEQ ID NO: 1456988 - RNA, 22 nt, Human
guuuuuaaacuguacagugucu

SEQ ID NO: 1456989 - RNA, 20 nt, Human
guuuuuaaacuguacagugu

SEQ ID NO: 1456990 - RNA, 18 nt, Human
guuuuuaaacuguacagu

SEQ ID NO: 1456991 - RNA, 17 nt, Human
guuuuuaaacuguacag

SEQ ID NO: 1456992 - RNA, 16 nt, Human
guuuuuaaacuguaca

SEQ ID NO: 1456993 - RNA, 15 nt, Human
guuuuuaaacuguac

SEQ ID NO: 1456994 - RNA, 14 nt, Human
guuuuuaaacugua

SEQ ID NO: 1456995 - RNA, 13 nt, Human
guuuuuaaacugu

SEQ ID NO: 1456996 - RNA, 16 nt, Human
guuuuuacugcucuga

SEQ ID NO: 1456997 - RNA, 18 nt, Human
guuuuuacugcucugaga

SEQ ID NO: 1456998 - RNA, 14 nt, Human
guuuuuacugcucu

SEQ ID NO: 1456999 - RNA, 19 nt, Human
guuuuuauggcuuuugugc

SEQ ID NO: 1457000 - RNA, 22 nt, Human
guuuuuauggcuuuugugcauu

SEQ ID NO: 1457001 - RNA, 23 nt, Human
guuuuuauggcuuuugugcauua

SEQ ID NO: 1457002 - RNA, 15 nt, Human
guuuuguuuuuacaa

SEQ ID NO: 1457003 - RNA, 16 nt, Human
guuuugugucucuuau

SEQ ID NO: 1457004 - RNA, 14 nt, Human
guuuugugucucuu

SEQ ID NO: 1457005 - RNA, 15 nt, Human
guuuuguauucucug

SEQ ID NO: 1457006 - RNA, 12 nt, Human
guuuuguauucu

SEQ ID NO: 1457007 - RNA, 17 nt, Human
guuuucugaaaauauaa

SEQ ID NO: 1457008 - RNA, 14 nt, Human
guuuucucugaaca

SEQ ID NO: 1457009 - RNA, 19 nt, Human
guuuucucucggcucccca

SEQ ID NO: 1457010 - RNA, 12 nt, Human
guuuucuaauug

SEQ ID NO: 1457011 - RNA, 11 nt, Human
guuuucuaauu

SEQ ID NO: 1457012 - RNA, 16 nt, Human
guuuucgaaaaucaaa

SEQ ID NO: 1457013 - RNA, 14 nt, Human
guuuucgaaaauca

SEQ ID NO: 1457014 - RNA, 17 nt, Human
guuuucucucggcuccc

SEQ ID NO: 1457015 - RNA, 18 nt, Human
guuuucuccaagagcuac

SEQ ID NO: 1457016 - RNA, 21 nt, Human
guuuucuccucccaggaacug

SEQ ID NO: 1457017 - RNA, 18 nt, Human
guuuucuccucccaggaa

SEQ ID NO: 1457018 - RNA, 16 nt, Human
guuuucuccucccagg

SEQ ID NO: 1457019 - RNA, 13 nt, Human
guuuucuccuccc

SEQ ID NO: 1457020 - RNA, 14 nt, Human
guuuucuaauugcu

SEQ ID NO: 1457021 - RNA, 21 nt, Human
guuuucauccauaacugaaca

SEQ ID NO: 1457022 - RNA, 20 nt, Human
guuuucauccauaacugaac

SEQ ID NO: 1457023 - RNA, 19 nt, Human
guuuucauccauaacugaa

SEQ ID NO: 1457024 - RNA, 16 nt, Human
guuuucauuugguuca

SEQ ID NO: 1457025 - RNA, 17 nt, Human
guuuucauuugguucau

SEQ ID NO: 1457026 - RNA, 18 nt, Human
guuuguuuacaaaaucag

SEQ ID NO: 1457027 - RNA, 22 nt, Human
guuuguugguugguuuucuucu

SEQ ID NO: 1457028 - RNA, 23 nt, Human
guuugugccuuuuuauuuuuguu

SEQ ID NO: 1457029 - RNA, 18 nt, Human
guuuucauccauaacuga

SEQ ID NO: 1457030 - RNA, 18 nt, Human
guuuucaggcuagaugua

SEQ ID NO: 1457031 - RNA, 11 nt, Human
uaaaaaacaac

SEQ ID NO: 1457032 - RNA, 12 nt, Human
uaaaaaacacug

SEQ ID NO: 1457033 - RNA, 20 nt, Human
uaaaaaagcuuaaaacuuug

SEQ ID NO: 1457034 - RNA, 17 nt, Human
uaaaaaagauaaacaca

SEQ ID NO: 1457035 - RNA, 16 nt, Human
uaaaaaagauaaacac

SEQ ID NO: 1457036 - RNA, 13 nt, Human
uaaaaaagauaaa

SEQ ID NO: 1457037 - RNA, 12 nt, Human
uaaaaaagauaa

SEQ ID NO: 1457038 - RNA, 19 nt, Human
uaaaaaacuaaaaacuaga

SEQ ID NO: 1457039 - RNA, 17 nt, Human
uaaaaaacuaaaaacua

SEQ ID NO: 1457040 - RNA, 15 nt, Human
uaaaaaaccacaugg

SEQ ID NO: 1457041 - RNA, 16 nt, Human
uaaaaaagaaacauuu

SEQ ID NO: 1457042 - RNA, 19 nt, Human
uaaaaaugauuucaguagc

SEQ ID NO: 1457043 - RNA, 16 nt, Human
uaaaaacugagugacu

SEQ ID NO: 1457044 - RNA, 21 nt, Human
uaaaaacugagugacucuaua

SEQ ID NO: 1457045 - RNA, 14 nt, Human
uaaaaacucaagga

SEQ ID NO: 1457046 - RNA, 20 nt, Human
uaaaaacuagaggugagaaa

SEQ ID NO: 1457047 - RNA, 18 nt, Human
uaaaaaagcuuaaaacuu

SEQ ID NO: 1457048 - RNA, 17 nt, Human
uaaaaaagcuuaaaacu

SEQ ID NO: 1457049 - RNA, 17 nt, Human
uaaaaaagaucccaaau

SEQ ID NO: 1457050 - RNA, 19 nt, Human
uaaaaaagcuuaaaacuuu

SEQ ID NO: 1457051 - RNA, 14 nt, Human
uaaaaaauggucac

SEQ ID NO: 1457052 - RNA, 12 nt, Human
uaaaaaaugguu

SEQ ID NO: 1457053 - RNA, 19 nt, Human
uaaaaaaugguucagaauu

SEQ ID NO: 1457054 - RNA, 17 nt, Human
uaaaaacaaagaaauua

SEQ ID NO: 1457055 - RNA, 15 nt, Human
guuuuuaugagaaac

SEQ ID NO: 1457056 - RNA, 17 nt, Human
guuuuuaugagaaacuu

SEQ ID NO: 1457057 - RNA, 21 nt, Human
guuuuuaucugaaaucaauua

SEQ ID NO: 1457058 - RNA, 19 nt, Human
uaaaaaaaaagaucuguuu

SEQ ID NO: 1457059 - RNA, 14 nt, Human
guuuuucacauuuu

SEQ ID NO: 1457060 - RNA, 12 nt, Human
guuuuucacauu

SEQ ID NO: 1457061 - RNA, 16 nt, Human
guuuuucacauuuucc

SEQ ID NO: 1457062 - RNA, 15 nt, Human
uaaaaaaaagaugaa

SEQ ID NO: 1457063 - RNA, 20 nt, Human
uaaaaaaauaagaagaaugc

SEQ ID NO: 1457064 - RNA, 15 nt, Human
uaaaaaaauaagaag

SEQ ID NO: 1457065 - RNA, 22 nt, Human
uaaaaaaauaagaagaaugcuu

SEQ ID NO: 1457066 - RNA, 11 nt, Human
uaaaaaacacu

SEQ ID NO: 1457067 - RNA, 19 nt, Human
guuugaugaggcccuccac

SEQ ID NO: 1457068 - RNA, 15 nt, Human
guuugaugaggcccu

SEQ ID NO: 1457069 - RNA, 16 nt, Human
guuugauagauuuucu

SEQ ID NO: 1457070 - RNA, 15 nt, Human
guuugagauucucaa

SEQ ID NO: 1457071 - RNA, 17 nt, Human
guuugauuaaauucuug

SEQ ID NO: 1457072 - RNA, 19 nt, Human
guuugauuaaauucuugca

SEQ ID NO: 1457073 - RNA, 22 nt, Human
guuugauuaaauucuugcaaag

SEQ ID NO: 1457074 - RNA, 20 nt, Human
guuugaugaggcccuccaca

SEQ ID NO: 1457075 - RNA, 17 nt, Human
guuuguaaauuaacuuu

SEQ ID NO: 1457076 - RNA, 19 nt, Human
guuuguaaauuaacuuuua

SEQ ID NO: 1457077 - RNA, 20 nt, Human
guuuguaaauuaacuuuuau

SEQ ID NO: 1457078 - RNA, 19 nt, Human
guuugugcuguaaagaguu

SEQ ID NO: 1457079 - RNA, 17 nt, Human
guuugugacagggcggg

SEQ ID NO: 1457080 - RNA, 16 nt, Human
guuugugacagggcgg

SEQ ID NO: 1457081 - RNA, 17 nt, Human
guuucuaaacuggagac

SEQ ID NO: 1457082 - RNA, 15 nt, Human
guuucuaaacuggag

SEQ ID NO: 1457083 - RNA, 23 nt, Human
guuucguggggaggucuaaucua

SEQ ID NO: 1457084 - RNA, 15 nt, Human
guuucguggggaggu

SEQ ID NO: 1457085 - RNA, 19 nt, Human
guuuccuugggaguuguca

SEQ ID NO: 1457086 - RNA, 18 nt, Human
guuucuaaacuggagacu

SEQ ID NO: 1457087 - RNA, 23 nt, Human
guuucuuucuuucuuuauuuuga

SEQ ID NO: 1457088 - RNA, 12 nt, Human
guuucuuucuuu

SEQ ID NO: 1457089 - RNA, 20 nt, Human
guuucuuucucugaggacaa

SEQ ID NO: 1457090 - RNA, 19 nt, Human
guuucuuucucugaggaca

SEQ ID NO: 1457091 - RNA, 14 nt, Human
guuucuuuguaaug

SEQ ID NO: 1457092 - RNA, 17 nt, Human
guuucuuuguaaugaaa

SEQ ID NO: 1457093 - RNA, 18 nt, Human
guuucuuuguaaugaaaa

SEQ ID NO: 1457094 - RNA, 14 nt, Human
guuugaauguuaaa

SEQ ID NO: 1457095 - RNA, 15 nt, Human
guuugaauguuaaau

SEQ ID NO: 1457096 - RNA, 19 nt, Human
guuuccagcauucccaggu

SEQ ID NO: 1457097 - RNA, 16 nt, Human
guuuccagcauuccca

SEQ ID NO: 1457098 - RNA, 13 nt, Human
guuuccagcauuc

SEQ ID NO: 1457099 - RNA, 16 nt, Human
guuuccacagccugca

SEQ ID NO: 1457100 - RNA, 21 nt, Human
guuucauuuagucaugugacc

SEQ ID NO: 1457101 - RNA, 20 nt, Human
guuucauuuagucaugugac

SEQ ID NO: 1457102 - RNA, 19 nt, Human
guuucauuuagucauguga

SEQ ID NO: 1457103 - RNA, 23 nt, Human
guuucaggagagaguugaaccua

SEQ ID NO: 1457104 - RNA, 22 nt, Human
guuucaggagagaguugaaccu

SEQ ID NO: 1457105 - RNA, 23 nt, Human
guuucagcacuagccaaaccuca

SEQ ID NO: 1457106 - RNA, 12 nt, Human
guuucagcacua

SEQ ID NO: 1457107 - RNA, 18 nt, Human
guuucagcgacuccguug

SEQ ID NO: 1457108 - RNA, 18 nt, Human
guuucagaaauguguuau

SEQ ID NO: 1457109 - RNA, 22 nt, Human
guuuccugaaacaacuuggaaa

SEQ ID NO: 1457110 - RNA, 14 nt, Human
guuucccaggccca

SEQ ID NO: 1457111 - RNA, 16 nt, Human
guuucccaagagcuac

SEQ ID NO: 1457112 - RNA, 23 nt, Human
guuuccucuguucaaagcugccu

SEQ ID NO: 1457113 - RNA, 16 nt, Human
guuuccuuauauuaug

SEQ ID NO: 1457114 - RNA, 16 nt, Human
guuuacuuguuucaga

SEQ ID NO: 1457115 - RNA, 20 nt, Human
gguuggcucugccaguccug

SEQ ID NO: 1457116 - RNA, 16 nt, Human
gguuggcucugccagu

SEQ ID NO: 1457117 - RNA, 14 nt, Human
gguugcagacagga

SEQ ID NO: 1457118 - RNA, 20 nt, Human
guuuagauuuaugguuguua

SEQ ID NO: 1457119 - RNA, 13 nt, Human
guuuagcucugag

SEQ ID NO: 1457120 - RNA, 12 nt, Human
guuuagcucuga

SEQ ID NO: 1457121 - RNA, 17 nt, Human
guuuagggaacaauuug

SEQ ID NO: 1457122 - RNA, 16 nt, Human
guuuagggaacaauuu

SEQ ID NO: 1457123 - RNA, 23 nt, Human
guuuaggcuauuuguaaaucugc

SEQ ID NO: 1457124 - RNA, 22 nt, Human
guuuaggcuauuuguaaaucug

SEQ ID NO: 1457125 - RNA, 15 nt, Human
guuuaggcuauuugu

SEQ ID NO: 1457126 - RNA, 15 nt, Human
guuuagcucugagaa

SEQ ID NO: 1457127 - RNA, 14 nt, Human
guuuagcucugaga

SEQ ID NO: 1457128 - RNA, 16 nt, Human
guuuagcucugagaac

SEQ ID NO: 1457129 - RNA, 14 nt, Human
guuuaggcuauuug

SEQ ID NO: 1457130 - RNA, 16 nt, Human
guuuaguaaucauauu

SEQ ID NO: 1457131 - RNA, 22 nt, Human
ucaauagccacuaaccuugccu

SEQ ID NO: 1457132 - RNA, 23 nt, Human
ucaauagccacuaaccuugccug

SEQ ID NO: 1457133 - RNA, 13 nt, Human
ucaauagccacua

SEQ ID NO: 1457134 - RNA, 12 nt, Human
ucaauagccacu

SEQ ID NO: 1457135 - RNA, 14 nt, Human
ucaauacagauaua

SEQ ID NO: 1457136 - RNA, 19 nt, Human
ucaauacagauauauuuuc

SEQ ID NO: 1457137 - RNA, 16 nt, Human
ucaauacagauauauu

SEQ ID NO: 1457138 - RNA, 15 nt, Human
ucaauacagauauau

SEQ ID NO: 1457139 - RNA, 14 nt, Human
ucaauggggccagu

SEQ ID NO: 1457140 - RNA, 12 nt, Human
ucaaugcucaua

SEQ ID NO: 1457141 - RNA, 13 nt, Human
ucaaugcucauaa

SEQ ID NO: 1457142 - RNA, 14 nt, Human
ucaaugcucauaac

SEQ ID NO: 1457143 - RNA, 13 nt, Human
ucacacaaagcag

SEQ ID NO: 1457144 - RNA, 15 nt, Human
ucacaaugagauuga

SEQ ID NO: 1457145 - RNA, 15 nt, Human
ucacaauaauuuucu

SEQ ID NO: 1457146 - RNA, 13 nt, Human
ucacaauacuguu

SEQ ID NO: 1457147 - RNA, 16 nt, Human
ucacaauaauuuucua

SEQ ID NO: 1457148 - RNA, 23 nt, Human
ucacacaggcauuuccugggugg

SEQ ID NO: 1457149 - RNA, 21 nt, Human
ucacacaggcauuuccugggu

SEQ ID NO: 1457150 - RNA, 20 nt, Human
ucacacaggcauuuccuggg

SEQ ID NO: 1457151 - RNA, 14 nt, Human
ucacacaaagcaga

SEQ ID NO: 1457152 - RNA, 23 nt, Human
ucacaggacagcccuucuuucca

SEQ ID NO: 1457153 - RNA, 21 nt, Human
ucaagcugaguauuaaaaugu

SEQ ID NO: 1457154 - RNA, 23 nt, Human
ucaagcugaguauuaaaauguau

SEQ ID NO: 1457155 - RNA, 20 nt, Human
ucaagcugaguauuaaaaug

SEQ ID NO: 1457156 - RNA, 18 nt, Human
ucaagcucugagggaaag

SEQ ID NO: 1457157 - RNA, 21 nt, Human
ucaagcucugagggaaagggc

SEQ ID NO: 1457158 - RNA, 15 nt, Human
ucaagcucugaggga

SEQ ID NO: 1457159 - RNA, 13 nt, Human
ucaagcucugagg

SEQ ID NO: 1457160 - RNA, 12 nt, Human
ucaagcucugag

SEQ ID NO: 1457161 - RNA, 11 nt, Human
ucaagcucuga

SEQ ID NO: 1457162 - RNA, 16 nt, Human
ucaagccccggacuca

SEQ ID NO: 1457163 - RNA, 12 nt, Human
ucaagcccugca

SEQ ID NO: 1457164 - RNA, 13 nt, Human
ucaagcccugcag

SEQ ID NO: 1457165 - RNA, 23 nt, Human
ucaagcagucgugccugugucca

SEQ ID NO: 1457166 - RNA, 22 nt, Human
ucaagcagucgugccugugucc

SEQ ID NO: 1457167 - RNA, 21 nt, Human
ucaagcagucgugccuguguc

SEQ ID NO: 1457168 - RNA, 20 nt, Human
ucaagcagucgugccugugu

SEQ ID NO: 1457169 - RNA, 19 nt, Human
ucaagcagucgugccugug

SEQ ID NO: 1457170 - RNA, 15 nt, Human
ucaagcgauucuccu

SEQ ID NO: 1457171 - RNA, 16 nt, Human
ucaaagaaaguguauu

SEQ ID NO: 1457172 - RNA, 15 nt, Human
ucaaagaaaguguau

SEQ ID NO: 1457173 - RNA, 14 nt, Human
ucaaagaaagugua

SEQ ID NO: 1457174 - RNA, 12 nt, Human
ucaaagaaagug

SEQ ID NO: 1457175 - RNA, 15 nt, Human
ucaaacugaggaauu

SEQ ID NO: 1457176 - RNA, 16 nt, Human
ucaaacuuuacuaugg

SEQ ID NO: 1457177 - RNA, 21 nt, Human
ucaaacuccugaccucaggca

SEQ ID NO: 1457178 - RNA, 20 nt, Human
ucaaacuccugaccucaggc

SEQ ID NO: 1457179 - RNA, 18 nt, Human
ucaaacuccugaccucag

SEQ ID NO: 1457180 - RNA, 20 nt, Human
ucaaacuacuuugcugcuaa

SEQ ID NO: 1457181 - RNA, 15 nt, Human
ucaaacuuuacuaug

SEQ ID NO: 1457182 - RNA, 13 nt, Human
ucaaacuuuacua

SEQ ID NO: 1457183 - RNA, 15 nt, Human
ucaacguauuguuuc

SEQ ID NO: 1457184 - RNA, 21 nt, Human
ucaacggaaagugcugucuua

SEQ ID NO: 1457185 - RNA, 12 nt, Human
ucaaccucccaa

SEQ ID NO: 1457186 - RNA, 11 nt, Human
ucaaccucauc

SEQ ID NO: 1457187 - RNA, 18 nt, Human
ucaagcagucgugccugu

SEQ ID NO: 1457188 - RNA, 17 nt, Human
ucaagcagucgugccug

SEQ ID NO: 1457189 - RNA, 16 nt, Human
ucaagcagucgugccu

SEQ ID NO: 1457190 - RNA, 23 nt, Human
ucaagcagcgaccgcccccuccu

SEQ ID NO: 1457191 - RNA, 15 nt, Human
ucaacuaggaucaga

SEQ ID NO: 1457192 - RNA, 19 nt, Human
ucaacuccaaacugacucu

SEQ ID NO: 1457193 - RNA, 21 nt, Human
uauuuuagugaacuugaaaua

SEQ ID NO: 1457194 - RNA, 23 nt, Human
uauuugggccugcuccagaccug

SEQ ID NO: 1457195 - RNA, 15 nt, Human
uauuugggaagugaa

SEQ ID NO: 1457196 - RNA, 14 nt, Human
uauuugggaaguga

SEQ ID NO: 1457197 - RNA, 19 nt, Human
uauuuggaaauaaagucag

SEQ ID NO: 1457198 - RNA, 17 nt, Human
uauuuggaaauaaaguc

SEQ ID NO: 1457199 - RNA, 16 nt, Human
uauuuggaaauaaagu

SEQ ID NO: 1457200 - RNA, 11 nt, Human
uauuugcuuuu

SEQ ID NO: 1457201 - RNA, 14 nt, Human
uauuugcuaauuuu

SEQ ID NO: 1457202 - RNA, 19 nt, Human
uauuugauguaauacuucu

SEQ ID NO: 1457203 - RNA, 14 nt, Human
uauuugauguaaua

SEQ ID NO: 1457204 - RNA, 16 nt, Human
uauuucuuaaacacuu

SEQ ID NO: 1457205 - RNA, 13 nt, Human
uauuucuuaaaca

SEQ ID NO: 1457206 - RNA, 14 nt, Human
uauuucugccuccc

SEQ ID NO: 1457207 - RNA, 17 nt, Human
uauuucugcauauguug

SEQ ID NO: 1457208 - RNA, 19 nt, Human
uaucugaauuuuuaaacaa

SEQ ID NO: 1457209 - RNA, 20 nt, Human
uaucugaauuuuuaaacaag

SEQ ID NO: 1457210 - RNA, 21 nt, Human
uauuucuaugaaauauuaugu

SEQ ID NO: 1457211 - RNA, 17 nt, Human
uauuuauuguauucugg

SEQ ID NO: 1457212 - RNA, 13 nt, Human
uauuuauuguauu

SEQ ID NO: 1457213 - RNA, 14 nt, Human
uauuuauugguuuu

SEQ ID NO: 1457214 - RNA, 22 nt, Human
uauuucuaugaaauauuauguu

SEQ ID NO: 1457215 - RNA, 13 nt, Human
uauuuauuacugu

SEQ ID NO: 1457216 - RNA, 16 nt, Human
ucaaaacuacaaauca

SEQ ID NO: 1457217 - RNA, 15 nt, Human
ucaaaaccuuuugaa

SEQ ID NO: 1457218 - RNA, 21 nt, Human
ucaaacuacuuugcugcuaau

SEQ ID NO: 1457219 - RNA, 16 nt, Human
ucaaacuacuuugcug

SEQ ID NO: 1457220 - RNA, 18 nt, Human
ucaaacuacauauuguaa

SEQ ID NO: 1457221 - RNA, 22 nt, Human
ucaaaaccagguccaaugagcu

SEQ ID NO: 1457222 - RNA, 22 nt, Human
ucaaaacauugugccaugucaa

SEQ ID NO: 1457223 - RNA, 12 nt, Human
ucaaaacauugu

SEQ ID NO: 1457224 - RNA, 12 nt, Human
ucaaaaagaacc

SEQ ID NO: 1457225 - RNA, 22 nt, Human
ucaaaaacuuuggaguccccuc

SEQ ID NO: 1457226 - RNA, 17 nt, Human
ucaaaaacuuuggaguc

SEQ ID NO: 1457227 - RNA, 13 nt, Human
ucaaaaacuauuu

SEQ ID NO: 1457228 - RNA, 13 nt, Human
ucaaaaaauugca

SEQ ID NO: 1457229 - RNA, 17 nt, Human
uauuuuuuucugaaauu

SEQ ID NO: 1457230 - RNA, 16 nt, Human
uauuuuuuucugaaau

SEQ ID NO: 1457231 - RNA, 12 nt, Human
ucaaaaaaggca

SEQ ID NO: 1457232 - RNA, 17 nt, Human
uauuuuuuucuauuuuu

SEQ ID NO: 1457233 - RNA, 22 nt, Human
uauuuuuuucugaauuauuuuc

SEQ ID NO: 1457234 - RNA, 15 nt, Human
uauuuuuuuacuaau

SEQ ID NO: 1457235 - RNA, 15 nt, Human
uauuuuuuaauuauu

SEQ ID NO: 1457236 - RNA, 12 nt, Human
uauuuuuuaauu

SEQ ID NO: 1457237 - RNA, 17 nt, Human
uauuuugacauaaaguu

SEQ ID NO: 1457238 - RNA, 18 nt, Human
uauuuugacauaaaguug

SEQ ID NO: 1457239 - RNA, 23 nt, Human
uauuuugaaucaauaauauauuu

SEQ ID NO: 1457240 - RNA, 22 nt, Human
uauuuugaaucaauaauauauu

SEQ ID NO: 1457241 - RNA, 16 nt, Human
uauuuugaaucaauaa

SEQ ID NO: 1457242 - RNA, 15 nt, Human
uauuuugaaucaaua

SEQ ID NO: 1457243 - RNA, 13 nt, Human
uauuuugaaucaa

SEQ ID NO: 1457244 - RNA, 12 nt, Human
uauuuugaauca

SEQ ID NO: 1457245 - RNA, 14 nt, Human
uauuuucauucaaa

SEQ ID NO: 1457246 - RNA, 12 nt, Human
uauuuucuuucu

SEQ ID NO: 1457247 - RNA, 13 nt, Human
uauuuucuuggau

SEQ ID NO: 1457248 - RNA, 19 nt, Human
uauuuucauccuugucuua

SEQ ID NO: 1457249 - RNA, 18 nt, Human
uauuuucaauagccacua

SEQ ID NO: 1457250 - RNA, 14 nt, Human
uauuuucagaugug

SEQ ID NO: 1457251 - RNA, 14 nt, Human
uauuuucaccauuu

SEQ ID NO: 1457252 - RNA, 13 nt, Human
uauuuucaccauu

SEQ ID NO: 1457253 - RNA, 21 nt, Human
uauuuuauguuauauauaaau

SEQ ID NO: 1457254 - RNA, 19 nt, Human
uauuuucaauagccacuaa

SEQ ID NO: 1457255 - RNA, 16 nt, Human
uauuuucaagaaacug

SEQ ID NO: 1457256 - RNA, 13 nt, Human
uauuuucaagaaa

SEQ ID NO: 1457257 - RNA, 14 nt, Human
uauuuuauguuaua

SEQ ID NO: 1457258 - RNA, 12 nt, Human
uauuuuauguua

SEQ ID NO: 1457259 - RNA, 15 nt, Human
uauuuuauguugcau

SEQ ID NO: 1457260 - RNA, 16 nt, Human
uauuuuauguugcaua

SEQ ID NO: 1457261 - RNA, 23 nt, Human
ucagaaagugccugacacacuaa

SEQ ID NO: 1457262 - RNA, 15 nt, Human
ucagaaagugccuga

SEQ ID NO: 1457263 - RNA, 23 nt, Human
ucagaaagggagggcucugaggc

SEQ ID NO: 1457264 - RNA, 13 nt, Human
ucagaaauacaga

SEQ ID NO: 1457265 - RNA, 16 nt, Human
ucagaaauacagauuu

SEQ ID NO: 1457266 - RNA, 20 nt, Human
ucagaaauacagauuuugau

SEQ ID NO: 1457267 - RNA, 22 nt, Human
ucagaaagggagggcucugagg

SEQ ID NO: 1457268 - RNA, 21 nt, Human
ucagaaagggagggcucugag

SEQ ID NO: 1457269 - RNA, 20 nt, Human
ucagaaagggagggcucuga

SEQ ID NO: 1457270 - RNA, 19 nt, Human
ucagaaagggagggcucug

SEQ ID NO: 1457271 - RNA, 18 nt, Human
ucagaaagggagggcucu

SEQ ID NO: 1457272 - RNA, 17 nt, Human
ucagaaagggagggcuc

SEQ ID NO: 1457273 - RNA, 14 nt, Human
ucagaaagggaggg

SEQ ID NO: 1457274 - RNA, 17 nt, Human
ucagaaaggaaaaacaa

SEQ ID NO: 1457275 - RNA, 20 nt, Human
ucagaaaggaaaaacaaacu

SEQ ID NO: 1457276 - RNA, 23 nt, Human
ucagaaaauguucuguuugcugu

SEQ ID NO: 1457277 - RNA, 19 nt, Human
ucagaaaauguucuguuug

SEQ ID NO: 1457278 - RNA, 18 nt, Human
ucagaaaauguucuguuu

SEQ ID NO: 1457279 - RNA, 13 nt, Human
ucagaaagacuug

SEQ ID NO: 1457280 - RNA, 15 nt, Human
ucagaaaauguucug

SEQ ID NO: 1457281 - RNA, 20 nt, Human
ucagaaaauaucccuccugu

SEQ ID NO: 1457282 - RNA, 20 nt, Human
ucacuuuuugaggcaaaaga

SEQ ID NO: 1457283 - RNA, 16 nt, Human
ucacuuuuugaggcaa

SEQ ID NO: 1457284 - RNA, 22 nt, Human
ucacuuuuugaggcaaaagaag

SEQ ID NO: 1457285 - RNA, 17 nt, Human
ucacuuuuucugauaaa

SEQ ID NO: 1457286 - RNA, 16 nt, Human
ucacuuuuucugauaa

SEQ ID NO: 1457287 - RNA, 14 nt, Human
ucacuuuuucugau

SEQ ID NO: 1457288 - RNA, 13 nt, Human
ucacuuuuucuga

SEQ ID NO: 1457289 - RNA, 15 nt, Human
ucacuuuucccacuc

SEQ ID NO: 1457290 - RNA, 18 nt, Human
ucacuuuugacaaaggca

SEQ ID NO: 1457291 - RNA, 18 nt, Human
ucacuuuuccucccucag

SEQ ID NO: 1457292 - RNA, 13 nt, Human
ucacuuuuccucc

SEQ ID NO: 1457293 - RNA, 21 nt, Human
ucacuuuuaaugaacaaaugg

SEQ ID NO: 1457294 - RNA, 19 nt, Human
ucacuuuuaaugaacaaau

SEQ ID NO: 1457295 - RNA, 14 nt, Human
ucacuuucucaguu

SEQ ID NO: 1457296 - RNA, 17 nt, Human
ucacuugugcaguguug

SEQ ID NO: 1457297 - RNA, 12 nt, Human
ucacuuuuccuc

SEQ ID NO: 1457298 - RNA, 14 nt, Human
ucacuuuucccacu

SEQ ID NO: 1457299 - RNA, 13 nt, Human
ucacuuuucccac

SEQ ID NO: 1457300 - RNA, 17 nt, Human
ucacucugaguguuuua

SEQ ID NO: 1457301 - RNA, 15 nt, Human
ucacugcuuaacuuc

SEQ ID NO: 1457302 - RNA, 17 nt, Human
ucacugcuuaacuucac

SEQ ID NO: 1457303 - RNA, 18 nt, Human
ucacugcuuaacuucaca

SEQ ID NO: 1457304 - RNA, 20 nt, Human
ucacugcuuaacuucacaua

SEQ ID NO: 1457305 - RNA, 17 nt, Human
ucacuggcucuccuggc

SEQ ID NO: 1457306 - RNA, 12 nt, Human
ucacuggcucuc

SEQ ID NO: 1457307 - RNA, 13 nt, Human
ucacuggcucucc

SEQ ID NO: 1457308 - RNA, 22 nt, Human
ucacuggcgacacguagcagcu

SEQ ID NO: 1457309 - RNA, 20 nt, Human
ucacuggcgacacguagcag

SEQ ID NO: 1457310 - RNA, 15 nt, Human
ucacuuguacaaaau

SEQ ID NO: 1457311 - RNA, 14 nt, Human
ucacuuguacaaaa

SEQ ID NO: 1457312 - RNA, 13 nt, Human
ucacuuguacaaa

SEQ ID NO: 1457313 - RNA, 18 nt, Human
ucacuggcucuccuggcc

SEQ ID NO: 1457314 - RNA, 22 nt, Human
ucacuugucaggagugugugug

SEQ ID NO: 1457315 - RNA, 21 nt, Human
ucacuugucaggagugugugu

SEQ ID NO: 1457316 - RNA, 19 nt, Human
ucacuugucaggagugugu

SEQ ID NO: 1457317 - RNA, 17 nt, Human
ucacuuguacaaaauaa

SEQ ID NO: 1457318 - RNA, 16 nt, Human
ucacuuguacaaaaua

SEQ ID NO: 1457319 - RNA, 17 nt, Human
ucacuugucaauaaaau

SEQ ID NO: 1457320 - RNA, 18 nt, Human
ucagacugacaguuuaca

SEQ ID NO: 1457321 - RNA, 18 nt, Human
ucagacucuaagaaagaa

SEQ ID NO: 1457322 - RNA, 17 nt, Human
ucagacucuaagaaaga

SEQ ID NO: 1457323 - RNA, 15 nt, Human
ucagacuaagccagc

SEQ ID NO: 1457324 - RNA, 19 nt, Human
ucagacucuaagaaagaac

SEQ ID NO: 1457325 - RNA, 22 nt, Human
ucagacucccauuccugaagaa

SEQ ID NO: 1457326 - RNA, 21 nt, Human
ucagacucccauuccugaaga

SEQ ID NO: 1457327 - RNA, 19 nt, Human
ucagacucccauuccugaa

SEQ ID NO: 1457328 - RNA, 17 nt, Human
ucagacuaagccagcac

SEQ ID NO: 1457329 - RNA, 14 nt, Human
ucagaccacggcuc

SEQ ID NO: 1457330 - RNA, 14 nt, Human
ucagaccacaugcc

SEQ ID NO: 1457331 - RNA, 22 nt, Human
ucagacaucugagguuuuauuu

SEQ ID NO: 1457332 - RNA, 19 nt, Human
ucagacaucugagguuuua

SEQ ID NO: 1457333 - RNA, 19 nt, Human
ucagcacaaggccaucugg

SEQ ID NO: 1457334 - RNA, 19 nt, Human
ucagcaagacuucucuuug

SEQ ID NO: 1457335 - RNA, 16 nt, Human
ucagcaacucgcuuua

SEQ ID NO: 1457336 - RNA, 20 nt, Human
ucagcaaagugguucccucu

SEQ ID NO: 1457337 - RNA, 18 nt, Human
ucagcaaagugguucccu

SEQ ID NO: 1457338 - RNA, 19 nt, Human
ucagcacuuggcccuucua

SEQ ID NO: 1457339 - RNA, 21 nt, Human
ucagcacugucccuugccuca

SEQ ID NO: 1457340 - RNA, 14 nt, Human
ucagcacugucccu

SEQ ID NO: 1457341 - RNA, 13 nt, Human
ucagcacuguccc

SEQ ID NO: 1457342 - RNA, 12 nt, Human
ucagcacugucc

SEQ ID NO: 1457343 - RNA, 22 nt, Human
ucagcacugccugcucccaucc

SEQ ID NO: 1457344 - RNA, 18 nt, Human
ucagcacugccugcuccc

SEQ ID NO: 1457345 - RNA, 15 nt, Human
ucagcacugccugcu

SEQ ID NO: 1457346 - RNA, 13 nt, Human
ucagcacaaggcc

SEQ ID NO: 1457347 - RNA, 14 nt, Human
ucagcacuagccaa

SEQ ID NO: 1457348 - RNA, 19 nt, Human
ucagcacgauuucuguuua

SEQ ID NO: 1457349 - RNA, 22 nt, Human
ucagaggcccucgcugccagcu

SEQ ID NO: 1457350 - RNA, 21 nt, Human
ucagaggcccucgcugccagc

SEQ ID NO: 1457351 - RNA, 18 nt, Human
ucagaggcccucgcugcc

SEQ ID NO: 1457352 - RNA, 19 nt, Human
ucagagugacauccaggag

SEQ ID NO: 1457353 - RNA, 18 nt, Human
ucagaguccuuaaaaugu

SEQ ID NO: 1457354 - RNA, 17 nt, Human
ucagaguccuuaaaaug

SEQ ID NO: 1457355 - RNA, 16 nt, Human
ucagaggcgcacugug

SEQ ID NO: 1457356 - RNA, 19 nt, Human
ucagaguucuuuuugaagu

SEQ ID NO: 1457357 - RNA, 16 nt, Human
ucagaguucuuuuuga

SEQ ID NO: 1457358 - RNA, 20 nt, Human
ucagagugacuacacacagu

SEQ ID NO: 1457359 - RNA, 21 nt, Human
ucagagugacauccaggagga

SEQ ID NO: 1457360 - RNA, 22 nt, Human
ucagaguugaugguuguacaua

SEQ ID NO: 1457361 - RNA, 15 nt, Human
ucagcaaacaggauc

SEQ ID NO: 1457362 - RNA, 21 nt, Human
ucagaguugcugcaaaccuga

SEQ ID NO: 1457363 - RNA, 15 nt, Human
ucagcaaacucuuuu

SEQ ID NO: 1457364 - RNA, 21 nt, Human
ucagcaaacaggaucaguuaa

SEQ ID NO: 1457365 - RNA, 14 nt, Human
ucacgcaugcagug

SEQ ID NO: 1457366 - RNA, 18 nt, Human
ucacgccagacuucccac

SEQ ID NO: 1457367 - RNA, 16 nt, Human
ucacgcaugcaguguu

SEQ ID NO: 1457368 - RNA, 22 nt, Human
ucaccucagauggcagcuuuua

SEQ ID NO: 1457369 - RNA, 23 nt, Human
ucaccucagauggcagcuuuuaa

SEQ ID NO: 1457370 - RNA, 21 nt, Human
ucaccucagauggcagcuuuu

SEQ ID NO: 1457371 - RNA, 20 nt, Human
ucaccucagauggcagcuuu

SEQ ID NO: 1457372 - RNA, 19 nt, Human
ucaccucagauggcagcuu

SEQ ID NO: 1457373 - RNA, 18 nt, Human
ucaccucagauggcagcu

SEQ ID NO: 1457374 - RNA, 17 nt, Human
ucaccucagauggcagc

SEQ ID NO: 1457375 - RNA, 16 nt, Human
ucaccucagauggcag

SEQ ID NO: 1457376 - RNA, 20 nt, Human
ucaccuauuuccauucaaca

SEQ ID NO: 1457377 - RNA, 23 nt, Human
ucaccuaggaagccucagauucc

SEQ ID NO: 1457378 - RNA, 20 nt, Human
ucaccuaggaagccucagau

SEQ ID NO: 1457379 - RNA, 19 nt, Human
ucaccuaggaagccucaga

SEQ ID NO: 1457380 - RNA, 17 nt, Human
ucaccuaggaagccuca

SEQ ID NO: 1457381 - RNA, 15 nt, Human
ucaccuaggaagccu

SEQ ID NO: 1457382 - RNA, 14 nt, Human
ucaccuaggaagcc

SEQ ID NO: 1457383 - RNA, 23 nt, Human
ucaccuagcugaauguuuuucua

SEQ ID NO: 1457384 - RNA, 22 nt, Human
ucaccuagcugaauguuuuucu

SEQ ID NO: 1457385 - RNA, 19 nt, Human
ucaccuuggcaccagacac

SEQ ID NO: 1457386 - RNA, 18 nt, Human
ucaccuuggcaccagaca

SEQ ID NO: 1457387 - RNA, 19 nt, Human
ucacacaggcauuuccugg

SEQ ID NO: 1457388 - RNA, 23 nt, Human
ucaccuuggcaccagacacccag

SEQ ID NO: 1457389 - RNA, 20 nt, Human
ucaccuagcugaauguuuuu

SEQ ID NO: 1457390 - RNA, 16 nt, Human
ucaccuagcugaaugu

SEQ ID NO: 1457391 - RNA, 19 nt, Human
ucaccuacucacacaggca

SEQ ID NO: 1457392 - RNA, 20 nt, Human
ucacagggcaguaccugagg

SEQ ID NO: 1457393 - RNA, 22 nt, Human
ucacagggcaguaccugagggu

SEQ ID NO: 1457394 - RNA, 18 nt, Human
ucacagggcaguaccuga

SEQ ID NO: 1457395 - RNA, 16 nt, Human
ucacagggcaguaccu

SEQ ID NO: 1457396 - RNA, 12 nt, Human
ucacagggcagu

SEQ ID NO: 1457397 - RNA, 23 nt, Human
ucacaggcagccagugcccugag

SEQ ID NO: 1457398 - RNA, 22 nt, Human
ucacaggcagccagugcccuga

SEQ ID NO: 1457399 - RNA, 19 nt, Human
ucacaggcagccagugccc

SEQ ID NO: 1457400 - RNA, 19 nt, Human
ucacaggccccaggaaagg

SEQ ID NO: 1457401 - RNA, 15 nt, Human
ucacaggcagccagu

SEQ ID NO: 1457402 - RNA, 14 nt, Human
ucacaggcagccag

SEQ ID NO: 1457403 - RNA, 16 nt, Human
ucacgcuuuuugaaaa

SEQ ID NO: 1457404 - RNA, 22 nt, Human
ucacgcuuuccugaauccaaac

SEQ ID NO: 1457405 - RNA, 17 nt, Human
ucacgcuuuccugaauc

SEQ ID NO: 1457406 - RNA, 16 nt, Human
ucacgcuuuccugaau

SEQ ID NO: 1457407 - RNA, 15 nt, Human
ucacgcuuuccugaa

SEQ ID NO: 1457408 - RNA, 14 nt, Human
ucacgcuuuccuga

SEQ ID NO: 1457409 - RNA, 17 nt, Human
ucacgggacuauuucca

SEQ ID NO: 1457410 - RNA, 19 nt, Human
ucacggcugcgcacugugu

SEQ ID NO: 1457411 - RNA, 18 nt, Human
ucacggcugcgcacugug

SEQ ID NO: 1457412 - RNA, 14 nt, Human
ucacggcugcgcac

SEQ ID NO: 1457413 - RNA, 20 nt, Human
ucacggccacacagcugccg

SEQ ID NO: 1457414 - RNA, 19 nt, Human
ucacggccacacagcugcc

SEQ ID NO: 1457415 - RNA, 21 nt, Human
ucacucuaauuaauuguaauc

SEQ ID NO: 1457416 - RNA, 16 nt, Human
ucacucgucuccccca

SEQ ID NO: 1457417 - RNA, 18 nt, Human
ucacucgauaauaaagua

SEQ ID NO: 1457418 - RNA, 14 nt, Human
ucacucgauaauaa

SEQ ID NO: 1457419 - RNA, 18 nt, Human
ucacuccuuuuaaagaaa

SEQ ID NO: 1457420 - RNA, 17 nt, Human
ucacuccuuuuaaagaa

SEQ ID NO: 1457421 - RNA, 16 nt, Human
ucacuccuuuuaaaga

SEQ ID NO: 1457422 - RNA, 15 nt, Human
ucacuccuuuuaaag

SEQ ID NO: 1457423 - RNA, 14 nt, Human
ucacuccuuuuaaa

SEQ ID NO: 1457424 - RNA, 13 nt, Human
ucacuccuuuuaa

SEQ ID NO: 1457425 - RNA, 20 nt, Human
ucacucugaguguuuuauga

SEQ ID NO: 1457426 - RNA, 15 nt, Human
ucacucugaguguuu

SEQ ID NO: 1457427 - RNA, 21 nt, Human
ucacucuagucaaugacauga

SEQ ID NO: 1457428 - RNA, 20 nt, Human
ucacucuagucaaugacaug

SEQ ID NO: 1457429 - RNA, 18 nt, Human
ucacucuagucaaugaca

SEQ ID NO: 1457430 - RNA, 16 nt, Human
ucccccucccuccccu

SEQ ID NO: 1457431 - RNA, 15 nt, Human
ucccccucuguccag

SEQ ID NO: 1457432 - RNA, 12 nt, Human
ucccccucuguc

SEQ ID NO: 1457433 - RNA, 16 nt, Human
ucccccauguucuguc

SEQ ID NO: 1457434 - RNA, 17 nt, Human
uccccagcucccaggac

SEQ ID NO: 1457435 - RNA, 16 nt, Human
uccccagcucccagga

SEQ ID NO: 1457436 - RNA, 15 nt, Human
uccccagcucccagg

SEQ ID NO: 1457437 - RNA, 13 nt, Human
uccccagcuccca

SEQ ID NO: 1457438 - RNA, 23 nt, Human
uccccagcgauucccucucccag

SEQ ID NO: 1457439 - RNA, 14 nt, Human
uccccagccuggga

SEQ ID NO: 1457440 - RNA, 11 nt, Human
uccccagagaa

SEQ ID NO: 1457441 - RNA, 10 nt, Human
uccccagaga

SEQ ID NO: 1457442 - RNA, 17 nt, Human
uccccagacuuguuggc

SEQ ID NO: 1457443 - RNA, 15 nt, Human
uccccagacuuguug

SEQ ID NO: 1457444 - RNA, 23 nt, Human
ucccccagucauucugggaacau

SEQ ID NO: 1457445 - RNA, 12 nt, Human
ucccccagccuc

SEQ ID NO: 1457446 - RNA, 19 nt, Human
uccccugcccccugcagga

SEQ ID NO: 1457447 - RNA, 18 nt, Human
uccccugcccccugcagg

SEQ ID NO: 1457448 - RNA, 17 nt, Human
uccccugcccccugcag

SEQ ID NO: 1457449 - RNA, 16 nt, Human
uccccugcccccugca

SEQ ID NO: 1457450 - RNA, 12 nt, Human
uccccugccccc

SEQ ID NO: 1457451 - RNA, 21 nt, Human
uccccugcccaugcugggagc

SEQ ID NO: 1457452 - RNA, 15 nt, Human
uccccugcccaugcu

SEQ ID NO: 1457453 - RNA, 14 nt, Human
uccccugcccaugc

SEQ ID NO: 1457454 - RNA, 20 nt, Human
uccccugcaggcugagugca

SEQ ID NO: 1457455 - RNA, 20 nt, Human
uccccugccagggcagggcc

SEQ ID NO: 1457456 - RNA, 15 nt, Human
uccccugccagggca

SEQ ID NO: 1457457 - RNA, 14 nt, Human
uccccugccagggc

SEQ ID NO: 1457458 - RNA, 12 nt, Human
uccccugccagg

SEQ ID NO: 1457459 - RNA, 19 nt, Human
uccccugccaccaggccac

SEQ ID NO: 1457460 - RNA, 17 nt, Human
uccccugccaccaggcc

SEQ ID NO: 1457461 - RNA, 16 nt, Human
uccccugccaccaggc

SEQ ID NO: 1457462 - RNA, 14 nt, Human
uccccugccaccag

SEQ ID NO: 1457463 - RNA, 13 nt, Human
uccccugccacca

SEQ ID NO: 1457464 - RNA, 18 nt, Human
uccccugcaggcugagug

SEQ ID NO: 1457465 - RNA, 14 nt, Human
uccccugcaggcug

SEQ ID NO: 1457466 - RNA, 22 nt, Human
uccccugcacuguaaaaugugg

SEQ ID NO: 1457467 - RNA, 19 nt, Human
uccccugcacuguaaaaug

SEQ ID NO: 1457468 - RNA, 18 nt, Human
uccccugcacuguaaaau

SEQ ID NO: 1457469 - RNA, 17 nt, Human
uccccugcacuguaaaa

SEQ ID NO: 1457470 - RNA, 16 nt, Human
uccccugcacuguaaa

SEQ ID NO: 1457471 - RNA, 15 nt, Human
uccccugcacuguaa

SEQ ID NO: 1457472 - RNA, 14 nt, Human
uccccugcacugua

SEQ ID NO: 1457473 - RNA, 13 nt, Human
uccccugcacugu

SEQ ID NO: 1457474 - RNA, 23 nt, Human
uccccgauaccaugcuguaagga

SEQ ID NO: 1457475 - RNA, 21 nt, Human
uccccgcaccccccaagcugu

SEQ ID NO: 1457476 - RNA, 14 nt, Human
uccccgcacccccc

SEQ ID NO: 1457477 - RNA, 17 nt, Human
uccccgacuggggcagg

SEQ ID NO: 1457478 - RNA, 18 nt, Human
uccccugccugcccuggu

SEQ ID NO: 1457479 - RNA, 23 nt, Human
uccccugcccccugcaggaagga

SEQ ID NO: 1457480 - RNA, 21 nt, Human
uccccugcccccugcaggaag

SEQ ID NO: 1457481 - RNA, 19 nt, Human
uccccuggagggggaaugg

SEQ ID NO: 1457482 - RNA, 20 nt, Human
uccccuggaacugucucuca

SEQ ID NO: 1457483 - RNA, 18 nt, Human
uccccuggaacugucucu

SEQ ID NO: 1457484 - RNA, 18 nt, Human
uccccuuccacugagggc

SEQ ID NO: 1457485 - RNA, 17 nt, Human
uccccuuccacugaggg

SEQ ID NO: 1457486 - RNA, 13 nt, Human
uccccuuccacug

SEQ ID NO: 1457487 - RNA, 11 nt, Human
ucccuaauaaa

SEQ ID NO: 1457488 - RNA, 12 nt, Human
ucccuaauaaag

SEQ ID NO: 1457489 - RNA, 14 nt, Human
ucccucccucuccg

SEQ ID NO: 1457490 - RNA, 21 nt, Human
ucccuacugaagcccuuguga

SEQ ID NO: 1457491 - RNA, 18 nt, Human
ucccuacugaagcccuug

SEQ ID NO: 1457492 - RNA, 15 nt, Human
ucccuacugaagccc

SEQ ID NO: 1457493 - RNA, 19 nt, Human
ucccuaccuugaaagaaga

SEQ ID NO: 1457494 - RNA, 15 nt, Human
ucccuacuguaauuu

SEQ ID NO: 1457495 - RNA, 13 nt, Human
ucccuaauaaagc

SEQ ID NO: 1457496 - RNA, 14 nt, Human
ucccuaauaaagcu

SEQ ID NO: 1457497 - RNA, 19 nt, Human
ucccaaauuugauugauuu

SEQ ID NO: 1457498 - RNA, 17 nt, Human
ucccaaauuugauugau

SEQ ID NO: 1457499 - RNA, 14 nt, Human
ucccaaaugagcca

SEQ ID NO: 1457500 - RNA, 16 nt, Human
ucccaagcucagaggc

SEQ ID NO: 1457501 - RNA, 22 nt, Human
ucccaaauuugauugauuugaa

SEQ ID NO: 1457502 - RNA, 20 nt, Human
ucccaaauuugauugauuug

SEQ ID NO: 1457503 - RNA, 17 nt, Human
uccauccauggccagca

SEQ ID NO: 1457504 - RNA, 16 nt, Human
uccauccauggccagc

SEQ ID NO: 1457505 - RNA, 19 nt, Human
uccauccauggccagcagc

SEQ ID NO: 1457506 - RNA, 15 nt, Human
uccauccacauggga

SEQ ID NO: 1457507 - RNA, 21 nt, Human
uccauccaaggccagguucuc

SEQ ID NO: 1457508 - RNA, 13 nt, Human
uccauccaaggcc

SEQ ID NO: 1457509 - RNA, 15 nt, Human
uccauccauggccag

SEQ ID NO: 1457510 - RNA, 18 nt, Human
uccauccaccuuucccaa

SEQ ID NO: 1457511 - RNA, 23 nt, Human
uccagcucccugugcccccaggg

SEQ ID NO: 1457512 - RNA, 20 nt, Human
uccagcucccugugccccca

SEQ ID NO: 1457513 - RNA, 19 nt, Human
uccagcucccugugccccc

SEQ ID NO: 1457514 - RNA, 17 nt, Human
uccagcucccugugccc

SEQ ID NO: 1457515 - RNA, 19 nt, Human
uccagcuccaaccugcaaa

SEQ ID NO: 1457516 - RNA, 18 nt, Human
uccagcuccaaccugcaa

SEQ ID NO: 1457517 - RNA, 16 nt, Human
uccagcuccaaccugc

SEQ ID NO: 1457518 - RNA, 12 nt, Human
uccagcuccaac

SEQ ID NO: 1457519 - RNA, 16 nt, Human
uccagcauucccaggu

SEQ ID NO: 1457520 - RNA, 17 nt, Human
uccagcauucccaggua

SEQ ID NO: 1457521 - RNA, 24 nt, Human
uccauguaacugccuagaaacaac

SEQ ID NO: 1457522 - RNA, 15 nt, Human
uccauguaacugccu

SEQ ID NO: 1457523 - RNA, 14 nt, Human
uccauguaacugcc

SEQ ID NO: 1457524 - RNA, 12 nt, Human
uccauguaacug

SEQ ID NO: 1457525 - RNA, 17 nt, Human
uccauggccagcagcac

SEQ ID NO: 1457526 - RNA, 22 nt, Human
uccauguaacugccuagaaaca

SEQ ID NO: 1457527 - RNA, 14 nt, Human
uccauggccagcag

SEQ ID NO: 1457528 - RNA, 18 nt, Human
uccauggcaggaaggcuu

SEQ ID NO: 1457529 - RNA, 20 nt, Human
uccauggcccugcaaaagga

SEQ ID NO: 1457530 - RNA, 16 nt, Human
uccauggccagcagca

SEQ ID NO: 1457531 - RNA, 15 nt, Human
uccauggccagcagc

SEQ ID NO: 1457532 - RNA, 14 nt, Human
uccauggcccugcc

SEQ ID NO: 1457533 - RNA, 15 nt, Human
ucccauuccugaaga

SEQ ID NO: 1457534 - RNA, 17 nt, Human
ucccauuccugaagaac

SEQ ID NO: 1457535 - RNA, 14 nt, Human
ucccauuccugaag

SEQ ID NO: 1457536 - RNA, 13 nt, Human
ucccauuccugaa

SEQ ID NO: 1457537 - RNA, 19 nt, Human
uccccacuuguccgcuggg

SEQ ID NO: 1457538 - RNA, 19 nt, Human
uccccacuugcagcccugu

SEQ ID NO: 1457539 - RNA, 21 nt, Human
uccccacuuguccgcugggug

SEQ ID NO: 1457540 - RNA, 21 nt, Human
uccccagacgccuggcugcug

SEQ ID NO: 1457541 - RNA, 18 nt, Human
uccccagacgccuggcug

SEQ ID NO: 1457542 - RNA, 23 nt, Human
ucccaugggcagaggaccaggcu

SEQ ID NO: 1457543 - RNA, 14 nt, Human
ucccauggggaggg

SEQ ID NO: 1457544 - RNA, 13 nt, Human
ucccaucugcuuc

SEQ ID NO: 1457545 - RNA, 19 nt, Human
ucccaggacccuggaccca

SEQ ID NO: 1457546 - RNA, 22 nt, Human
ucccaggagacaguucaagaaa

SEQ ID NO: 1457547 - RNA, 16 nt, Human
ucccaggagacaguuc

SEQ ID NO: 1457548 - RNA, 15 nt, Human
ucccaggagacaguu

SEQ ID NO: 1457549 - RNA, 19 nt, Human
ucccaggacccugaagggg

SEQ ID NO: 1457550 - RNA, 16 nt, Human
ucccaggacccugaag

SEQ ID NO: 1457551 - RNA, 14 nt, Human
ucccaggacccuga

SEQ ID NO: 1457552 - RNA, 17 nt, Human
ucccaccuagcagcacc

SEQ ID NO: 1457553 - RNA, 19 nt, Human
ucccaaggggccugagcag

SEQ ID NO: 1457554 - RNA, 13 nt, Human
ucccaggacccug

SEQ ID NO: 1457555 - RNA, 18 nt, Human
ucccaaggggccugagca

SEQ ID NO: 1457556 - RNA, 17 nt, Human
ucccaaggggccugagc

SEQ ID NO: 1457557 - RNA, 16 nt, Human
ucccaaggggccugag

SEQ ID NO: 1457558 - RNA, 15 nt, Human
ucccaagggcugccg

SEQ ID NO: 1457559 - RNA, 20 nt, Human
ucccaaguaacugggauuac

SEQ ID NO: 1457560 - RNA, 21 nt, Human
ucccaaguaacugggauuaca

SEQ ID NO: 1457561 - RNA, 21 nt, Human
uccacaaauuauuaaugaaaa

SEQ ID NO: 1457562 - RNA, 20 nt, Human
uccacaaaauaaccaauccu

SEQ ID NO: 1457563 - RNA, 12 nt, Human
uccacaaaauaa

SEQ ID NO: 1457564 - RNA, 22 nt, Human
uccaauuuucuggaauacauga

SEQ ID NO: 1457565 - RNA, 20 nt, Human
uccacaaauuauuaaugaaa

SEQ ID NO: 1457566 - RNA, 14 nt, Human
uccacaaauuauua

SEQ ID NO: 1457567 - RNA, 20 nt, Human
uccaagcauuuagauguaua

SEQ ID NO: 1457568 - RNA, 20 nt, Human
uccaagauucuagaugauua

SEQ ID NO: 1457569 - RNA, 18 nt, Human
uccaagauucuagaugau

SEQ ID NO: 1457570 - RNA, 15 nt, Human
uccaagcaaauguga

SEQ ID NO: 1457571 - RNA, 23 nt, Human
uccaccgucuuucuuuuauacug

SEQ ID NO: 1457572 - RNA, 14 nt, Human
uccaccucaacucc

SEQ ID NO: 1457573 - RNA, 15 nt, Human
uccaccgcagaagga

SEQ ID NO: 1457574 - RNA, 16 nt, Human
uccaccgcagaaggaa

SEQ ID NO: 1457575 - RNA, 17 nt, Human
uccaccgcagaaggaag

SEQ ID NO: 1457576 - RNA, 18 nt, Human
uccaccgcagaaggaagg

SEQ ID NO: 1457577 - RNA, 19 nt, Human
uccagaaauacaauuuuag

SEQ ID NO: 1457578 - RNA, 19 nt, Human
uccacuucugacagccuca

SEQ ID NO: 1457579 - RNA, 17 nt, Human
uccacuucugacagccu

SEQ ID NO: 1457580 - RNA, 15 nt, Human
uccagcauucccagg

SEQ ID NO: 1457581 - RNA, 22 nt, Human
uccagcagauuuccagccuucu

SEQ ID NO: 1457582 - RNA, 14 nt, Human
uccagauccuggaa

SEQ ID NO: 1457583 - RNA, 17 nt, Human
uccagauccuggaaauc

SEQ ID NO: 1457584 - RNA, 16 nt, Human
uccagauccuggaaau

SEQ ID NO: 1457585 - RNA, 22 nt, Human
uccaagacaugucuguucuaca

SEQ ID NO: 1457586 - RNA, 20 nt, Human
uccaagacaugucuguucua

SEQ ID NO: 1457587 - RNA, 17 nt, Human
uccaagacaugucuguu

SEQ ID NO: 1457588 - RNA, 22 nt, Human
uccaagauauuuuaaaaucugu

SEQ ID NO: 1457589 - RNA, 18 nt, Human
uccaagauauuuuaaaau

SEQ ID NO: 1457590 - RNA, 18 nt, Human
uccaagagucuaaagaug

SEQ ID NO: 1457591 - RNA, 17 nt, Human
uccaagagucuaaagau

SEQ ID NO: 1457592 - RNA, 16 nt, Human
uccaagagucuaaaga

SEQ ID NO: 1457593 - RNA, 17 nt, Human
uccaagcauuuagaugu

SEQ ID NO: 1457594 - RNA, 17 nt, Human
uccaagauucuagauga

SEQ ID NO: 1457595 - RNA, 16 nt, Human
uccaagauucuagaug

SEQ ID NO: 1457596 - RNA, 15 nt, Human
uccaagauucuagau

SEQ ID NO: 1457597 - RNA, 14 nt, Human
uccaagauucuaga

SEQ ID NO: 1457598 - RNA, 13 nt, Human
uccaagauucuag

SEQ ID NO: 1457599 - RNA, 12 nt, Human
uccaagauucua

SEQ ID NO: 1457600 - RNA, 15 nt, Human
uccaagauuccggau

SEQ ID NO: 1457601 - RNA, 13 nt, Human
uccaagauuccgg

SEQ ID NO: 1457602 - RNA, 13 nt, Human
uccaagcaaaugu

SEQ ID NO: 1457603 - RNA, 15 nt, Human
uccaaagcagacagc

SEQ ID NO: 1457604 - RNA, 14 nt, Human
uccaaagcagacag

SEQ ID NO: 1457605 - RNA, 16 nt, Human
uccaaagcuucccacg

SEQ ID NO: 1457606 - RNA, 22 nt, Human
uccaaaggaggauggcauauaa

SEQ ID NO: 1457607 - RNA, 14 nt, Human
uccaagaauccaca

SEQ ID NO: 1457608 - RNA, 23 nt, Human
uccaagaauccacauuucuaaaa

SEQ ID NO: 1457609 - RNA, 22 nt, Human
uccaagaauccacauuucuaaa

SEQ ID NO: 1457610 - RNA, 21 nt, Human
uccaagaauccacauuucuaa

SEQ ID NO: 1457611 - RNA, 20 nt, Human
uccaagaauccacauuucua

SEQ ID NO: 1457612 - RNA, 19 nt, Human
uccaagaauccacauuucu

SEQ ID NO: 1457613 - RNA, 16 nt, Human
uccaagaauccacauu

SEQ ID NO: 1457614 - RNA, 14 nt, Human
uccaagaauuucua

SEQ ID NO: 1457615 - RNA, 22 nt, Human
ucauuucuuuuugggagagacu

SEQ ID NO: 1457616 - RNA, 16 nt, Human
uccaaaagcuuuuuau

SEQ ID NO: 1457617 - RNA, 17 nt, Human
uccaaaauaaaacuuuu

SEQ ID NO: 1457618 - RNA, 13 nt, Human
uccaaaagcuuuu

SEQ ID NO: 1457619 - RNA, 22 nt, Human
uccaaaagauugcugaaauuuu

SEQ ID NO: 1457620 - RNA, 20 nt, Human
uccaaaagauugcugaaauu

SEQ ID NO: 1457621 - RNA, 19 nt, Human
uccaaaagauugcugaaau

SEQ ID NO: 1457622 - RNA, 16 nt, Human
uccaaaauaaaacuuu

SEQ ID NO: 1457623 - RNA, 23 nt, Human
uccaaagaguagaauugcauuga

SEQ ID NO: 1457624 - RNA, 22 nt, Human
uccaaagaguagaauugcauug

SEQ ID NO: 1457625 - RNA, 19 nt, Human
uccaaacugaagcagccuc

SEQ ID NO: 1457626 - RNA, 19 nt, Human
uccaaacucuucccucucu

SEQ ID NO: 1457627 - RNA, 20 nt, Human
uccaaacugccuaagcccuc

SEQ ID NO: 1457628 - RNA, 23 nt, Human
uccaaacugacucuuaagaagac

SEQ ID NO: 1457629 - RNA, 23 nt, Human
ucauuucuuuuugggagagacuu

SEQ ID NO: 1457630 - RNA, 16 nt, Human
uccaaaagauugcuga

SEQ ID NO: 1457631 - RNA, 14 nt, Human
ucauuucucaucca

SEQ ID NO: 1457632 - RNA, 18 nt, Human
ucauucauuagucauguu

SEQ ID NO: 1457633 - RNA, 22 nt, Human
ucauucagauaugauucaaaug

SEQ ID NO: 1457634 - RNA, 12 nt, Human
ucaucugugcac

SEQ ID NO: 1457635 - RNA, 18 nt, Human
ucaucugucccuccggga

SEQ ID NO: 1457636 - RNA, 17 nt, Human
ucaucugucccuccggg

SEQ ID NO: 1457637 - RNA, 12 nt, Human
ucaucugucccu

SEQ ID NO: 1457638 - RNA, 20 nt, Human
ucaucugguugaacucuggu

SEQ ID NO: 1457639 - RNA, 23 nt, Human
ucaucugguugaacucugguggc

SEQ ID NO: 1457640 - RNA, 21 nt, Human
ucaucuggggagcaggcagcc

SEQ ID NO: 1457641 - RNA, 23 nt, Human
ucaucuggggagcaggcagccag

SEQ ID NO: 1457642 - RNA, 20 nt, Human
ucaucuggggagcaggcagc

SEQ ID NO: 1457643 - RNA, 16 nt, Human
ucaucuggggagcagg

SEQ ID NO: 1457644 - RNA, 14 nt, Human
ucaucucuucuuuu

SEQ ID NO: 1457645 - RNA, 16 nt, Human
ucaucucucugcccaa

SEQ ID NO: 1457646 - RNA, 14 nt, Human
ucaucucucugccc

SEQ ID NO: 1457647 - RNA, 23 nt, Human
ucaucuccugccuuccuccuggg

SEQ ID NO: 1457648 - RNA, 22 nt, Human
ucaucuccugccuuccuccugg

SEQ ID NO: 1457649 - RNA, 21 nt, Human
ucaucuccugccuuccuccug

SEQ ID NO: 1457650 - RNA, 21 nt, Human
ucauaguaacuucuuauggaa

SEQ ID NO: 1457651 - RNA, 18 nt, Human
ucauaguaacuucuuaug

SEQ ID NO: 1457652 - RNA, 16 nt, Human
ucauaguaacuucuua

SEQ ID NO: 1457653 - RNA, 15 nt, Human
ucauaguaacuucuu

SEQ ID NO: 1457654 - RNA, 14 nt, Human
ucauaguaacuucu

SEQ ID NO: 1457655 - RNA, 16 nt, Human
ucauaggucugaaauu

SEQ ID NO: 1457656 - RNA, 22 nt, Human
ucauaggucugaaauuuuucuu

SEQ ID NO: 1457657 - RNA, 15 nt, Human
ucauaggucugaaau

SEQ ID NO: 1457658 - RNA, 14 nt, Human
ucauaggucugaaa

SEQ ID NO: 1457659 - RNA, 15 nt, Human
ucauaccaaugaaaa

SEQ ID NO: 1457660 - RNA, 21 nt, Human
ucauacauuuucuaagaaaca

SEQ ID NO: 1457661 - RNA, 15 nt, Human
ucaugcuaucucugu

SEQ ID NO: 1457662 - RNA, 22 nt, Human
ucaugccucugaggccagccug

SEQ ID NO: 1457663 - RNA, 21 nt, Human
ucaugccucugaggccagccu

SEQ ID NO: 1457664 - RNA, 16 nt, Human
ucaugccucugaggcc

SEQ ID NO: 1457665 - RNA, 15 nt, Human
ucaugccucugaggc

SEQ ID NO: 1457666 - RNA, 14 nt, Human
ucaugccucugagg

SEQ ID NO: 1457667 - RNA, 13 nt, Human
ucaugccucugag

SEQ ID NO: 1457668 - RNA, 15 nt, Human
ucaugcccugugcaa

SEQ ID NO: 1457669 - RNA, 16 nt, Human
ucaugccccuggcugg

SEQ ID NO: 1457670 - RNA, 13 nt, Human
ucauguaaauaau

SEQ ID NO: 1457671 - RNA, 16 nt, Human
ucauguaaacugugca

SEQ ID NO: 1457672 - RNA, 17 nt, Human
ucauguaaacugugcac

SEQ ID NO: 1457673 - RNA, 14 nt, Human
ucauguaaacugug

SEQ ID NO: 1457674 - RNA, 13 nt, Human
ucauguaaacugu

SEQ ID NO: 1457675 - RNA, 20 nt, Human
ucauguaacuucccugaaaa

SEQ ID NO: 1457676 - RNA, 18 nt, Human
ucauguaaauaauacauu

SEQ ID NO: 1457677 - RNA, 19 nt, Human
ucauguaaauaauacauua

SEQ ID NO: 1457678 - RNA, 16 nt, Human
ucauuaggugugacug

SEQ ID NO: 1457679 - RNA, 22 nt, Human
ucauuauuuauguauugugcaa

SEQ ID NO: 1457680 - RNA, 22 nt, Human
ucauuaggugugacugaauuuc

SEQ ID NO: 1457681 - RNA, 18 nt, Human
ucauuaggugugacugaa

SEQ ID NO: 1457682 - RNA, 21 nt, Human
ucauuaggugugacugaauuu

SEQ ID NO: 1457683 - RNA, 15 nt, Human
ucauguaauccucaa

SEQ ID NO: 1457684 - RNA, 23 nt, Human
ucauacagagaagucacagggca

SEQ ID NO: 1457685 - RNA, 14 nt, Human
ucauacagagaagu

SEQ ID NO: 1457686 - RNA, 13 nt, Human
ucauacagagaag

SEQ ID NO: 1457687 - RNA, 12 nt, Human
ucauacagagaa

SEQ ID NO: 1457688 - RNA, 11 nt, Human
ucauacagaga

SEQ ID NO: 1457689 - RNA, 13 nt, Human
ucauacacagaaa

SEQ ID NO: 1457690 - RNA, 14 nt, Human
ucauacauuuucua

SEQ ID NO: 1457691 - RNA, 17 nt, Human
ucauacagagaagucac

SEQ ID NO: 1457692 - RNA, 16 nt, Human
ucauacagagaaguca

SEQ ID NO: 1457693 - RNA, 15 nt, Human
ucauacagagaaguc

SEQ ID NO: 1457694 - RNA, 19 nt, Human
ucauaauugcauugacuuu

SEQ ID NO: 1457695 - RNA, 23 nt, Human
ucauaauugcauugacuuucccc

SEQ ID NO: 1457696 - RNA, 19 nt, Human
ucauaauggggguaaaguu

SEQ ID NO: 1457697 - RNA, 13 nt, Human
ucaguugucucug

SEQ ID NO: 1457698 - RNA, 15 nt, Human
ucauaauuauuauuu

SEQ ID NO: 1457699 - RNA, 15 nt, Human
ucaguugugacuaac

SEQ ID NO: 1457700 - RNA, 18 nt, Human
ucaguugauuuucuggau

SEQ ID NO: 1457701 - RNA, 17 nt, Human
ucaguugauuuucugga

SEQ ID NO: 1457702 - RNA, 12 nt, Human
ucaguugcagcc

SEQ ID NO: 1457703 - RNA, 17 nt, Human
ucagcagccucccugaa

SEQ ID NO: 1457704 - RNA, 16 nt, Human
ucagcacuuggcccuu

SEQ ID NO: 1457705 - RNA, 14 nt, Human
ucagcacuuggccc

SEQ ID NO: 1457706 - RNA, 21 nt, Human
ucagcacuuuagaauaugccu

SEQ ID NO: 1457707 - RNA, 11 nt, Human
ucugacccagu

SEQ ID NO: 1457708 - RNA, 17 nt, Human
ucugacauucugauucg

SEQ ID NO: 1457709 - RNA, 15 nt, Human
ucugacccagugccc

SEQ ID NO: 1457710 - RNA, 14 nt, Human
ucugacccagugcc

SEQ ID NO: 1457711 - RNA, 13 nt, Human
ucugacccagugc

SEQ ID NO: 1457712 - RNA, 23 nt, Human
ucugacauuaugugguuuuagau

SEQ ID NO: 1457713 - RNA, 22 nt, Human
ucugacauuaugugguuuuaga

SEQ ID NO: 1457714 - RNA, 18 nt, Human
ucugaacuugcauuguga

SEQ ID NO: 1457715 - RNA, 19 nt, Human
ucugaacuugcauugugau

SEQ ID NO: 1457716 - RNA, 22 nt, Human
ucugagcacuguuuauacacug

SEQ ID NO: 1457717 - RNA, 21 nt, Human
ucugagcagcgagccugcuag

SEQ ID NO: 1457718 - RNA, 19 nt, Human
ucugagcagcgagccugcu

SEQ ID NO: 1457719 - RNA, 18 nt, Human
ucugagcagcgagccugc

SEQ ID NO: 1457720 - RNA, 17 nt, Human
ucugagcagcgagccug

SEQ ID NO: 1457721 - RNA, 22 nt, Human
ucugagauggcucccaggggcu

SEQ ID NO: 1457722 - RNA, 19 nt, Human
ucugagauggcucccaggg

SEQ ID NO: 1457723 - RNA, 18 nt, Human
ucugagauggcucccagg

SEQ ID NO: 1457724 - RNA, 22 nt, Human
ucugagaucuguugauugauga

SEQ ID NO: 1457725 - RNA, 23 nt, Human
ucugacccagugcccccacugac

SEQ ID NO: 1457726 - RNA, 22 nt, Human
ucugacccagugcccccacuga

SEQ ID NO: 1457727 - RNA, 19 nt, Human
ucugacccagugcccccac

SEQ ID NO: 1457728 - RNA, 20 nt, Human
ucugauucgaaugacacugu

SEQ ID NO: 1457729 - RNA, 22 nt, Human
ucugauucgaaugacacuguuc

SEQ ID NO: 1457730 - RNA, 19 nt, Human
ucugauucgaaugacacug

SEQ ID NO: 1457731 - RNA, 18 nt, Human
ucugaggacaagagaaaa

SEQ ID NO: 1457732 - RNA, 20 nt, Human
ucugcaauuccccucugcug

SEQ ID NO: 1457733 - RNA, 18 nt, Human
ucugcaauuccccucugc

SEQ ID NO: 1457734 - RNA, 16 nt, Human
ucugcaauuccccucu

SEQ ID NO: 1457735 - RNA, 23 nt, Human
ucugcaauucaaaaguuccaaga

SEQ ID NO: 1457736 - RNA, 16 nt, Human
ucugauugugauguga

SEQ ID NO: 1457737 - RNA, 22 nt, Human
ucugcaauuccccucugcugcu

SEQ ID NO: 1457738 - RNA, 21 nt, Human
ucugcaauuccccucugcugc

SEQ ID NO: 1457739 - RNA, 12 nt, Human
ucugagcuccug

SEQ ID NO: 1457740 - RNA, 20 nt, Human
ucugagcuccuguccccugc

SEQ ID NO: 1457741 - RNA, 19 nt, Human
ucugagcagugaaugauuc

SEQ ID NO: 1457742 - RNA, 10 nt, Human
ucugagcugu

SEQ ID NO: 1457743 - RNA, 19 nt, Human
ucugagcugucaacgagac

SEQ ID NO: 1457744 - RNA, 17 nt, Human
ucugaggacaagagaaa

SEQ ID NO: 1457745 - RNA, 14 nt, Human
ucugaggacaagag

SEQ ID NO: 1457746 - RNA, 18 nt, Human
ucucuuuuugcuuucgaa

SEQ ID NO: 1457747 - RNA, 14 nt, Human
ucucuuugccucaa

SEQ ID NO: 1457748 - RNA, 21 nt, Human
ucugaacucaaacugaggaau

SEQ ID NO: 1457749 - RNA, 17 nt, Human
ucugaacucaaacugag

SEQ ID NO: 1457750 - RNA, 16 nt, Human
ucugaacucaaacuga

SEQ ID NO: 1457751 - RNA, 14 nt, Human
ucugaacucaaacu

SEQ ID NO: 1457752 - RNA, 12 nt, Human
ucugaacucaaa

SEQ ID NO: 1457753 - RNA, 13 nt, Human
ucugaaaugaaga

SEQ ID NO: 1457754 - RNA, 14 nt, Human
ucugaaauuuccug

SEQ ID NO: 1457755 - RNA, 22 nt, Human
ucucuuauugccucacuucagg

SEQ ID NO: 1457756 - RNA, 13 nt, Human
ucucuucagucuc

SEQ ID NO: 1457757 - RNA, 17 nt, Human
ucucuucagucucuaua

SEQ ID NO: 1457758 - RNA, 15 nt, Human
ucucugcagacuucc

SEQ ID NO: 1457759 - RNA, 20 nt, Human
ucucugcagacuucccagcu

SEQ ID NO: 1457760 - RNA, 16 nt, Human
ucucuuauugccucac

SEQ ID NO: 1457761 - RNA, 15 nt, Human
ucucuuauugccuca

SEQ ID NO: 1457762 - RNA, 20 nt, Human
ucucuuauggauguccccag

SEQ ID NO: 1457763 - RNA, 20 nt, Human
ucucugcaggcagccugccu

SEQ ID NO: 1457764 - RNA, 16 nt, Human
ucucuuauggaugucc

SEQ ID NO: 1457765 - RNA, 11 nt, Human
ucucugcaggu

SEQ ID NO: 1457766 - RNA, 22 nt, Human
ucucuuccucuucccccaagau

SEQ ID NO: 1457767 - RNA, 20 nt, Human
ucucuuccuuuuaucaguag

SEQ ID NO: 1457768 - RNA, 16 nt, Human
ucucuucucuccagcu

SEQ ID NO: 1457769 - RNA, 15 nt, Human
ucucuucucuccagc

SEQ ID NO: 1457770 - RNA, 14 nt, Human
ucucuucucuccag

SEQ ID NO: 1457771 - RNA, 12 nt, Human
ucucuucucucc

SEQ ID NO: 1457772 - RNA, 13 nt, Human
ucucuuugccuca

SEQ ID NO: 1457773 - RNA, 23 nt, Human
ucucuucucuccagcugacuaaa

SEQ ID NO: 1457774 - RNA, 19 nt, Human
ucucuucugaauaaagcaa

SEQ ID NO: 1457775 - RNA, 20 nt, Human
ucucuucugaauaaagcaau

SEQ ID NO: 1457776 - RNA, 19 nt, Human
ucucuaccuucuccccagc

SEQ ID NO: 1457777 - RNA, 22 nt, Human
ucucuacugaaugucauugaaa

SEQ ID NO: 1457778 - RNA, 23 nt, Human
ucucuaccuucuccccagcuccc

SEQ ID NO: 1457779 - RNA, 18 nt, Human
ucucuaccuucuccccag

SEQ ID NO: 1457780 - RNA, 16 nt, Human
ucucuaccuucucccc

SEQ ID NO: 1457781 - RNA, 14 nt, Human
ucucuaccuucucc

SEQ ID NO: 1457782 - RNA, 20 nt, Human
ucucuaccacugcugauauu

SEQ ID NO: 1457783 - RNA, 22 nt, Human
ucucuacagucucgucucuuuu

SEQ ID NO: 1457784 - RNA, 21 nt, Human
ucucuacagucucgucucuuu

SEQ ID NO: 1457785 - RNA, 18 nt, Human
ucucuacagucucgucuc

SEQ ID NO: 1457786 - RNA, 15 nt, Human
ucucuaauucuauua

SEQ ID NO: 1457787 - RNA, 13 nt, Human
ucuccuguaccuc

SEQ ID NO: 1457788 - RNA, 19 nt, Human
ucucuaggaaauauuuauu

SEQ ID NO: 1457789 - RNA, 13 nt, Human
ucucuaggaaaua

SEQ ID NO: 1457790 - RNA, 18 nt, Human
ucucuaguuugauuaaau

SEQ ID NO: 1457791 - RNA, 19 nt, Human
ucucuaguuugauuaaauu

SEQ ID NO: 1457792 - RNA, 14 nt, Human
ucucuauaccaaua

SEQ ID NO: 1457793 - RNA, 16 nt, Human
ucucuauaccaauaaa

SEQ ID NO: 1457794 - RNA, 17 nt, Human
ucucuauaccaauaaag

SEQ ID NO: 1457795 - RNA, 19 nt, Human
ucucuauaccaauaaagug

SEQ ID NO: 1457796 - RNA, 12 nt, Human
ucucuaucauuu

SEQ ID NO: 1457797 - RNA, 13 nt, Human
ucucuaucauuua

SEQ ID NO: 1457798 - RNA, 14 nt, Human
ucucuaucauuuaa

SEQ ID NO: 1457799 - RNA, 15 nt, Human
ucucuaucauuuaau

SEQ ID NO: 1457800 - RNA, 16 nt, Human
ucucuaucauuuaaua

SEQ ID NO: 1457801 - RNA, 17 nt, Human
ucucuaucauuuaauaa

SEQ ID NO: 1457802 - RNA, 16 nt, Human
ucucugacuucugccu

SEQ ID NO: 1457803 - RNA, 14 nt, Human
ucucugacuucugc

SEQ ID NO: 1457804 - RNA, 20 nt, Human
ucucucuuugcauggauuuc

SEQ ID NO: 1457805 - RNA, 12 nt, Human
ucucugaacaca

SEQ ID NO: 1457806 - RNA, 17 nt, Human
ucucucuuuauacagcu

SEQ ID NO: 1457807 - RNA, 12 nt, Human
ucucucuucucu

SEQ ID NO: 1457808 - RNA, 16 nt, Human
ucucucuuuauacagc

SEQ ID NO: 1457809 - RNA, 16 nt, Human
ucucugagcugugcag

SEQ ID NO: 1457810 - RNA, 15 nt, Human
ucucugagcugugca

SEQ ID NO: 1457811 - RNA, 14 nt, Human
ucucugagcaguga

SEQ ID NO: 1457812 - RNA, 19 nt, Human
ucucugacuucugccugga

SEQ ID NO: 1457813 - RNA, 18 nt, Human
ucucugacuucugccugg

SEQ ID NO: 1457814 - RNA, 17 nt, Human
ucucugacuucugccug

SEQ ID NO: 1457815 - RNA, 20 nt, Human
ucucugauuuucaaagcuuu

SEQ ID NO: 1457816 - RNA, 19 nt, Human
ucucugauuuucaaagcuu

SEQ ID NO: 1457817 - RNA, 23 nt, Human
ucucucggcuccccauguguccu

SEQ ID NO: 1457818 - RNA, 20 nt, Human
ucucucggcuccccaugugu

SEQ ID NO: 1457819 - RNA, 15 nt, Human
ucucucggcucccca

SEQ ID NO: 1457820 - RNA, 19 nt, Human
ucucucaacaccaugauuc

SEQ ID NO: 1457821 - RNA, 13 nt, Human
ucucucaacacca

SEQ ID NO: 1457822 - RNA, 13 nt, Human
ucucuaugccucu

SEQ ID NO: 1457823 - RNA, 18 nt, Human
ucucuauccucucuuccu

SEQ ID NO: 1457824 - RNA, 20 nt, Human
ucucuaucauuuaauaauau

SEQ ID NO: 1457825 - RNA, 22 nt, Human
ucucuaucauuuaauaauauac

SEQ ID NO: 1457826 - RNA, 11 nt, Human
ucucucugugg

SEQ ID NO: 1457827 - RNA, 22 nt, Human
ucucucucacucccucccuuuc

SEQ ID NO: 1457828 - RNA, 13 nt, Human
ucucucuaugccu

SEQ ID NO: 1457829 - RNA, 15 nt, Human
ucucucgugaguaua

SEQ ID NO: 1457830 - RNA, 13 nt, Human
ucucccugcaugg

SEQ ID NO: 1457831 - RNA, 22 nt, Human
ucucccugagaugggcuuccca

SEQ ID NO: 1457832 - RNA, 16 nt, Human
ucuccugccuugaaaa

SEQ ID NO: 1457833 - RNA, 23 nt, Human
ucuccuggcuucccauccccagc

SEQ ID NO: 1457834 - RNA, 20 nt, Human
ucuccugccuuccuccuggg

SEQ ID NO: 1457835 - RNA, 18 nt, Human
ucuccugccuuccuccug

SEQ ID NO: 1457836 - RNA, 17 nt, Human
ucuccugccuuccuccu

SEQ ID NO: 1457837 - RNA, 16 nt, Human
ucuccugccuuccucc

SEQ ID NO: 1457838 - RNA, 16 nt, Human
ucucagugaagacuau

SEQ ID NO: 1457839 - RNA, 20 nt, Human
ucucaguaccccauggagcu

SEQ ID NO: 1457840 - RNA, 20 nt, Human
ucucagugaagacuaugaaa

SEQ ID NO: 1457841 - RNA, 22 nt, Human
ucucaguguugagccuuuuccc

SEQ ID NO: 1457842 - RNA, 18 nt, Human
ucucaguguugagccuuu

SEQ ID NO: 1457843 - RNA, 20 nt, Human
ucucccggagguuggguggg

SEQ ID NO: 1457844 - RNA, 19 nt, Human
ucuccccugcccccugcag

SEQ ID NO: 1457845 - RNA, 21 nt, Human
ucuccccugcccccugcagga

SEQ ID NO: 1457846 - RNA, 18 nt, Human
ucuccccugcccccugca

SEQ ID NO: 1457847 - RNA, 15 nt, Human
ucuccccccgccugc

SEQ ID NO: 1457848 - RNA, 14 nt, Human
ucucaguugcagcc

SEQ ID NO: 1457849 - RNA, 22 nt, Human
ucuagucaaugacaugaauuuu

SEQ ID NO: 1457850 - RNA, 20 nt, Human
ucuagucaaugacaugaauu

SEQ ID NO: 1457851 - RNA, 14 nt, Human
ucuagucaaugaca

SEQ ID NO: 1457852 - RNA, 24 nt, Human
ucuaguauuccagaccugaagaau

SEQ ID NO: 1457853 - RNA, 22 nt, Human
ucuaguacuugggagaccugua

SEQ ID NO: 1457854 - RNA, 20 nt, Human
ucuagguuucaaagaugcug

SEQ ID NO: 1457855 - RNA, 19 nt, Human
ucuagguuucaaagaugcu

SEQ ID NO: 1457856 - RNA, 17 nt, Human
ucuagguuucaaagaug

SEQ ID NO: 1457857 - RNA, 15 nt, Human
ucuagguuucaaaga

SEQ ID NO: 1457858 - RNA, 20 nt, Human
ucuaggguacauggugcugg

SEQ ID NO: 1457859 - RNA, 23 nt, Human
ucuaggguacauggugcugggag

SEQ ID NO: 1457860 - RNA, 20 nt, Human
ucucaacaggccucagggcu

SEQ ID NO: 1457861 - RNA, 23 nt, Human
ucucaacaggccucagggcuccu

SEQ ID NO: 1457862 - RNA, 19 nt, Human
ucucaacaggccucagggc

SEQ ID NO: 1457863 - RNA, 18 nt, Human
ucucaacaggccucaggg

SEQ ID NO: 1457864 - RNA, 17 nt, Human
ucucaacaggccucagg

SEQ ID NO: 1457865 - RNA, 16 nt, Human
ucucaacaggccucag

SEQ ID NO: 1457866 - RNA, 23 nt, Human
ucucaacacccaguuuccuuggg

SEQ ID NO: 1457867 - RNA, 19 nt, Human
ucucaacacccaguuuccu

SEQ ID NO: 1457868 - RNA, 14 nt, Human
ucucaacacccagu

SEQ ID NO: 1457869 - RNA, 21 nt, Human
ucucaacaccaugauuccuuu

SEQ ID NO: 1457870 - RNA, 23 nt, Human
ucucaaacuccugaccucaggca

SEQ ID NO: 1457871 - RNA, 14 nt, Human
ucucaaacuggggc

SEQ ID NO: 1457872 - RNA, 21 nt, Human
ucucaaacuccugaccucagg

SEQ ID NO: 1457873 - RNA, 16 nt, Human
ucucaaacuccugacc

SEQ ID NO: 1457874 - RNA, 21 nt, Human
ucucagaaucccuuaacaguu

SEQ ID NO: 1457875 - RNA, 12 nt, Human
ucucagaauccc

SEQ ID NO: 1457876 - RNA, 21 nt, Human
ucucagaaagugccugacaca

SEQ ID NO: 1457877 - RNA, 19 nt, Human
ucucagaaagugccugaca

SEQ ID NO: 1457878 - RNA, 17 nt, Human
ucucagaaagugccuga

SEQ ID NO: 1457879 - RNA, 11 nt, Human
ucucagaaagu

SEQ ID NO: 1457880 - RNA, 15 nt, Human
ucucaacuccaaacu

SEQ ID NO: 1457881 - RNA, 23 nt, Human
ucuagaaucugcaauucaaaagu

SEQ ID NO: 1457882 - RNA, 22 nt, Human
ucuagaaucugcaauucaaaag

SEQ ID NO: 1457883 - RNA, 19 nt, Human
ucuacugggaaggcuacuu

SEQ ID NO: 1457884 - RNA, 17 nt, Human
ucuagaacacaggcaaa

SEQ ID NO: 1457885 - RNA, 13 nt, Human
ucuaacucagcaa

SEQ ID NO: 1457886 - RNA, 15 nt, Human
ucuaacuacaaaggu

SEQ ID NO: 1457887 - RNA, 17 nt, Human
ucuaacuacaaagguuu

SEQ ID NO: 1457888 - RNA, 22 nt, Human
ucuaacggucuguucuguuuca

SEQ ID NO: 1457889 - RNA, 17 nt, Human
ucuaacggucuguucug

SEQ ID NO: 1457890 - RNA, 23 nt, Human
ucuaacgccugagcccagggagg

SEQ ID NO: 1457891 - RNA, 21 nt, Human
ucuaacgccugagcccaggga

SEQ ID NO: 1457892 - RNA, 16 nt, Human
ucuaacgccugagccc

SEQ ID NO: 1457893 - RNA, 15 nt, Human
ucuaacgccugagcc

SEQ ID NO: 1457894 - RNA, 14 nt, Human
ucuaacgccugagc

SEQ ID NO: 1457895 - RNA, 13 nt, Human
ucuaacgccugag

SEQ ID NO: 1457896 - RNA, 22 nt, Human
ucuaaccuuuacaugaggacuc

SEQ ID NO: 1457897 - RNA, 16 nt, Human
ucuaaccuuuacauga

SEQ ID NO: 1457898 - RNA, 14 nt, Human
ucuaaccuuuacau

SEQ ID NO: 1457899 - RNA, 20 nt, Human
ucuaaccucaucuucuucac

SEQ ID NO: 1457900 - RNA, 18 nt, Human
ucuaaccucaucuucuuc

SEQ ID NO: 1457901 - RNA, 13 nt, Human
ucuaaccucaucu

SEQ ID NO: 1457902 - RNA, 21 nt, Human
ucuacacuaagagagaaugag

SEQ ID NO: 1457903 - RNA, 22 nt, Human
ucuaacuucaccauauuaccac

SEQ ID NO: 1457904 - RNA, 15 nt, Human
ucuaacuucaccaua

SEQ ID NO: 1457905 - RNA, 16 nt, Human
ucuaacuucaccauau

SEQ ID NO: 1457906 - RNA, 19 nt, Human
ucuaacccuauacuguagu

SEQ ID NO: 1457907 - RNA, 12 nt, Human
ucuaacaaguca

SEQ ID NO: 1457908 - RNA, 21 nt, Human
ucuaaauguaguucugcucca

SEQ ID NO: 1457909 - RNA, 16 nt, Human
ucuaaauucuuucauu

SEQ ID NO: 1457910 - RNA, 17 nt, Human
uccuuaagucagaacag

SEQ ID NO: 1457911 - RNA, 19 nt, Human
uccuuaaggcucuuuugua

SEQ ID NO: 1457912 - RNA, 21 nt, Human
uccuguauuuguucccaagag

SEQ ID NO: 1457913 - RNA, 22 nt, Human
uccuguauuuguucccaagagc

SEQ ID NO: 1457914 - RNA, 20 nt, Human
uccuguauuuguucccaaga

SEQ ID NO: 1457915 - RNA, 19 nt, Human
uccuguauuuguucccaag

SEQ ID NO: 1457916 - RNA, 17 nt, Human
uccuguauuuguuccca

SEQ ID NO: 1457917 - RNA, 21 nt, Human
uccuguauucagacagaugag

SEQ ID NO: 1457918 - RNA, 22 nt, Human
uccugucaucaucauggccagc

SEQ ID NO: 1457919 - RNA, 16 nt, Human
uccuuaaggcucuuuu

SEQ ID NO: 1457920 - RNA, 20 nt, Human
uccuucaacaauucuaaaau

SEQ ID NO: 1457921 - RNA, 18 nt, Human
uccuucaacaauucuaaa

SEQ ID NO: 1457922 - RNA, 21 nt, Human
uccuucaaaguuuaauaaauu

SEQ ID NO: 1457923 - RNA, 22 nt, Human
uccuuacaaguuagaaaacaua

SEQ ID NO: 1457924 - RNA, 21 nt, Human
uccuuacaaguuagaaaacau

SEQ ID NO: 1457925 - RNA, 23 nt, Human
uccuugauuuuagccuucucugu

SEQ ID NO: 1457926 - RNA, 22 nt, Human
uccuugauuuuagccuucucug

SEQ ID NO: 1457927 - RNA, 22 nt, Human
uccuugauuuaucacacaaagc

SEQ ID NO: 1457928 - RNA, 14 nt, Human
uccuggugccaccu

SEQ ID NO: 1457929 - RNA, 15 nt, Human
uccuggugccaccuc

SEQ ID NO: 1457930 - RNA, 13 nt, Human
uccuggugccacc

SEQ ID NO: 1457931 - RNA, 21 nt, Human
uccuggugccaauuucaaguu

SEQ ID NO: 1457932 - RNA, 20 nt, Human
uccuggugccaauuucaagu

SEQ ID NO: 1457933 - RNA, 21 nt, Human
uccuggucaccuaggaagccu

SEQ ID NO: 1457934 - RNA, 20 nt, Human
uccuggucaccuaggaagcc

SEQ ID NO: 1457935 - RNA, 17 nt, Human
uccuggucaccuaggaa

SEQ ID NO: 1457936 - RNA, 15 nt, Human
uccuggcccagccuu

SEQ ID NO: 1457937 - RNA, 14 nt, Human
uccuggcccagccu

SEQ ID NO: 1457938 - RNA, 13 nt, Human
uccuggcccagcc

SEQ ID NO: 1457939 - RNA, 23 nt, Human
uccugguucccguuucuccaccu

SEQ ID NO: 1457940 - RNA, 21 nt, Human
uccugguucccguuucuccac

SEQ ID NO: 1457941 - RNA, 15 nt, Human
uccugguucccguuu

SEQ ID NO: 1457942 - RNA, 19 nt, Human
uccuguaaagguuacaagc

SEQ ID NO: 1457943 - RNA, 20 nt, Human
uccuguauucagacagauga

SEQ ID NO: 1457944 - RNA, 17 nt, Human
uccuguauucagacaga

SEQ ID NO: 1457945 - RNA, 16 nt, Human
uccuguauucagacag

SEQ ID NO: 1457946 - RNA, 19 nt, Human
uccuguauaccuccuccag

SEQ ID NO: 1457947 - RNA, 16 nt, Human
uccuggugguauuuuc

SEQ ID NO: 1457948 - RNA, 21 nt, Human
uccugguggggcagcuccucu

SEQ ID NO: 1457949 - RNA, 19 nt, Human
uccugguggggcagcuccu

SEQ ID NO: 1457950 - RNA, 17 nt, Human
uccugguggggcagcuc

SEQ ID NO: 1457951 - RNA, 16 nt, Human
uccugguggggcagcu

SEQ ID NO: 1457952 - RNA, 13 nt, Human
uccugguggggca

SEQ ID NO: 1457953 - RNA, 14 nt, Human
uccuggugcuggag

SEQ ID NO: 1457954 - RNA, 12 nt, Human
uccuggugcugg

SEQ ID NO: 1457955 - RNA, 19 nt, Human
uccuggugguauuuucaau

SEQ ID NO: 1457956 - RNA, 18 nt, Human
uccuggugguauuuucaa

SEQ ID NO: 1457957 - RNA, 21 nt, Human
uccuggugguauuuucaauag

SEQ ID NO: 1457958 - RNA, 16 nt, Human
uccuugggcccuuuga

SEQ ID NO: 1457959 - RNA, 14 nt, Human
uccuugggcccuuu

SEQ ID NO: 1457960 - RNA, 13 nt, Human
uccuugggcccuu

SEQ ID NO: 1457961 - RNA, 23 nt, Human
uccuuggccugcuaaggucuugg

SEQ ID NO: 1457962 - RNA, 17 nt, Human
uccuuggccaugcagaa

SEQ ID NO: 1457963 - RNA, 17 nt, Human
uccuuuuuaauaugcuu

SEQ ID NO: 1457964 - RNA, 12 nt, Human
uccuuuuuaaua

SEQ ID NO: 1457965 - RNA, 13 nt, Human
ucgaaacacagaa

SEQ ID NO: 1457966 - RNA, 14 nt, Human
ucgaaaaucaaaug

SEQ ID NO: 1457967 - RNA, 14 nt, Human
uccuuuuuuuguac

SEQ ID NO: 1457968 - RNA, 21 nt, Human
uccuuuuuuuccaucuuuaca

SEQ ID NO: 1457969 - RNA, 12 nt, Human
uccuuuuuuucc

SEQ ID NO: 1457970 - RNA, 23 nt, Human
uccuuuuuggucgaggaguaaca

SEQ ID NO: 1457971 - RNA, 16 nt, Human
uccuuuuuccucucca

SEQ ID NO: 1457972 - RNA, 21 nt, Human
uccuuuuuccucuccacacag

SEQ ID NO: 1457973 - RNA, 12 nt, Human
uccuuuuuccuc

SEQ ID NO: 1457974 - RNA, 15 nt, Human
uccuuuuuccaacaa

SEQ ID NO: 1457975 - RNA, 17 nt, Human
uccuuuuuccaacaaga

SEQ ID NO: 1457976 - RNA, 14 nt, Human
ucgauacugcgacu

SEQ ID NO: 1457977 - RNA, 15 nt, Human
ucgaguucccagggu

SEQ ID NO: 1457978 - RNA, 23 nt, Human
ucgagugagacagacuagaaguu

SEQ ID NO: 1457979 - RNA, 14 nt, Human
ucgagugagacaga

SEQ ID NO: 1457980 - RNA, 19 nt, Human
ucgcccaggcuggagugca

SEQ ID NO: 1457981 - RNA, 21 nt, Human
ucgcccagcggcaucaggcuu

SEQ ID NO: 1457982 - RNA, 10 nt, Human
ucgcagccac

SEQ ID NO: 1457983 - RNA, 17 nt, Human
ucgcaccauucugacuc

SEQ ID NO: 1457984 - RNA, 16 nt, Human
ucgcaccauucugacu

SEQ ID NO: 1457985 - RNA, 21 nt, Human
ucgcaccacuguguauuuaac

SEQ ID NO: 1457986 - RNA, 20 nt, Human
ucgcaacccgugccaagucc

SEQ ID NO: 1457987 - RNA, 15 nt, Human
ucgauuucuccagga

SEQ ID NO: 1457988 - RNA, 16 nt, Human
ucgcuucuugccucug

SEQ ID NO: 1457989 - RNA, 15 nt, Human
ucgcuucuugccucu

SEQ ID NO: 1457990 - RNA, 14 nt, Human
ucgcuucuugccuc

SEQ ID NO: 1457991 - RNA, 15 nt, Human
ucgcuguugcugaau

SEQ ID NO: 1457992 - RNA, 17 nt, Human
ucgcuguugcugaauag

SEQ ID NO: 1457993 - RNA, 12 nt, Human
ucgcuguugcug

SEQ ID NO: 1457994 - RNA, 14 nt, Human
ucgcuguugcugaa

SEQ ID NO: 1457995 - RNA, 19 nt, Human
ucgcuucuugccucugugc

SEQ ID NO: 1457996 - RNA, 15 nt, Human
ucggaaaucuuaaac

SEQ ID NO: 1457997 - RNA, 17 nt, Human
ucgcuucuugccucugu

SEQ ID NO: 1457998 - RNA, 21 nt, Human
ucggacaagacccccagcacu

SEQ ID NO: 1457999 - RNA, 19 nt, Human
ucggacaagacccccagca

SEQ ID NO: 1458000 - RNA, 10 nt, Human
ucggaccagc

SEQ ID NO: 1458001 - RNA, 12 nt, Human
ugaagacauaaa

SEQ ID NO: 1458002 - RNA, 17 nt, Human
ugaacuugcauugugau

SEQ ID NO: 1458003 - RNA, 18 nt, Human
ugaagacuggaagcuaau

SEQ ID NO: 1458004 - RNA, 23 nt, Human
ugaagaggaggggaagaggccug

SEQ ID NO: 1458005 - RNA, 17 nt, Human
ugaagaggaggggaaga

SEQ ID NO: 1458006 - RNA, 22 nt, Human
ugaacuuguaaaggaauuuaaa

SEQ ID NO: 1458007 - RNA, 21 nt, Human
ugaacuggacccuguugcuaa

SEQ ID NO: 1458008 - RNA, 22 nt, Human
ugaacuggacccuguugcuaag

SEQ ID NO: 1458009 - RNA, 23 nt, Human
ugaacuggacccuguugcuaagc

SEQ ID NO: 1458010 - RNA, 14 nt, Human
ugaaggcaaaauug

SEQ ID NO: 1458011 - RNA, 20 nt, Human
ugaaggccuucaacccgaga

SEQ ID NO: 1458012 - RNA, 17 nt, Human
ugaaggcaaaauugcaa

SEQ ID NO: 1458013 - RNA, 16 nt, Human
ugaaggcaaaauugca

SEQ ID NO: 1458014 - RNA, 22 nt, Human
ugaaguccaagcauuuagaugu

SEQ ID NO: 1458015 - RNA, 21 nt, Human
ugaaguccaagcauuuagaug

SEQ ID NO: 1458016 - RNA, 20 nt, Human
ugaagaucuaaauaaaaugc

SEQ ID NO: 1458017 - RNA, 22 nt, Human
ugaagaucuaaauaaaaugcua

SEQ ID NO: 1458018 - RNA, 15 nt, Human
ugaagaucuaaauaa

SEQ ID NO: 1458019 - RNA, 14 nt, Human
ugaagaucuaaaua

SEQ ID NO: 1458020 - RNA, 23 nt, Human
ugaaggagccccauuccugggaa

SEQ ID NO: 1458021 - RNA, 22 nt, Human
ugaaggagccccauuccuggga

SEQ ID NO: 1458022 - RNA, 11 nt, Human
ugaaggagccc

SEQ ID NO: 1458023 - RNA, 22 nt, Human
ugaaggagaggcaacauccaaa

SEQ ID NO: 1458024 - RNA, 19 nt, Human
ugaagagguuuuaaagcuu

SEQ ID NO: 1458025 - RNA, 22 nt, Human
ugaacugaacaccauugaaggc

SEQ ID NO: 1458026 - RNA, 13 nt, Human
ugaacugauaaag

SEQ ID NO: 1458027 - RNA, 21 nt, Human
ugaacugauucacaucucauu

SEQ ID NO: 1458028 - RNA, 20 nt, Human
ugaacugauucacaucucau

SEQ ID NO: 1458029 - RNA, 17 nt, Human
ugaacugauucacaucu

SEQ ID NO: 1458030 - RNA, 12 nt, Human
ugaacugauuca

SEQ ID NO: 1458031 - RNA, 17 nt, Human
ugaacuggacccuguug

SEQ ID NO: 1458032 - RNA, 18 nt, Human
ugaacuggacccuguugc

SEQ ID NO: 1458033 - RNA, 19 nt, Human
ugaacuggacccuguugcu

SEQ ID NO: 1458034 - RNA, 20 nt, Human
ugaacuggacccuguugcua

SEQ ID NO: 1458035 - RNA, 15 nt, Human
ugaacugauaaagau

SEQ ID NO: 1458036 - RNA, 12 nt, Human
ugaacugaacac

SEQ ID NO: 1458037 - RNA, 14 nt, Human
ugaacugaacacca

SEQ ID NO: 1458038 - RNA, 13 nt, Human
ugaacugaacacc

SEQ ID NO: 1458039 - RNA, 15 nt, Human
ugaacucuucacucu

SEQ ID NO: 1458040 - RNA, 21 nt, Human
ugaacucuuaaucaaauagca

SEQ ID NO: 1458041 - RNA, 17 nt, Human
ugaacaucugaguccug

SEQ ID NO: 1458042 - RNA, 20 nt, Human
ugaacaucugaguccuggau

SEQ ID NO: 1458043 - RNA, 20 nt, Human
ugaacaucccuuuuucaaug

SEQ ID NO: 1458044 - RNA, 17 nt, Human
ugaacauauuguugaaa

SEQ ID NO: 1458045 - RNA, 13 nt, Human
ugaacagaacaua

SEQ ID NO: 1458046 - RNA, 16 nt, Human
ugaacacgaagcuuag

SEQ ID NO: 1458047 - RNA, 20 nt, Human
ugaacaccauugaaggcuua

SEQ ID NO: 1458048 - RNA, 17 nt, Human
ugaacaccauugaaggc

SEQ ID NO: 1458049 - RNA, 19 nt, Human
ugaacacaaacuguaaaua

SEQ ID NO: 1458050 - RNA, 19 nt, Human
ugaaauggacuuuuguaca

SEQ ID NO: 1458051 - RNA, 19 nt, Human
ugaaaugcagagucaauga

SEQ ID NO: 1458052 - RNA, 14 nt, Human
ugaaauccugcuuc

SEQ ID NO: 1458053 - RNA, 15 nt, Human
ugaaaggacccugug

SEQ ID NO: 1458054 - RNA, 12 nt, Human
ugaaaagagcug

SEQ ID NO: 1458055 - RNA, 20 nt, Human
ugaaaggaaauuaaggcaac

SEQ ID NO: 1458056 - RNA, 16 nt, Human
ugaaaggaaauuaagg

SEQ ID NO: 1458057 - RNA, 12 nt, Human
ugaaaggaaauu

SEQ ID NO: 1458058 - RNA, 13 nt, Human
ugaaagauucaau

SEQ ID NO: 1458059 - RNA, 16 nt, Human
ugaaagcugauuuuuu

SEQ ID NO: 1458060 - RNA, 22 nt, Human
ucuuuuugggagagacuuguuu

SEQ ID NO: 1458061 - RNA, 19 nt, Human
ucuuuuuuaaaugaagaaa

SEQ ID NO: 1458062 - RNA, 20 nt, Human
ucuuuuuguagcuggggcuu

SEQ ID NO: 1458063 - RNA, 19 nt, Human
ucuuuuugggagagacuug

SEQ ID NO: 1458064 - RNA, 15 nt, Human
ucuuuuugaaguauu

SEQ ID NO: 1458065 - RNA, 17 nt, Human
ucuuuuugaaguauuua

SEQ ID NO: 1458066 - RNA, 14 nt, Human
ucuuuuugaaguau

SEQ ID NO: 1458067 - RNA, 13 nt, Human
ugaaaagaauugu

SEQ ID NO: 1458068 - RNA, 16 nt, Human
ugaaaacuuuguagua

SEQ ID NO: 1458069 - RNA, 13 nt, Human
ugaaaacuuugua

SEQ ID NO: 1458070 - RNA, 18 nt, Human
ugaaaacucuuugcugcu

SEQ ID NO: 1458071 - RNA, 17 nt, Human
ugaaaacucuuugcugc

SEQ ID NO: 1458072 - RNA, 13 nt, Human
ugaaaacucuuug

SEQ ID NO: 1458073 - RNA, 16 nt, Human
ucuuuuuucaaaagaa

SEQ ID NO: 1458074 - RNA, 21 nt, Human
ucuuuuggaggacguacguaa

SEQ ID NO: 1458075 - RNA, 18 nt, Human
ucuuuugcuuuuggcaaa

SEQ ID NO: 1458076 - RNA, 19 nt, Human
ucuuuugcuuuugcccauu

SEQ ID NO: 1458077 - RNA, 13 nt, Human
ucuuuugcuuuug

SEQ ID NO: 1458078 - RNA, 23 nt, Human
ucuuuugccuuuugcaaccagga

SEQ ID NO: 1458079 - RNA, 13 nt, Human
ucuuuugccauga

SEQ ID NO: 1458080 - RNA, 20 nt, Human
ucuuuugguuaugaauacuu

SEQ ID NO: 1458081 - RNA, 22 nt, Human
ucuuuugguaaagacuggcuuu

SEQ ID NO: 1458082 - RNA, 19 nt, Human
ucuuuuguaagguuuuugu

SEQ ID NO: 1458083 - RNA, 17 nt, Human
ucuuuugccguuauuaa

SEQ ID NO: 1458084 - RNA, 19 nt, Human
ucuuuugccguuauuaaaa

SEQ ID NO: 1458085 - RNA, 12 nt, Human
ucuuuucuuuac

SEQ ID NO: 1458086 - RNA, 19 nt, Human
ucuuuucuggaauguaauc

SEQ ID NO: 1458087 - RNA, 15 nt, Human
ucuuucacagcuccu

SEQ ID NO: 1458088 - RNA, 14 nt, Human
ucuuucacagcucc

SEQ ID NO: 1458089 - RNA, 20 nt, Human
ucuuucaauacagauauauu

SEQ ID NO: 1458090 - RNA, 19 nt, Human
ucuuucaauacagauauau

SEQ ID NO: 1458091 - RNA, 18 nt, Human
ucuuucaauacagauaua

SEQ ID NO: 1458092 - RNA, 16 nt, Human
ucuuucaauacagaua

SEQ ID NO: 1458093 - RNA, 19 nt, Human
ucuuuaaaagaugcuuuua

SEQ ID NO: 1458094 - RNA, 20 nt, Human
ucuuucacagcuccucccac

SEQ ID NO: 1458095 - RNA, 19 nt, Human
ucuuucacagcuccuccca

SEQ ID NO: 1458096 - RNA, 18 nt, Human
ucuuucacagcuccuccc

SEQ ID NO: 1458097 - RNA, 17 nt, Human
ucuuucacauuuaaaua

SEQ ID NO: 1458098 - RNA, 23 nt, Human
ucuuaugcuguacccaguuucua

SEQ ID NO: 1458099 - RNA, 18 nt, Human
ucuuaugcuguacccagu

SEQ ID NO: 1458100 - RNA, 15 nt, Human
ucuuaugcuguaccc

SEQ ID NO: 1458101 - RNA, 16 nt, Human
ucuuauaguucuaggc

SEQ ID NO: 1458102 - RNA, 17 nt, Human
ucuuauaguucuaggca

SEQ ID NO: 1458103 - RNA, 13 nt, Human
ucuuauaguucua

SEQ ID NO: 1458104 - RNA, 21 nt, Human
ucuuauaauuguucucagaau

SEQ ID NO: 1458105 - RNA, 19 nt, Human
ucuuauggauguccccagc

SEQ ID NO: 1458106 - RNA, 12 nt, Human
ucuuauggaugu

SEQ ID NO: 1458107 - RNA, 22 nt, Human
ucuuauggaauugauuugcauu

SEQ ID NO: 1458108 - RNA, 21 nt, Human
ucuuauggaauugauuugcau

SEQ ID NO: 1458109 - RNA, 18 nt, Human
ucuuauggaauugauuug

SEQ ID NO: 1458110 - RNA, 17 nt, Human
ucuuauggaauugauuu

SEQ ID NO: 1458111 - RNA, 15 nt, Human
ucuuauggaauugau

SEQ ID NO: 1458112 - RNA, 14 nt, Human
ucuuauggaauuga

SEQ ID NO: 1458113 - RNA, 18 nt, Human
ucuuauggauguccccag

SEQ ID NO: 1458114 - RNA, 13 nt, Human
ucuuaaaacuccu

SEQ ID NO: 1458115 - RNA, 12 nt, Human
ucuuaaaacucc

SEQ ID NO: 1458116 - RNA, 22 nt, Human
ucuuaaaaaguuauaaccaacu

SEQ ID NO: 1458117 - RNA, 20 nt, Human
ucuuaaaacauuaugaguuu

SEQ ID NO: 1458118 - RNA, 14 nt, Human
ucuuaguguaugau

SEQ ID NO: 1458119 - RNA, 22 nt, Human
ucuucuacucacuuuucccacu

SEQ ID NO: 1458120 - RNA, 14 nt, Human
ucuucuaccaccca

SEQ ID NO: 1458121 - RNA, 12 nt, Human
ucuucuaaaugg

SEQ ID NO: 1458122 - RNA, 22 nt, Human
ucuucuaaacuuccccaucuuc

SEQ ID NO: 1458123 - RNA, 13 nt, Human
ucuucuaaacuuc

SEQ ID NO: 1458124 - RNA, 11 nt, Human
ucuucucaagu

SEQ ID NO: 1458125 - RNA, 13 nt, Human
ucuucuauuuugu

SEQ ID NO: 1458126 - RNA, 14 nt, Human
ucuucuagaguuca

SEQ ID NO: 1458127 - RNA, 17 nt, Human
ucuucuagguucuaaaa

SEQ ID NO: 1458128 - RNA, 17 nt, Human
ucuucuagaguucagag

SEQ ID NO: 1458129 - RNA, 12 nt, Human
ucuucuagaguu

SEQ ID NO: 1458130 - RNA, 18 nt, Human
ucuucuacaacucauaca

SEQ ID NO: 1458131 - RNA, 23 nt, Human
ucuucucaaguucuaagauucua

SEQ ID NO: 1458132 - RNA, 21 nt, Human
ucuucucaaguucuaagauuc

SEQ ID NO: 1458133 - RNA, 19 nt, Human
ucuucucaaguucuaagau

SEQ ID NO: 1458134 - RNA, 18 nt, Human
ucuucucaaguucuaaga

SEQ ID NO: 1458135 - RNA, 17 nt, Human
ucuucucaaguucuaag

SEQ ID NO: 1458136 - RNA, 15 nt, Human
ucuucucaaguucua

SEQ ID NO: 1458137 - RNA, 14 nt, Human
ucuucucaaguucu

SEQ ID NO: 1458138 - RNA, 19 nt, Human
ucuugccucugugcugugu

SEQ ID NO: 1458139 - RNA, 16 nt, Human
ucuugccucugugcug

SEQ ID NO: 1458140 - RNA, 15 nt, Human
ucuugccucugugcu

SEQ ID NO: 1458141 - RNA, 14 nt, Human
ucuugccucugugc

SEQ ID NO: 1458142 - RNA, 13 nt, Human
ucuugccucugug

SEQ ID NO: 1458143 - RNA, 12 nt, Human
ucuugccucugu

SEQ ID NO: 1458144 - RNA, 16 nt, Human
ucuugccucaaccucc

SEQ ID NO: 1458145 - RNA, 16 nt, Human
ucuugacuacagucag

SEQ ID NO: 1458146 - RNA, 23 nt, Human
ucuugaauuuaauaaucuguagg

SEQ ID NO: 1458147 - RNA, 21 nt, Human
ucuugaauuuaauaaucugua

SEQ ID NO: 1458148 - RNA, 13 nt, Human
ucuugaauuuaau

SEQ ID NO: 1458149 - RNA, 13 nt, Human
ucuugucauuuuu

SEQ ID NO: 1458150 - RNA, 17 nt, Human
ucuugucauguguauaa

SEQ ID NO: 1458151 - RNA, 15 nt, Human
ucuugucauguguau

SEQ ID NO: 1458152 - RNA, 13 nt, Human
ucuugucaugugu

SEQ ID NO: 1458153 - RNA, 11 nt, Human
ucuugucaugu

SEQ ID NO: 1458154 - RNA, 22 nt, Human
ucuuguauuuauugguuuugca

SEQ ID NO: 1458155 - RNA, 15 nt, Human
ucuuguauuuauugg

SEQ ID NO: 1458156 - RNA, 23 nt, Human
ucuugccuguuucccaggcccac

SEQ ID NO: 1458157 - RNA, 16 nt, Human
ucuugccuguuuccca

SEQ ID NO: 1458158 - RNA, 21 nt, Human
ucuugccugaacuccugccau

SEQ ID NO: 1458159 - RNA, 16 nt, Human
ucuuuaaaaggaaaga

SEQ ID NO: 1458160 - RNA, 18 nt, Human
ucuuuaaaaggaaagaaa

SEQ ID NO: 1458161 - RNA, 15 nt, Human
ucuugugaaggcagg

SEQ ID NO: 1458162 - RNA, 12 nt, Human
ucuugucuuuau

SEQ ID NO: 1458163 - RNA, 21 nt, Human
ucuuguccccaacaccccaca

SEQ ID NO: 1458164 - RNA, 23 nt, Human
ucuggagcccacuguacuugcuc

SEQ ID NO: 1458165 - RNA, 14 nt, Human
ucuggagagaacag

SEQ ID NO: 1458166 - RNA, 20 nt, Human
ucuggagaccaccagggcau

SEQ ID NO: 1458167 - RNA, 19 nt, Human
ucuggagaccaccagggca

SEQ ID NO: 1458168 - RNA, 16 nt, Human
ucuggagaccaccagg

SEQ ID NO: 1458169 - RNA, 13 nt, Human
ucuggcucugucu

SEQ ID NO: 1458170 - RNA, 20 nt, Human
ucuggcucuaauucacagug

SEQ ID NO: 1458171 - RNA, 22 nt, Human
ucuggcucuaauucacagugcu

SEQ ID NO: 1458172 - RNA, 17 nt, Human
ucuggcuaugcauuuga

SEQ ID NO: 1458173 - RNA, 14 nt, Human
ucuggcuaugcauu

SEQ ID NO: 1458174 - RNA, 21 nt, Human
ucuggaggggagggggauccg

SEQ ID NO: 1458175 - RNA, 14 nt, Human
ucuggaggggaggg

SEQ ID NO: 1458176 - RNA, 20 nt, Human
ucugguucucaauuccaaca

SEQ ID NO: 1458177 - RNA, 19 nt, Human
ucugguucucaauuccaac

SEQ ID NO: 1458178 - RNA, 18 nt, Human
ucugguucucaauuccaa

SEQ ID NO: 1458179 - RNA, 17 nt, Human
ucugguucucaauucca

SEQ ID NO: 1458180 - RNA, 21 nt, Human
ucuggcuuggccacagccagg

SEQ ID NO: 1458181 - RNA, 20 nt, Human
ucuggcuuggccacagccag

SEQ ID NO: 1458182 - RNA, 19 nt, Human
ucuguaauaaacucauuuc

SEQ ID NO: 1458183 - RNA, 23 nt, Human
ucuguaauaaacucauuucuagc

SEQ ID NO: 1458184 - RNA, 24 nt, Human
ucuguaauaaacucauuucuagca

SEQ ID NO: 1458185 - RNA, 22 nt, Human
ucugguuguuucuguuccaaau

SEQ ID NO: 1458186 - RNA, 20 nt, Human
ucugguuguuucuguuccaa

SEQ ID NO: 1458187 - RNA, 18 nt, Human
ucugguuguuucuguucc

SEQ ID NO: 1458188 - RNA, 17 nt, Human
ucugguuguuucuguuc

SEQ ID NO: 1458189 - RNA, 16 nt, Human
ucugguuguuucuguu

SEQ ID NO: 1458190 - RNA, 15 nt, Human
ucugguuguuucugu

SEQ ID NO: 1458191 - RNA, 15 nt, Human
ucugguugaacucug

SEQ ID NO: 1458192 - RNA, 18 nt, Human
ucuguaagcauaagcuua

SEQ ID NO: 1458193 - RNA, 17 nt, Human
ucuguaaaaucuuucuu

SEQ ID NO: 1458194 - RNA, 13 nt, Human
ucuguaaaaucuu

SEQ ID NO: 1458195 - RNA, 14 nt, Human
ucuguaaaaucuuu

SEQ ID NO: 1458196 - RNA, 14 nt, Human
ucuguaaaacuaag

SEQ ID NO: 1458197 - RNA, 21 nt, Human
ucuguaaaacuaagaaacuua

SEQ ID NO: 1458198 - RNA, 11 nt, Human
ucuguaaaauc

SEQ ID NO: 1458199 - RNA, 12 nt, Human
ucuguaaaaucu

SEQ ID NO: 1458200 - RNA, 21 nt, Human
ucugugucuuucacagcuccu

SEQ ID NO: 1458201 - RNA, 12 nt, Human
ucugugucuugu

SEQ ID NO: 1458202 - RNA, 23 nt, Human
ucugugucuaagauucuagauca

SEQ ID NO: 1458203 - RNA, 22 nt, Human
ucugugucuaagauucuagauc

SEQ ID NO: 1458204 - RNA, 20 nt, Human
ucugugucuaagauucuaga

SEQ ID NO: 1458205 - RNA, 18 nt, Human
ucugugucuaagauucua

SEQ ID NO: 1458206 - RNA, 17 nt, Human
ucugugucuaagauucu

SEQ ID NO: 1458207 - RNA, 16 nt, Human
ucugugucuaagauuc

SEQ ID NO: 1458208 - RNA, 14 nt, Human
ucugugucuaagau

SEQ ID NO: 1458209 - RNA, 23 nt, Human
ucugucccuagguguuuuguuca

SEQ ID NO: 1458210 - RNA, 22 nt, Human
ucuguaccaguuaauuuuucca

SEQ ID NO: 1458211 - RNA, 13 nt, Human
ucuguaccaguua

SEQ ID NO: 1458212 - RNA, 12 nt, Human
ucuguaccaguu

SEQ ID NO: 1458213 - RNA, 22 nt, Human
ucugucccuugccccccuggcc

SEQ ID NO: 1458214 - RNA, 16 nt, Human
ucugucccuugccccc

SEQ ID NO: 1458215 - RNA, 19 nt, Human
ucugucccuugccccccug

SEQ ID NO: 1458216 - RNA, 20 nt, Human
ucuguccguucacaugugug

SEQ ID NO: 1458217 - RNA, 19 nt, Human
ucuguuacacuuuuuggaa

SEQ ID NO: 1458218 - RNA, 21 nt, Human
ucuguuaacugaauaccacuc

SEQ ID NO: 1458219 - RNA, 20 nt, Human
ucuguuaacugaauaccacu

SEQ ID NO: 1458220 - RNA, 17 nt, Human
ucuguuaacugaauacc

SEQ ID NO: 1458221 - RNA, 16 nt, Human
ucuguuaacugaauac

SEQ ID NO: 1458222 - RNA, 13 nt, Human
ucuguuaacugaa

SEQ ID NO: 1458223 - RNA, 18 nt, Human
ucuguguuuugaaagaau

SEQ ID NO: 1458224 - RNA, 11 nt, Human
ucugugucuuu

SEQ ID NO: 1458225 - RNA, 16 nt, Human
ucuguguugccaagcu

SEQ ID NO: 1458226 - RNA, 14 nt, Human
ucuguguugccaag

SEQ ID NO: 1458227 - RNA, 20 nt, Human
ucuguucaaagcugccuguc

SEQ ID NO: 1458228 - RNA, 22 nt, Human
ucuguucacuuuuccucccuca

SEQ ID NO: 1458229 - RNA, 21 nt, Human
ucuguucacuuuuccucccuc

SEQ ID NO: 1458230 - RNA, 19 nt, Human
ucuguucacuuuuccuccc

SEQ ID NO: 1458231 - RNA, 17 nt, Human
ucuguuaugcugugaca

SEQ ID NO: 1458232 - RNA, 22 nt, Human
ucuguuuuauaauuuugugaag

SEQ ID NO: 1458233 - RNA, 23 nt, Human
ugccugagucgugaccugcuagg

SEQ ID NO: 1458234 - RNA, 24 nt, Human
ugccugagucgugaccugcuaggc

SEQ ID NO: 1458235 - RNA, 20 nt, Human
ugccugagucgugaccugcu

SEQ ID NO: 1458236 - RNA, 19 nt, Human
ugccugagucgugaccugc

SEQ ID NO: 1458237 - RNA, 18 nt, Human
ugccucugucuucuggac

SEQ ID NO: 1458238 - RNA, 13 nt, Human
ugccugacacacu

SEQ ID NO: 1458239 - RNA, 15 nt, Human
ugccugaauauuugu

SEQ ID NO: 1458240 - RNA, 16 nt, Human
ugccucugugcugugu

SEQ ID NO: 1458241 - RNA, 14 nt, Human
ugccucugugcugu

SEQ ID NO: 1458242 - RNA, 17 nt, Human
ugccucugugcugugug

SEQ ID NO: 1458243 - RNA, 13 nt, Human
ugccucugugcug

SEQ ID NO: 1458244 - RNA, 12 nt, Human
ugccucugugcu

SEQ ID NO: 1458245 - RNA, 11 nt, Human
ugccucugugc

SEQ ID NO: 1458246 - RNA, 16 nt, Human
ugccucugucuucugg

SEQ ID NO: 1458247 - RNA, 13 nt, Human
ugccuccuuccuc

SEQ ID NO: 1458248 - RNA, 18 nt, Human
ugccuccccucuccuucc

SEQ ID NO: 1458249 - RNA, 17 nt, Human
ugccuccccucuccuuc

SEQ ID NO: 1458250 - RNA, 16 nt, Human
ugccuaggccugggca

SEQ ID NO: 1458251 - RNA, 20 nt, Human
ugccuaggccugggcagugg

SEQ ID NO: 1458252 - RNA, 14 nt, Human
ugccuaggccuggg

SEQ ID NO: 1458253 - RNA, 22 nt, Human
ugccuagaaacaacacuguagu

SEQ ID NO: 1458254 - RNA, 17 nt, Human
ugccuagauucagggaa

SEQ ID NO: 1458255 - RNA, 23 nt, Human
ugccuagaaacaacacuguagua

SEQ ID NO: 1458256 - RNA, 19 nt, Human
ugccuagaaacaacacugu

SEQ ID NO: 1458257 - RNA, 18 nt, Human
ugccuagaaacaacacug

SEQ ID NO: 1458258 - RNA, 13 nt, Human
ugccuagaaacaa

SEQ ID NO: 1458259 - RNA, 23 nt, Human
ugccuacagaacuucagaaagac

SEQ ID NO: 1458260 - RNA, 22 nt, Human
ugccuacagaacuucagaaaga

SEQ ID NO: 1458261 - RNA, 17 nt, Human
ugccuacagaacuucag

SEQ ID NO: 1458262 - RNA, 22 nt, Human
ugccuaaguccaguguuucuuu

SEQ ID NO: 1458263 - RNA, 16 nt, Human
ugccuuccuccugggc

SEQ ID NO: 1458264 - RNA, 15 nt, Human
ugccuuccuccuggg

SEQ ID NO: 1458265 - RNA, 14 nt, Human
ugccuuccuccugg

SEQ ID NO: 1458266 - RNA, 18 nt, Human
ugccuuccagaaaacaaa

SEQ ID NO: 1458267 - RNA, 15 nt, Human
ugccuuccagaaaac

SEQ ID NO: 1458268 - RNA, 12 nt, Human
ugccuucauuug

SEQ ID NO: 1458269 - RNA, 17 nt, Human
ugccuuauucagggaag

SEQ ID NO: 1458270 - RNA, 23 nt, Human
ugccuuauuagagugucuuucca

SEQ ID NO: 1458271 - RNA, 21 nt, Human
ugccuuauuagagugucuuuc

SEQ ID NO: 1458272 - RNA, 12 nt, Human
ugccuucaagaa

SEQ ID NO: 1458273 - RNA, 18 nt, Human
ugccuuauucagggaagg

SEQ ID NO: 1458274 - RNA, 15 nt, Human
ugccuggcggggugg

SEQ ID NO: 1458275 - RNA, 21 nt, Human
ugcgcccccuccgcccugcca

SEQ ID NO: 1458276 - RNA, 23 nt, Human
ugcgcccagggcugggaggaagg

SEQ ID NO: 1458277 - RNA, 19 nt, Human
ugcgcccagggcugggagg

SEQ ID NO: 1458278 - RNA, 18 nt, Human
ugcgcccagggcugggag

SEQ ID NO: 1458279 - RNA, 19 nt, Human
ugcgguuauaaaaaauggu

SEQ ID NO: 1458280 - RNA, 21 nt, Human
ugcgguuaauuuugaagugcu

SEQ ID NO: 1458281 - RNA, 16 nt, Human
ugcgguuaauuuugaa

SEQ ID NO: 1458282 - RNA, 23 nt, Human
ugcgcccccuccgcccugccacu

SEQ ID NO: 1458283 - RNA, 21 nt, Human
ugcgcccuuaacugcauccag

SEQ ID NO: 1458284 - RNA, 20 nt, Human
ugccuucgcuucuugccucu

SEQ ID NO: 1458285 - RNA, 17 nt, Human
ugccuucgcuucuugcc

SEQ ID NO: 1458286 - RNA, 16 nt, Human
ugccuucgcuucuugc

SEQ ID NO: 1458287 - RNA, 14 nt, Human
ugccuucgcuucuu

SEQ ID NO: 1458288 - RNA, 13 nt, Human
ugccuucgcuucu

SEQ ID NO: 1458289 - RNA, 19 nt, Human
ugccuuccuguuuuucaca

SEQ ID NO: 1458290 - RNA, 15 nt, Human
ugccuuccuguuuuu

SEQ ID NO: 1458291 - RNA, 20 nt, Human
ugccuuccuccugggcccuc

SEQ ID NO: 1458292 - RNA, 19 nt, Human
ugccuuccuccugggcccu

SEQ ID NO: 1458293 - RNA, 17 nt, Human
ugccuuccuccugggcc

SEQ ID NO: 1458294 - RNA, 13 nt, Human
ugccuucucucuc

SEQ ID NO: 1458295 - RNA, 22 nt, Human
ugccuucucaacuccaaacuga

SEQ ID NO: 1458296 - RNA, 20 nt, Human
ugcguggaaugcccuucacu

SEQ ID NO: 1458297 - RNA, 19 nt, Human
ugcguccacgagcuguuua

SEQ ID NO: 1458298 - RNA, 15 nt, Human
ugcgugcauaccacu

SEQ ID NO: 1458299 - RNA, 23 nt, Human
ugcgguucaggaaaauugaaugc

SEQ ID NO: 1458300 - RNA, 18 nt, Human
ugcgguuccggcauggac

SEQ ID NO: 1458301 - RNA, 22 nt, Human
ugcgguuauaaaaaaugguuca

SEQ ID NO: 1458302 - RNA, 20 nt, Human
ugcgguuauaaaaaaugguu

SEQ ID NO: 1458303 - RNA, 21 nt, Human
ugcgugguggucccuggguag

SEQ ID NO: 1458304 - RNA, 19 nt, Human
ugcgugguggucccugggu

SEQ ID NO: 1458305 - RNA, 18 nt, Human
ugcgugguggucccuggg

SEQ ID NO: 1458306 - RNA, 23 nt, Human
ugcgugggugugugcguguuugg

SEQ ID NO: 1458307 - RNA, 14 nt, Human
ugcgugggugugug

SEQ ID NO: 1458308 - RNA, 18 nt, Human
ugcgugggagugugugcc

SEQ ID NO: 1458309 - RNA, 14 nt, Human
ugcuagagcuccuc

SEQ ID NO: 1458310 - RNA, 13 nt, Human
ugcuagagcuccu

SEQ ID NO: 1458311 - RNA, 13 nt, Human
ugcuagguucuac

SEQ ID NO: 1458312 - RNA, 12 nt, Human
ugcuagguucua

SEQ ID NO: 1458313 - RNA, 20 nt, Human
ugcucagcugucaaggcuca

SEQ ID NO: 1458314 - RNA, 16 nt, Human
ugcucagcugucaagg

SEQ ID NO: 1458315 - RNA, 20 nt, Human
ugcucagcucugggccauuc

SEQ ID NO: 1458316 - RNA, 18 nt, Human
ugcucagcucugggccau

SEQ ID NO: 1458317 - RNA, 20 nt, Human
ugcucagcuucuccaacaau

SEQ ID NO: 1458318 - RNA, 17 nt, Human
ugcucagcuucuccaac

SEQ ID NO: 1458319 - RNA, 14 nt, Human
ugcucaggagcccu

SEQ ID NO: 1458320 - RNA, 21 nt, Human
ugcuccuggaucucccugaga

SEQ ID NO: 1458321 - RNA, 18 nt, Human
ugcuccuggaucucccug

SEQ ID NO: 1458322 - RNA, 16 nt, Human
ugcuccucuuccccag

SEQ ID NO: 1458323 - RNA, 19 nt, Human
ugcuccucuuccccagacg

SEQ ID NO: 1458324 - RNA, 15 nt, Human
ugcuccucuucccca

SEQ ID NO: 1458325 - RNA, 13 nt, Human
ugcuccucuuccc

SEQ ID NO: 1458326 - RNA, 18 nt, Human
ugcucaucugcugguccg

SEQ ID NO: 1458327 - RNA, 16 nt, Human
ugcucaucugcugguc

SEQ ID NO: 1458328 - RNA, 15 nt, Human
ugcucaucugcuggu

SEQ ID NO: 1458329 - RNA, 14 nt, Human
ugcucaucugcugg

SEQ ID NO: 1458330 - RNA, 13 nt, Human
ugcucaucugcug

SEQ ID NO: 1458331 - RNA, 17 nt, Human
ugcucauccacucuacu

SEQ ID NO: 1458332 - RNA, 11 nt, Human
ugcucauggaa

SEQ ID NO: 1458333 - RNA, 23 nt, Human
ugcucaucauucucugucucauc

SEQ ID NO: 1458334 - RNA, 21 nt, Human
ugcucaucauucucugucuca

SEQ ID NO: 1458335 - RNA, 20 nt, Human
ugcucaucauucucugucuc

SEQ ID NO: 1458336 - RNA, 19 nt, Human
ugcucaucauucucugucu

SEQ ID NO: 1458337 - RNA, 17 nt, Human
ugcucaucauucucugu

SEQ ID NO: 1458338 - RNA, 15 nt, Human
ugcucaucauucucu

SEQ ID NO: 1458339 - RNA, 15 nt, Human
ugcucaggagcccug

SEQ ID NO: 1458340 - RNA, 18 nt, Human
ugcugaaaauguccuugu

SEQ ID NO: 1458341 - RNA, 21 nt, Human
ugcugaaaauguccuugugau

SEQ ID NO: 1458342 - RNA, 16 nt, Human
ugcugaaaauguccuu

SEQ ID NO: 1458343 - RNA, 22 nt, Human
ugcucuuuguuuugugucucuu

SEQ ID NO: 1458344 - RNA, 16 nt, Human
ugcugaaaaaugggca

SEQ ID NO: 1458345 - RNA, 11 nt, Human
ugcugaauagg

SEQ ID NO: 1458346 - RNA, 18 nt, Human
ugcugaauaggcgaucac

SEQ ID NO: 1458347 - RNA, 21 nt, Human
ugcugaauaggcgaucacaac

SEQ ID NO: 1458348 - RNA, 23 nt, Human
ugcucuuuucuccucacuguauc

SEQ ID NO: 1458349 - RNA, 21 nt, Human
ugcucuuuucuccucacugua

SEQ ID NO: 1458350 - RNA, 15 nt, Human
ugcucuuuucuccuc

SEQ ID NO: 1458351 - RNA, 13 nt, Human
ugcucuuuucucc

SEQ ID NO: 1458352 - RNA, 20 nt, Human
ugcucuuuguuuugugucuc

SEQ ID NO: 1458353 - RNA, 18 nt, Human
ugcucuuuguuuuguguc

SEQ ID NO: 1458354 - RNA, 15 nt, Human
ugcucuuuguuuugu

SEQ ID NO: 1458355 - RNA, 14 nt, Human
ugcucuuuguuuug

SEQ ID NO: 1458356 - RNA, 22 nt, Human
ugcucuuucucugccagugaca

SEQ ID NO: 1458357 - RNA, 21 nt, Human
ugcucuuucucugccagugac

SEQ ID NO: 1458358 - RNA, 18 nt, Human
ugcucuuucucugccagu

SEQ ID NO: 1458359 - RNA, 17 nt, Human
ugcucuuucucugccag

SEQ ID NO: 1458360 - RNA, 16 nt, Human
ugcucuuucucugcca

SEQ ID NO: 1458361 - RNA, 13 nt, Human
ugcuccuucccca

SEQ ID NO: 1458362 - RNA, 21 nt, Human
ugcuccuugggcccuuugagu

SEQ ID NO: 1458363 - RNA, 19 nt, Human
ugcuccuugggcccuuuga

SEQ ID NO: 1458364 - RNA, 18 nt, Human
ugcuccuugggcccuuug

SEQ ID NO: 1458365 - RNA, 16 nt, Human
ugcuccuugggcccuu

SEQ ID NO: 1458366 - RNA, 15 nt, Human
ugcuccuugggcccu

SEQ ID NO: 1458367 - RNA, 14 nt, Human
ugcuccuugggccc

SEQ ID NO: 1458368 - RNA, 12 nt, Human
ugcuccuugggc

SEQ ID NO: 1458369 - RNA, 15 nt, Human
ugcuccuuccccauc

SEQ ID NO: 1458370 - RNA, 21 nt, Human
ugcuccuguucacaccagaga

SEQ ID NO: 1458371 - RNA, 20 nt, Human
ugcugaauguugggacugcu

SEQ ID NO: 1458372 - RNA, 18 nt, Human
ugcugaauguugggacug

SEQ ID NO: 1458373 - RNA, 18 nt, Human
ugcugaauauacagcagg

SEQ ID NO: 1458374 - RNA, 18 nt, Human
ugcugaucgccuucccca

SEQ ID NO: 1458375 - RNA, 17 nt, Human
ugcugaucgccuucccc

SEQ ID NO: 1458376 - RNA, 21 nt, Human
ugcugaugaacucuuaaucaa

SEQ ID NO: 1458377 - RNA, 16 nt, Human
ugcugaucgccuuccc

SEQ ID NO: 1458378 - RNA, 18 nt, Human
ugcugauauuuucucuag

SEQ ID NO: 1458379 - RNA, 21 nt, Human
ugcugauauuuucucuaggaa

SEQ ID NO: 1458380 - RNA, 15 nt, Human
ugcugauauuuucuc

SEQ ID NO: 1458381 - RNA, 22 nt, Human
ugcaggaucucaccaggcagcc

SEQ ID NO: 1458382 - RNA, 21 nt, Human
ugcaggaucucaccaggcagc

SEQ ID NO: 1458383 - RNA, 20 nt, Human
ugcaggaucucaccaggcag

SEQ ID NO: 1458384 - RNA, 19 nt, Human
ugcaggaucucaccaggca

SEQ ID NO: 1458385 - RNA, 17 nt, Human
ugcaggaucucaccagg

SEQ ID NO: 1458386 - RNA, 19 nt, Human
ugcaggaaucuuuaaaaga

SEQ ID NO: 1458387 - RNA, 16 nt, Human
ugcauguccuguaaag

SEQ ID NO: 1458388 - RNA, 19 nt, Human
ugcauccucuggagccagc

SEQ ID NO: 1458389 - RNA, 22 nt, Human
ugcauccucuggagccagccga

SEQ ID NO: 1458390 - RNA, 14 nt, Human
ugcaggaugguguc

SEQ ID NO: 1458391 - RNA, 18 nt, Human
ugcaggauggugucucuu

SEQ ID NO: 1458392 - RNA, 21 nt, Human
ugcauccagccuggggcugag

SEQ ID NO: 1458393 - RNA, 23 nt, Human
ugccaagacugcuguggccagga

SEQ ID NO: 1458394 - RNA, 22 nt, Human
ugccaagacugcuguggccagg

SEQ ID NO: 1458395 - RNA, 21 nt, Human
ugccaagacugcuguggccag

SEQ ID NO: 1458396 - RNA, 17 nt, Human
ugccaagacugcugugg

SEQ ID NO: 1458397 - RNA, 14 nt, Human
ugccaagacugcug

SEQ ID NO: 1458398 - RNA, 21 nt, Human
ugccaaaaagugaaauaaugu

SEQ ID NO: 1458399 - RNA, 22 nt, Human
ugccaaaaagugaaauaaugug

SEQ ID NO: 1458400 - RNA, 19 nt, Human
ugccaaaaagugaaauaau

SEQ ID NO: 1458401 - RNA, 18 nt, Human
ugccaaaaagugaaauaa

SEQ ID NO: 1458402 - RNA, 17 nt, Human
ugccaaaaagugaaaua

SEQ ID NO: 1458403 - RNA, 16 nt, Human
ugccaaaaagugaaau

SEQ ID NO: 1458404 - RNA, 16 nt, Human
ugccaaaaaaaaauac

SEQ ID NO: 1458405 - RNA, 23 nt, Human
ugcauuuuguuugguauuguauu

SEQ ID NO: 1458406 - RNA, 19 nt, Human
ugcauuaaauucacaaacu

SEQ ID NO: 1458407 - RNA, 17 nt, Human
ugcauuaaauucacaaa

SEQ ID NO: 1458408 - RNA, 16 nt, Human
ugcauuaaauucacaa

SEQ ID NO: 1458409 - RNA, 15 nt, Human
ugcauuaaauucaca

SEQ ID NO: 1458410 - RNA, 14 nt, Human
ugcauuaaauucac

SEQ ID NO: 1458411 - RNA, 13 nt, Human
ugcauuaaauuca

SEQ ID NO: 1458412 - RNA, 17 nt, Human
ugcauuaaauuacagaa

SEQ ID NO: 1458413 - RNA, 21 nt, Human
ugcauuauauuuauuacugua

SEQ ID NO: 1458414 - RNA, 20 nt, Human
ugcauuauauuuauuacugu

SEQ ID NO: 1458415 - RNA, 20 nt, Human
ugcauuaaauuacagaaauu

SEQ ID NO: 1458416 - RNA, 21 nt, Human
ugcauuaaauucacaaacuuu

SEQ ID NO: 1458417 - RNA, 20 nt, Human
ugcauuaaauucacaaacuu

SEQ ID NO: 1458418 - RNA, 15 nt, Human
ugcauuauauuuauu

SEQ ID NO: 1458419 - RNA, 21 nt, Human
ugcccacagugucaggcacug

SEQ ID NO: 1458420 - RNA, 23 nt, Human
ugcccacagugucaggcacuggg

SEQ ID NO: 1458421 - RNA, 20 nt, Human
ugcccacagugucaggcacu

SEQ ID NO: 1458422 - RNA, 18 nt, Human
ugcccacagugucaggca

SEQ ID NO: 1458423 - RNA, 20 nt, Human
ugccaugaugccucugucuu

SEQ ID NO: 1458424 - RNA, 21 nt, Human
ugccaugaugccucugucuuc

SEQ ID NO: 1458425 - RNA, 22 nt, Human
ugccaucugcgugacaauaaaa

SEQ ID NO: 1458426 - RNA, 17 nt, Human
ugccaguauuuuaaaau

SEQ ID NO: 1458427 - RNA, 21 nt, Human
ugccaguauuuuaaaauagcg

SEQ ID NO: 1458428 - RNA, 21 nt, Human
ugccaguaacgcgucuuccug

SEQ ID NO: 1458429 - RNA, 18 nt, Human
ugccaguaacgcgucuuc

SEQ ID NO: 1458430 - RNA, 17 nt, Human
ugccaguaacaggcuca

SEQ ID NO: 1458431 - RNA, 23 nt, Human
ugccaguaacgcgucuuccugag

SEQ ID NO: 1458432 - RNA, 22 nt, Human
ugccaguaacgcgucuuccuga

SEQ ID NO: 1458433 - RNA, 13 nt, Human
ugccacccaggau

SEQ ID NO: 1458434 - RNA, 22 nt, Human
ugccacccagccccagccaggg

SEQ ID NO: 1458435 - RNA, 21 nt, Human
ugccacccagccccagccagg

SEQ ID NO: 1458436 - RNA, 20 nt, Human
ugccacccagccccagccag

SEQ ID NO: 1458437 - RNA, 17 nt, Human
ugccacccagccccagc

SEQ ID NO: 1458438 - RNA, 12 nt, Human
ugccagggcagg

SEQ ID NO: 1458439 - RNA, 11 nt, Human
ugccagggcag

SEQ ID NO: 1458440 - RNA, 22 nt, Human
ugccagggcaaugaugaaugag

SEQ ID NO: 1458441 - RNA, 17 nt, Human
ugccagggcaaugauga

SEQ ID NO: 1458442 - RNA, 20 nt, Human
ugccaggcuggagugcagug

SEQ ID NO: 1458443 - RNA, 22 nt, Human
ugcacacuuugguaccagauaa

SEQ ID NO: 1458444 - RNA, 14 nt, Human
ugcacacuuugcca

SEQ ID NO: 1458445 - RNA, 22 nt, Human
ugcacacuuugccauauuuuca

SEQ ID NO: 1458446 - RNA, 17 nt, Human
ugcacacuuugguacca

SEQ ID NO: 1458447 - RNA, 13 nt, Human
ugcacacuuuggu

SEQ ID NO: 1458448 - RNA, 21 nt, Human
ugcacagaguuguuacauuuu

SEQ ID NO: 1458449 - RNA, 22 nt, Human
ugcacagaguuguuacauuuuu

SEQ ID NO: 1458450 - RNA, 23 nt, Human
ugcacagcacaaauuaguuauau

SEQ ID NO: 1458451 - RNA, 18 nt, Human
ugcacagcacaaauuagu

SEQ ID NO: 1458452 - RNA, 16 nt, Human
ugcacagcacaaauua

SEQ ID NO: 1458453 - RNA, 23 nt, Human
ugcacagaguuguuacauuuuua

SEQ ID NO: 1458454 - RNA, 22 nt, Human
ugcacagcacaaauuaguuaua

SEQ ID NO: 1458455 - RNA, 23 nt, Human
ugcacaggagggggucguggaga

SEQ ID NO: 1458456 - RNA, 15 nt, Human
ugcacaggagggggu

SEQ ID NO: 1458457 - RNA, 13 nt, Human
ugcacaggagggg

SEQ ID NO: 1458458 - RNA, 12 nt, Human
ugcacaggaggg

SEQ ID NO: 1458459 - RNA, 21 nt, Human
ugcaccuaaagaaaaacaaac

SEQ ID NO: 1458460 - RNA, 19 nt, Human
ugcaccuaaagaaaaacaa

SEQ ID NO: 1458461 - RNA, 16 nt, Human
ugcaccuaaagaaaaa

SEQ ID NO: 1458462 - RNA, 15 nt, Human
ugcaccuaaagaaaa

SEQ ID NO: 1458463 - RNA, 14 nt, Human
ugcaccuaaagaaa

SEQ ID NO: 1458464 - RNA, 13 nt, Human
ugcaccuaaagaa

SEQ ID NO: 1458465 - RNA, 19 nt, Human
ugcacaucugugucuuguu

SEQ ID NO: 1458466 - RNA, 18 nt, Human
ugcacaucugugucuugu

SEQ ID NO: 1458467 - RNA, 16 nt, Human
ugcacaucugugucuu

SEQ ID NO: 1458468 - RNA, 15 nt, Human
ugcacaucugugucu

SEQ ID NO: 1458469 - RNA, 22 nt, Human
ugcacaucuguaaaucuacaca

SEQ ID NO: 1458470 - RNA, 12 nt, Human
ugcacaucccug

SEQ ID NO: 1458471 - RNA, 15 nt, Human
ugcacaucaaaauau

SEQ ID NO: 1458472 - RNA, 22 nt, Human
ugcagcuuguagccagccgggg

SEQ ID NO: 1458473 - RNA, 21 nt, Human
ugcagcuuguagccagccggg

SEQ ID NO: 1458474 - RNA, 14 nt, Human
ugcaggaaggagcu

SEQ ID NO: 1458475 - RNA, 12 nt, Human
ugcaggaaggag

SEQ ID NO: 1458476 - RNA, 22 nt, Human
ugcaggaaggagcugccuggac

SEQ ID NO: 1458477 - RNA, 21 nt, Human
ugcaggaaggagcugccugga

SEQ ID NO: 1458478 - RNA, 20 nt, Human
ugcaggaaggagcugccugg

SEQ ID NO: 1458479 - RNA, 19 nt, Human
ugcaggaaggagcugccug

SEQ ID NO: 1458480 - RNA, 18 nt, Human
ugcaggaaggagcugccu

SEQ ID NO: 1458481 - RNA, 17 nt, Human
ugcaggaaggagcugcc

SEQ ID NO: 1458482 - RNA, 16 nt, Human
ugcaggaaggagcugc

SEQ ID NO: 1458483 - RNA, 15 nt, Human
ugcaggaaggagcug

SEQ ID NO: 1458484 - RNA, 23 nt, Human
ugcaggaaggagcugccuggacc

SEQ ID NO: 1458485 - RNA, 14 nt, Human
ugcagcaauaaagc

SEQ ID NO: 1458486 - RNA, 15 nt, Human
ugcagcaauaaagca

SEQ ID NO: 1458487 - RNA, 16 nt, Human
ugcagcaauaaagcag

SEQ ID NO: 1458488 - RNA, 20 nt, Human
ugcagcaauaaagcagcguu

SEQ ID NO: 1458489 - RNA, 16 nt, Human
ugcacuuggcugcaua

SEQ ID NO: 1458490 - RNA, 22 nt, Human
ugcacuugcgguuccggcaugg

SEQ ID NO: 1458491 - RNA, 21 nt, Human
ugcacguaaaguacuuguagu

SEQ ID NO: 1458492 - RNA, 19 nt, Human
ugcacguaaaguacuugua

SEQ ID NO: 1458493 - RNA, 18 nt, Human
ugcacguaaaguacuugu

SEQ ID NO: 1458494 - RNA, 16 nt, Human
ugcacguaaaguacuu

SEQ ID NO: 1458495 - RNA, 12 nt, Human
uggcagaaaagu

SEQ ID NO: 1458496 - RNA, 16 nt, Human
uggcacuuugaagggg

SEQ ID NO: 1458497 - RNA, 11 nt, Human
uggcacuuuga

SEQ ID NO: 1458498 - RNA, 21 nt, Human
uggcaggcagaggcccaggcu

SEQ ID NO: 1458499 - RNA, 18 nt, Human
uggcaggcagaggcccag

SEQ ID NO: 1458500 - RNA, 17 nt, Human
uggcaggcagaggccca

SEQ ID NO: 1458501 - RNA, 12 nt, Human
uggcaggcagag

SEQ ID NO: 1458502 - RNA, 21 nt, Human
uggaugccaauauuaaaucug

SEQ ID NO: 1458503 - RNA, 20 nt, Human
uggaugccaauauuaaaucu

SEQ ID NO: 1458504 - RNA, 20 nt, Human
uggaugauacuaauaaacua

SEQ ID NO: 1458505 - RNA, 23 nt, Human
uggaugcagugcucgcuguugcu

SEQ ID NO: 1458506 - RNA, 15 nt, Human
uggcaggcuggccag

SEQ ID NO: 1458507 - RNA, 18 nt, Human
uggcaggcuggccagucc

SEQ ID NO: 1458508 - RNA, 14 nt, Human
uggcaggcuggcca

SEQ ID NO: 1458509 - RNA, 13 nt, Human
uggcaggcuggcc

SEQ ID NO: 1458510 - RNA, 12 nt, Human
uggcaggcuggc

SEQ ID NO: 1458511 - RNA, 15 nt, Human
uggcaggccagcugu

SEQ ID NO: 1458512 - RNA, 20 nt, Human
uggcaggcaggcucccaggg

SEQ ID NO: 1458513 - RNA, 22 nt, Human
uggcaggcagaggcccaggcug

SEQ ID NO: 1458514 - RNA, 23 nt, Human
uggcaggcagaggcccaggcugc

SEQ ID NO: 1458515 - RNA, 18 nt, Human
uggccagacacaggcccu

SEQ ID NO: 1458516 - RNA, 13 nt, Human
uggccagacacag

SEQ ID NO: 1458517 - RNA, 12 nt, Human
uggccagacaca

SEQ ID NO: 1458518 - RNA, 16 nt, Human
uggcaguuuauauuua

SEQ ID NO: 1458519 - RNA, 23 nt, Human
uggccacuccgagaggugggcca

SEQ ID NO: 1458520 - RNA, 20 nt, Human
uggccacuccgagagguggg

SEQ ID NO: 1458521 - RNA, 21 nt, Human
uggccacuugggucuucccug

SEQ ID NO: 1458522 - RNA, 20 nt, Human
uggcaguuuauauuuaacuc

SEQ ID NO: 1458523 - RNA, 13 nt, Human
uggcaguuauauu

SEQ ID NO: 1458524 - RNA, 18 nt, Human
uggccacuccgagaggug

SEQ ID NO: 1458525 - RNA, 14 nt, Human
uggccacuccgaga

SEQ ID NO: 1458526 - RNA, 16 nt, Human
uggaugauacuaauaa

SEQ ID NO: 1458527 - RNA, 23 nt, Human
uggaugagcucccacaagccuga

SEQ ID NO: 1458528 - RNA, 19 nt, Human
uggaugauauaaugcgggu

SEQ ID NO: 1458529 - RNA, 13 nt, Human
uggaugagcuccc

SEQ ID NO: 1458530 - RNA, 14 nt, Human
uggaugacauuaaa

SEQ ID NO: 1458531 - RNA, 21 nt, Human
uggaucuugauguaaggaugg

SEQ ID NO: 1458532 - RNA, 16 nt, Human
uggauauaguuuuacu

SEQ ID NO: 1458533 - RNA, 15 nt, Human
uggauacuuggauuu

SEQ ID NO: 1458534 - RNA, 14 nt, Human
uggauacuuggauu

SEQ ID NO: 1458535 - RNA, 22 nt, Human
uggauacuuggauuuaguuuca

SEQ ID NO: 1458536 - RNA, 15 nt, Human
uggauaccauuauau

SEQ ID NO: 1458537 - RNA, 13 nt, Human
uggauaccauuau

SEQ ID NO: 1458538 - RNA, 12 nt, Human
uggaggcugcuc

SEQ ID NO: 1458539 - RNA, 15 nt, Human
uggaggcccaguuca

SEQ ID NO: 1458540 - RNA, 18 nt, Human
uggaggccccaacccugu

SEQ ID NO: 1458541 - RNA, 12 nt, Human
uggaggcccagu

SEQ ID NO: 1458542 - RNA, 18 nt, Human
uggaggcccaggcuggga

SEQ ID NO: 1458543 - RNA, 14 nt, Human
uggaggcccaggcu

SEQ ID NO: 1458544 - RNA, 12 nt, Human
uggaggcccagg

SEQ ID NO: 1458545 - RNA, 22 nt, Human
uggaggccauugugugagccua

SEQ ID NO: 1458546 - RNA, 14 nt, Human
uggaggcaggggcu

SEQ ID NO: 1458547 - RNA, 19 nt, Human
uggaggcaggggcuuccug

SEQ ID NO: 1458548 - RNA, 21 nt, Human
uggaggccacuguuuggaaau

SEQ ID NO: 1458549 - RNA, 20 nt, Human
uggaggcaggggcuuccugg

SEQ ID NO: 1458550 - RNA, 18 nt, Human
uggaggcaggggcuuccu

SEQ ID NO: 1458551 - RNA, 17 nt, Human
uggaggcaggggcuucc

SEQ ID NO: 1458552 - RNA, 13 nt, Human
uggacaggaugug

SEQ ID NO: 1458553 - RNA, 23 nt, Human
uggacaggacuaacacucagaag

SEQ ID NO: 1458554 - RNA, 13 nt, Human
uggacagcuugug

SEQ ID NO: 1458555 - RNA, 12 nt, Human
uggacagcuugu

SEQ ID NO: 1458556 - RNA, 19 nt, Human
uggacagcugugccucgcu

SEQ ID NO: 1458557 - RNA, 18 nt, Human
uggacagcugugccucgc

SEQ ID NO: 1458558 - RNA, 16 nt, Human
uggacagcugugccuc

SEQ ID NO: 1458559 - RNA, 15 nt, Human
uggacagcugugccu

SEQ ID NO: 1458560 - RNA, 14 nt, Human
uggacagcugugcc

SEQ ID NO: 1458561 - RNA, 13 nt, Human
uggacagcugugc

SEQ ID NO: 1458562 - RNA, 19 nt, Human
uggagagagcagacuggcg

SEQ ID NO: 1458563 - RNA, 23 nt, Human
uggagacugugugugcccucugg

SEQ ID NO: 1458564 - RNA, 21 nt, Human
uggagacuuagggcaccaggg

SEQ ID NO: 1458565 - RNA, 16 nt, Human
uggagacuuagggcac

SEQ ID NO: 1458566 - RNA, 21 nt, Human
uggagacugugugugcccucu

SEQ ID NO: 1458567 - RNA, 20 nt, Human
uggagacugugugugcccuc

SEQ ID NO: 1458568 - RNA, 18 nt, Human
uggagacugugugugccc

SEQ ID NO: 1458569 - RNA, 21 nt, Human
uggagacugucuggccccccu

SEQ ID NO: 1458570 - RNA, 20 nt, Human
uggagacugucuggcccccc

SEQ ID NO: 1458571 - RNA, 18 nt, Human
uggacaggauguguuugc

SEQ ID NO: 1458572 - RNA, 18 nt, Human
uggagagggaaugugaaa

SEQ ID NO: 1458573 - RNA, 19 nt, Human
uggagagggaaugugaaau

SEQ ID NO: 1458574 - RNA, 17 nt, Human
uggagagggaaugugaa

SEQ ID NO: 1458575 - RNA, 16 nt, Human
uggagagggaauguga

SEQ ID NO: 1458576 - RNA, 15 nt, Human
uggagagggaaugug

SEQ ID NO: 1458577 - RNA, 19 nt, Human
uggagaugaggccagacca

SEQ ID NO: 1458578 - RNA, 22 nt, Human
uggagaugaggccagaccaugg

SEQ ID NO: 1458579 - RNA, 18 nt, Human
uggagaugaggccagacc

SEQ ID NO: 1458580 - RNA, 24 nt, Human
uggagaugaggccagaccauggac

SEQ ID NO: 1458581 - RNA, 16 nt, Human
uggagauugaccugga

SEQ ID NO: 1458582 - RNA, 15 nt, Human
uggagauugaccugg

SEQ ID NO: 1458583 - RNA, 13 nt, Human
uggagauguuuag

SEQ ID NO: 1458584 - RNA, 16 nt, Human
ugcuucuaaguaaaua

SEQ ID NO: 1458585 - RNA, 18 nt, Human
ugcuucgggcccuuccca

SEQ ID NO: 1458586 - RNA, 15 nt, Human
ugcuucgggcccuuc

SEQ ID NO: 1458587 - RNA, 22 nt, Human
ugcuucuaaguaaauacaauuu

SEQ ID NO: 1458588 - RNA, 20 nt, Human
ugcuucuaaguaaauacaau

SEQ ID NO: 1458589 - RNA, 19 nt, Human
ugcuucuaaguaaauacaa

SEQ ID NO: 1458590 - RNA, 18 nt, Human
ugcuucuaaguaaauaca

SEQ ID NO: 1458591 - RNA, 17 nt, Human
ugcuucuaaguaaauac

SEQ ID NO: 1458592 - RNA, 19 nt, Human
ugcuucuaguucugccagg

SEQ ID NO: 1458593 - RNA, 18 nt, Human
ugcuucuaguucugccag

SEQ ID NO: 1458594 - RNA, 20 nt, Human
ugcuucucugacuucugccu

SEQ ID NO: 1458595 - RNA, 19 nt, Human
ugcuucucugacuucugcc

SEQ ID NO: 1458596 - RNA, 17 nt, Human
ugcuucucugacuucug

SEQ ID NO: 1458597 - RNA, 14 nt, Human
ugcuucucugacuu

SEQ ID NO: 1458598 - RNA, 20 nt, Human
ugcuucuaguucugccagga

SEQ ID NO: 1458599 - RNA, 23 nt, Human
ugcuucucugacuucugccugga

SEQ ID NO: 1458600 - RNA, 22 nt, Human
ugcuucucugacuucugccugg

SEQ ID NO: 1458601 - RNA, 21 nt, Human
ugcuucucugacuucugccug

SEQ ID NO: 1458602 - RNA, 14 nt, Human
ugcuucuguuuuau

SEQ ID NO: 1458603 - RNA, 15 nt, Human
ugcuucuuucuagaa

SEQ ID NO: 1458604 - RNA, 19 nt, Human
ugcuucuuucuuugggaau

SEQ ID NO: 1458605 - RNA, 14 nt, Human
ugcuucuuucuaga

SEQ ID NO: 1458606 - RNA, 17 nt, Human
ugcuuuuuuguuuuggc

SEQ ID NO: 1458607 - RNA, 18 nt, Human
ugcuuuccauucgugaaa

SEQ ID NO: 1458608 - RNA, 16 nt, Human
ugcuuuuuguguuuuu

SEQ ID NO: 1458609 - RNA, 14 nt, Human
ugcuuuauuccaga

SEQ ID NO: 1458610 - RNA, 17 nt, Human
ugcuuuauuccagaaug

SEQ ID NO: 1458611 - RNA, 15 nt, Human
ugcuuuauuccagaa

SEQ ID NO: 1458612 - RNA, 22 nt, Human
uggaacugaagggggcggccua

SEQ ID NO: 1458613 - RNA, 21 nt, Human
uggaacugaagggggcggccu

SEQ ID NO: 1458614 - RNA, 20 nt, Human
uggaacugaagggggcggcc

SEQ ID NO: 1458615 - RNA, 16 nt, Human
uggaacugaagggggc

SEQ ID NO: 1458616 - RNA, 15 nt, Human
uggaacugaaggggg

SEQ ID NO: 1458617 - RNA, 13 nt, Human
uggaacugaaggg

SEQ ID NO: 1458618 - RNA, 13 nt, Human
uggaacucugcuu

SEQ ID NO: 1458619 - RNA, 17 nt, Human
uggaaccucagccuggc

SEQ ID NO: 1458620 - RNA, 16 nt, Human
uggaaccucagccugg

SEQ ID NO: 1458621 - RNA, 15 nt, Human
uggaaccucagccug

SEQ ID NO: 1458622 - RNA, 17 nt, Human
uggaacuggaggcaggg

SEQ ID NO: 1458623 - RNA, 23 nt, Human
uggaacugucucucaugaaccuc

SEQ ID NO: 1458624 - RNA, 16 nt, Human
uggaacuggaggcagg

SEQ ID NO: 1458625 - RNA, 13 nt, Human
uggaacuggaggc

SEQ ID NO: 1458626 - RNA, 20 nt, Human
uggaacuggaauccuuucag

SEQ ID NO: 1458627 - RNA, 20 nt, Human
uggaacugcugccacugagg

SEQ ID NO: 1458628 - RNA, 19 nt, Human
uggaacugcugccacugag

SEQ ID NO: 1458629 - RNA, 17 nt, Human
uggaacugcugccacug

SEQ ID NO: 1458630 - RNA, 15 nt, Human
uggaacugcugccac

SEQ ID NO: 1458631 - RNA, 13 nt, Human
uggaacugcugcc

SEQ ID NO: 1458632 - RNA, 16 nt, Human
uggaaaaacagcaugu

SEQ ID NO: 1458633 - RNA, 14 nt, Human
ugcuuuuuuuuccu

SEQ ID NO: 1458634 - RNA, 23 nt, Human
ugcuuuuuuuguguguauuugcu

SEQ ID NO: 1458635 - RNA, 17 nt, Human
ugcuuuuuuugugugua

SEQ ID NO: 1458636 - RNA, 17 nt, Human
ugcuuuuuuuuccuucu

SEQ ID NO: 1458637 - RNA, 15 nt, Human
uggaacccagacuca

SEQ ID NO: 1458638 - RNA, 14 nt, Human
uggaacccagacuc

SEQ ID NO: 1458639 - RNA, 12 nt, Human
uggaacccagac

SEQ ID NO: 1458640 - RNA, 17 nt, Human
uggaacccagacucaga

SEQ ID NO: 1458641 - RNA, 16 nt, Human
uggaacccagacucag

SEQ ID NO: 1458642 - RNA, 22 nt, Human
uggaacccagacucagacauug

SEQ ID NO: 1458643 - RNA, 19 nt, Human
uggaacccuaaauaauaaa

SEQ ID NO: 1458644 - RNA, 13 nt, Human
uggaauccuuuca

SEQ ID NO: 1458645 - RNA, 23 nt, Human
uggaaucaggaauauuuuccaaa

SEQ ID NO: 1458646 - RNA, 22 nt, Human
uggaaucaggaauauuuuccaa

SEQ ID NO: 1458647 - RNA, 21 nt, Human
uggaaucaggaauauuuucca

SEQ ID NO: 1458648 - RNA, 16 nt, Human
uggaaucagcucagga

SEQ ID NO: 1458649 - RNA, 22 nt, Human
uggaaucacuguuuagaacaca

SEQ ID NO: 1458650 - RNA, 20 nt, Human
uggaauauuguccauugucc

SEQ ID NO: 1458651 - RNA, 15 nt, Human
uggaauauuguccau

SEQ ID NO: 1458652 - RNA, 21 nt, Human
uggaauguggccccugaacaa

SEQ ID NO: 1458653 - RNA, 14 nt, Human
uggaauguaaucaa

SEQ ID NO: 1458654 - RNA, 23 nt, Human
uggaauguggccccugaacaaga

SEQ ID NO: 1458655 - RNA, 18 nt, Human
uggaaguuauuaacuuua

SEQ ID NO: 1458656 - RNA, 15 nt, Human
uggaauacaugaaau

SEQ ID NO: 1458657 - RNA, 14 nt, Human
uggaauacaugaaa

SEQ ID NO: 1458658 - RNA, 19 nt, Human
uggaaguuuagcucugaga

SEQ ID NO: 1458659 - RNA, 18 nt, Human
uggaaguuuagcucugag

SEQ ID NO: 1458660 - RNA, 20 nt, Human
uggaaguuuagcucugagaa

SEQ ID NO: 1458661 - RNA, 18 nt, Human
uggaauacuuuuuguuau

SEQ ID NO: 1458662 - RNA, 13 nt, Human
uggaauacuuuuu

SEQ ID NO: 1458663 - RNA, 12 nt, Human
uggaauacuuuu

SEQ ID NO: 1458664 - RNA, 16 nt, Human
uggaauacucuuauau

SEQ ID NO: 1458665 - RNA, 15 nt, Human
uggcucucaccucua

SEQ ID NO: 1458666 - RNA, 14 nt, Human
uggcucuacuuccc

SEQ ID NO: 1458667 - RNA, 19 nt, Human
uggcucuaauucacagugc

SEQ ID NO: 1458668 - RNA, 21 nt, Human
uggcucgaaucucugugccuu

SEQ ID NO: 1458669 - RNA, 18 nt, Human
uggcuccuugugccagag

SEQ ID NO: 1458670 - RNA, 20 nt, Human
uggcucgaaucucugugccu

SEQ ID NO: 1458671 - RNA, 19 nt, Human
uggcucgaaucucugugcc

SEQ ID NO: 1458672 - RNA, 18 nt, Human
uggcucgaaucucugugc

SEQ ID NO: 1458673 - RNA, 20 nt, Human
uggcuccuugugccagagaa

SEQ ID NO: 1458674 - RNA, 17 nt, Human
uggcuccuugugccaga

SEQ ID NO: 1458675 - RNA, 19 nt, Human
uggcuccuucccaucgcug

SEQ ID NO: 1458676 - RNA, 17 nt, Human
uggcuccuucccaucgc

SEQ ID NO: 1458677 - RNA, 14 nt, Human
uggcuaaagcucga

SEQ ID NO: 1458678 - RNA, 18 nt, Human
uggcguaggcuacagaga

SEQ ID NO: 1458679 - RNA, 24 nt, Human
uggccuuugcgcuccuggcccagc

SEQ ID NO: 1458680 - RNA, 19 nt, Human
uggccuuugcgcuccuggc

SEQ ID NO: 1458681 - RNA, 16 nt, Human
uggccuuugcgcuccu

SEQ ID NO: 1458682 - RNA, 14 nt, Human
uggccuuugcgcuc

SEQ ID NO: 1458683 - RNA, 12 nt, Human
uggccuuuauua

SEQ ID NO: 1458684 - RNA, 22 nt, Human
uggccuuuauuaaaaacugagu

SEQ ID NO: 1458685 - RNA, 19 nt, Human
uggccuuguucugucacca

SEQ ID NO: 1458686 - RNA, 14 nt, Human
uggccuuguucugu

SEQ ID NO: 1458687 - RNA, 22 nt, Human
uggcguaggcuacagagaagcc

SEQ ID NO: 1458688 - RNA, 23 nt, Human
uggcguaggcuacagagaagccu

SEQ ID NO: 1458689 - RNA, 21 nt, Human
uggcguaggcuacagagaagc

SEQ ID NO: 1458690 - RNA, 20 nt, Human
uggcguaggcuacagagaag

SEQ ID NO: 1458691 - RNA, 19 nt, Human
uggcguaggcuacagagaa

SEQ ID NO: 1458692 - RNA, 22 nt, Human
uggccuuuuucauuuaucuaua

SEQ ID NO: 1458693 - RNA, 20 nt, Human
uggccuuuuucauuuaucua

SEQ ID NO: 1458694 - RNA, 19 nt, Human
uggccuuuuucauuuaucu

SEQ ID NO: 1458695 - RNA, 16 nt, Human
uggccuuuuucauuua

SEQ ID NO: 1458696 - RNA, 17 nt, Human
uggcgccgucuccaggg

SEQ ID NO: 1458697 - RNA, 15 nt, Human
uggcgccgucuccag

SEQ ID NO: 1458698 - RNA, 21 nt, Human
uggcgcgaucucggcucacug

SEQ ID NO: 1458699 - RNA, 18 nt, Human
uggcgccgucuccagggg

SEQ ID NO: 1458700 - RNA, 18 nt, Human
uggcgcgaucucagcuca

SEQ ID NO: 1458701 - RNA, 22 nt, Human
uggcuuuuauuaaugcacuuuc

SEQ ID NO: 1458702 - RNA, 17 nt, Human
ugggaauggaggggcag

SEQ ID NO: 1458703 - RNA, 19 nt, Human
ugggaauggaggggcagag

SEQ ID NO: 1458704 - RNA, 21 nt, Human
ugggacagucaccucauggaa

SEQ ID NO: 1458705 - RNA, 20 nt, Human
ugggacagucaccucaugga

SEQ ID NO: 1458706 - RNA, 18 nt, Human
ugggacagucaccucaug

SEQ ID NO: 1458707 - RNA, 23 nt, Human
ugggaauggaggggcagagccag

SEQ ID NO: 1458708 - RNA, 16 nt, Human
uggcuguaaggcucua

SEQ ID NO: 1458709 - RNA, 15 nt, Human
uggcuguaaggcucu

SEQ ID NO: 1458710 - RNA, 21 nt, Human
uggcugguguuaacagaaggg

SEQ ID NO: 1458711 - RNA, 20 nt, Human
uggcugguguuaacagaagg

SEQ ID NO: 1458712 - RNA, 21 nt, Human
uggcuguaaggcucuagauca

SEQ ID NO: 1458713 - RNA, 20 nt, Human
uggcuguaaggcucuagauc

SEQ ID NO: 1458714 - RNA, 19 nt, Human
uggcuguaaggcucuagau

SEQ ID NO: 1458715 - RNA, 21 nt, Human
uggcuuuuauuaaugcacuuu

SEQ ID NO: 1458716 - RNA, 20 nt, Human
uggcuuuuauuaaugcacuu

SEQ ID NO: 1458717 - RNA, 17 nt, Human
uggcuuuuauuaaugca

SEQ ID NO: 1458718 - RNA, 20 nt, Human
uggcuuugugauucaaucug

SEQ ID NO: 1458719 - RNA, 19 nt, Human
uggcugguguuaacagaag

SEQ ID NO: 1458720 - RNA, 16 nt, Human
ugggagcugaggccac

SEQ ID NO: 1458721 - RNA, 22 nt, Human
ugggagcuccacucugcuucuc

SEQ ID NO: 1458722 - RNA, 19 nt, Human
ugggagcuccacucugcuu

SEQ ID NO: 1458723 - RNA, 16 nt, Human
ugggagcuccacucug

SEQ ID NO: 1458724 - RNA, 23 nt, Human
ugggagccgggucugccucuucu

SEQ ID NO: 1458725 - RNA, 18 nt, Human
ugggagccgggucugccu

SEQ ID NO: 1458726 - RNA, 14 nt, Human
ugggagccgggucu

SEQ ID NO: 1458727 - RNA, 19 nt, Human
ugggagcccccagccuguc

SEQ ID NO: 1458728 - RNA, 20 nt, Human
ugggagcccccagccuguca

SEQ ID NO: 1458729 - RNA, 18 nt, Human
ugggagcccccagccugu

SEQ ID NO: 1458730 - RNA, 17 nt, Human
ugggagcccccagccug

SEQ ID NO: 1458731 - RNA, 16 nt, Human
ugggagcccccagccu

SEQ ID NO: 1458732 - RNA, 15 nt, Human
ugggagcccccagcc

SEQ ID NO: 1458733 - RNA, 12 nt, Human
ugggagccaggg

SEQ ID NO: 1458734 - RNA, 22 nt, Human
ugggagcaaacugcaugcccag

SEQ ID NO: 1458735 - RNA, 20 nt, Human
ugggagcaaacugcaugccc

SEQ ID NO: 1458736 - RNA, 19 nt, Human
ugggagcaaacugcaugcc

SEQ ID NO: 1458737 - RNA, 14 nt, Human
ugggaccaggcacc

SEQ ID NO: 1458738 - RNA, 13 nt, Human
ugggaccaggcac

SEQ ID NO: 1458739 - RNA, 17 nt, Human
ugggaccacaacuauuu

SEQ ID NO: 1458740 - RNA, 17 nt, Human
ugggacauuccaaagaa

SEQ ID NO: 1458741 - RNA, 20 nt, Human
ugggacauuugcucauggaa

SEQ ID NO: 1458742 - RNA, 19 nt, Human
ugggacauuugcucaugga

SEQ ID NO: 1458743 - RNA, 20 nt, Human
uggggcaggaguagcugagc

SEQ ID NO: 1458744 - RNA, 19 nt, Human
uggggcaggaguagcugag

SEQ ID NO: 1458745 - RNA, 18 nt, Human
uggggcaggaguagcuga

SEQ ID NO: 1458746 - RNA, 15 nt, Human
uggggcaggaguagc

SEQ ID NO: 1458747 - RNA, 14 nt, Human
uggggcaggaguag

SEQ ID NO: 1458748 - RNA, 13 nt, Human
uggggcaggagua

SEQ ID NO: 1458749 - RNA, 12 nt, Human
uggggcaggagu

SEQ ID NO: 1458750 - RNA, 22 nt, Human
ugggcuugggccuaggcugcau

SEQ ID NO: 1458751 - RNA, 19 nt, Human
ugggcuugggccuaggcug

SEQ ID NO: 1458752 - RNA, 18 nt, Human
ugggcuugggccuaggcu

SEQ ID NO: 1458753 - RNA, 15 nt, Human
ugggcuugggccuag

SEQ ID NO: 1458754 - RNA, 14 nt, Human
ugggcuugggccua

SEQ ID NO: 1458755 - RNA, 13 nt, Human
ugggcuugggccu

SEQ ID NO: 1458756 - RNA, 22 nt, Human
ugggcgcugguccuuucuuccg

SEQ ID NO: 1458757 - RNA, 14 nt, Human
ugggcgcugguccu

SEQ ID NO: 1458758 - RNA, 16 nt, Human
ugggccuugggcuccg

SEQ ID NO: 1458759 - RNA, 15 nt, Human
ugggccuugggcucc

SEQ ID NO: 1458760 - RNA, 14 nt, Human
ugggccuugggcuc

SEQ ID NO: 1458761 - RNA, 19 nt, Human
ugggccuuggccuggagca

SEQ ID NO: 1458762 - RNA, 18 nt, Human
ugggccuuggccuggagc

SEQ ID NO: 1458763 - RNA, 17 nt, Human
ugggccuuggccuggag

SEQ ID NO: 1458764 - RNA, 16 nt, Human
ugggccuuggccugga

SEQ ID NO: 1458765 - RNA, 16 nt, Human
ugggcaguuuuuugaa

SEQ ID NO: 1458766 - RNA, 15 nt, Human
ugggcaguuuuuuga

SEQ ID NO: 1458767 - RNA, 13 nt, Human
ugggaggaaggac

SEQ ID NO: 1458768 - RNA, 20 nt, Human
ugggagcugguuagaaaugc

SEQ ID NO: 1458769 - RNA, 18 nt, Human
ugggagcugguuagaaau

SEQ ID NO: 1458770 - RNA, 16 nt, Human
ugggagcuugggaaug

SEQ ID NO: 1458771 - RNA, 19 nt, Human
ugggagcugguuagaaaug

SEQ ID NO: 1458772 - RNA, 16 nt, Human
ugggagcuuuuguaga

SEQ ID NO: 1458773 - RNA, 15 nt, Human
ugggccuuggccugg

SEQ ID NO: 1458774 - RNA, 13 nt, Human
ugggccuuggccu

SEQ ID NO: 1458775 - RNA, 12 nt, Human
ugggccuuggcc

SEQ ID NO: 1458776 - RNA, 22 nt, Human
ugggcaugagggguuccucccc

SEQ ID NO: 1458777 - RNA, 23 nt, Human
ugggcaugagggguuccuccccu

SEQ ID NO: 1458778 - RNA, 19 nt, Human
ugggcaucuuuuguauuaa

SEQ ID NO: 1458779 - RNA, 18 nt, Human
ugggcaucuuuuguauua

SEQ ID NO: 1458780 - RNA, 15 nt, Human
ugggcaucuuuugua

SEQ ID NO: 1458781 - RNA, 13 nt, Human
ugggcaucuuuug

SEQ ID NO: 1458782 - RNA, 20 nt, Human
ugggcaugguguucuccugc

SEQ ID NO: 1458783 - RNA, 19 nt, Human
ugggcaugguguucuccug

SEQ ID NO: 1458784 - RNA, 13 nt, Human
ugggcauucaaau

SEQ ID NO: 1458785 - RNA, 17 nt, Human
uggguccaugggcagag

SEQ ID NO: 1458786 - RNA, 14 nt, Human
uggguccaugggca

SEQ ID NO: 1458787 - RNA, 13 nt, Human
uggguccaggagg

SEQ ID NO: 1458788 - RNA, 15 nt, Human
uggguuccacagacg

SEQ ID NO: 1458789 - RNA, 14 nt, Human
uggguuccacagac

SEQ ID NO: 1458790 - RNA, 13 nt, Human
uggguuccacaga

SEQ ID NO: 1458791 - RNA, 15 nt, Human
uggguugucaccaag

SEQ ID NO: 1458792 - RNA, 15 nt, Human
uggguugggaucagg

SEQ ID NO: 1458793 - RNA, 21 nt, Human
uggguugcagacaggaaucuu

SEQ ID NO: 1458794 - RNA, 16 nt, Human
uggguugcagacagga

SEQ ID NO: 1458795 - RNA, 22 nt, Human
uggguucugccugccagcugca

SEQ ID NO: 1458796 - RNA, 21 nt, Human
uggguucugccugccagcugc

SEQ ID NO: 1458797 - RNA, 18 nt, Human
uggggcaggcugggccau

SEQ ID NO: 1458798 - RNA, 17 nt, Human
uggggcaggcugggcca

SEQ ID NO: 1458799 - RNA, 16 nt, Human
uggggcaggcugggcc

SEQ ID NO: 1458800 - RNA, 15 nt, Human
uggggcaggcugggc

SEQ ID NO: 1458801 - RNA, 14 nt, Human
uggggcaggcuggg

SEQ ID NO: 1458802 - RNA, 21 nt, Human
uggggcaggccaccuggcucu

SEQ ID NO: 1458803 - RNA, 21 nt, Human
uggggcaggaguagcugagcu

SEQ ID NO: 1458804 - RNA, 22 nt, Human
uggggcaggaguagcugagcuc

SEQ ID NO: 1458805 - RNA, 18 nt, Human
uggggcaggggccggggg

SEQ ID NO: 1458806 - RNA, 20 nt, Human
uggggcaggcugggccaugu

SEQ ID NO: 1458807 - RNA, 16 nt, Human
uggggcaggggccggg

SEQ ID NO: 1458808 - RNA, 19 nt, Human
ugggguggggggggugcug

SEQ ID NO: 1458809 - RNA, 16 nt, Human
uggguagacacacaug

SEQ ID NO: 1458810 - RNA, 17 nt, Human
uggguagacacacauga

SEQ ID NO: 1458811 - RNA, 21 nt, Human
ugggguggggggggugcuggg

SEQ ID NO: 1458812 - RNA, 22 nt, Human
ugggguggggggggugcugggc

SEQ ID NO: 1458813 - RNA, 14 nt, Human
uggguccaggagga

SEQ ID NO: 1458814 - RNA, 12 nt, Human
uggguccaggag

SEQ ID NO: 1458815 - RNA, 13 nt, Human
ugggucaggcagg

SEQ ID NO: 1458816 - RNA, 18 nt, Human
uggguaggguaaaucagu

SEQ ID NO: 1458817 - RNA, 12 nt, Human
uggguauaaaag

SEQ ID NO: 1458818 - RNA, 14 nt, Human
uggguauaaaagau

SEQ ID NO: 1458819 - RNA, 23 nt, Human
uggguaggaaagaggaagcaaau

SEQ ID NO: 1458820 - RNA, 17 nt, Human
uguuuguuuccuuuguu

SEQ ID NO: 1458821 - RNA, 18 nt, Human
uguuuuaaaaugagaaau

SEQ ID NO: 1458822 - RNA, 14 nt, Human
uguuuguuuaauuu

SEQ ID NO: 1458823 - RNA, 13 nt, Human
uguuuguuuaauu

SEQ ID NO: 1458824 - RNA, 22 nt, Human
uguuuacagauaauuaccuacu

SEQ ID NO: 1458825 - RNA, 16 nt, Human
uguuuacagauaauua

SEQ ID NO: 1458826 - RNA, 15 nt, Human
uguuuacagauaauu

SEQ ID NO: 1458827 - RNA, 16 nt, Human
uguuucuauuuuuuga

SEQ ID NO: 1458828 - RNA, 21 nt, Human
uguuucucccccauguucugu

SEQ ID NO: 1458829 - RNA, 13 nt, Human
uguuucuccccca

SEQ ID NO: 1458830 - RNA, 22 nt, Human
uguuucuauuuuuugaaaagca

SEQ ID NO: 1458831 - RNA, 12 nt, Human
uguuuuuucuaa

SEQ ID NO: 1458832 - RNA, 22 nt, Human
uguuuuucuauuaaaagacuca

SEQ ID NO: 1458833 - RNA, 21 nt, Human
uguuuuucuauuaaaagacuc

SEQ ID NO: 1458834 - RNA, 20 nt, Human
uguuuuucuauuaaaagacu

SEQ ID NO: 1458835 - RNA, 19 nt, Human
uguuuuucuauuaaaagac

SEQ ID NO: 1458836 - RNA, 18 nt, Human
uguuuuucuauuaaaaga

SEQ ID NO: 1458837 - RNA, 17 nt, Human
uguuuuucuauuaaaag

SEQ ID NO: 1458838 - RNA, 16 nt, Human
uguuuuucuauuaaaa

SEQ ID NO: 1458839 - RNA, 15 nt, Human
uguuuuucuauuaaa

SEQ ID NO: 1458840 - RNA, 14 nt, Human
uguuuuucuauuaa

SEQ ID NO: 1458841 - RNA, 13 nt, Human
uguuuuucuauua

SEQ ID NO: 1458842 - RNA, 13 nt, Human
uguuuuucuaaag

SEQ ID NO: 1458843 - RNA, 16 nt, Human
uguuuuuccuuccaau

SEQ ID NO: 1458844 - RNA, 11 nt, Human
uguuuuucauu

SEQ ID NO: 1458845 - RNA, 13 nt, Human
uguuuuucacauu

SEQ ID NO: 1458846 - RNA, 16 nt, Human
uguuuuuaucuuuuua

SEQ ID NO: 1458847 - RNA, 23 nt, Human
uguuuuggcugaaauucuccugg

SEQ ID NO: 1458848 - RNA, 18 nt, Human
uguuuuggcugaaauucu

SEQ ID NO: 1458849 - RNA, 19 nt, Human
uguuuuggacaguuuacca

SEQ ID NO: 1458850 - RNA, 14 nt, Human
uguuuugcuaaagg

SEQ ID NO: 1458851 - RNA, 22 nt, Human
uguuuuaaacauuaauagcagc

SEQ ID NO: 1458852 - RNA, 23 nt, Human
uguuuuaaaaugagaaaucuaaa

SEQ ID NO: 1458853 - RNA, 19 nt, Human
uuaaagagucuagauucaa

SEQ ID NO: 1458854 - RNA, 14 nt, Human
uuaaagccuccuca

SEQ ID NO: 1458855 - RNA, 23 nt, Human
uuaaagagucuagauucaaaggu

SEQ ID NO: 1458856 - RNA, 18 nt, Human
uuaaagagucuagauuca

SEQ ID NO: 1458857 - RNA, 17 nt, Human
uuaaagagucuagauuc

SEQ ID NO: 1458858 - RNA, 16 nt, Human
uuaaagagucuagauu

SEQ ID NO: 1458859 - RNA, 15 nt, Human
uuaaagagucuagau

SEQ ID NO: 1458860 - RNA, 14 nt, Human
uuaaagagucuaga

SEQ ID NO: 1458861 - RNA, 12 nt, Human
uuaaagagucua

SEQ ID NO: 1458862 - RNA, 20 nt, Human
uuaaacuuaaucuaaaugga

SEQ ID NO: 1458863 - RNA, 22 nt, Human
uuaaacuuaaucuaaauggaac

SEQ ID NO: 1458864 - RNA, 12 nt, Human
uuaaaagacuca

SEQ ID NO: 1458865 - RNA, 18 nt, Human
uuaaaagacucauccguc

SEQ ID NO: 1458866 - RNA, 14 nt, Human
uuaaaagacucauc

SEQ ID NO: 1458867 - RNA, 13 nt, Human
uuaaaagacucau

SEQ ID NO: 1458868 - RNA, 16 nt, Human
uuaaacuuaaucuaaa

SEQ ID NO: 1458869 - RNA, 18 nt, Human
uuaaacuuaaucuaaaug

SEQ ID NO: 1458870 - RNA, 14 nt, Human
uuaaaacagacacu

SEQ ID NO: 1458871 - RNA, 21 nt, Human
uuaaaacagacacuggcaugg

SEQ ID NO: 1458872 - RNA, 15 nt, Human
uuaaaacauuaaaau

SEQ ID NO: 1458873 - RNA, 19 nt, Human
uuaaaagaaugauuaugaa

SEQ ID NO: 1458874 - RNA, 17 nt, Human
uuaaauguaaagauauu

SEQ ID NO: 1458875 - RNA, 13 nt, Human
uuaaauguaaaga

SEQ ID NO: 1458876 - RNA, 18 nt, Human
uuaaauguaaagacaaaa

SEQ ID NO: 1458877 - RNA, 11 nt, Human
uuaacauuccu

SEQ ID NO: 1458878 - RNA, 17 nt, Human
uuaacauuccaagacuc

SEQ ID NO: 1458879 - RNA, 14 nt, Human
uuaacauuccaaga

SEQ ID NO: 1458880 - RNA, 13 nt, Human
uuaacauuccaag

SEQ ID NO: 1458881 - RNA, 14 nt, Human
uuaaagcuguuauu

SEQ ID NO: 1458882 - RNA, 19 nt, Human
uuaaauagcuuuuuucucu

SEQ ID NO: 1458883 - RNA, 20 nt, Human
uuaaagcuuccauuguuguc

SEQ ID NO: 1458884 - RNA, 15 nt, Human
uuaaagcuuccauug

SEQ ID NO: 1458885 - RNA, 16 nt, Human
uuaaaugcaccuggaa

SEQ ID NO: 1458886 - RNA, 17 nt, Human
uuaaaugcaccuggaau

SEQ ID NO: 1458887 - RNA, 18 nt, Human
uuaaaugcaccuggaaua

SEQ ID NO: 1458888 - RNA, 19 nt, Human
uuaacauuccaagacucua

SEQ ID NO: 1458889 - RNA, 23 nt, Human
uuaacauuccucaugaauguaaa

SEQ ID NO: 1458890 - RNA, 17 nt, Human
uuaaggaugcuuguaca

SEQ ID NO: 1458891 - RNA, 18 nt, Human
uuaaggaugcuuguacau

SEQ ID NO: 1458892 - RNA, 19 nt, Human
uuaaggaugcuuguacaua

SEQ ID NO: 1458893 - RNA, 20 nt, Human
uuaaggaugcuuguacauaa

SEQ ID NO: 1458894 - RNA, 22 nt, Human
uuaaggaugcuuguacauaaug

SEQ ID NO: 1458895 - RNA, 19 nt, Human
uuaauaauuuagacuucaa

SEQ ID NO: 1458896 - RNA, 16 nt, Human
uuaauagguuuggaca

SEQ ID NO: 1458897 - RNA, 18 nt, Human
uuaauaauguuucaaaca

SEQ ID NO: 1458898 - RNA, 18 nt, Human
uuaagggaagaauuccag

SEQ ID NO: 1458899 - RNA, 14 nt, Human
uuaauuauuauuug

SEQ ID NO: 1458900 - RNA, 14 nt, Human
uuaauuauuauuua

SEQ ID NO: 1458901 - RNA, 17 nt, Human
uuaauuauuauucuuca

SEQ ID NO: 1458902 - RNA, 14 nt, Human
uuaauuauuauucu

SEQ ID NO: 1458903 - RNA, 22 nt, Human
uuaauuaugccuuuuuugauca

SEQ ID NO: 1458904 - RNA, 21 nt, Human
uuaauuagugcuaagugugaa

SEQ ID NO: 1458905 - RNA, 16 nt, Human
uuaauggcugauaauu

SEQ ID NO: 1458906 - RNA, 16 nt, Human
uuaauuagugcuaagu

SEQ ID NO: 1458907 - RNA, 18 nt, Human
uuaauuagugcuaagugu

SEQ ID NO: 1458908 - RNA, 20 nt, Human
uuaauuagugcuaaguguga

SEQ ID NO: 1458909 - RNA, 18 nt, Human
uuaauggcugauaauuuu

SEQ ID NO: 1458910 - RNA, 20 nt, Human
uuaauaugcuuaaaauaagc

SEQ ID NO: 1458911 - RNA, 19 nt, Human
uuaauauccuaaacaucau

SEQ ID NO: 1458912 - RNA, 17 nt, Human
uuaauauccuaaacauc

SEQ ID NO: 1458913 - RNA, 14 nt, Human
uuaauauccuaaac

SEQ ID NO: 1458914 - RNA, 20 nt, Human
uuaauaucccuacauguauu

SEQ ID NO: 1458915 - RNA, 19 nt, Human
uuaauaucccuacauguau

SEQ ID NO: 1458916 - RNA, 23 nt, Human
uuaauauaaaguaguccugugaa

SEQ ID NO: 1458917 - RNA, 22 nt, Human
uuaauauaaaguaguccuguga

SEQ ID NO: 1458918 - RNA, 21 nt, Human
uuaauagguuuggacaaaaug

SEQ ID NO: 1458919 - RNA, 20 nt, Human
uuacauuuguauaaaauaau

SEQ ID NO: 1458920 - RNA, 23 nt, Human
uuacauuuuuaagugcugcauuu

SEQ ID NO: 1458921 - RNA, 22 nt, Human
uuacauuuuuaagugcugcauu

SEQ ID NO: 1458922 - RNA, 20 nt, Human
uuacauuuuuaagugcugca

SEQ ID NO: 1458923 - RNA, 21 nt, Human
uuacauuuuuaagugcugcau

SEQ ID NO: 1458924 - RNA, 24 nt, Human
uuaccagauuuuuacacauguauc

SEQ ID NO: 1458925 - RNA, 21 nt, Human
uuaccagauuuuuacacaugu

SEQ ID NO: 1458926 - RNA, 18 nt, Human
uuaccuuuuuauuugcau

SEQ ID NO: 1458927 - RNA, 15 nt, Human
uuaccuuuuuauuug

SEQ ID NO: 1458928 - RNA, 21 nt, Human
uuaccacuuguguuuugcaag

SEQ ID NO: 1458929 - RNA, 20 nt, Human
uuaccuuuuuauuugcaugu

SEQ ID NO: 1458930 - RNA, 22 nt, Human
uuaccuuuuuuauacauaaaca

SEQ ID NO: 1458931 - RNA, 19 nt, Human
uuaccuuuuuuauacauaa

SEQ ID NO: 1458932 - RNA, 20 nt, Human
uuaccuuuuuuauacauaaa

SEQ ID NO: 1458933 - RNA, 22 nt, Human
uuacguaugucugguucucaau

SEQ ID NO: 1458934 - RNA, 19 nt, Human
uuacguaugucugguucuc

SEQ ID NO: 1458935 - RNA, 13 nt, Human
uuacgcuuugauu

SEQ ID NO: 1458936 - RNA, 16 nt, Human
uuacgcuuugauucau

SEQ ID NO: 1458937 - RNA, 15 nt, Human
uuacgcuuugauuca

SEQ ID NO: 1458938 - RNA, 16 nt, Human
uuacggaacucaaaua

SEQ ID NO: 1458939 - RNA, 15 nt, Human
uuacaauguaauuau

SEQ ID NO: 1458940 - RNA, 14 nt, Human
uuacaauguaauua

SEQ ID NO: 1458941 - RNA, 13 nt, Human
uuacaauguaauu

SEQ ID NO: 1458942 - RNA, 19 nt, Human
uuacaauguaauuauuuau

SEQ ID NO: 1458943 - RNA, 21 nt, Human
uuacaauguaauuauuuaugu

SEQ ID NO: 1458944 - RNA, 17 nt, Human
uuacaauguaauuauuu

SEQ ID NO: 1458945 - RNA, 16 nt, Human
uuacaauguaauuauu

SEQ ID NO: 1458946 - RNA, 21 nt, Human
uuaauucagaaccccaacuac

SEQ ID NO: 1458947 - RNA, 21 nt, Human
uuaauuauuauuuguguuuua

SEQ ID NO: 1458948 - RNA, 15 nt, Human
uuacaauaguucugu

SEQ ID NO: 1458949 - RNA, 17 nt, Human
uuacaauaguucugugg

SEQ ID NO: 1458950 - RNA, 16 nt, Human
uuacauguuuuaaaga

SEQ ID NO: 1458951 - RNA, 13 nt, Human
uuacauguuugca

SEQ ID NO: 1458952 - RNA, 12 nt, Human
uuacauguuugc

SEQ ID NO: 1458953 - RNA, 23 nt, Human
uuacauggcuggagcuagaauuu

SEQ ID NO: 1458954 - RNA, 18 nt, Human
uuacagauauuugucaug

SEQ ID NO: 1458955 - RNA, 22 nt, Human
uuacauggcuggagcuagaauu

SEQ ID NO: 1458956 - RNA, 14 nt, Human
uuacauguuugcac

SEQ ID NO: 1458957 - RNA, 19 nt, Human
uuacauuauuaucaacaau

SEQ ID NO: 1458958 - RNA, 15 nt, Human
uuacauuuguauaaa

SEQ ID NO: 1458959 - RNA, 14 nt, Human
uuacauuuguauaa

SEQ ID NO: 1458960 - RNA, 15 nt, Human
uguuacuguaauucc

SEQ ID NO: 1458961 - RNA, 23 nt, Human
uguuaccaaaaauaaauauaucu

SEQ ID NO: 1458962 - RNA, 19 nt, Human
uguuaccaaaaauaaauau

SEQ ID NO: 1458963 - RNA, 22 nt, Human
uguuacauuuuuaagugcugca

SEQ ID NO: 1458964 - RNA, 15 nt, Human
uguuacauuauuauc

SEQ ID NO: 1458965 - RNA, 13 nt, Human
uguuacauuuuua

SEQ ID NO: 1458966 - RNA, 15 nt, Human
uguguuuguguauuu

SEQ ID NO: 1458967 - RNA, 19 nt, Human
uguguuugucauuagccug

SEQ ID NO: 1458968 - RNA, 17 nt, Human
uguguuuggcuuucagg

SEQ ID NO: 1458969 - RNA, 14 nt, Human
uguguuugucauua

SEQ ID NO: 1458970 - RNA, 17 nt, Human
uguguuugucauuagcc

SEQ ID NO: 1458971 - RNA, 16 nt, Human
uguguuuggcuuucag

SEQ ID NO: 1458972 - RNA, 15 nt, Human
uguguuuggcuuuca

SEQ ID NO: 1458973 - RNA, 17 nt, Human
uguguuuggaagacuau

SEQ ID NO: 1458974 - RNA, 15 nt, Human
uguguuugcuuucug

SEQ ID NO: 1458975 - RNA, 14 nt, Human
uguguuugcuuucu

SEQ ID NO: 1458976 - RNA, 18 nt, Human
uguuaaacuagcauaucu

SEQ ID NO: 1458977 - RNA, 19 nt, Human
uguuaaacuagcauaucug

SEQ ID NO: 1458978 - RNA, 20 nt, Human
uguuaaacuagcauaucugc

SEQ ID NO: 1458979 - RNA, 22 nt, Human
uguuaaacuagcauaucugccu

SEQ ID NO: 1458980 - RNA, 23 nt, Human
uguuaaacuagcauaucugccuu

SEQ ID NO: 1458981 - RNA, 16 nt, Human
uguucacaccagagaa

SEQ ID NO: 1458982 - RNA, 15 nt, Human
uguucaauauuuucu

SEQ ID NO: 1458983 - RNA, 21 nt, Human
uguucaagcgauucuccugcc

SEQ ID NO: 1458984 - RNA, 16 nt, Human
uguucacaauauauuu

SEQ ID NO: 1458985 - RNA, 23 nt, Human
uguuaguuaccuuauaguuacug

SEQ ID NO: 1458986 - RNA, 20 nt, Human
uguuaguuaccuuauaguua

SEQ ID NO: 1458987 - RNA, 19 nt, Human
uguucaacuaggaucagaa

SEQ ID NO: 1458988 - RNA, 12 nt, Human
uguuauaaucuu

SEQ ID NO: 1458989 - RNA, 20 nt, Human
uguuagauuaagaaauagac

SEQ ID NO: 1458990 - RNA, 17 nt, Human
uguuagauuaagaaaua

SEQ ID NO: 1458991 - RNA, 21 nt, Human
uguguauauauauauauaugu

SEQ ID NO: 1458992 - RNA, 22 nt, Human
uguguauaaacaagaaaaauaa

SEQ ID NO: 1458993 - RNA, 21 nt, Human
uguguauaaacaagaaaaaua

SEQ ID NO: 1458994 - RNA, 14 nt, Human
uguguauaaacaag

SEQ ID NO: 1458995 - RNA, 13 nt, Human
uguguauaaacaa

SEQ ID NO: 1458996 - RNA, 21 nt, Human
uguguauaaaaauaaaaaaga

SEQ ID NO: 1458997 - RNA, 17 nt, Human
uguguaguucauguaaa

SEQ ID NO: 1458998 - RNA, 14 nt, Human
uguguaguucaugu

SEQ ID NO: 1458999 - RNA, 13 nt, Human
uguguauauggac

SEQ ID NO: 1459000 - RNA, 14 nt, Human
uguguauauggaca

SEQ ID NO: 1459001 - RNA, 14 nt, Human
uguguauuccaaga

SEQ ID NO: 1459002 - RNA, 23 nt, Human
ugugucacaaugagauugaauuu

SEQ ID NO: 1459003 - RNA, 15 nt, Human
uguguauuugcuaau

SEQ ID NO: 1459004 - RNA, 13 nt, Human
uguguauuugcua

SEQ ID NO: 1459005 - RNA, 11 nt, Human
uguguauuugc

SEQ ID NO: 1459006 - RNA, 15 nt, Human
uguguauuuacgcuu

SEQ ID NO: 1459007 - RNA, 22 nt, Human
ugugugaaugaacacucuuuug

SEQ ID NO: 1459008 - RNA, 18 nt, Human
ugugugaaugaacacucu

SEQ ID NO: 1459009 - RNA, 17 nt, Human
ugugugaaugaacacuc

SEQ ID NO: 1459010 - RNA, 16 nt, Human
ugugugaaugaacacu

SEQ ID NO: 1459011 - RNA, 12 nt, Human
ugugugaaugaa

SEQ ID NO: 1459012 - RNA, 20 nt, Human
ugugugcccucugggcucug

SEQ ID NO: 1459013 - RNA, 14 nt, Human
ugugugcccucugg

SEQ ID NO: 1459014 - RNA, 19 nt, Human
ugugugcguccugucggag

SEQ ID NO: 1459015 - RNA, 17 nt, Human
ugugugcaucaggcuuu

SEQ ID NO: 1459016 - RNA, 22 nt, Human
ugugugcaucaggcuuucuuuu

SEQ ID NO: 1459017 - RNA, 15 nt, Human
ugugugcaucaggcu

SEQ ID NO: 1459018 - RNA, 19 nt, Human
uguguguccaaaacugccu

SEQ ID NO: 1459019 - RNA, 16 nt, Human
uguguguccaaaacug

SEQ ID NO: 1459020 - RNA, 20 nt, Human
uguguguauuugcuaauuuu

SEQ ID NO: 1459021 - RNA, 14 nt, Human
uguguguauuugcu

SEQ ID NO: 1459022 - RNA, 13 nt, Human
uguguguauuugc

SEQ ID NO: 1459023 - RNA, 12 nt, Human
uguguguaugca

SEQ ID NO: 1459024 - RNA, 20 nt, Human
uguguuuacuuuauguuacu

SEQ ID NO: 1459025 - RNA, 22 nt, Human
uguguguccacgacugucucca

SEQ ID NO: 1459026 - RNA, 22 nt, Human
uguguuuaggaacuacugagga

SEQ ID NO: 1459027 - RNA, 21 nt, Human
uguucuccugcugcucccuca

SEQ ID NO: 1459028 - RNA, 23 nt, Human
uguucucuugggaacugaacuca

SEQ ID NO: 1459029 - RNA, 13 nt, Human
uguucuccugcug

SEQ ID NO: 1459030 - RNA, 11 nt, Human
uguucuccugc

SEQ ID NO: 1459031 - RNA, 15 nt, Human
uguucugauaaugaa

SEQ ID NO: 1459032 - RNA, 14 nt, Human
uguucuuucuggcu

SEQ ID NO: 1459033 - RNA, 17 nt, Human
uguugaaaauguucaga

SEQ ID NO: 1459034 - RNA, 14 nt, Human
uguugaaaauguuc

SEQ ID NO: 1459035 - RNA, 20 nt, Human
uguucuuucuggcuaugcau

SEQ ID NO: 1459036 - RNA, 22 nt, Human
uguucuuucuggcuaugcauuu

SEQ ID NO: 1459037 - RNA, 23 nt, Human
uguugaaagguuuuuuuucaguu

SEQ ID NO: 1459038 - RNA, 24 nt, Human
uguugaaagguaauuugagagaaa

SEQ ID NO: 1459039 - RNA, 22 nt, Human
uguucucagaaucccuuaacag

SEQ ID NO: 1459040 - RNA, 12 nt, Human
uguucucagauu

SEQ ID NO: 1459041 - RNA, 23 nt, Human
uguucucacacuggucugcuguc

SEQ ID NO: 1459042 - RNA, 22 nt, Human
uguucucacacuggucugcugu

SEQ ID NO: 1459043 - RNA, 17 nt, Human
uguucucacacuggucu

SEQ ID NO: 1459044 - RNA, 21 nt, Human
uguucuaguuuuuuacuuuug

SEQ ID NO: 1459045 - RNA, 14 nt, Human
uguucuaguuuuuu

SEQ ID NO: 1459046 - RNA, 12 nt, Human
uguucuauagcu

SEQ ID NO: 1459047 - RNA, 15 nt, Human
uguucaccauuauaa

SEQ ID NO: 1459048 - RNA, 22 nt, Human
uguucaccauuauaaugaauuu

SEQ ID NO: 1459049 - RNA, 13 nt, Human
uguucauaaauaa

SEQ ID NO: 1459050 - RNA, 13 nt, Human
uguucauuuccuc

SEQ ID NO: 1459051 - RNA, 11 nt, Human
uguucauuucc

SEQ ID NO: 1459052 - RNA, 13 nt, Human
uguucauggcaga

SEQ ID NO: 1459053 - RNA, 14 nt, Human
uguucauggcagau

SEQ ID NO: 1459054 - RNA, 14 nt, Human
uguucauuccucca

SEQ ID NO: 1459055 - RNA, 15 nt, Human
uguucauuccuccag

SEQ ID NO: 1459056 - RNA, 16 nt, Human
uguucauuccuccagg

SEQ ID NO: 1459057 - RNA, 21 nt, Human
uguuggagaagaacugaaauc

SEQ ID NO: 1459058 - RNA, 18 nt, Human
uguugagccuuuucccuc

SEQ ID NO: 1459059 - RNA, 16 nt, Human
uguugagccuuuuccc

SEQ ID NO: 1459060 - RNA, 19 nt, Human
uguugauacuguugcacgu

SEQ ID NO: 1459061 - RNA, 23 nt, Human
uguugcugaauaggcgaucacaa

SEQ ID NO: 1459062 - RNA, 17 nt, Human
uguugauacuguugcac

SEQ ID NO: 1459063 - RNA, 16 nt, Human
uguugauacuguugca

SEQ ID NO: 1459064 - RNA, 15 nt, Human
uguugauacuguugc

SEQ ID NO: 1459065 - RNA, 14 nt, Human
uguugauacuguug

SEQ ID NO: 1459066 - RNA, 20 nt, Human
uguugagcaucacagaaugu

SEQ ID NO: 1459067 - RNA, 17 nt, Human
uguugagcaucacagaa

SEQ ID NO: 1459068 - RNA, 16 nt, Human
uguugagcaucacaga

SEQ ID NO: 1459069 - RNA, 15 nt, Human
uguugagagugugac

SEQ ID NO: 1459070 - RNA, 17 nt, Human
uguugaagccacugccu

SEQ ID NO: 1459071 - RNA, 13 nt, Human
uguugagacagag

SEQ ID NO: 1459072 - RNA, 19 nt, Human
uguugaagagguuuuaaag

SEQ ID NO: 1459073 - RNA, 18 nt, Human
uguuuaaaacuucaguuu

SEQ ID NO: 1459074 - RNA, 12 nt, Human
uguuuaaaacuu

SEQ ID NO: 1459075 - RNA, 18 nt, Human
uguuuacacucuuuguaa

SEQ ID NO: 1459076 - RNA, 16 nt, Human
uguuuacacucuuugu

SEQ ID NO: 1459077 - RNA, 19 nt, Human
uguuuacaaaaucagguaa

SEQ ID NO: 1459078 - RNA, 21 nt, Human
uguuuacaaaaauuucuguaa

SEQ ID NO: 1459079 - RNA, 21 nt, Human
uguuuaauuuuuauuucuucc

SEQ ID NO: 1459080 - RNA, 19 nt, Human
uguuuaauuuuuauuucuu

SEQ ID NO: 1459081 - RNA, 18 nt, Human
uguuuaauuuuuauuucu

SEQ ID NO: 1459082 - RNA, 19 nt, Human
uguuuacacucuuuguaag

SEQ ID NO: 1459083 - RNA, 17 nt, Human
uguuguuucuuaaauaa

SEQ ID NO: 1459084 - RNA, 21 nt, Human
uguuguuucuuaaauaagaaa

SEQ ID NO: 1459085 - RNA, 16 nt, Human
uguuguuucuuaaaua

SEQ ID NO: 1459086 - RNA, 15 nt, Human
uguuguuucuuaaau

SEQ ID NO: 1459087 - RNA, 19 nt, Human
uguuguugaaagguuuuuu

SEQ ID NO: 1459088 - RNA, 16 nt, Human
uguuuaaaacaucauu

SEQ ID NO: 1459089 - RNA, 15 nt, Human
uguuuaaaacaucau

SEQ ID NO: 1459090 - RNA, 12 nt, Human
uguuuaaaacau

SEQ ID NO: 1459091 - RNA, 18 nt, Human
uguuuaaaaaaccacaug

SEQ ID NO: 1459092 - RNA, 16 nt, Human
ugugggggacuguaag

SEQ ID NO: 1459093 - RNA, 15 nt, Human
ugugggggacuguaa

SEQ ID NO: 1459094 - RNA, 14 nt, Human
uguggggccuggga

SEQ ID NO: 1459095 - RNA, 16 nt, Human
uguggggccugggagg

SEQ ID NO: 1459096 - RNA, 15 nt, Human
uguggggccagguca

SEQ ID NO: 1459097 - RNA, 16 nt, Human
uguggggauuuucacu

SEQ ID NO: 1459098 - RNA, 22 nt, Human
ugugggggguaaucccugcuuu

SEQ ID NO: 1459099 - RNA, 19 nt, Human
ugugggggguaaucccugc

SEQ ID NO: 1459100 - RNA, 17 nt, Human
uguggcuuucagagccu

SEQ ID NO: 1459101 - RNA, 15 nt, Human
uguggcuccuuccca

SEQ ID NO: 1459102 - RNA, 14 nt, Human
uguggcuccuuccc

SEQ ID NO: 1459103 - RNA, 17 nt, Human
ugugggacuagccuggc

SEQ ID NO: 1459104 - RNA, 16 nt, Human
uguggaaaagauggca

SEQ ID NO: 1459105 - RNA, 16 nt, Human
ugugcuuuuuuugugu

SEQ ID NO: 1459106 - RNA, 17 nt, Human
ugugcuuuuuuugugug

SEQ ID NO: 1459107 - RNA, 23 nt, Human
uguggacucuggugccuccagag

SEQ ID NO: 1459108 - RNA, 22 nt, Human
uguggacucuggugccuccaga

SEQ ID NO: 1459109 - RNA, 12 nt, Human
uguggacucugg

SEQ ID NO: 1459110 - RNA, 21 nt, Human
uguggacuaaaagauauaagu

SEQ ID NO: 1459111 - RNA, 19 nt, Human
ugugcaguacuuugugcau

SEQ ID NO: 1459112 - RNA, 17 nt, Human
ugugcaggagcggcaga

SEQ ID NO: 1459113 - RNA, 14 nt, Human
ugugcagguuccca

SEQ ID NO: 1459114 - RNA, 23 nt, Human
ugugcagguggggagacugggcu

SEQ ID NO: 1459115 - RNA, 16 nt, Human
ugugcagguggggaga

SEQ ID NO: 1459116 - RNA, 18 nt, Human
ugugcaggagcggcagau

SEQ ID NO: 1459117 - RNA, 19 nt, Human
ugugcagccgcugagcgag

SEQ ID NO: 1459118 - RNA, 20 nt, Human
ugugcacguaaaguacuugu

SEQ ID NO: 1459119 - RNA, 22 nt, Human
ugugcacguaaaguacuuguag

SEQ ID NO: 1459120 - RNA, 20 nt, Human
ugugcaauguguauaaacaa

SEQ ID NO: 1459121 - RNA, 14 nt, Human
ugugcaccaggguu

SEQ ID NO: 1459122 - RNA, 13 nt, Human
ugugcaccagggu

SEQ ID NO: 1459123 - RNA, 22 nt, Human
ugugcaauguguauaaacaaga

SEQ ID NO: 1459124 - RNA, 16 nt, Human
ugugcaauguguauaa

SEQ ID NO: 1459125 - RNA, 15 nt, Human
ugugcaauguguaua

SEQ ID NO: 1459126 - RNA, 13 nt, Human
ugugcaucaggcu

SEQ ID NO: 1459127 - RNA, 12 nt, Human
ugugcaguguug

SEQ ID NO: 1459128 - RNA, 22 nt, Human
ugugcgugguggucccugggua

SEQ ID NO: 1459129 - RNA, 21 nt, Human
ugugcgugguggucccugggu

SEQ ID NO: 1459130 - RNA, 19 nt, Human
ugugcgugguggucccugg

SEQ ID NO: 1459131 - RNA, 16 nt, Human
ugugcguggugguccc

SEQ ID NO: 1459132 - RNA, 22 nt, Human
ugugcuacaauucauuguguua

SEQ ID NO: 1459133 - RNA, 16 nt, Human
ugugcuuuuaaaugca

SEQ ID NO: 1459134 - RNA, 14 nt, Human
ugugcuucuuucuu

SEQ ID NO: 1459135 - RNA, 21 nt, Human
ugugcuucuuucuuugggaau

SEQ ID NO: 1459136 - RNA, 19 nt, Human
ugugcuucgggcccuuccc

SEQ ID NO: 1459137 - RNA, 19 nt, Human
ugugcuuaugguaccagau

SEQ ID NO: 1459138 - RNA, 15 nt, Human
ugugccugacccuac

SEQ ID NO: 1459139 - RNA, 17 nt, Human
ugugcggcugugugugc

SEQ ID NO: 1459140 - RNA, 14 nt, Human
ugugcguccugucg

SEQ ID NO: 1459141 - RNA, 15 nt, Human
ugugcggcugugugu

SEQ ID NO: 1459142 - RNA, 19 nt, Human
ugucugccaaccuaaaacu

SEQ ID NO: 1459143 - RNA, 15 nt, Human
ugucugccaaccuaa

SEQ ID NO: 1459144 - RNA, 16 nt, Human
ugucucaaugcucaua

SEQ ID NO: 1459145 - RNA, 17 nt, Human
ugucucaaugcucauaa

SEQ ID NO: 1459146 - RNA, 19 nt, Human
ugucucaaugcucauaacg

SEQ ID NO: 1459147 - RNA, 22 nt, Human
ugucucaaugcucauaacggau

SEQ ID NO: 1459148 - RNA, 19 nt, Human
ugucucaagcucuuccuua

SEQ ID NO: 1459149 - RNA, 14 nt, Human
ugucucaaugcuca

SEQ ID NO: 1459150 - RNA, 15 nt, Human
ugucucaaugcucau

SEQ ID NO: 1459151 - RNA, 20 nt, Human
uguccccaacagcgcccaaa

SEQ ID NO: 1459152 - RNA, 14 nt, Human
uguccccaacagcg

SEQ ID NO: 1459153 - RNA, 13 nt, Human
uguccccaacagc

SEQ ID NO: 1459154 - RNA, 16 nt, Human
ugucugguggccccgu

SEQ ID NO: 1459155 - RNA, 14 nt, Human
ugucugguggcccc

SEQ ID NO: 1459156 - RNA, 13 nt, Human
ugucugguggccc

SEQ ID NO: 1459157 - RNA, 21 nt, Human
ugucugggugcuacuggggaa

SEQ ID NO: 1459158 - RNA, 16 nt, Human
ugucugggugcuacug

SEQ ID NO: 1459159 - RNA, 15 nt, Human
ugucugggugcuacu

SEQ ID NO: 1459160 - RNA, 14 nt, Human
ugucuggggcagaa

SEQ ID NO: 1459161 - RNA, 21 nt, Human
ugucuggggagcgggucugcu

SEQ ID NO: 1459162 - RNA, 22 nt, Human
ugucugguucucaauuccaaca

SEQ ID NO: 1459163 - RNA, 14 nt, Human
ugucuuuuuucuaa

SEQ ID NO: 1459164 - RNA, 15 nt, Human
ugugaaacuuucauu

SEQ ID NO: 1459165 - RNA, 14 nt, Human
ugugaaacuuucau

SEQ ID NO: 1459166 - RNA, 22 nt, Human
ugucuuuuuuuguauaguuaac

SEQ ID NO: 1459167 - RNA, 23 nt, Human
ugucuuuuuuuguauaguuaaca

SEQ ID NO: 1459168 - RNA, 16 nt, Human
ugucuuuuuuuguaua

SEQ ID NO: 1459169 - RNA, 14 nt, Human
ugucuuuuuuugua

SEQ ID NO: 1459170 - RNA, 14 nt, Human
ugucugguucucaa

SEQ ID NO: 1459171 - RNA, 13 nt, Human
ugucugguucuca

SEQ ID NO: 1459172 - RNA, 20 nt, Human
ugucugggugcuacugggga

SEQ ID NO: 1459173 - RNA, 21 nt, Human
ugucuggugguggcaccaucu

SEQ ID NO: 1459174 - RNA, 13 nt, Human
ugugaaacauguu

SEQ ID NO: 1459175 - RNA, 21 nt, Human
ugugacauacccccuccccca

SEQ ID NO: 1459176 - RNA, 16 nt, Human
ugugacauacccccuc

SEQ ID NO: 1459177 - RNA, 12 nt, Human
ugugacagggcg

SEQ ID NO: 1459178 - RNA, 21 nt, Human
ugugacaaaaaauuaaagcau

SEQ ID NO: 1459179 - RNA, 16 nt, Human
ugugacaaaaaauuaa

SEQ ID NO: 1459180 - RNA, 15 nt, Human
ugugacaaaaaauua

SEQ ID NO: 1459181 - RNA, 12 nt, Human
ugugacaaaaaa

SEQ ID NO: 1459182 - RNA, 15 nt, Human
ugugaccacaacaug

SEQ ID NO: 1459183 - RNA, 17 nt, Human
ugugaaugccacugccu

SEQ ID NO: 1459184 - RNA, 17 nt, Human
ugugaaugaacacucuu

SEQ ID NO: 1459185 - RNA, 23 nt, Human
ugugaaugaacacucuuuugcuu

SEQ ID NO: 1459186 - RNA, 14 nt, Human
ugugaaugaacacu

SEQ ID NO: 1459187 - RNA, 22 nt, Human
ugugaauagaacucugaaauga

SEQ ID NO: 1459188 - RNA, 21 nt, Human
ugugaauaccugcucacguca

SEQ ID NO: 1459189 - RNA, 22 nt, Human
ugugaaucaagggucaggccuu

SEQ ID NO: 1459190 - RNA, 21 nt, Human
ugugaaucaagggucaggccu

SEQ ID NO: 1459191 - RNA, 17 nt, Human
ugugaaucaagggucag

SEQ ID NO: 1459192 - RNA, 16 nt, Human
ugugaaucaaggguca

SEQ ID NO: 1459193 - RNA, 16 nt, Human
ugugaaucauuuuacc

SEQ ID NO: 1459194 - RNA, 17 nt, Human
ugugacccccagcuccg

SEQ ID NO: 1459195 - RNA, 20 nt, Human
ugugacccccagcuccggcc

SEQ ID NO: 1459196 - RNA, 16 nt, Human
ugugacccccagcucc

SEQ ID NO: 1459197 - RNA, 15 nt, Human
ugugacccccagcuc

SEQ ID NO: 1459198 - RNA, 13 nt, Human
ugugauaaggaaa

SEQ ID NO: 1459199 - RNA, 21 nt, Human
ugugauacaaugcugugcccu

SEQ ID NO: 1459200 - RNA, 21 nt, Human
ugugagucaauacauagugcu

SEQ ID NO: 1459201 - RNA, 23 nt, Human
ugugaguuuaccuuguauacugu

SEQ ID NO: 1459202 - RNA, 16 nt, Human
ugugagucaauacaua

SEQ ID NO: 1459203 - RNA, 22 nt, Human
ugugaguuuaccuuguauacug

SEQ ID NO: 1459204 - RNA, 14 nt, Human
ugugcaauguguau

SEQ ID NO: 1459205 - RNA, 11 nt, Human
ugugcaaugug

SEQ ID NO: 1459206 - RNA, 18 nt, Human
ugugcaauguaaauauuu

SEQ ID NO: 1459207 - RNA, 17 nt, Human
ugugcaauguaaauauu

SEQ ID NO: 1459208 - RNA, 16 nt, Human
ugugcaauagaaggug

SEQ ID NO: 1459209 - RNA, 13 nt, Human
ugugcaauagaag

SEQ ID NO: 1459210 - RNA, 21 nt, Human
ugugcaaggcagccgugggcc

SEQ ID NO: 1459211 - RNA, 18 nt, Human
ugugcaagguauuacacu

SEQ ID NO: 1459212 - RNA, 19 nt, Human
ugugcaaggcagccguggg

SEQ ID NO: 1459213 - RNA, 17 nt, Human
ugugcaaggcagccgug

SEQ ID NO: 1459214 - RNA, 15 nt, Human
ugugcaaggcagccg

SEQ ID NO: 1459215 - RNA, 13 nt, Human
ugugauauaagug

SEQ ID NO: 1459216 - RNA, 22 nt, Human
uguccaugcgcucagggccaug

SEQ ID NO: 1459217 - RNA, 20 nt, Human
ugucauuguuauauaaucau

SEQ ID NO: 1459218 - RNA, 14 nt, Human
ugucauuguuauau

SEQ ID NO: 1459219 - RNA, 12 nt, Human
ugucauuguuau

SEQ ID NO: 1459220 - RNA, 16 nt, Human
ugucauugaaaaacua

SEQ ID NO: 1459221 - RNA, 23 nt, Human
ugucauucgcuacuaugauuuaa

SEQ ID NO: 1459222 - RNA, 13 nt, Human
ugucauuagccug

SEQ ID NO: 1459223 - RNA, 14 nt, Human
ugucauuagccuga

SEQ ID NO: 1459224 - RNA, 17 nt, Human
ugucauuagccugagua

SEQ ID NO: 1459225 - RNA, 20 nt, Human
ugucauuagccugaguagaa

SEQ ID NO: 1459226 - RNA, 21 nt, Human
ugucauuagccugaguagaaa

SEQ ID NO: 1459227 - RNA, 23 nt, Human
ugucauuaaauggggcucacaaa

SEQ ID NO: 1459228 - RNA, 15 nt, Human
ugucaucaauuaaag

SEQ ID NO: 1459229 - RNA, 14 nt, Human
ugucaucaauuaaa

SEQ ID NO: 1459230 - RNA, 16 nt, Human
ugucauagaaauuaca

SEQ ID NO: 1459231 - RNA, 15 nt, Human
ugucauagaaauuac

SEQ ID NO: 1459232 - RNA, 18 nt, Human
ugucccaugaucccugug

SEQ ID NO: 1459233 - RNA, 17 nt, Human
ugucccaugaucccugu

SEQ ID NO: 1459234 - RNA, 16 nt, Human
ugucccaugaucccug

SEQ ID NO: 1459235 - RNA, 21 nt, Human
ugucccaucggagugcggacc

SEQ ID NO: 1459236 - RNA, 17 nt, Human
ugucccagguccucacu

SEQ ID NO: 1459237 - RNA, 16 nt, Human
ugucccagguccucac

SEQ ID NO: 1459238 - RNA, 14 nt, Human
ugucccagguccuc

SEQ ID NO: 1459239 - RNA, 21 nt, Human
ugucccagaagaugacugagg

SEQ ID NO: 1459240 - RNA, 16 nt, Human
ugucccagaagaugac

SEQ ID NO: 1459241 - RNA, 14 nt, Human
ugucccagaagaug

SEQ ID NO: 1459242 - RNA, 17 nt, Human
uguccauuguccaaucc

SEQ ID NO: 1459243 - RNA, 14 nt, Human
uguccauuguccaa

SEQ ID NO: 1459244 - RNA, 15 nt, Human
ugucagucacagcca

SEQ ID NO: 1459245 - RNA, 14 nt, Human
ugucagucacagcc

SEQ ID NO: 1459246 - RNA, 17 nt, Human
ugucacugacacacacg

SEQ ID NO: 1459247 - RNA, 22 nt, Human
ugucacucaaggcggugcuuga

SEQ ID NO: 1459248 - RNA, 20 nt, Human
ugucacucaaggcggugcuu

SEQ ID NO: 1459249 - RNA, 17 nt, Human
ugucacucaaggcggug

SEQ ID NO: 1459250 - RNA, 14 nt, Human
ugucacucaaggcg

SEQ ID NO: 1459251 - RNA, 14 nt, Human
ugucacuaaagcag

SEQ ID NO: 1459252 - RNA, 15 nt, Human
ugucacuaaagcagg

SEQ ID NO: 1459253 - RNA, 17 nt, Human
uguauuugcuaauuuuu

SEQ ID NO: 1459254 - RNA, 21 nt, Human
uguauuuggaaauaaagucag

SEQ ID NO: 1459255 - RNA, 13 nt, Human
uguauuuggaaau

SEQ ID NO: 1459256 - RNA, 12 nt, Human
uguauuuggaaa

SEQ ID NO: 1459257 - RNA, 14 nt, Human
uguauuugcuuuuu

SEQ ID NO: 1459258 - RNA, 13 nt, Human
uguauuugcuaau

SEQ ID NO: 1459259 - RNA, 12 nt, Human
uguauuugcuaa

SEQ ID NO: 1459260 - RNA, 16 nt, Human
ugucauacagagaagu

SEQ ID NO: 1459261 - RNA, 18 nt, Human
ugucauacagagaaguca

SEQ ID NO: 1459262 - RNA, 15 nt, Human
ugucauacagagaag

SEQ ID NO: 1459263 - RNA, 14 nt, Human
ugucauacagagaa

SEQ ID NO: 1459264 - RNA, 13 nt, Human
ugucauacagaga

SEQ ID NO: 1459265 - RNA, 12 nt, Human
ugucauacagag

SEQ ID NO: 1459266 - RNA, 22 nt, Human
ugucagucacagccaccccuga

SEQ ID NO: 1459267 - RNA, 18 nt, Human
ugucagucacagccaccc

SEQ ID NO: 1459268 - RNA, 17 nt, Human
ugucagucacagccacc

SEQ ID NO: 1459269 - RNA, 16 nt, Human
ugucagucacagccac

SEQ ID NO: 1459270 - RNA, 21 nt, Human
uguauaauuggauuuccuaau

SEQ ID NO: 1459271 - RNA, 19 nt, Human
uguauaauuggauuuccua

SEQ ID NO: 1459272 - RNA, 18 nt, Human
uguauaauuggauuuccu

SEQ ID NO: 1459273 - RNA, 14 nt, Human
uguauaauuggauu

SEQ ID NO: 1459274 - RNA, 19 nt, Human
uguagcacuuacugguagg

SEQ ID NO: 1459275 - RNA, 15 nt, Human
uguagcacuuacugg

SEQ ID NO: 1459276 - RNA, 20 nt, Human
uguagcaacuacagucuaaa

SEQ ID NO: 1459277 - RNA, 16 nt, Human
uguauccccugcaggc

SEQ ID NO: 1459278 - RNA, 14 nt, Human
uguauccccugcag

SEQ ID NO: 1459279 - RNA, 19 nt, Human
uguauacuauaguaccagu

SEQ ID NO: 1459280 - RNA, 15 nt, Human
uguauacuauaguac

SEQ ID NO: 1459281 - RNA, 17 nt, Human
uguauacuauaguacca

SEQ ID NO: 1459282 - RNA, 14 nt, Human
uguauacuauagua

SEQ ID NO: 1459283 - RNA, 19 nt, Human
uguaucuaugcauuuucug

SEQ ID NO: 1459284 - RNA, 15 nt, Human
uguaugcauguuguc

SEQ ID NO: 1459285 - RNA, 21 nt, Human
uguaugcacaugaacuuagau

SEQ ID NO: 1459286 - RNA, 18 nt, Human
uguaucuaugcauuuucu

SEQ ID NO: 1459287 - RNA, 18 nt, Human
uguaugcacaugaacuua

SEQ ID NO: 1459288 - RNA, 17 nt, Human
uguaugcacaugaacuu

SEQ ID NO: 1459289 - RNA, 16 nt, Human
uguaugcacaguaaaa

SEQ ID NO: 1459290 - RNA, 17 nt, Human
uguauuugaaauaagaa

SEQ ID NO: 1459291 - RNA, 21 nt, Human
uguauuuauaaauauauuuaa

SEQ ID NO: 1459292 - RNA, 14 nt, Human
uguauuuauaaaua

SEQ ID NO: 1459293 - RNA, 23 nt, Human
uguauuuacgcuuugauucauag

SEQ ID NO: 1459294 - RNA, 21 nt, Human
uguauuuacgcuuugauucau

SEQ ID NO: 1459295 - RNA, 20 nt, Human
uguauuuacgcuuugauuca

SEQ ID NO: 1459296 - RNA, 21 nt, Human
uguauuuaacagaaauuguau

SEQ ID NO: 1459297 - RNA, 16 nt, Human
uguauuuaacagaaau

SEQ ID NO: 1459298 - RNA, 15 nt, Human
uguauuuaacagaaa

SEQ ID NO: 1459299 - RNA, 14 nt, Human
uguauuuaacagaa

SEQ ID NO: 1459300 - RNA, 19 nt, Human
uguauugcacauuguaaaa

SEQ ID NO: 1459301 - RNA, 15 nt, Human
uguauugcacauugu

SEQ ID NO: 1459302 - RNA, 14 nt, Human
uguauugcacauug

SEQ ID NO: 1459303 - RNA, 13 nt, Human
uguaugcauguug

SEQ ID NO: 1459304 - RNA, 16 nt, Human
uguauuguauauuaca

SEQ ID NO: 1459305 - RNA, 18 nt, Human
uguauuguauauuacaau

SEQ ID NO: 1459306 - RNA, 18 nt, Human
uguaacugcccaaagcag

SEQ ID NO: 1459307 - RNA, 16 nt, Human
uguaacugccuagaaa

SEQ ID NO: 1459308 - RNA, 13 nt, Human
uguaacugcccaa

SEQ ID NO: 1459309 - RNA, 11 nt, Human
uguaacugccc

SEQ ID NO: 1459310 - RNA, 18 nt, Human
uguaacugccaggcucuc

SEQ ID NO: 1459311 - RNA, 15 nt, Human
uguaacugccaggcu

SEQ ID NO: 1459312 - RNA, 13 nt, Human
uguaacugccagg

SEQ ID NO: 1459313 - RNA, 17 nt, Human
uguaaucauauaauaaa

SEQ ID NO: 1459314 - RNA, 18 nt, Human
uguaacuacuuuauaacu

SEQ ID NO: 1459315 - RNA, 17 nt, Human
uguaacuacuuuauaac

SEQ ID NO: 1459316 - RNA, 16 nt, Human
uguaacuacuuuauaa

SEQ ID NO: 1459317 - RNA, 23 nt, Human
uguaacuaaaauaauuuuguaau

SEQ ID NO: 1459318 - RNA, 15 nt, Human
uguaacuaaaauaau

SEQ ID NO: 1459319 - RNA, 14 nt, Human
uguaacuaaaauaa

SEQ ID NO: 1459320 - RNA, 19 nt, Human
uguaacgcaaguucccagu

SEQ ID NO: 1459321 - RNA, 23 nt, Human
uguaacgcaaguucccaguugga

SEQ ID NO: 1459322 - RNA, 13 nt, Human
uguaaauuaugua

SEQ ID NO: 1459323 - RNA, 12 nt, Human
uguaaauuaugu

SEQ ID NO: 1459324 - RNA, 14 nt, Human
uguaaauuaucagg

SEQ ID NO: 1459325 - RNA, 11 nt, Human
uguaaauuggc

SEQ ID NO: 1459326 - RNA, 19 nt, Human
uguaaccucuucagaggcc

SEQ ID NO: 1459327 - RNA, 12 nt, Human
uguaaauuggca

SEQ ID NO: 1459328 - RNA, 13 nt, Human
uguaaaucugcca

SEQ ID NO: 1459329 - RNA, 11 nt, Human
uguaaacacag

SEQ ID NO: 1459330 - RNA, 21 nt, Human
uguaaacaaacuguguaacug

SEQ ID NO: 1459331 - RNA, 19 nt, Human
ugguagggugggagugguu

SEQ ID NO: 1459332 - RNA, 13 nt, Human
ugguaggguggga

SEQ ID NO: 1459333 - RNA, 16 nt, Human
ugguaggcauuuccua

SEQ ID NO: 1459334 - RNA, 16 nt, Human
uguaaaucugccacaa

SEQ ID NO: 1459335 - RNA, 15 nt, Human
uguaaaucugccaca

SEQ ID NO: 1459336 - RNA, 14 nt, Human
uguaaaucugccac

SEQ ID NO: 1459337 - RNA, 13 nt, Human
uguaaauuaacuu

SEQ ID NO: 1459338 - RNA, 14 nt, Human
uguaaauuaacuuu

SEQ ID NO: 1459339 - RNA, 15 nt, Human
uguaaauuaacuuuu

SEQ ID NO: 1459340 - RNA, 16 nt, Human
uguaaauuaacuuuua

SEQ ID NO: 1459341 - RNA, 17 nt, Human
uguaaauuaacuuuuau

SEQ ID NO: 1459342 - RNA, 18 nt, Human
uguacaguauguucaaag

SEQ ID NO: 1459343 - RNA, 20 nt, Human
uguacaguagauuuuccaaa

SEQ ID NO: 1459344 - RNA, 18 nt, Human
uguacaguagauuuucca

SEQ ID NO: 1459345 - RNA, 17 nt, Human
uguacaguagauuuucc

SEQ ID NO: 1459346 - RNA, 14 nt, Human
uguacaguagauuu

SEQ ID NO: 1459347 - RNA, 23 nt, Human
uguaauguaucaaauacauuuaa

SEQ ID NO: 1459348 - RNA, 19 nt, Human
uguaaugguacugacuuug

SEQ ID NO: 1459349 - RNA, 21 nt, Human
uguaaugguacugacuuugcu

SEQ ID NO: 1459350 - RNA, 23 nt, Human
uguaauggcaguuauauuuugca

SEQ ID NO: 1459351 - RNA, 17 nt, Human
uguaauggcaguuauau

SEQ ID NO: 1459352 - RNA, 12 nt, Human
uguaaugacagg

SEQ ID NO: 1459353 - RNA, 12 nt, Human
uguacccaguuu

SEQ ID NO: 1459354 - RNA, 14 nt, Human
uguacccaguuucu

SEQ ID NO: 1459355 - RNA, 21 nt, Human
uguacccaccgggccacuccu

SEQ ID NO: 1459356 - RNA, 20 nt, Human
uguacccaccgggccacucc

SEQ ID NO: 1459357 - RNA, 16 nt, Human
uguacccaccgggcca

SEQ ID NO: 1459358 - RNA, 12 nt, Human
uguacccaccgg

SEQ ID NO: 1459359 - RNA, 18 nt, Human
uguaccauuuuaaaguua

SEQ ID NO: 1459360 - RNA, 14 nt, Human
uguaccauuugccu

SEQ ID NO: 1459361 - RNA, 18 nt, Human
uguaccugcccccaaucc

SEQ ID NO: 1459362 - RNA, 17 nt, Human
uguacccucugaaauac

SEQ ID NO: 1459363 - RNA, 23 nt, Human
uguaccucuugagccuugaacuu

SEQ ID NO: 1459364 - RNA, 22 nt, Human
uguaccucuugagccuugaacu

SEQ ID NO: 1459365 - RNA, 14 nt, Human
uguaccucuugagc

SEQ ID NO: 1459366 - RNA, 20 nt, Human
uguacuaaagccaaacauau

SEQ ID NO: 1459367 - RNA, 18 nt, Human
uguacuaaagccaaacau

SEQ ID NO: 1459368 - RNA, 16 nt, Human
uguacuaaagccaaac

SEQ ID NO: 1459369 - RNA, 15 nt, Human
uguacuaaagccaaa

SEQ ID NO: 1459370 - RNA, 14 nt, Human
uguacuauuuaacu

SEQ ID NO: 1459371 - RNA, 16 nt, Human
uguacuaacuagcauu

SEQ ID NO: 1459372 - RNA, 18 nt, Human
uguacuauuuaacugacu

SEQ ID NO: 1459373 - RNA, 15 nt, Human
uguacuauuuaacug

SEQ ID NO: 1459374 - RNA, 12 nt, Human
uguacugaaaaa

SEQ ID NO: 1459375 - RNA, 20 nt, Human
uguacugaaaaaugguaauu

SEQ ID NO: 1459376 - RNA, 17 nt, Human
uguacugagccuuguaa

SEQ ID NO: 1459377 - RNA, 20 nt, Human
uguacugagccuuguaauuc

SEQ ID NO: 1459378 - RNA, 19 nt, Human
uguacugagccuuguaauu

SEQ ID NO: 1459379 - RNA, 22 nt, Human
uguacugagccuuguaauucua

SEQ ID NO: 1459380 - RNA, 14 nt, Human
uguagauaaguguu

SEQ ID NO: 1459381 - RNA, 13 nt, Human
uguagauaagugu

SEQ ID NO: 1459382 - RNA, 20 nt, Human
uguagaguugcugagagggc

SEQ ID NO: 1459383 - RNA, 15 nt, Human
uguagaguugcugag

SEQ ID NO: 1459384 - RNA, 14 nt, Human
uguagaguugcuga

SEQ ID NO: 1459385 - RNA, 13 nt, Human
uguagaguugcug

SEQ ID NO: 1459386 - RNA, 17 nt, Human
uguagauaauacaguuc

SEQ ID NO: 1459387 - RNA, 14 nt, Human
uuguacauaaugcg

SEQ ID NO: 1459388 - RNA, 14 nt, Human
uuguauccccugca

SEQ ID NO: 1459389 - RNA, 15 nt, Human
uuguauccccugcag

SEQ ID NO: 1459390 - RNA, 19 nt, Human
uuguagauugauuguauug

SEQ ID NO: 1459391 - RNA, 15 nt, Human
uuguagauugauugu

SEQ ID NO: 1459392 - RNA, 22 nt, Human
uuguauucaaaaauuaucuaua

SEQ ID NO: 1459393 - RNA, 17 nt, Human
uuguauuagauguucuc

SEQ ID NO: 1459394 - RNA, 15 nt, Human
uuguauuagauguuc

SEQ ID NO: 1459395 - RNA, 16 nt, Human
uuguauuagauguucu

SEQ ID NO: 1459396 - RNA, 13 nt, Human
uuguauuagaugu

SEQ ID NO: 1459397 - RNA, 14 nt, Human
uuguauucagaguu

SEQ ID NO: 1459398 - RNA, 21 nt, Human
uuguauucagaguugaugguu

SEQ ID NO: 1459399 - RNA, 14 nt, Human
uuguaaauauugug

SEQ ID NO: 1459400 - RNA, 13 nt, Human
uuguaaauauugu

SEQ ID NO: 1459401 - RNA, 17 nt, Human
uuguaaaguauguauua

SEQ ID NO: 1459402 - RNA, 16 nt, Human
uuguaaaggaauuuaa

SEQ ID NO: 1459403 - RNA, 17 nt, Human
uuggcaucccugggccu

SEQ ID NO: 1459404 - RNA, 13 nt, Human
uuggcaucccugg

SEQ ID NO: 1459405 - RNA, 22 nt, Human
uuggcauggaaauuuaaagcag

SEQ ID NO: 1459406 - RNA, 21 nt, Human
uuggcauggaaauuuaaagca

SEQ ID NO: 1459407 - RNA, 20 nt, Human
uuggcauggaaauuuaaagc

SEQ ID NO: 1459408 - RNA, 16 nt, Human
uuggcauggaaauuua

SEQ ID NO: 1459409 - RNA, 15 nt, Human
uuggcaucccugggc

SEQ ID NO: 1459410 - RNA, 17 nt, Human
uuggccaaggaaaggca

SEQ ID NO: 1459411 - RNA, 22 nt, Human
uuggccacuccgagaggugggc

SEQ ID NO: 1459412 - RNA, 21 nt, Human
uuggccacuccgagagguggg

SEQ ID NO: 1459413 - RNA, 14 nt, Human
uuggccacuccgag

SEQ ID NO: 1459414 - RNA, 23 nt, Human
uuggccaaugcaccuaaagaaaa

SEQ ID NO: 1459415 - RNA, 22 nt, Human
uuggccaaugcaccuaaagaaa

SEQ ID NO: 1459416 - RNA, 22 nt, Human
uuggcuggugugguacagagaa

SEQ ID NO: 1459417 - RNA, 23 nt, Human
uuggcuggugugguacagagaag

SEQ ID NO: 1459418 - RNA, 21 nt, Human
uuggcuggugugguacagaga

SEQ ID NO: 1459419 - RNA, 20 nt, Human
uuggcuggugugguacagag

SEQ ID NO: 1459420 - RNA, 18 nt, Human
uuggccauauuuaccuca

SEQ ID NO: 1459421 - RNA, 15 nt, Human
uuggccacagccagg

SEQ ID NO: 1459422 - RNA, 19 nt, Human
uuggccauauuuaccucag

SEQ ID NO: 1459423 - RNA, 15 nt, Human
uuggcuggacccagc

SEQ ID NO: 1459424 - RNA, 17 nt, Human
uuggcuggacccagcca

SEQ ID NO: 1459425 - RNA, 12 nt, Human
uuggcuggaccc

SEQ ID NO: 1459426 - RNA, 18 nt, Human
uugggaacugaacucacu

SEQ ID NO: 1459427 - RNA, 14 nt, Human
uuggcuuaccuggc

SEQ ID NO: 1459428 - RNA, 16 nt, Human
uugggaaacuuggcuc

SEQ ID NO: 1459429 - RNA, 15 nt, Human
uuggguuuuuuuccu

SEQ ID NO: 1459430 - RNA, 12 nt, Human
uugguaaaccuu

SEQ ID NO: 1459431 - RNA, 19 nt, Human
uugguaaagacuggcuuuu

SEQ ID NO: 1459432 - RNA, 16 nt, Human
uugguaaagacuggcu

SEQ ID NO: 1459433 - RNA, 14 nt, Human
uugguaaaccuuuu

SEQ ID NO: 1459434 - RNA, 14 nt, Human
uugcgguucaggaa

SEQ ID NO: 1459435 - RNA, 14 nt, Human
uugcggcuccucag

SEQ ID NO: 1459436 - RNA, 15 nt, Human
uugccugguacagua

SEQ ID NO: 1459437 - RNA, 14 nt, Human
uugccugguacagu

SEQ ID NO: 1459438 - RNA, 13 nt, Human
uugccugguacag

SEQ ID NO: 1459439 - RNA, 12 nt, Human
uugccugguaca

SEQ ID NO: 1459440 - RNA, 16 nt, Human
uugccugccuuuccau

SEQ ID NO: 1459441 - RNA, 23 nt, Human
uugccugccuuuccauccauggc

SEQ ID NO: 1459442 - RNA, 15 nt, Human
uugccugccuuucca

SEQ ID NO: 1459443 - RNA, 14 nt, Human
uugccugccuuucc

SEQ ID NO: 1459444 - RNA, 12 nt, Human
uugccugccuuu

SEQ ID NO: 1459445 - RNA, 12 nt, Human
uugccugcaggc

SEQ ID NO: 1459446 - RNA, 19 nt, Human
uugccugaacuccugccau

SEQ ID NO: 1459447 - RNA, 19 nt, Human
uugccucuuccagucuucc

SEQ ID NO: 1459448 - RNA, 17 nt, Human
uugccucuuccagucuu

SEQ ID NO: 1459449 - RNA, 19 nt, Human
uugccucugugcugugugu

SEQ ID NO: 1459450 - RNA, 14 nt, Human
uugccucugugcug

SEQ ID NO: 1459451 - RNA, 15 nt, Human
uugcugcauggcagg

SEQ ID NO: 1459452 - RNA, 16 nt, Human
uugcugcauggcaggg

SEQ ID NO: 1459453 - RNA, 20 nt, Human
uugcugcaagcacagcccuu

SEQ ID NO: 1459454 - RNA, 15 nt, Human
uugcugcaaaccuga

SEQ ID NO: 1459455 - RNA, 13 nt, Human
uugcugcaaaccu

SEQ ID NO: 1459456 - RNA, 20 nt, Human
uugcugccccaucagugcuc

SEQ ID NO: 1459457 - RNA, 19 nt, Human
uugcugccccaucagugcu

SEQ ID NO: 1459458 - RNA, 22 nt, Human
uugcuaaaggaaaaaaccaucc

SEQ ID NO: 1459459 - RNA, 13 nt, Human
uugccucugugcu

SEQ ID NO: 1459460 - RNA, 12 nt, Human
uugccucugugc

SEQ ID NO: 1459461 - RNA, 13 nt, Human
uugccauauugca

SEQ ID NO: 1459462 - RNA, 15 nt, Human
uugccauauugcaca

SEQ ID NO: 1459463 - RNA, 17 nt, Human
uugccauauugcacaug

SEQ ID NO: 1459464 - RNA, 22 nt, Human
uugccauauugcacaugucuua

SEQ ID NO: 1459465 - RNA, 23 nt, Human
uugccauauugcacaugucuuaa

SEQ ID NO: 1459466 - RNA, 13 nt, Human
uugcuguuuugau

SEQ ID NO: 1459467 - RNA, 18 nt, Human
uugcuguuuuaaacauua

SEQ ID NO: 1459468 - RNA, 16 nt, Human
uugcuguaauguuaau

SEQ ID NO: 1459469 - RNA, 21 nt, Human
uuggaaaguacacucugcugu

SEQ ID NO: 1459470 - RNA, 21 nt, Human
uuggaaauaaagucagaugga

SEQ ID NO: 1459471 - RNA, 13 nt, Human
uuggaaauaaagu

SEQ ID NO: 1459472 - RNA, 22 nt, Human
uuggaaaguacacucugcuguu

SEQ ID NO: 1459473 - RNA, 17 nt, Human
uuggaaaguacacucug

SEQ ID NO: 1459474 - RNA, 14 nt, Human
uuggaaaggaccag

SEQ ID NO: 1459475 - RNA, 13 nt, Human
uuggaaagcaggu

SEQ ID NO: 1459476 - RNA, 14 nt, Human
uugcuuaccucuca

SEQ ID NO: 1459477 - RNA, 14 nt, Human
uuggaaccuuguuu

SEQ ID NO: 1459478 - RNA, 15 nt, Human
uuggaaccagacucu

SEQ ID NO: 1459479 - RNA, 14 nt, Human
uuggaaccagacuc

SEQ ID NO: 1459480 - RNA, 13 nt, Human
uuggaaccagacu

SEQ ID NO: 1459481 - RNA, 22 nt, Human
uuggaacauuggaauguucuca

SEQ ID NO: 1459482 - RNA, 18 nt, Human
uuggaaauuuagcauugu

SEQ ID NO: 1459483 - RNA, 17 nt, Human
uuggaaauuuagcauug

SEQ ID NO: 1459484 - RNA, 16 nt, Human
uuggaaauuuagcauu

SEQ ID NO: 1459485 - RNA, 15 nt, Human
uuggaaauuuagcau

SEQ ID NO: 1459486 - RNA, 20 nt, Human
uuggauucuuuccauuugca

SEQ ID NO: 1459487 - RNA, 18 nt, Human
uuggauuguauauugugu

SEQ ID NO: 1459488 - RNA, 14 nt, Human
uuggauuguauauu

SEQ ID NO: 1459489 - RNA, 16 nt, Human
uuggaacuggaggcag

SEQ ID NO: 1459490 - RNA, 14 nt, Human
uuggaacuggaggc

SEQ ID NO: 1459491 - RNA, 13 nt, Human
uuggaacuggagg

SEQ ID NO: 1459492 - RNA, 17 nt, Human
uuggaacugaagggggc

SEQ ID NO: 1459493 - RNA, 16 nt, Human
uuggaacucugcuuga

SEQ ID NO: 1459494 - RNA, 19 nt, Human
uuggaaccuuguuuuggac

SEQ ID NO: 1459495 - RNA, 18 nt, Human
uuggaagaaggggcaggu

SEQ ID NO: 1459496 - RNA, 14 nt, Human
uuggaacuugccug

SEQ ID NO: 1459497 - RNA, 22 nt, Human
uuggaacuugccugccuuucca

SEQ ID NO: 1459498 - RNA, 15 nt, Human
uuggaaguuuuaauc

SEQ ID NO: 1459499 - RNA, 21 nt, Human
uuggaaguuuagcucugagaa

SEQ ID NO: 1459500 - RNA, 19 nt, Human
uuggaaguuuagcucugag

SEQ ID NO: 1459501 - RNA, 18 nt, Human
uuggaaguuuagcucuga

SEQ ID NO: 1459502 - RNA, 17 nt, Human
uuggaaguuuagcucug

SEQ ID NO: 1459503 - RNA, 20 nt, Human
uuggaagugaaaacuuugua

SEQ ID NO: 1459504 - RNA, 13 nt, Human
uuggaaggagcag

SEQ ID NO: 1459505 - RNA, 15 nt, Human
uuggaaggagcagaa

SEQ ID NO: 1459506 - RNA, 20 nt, Human
uuggaaguuuagcucugaga

SEQ ID NO: 1459507 - RNA, 14 nt, Human
uugcaaccucgcug

SEQ ID NO: 1459508 - RNA, 14 nt, Human
uugcaaccgucugu

SEQ ID NO: 1459509 - RNA, 18 nt, Human
uugcaaccaggaacagca

SEQ ID NO: 1459510 - RNA, 13 nt, Human
uugcaaccaggaa

SEQ ID NO: 1459511 - RNA, 16 nt, Human
uugcagacaggaaucu

SEQ ID NO: 1459512 - RNA, 15 nt, Human
uugcagacaggaauc

SEQ ID NO: 1459513 - RNA, 11 nt, Human
uugcagacagg

SEQ ID NO: 1459514 - RNA, 20 nt, Human
uugcagaagggggucucuuc

SEQ ID NO: 1459515 - RNA, 14 nt, Human
uugcagguggccaa

SEQ ID NO: 1459516 - RNA, 17 nt, Human
uugcaggguccucuucu

SEQ ID NO: 1459517 - RNA, 23 nt, Human
uugcaggguccucuucugggccu

SEQ ID NO: 1459518 - RNA, 13 nt, Human
uugcaguaacugu

SEQ ID NO: 1459519 - RNA, 23 nt, Human
uugcagguggccaaguuccucua

SEQ ID NO: 1459520 - RNA, 15 nt, Human
uugcaguaacuguuu

SEQ ID NO: 1459521 - RNA, 20 nt, Human
uugcagcuguuuuguugaca

SEQ ID NO: 1459522 - RNA, 21 nt, Human
uugcagcuguuuuguugacau

SEQ ID NO: 1459523 - RNA, 18 nt, Human
uugcagcuguuuuguuga

SEQ ID NO: 1459524 - RNA, 18 nt, Human
uugcagacaggaaucuua

SEQ ID NO: 1459525 - RNA, 20 nt, Human
uugccaccucuaacagcacc

SEQ ID NO: 1459526 - RNA, 18 nt, Human
uugccaccucuaacagca

SEQ ID NO: 1459527 - RNA, 16 nt, Human
uugccacccucaugcu

SEQ ID NO: 1459528 - RNA, 22 nt, Human
uugcauaguaccaaucauuuua

SEQ ID NO: 1459529 - RNA, 13 nt, Human
uugccacccucau

SEQ ID NO: 1459530 - RNA, 21 nt, Human
uugcagucccaagcggugucu

SEQ ID NO: 1459531 - RNA, 13 nt, Human
uugcagucccaag

SEQ ID NO: 1459532 - RNA, 22 nt, Human
uugcagucacucuagucaauga

SEQ ID NO: 1459533 - RNA, 16 nt, Human
uugcagucacucuagu

SEQ ID NO: 1459534 - RNA, 14 nt, Human
uugcagucacucua

SEQ ID NO: 1459535 - RNA, 23 nt, Human
uugcagucccaagcggugucucu

SEQ ID NO: 1459536 - RNA, 14 nt, Human
uugcauagaauaaa

SEQ ID NO: 1459537 - RNA, 17 nt, Human
uugcagcuguuuuguug

SEQ ID NO: 1459538 - RNA, 19 nt, Human
uugcaaaaacuacaaccaa

SEQ ID NO: 1459539 - RNA, 20 nt, Human
uugcaaaaacuacaaccaau

SEQ ID NO: 1459540 - RNA, 15 nt, Human
uugcaaaaacuacaa

SEQ ID NO: 1459541 - RNA, 19 nt, Human
uugcaaaaaauguuuuugg

SEQ ID NO: 1459542 - RNA, 20 nt, Human
uugauuuuugccucuuccag

SEQ ID NO: 1459543 - RNA, 14 nt, Human
uugauuuucuggau

SEQ ID NO: 1459544 - RNA, 18 nt, Human
uugauuuccguuaaaaua

SEQ ID NO: 1459545 - RNA, 22 nt, Human
uugcaaauguaguauggccugu

SEQ ID NO: 1459546 - RNA, 19 nt, Human
uugaucuggaacccagacu

SEQ ID NO: 1459547 - RNA, 17 nt, Human
uugaucuggaacccaga

SEQ ID NO: 1459548 - RNA, 16 nt, Human
uugaucuggaacccag

SEQ ID NO: 1459549 - RNA, 15 nt, Human
uugaucuggaaccca

SEQ ID NO: 1459550 - RNA, 13 nt, Human
uugaugaagaagu

SEQ ID NO: 1459551 - RNA, 12 nt, Human
uugaugaagaag

SEQ ID NO: 1459552 - RNA, 21 nt, Human
uugauuggugauuagguggug

SEQ ID NO: 1459553 - RNA, 15 nt, Human
uugaggggaccagga

SEQ ID NO: 1459554 - RNA, 17 nt, Human
uugaggggaccaggagu

SEQ ID NO: 1459555 - RNA, 14 nt, Human
uugaggggaccagg

SEQ ID NO: 1459556 - RNA, 15 nt, Human
uugaggacacugaua

SEQ ID NO: 1459557 - RNA, 14 nt, Human
uugaggacacugau

SEQ ID NO: 1459558 - RNA, 13 nt, Human
uugaggacacaug

SEQ ID NO: 1459559 - RNA, 14 nt, Human
uugaggacacaugu

SEQ ID NO: 1459560 - RNA, 15 nt, Human
uugaggacacauguc

SEQ ID NO: 1459561 - RNA, 16 nt, Human
uugaggacacaugucc

SEQ ID NO: 1459562 - RNA, 23 nt, Human
uugacuagaugauggaugccaau

SEQ ID NO: 1459563 - RNA, 22 nt, Human
uugacuagaaaauuuaaaacau

SEQ ID NO: 1459564 - RNA, 16 nt, Human
uugagcuuaaucuuug

SEQ ID NO: 1459565 - RNA, 15 nt, Human
uugagcuuaaucuuu

SEQ ID NO: 1459566 - RNA, 23 nt, Human
uugaggaaaacaagcauucacaa

SEQ ID NO: 1459567 - RNA, 13 nt, Human
uugaggaaaacaa

SEQ ID NO: 1459568 - RNA, 23 nt, Human
uugaggaaagcaagaaucagaga

SEQ ID NO: 1459569 - RNA, 15 nt, Human
uugaggaaagcaaga

SEQ ID NO: 1459570 - RNA, 11 nt, Human
uugaggacaca

SEQ ID NO: 1459571 - RNA, 16 nt, Human
uugaaugcaaaccaua

SEQ ID NO: 1459572 - RNA, 16 nt, Human
uugaaugcauuuuguu

SEQ ID NO: 1459573 - RNA, 23 nt, Human
uugaaugcauuuuguuugguauu

SEQ ID NO: 1459574 - RNA, 15 nt, Human
uugaaugcaaaccau

SEQ ID NO: 1459575 - RNA, 12 nt, Human
uugaaugcauuu

SEQ ID NO: 1459576 - RNA, 13 nt, Human
uugaaugcauuuu

SEQ ID NO: 1459577 - RNA, 16 nt, Human
uugaauggcuauguuu

SEQ ID NO: 1459578 - RNA, 20 nt, Human
uugaauggcuauguuuuuaa

SEQ ID NO: 1459579 - RNA, 13 nt, Human
uugaccugaggcu

SEQ ID NO: 1459580 - RNA, 19 nt, Human
uugaccugaggcugugguc

SEQ ID NO: 1459581 - RNA, 21 nt, Human
uugaccugccucccuucaugc

SEQ ID NO: 1459582 - RNA, 21 nt, Human
uugaccuuuuauguaguaauu

SEQ ID NO: 1459583 - RNA, 23 nt, Human
uugaccugccucccuucaugcau

SEQ ID NO: 1459584 - RNA, 22 nt, Human
uugaccuggauggggcaggcca

SEQ ID NO: 1459585 - RNA, 22 nt, Human
uugaccugccucccuucaugca

SEQ ID NO: 1459586 - RNA, 12 nt, Human
uucuuguaauuu

SEQ ID NO: 1459587 - RNA, 23 nt, Human
uucuugguuuguaaauuaacuuu

SEQ ID NO: 1459588 - RNA, 17 nt, Human
uucuugguuuguaaauu

SEQ ID NO: 1459589 - RNA, 18 nt, Human
uucuugguuuguaaauua

SEQ ID NO: 1459590 - RNA, 22 nt, Human
uucuugguugaggaaacaaaca

SEQ ID NO: 1459591 - RNA, 14 nt, Human
uucuucacugcaac

SEQ ID NO: 1459592 - RNA, 13 nt, Human
uucuucacugcaa

SEQ ID NO: 1459593 - RNA, 16 nt, Human
uucuucaccaaaucuu

SEQ ID NO: 1459594 - RNA, 13 nt, Human
uucuugguuugua

SEQ ID NO: 1459595 - RNA, 16 nt, Human
uucuugguuuguaaau

SEQ ID NO: 1459596 - RNA, 19 nt, Human
uucuuauuuuuuucuauuu

SEQ ID NO: 1459597 - RNA, 21 nt, Human
uucuguucuaguuuuuuacuu

SEQ ID NO: 1459598 - RNA, 14 nt, Human
uucuguucuaguuu

SEQ ID NO: 1459599 - RNA, 13 nt, Human
uucuguucuaguu

SEQ ID NO: 1459600 - RNA, 19 nt, Human
uucuguuccaaauucaguu

SEQ ID NO: 1459601 - RNA, 17 nt, Human
uucuguuccaaauucag

SEQ ID NO: 1459602 - RNA, 11 nt, Human
uucuguucuuu

SEQ ID NO: 1459603 - RNA, 13 nt, Human
uucuguuccaaau

SEQ ID NO: 1459604 - RNA, 17 nt, Human
uucuguuaacugaauac

SEQ ID NO: 1459605 - RNA, 21 nt, Human
uucuguuaacugaauaccacu

SEQ ID NO: 1459606 - RNA, 16 nt, Human
uucuguuaacugaaua

SEQ ID NO: 1459607 - RNA, 15 nt, Human
uucuguuaacugaau

SEQ ID NO: 1459608 - RNA, 14 nt, Human
uucuguuaacugaa

SEQ ID NO: 1459609 - RNA, 13 nt, Human
uucuguuaacuga

SEQ ID NO: 1459610 - RNA, 15 nt, Human
uucugagcuccuguc

SEQ ID NO: 1459611 - RNA, 14 nt, Human
uucugagccugccu

SEQ ID NO: 1459612 - RNA, 19 nt, Human
uucugagcuccuguccccu

SEQ ID NO: 1459613 - RNA, 13 nt, Human
uucugagcuccug

SEQ ID NO: 1459614 - RNA, 22 nt, Human
uucugagcccgguaagagcaaa

SEQ ID NO: 1459615 - RNA, 23 nt, Human
uucugagcuauuucaucuauuuu

SEQ ID NO: 1459616 - RNA, 16 nt, Human
uucugagcuauuucau

SEQ ID NO: 1459617 - RNA, 19 nt, Human
uucugagcccgguaagagc

SEQ ID NO: 1459618 - RNA, 22 nt, Human
uucugagcagcgagccugcuag

SEQ ID NO: 1459619 - RNA, 20 nt, Human
uucugagcagcgagccugcu

SEQ ID NO: 1459620 - RNA, 14 nt, Human
uucugagcauuuaa

SEQ ID NO: 1459621 - RNA, 20 nt, Human
uugaacucuucacucuucaa

SEQ ID NO: 1459622 - RNA, 15 nt, Human
uugaacucugguggc

SEQ ID NO: 1459623 - RNA, 14 nt, Human
uugaaagaauagaa

SEQ ID NO: 1459624 - RNA, 16 nt, Human
uugaacugauaaagau

SEQ ID NO: 1459625 - RNA, 19 nt, Human
uugaagaauguuaagacuu

SEQ ID NO: 1459626 - RNA, 15 nt, Human
uugaagaauguuaag

SEQ ID NO: 1459627 - RNA, 19 nt, Human
uugaagaacugcaggcccu

SEQ ID NO: 1459628 - RNA, 20 nt, Human
uugaagaacugcaggcccug

SEQ ID NO: 1459629 - RNA, 16 nt, Human
uugaagaacugcaggc

SEQ ID NO: 1459630 - RNA, 22 nt, Human
uugaacuuugaccucugcagca

SEQ ID NO: 1459631 - RNA, 21 nt, Human
uugaagaauguuaagacuuga

SEQ ID NO: 1459632 - RNA, 23 nt, Human
uugaagaauguuaagacuugaca

SEQ ID NO: 1459633 - RNA, 14 nt, Human
uugaaucuugucuc

SEQ ID NO: 1459634 - RNA, 15 nt, Human
uugaaucuugucuca

SEQ ID NO: 1459635 - RNA, 16 nt, Human
uugaaucuugucucaa

SEQ ID NO: 1459636 - RNA, 17 nt, Human
uugaaucuugucucaau

SEQ ID NO: 1459637 - RNA, 20 nt, Human
uugaaucuugucucaaugcu

SEQ ID NO: 1459638 - RNA, 22 nt, Human
uugaaucuugucucaaugcuca

SEQ ID NO: 1459639 - RNA, 23 nt, Human
uugaaucuugucucaaugcucau

SEQ ID NO: 1459640 - RNA, 15 nt, Human
uucuuucaauacaga

SEQ ID NO: 1459641 - RNA, 18 nt, Human
uucuuucaauacagauau

SEQ ID NO: 1459642 - RNA, 13 nt, Human
uucuuguaauuuu

SEQ ID NO: 1459643 - RNA, 22 nt, Human
uucuuuauaagaaagccugagu

SEQ ID NO: 1459644 - RNA, 14 nt, Human
uucuuuauaagaaa

SEQ ID NO: 1459645 - RNA, 18 nt, Human
uucucaaaggagcgagca

SEQ ID NO: 1459646 - RNA, 15 nt, Human
uucucauccugcagg

SEQ ID NO: 1459647 - RNA, 16 nt, Human
uucuccaagagcuaca

SEQ ID NO: 1459648 - RNA, 22 nt, Human
uucuccaacaucacagcccagc

SEQ ID NO: 1459649 - RNA, 20 nt, Human
uucuccaaacugaagcagcc

SEQ ID NO: 1459650 - RNA, 14 nt, Human
uucucaugauccaa

SEQ ID NO: 1459651 - RNA, 15 nt, Human
uucuauuuuuuguuu

SEQ ID NO: 1459652 - RNA, 16 nt, Human
uucuauuuuuaucuga

SEQ ID NO: 1459653 - RNA, 23 nt, Human
uucuauuuuuuguuuuguuuccu

SEQ ID NO: 1459654 - RNA, 16 nt, Human
uucuauuuuguaaacu

SEQ ID NO: 1459655 - RNA, 13 nt, Human
uucuauuuuguaa

SEQ ID NO: 1459656 - RNA, 19 nt, Human
uucuauuuuauuaugaaga

SEQ ID NO: 1459657 - RNA, 20 nt, Human
uucuauuuuauuaugaagaa

SEQ ID NO: 1459658 - RNA, 18 nt, Human
uucuauuuuauuaugaag

SEQ ID NO: 1459659 - RNA, 15 nt, Human
uucuauuuuauuaug

SEQ ID NO: 1459660 - RNA, 18 nt, Human
uucuauuuggggcuugau

SEQ ID NO: 1459661 - RNA, 16 nt, Human
uucuauuuggggcuug

SEQ ID NO: 1459662 - RNA, 14 nt, Human
uucuauuuggggcu

SEQ ID NO: 1459663 - RNA, 15 nt, Human
uucuauuucacugga

SEQ ID NO: 1459664 - RNA, 19 nt, Human
uucuauuucuccuccaugg

SEQ ID NO: 1459665 - RNA, 17 nt, Human
uucuauuucuccuccau

SEQ ID NO: 1459666 - RNA, 17 nt, Human
uucuauuucacuggagc

SEQ ID NO: 1459667 - RNA, 19 nt, Human
uucuauuuauauguacaug

SEQ ID NO: 1459668 - RNA, 18 nt, Human
uucuauuuauauguacau

SEQ ID NO: 1459669 - RNA, 19 nt, Human
uucuaauaauuucuaaugu

SEQ ID NO: 1459670 - RNA, 13 nt, Human
uucuaaugaugau

SEQ ID NO: 1459671 - RNA, 16 nt, Human
uucuaugacacaugca

SEQ ID NO: 1459672 - RNA, 17 nt, Human
uucuaugacacaugcaa

SEQ ID NO: 1459673 - RNA, 20 nt, Human
uucuauuacauuuucaguga

SEQ ID NO: 1459674 - RNA, 15 nt, Human
uucuauuaaagugcu

SEQ ID NO: 1459675 - RNA, 21 nt, Human
uucuauuaaagugcuaagguu

SEQ ID NO: 1459676 - RNA, 12 nt, Human
uucuauuaaagu

SEQ ID NO: 1459677 - RNA, 23 nt, Human
uucuauuaaaagugggaauuagg

SEQ ID NO: 1459678 - RNA, 18 nt, Human
uucuauuaaaagugggaa

SEQ ID NO: 1459679 - RNA, 14 nt, Human
uucuauuaaaagug

SEQ ID NO: 1459680 - RNA, 22 nt, Human
uucuauuaaaagacucauccgu

SEQ ID NO: 1459681 - RNA, 21 nt, Human
uucuauuaaaagacucauccg

SEQ ID NO: 1459682 - RNA, 19 nt, Human
uucuauuaaaagacucauc

SEQ ID NO: 1459683 - RNA, 18 nt, Human
uucuauuaaaagacucau

SEQ ID NO: 1459684 - RNA, 17 nt, Human
uucuauuaaaagacuca

SEQ ID NO: 1459685 - RNA, 16 nt, Human
uucuauuaaaagacuc

SEQ ID NO: 1459686 - RNA, 15 nt, Human
uucuauuaaaagacu

SEQ ID NO: 1459687 - RNA, 14 nt, Human
uucuauuaaaagac

SEQ ID NO: 1459688 - RNA, 13 nt, Human
uucuauuaaaaga

SEQ ID NO: 1459689 - RNA, 18 nt, Human
uucuauggguguuaucac

SEQ ID NO: 1459690 - RNA, 15 nt, Human
uucuauggguguuau

SEQ ID NO: 1459691 - RNA, 15 nt, Human
uucuccacagcaacc

SEQ ID NO: 1459692 - RNA, 22 nt, Human
uucuccacagcaaccccaggcu

SEQ ID NO: 1459693 - RNA, 15 nt, Human
uucuccauccuacca

SEQ ID NO: 1459694 - RNA, 20 nt, Human
uucuccauccacaugggagc

SEQ ID NO: 1459695 - RNA, 19 nt, Human
uucucccaggcaaggcugu

SEQ ID NO: 1459696 - RNA, 18 nt, Human
uucucccacucuccuagg

SEQ ID NO: 1459697 - RNA, 16 nt, Human
uucucccacucuccua

SEQ ID NO: 1459698 - RNA, 12 nt, Human
uucucccacucu

SEQ ID NO: 1459699 - RNA, 11 nt, Human
uucucccacuc

SEQ ID NO: 1459700 - RNA, 23 nt, Human
uucucccaauucauccucacuca

SEQ ID NO: 1459701 - RNA, 18 nt, Human
uucuccauggcccugcca

SEQ ID NO: 1459702 - RNA, 21 nt, Human
uucucccccauguucuguccc

SEQ ID NO: 1459703 - RNA, 18 nt, Human
uucuccccagcucccagg

SEQ ID NO: 1459704 - RNA, 15 nt, Human
uucuccccagcuccc

SEQ ID NO: 1459705 - RNA, 12 nt, Human
uucuccccagcu

SEQ ID NO: 1459706 - RNA, 12 nt, Human
uucucuccagcu

SEQ ID NO: 1459707 - RNA, 15 nt, Human
uucuccccugcacug

SEQ ID NO: 1459708 - RNA, 16 nt, Human
uucuccccugcacugu

SEQ ID NO: 1459709 - RNA, 17 nt, Human
uucucucggcuccccau

SEQ ID NO: 1459710 - RNA, 19 nt, Human
uucucuccagcugacuaaa

SEQ ID NO: 1459711 - RNA, 23 nt, Human
uucucuccucuccccaugauguu

SEQ ID NO: 1459712 - RNA, 16 nt, Human
uucugacucugagcua

SEQ ID NO: 1459713 - RNA, 15 nt, Human
uucugacucugagcu

SEQ ID NO: 1459714 - RNA, 19 nt, Human
uucugacucgguuucucca

SEQ ID NO: 1459715 - RNA, 18 nt, Human
uucugacucgguuucucc

SEQ ID NO: 1459716 - RNA, 12 nt, Human
uucucugucuca

SEQ ID NO: 1459717 - RNA, 13 nt, Human
uucucugucucau

SEQ ID NO: 1459718 - RNA, 19 nt, Human
uucucugguaauauugacu

SEQ ID NO: 1459719 - RNA, 20 nt, Human
uucucuggcuguaaggcucu

SEQ ID NO: 1459720 - RNA, 13 nt, Human
uucucugccagug

SEQ ID NO: 1459721 - RNA, 12 nt, Human
uucucugccagu

SEQ ID NO: 1459722 - RNA, 10 nt, Human
uucucugcca

SEQ ID NO: 1459723 - RNA, 17 nt, Human
uucucugauacagaaaa

SEQ ID NO: 1459724 - RNA, 16 nt, Human
uucucugacuucugcc

SEQ ID NO: 1459725 - RNA, 12 nt, Human
uucucugacuuc

SEQ ID NO: 1459726 - RNA, 11 nt, Human
uucucugacuu

SEQ ID NO: 1459727 - RNA, 21 nt, Human
uucucucuuuauacagcugua

SEQ ID NO: 1459728 - RNA, 20 nt, Human
uucucucuuuauacagcugu

SEQ ID NO: 1459729 - RNA, 18 nt, Human
uucucucuuuauacagcu

SEQ ID NO: 1459730 - RNA, 17 nt, Human
uucucucuuuauacagc

SEQ ID NO: 1459731 - RNA, 16 nt, Human
uucucugauacagaaa

SEQ ID NO: 1459732 - RNA, 15 nt, Human
uucucugauacagaa

SEQ ID NO: 1459733 - RNA, 17 nt, Human
uucucugacuucugccu

SEQ ID NO: 1459734 - RNA, 14 nt, Human
uucucugauacaga

SEQ ID NO: 1459735 - RNA, 22 nt, Human
uuccuuugaauccucucucugu

SEQ ID NO: 1459736 - RNA, 18 nt, Human
uuccuuucuuuucccccu

SEQ ID NO: 1459737 - RNA, 14 nt, Human
uucuaaaaugccuu

SEQ ID NO: 1459738 - RNA, 15 nt, Human
uucuaaaaugauugu

SEQ ID NO: 1459739 - RNA, 22 nt, Human
uucuaaaaucuuauaguucuag

SEQ ID NO: 1459740 - RNA, 21 nt, Human
uucuaaaaucuuauaguucua

SEQ ID NO: 1459741 - RNA, 20 nt, Human
uucuaaaaucuuauaguucu

SEQ ID NO: 1459742 - RNA, 17 nt, Human
uuccuuucuuuuccccc

SEQ ID NO: 1459743 - RNA, 15 nt, Human
uucuaaaagguguga

SEQ ID NO: 1459744 - RNA, 18 nt, Human
uucuaauaauuucuaaug

SEQ ID NO: 1459745 - RNA, 16 nt, Human
uucuaauaauuucuaa

SEQ ID NO: 1459746 - RNA, 15 nt, Human
uucuaauaauuucua

SEQ ID NO: 1459747 - RNA, 21 nt, Human
uucuaaguuucuaagauucua

SEQ ID NO: 1459748 - RNA, 19 nt, Human
uucuaaaggaguuuauguu

SEQ ID NO: 1459749 - RNA, 20 nt, Human
uucuaaguuucuaagauucu

SEQ ID NO: 1459750 - RNA, 23 nt, Human
uucuaaaggaguuuauguuccau

SEQ ID NO: 1459751 - RNA, 19 nt, Human
uucuaaaggcuaccuuugu

SEQ ID NO: 1459752 - RNA, 17 nt, Human
uucuaaaggcuaccuuu

SEQ ID NO: 1459753 - RNA, 18 nt, Human
uucuaaaggcuaccuuug

SEQ ID NO: 1459754 - RNA, 15 nt, Human
uucuaaacuggagac

SEQ ID NO: 1459755 - RNA, 23 nt, Human
uucuaaacccaauccaaauggcg

SEQ ID NO: 1459756 - RNA, 19 nt, Human
uucuaaacccaauccaaau

SEQ ID NO: 1459757 - RNA, 18 nt, Human
uucuaaacccaauccaaa

SEQ ID NO: 1459758 - RNA, 23 nt, Human
uucuaaaaugugauguucuaagg

SEQ ID NO: 1459759 - RNA, 20 nt, Human
uucuaaaaugugauguucua

SEQ ID NO: 1459760 - RNA, 19 nt, Human
uucuaaaaugugauguucu

SEQ ID NO: 1459761 - RNA, 15 nt, Human
uucuaaaaugugaug

SEQ ID NO: 1459762 - RNA, 16 nt, Human
uucuaaaggaguuuau

SEQ ID NO: 1459763 - RNA, 18 nt, Human
uucuaaacuggagacugu

SEQ ID NO: 1459764 - RNA, 16 nt, Human
uucuaaaggcuaccuu

SEQ ID NO: 1459765 - RNA, 14 nt, Human
uuccuccuggaaau

SEQ ID NO: 1459766 - RNA, 13 nt, Human
uuccuccuggaaa

SEQ ID NO: 1459767 - RNA, 11 nt, Human
uuccuccugga

SEQ ID NO: 1459768 - RNA, 15 nt, Human
uuccuccugcucaua

SEQ ID NO: 1459769 - RNA, 13 nt, Human
uuccuccugcuca

SEQ ID NO: 1459770 - RNA, 18 nt, Human
uuccugccccaggccuga

SEQ ID NO: 1459771 - RNA, 12 nt, Human
uuccuuccgcuu

SEQ ID NO: 1459772 - RNA, 21 nt, Human
uuccuuccaaugucuggagac

SEQ ID NO: 1459773 - RNA, 17 nt, Human
uuccuucauuuccuccg

SEQ ID NO: 1459774 - RNA, 18 nt, Human
uuccugccgcaacaguuu

SEQ ID NO: 1459775 - RNA, 19 nt, Human
uuccuucccuuuucuguuc

SEQ ID NO: 1459776 - RNA, 16 nt, Human
uuccuucccugugccu

SEQ ID NO: 1459777 - RNA, 14 nt, Human
uuccuucccaugga

SEQ ID NO: 1459778 - RNA, 15 nt, Human
uuccuucccugcugu

SEQ ID NO: 1459779 - RNA, 19 nt, Human
uuccuucccugcugugaaa

SEQ ID NO: 1459780 - RNA, 21 nt, Human
uuccuucccugcugugaaaga

SEQ ID NO: 1459781 - RNA, 13 nt, Human
uuccuccucaggc

SEQ ID NO: 1459782 - RNA, 16 nt, Human
uuccuccuccccacuu

SEQ ID NO: 1459783 - RNA, 14 nt, Human
uuccuccuccccac

SEQ ID NO: 1459784 - RNA, 20 nt, Human
uuccuccucaggcacacagc

SEQ ID NO: 1459785 - RNA, 21 nt, Human
uuccucaugaauguaaauuug

SEQ ID NO: 1459786 - RNA, 18 nt, Human
uuccucaugaauguaaau

SEQ ID NO: 1459787 - RNA, 17 nt, Human
uuccucaugaauguaaa

SEQ ID NO: 1459788 - RNA, 16 nt, Human
uuccucaugaauguaa

SEQ ID NO: 1459789 - RNA, 15 nt, Human
uuccucaugaaugua

SEQ ID NO: 1459790 - RNA, 14 nt, Human
uuccucaugaaugu

SEQ ID NO: 1459791 - RNA, 18 nt, Human
uuccucauccaccccauc

SEQ ID NO: 1459792 - RNA, 19 nt, Human
uuccucauccaccccaucc

SEQ ID NO: 1459793 - RNA, 15 nt, Human
uuccucagccagccu

SEQ ID NO: 1459794 - RNA, 14 nt, Human
uuccucagccagcc

SEQ ID NO: 1459795 - RNA, 18 nt, Human
uuccuaguuuucuccucc

SEQ ID NO: 1459796 - RNA, 15 nt, Human
uuccuaguuuucucc

SEQ ID NO: 1459797 - RNA, 16 nt, Human
uuccuaguucuguaga

SEQ ID NO: 1459798 - RNA, 17 nt, Human
uuccuaguucuguagaa

SEQ ID NO: 1459799 - RNA, 20 nt, Human
uuccuaguucuguagaaaug

SEQ ID NO: 1459800 - RNA, 16 nt, Human
uuccucagccagccuc

SEQ ID NO: 1459801 - RNA, 19 nt, Human
uuccucagccagccucgcc

SEQ ID NO: 1459802 - RNA, 18 nt, Human
uuccuagcugugugaaua

SEQ ID NO: 1459803 - RNA, 18 nt, Human
uuccuagcccucucacau

SEQ ID NO: 1459804 - RNA, 14 nt, Human
uuccuagcccucuc

SEQ ID NO: 1459805 - RNA, 20 nt, Human
uuccuagguauaauucacau

SEQ ID NO: 1459806 - RNA, 23 nt, Human
uucccuucaguacccucucagcu

SEQ ID NO: 1459807 - RNA, 22 nt, Human
uucccuucaguacccucucagc

SEQ ID NO: 1459808 - RNA, 19 nt, Human
uucccuucaguacccucuc

SEQ ID NO: 1459809 - RNA, 18 nt, Human
uucccuguuuucccccca

SEQ ID NO: 1459810 - RNA, 18 nt, Human
uucccugugccuccuccc

SEQ ID NO: 1459811 - RNA, 23 nt, Human
uucccuggucccuuguauccccu

SEQ ID NO: 1459812 - RNA, 19 nt, Human
uuccccacccaccaacccu

SEQ ID NO: 1459813 - RNA, 23 nt, Human
uuccccacccaccaacccucagg

SEQ ID NO: 1459814 - RNA, 20 nt, Human
uuccccaccagaugcugaaa

SEQ ID NO: 1459815 - RNA, 12 nt, Human
uuccccagagaa

SEQ ID NO: 1459816 - RNA, 11 nt, Human
uuccccagaga

SEQ ID NO: 1459817 - RNA, 15 nt, Human
uuccccagacuuguu

SEQ ID NO: 1459818 - RNA, 18 nt, Human
uuccccagacgccuggcu

SEQ ID NO: 1459819 - RNA, 14 nt, Human
uuccccacuggagc

SEQ ID NO: 1459820 - RNA, 13 nt, Human
uuccccacuggag

SEQ ID NO: 1459821 - RNA, 19 nt, Human
uuccuagagaagacaggcu

SEQ ID NO: 1459822 - RNA, 13 nt, Human
uucccuuuccuga

SEQ ID NO: 1459823 - RNA, 20 nt, Human
uucccuuguagcuccucccc

SEQ ID NO: 1459824 - RNA, 16 nt, Human
uucccuuguagcuccu

SEQ ID NO: 1459825 - RNA, 15 nt, Human
uucccugugccuccu

SEQ ID NO: 1459826 - RNA, 14 nt, Human
uucccuucaucugg

SEQ ID NO: 1459827 - RNA, 15 nt, Human
uucccuucaucugga

SEQ ID NO: 1459828 - RNA, 16 nt, Human
uucccuucaucuggaa

SEQ ID NO: 1459829 - RNA, 17 nt, Human
uucaguuguucuuuuua

SEQ ID NO: 1459830 - RNA, 15 nt, Human
uucaguugucucuga

SEQ ID NO: 1459831 - RNA, 23 nt, Human
uucagggaaggaggagccugucc

SEQ ID NO: 1459832 - RNA, 22 nt, Human
uucagggaaggaggagccuguc

SEQ ID NO: 1459833 - RNA, 21 nt, Human
uucagggaaggaggagccugu

SEQ ID NO: 1459834 - RNA, 20 nt, Human
uucagggaaggaggagccug

SEQ ID NO: 1459835 - RNA, 23 nt, Human
uucaucuauuuuuggcagucuga

SEQ ID NO: 1459836 - RNA, 20 nt, Human
uucaucuaccauuuucuggu

SEQ ID NO: 1459837 - RNA, 15 nt, Human
uucaucuaggauuuu

SEQ ID NO: 1459838 - RNA, 15 nt, Human
uucauaaucacucua

SEQ ID NO: 1459839 - RNA, 17 nt, Human
uucauaaguauuucaaa

SEQ ID NO: 1459840 - RNA, 20 nt, Human
uucauaaguauuaugucucu

SEQ ID NO: 1459841 - RNA, 19 nt, Human
uucauaaguauuaugucuc

SEQ ID NO: 1459842 - RNA, 12 nt, Human
uucauaaguauu

SEQ ID NO: 1459843 - RNA, 21 nt, Human
uucaguuuucauuugguucau

SEQ ID NO: 1459844 - RNA, 13 nt, Human
uucaguuucauaa

SEQ ID NO: 1459845 - RNA, 16 nt, Human
uucaguuucauaaaag

SEQ ID NO: 1459846 - RNA, 22 nt, Human
uucaguuuauuugaaccaauaa

SEQ ID NO: 1459847 - RNA, 15 nt, Human
uucaugacagccucc

SEQ ID NO: 1459848 - RNA, 19 nt, Human
uucaucuucaguugucucu

SEQ ID NO: 1459849 - RNA, 18 nt, Human
uucaugaaagauucaaug

SEQ ID NO: 1459850 - RNA, 22 nt, Human
uucaucucccaccuagcagcac

SEQ ID NO: 1459851 - RNA, 21 nt, Human
uucauuuuaacaucugagaaa

SEQ ID NO: 1459852 - RNA, 18 nt, Human
uucauuuuaacaucugag

SEQ ID NO: 1459853 - RNA, 16 nt, Human
uucauuuccuccguca

SEQ ID NO: 1459854 - RNA, 22 nt, Human
uucauuugguucauuaauucua

SEQ ID NO: 1459855 - RNA, 16 nt, Human
uucauuuccucaaaaa

SEQ ID NO: 1459856 - RNA, 13 nt, Human
uucauuuccucaa

SEQ ID NO: 1459857 - RNA, 13 nt, Human
uucauuucaucua

SEQ ID NO: 1459858 - RNA, 15 nt, Human
uucauuucaacuguu

SEQ ID NO: 1459859 - RNA, 18 nt, Human
uucauuuaucuauaauuu

SEQ ID NO: 1459860 - RNA, 17 nt, Human
uucauuuaucuauaauu

SEQ ID NO: 1459861 - RNA, 19 nt, Human
uucauuuagucaugugacc

SEQ ID NO: 1459862 - RNA, 23 nt, Human
uucaugauuucauuucaacuguu

SEQ ID NO: 1459863 - RNA, 17 nt, Human
uucaugauuucauuuca

SEQ ID NO: 1459864 - RNA, 23 nt, Human
uucaugauuagaaauuaccugug

SEQ ID NO: 1459865 - RNA, 15 nt, Human
uucaugauuagaaau

SEQ ID NO: 1459866 - RNA, 18 nt, Human
uucaugauaaugaacaga

SEQ ID NO: 1459867 - RNA, 15 nt, Human
uucaugauaaugaac

SEQ ID NO: 1459868 - RNA, 12 nt, Human
uucaugauaaug

SEQ ID NO: 1459869 - RNA, 16 nt, Human
uucaugacagccucca

SEQ ID NO: 1459870 - RNA, 16 nt, Human
uucaugaccaguaaag

SEQ ID NO: 1459871 - RNA, 15 nt, Human
uuccacugagggcag

SEQ ID NO: 1459872 - RNA, 13 nt, Human
uucauuuucucua

SEQ ID NO: 1459873 - RNA, 16 nt, Human
uuccacugagggcagu

SEQ ID NO: 1459874 - RNA, 17 nt, Human
uuccacuuauagccucu

SEQ ID NO: 1459875 - RNA, 22 nt, Human
uuccacugugcagguucccacu

SEQ ID NO: 1459876 - RNA, 20 nt, Human
uuccacuuauagccucuguc

SEQ ID NO: 1459877 - RNA, 18 nt, Human
uuccacuuauagccucug

SEQ ID NO: 1459878 - RNA, 14 nt, Human
uuccagccccucug

SEQ ID NO: 1459879 - RNA, 17 nt, Human
uuccagcauucccaggu

SEQ ID NO: 1459880 - RNA, 20 nt, Human
uuccagcauucccagguagg

SEQ ID NO: 1459881 - RNA, 15 nt, Human
uuccagcauucccag

SEQ ID NO: 1459882 - RNA, 20 nt, Human
uuccagccccucuggucgcu

SEQ ID NO: 1459883 - RNA, 17 nt, Human
uuccagccccucugguc

SEQ ID NO: 1459884 - RNA, 16 nt, Human
uuccagccccucuggu

SEQ ID NO: 1459885 - RNA, 21 nt, Human
uuccaugacugcuugcccuaa

SEQ ID NO: 1459886 - RNA, 16 nt, Human
uuccaugacaucaaga

SEQ ID NO: 1459887 - RNA, 18 nt, Human
uuccaucuuuacaaaacu

SEQ ID NO: 1459888 - RNA, 13 nt, Human
uuccaucuuuaca

SEQ ID NO: 1459889 - RNA, 12 nt, Human
uuccaucugauu

SEQ ID NO: 1459890 - RNA, 18 nt, Human
uuccaugauucuauuuau

SEQ ID NO: 1459891 - RNA, 17 nt, Human
uuccaugauucuauuua

SEQ ID NO: 1459892 - RNA, 19 nt, Human
uuccaugacugcuugcccu

SEQ ID NO: 1459893 - RNA, 18 nt, Human
uuccauuugcauuuguuu

SEQ ID NO: 1459894 - RNA, 15 nt, Human
uuccauuugcauuug

SEQ ID NO: 1459895 - RNA, 17 nt, Human
uuccauuugcaagggaa

SEQ ID NO: 1459896 - RNA, 13 nt, Human
uuccauuugcaag

SEQ ID NO: 1459897 - RNA, 20 nt, Human
uuccauugguccaagauucc

SEQ ID NO: 1459898 - RNA, 15 nt, Human
uuccccaccagaugc

SEQ ID NO: 1459899 - RNA, 19 nt, Human
uucccaaaauguugaaaua

SEQ ID NO: 1459900 - RNA, 17 nt, Human
uuccauuugcauuuguu

SEQ ID NO: 1459901 - RNA, 22 nt, Human
uucccaaaauguugaaauauga

SEQ ID NO: 1459902 - RNA, 11 nt, Human
uucccaaaagc

SEQ ID NO: 1459903 - RNA, 21 nt, Human
uucccaaaagcccauucauuc

SEQ ID NO: 1459904 - RNA, 23 nt, Human
uucagcugccaguguccugagcc

SEQ ID NO: 1459905 - RNA, 23 nt, Human
uucagcugagguuugcacuuccu

SEQ ID NO: 1459906 - RNA, 15 nt, Human
uucagcucugaaaga

SEQ ID NO: 1459907 - RNA, 13 nt, Human
uucagcuccugac

SEQ ID NO: 1459908 - RNA, 14 nt, Human
uucagcuccugacc

SEQ ID NO: 1459909 - RNA, 12 nt, Human
uucagcuccuga

SEQ ID NO: 1459910 - RNA, 10 nt, Human
uucagcuccu

SEQ ID NO: 1459911 - RNA, 20 nt, Human
uucaggaggaauacugaaca

SEQ ID NO: 1459912 - RNA, 18 nt, Human
uucaggaggaauacugaa

SEQ ID NO: 1459913 - RNA, 15 nt, Human
uucaggaggaauacu

SEQ ID NO: 1459914 - RNA, 21 nt, Human
uucaggagagaguugaaccua

SEQ ID NO: 1459915 - RNA, 20 nt, Human
uucaggagagaguugaaccu

SEQ ID NO: 1459916 - RNA, 18 nt, Human
uucaggacacucacuaca

SEQ ID NO: 1459917 - RNA, 22 nt, Human
uucaggaucuauuuuuggaggu

SEQ ID NO: 1459918 - RNA, 14 nt, Human
uucaggaucuauuu

SEQ ID NO: 1459919 - RNA, 12 nt, Human
uucaggaucuau

SEQ ID NO: 1459920 - RNA, 23 nt, Human
uucaggaucuauuuuuggagguu

SEQ ID NO: 1459921 - RNA, 13 nt, Human
uucagcugccagu

SEQ ID NO: 1459922 - RNA, 19 nt, Human
uucacccccuuuccuggac

SEQ ID NO: 1459923 - RNA, 20 nt, Human
uucacucuucaaaugccuga

SEQ ID NO: 1459924 - RNA, 16 nt, Human
uucacccccuuuccug

SEQ ID NO: 1459925 - RNA, 22 nt, Human
uucagaggcucagauuguaaua

SEQ ID NO: 1459926 - RNA, 13 nt, Human
uucagaggcucag

SEQ ID NO: 1459927 - RNA, 12 nt, Human
uucagaggcuca

SEQ ID NO: 1459928 - RNA, 23 nt, Human
uucagaggcccucgcugccagcu

SEQ ID NO: 1459929 - RNA, 22 nt, Human
uucagaggcccucgcugccagc

SEQ ID NO: 1459930 - RNA, 21 nt, Human
uucagacucccauuccugaag

SEQ ID NO: 1459931 - RNA, 20 nt, Human
uucagacucccauuccugaa

SEQ ID NO: 1459932 - RNA, 21 nt, Human
uucaaagccagcguccuccuc

SEQ ID NO: 1459933 - RNA, 13 nt, Human
uucaaagccagcg

SEQ ID NO: 1459934 - RNA, 16 nt, Human
uucaaagcaugaaaug

SEQ ID NO: 1459935 - RNA, 18 nt, Human
uucaaagaugcugugagu

SEQ ID NO: 1459936 - RNA, 13 nt, Human
uucaaagaugcug

SEQ ID NO: 1459937 - RNA, 21 nt, Human
uucaacaaagaaacaaagaug

SEQ ID NO: 1459938 - RNA, 20 nt, Human
uucaacaaacauuugcugaa

SEQ ID NO: 1459939 - RNA, 12 nt, Human
uucaacaaacau

SEQ ID NO: 1459940 - RNA, 16 nt, Human
uuauuuugauguaaag

SEQ ID NO: 1459941 - RNA, 11 nt, Human
uuauuuugaug

SEQ ID NO: 1459942 - RNA, 17 nt, Human
uuauuuugacauaaagu

SEQ ID NO: 1459943 - RNA, 12 nt, Human
uuauuuucuggu

SEQ ID NO: 1459944 - RNA, 12 nt, Human
uucaaagaugcu

SEQ ID NO: 1459945 - RNA, 15 nt, Human
uuauuuugacauaaa

SEQ ID NO: 1459946 - RNA, 13 nt, Human
uuauuuugaugua

SEQ ID NO: 1459947 - RNA, 13 nt, Human
uucaaagauauuu

SEQ ID NO: 1459948 - RNA, 18 nt, Human
uuacuaaaaaaaagauga

SEQ ID NO: 1459949 - RNA, 17 nt, Human
uuacuaaaaaaaagaug

SEQ ID NO: 1459950 - RNA, 15 nt, Human
uuacgugcucugugg

SEQ ID NO: 1459951 - RNA, 12 nt, Human
uuauuuucacug

SEQ ID NO: 1459952 - RNA, 15 nt, Human
uucaaucuguaaacu

SEQ ID NO: 1459953 - RNA, 14 nt, Human
uucaaucuguaaac

SEQ ID NO: 1459954 - RNA, 16 nt, Human
uucaauauuuucuuuu

SEQ ID NO: 1459955 - RNA, 11 nt, Human
uucaauauuuu

SEQ ID NO: 1459956 - RNA, 19 nt, Human
uucaacaauucuaaaauga

SEQ ID NO: 1459957 - RNA, 15 nt, Human
uucaacaauucuaaa

SEQ ID NO: 1459958 - RNA, 14 nt, Human
uucaacaauucuaa

SEQ ID NO: 1459959 - RNA, 22 nt, Human
uucaacaaagaaacaaagaugu

SEQ ID NO: 1459960 - RNA, 18 nt, Human
uucaacaauucuaaaaug

SEQ ID NO: 1459961 - RNA, 15 nt, Human
uucaauucaaagcug

SEQ ID NO: 1459962 - RNA, 15 nt, Human
uucaauguuagccuc

SEQ ID NO: 1459963 - RNA, 20 nt, Human
uucaaucuguaaacugugua

SEQ ID NO: 1459964 - RNA, 18 nt, Human
uucaaucuguaaacugug

SEQ ID NO: 1459965 - RNA, 17 nt, Human
uucaaucuguaaacugu

SEQ ID NO: 1459966 - RNA, 16 nt, Human
uucaaucuguaaacug

SEQ ID NO: 1459967 - RNA, 19 nt, Human
uucaaugccccugaauuua

SEQ ID NO: 1459968 - RNA, 16 nt, Human
uuuucacuguagaaug

SEQ ID NO: 1459969 - RNA, 18 nt, Human
uuuucaaugaauuuuaua

SEQ ID NO: 1459970 - RNA, 16 nt, Human
uuuucaauagccacua

SEQ ID NO: 1459971 - RNA, 14 nt, Human
uuuucaauagccac

SEQ ID NO: 1459972 - RNA, 16 nt, Human
uuuucaagaauaauca

SEQ ID NO: 1459973 - RNA, 15 nt, Human
uuuucaagaaacuga

SEQ ID NO: 1459974 - RNA, 14 nt, Human
uuuucaagaaacug

SEQ ID NO: 1459975 - RNA, 17 nt, Human
uuuuaucccucaccugu

SEQ ID NO: 1459976 - RNA, 19 nt, Human
uuuucggccccauguaucu

SEQ ID NO: 1459977 - RNA, 16 nt, Human
uuuucgaaaaucaaau

SEQ ID NO: 1459978 - RNA, 15 nt, Human
uuuucgaaaaucaaa

SEQ ID NO: 1459979 - RNA, 14 nt, Human
uuuucgaaaaucaa

SEQ ID NO: 1459980 - RNA, 13 nt, Human
uuuuccuuugugc

SEQ ID NO: 1459981 - RNA, 17 nt, Human
uuuuccuuugaauccuc

SEQ ID NO: 1459982 - RNA, 21 nt, Human
uuuuccuuccaaugucuggag

SEQ ID NO: 1459983 - RNA, 19 nt, Human
uuuuccuucccuuuucugu

SEQ ID NO: 1459984 - RNA, 16 nt, Human
uuuuccucuccacaca

SEQ ID NO: 1459985 - RNA, 18 nt, Human
uuuuccucuucuauuuug

SEQ ID NO: 1459986 - RNA, 21 nt, Human
uuuuccauggcaggaaggcuu

SEQ ID NO: 1459987 - RNA, 22 nt, Human
uuuuccauggcaggaaggcuug

SEQ ID NO: 1459988 - RNA, 20 nt, Human
uuuuccaugcguguuucuga

SEQ ID NO: 1459989 - RNA, 13 nt, Human
uuuuccucccuca

SEQ ID NO: 1459990 - RNA, 11 nt, Human
uuuuccuauau

SEQ ID NO: 1459991 - RNA, 17 nt, Human
uuuucccacuccaagcc

SEQ ID NO: 1459992 - RNA, 12 nt, Human
uuuucccacgag

SEQ ID NO: 1459993 - RNA, 20 nt, Human
uuuucccaaagcaucccucu

SEQ ID NO: 1459994 - RNA, 18 nt, Human
uuuucccaaaauguugaa

SEQ ID NO: 1459995 - RNA, 16 nt, Human
uuuuccuccugagugc

SEQ ID NO: 1459996 - RNA, 13 nt, Human
uuuuccugaaaac

SEQ ID NO: 1459997 - RNA, 15 nt, Human
uuuuaucccaaaguu

SEQ ID NO: 1459998 - RNA, 19 nt, Human
uuuuaucauuuucaaaaug

SEQ ID NO: 1459999 - RNA, 19 nt, Human
uuuuaucgucacugcuuaa

SEQ ID NO: 1460000 - RNA, 18 nt, Human
uuuuaucgucacugcuua

SEQ ID NO: 1460001 - RNA, 16 nt, Human
uuuuaugauacuugaa

SEQ ID NO: 1460002 - RNA, 20 nt, Human
uuuuaugauacuugaaaauu

SEQ ID NO: 1460003 - RNA, 16 nt, Human
uuuuaucaugcauguc

SEQ ID NO: 1460004 - RNA, 12 nt, Human
uuuuaucaguag

SEQ ID NO: 1460005 - RNA, 21 nt, Human
uuuuauauuaaccagauauau

SEQ ID NO: 1460006 - RNA, 20 nt, Human
uuuuauauuaaccagauaua

SEQ ID NO: 1460007 - RNA, 10 nt, Human
uuuuauauuu

SEQ ID NO: 1460008 - RNA, 15 nt, Human
uuuuauauauuauau

SEQ ID NO: 1460009 - RNA, 12 nt, Human
uuuuauauauua

SEQ ID NO: 1460010 - RNA, 13 nt, Human
uuuuauaucccau

SEQ ID NO: 1460011 - RNA, 20 nt, Human
uuuuauaugcuucuguuuua

SEQ ID NO: 1460012 - RNA, 15 nt, Human
uuuuauaugcuucug

SEQ ID NO: 1460013 - RNA, 16 nt, Human
uuuuacugcucugaga

SEQ ID NO: 1460014 - RNA, 16 nt, Human
uuuuacucugccuaca

SEQ ID NO: 1460015 - RNA, 22 nt, Human
uuuuacucugccuacagaacuu

SEQ ID NO: 1460016 - RNA, 14 nt, Human
uuuuacucugccua

SEQ ID NO: 1460017 - RNA, 13 nt, Human
uuuuacucugccu

SEQ ID NO: 1460018 - RNA, 11 nt, Human
uuuuauauaua

SEQ ID NO: 1460019 - RNA, 14 nt, Human
uuuuacuguacaga

SEQ ID NO: 1460020 - RNA, 21 nt, Human
uuuuaauuugguuuucacauu

SEQ ID NO: 1460021 - RNA, 17 nt, Human
uuuuaauuugguuuuca

SEQ ID NO: 1460022 - RNA, 22 nt, Human
uuuuacauaaauuuaguauuuu

SEQ ID NO: 1460023 - RNA, 12 nt, Human
uuuuacucugcc

SEQ ID NO: 1460024 - RNA, 17 nt, Human
uuuuacuauuguuacau

SEQ ID NO: 1460025 - RNA, 14 nt, Human
uuuuacaugaagua

SEQ ID NO: 1460026 - RNA, 12 nt, Human
uuuuacaugaag

SEQ ID NO: 1460027 - RNA, 11 nt, Human
uuuuacaugaa

SEQ ID NO: 1460028 - RNA, 18 nt, Human
uuuuacaugaaguauuuu

SEQ ID NO: 1460029 - RNA, 15 nt, Human
uuuuacaugaaguau

SEQ ID NO: 1460030 - RNA, 13 nt, Human
uuuuacauuaaau

SEQ ID NO: 1460031 - RNA, 22 nt, Human
uuuguuuaauuuuuauuucuuc

SEQ ID NO: 1460032 - RNA, 21 nt, Human
uuuguuuaauuuuuauuucuu

SEQ ID NO: 1460033 - RNA, 14 nt, Human
uuuguuuaaaaagu

SEQ ID NO: 1460034 - RNA, 20 nt, Human
uuuguuuaaaaaguaauaaa

SEQ ID NO: 1460035 - RNA, 14 nt, Human
uuuguuuaaaaagg

SEQ ID NO: 1460036 - RNA, 21 nt, Human
uuuguuuaugguaaaaaauuu

SEQ ID NO: 1460037 - RNA, 15 nt, Human
uuuguuuauguaauu

SEQ ID NO: 1460038 - RNA, 15 nt, Human
uuuuaaaaugagaaa

SEQ ID NO: 1460039 - RNA, 20 nt, Human
uuuuaaaauuuguucuugua

SEQ ID NO: 1460040 - RNA, 15 nt, Human
uuuuaaaauuuguuc

SEQ ID NO: 1460041 - RNA, 11 nt, Human
uuuuaaaauuu

SEQ ID NO: 1460042 - RNA, 13 nt, Human
uuuuaaaauguac

SEQ ID NO: 1460043 - RNA, 14 nt, Human
uuuuaaaauguaca

SEQ ID NO: 1460044 - RNA, 22 nt, Human
uuuuaaaaugagaaaucuaaaa

SEQ ID NO: 1460045 - RNA, 22 nt, Human
uuugucaugcugggauuuccaa

SEQ ID NO: 1460046 - RNA, 20 nt, Human
uuugucauuagccugaguag

SEQ ID NO: 1460047 - RNA, 23 nt, Human
uuugucauuagccugaguagaaa

SEQ ID NO: 1460048 - RNA, 17 nt, Human
uuuguguucuguuuugu

SEQ ID NO: 1460049 - RNA, 13 nt, Human
uuuguguucuguu

SEQ ID NO: 1460050 - RNA, 12 nt, Human
uuugucccaggu

SEQ ID NO: 1460051 - RNA, 16 nt, Human
uuuguuauuuugcaac

SEQ ID NO: 1460052 - RNA, 21 nt, Human
uuuguuaauuuagaaaacuuu

SEQ ID NO: 1460053 - RNA, 12 nt, Human
uuuguuaauuua

SEQ ID NO: 1460054 - RNA, 15 nt, Human
uuuguucccaagagc

SEQ ID NO: 1460055 - RNA, 19 nt, Human
uuuguuccccacuggagca

SEQ ID NO: 1460056 - RNA, 17 nt, Human
uuuguuccccacuggag

SEQ ID NO: 1460057 - RNA, 13 nt, Human
uuugguguauggu

SEQ ID NO: 1460058 - RNA, 12 nt, Human
uuugguguaugg

SEQ ID NO: 1460059 - RNA, 17 nt, Human
uuuggaauacuuuuugu

SEQ ID NO: 1460060 - RNA, 15 nt, Human
uuuggaauacuuuuu

SEQ ID NO: 1460061 - RNA, 13 nt, Human
uuuggaauacuuu

SEQ ID NO: 1460062 - RNA, 11 nt, Human
uuuggaaggag

SEQ ID NO: 1460063 - RNA, 19 nt, Human
uuuggaaguuuagcucuga

SEQ ID NO: 1460064 - RNA, 20 nt, Human
uuugguuaugaauacuuugc

SEQ ID NO: 1460065 - RNA, 15 nt, Human
uuuguaaauuaacuu

SEQ ID NO: 1460066 - RNA, 16 nt, Human
uuuguaaauuaacuuu

SEQ ID NO: 1460067 - RNA, 17 nt, Human
uuuguaaauuaacuuuu

SEQ ID NO: 1460068 - RNA, 21 nt, Human
uuuguauaauuggauuuccua

SEQ ID NO: 1460069 - RNA, 13 nt, Human
uuuguauaauugg

SEQ ID NO: 1460070 - RNA, 21 nt, Human
uuuguauaaaauaauuuuuau

SEQ ID NO: 1460071 - RNA, 22 nt, Human
uuuguaaauuaacuuuuauaaa

SEQ ID NO: 1460072 - RNA, 21 nt, Human
uuugucagggaguguucccua

SEQ ID NO: 1460073 - RNA, 22 nt, Human
uuugucagaacuagaauuugau

SEQ ID NO: 1460074 - RNA, 20 nt, Human
uuugucagaacuagaauuug

SEQ ID NO: 1460075 - RNA, 15 nt, Human
uuugucacuuuuucu

SEQ ID NO: 1460076 - RNA, 14 nt, Human
uuugucacuuuuuc

SEQ ID NO: 1460077 - RNA, 23 nt, Human
uuugcauaguaccaaucauuuua

SEQ ID NO: 1460078 - RNA, 22 nt, Human
uuugccaugacaacuucuaauu

SEQ ID NO: 1460079 - RNA, 21 nt, Human
uuuggaaccagacucuugccu

SEQ ID NO: 1460080 - RNA, 13 nt, Human
uuuggaaccuugu

SEQ ID NO: 1460081 - RNA, 12 nt, Human
uuuggaagaagg

SEQ ID NO: 1460082 - RNA, 14 nt, Human
uuuggaaccuuguu

SEQ ID NO: 1460083 - RNA, 18 nt, Human
uuuggaacccuaaauaau

SEQ ID NO: 1460084 - RNA, 21 nt, Human
uuugauagauuuucugcuacu

SEQ ID NO: 1460085 - RNA, 23 nt, Human
uuugauauagaaguauaaagaau

SEQ ID NO: 1460086 - RNA, 21 nt, Human
uuugauacuaagcauugaaug

SEQ ID NO: 1460087 - RNA, 16 nt, Human
uuugcagcgacuggca

SEQ ID NO: 1460088 - RNA, 11 nt, Human
uuugcagcuuu

SEQ ID NO: 1460089 - RNA, 19 nt, Human
uuugcauaacguauaaaag

SEQ ID NO: 1460090 - RNA, 23 nt, Human
uuugcauaacguauaaaagccug

SEQ ID NO: 1460091 - RNA, 18 nt, Human
uuugauacuaagcauuga

SEQ ID NO: 1460092 - RNA, 17 nt, Human
uuugauacuaagcauug

SEQ ID NO: 1460093 - RNA, 16 nt, Human
uuugauacuaagcauu

SEQ ID NO: 1460094 - RNA, 14 nt, Human
uuugauacauuuuu

SEQ ID NO: 1460095 - RNA, 15 nt, Human
uuugagcuuaaucuu

SEQ ID NO: 1460096 - RNA, 22 nt, Human
uuugaggucuguucuuuccaaa

SEQ ID NO: 1460097 - RNA, 21 nt, Human
uuucuuaacuucuugcuucuu

SEQ ID NO: 1460098 - RNA, 18 nt, Human
uuucuuaacuucuugcuu

SEQ ID NO: 1460099 - RNA, 17 nt, Human
uuucuuaacuucuugcu

SEQ ID NO: 1460100 - RNA, 16 nt, Human
uuucugaguuccugca

SEQ ID NO: 1460101 - RNA, 21 nt, Human
uuucugaggugcacugggagg

SEQ ID NO: 1460102 - RNA, 17 nt, Human
uuucugaggcuuuauga

SEQ ID NO: 1460103 - RNA, 14 nt, Human
uuucuuagaaauuu

SEQ ID NO: 1460104 - RNA, 22 nt, Human
uuucuuagaaauuuauuuccua

SEQ ID NO: 1460105 - RNA, 22 nt, Human
uuucuuacugucuuuuuucuaa

SEQ ID NO: 1460106 - RNA, 19 nt, Human
uuuccaaaaucucccauuu

SEQ ID NO: 1460107 - RNA, 20 nt, Human
uuuccagcauucccagguag

SEQ ID NO: 1460108 - RNA, 18 nt, Human
uuuccagcauucccaggu

SEQ ID NO: 1460109 - RNA, 17 nt, Human
uuuccagcauucccagg

SEQ ID NO: 1460110 - RNA, 19 nt, Human
uuuccagaggcuauuauuu

SEQ ID NO: 1460111 - RNA, 12 nt, Human
uuuccaaaguac

SEQ ID NO: 1460112 - RNA, 15 nt, Human
uuuccaaaguacacu

SEQ ID NO: 1460113 - RNA, 19 nt, Human
uuucaggcauuggauauuu

SEQ ID NO: 1460114 - RNA, 16 nt, Human
uuucaggaucuauuuu

SEQ ID NO: 1460115 - RNA, 14 nt, Human
uuucaggaucuauu

SEQ ID NO: 1460116 - RNA, 13 nt, Human
uuucaggaucuau

SEQ ID NO: 1460117 - RNA, 19 nt, Human
uuucagggagguggcuggg

SEQ ID NO: 1460118 - RNA, 22 nt, Human
uuucagggagguggcuggguuu

SEQ ID NO: 1460119 - RNA, 21 nt, Human
uuucauuccuucagauuuggc

SEQ ID NO: 1460120 - RNA, 13 nt, Human
uuucauuccuuca

SEQ ID NO: 1460121 - RNA, 22 nt, Human
uuucaggaggaauacugaacau

SEQ ID NO: 1460122 - RNA, 21 nt, Human
uuucaggaggaauacugaaca

SEQ ID NO: 1460123 - RNA, 19 nt, Human
uuucaggaggaauacugaa

SEQ ID NO: 1460124 - RNA, 18 nt, Human
uuucaggaggaauacuga

SEQ ID NO: 1460125 - RNA, 12 nt, Human
uuucaggaggaa

SEQ ID NO: 1460126 - RNA, 22 nt, Human
uuucaggagagaguugaaccua

SEQ ID NO: 1460127 - RNA, 16 nt, Human
uuuauuucugcauaug

SEQ ID NO: 1460128 - RNA, 13 nt, Human
uuuauuuccuccc

SEQ ID NO: 1460129 - RNA, 20 nt, Human
uuuauuucauuuuucaauag

SEQ ID NO: 1460130 - RNA, 18 nt, Human
uuuauuuguugagagugu

SEQ ID NO: 1460131 - RNA, 12 nt, Human
uuuauuuguuga

SEQ ID NO: 1460132 - RNA, 22 nt, Human
uuucagaguucuuuuugaagua

SEQ ID NO: 1460133 - RNA, 18 nt, Human
uuucagaguucuuuuuga

SEQ ID NO: 1460134 - RNA, 23 nt, Human
uuucagaguucuuuuugaaguau

SEQ ID NO: 1460135 - RNA, 21 nt, Human
uuucagauaaucacaauacau

SEQ ID NO: 1460136 - RNA, 15 nt, Human
uuucagcagcugcag

SEQ ID NO: 1460137 - RNA, 14 nt, Human
uuuauuuguugaga

SEQ ID NO: 1460138 - RNA, 13 nt, Human
uuuauuuguugag

SEQ ID NO: 1460139 - RNA, 22 nt, Human
uuucagagugacuacacacagu

SEQ ID NO: 1460140 - RNA, 13 nt, Human
uuucagagccucc

SEQ ID NO: 1460141 - RNA, 15 nt, Human
uuucagauaaucaca

SEQ ID NO: 1460142 - RNA, 19 nt, Human
uuucuaagcauaaaagaug

SEQ ID NO: 1460143 - RNA, 18 nt, Human
uuucuaagauucuaaagg

SEQ ID NO: 1460144 - RNA, 17 nt, Human
uuucuaagauucuaaag

SEQ ID NO: 1460145 - RNA, 15 nt, Human
uuucuaagauucuaa

SEQ ID NO: 1460146 - RNA, 14 nt, Human
uuucuaagauucua

SEQ ID NO: 1460147 - RNA, 13 nt, Human
uuucuaagauucu

SEQ ID NO: 1460148 - RNA, 14 nt, Human
uuucuaagaaacau

SEQ ID NO: 1460149 - RNA, 17 nt, Human
uuucuaagaaacauuua

SEQ ID NO: 1460150 - RNA, 22 nt, Human
uuucuaacuacaaagguuuaaa

SEQ ID NO: 1460151 - RNA, 20 nt, Human
uuucuaacuacaaagguuua

SEQ ID NO: 1460152 - RNA, 18 nt, Human
uuucuaacuacaaagguu

SEQ ID NO: 1460153 - RNA, 21 nt, Human
uuucuaaaggaguuuauguuc

SEQ ID NO: 1460154 - RNA, 18 nt, Human
uuucuaaaggcuaccuuu

SEQ ID NO: 1460155 - RNA, 16 nt, Human
uuucuaaaggaguuua

SEQ ID NO: 1460156 - RNA, 14 nt, Human
uuucuaaaggaguu

SEQ ID NO: 1460157 - RNA, 14 nt, Human
uuucuaaaggcuac

SEQ ID NO: 1460158 - RNA, 23 nt, Human
uuuccaggcuucugcuggggccu

SEQ ID NO: 1460159 - RNA, 19 nt, Human
uuuccaggcuucugcuggg

SEQ ID NO: 1460160 - RNA, 18 nt, Human
uuuccaggcuucugcugg

SEQ ID NO: 1460161 - RNA, 16 nt, Human
uuuccaggcuucugcu

SEQ ID NO: 1460162 - RNA, 23 nt, Human
uuuccuagcccucucacauuuau

SEQ ID NO: 1460163 - RNA, 21 nt, Human
uuuccuaguucuguagaaaug

SEQ ID NO: 1460164 - RNA, 17 nt, Human
uuuccuagcccucucac

SEQ ID NO: 1460165 - RNA, 15 nt, Human
uuuccuaugcuuuga

SEQ ID NO: 1460166 - RNA, 22 nt, Human
uuuccucuucuauuuuguaaac

SEQ ID NO: 1460167 - RNA, 21 nt, Human
uuuccucuucuauuuuguaaa

SEQ ID NO: 1460168 - RNA, 17 nt, Human
uuuccuaugggaacaau

SEQ ID NO: 1460169 - RNA, 15 nt, Human
uuuccuaugggaaca

SEQ ID NO: 1460170 - RNA, 21 nt, Human
uuuccugaaacaacuuggaaa

SEQ ID NO: 1460171 - RNA, 20 nt, Human
uuucuaagcauaaaagauga

SEQ ID NO: 1460172 - RNA, 15 nt, Human
uuucuccucccagga

SEQ ID NO: 1460173 - RNA, 14 nt, Human
uuucuccuccaugg

SEQ ID NO: 1460174 - RNA, 16 nt, Human
uuucuaggacugaauu

SEQ ID NO: 1460175 - RNA, 20 nt, Human
uuucucuuucccuggucccu

SEQ ID NO: 1460176 - RNA, 17 nt, Human
uuucucuuuccaugaca

SEQ ID NO: 1460177 - RNA, 22 nt, Human
uuucuccuuuaauuguaaagua

SEQ ID NO: 1460178 - RNA, 19 nt, Human
uuucuccuuuaauuguaaa

SEQ ID NO: 1460179 - RNA, 18 nt, Human
uuucuccuuuaauuguaa

SEQ ID NO: 1460180 - RNA, 18 nt, Human
uuuauuguauucuggggu

SEQ ID NO: 1460181 - RNA, 14 nt, Human
uuuauuguauucug

SEQ ID NO: 1460182 - RNA, 16 nt, Human
uuuauuguguuuguca

SEQ ID NO: 1460183 - RNA, 17 nt, Human
uuuauuguguuugucau

SEQ ID NO: 1460184 - RNA, 21 nt, Human
uuuauuguguuugucauuagc

SEQ ID NO: 1460185 - RNA, 22 nt, Human
uuuauuguguuugucauuagcc

SEQ ID NO: 1460186 - RNA, 13 nt, Human
uuuauuguauucu

SEQ ID NO: 1460187 - RNA, 23 nt, Human
uuuauugguuuugcagaagaagg

SEQ ID NO: 1460188 - RNA, 17 nt, Human
uuuauugguuuugcaga

SEQ ID NO: 1460189 - RNA, 15 nt, Human
uuuauugguuuugca

SEQ ID NO: 1460190 - RNA, 16 nt, Human
uuuauuggcugagaua

SEQ ID NO: 1460191 - RNA, 23 nt, Human
uuuauuccagaaugcuguacauc

SEQ ID NO: 1460192 - RNA, 22 nt, Human
uuuauuccagaaugcuguacau

SEQ ID NO: 1460193 - RNA, 19 nt, Human
uuuauuccagaaugcugua

SEQ ID NO: 1460194 - RNA, 18 nt, Human
uuuauuccagaaugcugu

SEQ ID NO: 1460195 - RNA, 14 nt, Human
uuuaugcauauuau

SEQ ID NO: 1460196 - RNA, 13 nt, Human
uuuauucaauaaa

SEQ ID NO: 1460197 - RNA, 21 nt, Human
uuuagagauaagaguuggcug

SEQ ID NO: 1460198 - RNA, 16 nt, Human
uuuagaguuagacugu

SEQ ID NO: 1460199 - RNA, 17 nt, Human
uuuagaguuagacuguu

SEQ ID NO: 1460200 - RNA, 22 nt, Human
uuuauaaaaguguucauuguuu

SEQ ID NO: 1460201 - RNA, 18 nt, Human
uuuagaguugauacuaca

SEQ ID NO: 1460202 - RNA, 18 nt, Human
uuuagaguuagacuguug

SEQ ID NO: 1460203 - RNA, 14 nt, Human
uuuauaaacuuuac

SEQ ID NO: 1460204 - RNA, 16 nt, Human
uuuauaaacuuuaccu

SEQ ID NO: 1460205 - RNA, 21 nt, Human
uuuaucgucacugcuuaacuu

SEQ ID NO: 1460206 - RNA, 18 nt, Human
uuuauaaacuuuaccuuu

SEQ ID NO: 1460207 - RNA, 19 nt, Human
uuuaugaaaaagaagaauc

SEQ ID NO: 1460208 - RNA, 12 nt, Human
uuuaucuuuuua

SEQ ID NO: 1460209 - RNA, 18 nt, Human
uuuaucuuuauaugaaga

SEQ ID NO: 1460210 - RNA, 20 nt, Human
uuuaucuauaauuuaccuaa

SEQ ID NO: 1460211 - RNA, 19 nt, Human
uuuaucuauaauuuaccua

SEQ ID NO: 1460212 - RNA, 14 nt, Human
uuuaucuauaauuu

SEQ ID NO: 1460213 - RNA, 16 nt, Human
uuuaucuuuuuaccuu

SEQ ID NO: 1460214 - RNA, 22 nt, Human
uuguauuuaacagaaauuguau

SEQ ID NO: 1460215 - RNA, 18 nt, Human
uuguauuuaacagaaauu

SEQ ID NO: 1460216 - RNA, 17 nt, Human
uuguauuuaacagaaau

SEQ ID NO: 1460217 - RNA, 13 nt, Human
uuguauuuaacag

SEQ ID NO: 1460218 - RNA, 18 nt, Human
uuguauuguugaaaaagu

SEQ ID NO: 1460219 - RNA, 16 nt, Human
uuguauuguuucaauu

SEQ ID NO: 1460220 - RNA, 14 nt, Human
uuguauuuauucaa

SEQ ID NO: 1460221 - RNA, 15 nt, Human
uuguauuuauucaau

SEQ ID NO: 1460222 - RNA, 16 nt, Human
uuguauuuauucaaua

SEQ ID NO: 1460223 - RNA, 20 nt, Human
uuguauuuauucaauaaagu

SEQ ID NO: 1460224 - RNA, 22 nt, Human
uuguauucucugagcugugcag

SEQ ID NO: 1460225 - RNA, 20 nt, Human
uuguauucucugagcugugc

SEQ ID NO: 1460226 - RNA, 16 nt, Human
uuguauucucugagcu

SEQ ID NO: 1460227 - RNA, 15 nt, Human
uuguauucucugagc

SEQ ID NO: 1460228 - RNA, 14 nt, Human
uuguauucucugag

SEQ ID NO: 1460229 - RNA, 15 nt, Human
uuguauuguuucaau

SEQ ID NO: 1460230 - RNA, 13 nt, Human
uuguauuguugaa

SEQ ID NO: 1460231 - RNA, 18 nt, Human
uuguauuguauauuacaa

SEQ ID NO: 1460232 - RNA, 19 nt, Human
uuguauuguauauuacaau

SEQ ID NO: 1460233 - RNA, 15 nt, Human
uuuaauccccaguaa

SEQ ID NO: 1460234 - RNA, 16 nt, Human
uuuaauccccaguaaa

SEQ ID NO: 1460235 - RNA, 22 nt, Human
uuuaauccccaguaaaauugcc

SEQ ID NO: 1460236 - RNA, 19 nt, Human
uuuacaauguaauuauuua

SEQ ID NO: 1460237 - RNA, 19 nt, Human
uuuacaauuuuuuaucaug

SEQ ID NO: 1460238 - RNA, 17 nt, Human
uuuacauggcuggagcu

SEQ ID NO: 1460239 - RNA, 16 nt, Human
uuuacaaguaacaaaa

SEQ ID NO: 1460240 - RNA, 17 nt, Human
uuuacaauguaauuauu

SEQ ID NO: 1460241 - RNA, 16 nt, Human
uuuacaauguaauuau

SEQ ID NO: 1460242 - RNA, 15 nt, Human
uuuacaauguaauua

SEQ ID NO: 1460243 - RNA, 17 nt, Human
uuuacaauaguucugug

SEQ ID NO: 1460244 - RNA, 18 nt, Human
uuuacuuuagaagccugc

SEQ ID NO: 1460245 - RNA, 12 nt, Human
uuuacauguuuu

SEQ ID NO: 1460246 - RNA, 22 nt, Human
uuuacauggcuggagcuagaau

SEQ ID NO: 1460247 - RNA, 13 nt, Human
uuuacuuuuguuu

SEQ ID NO: 1460248 - RNA, 16 nt, Human
uuuacuuuuaaacugu

SEQ ID NO: 1460249 - RNA, 15 nt, Human
uuuacuuuuaaacug

SEQ ID NO: 1460250 - RNA, 18 nt, Human
uuuacuuuuaaacaguga

SEQ ID NO: 1460251 - RNA, 15 nt, Human
uuuacuuuuaaacag

SEQ ID NO: 1460252 - RNA, 12 nt, Human
uuuagaaacaca

SEQ ID NO: 1460253 - RNA, 22 nt, Human
uuuagaaacagugcaacacugg

SEQ ID NO: 1460254 - RNA, 16 nt, Human
uuuagaaaacuuuaaa

SEQ ID NO: 1460255 - RNA, 15 nt, Human
uuuagaaaacuuuaa

SEQ ID NO: 1460256 - RNA, 14 nt, Human
uuuagaaaacuuua

SEQ ID NO: 1460257 - RNA, 13 nt, Human
uuuagaaaacuuu

SEQ ID NO: 1460258 - RNA, 12 nt, Human
uuuagaaaacuu

SEQ ID NO: 1460259 - RNA, 20 nt, Human
uuuagaaacacaacuauauu

SEQ ID NO: 1460260 - RNA, 22 nt, Human
uuuagagauaagaguuggcugg

SEQ ID NO: 1460261 - RNA, 15 nt, Human
uuuagacuuuaacau

SEQ ID NO: 1460262 - RNA, 22 nt, Human
uuuagacuuggauucuuuccau

SEQ ID NO: 1460263 - RNA, 21 nt, Human
uuuagacuuggauucuuucca

SEQ ID NO: 1460264 - RNA, 22 nt, Human
uuuagaagccaacuaugauuau

SEQ ID NO: 1460265 - RNA, 14 nt, Human
uuuagaagccaacu

SEQ ID NO: 1460266 - RNA, 15 nt, Human
uuuagacuucaagca

SEQ ID NO: 1460267 - RNA, 19 nt, Human
uuuagaaucccagcccccu

SEQ ID NO: 1460268 - RNA, 14 nt, Human
uuuagaaucccagc

SEQ ID NO: 1460269 - RNA, 14 nt, Human
uuuagaagccugca

SEQ ID NO: 1460270 - RNA, 17 nt, Human
uuuagaauaugccuugu

SEQ ID NO: 1460271 - RNA, 13 nt, Human
uuuuuuaugcuaa

SEQ ID NO: 1460272 - RNA, 15 nt, Human
uuuuuuauauaugug

SEQ ID NO: 1460273 - RNA, 13 nt, Human
uuuuuuaguugaa

SEQ ID NO: 1460274 - RNA, 13 nt, Human
uuuuuucguuugu

SEQ ID NO: 1460275 - RNA, 16 nt, Human
uuuuuuaugcuaauca

SEQ ID NO: 1460276 - RNA, 12 nt, Human
uuuuuucugaaa

SEQ ID NO: 1460277 - RNA, 12 nt, Human
uuuuuuaggaaa

SEQ ID NO: 1460278 - RNA, 14 nt, Human
uuuuuuacuuuugu

SEQ ID NO: 1460279 - RNA, 23 nt, Human
uuuuuuagaaagcauuugaaugc

SEQ ID NO: 1460280 - RNA, 16 nt, Human
uuuuucuucacugcaa

SEQ ID NO: 1460281 - RNA, 20 nt, Human
uuuuuuauacaggaugauga

SEQ ID NO: 1460282 - RNA, 13 nt, Human
uuuuucuguauaa

SEQ ID NO: 1460283 - RNA, 16 nt, Human
uuuuucuguaccaguu

SEQ ID NO: 1460284 - RNA, 14 nt, Human
uuuuucuguaccag

SEQ ID NO: 1460285 - RNA, 12 nt, Human
uuuugaaagaau

SEQ ID NO: 1460286 - RNA, 17 nt, Human
uuuugaaagucuguccu

SEQ ID NO: 1460287 - RNA, 20 nt, Human
uuuugaaaagcagacauuuu

SEQ ID NO: 1460288 - RNA, 13 nt, Human
uuuuuucuuacug

SEQ ID NO: 1460289 - RNA, 16 nt, Human
ggcuaggguggggaga

SEQ ID NO: 1460290 - RNA, 11 nt, Human
ggacuugggug

SEQ ID NO: 1460291 - RNA, 21 nt, Human
ggugucucuucuuuagaacag

SEQ ID NO: 1460292 - RNA, 15 nt, Human
gcuccccuggggagu

SEQ ID NO: 1460293 - RNA, 23 nt, Human
gcugcucggggugcacaggaggg

SEQ ID NO: 1460294 - RNA, 22 nt, Human
cccacccaggaguauccucuug

SEQ ID NO: 1460295 - RNA, 15 nt, Human
cccuuccuggacagc

SEQ ID NO: 1460296 - RNA, 22 nt, Human
cgcagacacacccacagaagga

SEQ ID NO: 1460297 - RNA, 14 nt, Human
ccuguguggacagg

SEQ ID NO: 1460298 - RNA, 22 nt, Human
gaacauaucuuagauggggagc

SEQ ID NO: 1460299 - RNA, 20 nt, Human
gaaccuggaacuuggggagu

SEQ ID NO: 1460300 - RNA, 13 nt, Human
gaaguguggggau

SEQ ID NO: 1460301 - RNA, 21 nt, Human
gaggcagggaacauggggagg

SEQ ID NO: 1460302 - RNA, 12 nt, Human
gcagcaggaggg

SEQ ID NO: 1460303 - RNA, 17 nt, Human
gaguggggguggggggu

SEQ ID NO: 1460304 - RNA, 17 nt, Human
gcacccucuccagauga

SEQ ID NO: 1460305 - RNA, 20 nt, Human
gacugcuguggccaggaggu

SEQ ID NO: 1460306 - RNA, 12 nt, Human
gauggggagcgu

SEQ ID NO: 1460307 - RNA, 15 nt, Human
gagaccacuugggcg

SEQ ID NO: 1460308 - RNA, 12 nt, Human
gagagggagacc

SEQ ID NO: 1460309 - RNA, 13 nt, Human
gcauuuuggucca

SEQ ID NO: 1460310 - RNA, 23 nt, Human
gcccagagccucgaggagguaau

SEQ ID NO: 1460311 - RNA, 21 nt, Human
cugggugacauuugggagaca

SEQ ID NO: 1460312 - RNA, 15 nt, Human
gaaaaaccuuggguu

SEQ ID NO: 1460313 - RNA, 15 nt, Human
guccaaagaggcugc

SEQ ID NO: 1460314 - RNA, 16 nt, Human
gugcgcccagggcugg

SEQ ID NO: 1460315 - RNA, 16 nt, Human
guggcuuugccaucgu

SEQ ID NO: 1460316 - RNA, 13 nt, Human
guggcacuugggg

SEQ ID NO: 1460317 - RNA, 21 nt, Human
gggcucaaucucugggggcug

SEQ ID NO: 1460318 - RNA, 14 nt, Human
ggagaggaguguga

SEQ ID NO: 1460319 - RNA, 20 nt, Human
gcuaagguguauuugguccu

SEQ ID NO: 1460320 - RNA, 21 nt, Human
ggagcucaggaaggggugugc

SEQ ID NO: 1460321 - RNA, 16 nt, Human
gcuuucuccaggagga

SEQ ID NO: 1460322 - RNA, 16 nt, Human
ggguugggcccagugu

SEQ ID NO: 1460323 - RNA, 16 nt, Human
gccacaccuuugucca

SEQ ID NO: 1460324 - RNA, 23 nt, Human
gcuaaaauaaagaaauagaacaa

SEQ ID NO: 1460325 - RNA, 23 nt, Human
guuggaaucacuguuuagaacac

SEQ ID NO: 1460326 - RNA, 19 nt, Human
uaccauuucagagaggccu

SEQ ID NO: 1460327 - RNA, 22 nt, Human
gugagaguaaugaggcuugggg

SEQ ID NO: 1460328 - RNA, 16 nt, Human
gugagguucuuggguu

SEQ ID NO: 1460329 - RNA, 15 nt, Human
ggacaaggaguguga

SEQ ID NO: 1460330 - RNA, 14 nt, Human
ggagcagaguguuc

SEQ ID NO: 1460331 - RNA, 23 nt, Human
guugcuuccguucauggaagcgc

SEQ ID NO: 1460332 - RNA, 16 nt, Human
ucagagaccagggcuc

SEQ ID NO: 1460333 - RNA, 14 nt, Human
ugccuugagguacu

SEQ ID NO: 1460334 - RNA, 14 nt, Human
ugucaggaggaacu

SEQ ID NO: 1460335 - RNA, 17 nt, Human
ucucagggugaggugcu

SEQ ID NO: 1460336 - RNA, 14 nt, Human
cgggaguggacagg

SEQ ID NO: 1460337 - RNA, 15 nt, Human
gaaguaacuacaguu

SEQ ID NO: 1460338 - RNA, 19 nt, Human
gagaaagcugacuuggcug

SEQ ID NO: 1460339 - RNA, 23 nt, Human
gacugcaacaggaacuuggagug

SEQ ID NO: 1460340 - RNA, 15 nt, Human
gacugucuggggagc

SEQ ID NO: 1460341 - RNA, 15 nt, Human
gaugauacuuggaug

SEQ ID NO: 1460342 - RNA, 18 nt, Human
gaugauauaaugcgggug

SEQ ID NO: 1460343 - RNA, 16 nt, Human
gaugccuggcggggug

SEQ ID NO: 1460344 - RNA, 19 nt, Human
gccagcccugccuggagga

SEQ ID NO: 1460345 - RNA, 15 nt, Human
gccacagcuugggug

SEQ ID NO: 1460346 - RNA, 14 nt, Human
uggccaagcggcca

SEQ ID NO: 1460347 - RNA, 19 nt, Human
gcauuuggguccaggagga

SEQ ID NO: 1460348 - RNA, 12 nt, Human
gcagagggcugg

SEQ ID NO: 1460349 - RNA, 22 nt, Human
gagcuggcccucuccuggggau

SEQ ID NO: 1460350 - RNA, 14 nt, Human
gaggcuuggggcug

SEQ ID NO: 1460351 - RNA, 18 nt, Human
gagagaaggaggggagca

SEQ ID NO: 1460352 - RNA, 14 nt, Human
gaaggacaggagga

SEQ ID NO: 1460353 - RNA, 19 nt, Human
gaagucucaucuggggagc

SEQ ID NO: 1460354 - RNA, 16 nt, Human
gccaguaauugguccg

SEQ ID NO: 1460355 - RNA, 21 nt, Human
gccacacacagaaaaggcugc

SEQ ID NO: 1460356 - RNA, 14 nt, Human
gccugccaggagga

SEQ ID NO: 1460357 - RNA, 15 nt, Human
cggggcucaggaggg

SEQ ID NO: 1460358 - RNA, 16 nt, Human
cuccagcugccccggc

SEQ ID NO: 1460359 - RNA, 22 nt, Human
cuccaggcccaaggcucccgga

SEQ ID NO: 1460360 - RNA, 16 nt, Human
cugaguagggggagca

SEQ ID NO: 1460361 - RNA, 21 nt, Human
cugcaagcuccgccucccggg

SEQ ID NO: 1460362 - RNA, 22 nt, Human
auaacaagacuuugacuugggg

SEQ ID NO: 1460363 - RNA, 18 nt, Human
aagugcaagauggggagu

SEQ ID NO: 1460364 - RNA, 13 nt, Human
agcuucaggaggg

SEQ ID NO: 1460365 - RNA, 22 nt, Human
ccaagcugaggugcccaggaga

SEQ ID NO: 1460366 - RNA, 22 nt, Human
ccagagcccccgggaagggcgc

SEQ ID NO: 1460367 - RNA, 17 nt, Human
augcccaauuagggccu

SEQ ID NO: 1460368 - RNA, 19 nt, Human
ccaggcugcucagggcugg

SEQ ID NO: 1460369 - RNA, 14 nt, Human
cacugccaggaggg

SEQ ID NO: 1460370 - RNA, 22 nt, Human
cccagcccugcagcaaggagga

SEQ ID NO: 1460371 - RNA, 19 nt, Human
cccucaggucccuugguca

SEQ ID NO: 1460372 - RNA, 15 nt, Human
ccgccuguggacagc

SEQ ID NO: 1460373 - RNA, 18 nt, Human
cgcaggugcacaggggga

SEQ ID NO: 1460374 - RNA, 23 nt, Human
cuccccaccuucccucucccggc

SEQ ID NO: 1460375 - RNA, 17 nt, Human
cugccaacacgcccggc

SEQ ID NO: 1460376 - RNA, 15 nt, Human
cuggcaugggagacc

SEQ ID NO: 1460377 - RNA, 14 nt, Human
cgaggaggggagaa

SEQ ID NO: 1460378 - RNA, 17 nt, Human
gugggagccagggcugu

SEQ ID NO: 1460379 - RNA, 16 nt, Human
uccccacgagggcugg

SEQ ID NO: 1460380 - RNA, 14 nt, Human
accucuuggggagu

SEQ ID NO: 1460381 - RNA, 13 nt, Hepatitis D virus
cuacucccucucg

SEQ ID NO: 1460382 - RNA, 17 nt, Hepatitis D virus
gcgaugcgcucucuguu

SEQ ID NO: 1460383 - RNA, 14 nt, Hepatitis D virus
ugcuuuccuccucg

SEQ ID NO: 1460384 - RNA, 11 nt, Hepatitis D virus
cuuugcuuucc

SEQ ID NO: 1460385 - RNA, 13 nt, Hepatitis D virus
cuucuugcuuucu

SEQ ID NO: 1460386 - RNA, 13 nt, Hepatitis D virus
ucuuuccccuucc

SEQ ID NO: 1460387 - RNA, 20 nt, Hepatitis D virus
cucgcgguccgaccugggca

SEQ ID NO: 1460388 - RNA, 20 nt, Hepatitis D virus
gccucacucguccccucucg

SEQ ID NO: 1460389 - RNA, 11 nt, Hepatitis D virus
auuccugggcg

SEQ ID NO: 1460390 - RNA, 21 nt, Hepatitis D virus
agccucacucguccccucucg

SEQ ID NO: 1460391 - RNA, 19 nt, Hepatitis D virus
cuauggucuacucccucuc

SEQ ID NO: 1460392 - RNA, 13 nt, Hepatitis D virus
cccucugggguac

SEQ ID NO: 1460393 - RNA, 22 nt, Hepatitis D virus
ccugcagaguggggucccgcca

SEQ ID NO: 1460394 - RNA, 17 nt, Hepatitis D virus
uucucucugggaagcua

SEQ ID NO: 1460395 - RNA, 12 nt, Hepatitis D virus
gguccucuggag

SEQ ID NO: 1460396 - RNA, 19 nt, Hepatitis D virus
gccuccuucucuuccaccu

SEQ ID NO: 1460397 - RNA, 20 nt, Hepatitis D virus
gccgacccucccuccucucc

SEQ ID NO: 1460398 - RNA, 17 nt, Hepatitis D virus
cuuugcuuuccuccucg

SEQ ID NO: 1460399 - RNA, 15 nt, Hepatitis D virus
ucccauggcuccacu

SEQ ID NO: 1460400 - RNA, 19 nt, Hepatitis D virus
ucucgcgaugcgcucucug

SEQ ID NO: 1460401 - RNA, 13 nt, Hepatitis D virus
cccucuuuccccu

SEQ ID NO: 1460402 - RNA, 17 nt, Hepatitis D virus
acuccguguggcuuccu

SEQ ID NO: 1460403 - RNA, 13 nt, Hepatitis D virus
ugcuuuccuccuc

SEQ ID NO: 1460404 - RNA, 17 nt, Hepatitis D virus
ccgacccucccuccucu

SEQ ID NO: 1460405 - RNA, 16 nt, Hepatitis D virus
ccuagcauccccuccu

SEQ ID NO: 1460406 - RNA, 13 nt, Hepatitis D virus
acccucccuccuc

SEQ ID NO: 1460407 - RNA, 21 nt, Hepatitis D virus
ccgacucaccccucucgggcg

SEQ ID NO: 1460408 - RNA, 22 nt, Hepatitis D virus
cuacuccguguggcuuccuccc

SEQ ID NO: 1460409 - RNA, 21 nt, Hepatitis D virus
uccccgggauaagccucacuc

SEQ ID NO: 1460410 - RNA, 13 nt, Hepatitis D virus
cuccaccuccucg

SEQ ID NO: 1460411 - RNA, 15 nt, Hepatitis D virus
ccgacccucccuccu

SEQ ID NO: 1460412 - RNA, 19 nt, Hepatitis D virus
gaggacgcacguccacucg

SEQ ID NO: 1460413 - RNA, 12 nt, Hepatitis D virus
uccucuggaggu

SEQ ID NO: 1460414 - RNA, 22 nt, Hepatitis D virus
ccgcugcucucuuugcuuuccu

SEQ ID NO: 1460415 - RNA, 20 nt, Hepatitis D virus
agccucacucguccccucuc

SEQ ID NO: 1460416 - RNA, 19 nt, Hepatitis D virus
cucucuuugcuuuccuccu

SEQ ID NO: 1460417 - RNA, 21 nt, Hepatitis D virus
gcuauggucuacucccucucg

SEQ ID NO: 1460418 - RNA, 18 nt, Hepatitis D virus
cggaacacccaccugcua

SEQ ID NO: 1460419 - RNA, 13 nt, Hepatitis D virus
cccaacuccuagc

SEQ ID NO: 1460420 - RNA, 20 nt, Hepatitis D virus
cucucaacccuucgggccgg

SEQ ID NO: 1460421 - RNA, 23 nt, Hepatitis D virus
aauucauccgcuucuugcuuucu

SEQ ID NO: 1460422 - RNA, 22 nt, Hepatitis D virus
gggcgacccuuggggggaagga

SEQ ID NO: 1460423 - RNA, 21 nt, Hepatitis D virus
cucuggaggugauuucucugu

SEQ ID NO: 1460424 - RNA, 23 nt, Hepatitis D virus
cgacccuuggggggaaggagcuu

SEQ ID NO: 1460425 - RNA, 19 nt, Hepatitis D virus
cucacucguccccucucgg

SEQ ID NO: 1460426 - RNA, 17 nt, Hepatitis D virus
uggcuaagggagagcca

SEQ ID NO: 1460427 - RNA, 18 nt, Hepatitis D virus
cauggcaucuccaccucc

SEQ ID NO: 1460428 - RNA, 21 nt, Hepatitis D virus
cuuccaccuucccucuuuccc

SEQ ID NO: 1460429 - RNA, 16 nt, Hepatitis D virus
ccgccauuccugggcg

SEQ ID NO: 1460430 - RNA, 18 nt, Hepatitis D virus
cugaagggguccucugga

SEQ ID NO: 1460431 - RNA, 15 nt, Hepatitis D virus
cugaucuauccuccc

SEQ ID NO: 1460432 - RNA, 16 nt, Hepatitis D virus
cgacucaccccucucg

SEQ ID NO: 1460433 - RNA, 23 nt, Hepatitis D virus
uuccccgggauaagccucacucg

SEQ ID NO: 1460434 - RNA, 12 nt, Hepatitis D virus
ccuucucuucca

SEQ ID NO: 1460435 - RNA, 14 nt, Hepatitis D virus
cccgcugcucucuu

SEQ ID NO: 1460436 - RNA, 22 nt, Hepatitis D virus
gggaggcccgccuccuucucuu

SEQ ID NO: 1460437 - RNA, 21 nt, Hepatitis D virus
uucgcugaagggguccucugg

SEQ ID NO: 1460438 - RNA, 18 nt, Hepatitis D virus
cuuggccgccgggccccu

SEQ ID NO: 1460439 - RNA, 22 nt, Hepatitis D virus
cccuccuaucgcuauggucuac

SEQ ID NO: 1460440 - RNA, 21 nt, Hepatitis D virus
uguggcuuccucccucugggg

SEQ ID NO: 1460441 - RNA, 14 nt, Hepatitis D virus
cauccgaaggagga

SEQ ID NO: 1460442 - RNA, 16 nt, Hepatitis D virus
agcggguuuccacucg

SEQ ID NO: 1460443 - RNA, 22 nt, Hepatitis D virus
ccuucucuuccaccuucccucu

SEQ ID NO: 1460444 - RNA, 20 nt, Hepatitis D virus
ucgcugaagggguccucugg

SEQ ID NO: 1460445 - RNA, 20 nt, Hepatitis D virus
ccucucgcgaugcgcucucu

SEQ ID NO: 1460446 - RNA, 20 nt, Hepatitis D virus
caccugcuagccccgcugcu

SEQ ID NO: 1460447 - RNA, 23 nt, Hepatitis D virus
cuccguguggcuuccucccucug

SEQ ID NO: 1460448 - RNA, 19 nt, Hepatitis D virus
auaaagcggguuuccacuc

SEQ ID NO: 1460449 - RNA, 17 nt, Hepatitis D virus
ggcuuccucccucuggg

SEQ ID NO: 1460450 - RNA, 19 nt, Hepatitis D virus
agccucacucguccccucu

SEQ ID NO: 1460451 - RNA, 13 nt, Hepatitis D virus
gccuccuucucuu

SEQ ID NO: 1460452 - RNA, 21 nt, Hepatitis D virus
gcuucggucucccccaacucc

SEQ ID NO: 1460453 - RNA, 20 nt, Hepatitis D virus
ccaauguucaaagucacccc

SEQ ID NO: 1460454 - RNA, 14 nt, Hepatitis D virus
acucaccccucucg

SEQ ID NO: 1460455 - RNA, 15 nt, Hepatitis D virus
agggguccucuggag

SEQ ID NO: 1460456 - RNA, 12 nt, Hepatitis D virus
aguguccuccaa

SEQ ID NO: 1460457 - RNA, 20 nt, Hepatitis D virus
gcguccuucuuuccucuucg

SEQ ID NO: 1460458 - RNA, 20 nt, Hepatitis D virus
cccaccugcuagccccgcug

SEQ ID NO: 1460459 - RNA, 15 nt, Hepatitis D virus
ccguguggcuuccuc

SEQ ID NO: 1460460 - RNA, 18 nt, Hepatitis D virus
cagaguggggucccgcca

SEQ ID NO: 1460461 - RNA, 14 nt, Hepatitis D virus
uggcaucuccaccu

SEQ ID NO: 1460462 - RNA, 14 nt, Hepatitis D virus
gcaucuccaccucc

SEQ ID NO: 1460463 - RNA, 13 nt, Hepatitis D virus
cacccaccugcua

SEQ ID NO: 1460464 - RNA, 14 nt, Hepatitis D virus
gugauuucucuguu

SEQ ID NO: 1460465 - RNA, 13 nt, Hepatitis D virus
cgggagucugcua

SEQ ID NO: 1460466 - RNA, 20 nt, Hepatitis D virus
ccccucucgggcgcugaucu

SEQ ID NO: 1460467 - RNA, 20 nt, Hepatitis D virus
gagccacuuuucucucgcuu

SEQ ID NO: 1460468 - RNA, 21 nt, Hepatitis D virus
uucucucgcuucucucuggga

SEQ ID NO: 1460469 - RNA, 13 nt, Hepatitis D virus
caccuucccucuu

SEQ ID NO: 1460470 - RNA, 15 nt, Hepatitis D virus
aucuccaccuccucg

SEQ ID NO: 1460471 - RNA, 20 nt, Hepatitis D virus
aggggacgguccccucggaa

SEQ ID NO: 1460472 - RNA, 15 nt, Hepatitis D virus
cgaugcgcucucugu

SEQ ID NO: 1460473 - RNA, 19 nt, Hepatitis D virus
uacuccguguggcuuccuc

SEQ ID NO: 1460474 - RNA, 19 nt, Hepatitis D virus
acuccguguggcuuccucc

SEQ ID NO: 1460475 - RNA, 15 nt, Hepatitis D virus
guccuucuuuccucu

SEQ ID NO: 1460476 - RNA, 21 nt, Hepatitis D virus
cguguggcuuccucccucugg

SEQ ID NO: 1460477 - RNA, 18 nt, Hepatitis D virus
gccgccgggccccucgga

SEQ ID NO: 1460478 - RNA, 13 nt, Hepatitis D virus
gacccucccuccu

SEQ ID NO: 1460479 - RNA, 12 nt, Hepatitis D virus
cgccgggccccu

SEQ ID NO: 1460480 - RNA, 14 nt, Hepatitis D virus
cuucucucugggaa

SEQ ID NO: 1460481 - RNA, 14 nt, Hepatitis D virus
agggguccucugga

SEQ ID NO: 1460482 - RNA, 16 nt, Hepatitis D virus
ucccagccgacccucc

SEQ ID NO: 1460483 - RNA, 16 nt, Hepatitis D virus
cuagccccgcugcucu

SEQ ID NO: 1460484 - RNA, 21 nt, Hepatitis D virus
cuagccccgcugcucucuuug

SEQ ID NO: 1460485 - RNA, 22 nt, Hepatitis D virus
ugcucucuuugcuuuccuccuc

SEQ ID NO: 1460486 - RNA, 15 nt, Hepatitis D virus
acuccuagcaucccc

SEQ ID NO: 1460487 - RNA, 14 nt, Hepatitis D virus
cucucgcuucucuc

SEQ ID NO: 1460488 - RNA, 13 nt, Hepatitis D virus
cgcuucucucugg

SEQ ID NO: 1460489 - RNA, 20 nt, Hepatitis D virus
aggcccgccuccuucucuuc

SEQ ID NO: 1460490 - RNA, 23 nt, Hepatitis D virus
auccgcuucuugcuuucucuuuu

SEQ ID NO: 1460491 - RNA, 17 nt, Hepatitis D virus
cgcguccuucuuuccuc

SEQ ID NO: 1460492 - RNA, 21 nt, Hepatitis D virus
caccuccucgcgguccgaccu

SEQ ID NO: 1460493 - RNA, 12 nt, Hepatitis D virus
cgaccugggcau

SEQ ID NO: 1460494 - RNA, 19 nt, Hepatitis D virus
ccacuuuucucucgcuucu

SEQ ID NO: 1460495 - RNA, 13 nt, Hepatitis D virus
ucuccaccuccuc

SEQ ID NO: 1460496 - RNA, 23 nt, Hepatitis D virus
ccgcugcucucuuugcuuuccuc

SEQ ID NO: 1460497 - RNA, 15 nt, Hepatitis D virus
ucgggaggagcaucc

SEQ ID NO: 1460498 - RNA, 13 nt, Hepatitis D virus
cucucgcuucucu

SEQ ID NO: 1460499 - RNA, 23 nt, Hepatitis D virus
cucuucccagccgacccucccuc

SEQ ID NO: 1460500 - RNA, 14 nt, Hepatitis D virus
cgaugcgcucucug

SEQ ID NO: 1460501 - RNA, 22 nt, Hepatitis D virus
ucuuuaccgacucaccccucuc

SEQ ID NO: 1460502 - RNA, 17 nt, Hepatitis D virus
cucuuuccccuuccuag

SEQ ID NO: 1460503 - RNA, 16 nt, Hepatitis D virus
uuugcuuuccuccucg

SEQ ID NO: 1460504 - RNA, 16 nt, Hepatitis D virus
gcuuccucccucuggg

SEQ ID NO: 1460505 - RNA, 18 nt, Hepatitis D virus
cucuuugcuuuccuccuc

SEQ ID NO: 1460506 - RNA, 15 nt, Hepatitis D virus
gccgccgggccccuc

SEQ ID NO: 1460507 - RNA, 16 nt, Hepatitis D virus
cuccuagcauccccuc

SEQ ID NO: 1460508 - RNA, 19 nt, Hepatitis D virus
ggucggcauggcaucucca

SEQ ID NO: 1460509 - RNA, 16 nt, Hepatitis D virus
cuuucucuuuuuuccu

SEQ ID NO: 1460510 - RNA, 19 nt, Hepatitis D virus
cggaaucgggaggagcauc

SEQ ID NO: 1460511 - RNA, 12 nt, Hepatitis D virus
gcccgccuccuu

SEQ ID NO: 1460512 - RNA, 22 nt, Hepatitis D virus
uggggacgauaagucgaguucc

SEQ ID NO: 1460513 - RNA, 23 nt, Hepatitis D virus
cuccucgcgguccgaccugggca

SEQ ID NO: 1460514 - RNA, 17 nt, Hepatitis D virus
cucuuuuuuccuucuug

SEQ ID NO: 1460515 - RNA, 15 nt, Hepatitis D virus
aagggguccucugga

SEQ ID NO: 1460516 - RNA, 15 nt, Hepatitis D virus
gaugcgcucucuguu

SEQ ID NO: 1460517 - RNA, 14 nt, Hepatitis D virus
cucaccccucucgg

SEQ ID NO: 1460518 - RNA, 19 nt, Hepatitis D virus
gcugcucucuuugcuuucc

SEQ ID NO: 1460519 - RNA, 13 nt, Hepatitis D virus
gcuucuugcuuuc

SEQ ID NO: 1460520 - RNA, 15 nt, Hepatitis D virus
ucucuuccaccuucc

SEQ ID NO: 1460521 - RNA, 15 nt, Hepatitis D virus
gcuuccucccucugg

SEQ ID NO: 1460522 - RNA, 22 nt, Hepatitis D virus
cccgccuccuucucuuccaccu

SEQ ID NO: 1460523 - RNA, 23 nt, Hepatitis D virus
cugcucucuuugcuuuccuccuc

SEQ ID NO: 1460524 - RNA, 20 nt, Hepatitis D virus
cagccgacccucccuccucu

SEQ ID NO: 1460525 - RNA, 19 nt, Hepatitis D virus
cccagccgacccucccucc

SEQ ID NO: 1460526 - RNA, 20 nt, Hepatitis D virus
ggggaaauucauccgcuucu

SEQ ID NO: 1460527 - RNA, 15 nt, Hepatitis D virus
ucgccauuaccgagg

SEQ ID NO: 1460528 - RNA, 14 nt, Hepatitis D virus
cccagccggcgcca

SEQ ID NO: 1460529 - RNA, 23 nt, Hepatitis D virus
cuucgggucggcauggcaucucc

SEQ ID NO: 1460530 - RNA, 15 nt, Hepatitis D virus
ggaggcccgccuccu

SEQ ID NO: 1460531 - RNA, 18 nt, Hepatitis D virus
cccuucgggccggagugu

SEQ ID NO: 1460532 - RNA, 14 nt, Hepatitis D virus
cagguaagaaagga

SEQ ID NO: 1460533 - RNA, 16 nt, Hepatitis D virus
guggcuuccucccucu

SEQ ID NO: 1460534 - RNA, 18 nt, Hepatitis D virus
ugggcauccgaaggagga

SEQ ID NO: 1460535 - RNA, 16 nt, Hepatitis D virus
uccuagcauccccucc

SEQ ID NO: 1460536 - RNA, 22 nt, Hepatitis D virus
gccagcgaggaggcugggacca

SEQ ID NO: 1460537 - RNA, 18 nt, Hepatitis D virus
aggcccgccuccuucucu

SEQ ID NO: 1460538 - RNA, 16 nt, Hepatitis D virus
ccucacucguccccuc

SEQ ID NO: 1460539 - RNA, 14 nt, Hepatitis D virus
uacucucaacccuu

SEQ ID NO: 1460540 - RNA, 19 nt, Hepatitis D virus
ccgaggggacgguccccuc

SEQ ID NO: 1460541 - RNA, 15 nt, Hepatitis D virus
cgcuucggucucccc

SEQ ID NO: 1460542 - RNA, 15 nt, Hepatitis D virus
cuuugcuuuccuccu

SEQ ID NO: 1460543 - RNA, 23 nt, Hepatitis D virus
ggagagccacuuuucucucgcuu

SEQ ID NO: 1460544 - RNA, 22 nt, Hepatitis D virus
agccucacucguccccucucgg

SEQ ID NO: 1460545 - RNA, 20 nt, Hepatitis D virus
cucucuuugcuuuccuccuc

SEQ ID NO: 1460546 - RNA, 14 nt, Hepatitis D virus
ggucuacucccucu

SEQ ID NO: 1460547 - RNA, 13 nt, Hepatitis D virus
gcugcucucuuug

SEQ ID NO: 1460548 - RNA, 19 nt, Hepatitis D virus
cucgcgaugcgcucucugu

SEQ ID NO: 1460549 - RNA, 17 nt, Hepatitis D virus
cauggcaucuccaccuc

SEQ ID NO: 1460550 - RNA, 22 nt, Hepatitis D virus
ccguguggcuuccucccucugg

SEQ ID NO: 1460551 - RNA, 15 nt, Hepatitis D virus
accccucucgggcgc

SEQ ID NO: 1460552 - RNA, 14 nt, Hepatitis D virus
cgcacguccacucg

SEQ ID NO: 1460553 - RNA, 19 nt, Hepatitis D virus
ccugcagaguggggucccg

SEQ ID NO: 1460554 - RNA, 22 nt, Hepatitis D virus
gcuucggucucccccaacuccu

SEQ ID NO: 1460555 - RNA, 15 nt, Hepatitis D virus
uggcuuccucccucu

SEQ ID NO: 1460556 - RNA, 14 nt, Hepatitis D virus
gaacacccaccugc

SEQ ID NO: 1460557 - RNA, 22 nt, Hepatitis D virus
ugcccagccggcgccagcgagg

SEQ ID NO: 1460558 - RNA, 14 nt, Hepatitis D virus
cuuccucccucugg

SEQ ID NO: 1460559 - RNA, 18 nt, Hepatitis D virus
cucgcguccuucuuuccu

SEQ ID NO: 1460560 - RNA, 18 nt, Hepatitis D virus
ucuuugcuuuccuccucg

SEQ ID NO: 1460561 - RNA, 19 nt, Hepatitis D virus
aaucgggaggagcauccca

SEQ ID NO: 1460562 - RNA, 22 nt, Hepatitis D virus
caacuccuagcauccccuccua

SEQ ID NO: 1460563 - RNA, 13 nt, Hepatitis D virus
agcauccccuccu

SEQ ID NO: 1460564 - RNA, 15 nt, Hepatitis D virus
cucacucguccccuc

SEQ ID NO: 1460565 - RNA, 15 nt, Hepatitis D virus
cacucguccccucuc

SEQ ID NO: 1460566 - RNA, 16 nt, Hepatitis D virus
guccuucuuuccucuu

SEQ ID NO: 1460567 - RNA, 18 nt, Hepatitis D virus
ccgccuccuucucuucca

SEQ ID NO: 1460568 - RNA, 15 nt, Hepatitis D virus
cuuccucccucuggg

SEQ ID NO: 1460569 - RNA, 18 nt, Hepatitis D virus
cggaauguugcccagccg

SEQ ID NO: 1460570 - RNA, 14 nt, Hepatitis D virus
ugggcgacccuugg

SEQ ID NO: 1460571 - RNA, 22 nt, Hepatitis D virus
ccucucgcgaugcgcucucugu

SEQ ID NO: 1460572 - RNA, 20 nt, Hepatitis D virus
cuccaaacuuggccgccggg

SEQ ID NO: 1460573 - RNA, 15 nt, Hepatitis D virus
cuccaccuccucgcg

SEQ ID NO: 1460574 - RNA, 22 nt, Hepatitis D virus
cccaacuccuagcauccccucc

SEQ ID NO: 1460575 - RNA, 23 nt, Hepatitis D virus
gcuaagggagagccacuuuucuc

SEQ ID NO: 1460576 - RNA, 16 nt, Hepatitis D virus
cgguccgaccugggca

SEQ ID NO: 1460577 - RNA, 13 nt, Hepatitis D virus
ucucaacccuucg

SEQ ID NO: 1460578 - RNA, 14 nt, Hepatitis D virus
uucucuuccaccuu

SEQ ID NO: 1460579 - RNA, 20 nt, Hepatitis D virus
cucacucguccccucucggg

SEQ ID NO: 1460580 - RNA, 18 nt, Hepatitis D virus
cccgccauuccugggcga

SEQ ID NO: 1460581 - RNA, 19 nt, Hepatitis D virus
gcuauggucuacucccucu

SEQ ID NO: 1460582 - RNA, 13 nt, Hepatitis D virus
acucaccccucuc

SEQ ID NO: 1460583 - RNA, 12 nt, Hepatitis D virus
gguuuccacucg

SEQ ID NO: 1460584 - RNA, 21 nt, Hepatitis D virus
accgaggggacgguccccucg

SEQ ID NO: 1460585 - RNA, 14 nt, Hepatitis D virus
ucuccaccuccucg

SEQ ID NO: 1460586 - RNA, 13 nt, Hepatitis D virus
uccaccuucccuc

SEQ ID NO: 1460587 - RNA, 18 nt, Hepatitis D virus
ucccucuuuccccuuccu

SEQ ID NO: 1460588 - RNA, 20 nt, Hepatitis D virus
cauuccugggcgacccuugg

SEQ ID NO: 1460589 - RNA, 16 nt, Hepatitis D virus
gccauuccugggcgac

SEQ ID NO: 1460590 - RNA, 17 nt, Hepatitis D virus
uggcuuccucccucugg

SEQ ID NO: 1460591 - RNA, 23 nt, Hepatitis D virus
ucccagccgacccucccuccucu

SEQ ID NO: 1460592 - RNA, 21 nt, Hepatitis D virus
gcugaucuauccuccccgcga

SEQ ID NO: 1460593 - RNA, 15 nt, Hepatitis D virus
cuugcuuucucuuuu

SEQ ID NO: 1460594 - RNA, 22 nt, Hepatitis D virus
ccugcuagccccgcugcucucu

SEQ ID NO: 1460595 - RNA, 23 nt, Hepatitis D virus
ccguguggcuuccucccucuggg

SEQ ID NO: 1460596 - RNA, 22 nt, Hepatitis D virus
uuuaccgacucaccccucucgg

SEQ ID NO: 1460597 - RNA, 19 nt, Hepatitis D virus
cguccuucuuuccucuucg

SEQ ID NO: 1460598 - RNA, 14 nt, Hepatitis D virus
acccuucgggccgg

SEQ ID NO: 1460599 - RNA, 12 nt, Hepatitis D virus
ccucccucuggg

SEQ ID NO: 1460600 - RNA, 20 nt, Hepatitis D virus
cccucuuuccccuuccuaga

SEQ ID NO: 1460601 - RNA, 13 nt, Hepatitis D virus
auuucucuguucu

SEQ ID NO: 1460602 - RNA, 17 nt, Hepatitis D virus
accgacucaccccucuc

SEQ ID NO: 1460603 - RNA, 18 nt, Hepatitis D virus
ccguguggcuuccucccu

SEQ ID NO: 1460604 - RNA, 15 nt, Hepatitis D virus
ucucgcuucucucug

SEQ ID NO: 1460605 - RNA, 15 nt, Hepatitis D virus
ugaagggguccucug

SEQ ID NO: 1460606 - RNA, 15 nt, Hepatitis D virus
gccgacccucccucc

SEQ ID NO: 1460607 - RNA, 17 nt, Hepatitis D virus
gccgccgggccccucgg

SEQ ID NO: 1460608 - RNA, 18 nt, Hepatitis D virus
cuccuucucuuccaccuu

SEQ ID NO: 1460609 - RNA, 14 nt, Hepatitis D virus
ucguccccucucgg

SEQ ID NO: 1460610 - RNA, 13 nt, Hepatitis D virus
gccgggccccucg

SEQ ID NO: 1460611 - RNA, 15 nt, Hepatitis D virus
gcucucuuugcuuuc

SEQ ID NO: 1460612 - RNA, 21 nt, Hepatitis D virus
cuccguguggcuuccucccuc

SEQ ID NO: 1460613 - RNA, 16 nt, Hepatitis D virus
cguguggcuuccuccc

SEQ ID NO: 1460614 - RNA, 21 nt, Hepatitis D virus
cgucucgcguccuucuuuccu

SEQ ID NO: 1460615 - RNA, 16 nt, Hepatitis D virus
cuuggccgccgggccc

SEQ ID NO: 1460616 - RNA, 19 nt, Hepatitis D virus
uguggcuuccucccucugg

SEQ ID NO: 1460617 - RNA, 12 nt, Hepatitis D virus
uacucccucucg

SEQ ID NO: 1460618 - RNA, 20 nt, Hepatitis D virus
aucgggaggcccgccuccuu

SEQ ID NO: 1460619 - RNA, 21 nt, Hepatitis D virus
cccucucgcgaugcgcucucu

SEQ ID NO: 1460620 - RNA, 20 nt, Hepatitis D virus
cgcugaagggguccucugga

SEQ ID NO: 1460621 - RNA, 16 nt, Hepatitis D virus
cauggcaucuccaccu

SEQ ID NO: 1460622 - RNA, 11 nt, Hepatitis D virus
cucucuguucg

SEQ ID NO: 1460623 - RNA, 21 nt, Hepatitis D virus
cacucggauggcuaagggaga

SEQ ID NO: 1460624 - RNA, 15 nt, Hepatitis D virus
cucaccccucucggg

SEQ ID NO: 1460625 - RNA, 21 nt, Hepatitis D virus
aucgcuauggucuacucccuc

SEQ ID NO: 1460626 - RNA, 17 nt, Hepatitis D virus
ucacucguccccucucg

SEQ ID NO: 1460627 - RNA, 14 nt, Hepatitis D virus
cucaacccuucggg

SEQ ID NO: 1460628 - RNA, 19 nt, Hepatitis D virus
agccgacccucccuccucu

SEQ ID NO: 1460629 - RNA, 15 nt, Hepatitis D virus
cgccauuccugggcg

SEQ ID NO: 1460630 - RNA, 18 nt, Hepatitis D virus
ccagccgacccucccucc

SEQ ID NO: 1460631 - RNA, 21 nt, Human
aaaacacuaaaaauaaaaaug

SEQ ID NO: 1460632 - RNA, 17 nt, Human
aaaacagacacuggcau

SEQ ID NO: 1460633 - RNA, 23 nt, Human
aaaacagggccacauagaugcug

SEQ ID NO: 1460634 - RNA, 18 nt, Human
aaaacagggccacauaga

SEQ ID NO: 1460635 - RNA, 12 nt, Human
aaaacagguaga

SEQ ID NO: 1460636 - RNA, 17 nt, Human
aaaacagguagaauuau

SEQ ID NO: 1460637 - RNA, 15 nt, Human
aaaagaaaauuuuug

SEQ ID NO: 1460638 - RNA, 13 nt, Human
aaaagaaaaagau

SEQ ID NO: 1460639 - RNA, 12 nt, Human
aaaagaaacuuu

SEQ ID NO: 1460640 - RNA, 12 nt, Human
aaaagaagaagu

SEQ ID NO: 1460641 - RNA, 20 nt, Human
aaaagacaaggaaaaaauaa

SEQ ID NO: 1460642 - RNA, 14 nt, Human
aaaagaagaaguuu

SEQ ID NO: 1460643 - RNA, 11 nt, Human
aaaagaaguaa

SEQ ID NO: 1460644 - RNA, 11 nt, Human
aaaagaaugau

SEQ ID NO: 1460645 - RNA, 10 nt, Human
aaaagauccc

SEQ ID NO: 1460646 - RNA, 14 nt, Human
aaaaguugcuauuu

SEQ ID NO: 1460647 - RNA, 18 nt, Human
aaaaguugaauuuuacau

SEQ ID NO: 1460648 - RNA, 22 nt, Human
aaaaguugcuauuugaacuuuu

SEQ ID NO: 1460649 - RNA, 13 nt, Human
aaaauaaaaaugg

SEQ ID NO: 1460650 - RNA, 13 nt, Human
aaagccaugcugg

SEQ ID NO: 1460651 - RNA, 13 nt, Human
aaagaucccaaau

SEQ ID NO: 1460652 - RNA, 16 nt, Human
aaagauauuuuuaucu

SEQ ID NO: 1460653 - RNA, 22 nt, Human
aaaccgaacugauguaaguaaa

SEQ ID NO: 1460654 - RNA, 20 nt, Human
aaaaucuauuuuguaacuuu

SEQ ID NO: 1460655 - RNA, 18 nt, Human
aacaucuuuaaggggagg

SEQ ID NO: 1460656 - RNA, 12 nt, Human
aacaucuuuaag

SEQ ID NO: 1460657 - RNA, 14 nt, Human
aacaggcucagagg

SEQ ID NO: 1460658 - RNA, 18 nt, Human
aacagccugacaacauuu

SEQ ID NO: 1460659 - RNA, 23 nt, Human
aaauucuucugaacucaaacuga

SEQ ID NO: 1460660 - RNA, 18 nt, Human
aaccuuuguuugcaucug

SEQ ID NO: 1460661 - RNA, 16 nt, Human
aaccgucuguuaugcu

SEQ ID NO: 1460662 - RNA, 18 nt, Human
aaccgucuguuaugcugu

SEQ ID NO: 1460663 - RNA, 22 nt, Human
aaccgucuguuaugcugugaca

SEQ ID NO: 1460664 - RNA, 22 nt, Human
aaauguugacaugggacauuug

SEQ ID NO: 1460665 - RNA, 15 nt, Human
aaauguucagaaggu

SEQ ID NO: 1460666 - RNA, 21 nt, Human
aaauguucagaagguugcucu

SEQ ID NO: 1460667 - RNA, 23 nt, Human
aaauguugacaugggacauuugc

SEQ ID NO: 1460668 - RNA, 16 nt, Human
aaauggccauuugcuu

SEQ ID NO: 1460669 - RNA, 13 nt, Human
aaauggccauuug

SEQ ID NO: 1460670 - RNA, 22 nt, Human
aaauauuguuuuacaauaguuc

SEQ ID NO: 1460671 - RNA, 16 nt, Human
aaauagcaaaagaaga

SEQ ID NO: 1460672 - RNA, 17 nt, Human
aaauagcaaaagaagaa

SEQ ID NO: 1460673 - RNA, 21 nt, Human
aaauauuuauuuuaauaaugu

SEQ ID NO: 1460674 - RNA, 14 nt, Human
aaauauuuguacau

SEQ ID NO: 1460675 - RNA, 15 nt, Human
aaauauuuguacaua

SEQ ID NO: 1460676 - RNA, 22 nt, Human
aaauauuuguacauaguuauuu

SEQ ID NO: 1460677 - RNA, 14 nt, Human
aaauauuuuaaaga

SEQ ID NO: 1460678 - RNA, 15 nt, Human
aaauauuuuaaagaa

SEQ ID NO: 1460679 - RNA, 16 nt, Human
aaauauuuuaaagaau

SEQ ID NO: 1460680 - RNA, 17 nt, Human
aaauauuuuaaagaauu

SEQ ID NO: 1460681 - RNA, 16 nt, Human
aaauauuuugcuaguu

SEQ ID NO: 1460682 - RNA, 14 nt, Human
aaaugaaaaaauau

SEQ ID NO: 1460683 - RNA, 18 nt, Human
aaaucuuuuauaggauuu

SEQ ID NO: 1460684 - RNA, 18 nt, Human
aaaucucaauauuucaga

SEQ ID NO: 1460685 - RNA, 21 nt, Human
aaauauuuuuucuuuucuauu

SEQ ID NO: 1460686 - RNA, 22 nt, Human
aaaucaaaagggccaaagaacc

SEQ ID NO: 1460687 - RNA, 16 nt, Human
aaaucucaauucuucc

SEQ ID NO: 1460688 - RNA, 13 nt, Human
aagcuacuuauug

SEQ ID NO: 1460689 - RNA, 19 nt, Human
aagcgauucucuugccuca

SEQ ID NO: 1460690 - RNA, 20 nt, Human
aagcgauucucuugccucaa

SEQ ID NO: 1460691 - RNA, 15 nt, Human
aagcgaaaaaaucag

SEQ ID NO: 1460692 - RNA, 19 nt, Human
aagcuagaauugaguguuu

SEQ ID NO: 1460693 - RNA, 14 nt, Human
aaggcagggaggag

SEQ ID NO: 1460694 - RNA, 19 nt, Human
aaggcagggaggaggcaga

SEQ ID NO: 1460695 - RNA, 22 nt, Human
aagagaucaggaagagaaggag

SEQ ID NO: 1460696 - RNA, 16 nt, Human
aagagaucaggaagag

SEQ ID NO: 1460697 - RNA, 15 nt, Human
aagagaucaggaaga

SEQ ID NO: 1460698 - RNA, 14 nt, Human
aagagauacagagg

SEQ ID NO: 1460699 - RNA, 16 nt, Human
aagacagaaguuugca

SEQ ID NO: 1460700 - RNA, 18 nt, Human
aagacagaaguuugcacu

SEQ ID NO: 1460701 - RNA, 14 nt, Human
aagaacggaagaag

SEQ ID NO: 1460702 - RNA, 16 nt, Human
aagaaccaaagaagaa

SEQ ID NO: 1460703 - RNA, 11 nt, Human
aagaacugaaa

SEQ ID NO: 1460704 - RNA, 13 nt, Human
aagaacucucugg

SEQ ID NO: 1460705 - RNA, 12 nt, Human
aagaacugaaau

SEQ ID NO: 1460706 - RNA, 13 nt, Human
aagaacugaaauc

SEQ ID NO: 1460707 - RNA, 15 nt, Human
aagaacugaaaucau

SEQ ID NO: 1460708 - RNA, 14 nt, Human
aagaacucucugga

SEQ ID NO: 1460709 - RNA, 21 nt, Human
aagacaaggaaaaaauaacaa

SEQ ID NO: 1460710 - RNA, 20 nt, Human
aagaagacugcauuauauuu

SEQ ID NO: 1460711 - RNA, 15 nt, Human
aagaagacugcauua

SEQ ID NO: 1460712 - RNA, 20 nt, Human
aagaacuuugagcuacugcc

SEQ ID NO: 1460713 - RNA, 13 nt, Human
aagaacuuugagc

SEQ ID NO: 1460714 - RNA, 18 nt, Human
aagaacuuugagcuacug

SEQ ID NO: 1460715 - RNA, 22 nt, Human
aagacaagaacuccccuuuuuu

SEQ ID NO: 1460716 - RNA, 13 nt, Human
aagacaauauaau

SEQ ID NO: 1460717 - RNA, 18 nt, Human
aagacaccguucauucag

SEQ ID NO: 1460718 - RNA, 14 nt, Human
aagaguucaagaaa

SEQ ID NO: 1460719 - RNA, 16 nt, Human
aagaguucaagaaaua

SEQ ID NO: 1460720 - RNA, 16 nt, Human
aauaaacacucuugaa

SEQ ID NO: 1460721 - RNA, 11 nt, Human
aauaaacacuc

SEQ ID NO: 1460722 - RNA, 14 nt, Human
aaguuuaauaaauu

SEQ ID NO: 1460723 - RNA, 17 nt, Human
aaguuuaauaaauuuau

SEQ ID NO: 1460724 - RNA, 19 nt, Human
aauaaacacucuugaaaaa

SEQ ID NO: 1460725 - RNA, 21 nt, Human
aaguuggggacacauguauuu

SEQ ID NO: 1460726 - RNA, 12 nt, Human
aauaaagcaauu

SEQ ID NO: 1460727 - RNA, 11 nt, Human
aauaaagcaau

SEQ ID NO: 1460728 - RNA, 17 nt, Human
aauaaagaauggaaagc

SEQ ID NO: 1460729 - RNA, 12 nt, Human
aauaaagaaugg

SEQ ID NO: 1460730 - RNA, 17 nt, Human
aaucucaauucuucccu

SEQ ID NO: 1460731 - RNA, 16 nt, Human
aaucucaauauuucag

SEQ ID NO: 1460732 - RNA, 22 nt, Human
aaucucaguugauuuucuggau

SEQ ID NO: 1460733 - RNA, 16 nt, Human
aaucucaguugauuuu

SEQ ID NO: 1460734 - RNA, 21 nt, Human
aaucucaguugauuuucugga

SEQ ID NO: 1460735 - RNA, 14 nt, Human
aaugaagcaaugcu

SEQ ID NO: 1460736 - RNA, 20 nt, Human
aaugaagauacugaaauaaa

SEQ ID NO: 1460737 - RNA, 20 nt, Human
aaugaauacuuuauaaagga

SEQ ID NO: 1460738 - RNA, 14 nt, Human
aaugauggcaauuu

SEQ ID NO: 1460739 - RNA, 17 nt, Human
aaugauggcaauuuugu

SEQ ID NO: 1460740 - RNA, 18 nt, Human
aaugauggcaauuuugua

SEQ ID NO: 1460741 - RNA, 19 nt, Human
aaugauggcaauuuuguaa

SEQ ID NO: 1460742 - RNA, 16 nt, Human
aauauauaucaaauau

SEQ ID NO: 1460743 - RNA, 16 nt, Human
aaucacgcuuuccuga

SEQ ID NO: 1460744 - RNA, 17 nt, Human
aaucacgcuuuuugaaa

SEQ ID NO: 1460745 - RNA, 18 nt, Human
aaucacgcuuuuugaaaa

SEQ ID NO: 1460746 - RNA, 14 nt, Human
aaucacgcuuuuug

SEQ ID NO: 1460747 - RNA, 15 nt, Human
aaucacgcuuuuuga

SEQ ID NO: 1460748 - RNA, 16 nt, Human
aaucacgcuuuuugaa

SEQ ID NO: 1460749 - RNA, 20 nt, Human
aaucacgcuuuuugaaaaag

SEQ ID NO: 1460750 - RNA, 18 nt, Human
aaucaaaagggccaaaga

SEQ ID NO: 1460751 - RNA, 19 nt, Human
aaucaaaagggccaaagaa

SEQ ID NO: 1460752 - RNA, 23 nt, Human
aaucaaaagggccaaagaaccaa

SEQ ID NO: 1460753 - RNA, 20 nt, Human
aaucaaaagggccaaagaac

SEQ ID NO: 1460754 - RNA, 12 nt, Human
acccucaugcug

SEQ ID NO: 1460755 - RNA, 16 nt, Human
acccucaucuuucuuc

SEQ ID NO: 1460756 - RNA, 19 nt, Human
acccucaucuuucuuccaa

SEQ ID NO: 1460757 - RNA, 13 nt, Human
acccucaucuuuc

SEQ ID NO: 1460758 - RNA, 14 nt, Human
acccucaucuuucu

SEQ ID NO: 1460759 - RNA, 13 nt, Human
acccucaugcugu

SEQ ID NO: 1460760 - RNA, 18 nt, Human
acccucauacacagaaac

SEQ ID NO: 1460761 - RNA, 13 nt, Human
acccuagcaaaag

SEQ ID NO: 1460762 - RNA, 18 nt, Human
acccuacuucuuuugcuc

SEQ ID NO: 1460763 - RNA, 14 nt, Human
acccuacuucuuuu

SEQ ID NO: 1460764 - RNA, 17 nt, Human
acccuaaccaaguuccu

SEQ ID NO: 1460765 - RNA, 16 nt, Human
acccuaaccaaguucc

SEQ ID NO: 1460766 - RNA, 13 nt, Human
acccuaccugugc

SEQ ID NO: 1460767 - RNA, 16 nt, Human
acccuaccugugccug

SEQ ID NO: 1460768 - RNA, 17 nt, Human
acccuaccugugccuga

SEQ ID NO: 1460769 - RNA, 15 nt, Human
acccuaaccaaguuc

SEQ ID NO: 1460770 - RNA, 14 nt, Human
acccuaaccaaguu

SEQ ID NO: 1460771 - RNA, 13 nt, Human
acccuaaccaagu

SEQ ID NO: 1460772 - RNA, 20 nt, Human
acccuaaauaauaaaaauaa

SEQ ID NO: 1460773 - RNA, 16 nt, Human
acccuaaauaauaaaa

SEQ ID NO: 1460774 - RNA, 13 nt, Human
acccguucaacuu

SEQ ID NO: 1460775 - RNA, 21 nt, Human
acccguucaacuuuuccuuug

SEQ ID NO: 1460776 - RNA, 16 nt, Human
acccguucacauuuuu

SEQ ID NO: 1460777 - RNA, 15 nt, Human
acccucacacuggga

SEQ ID NO: 1460778 - RNA, 23 nt, Human
acccuaugggucuaggacacagu

SEQ ID NO: 1460779 - RNA, 19 nt, Human
acccuaugggucuaggaca

SEQ ID NO: 1460780 - RNA, 16 nt, Human
acccuaugggucuagg

SEQ ID NO: 1460781 - RNA, 14 nt, Human
acccuaugggucua

SEQ ID NO: 1460782 - RNA, 15 nt, Human
accucaguaauuuag

SEQ ID NO: 1460783 - RNA, 17 nt, Human
accucaguaauuuagaa

SEQ ID NO: 1460784 - RNA, 21 nt, Human
accucaguaauuuagaaauca

SEQ ID NO: 1460785 - RNA, 13 nt, Human
accggggccuggg

SEQ ID NO: 1460786 - RNA, 21 nt, Human
accuccaaagcuucccacggc

SEQ ID NO: 1460787 - RNA, 19 nt, Human
accuccaaagcuucccacg

SEQ ID NO: 1460788 - RNA, 13 nt, Human
acgucuuaaauau

SEQ ID NO: 1460789 - RNA, 14 nt, Human
acgucuuaaauauu

SEQ ID NO: 1460790 - RNA, 13 nt, Human
acgugacacaaac

SEQ ID NO: 1460791 - RNA, 19 nt, Human
acgugacacaaacacacac

SEQ ID NO: 1460792 - RNA, 22 nt, Human
acgcaccaccaugccaggcuaa

SEQ ID NO: 1460793 - RNA, 18 nt, Human
acgugcucugugggucuc

SEQ ID NO: 1460794 - RNA, 20 nt, Human
acuaauguguaagacaaaaa

SEQ ID NO: 1460795 - RNA, 21 nt, Human
acuaauggcaugagaaauaca

SEQ ID NO: 1460796 - RNA, 22 nt, Human
acuaauggcaugagaaauacaa

SEQ ID NO: 1460797 - RNA, 23 nt, Human
acuaaugccuuacucuucuugaa

SEQ ID NO: 1460798 - RNA, 24 nt, Human
acuaaugccuuacucuucuugaaa

SEQ ID NO: 1460799 - RNA, 12 nt, Human
acuaauggcaug

SEQ ID NO: 1460800 - RNA, 13 nt, Human
acuaauggcauga

SEQ ID NO: 1460801 - RNA, 16 nt, Human
acuaauggcaugagaa

SEQ ID NO: 1460802 - RNA, 23 nt, Human
accuguggaacauaaaaaggaca

SEQ ID NO: 1460803 - RNA, 20 nt, Human
accuguggaacauaaaaagg

SEQ ID NO: 1460804 - RNA, 22 nt, Human
accucuguauuugaaucagccu

SEQ ID NO: 1460805 - RNA, 19 nt, Human
accuugcuuugauggaaua

SEQ ID NO: 1460806 - RNA, 13 nt, Human
acugaauuaugaa

SEQ ID NO: 1460807 - RNA, 14 nt, Human
acugaauuaugaaa

SEQ ID NO: 1460808 - RNA, 15 nt, Human
acugaauuaugaaac

SEQ ID NO: 1460809 - RNA, 20 nt, Human
acugaauuaugaaacuuuug

SEQ ID NO: 1460810 - RNA, 12 nt, Human
acugaaugaggu

SEQ ID NO: 1460811 - RNA, 20 nt, Human
acugaaugaggucagcaugu

SEQ ID NO: 1460812 - RNA, 13 nt, Human
acugacacacacg

SEQ ID NO: 1460813 - RNA, 14 nt, Human
acugauuacugccu

SEQ ID NO: 1460814 - RNA, 19 nt, Human
acugauaugggucuugaua

SEQ ID NO: 1460815 - RNA, 13 nt, Human
acugauguugugu

SEQ ID NO: 1460816 - RNA, 17 nt, Human
acugauguuguguuuuu

SEQ ID NO: 1460817 - RNA, 18 nt, Human
acugauguuguguuuuua

SEQ ID NO: 1460818 - RNA, 14 nt, Human
acucguuaauuugu

SEQ ID NO: 1460819 - RNA, 19 nt, Human
acucguuaauuuguagugu

SEQ ID NO: 1460820 - RNA, 14 nt, Human
acucguuuuuuaca

SEQ ID NO: 1460821 - RNA, 20 nt, Human
acuccgugcuuaaccaaaga

SEQ ID NO: 1460822 - RNA, 14 nt, Human
acuccauguuggcu

SEQ ID NO: 1460823 - RNA, 20 nt, Human
acuccauguuggcuagccuc

SEQ ID NO: 1460824 - RNA, 17 nt, Human
acuucagcgguuuauau

SEQ ID NO: 1460825 - RNA, 16 nt, Human
acuugaaaauuaacau

SEQ ID NO: 1460826 - RNA, 14 nt, Human
acuugaaaauuaac

SEQ ID NO: 1460827 - RNA, 12 nt, Human
acuugaaaauua

SEQ ID NO: 1460828 - RNA, 23 nt, Human
acuucuuuuuucaaaagaaaguc

SEQ ID NO: 1460829 - RNA, 22 nt, Human
acuucuuuuuucaaaagaaagu

SEQ ID NO: 1460830 - RNA, 21 nt, Human
acuucuuuuuucaaaagaaag

SEQ ID NO: 1460831 - RNA, 16 nt, Human
acuugguaauuguacu

SEQ ID NO: 1460832 - RNA, 14 nt, Human
acuuguacaaaaua

SEQ ID NO: 1460833 - RNA, 18 nt, Human
acuuguacaaaauaaaca

SEQ ID NO: 1460834 - RNA, 20 nt, Human
acuuguacaaaauaaacaaa

SEQ ID NO: 1460835 - RNA, 17 nt, Human
acuucaaauccuugaag

SEQ ID NO: 1460836 - RNA, 18 nt, Human
acuucaaauccuugaaga

SEQ ID NO: 1460837 - RNA, 19 nt, Human
acuucaaauccuugaagau

SEQ ID NO: 1460838 - RNA, 19 nt, Human
acuguuuuucggacaguuu

SEQ ID NO: 1460839 - RNA, 18 nt, Human
acuguuuuucggacaguu

SEQ ID NO: 1460840 - RNA, 16 nt, Human
acuggagugugcgugg

SEQ ID NO: 1460841 - RNA, 17 nt, Human
acuguaaaauaauaacu

SEQ ID NO: 1460842 - RNA, 15 nt, Human
acugccuauuuuaau

SEQ ID NO: 1460843 - RNA, 18 nt, Human
acugccgucagugcugug

SEQ ID NO: 1460844 - RNA, 12 nt, Human
acuggaaagaag

SEQ ID NO: 1460845 - RNA, 22 nt, Human
acuggaacacuagacaagccag

SEQ ID NO: 1460846 - RNA, 16 nt, Human
acuggaacacuagaca

SEQ ID NO: 1460847 - RNA, 17 nt, Human
acugcccaggcacugca

SEQ ID NO: 1460848 - RNA, 20 nt, Human
acugccgucagugcugugcu

SEQ ID NO: 1460849 - RNA, 16 nt, Human
acugucuuuuuucuaa

SEQ ID NO: 1460850 - RNA, 16 nt, Human
acuguaaaauguggga

SEQ ID NO: 1460851 - RNA, 21 nt, Human
acuguaaaaugugggauuaug

SEQ ID NO: 1460852 - RNA, 22 nt, Human
acuguaaaaugugggauuaugg

SEQ ID NO: 1460853 - RNA, 13 nt, Human
acuguaaacacag

SEQ ID NO: 1460854 - RNA, 16 nt, Human
acuguaaacacagaca

SEQ ID NO: 1460855 - RNA, 14 nt, Human
acuguaaacacaga

SEQ ID NO: 1460856 - RNA, 14 nt, Human
acugguuuucacau

SEQ ID NO: 1460857 - RNA, 23 nt, Human
acugucuuuuuucuaaaguaaaa

SEQ ID NO: 1460858 - RNA, 22 nt, Human
acugucuuuuuucuaaaguaaa

SEQ ID NO: 1460859 - RNA, 16 nt, Human
acuguaacugauuaca

SEQ ID NO: 1460860 - RNA, 16 nt, Human
acugugccauguguuu

SEQ ID NO: 1460861 - RNA, 23 nt, Human
acagugaucaaguuauuuuuaau

SEQ ID NO: 1460862 - RNA, 20 nt, Human
acagugcugaccagacagcc

SEQ ID NO: 1460863 - RNA, 16 nt, Human
acaguggaacuacauu

SEQ ID NO: 1460864 - RNA, 18 nt, Human
acaguggaacuacauuag

SEQ ID NO: 1460865 - RNA, 24 nt, Human
acaggaugguucccuugaugaaga

SEQ ID NO: 1460866 - RNA, 22 nt, Human
acaggauguguuugcuuucuga

SEQ ID NO: 1460867 - RNA, 16 nt, Human
acaggauguguuugcu

SEQ ID NO: 1460868 - RNA, 18 nt, Human
acaggauguguuugcuuu

SEQ ID NO: 1460869 - RNA, 19 nt, Human
acaggauguguuugcuuuc

SEQ ID NO: 1460870 - RNA, 20 nt, Human
acaggauguguuugcuuucu

SEQ ID NO: 1460871 - RNA, 21 nt, Human
acaggauguguuugcuuucug

SEQ ID NO: 1460872 - RNA, 15 nt, Human
acauuugcucaugga

SEQ ID NO: 1460873 - RNA, 16 nt, Human
acauuugcucauggaa

SEQ ID NO: 1460874 - RNA, 16 nt, Human
acauuuguauaaaaua

SEQ ID NO: 1460875 - RNA, 19 nt, Human
acauuuguauaaaauaauu

SEQ ID NO: 1460876 - RNA, 21 nt, Human
acauuuguauaaaauaauuuu

SEQ ID NO: 1460877 - RNA, 19 nt, Human
accaaccugaagacaccgu

SEQ ID NO: 1460878 - RNA, 20 nt, Human
acaucccuuaccugggaaag

SEQ ID NO: 1460879 - RNA, 18 nt, Human
acaugcacuuggcugcau

SEQ ID NO: 1460880 - RNA, 22 nt, Human
acaugcacuuggcugcauaaau

SEQ ID NO: 1460881 - RNA, 21 nt, Human
acaucauuucuuuuugggaga

SEQ ID NO: 1460882 - RNA, 20 nt, Human
acauaaguauuuaauucaug

SEQ ID NO: 1460883 - RNA, 12 nt, Human
acauaacugaaa

SEQ ID NO: 1460884 - RNA, 20 nt, Human
acauaacugaaaaugugcua

SEQ ID NO: 1460885 - RNA, 23 nt, Human
acauaaucuucugccuucucaug

SEQ ID NO: 1460886 - RNA, 21 nt, Human
acauacaccuaugucauuuca

SEQ ID NO: 1460887 - RNA, 18 nt, Human
acauacagaauuacugua

SEQ ID NO: 1460888 - RNA, 19 nt, Human
acauacagaauuacuguaa

SEQ ID NO: 1460889 - RNA, 20 nt, Human
acauacagaauuacuguaac

SEQ ID NO: 1460890 - RNA, 15 nt, Human
acaucauucuugaga

SEQ ID NO: 1460891 - RNA, 11 nt, Human
acaucauuucu

SEQ ID NO: 1460892 - RNA, 12 nt, Human
acaucauuucuu

SEQ ID NO: 1460893 - RNA, 13 nt, Human
acaucauuucuuu

SEQ ID NO: 1460894 - RNA, 22 nt, Human
acaucauuucuuuuugggagag

SEQ ID NO: 1460895 - RNA, 21 nt, Human
acauguuugcaccuuucuagu

SEQ ID NO: 1460896 - RNA, 22 nt, Human
acauguuugcaccuuucuaguu

SEQ ID NO: 1460897 - RNA, 22 nt, Human
aauuaucuauagcuaaguacac

SEQ ID NO: 1460898 - RNA, 15 nt, Human
aauuaucuauagcua

SEQ ID NO: 1460899 - RNA, 19 nt, Human
aauuaucuaauuuauaaaa

SEQ ID NO: 1460900 - RNA, 14 nt, Human
aauuaucuaauuua

SEQ ID NO: 1460901 - RNA, 15 nt, Human
aauuaucuaauuuau

SEQ ID NO: 1460902 - RNA, 18 nt, Human
aauuaucuaauuuauaaa

SEQ ID NO: 1460903 - RNA, 13 nt, Human
aauuauccaggaa

SEQ ID NO: 1460904 - RNA, 12 nt, Human
aauuaugaaacu

SEQ ID NO: 1460905 - RNA, 13 nt, Human
aauuaugaaacuu

SEQ ID NO: 1460906 - RNA, 15 nt, Human
aauuaugaaacuuuu

SEQ ID NO: 1460907 - RNA, 23 nt, Human
aauuaucuauagcuaaguacaca

SEQ ID NO: 1460908 - RNA, 18 nt, Human
aauuaugaaacuuuugga

SEQ ID NO: 1460909 - RNA, 16 nt, Human
aauucugcucagauag

SEQ ID NO: 1460910 - RNA, 21 nt, Human
aauugggagcuugggaaugga

SEQ ID NO: 1460911 - RNA, 23 nt, Human
aauucuaccaaggucuucuuaau

SEQ ID NO: 1460912 - RNA, 12 nt, Human
aauucuaaaaug

SEQ ID NO: 1460913 - RNA, 14 nt, Human
aauucuaaaaugau

SEQ ID NO: 1460914 - RNA, 17 nt, Human
aauucuaacccagguau

SEQ ID NO: 1460915 - RNA, 17 nt, Human
aauuuccugggagcuuu

SEQ ID NO: 1460916 - RNA, 12 nt, Human
aauuuccuggga

SEQ ID NO: 1460917 - RNA, 15 nt, Human
aauuuccugggagcu

SEQ ID NO: 1460918 - RNA, 16 nt, Human
aauuguacuaaagcca

SEQ ID NO: 1460919 - RNA, 17 nt, Human
aauuguacuaaagccaa

SEQ ID NO: 1460920 - RNA, 11 nt, Human
aauuguaauag

SEQ ID NO: 1460921 - RNA, 21 nt, Human
acacgcacggcagccacagcu

SEQ ID NO: 1460922 - RNA, 19 nt, Human
acacguaucccaccugaca

SEQ ID NO: 1460923 - RNA, 17 nt, Human
acacgugacacaaacac

SEQ ID NO: 1460924 - RNA, 16 nt, Human
acaaggucuuuaaagu

SEQ ID NO: 1460925 - RNA, 16 nt, Human
acaacuggcaggcagg

SEQ ID NO: 1460926 - RNA, 19 nt, Human
acaacuggcaggcaggcuc

SEQ ID NO: 1460927 - RNA, 16 nt, Human
acaaacuguaauacaa

SEQ ID NO: 1460928 - RNA, 17 nt, Human
acaaacuguaauacaau

SEQ ID NO: 1460929 - RNA, 21 nt, Human
acaaacucguuuuuuacaaag

SEQ ID NO: 1460930 - RNA, 20 nt, Human
acaaacucguuuuuuacaaa

SEQ ID NO: 1460931 - RNA, 19 nt, Human
acaaacuguaauacaauga

SEQ ID NO: 1460932 - RNA, 14 nt, Human
acaacauuucuaua

SEQ ID NO: 1460933 - RNA, 20 nt, Human
acaacauuucuauagccaaa

SEQ ID NO: 1460934 - RNA, 22 nt, Human
acaacauuucuauagccaaaaa

SEQ ID NO: 1460935 - RNA, 16 nt, Human
acaaccaauggaaugu

SEQ ID NO: 1460936 - RNA, 14 nt, Human
acaaccauuccaga

SEQ ID NO: 1460937 - RNA, 17 nt, Human
acaaacacacacaaaag

SEQ ID NO: 1460938 - RNA, 15 nt, Human
acaaacaccucccag

SEQ ID NO: 1460939 - RNA, 20 nt, Human
acaaacagggcugccuucug

SEQ ID NO: 1460940 - RNA, 18 nt, Human
aggaguuucguuuucaaa

SEQ ID NO: 1460941 - RNA, 14 nt, Human
aggaggugccacug

SEQ ID NO: 1460942 - RNA, 23 nt, Human
aggagguccuuaggccucugaga

SEQ ID NO: 1460943 - RNA, 18 nt, Human
aggagguccuuaggccuc

SEQ ID NO: 1460944 - RNA, 20 nt, Human
aggagacagguuagcugcuc

SEQ ID NO: 1460945 - RNA, 18 nt, Human
aggagacaguucaagaaa

SEQ ID NO: 1460946 - RNA, 14 nt, Human
aggagagaguugaa

SEQ ID NO: 1460947 - RNA, 15 nt, Human
aggagggcaggcauc

SEQ ID NO: 1460948 - RNA, 15 nt, Human
aggagggaggugcuu

SEQ ID NO: 1460949 - RNA, 13 nt, Human
aggagggcaggca

SEQ ID NO: 1460950 - RNA, 17 nt, Human
aggauguguuugcuuuc

SEQ ID NO: 1460951 - RNA, 18 nt, Human
aggauguguuugcuuucu

SEQ ID NO: 1460952 - RNA, 19 nt, Human
aggauguguuugcuuucug

SEQ ID NO: 1460953 - RNA, 14 nt, Human
aggaugugaauugu

SEQ ID NO: 1460954 - RNA, 20 nt, Human
aggauguggaaaccuccuuc

SEQ ID NO: 1460955 - RNA, 21 nt, Human
aggaugugucccaucuaggga

SEQ ID NO: 1460956 - RNA, 13 nt, Human
aggauguguuugc

SEQ ID NO: 1460957 - RNA, 13 nt, Human
aggauggcgcagg

SEQ ID NO: 1460958 - RNA, 23 nt, Human
aggcaugugucaccaugcccagc

SEQ ID NO: 1460959 - RNA, 19 nt, Human
aggcaucggggagccggga

SEQ ID NO: 1460960 - RNA, 14 nt, Human
aggcauuaaauuuu

SEQ ID NO: 1460961 - RNA, 22 nt, Human
aggcauuaaauuuuagcaaaga

SEQ ID NO: 1460962 - RNA, 22 nt, Human
aggcagaacucaucuagguaaa

SEQ ID NO: 1460963 - RNA, 14 nt, Human
agggacugagaaau

SEQ ID NO: 1460964 - RNA, 13 nt, Human
agggacugagaaa

SEQ ID NO: 1460965 - RNA, 15 nt, Human
agggacugagaaauu

SEQ ID NO: 1460966 - RNA, 17 nt, Human
agggacugagaaauuua

SEQ ID NO: 1460967 - RNA, 15 nt, Human
agggaugacuaaaau

SEQ ID NO: 1460968 - RNA, 22 nt, Human
agggaugacuaaaauauuuauu

SEQ ID NO: 1460969 - RNA, 22 nt, Human
aggcucuggagcccacuguacu

SEQ ID NO: 1460970 - RNA, 21 nt, Human
aggcuagguggguugaaagcc

SEQ ID NO: 1460971 - RNA, 23 nt, Human
aggcuagguggguugaaagccaa

SEQ ID NO: 1460972 - RNA, 14 nt, Human
aggcuagggugggg

SEQ ID NO: 1460973 - RNA, 15 nt, Human
aggcuagggugggga

SEQ ID NO: 1460974 - RNA, 16 nt, Human
aggcuaggguggggag

SEQ ID NO: 1460975 - RNA, 19 nt, Human
aggcuaggguggggagaga

SEQ ID NO: 1460976 - RNA, 14 nt, Human
aggcuuaaacccau

SEQ ID NO: 1460977 - RNA, 14 nt, Human
aggcuuacacccac

SEQ ID NO: 1460978 - RNA, 17 nt, Human
agcuguaugauucccag

SEQ ID NO: 1460979 - RNA, 18 nt, Human
agcuguaugauucccagc

SEQ ID NO: 1460980 - RNA, 17 nt, Human
agcugguuagaaaugca

SEQ ID NO: 1460981 - RNA, 18 nt, Human
aggaaaaaauaacaauga

SEQ ID NO: 1460982 - RNA, 19 nt, Human
agcuuuuuucucugauaca

SEQ ID NO: 1460983 - RNA, 20 nt, Human
agcuuuuuucucugauacag

SEQ ID NO: 1460984 - RNA, 22 nt, Human
agcuuuuuucucugauacagaa

SEQ ID NO: 1460985 - RNA, 23 nt, Human
agcuuuuuucucugauacagaaa

SEQ ID NO: 1460986 - RNA, 18 nt, Human
agcuuuguucuucuuaaa

SEQ ID NO: 1460987 - RNA, 12 nt, Human
agcuuuguucuu

SEQ ID NO: 1460988 - RNA, 13 nt, Human
agcugacucacac

SEQ ID NO: 1460989 - RNA, 15 nt, Human
agcugguuagaaaug

SEQ ID NO: 1460990 - RNA, 24 nt, Human
agcgauucuccugccucagccucc

SEQ ID NO: 1460991 - RNA, 20 nt, Human
agcuaaauaccucaaucagu

SEQ ID NO: 1460992 - RNA, 13 nt, Human
agcuacaaaugca

SEQ ID NO: 1460993 - RNA, 17 nt, Human
agcuaagcuaggaauga

SEQ ID NO: 1460994 - RNA, 18 nt, Human
agcuaagcuaggaaugaa

SEQ ID NO: 1460995 - RNA, 17 nt, Human
agccugcugccugcuuu

SEQ ID NO: 1460996 - RNA, 19 nt, Human
agccuggcuauguccuaau

SEQ ID NO: 1460997 - RNA, 23 nt, Human
agcgaaaaaaucagguggcuuuu

SEQ ID NO: 1460998 - RNA, 14 nt, Human
agauaugauucaaa

SEQ ID NO: 1460999 - RNA, 15 nt, Human
agauaugauucaaau

SEQ ID NO: 1461000 - RNA, 16 nt, Human
agauaugauucaaaug

SEQ ID NO: 1461001 - RNA, 18 nt, Human
agauaugaacauauuguu

SEQ ID NO: 1461002 - RNA, 20 nt, Human
agauagauaggucagugcaa

SEQ ID NO: 1461003 - RNA, 12 nt, Human
agaguugaaccu

SEQ ID NO: 1461004 - RNA, 13 nt, Human
agaguugaaccua

SEQ ID NO: 1461005 - RNA, 12 nt, Human
agauagaaugac

SEQ ID NO: 1461006 - RNA, 15 nt, Human
agauagaaugacagu

SEQ ID NO: 1461007 - RNA, 16 nt, Human
agauagaaugacaguc

SEQ ID NO: 1461008 - RNA, 17 nt, Human
agauugagauguguuca

SEQ ID NO: 1461009 - RNA, 18 nt, Human
agauugagagaagagaca

SEQ ID NO: 1461010 - RNA, 19 nt, Human
agauugagagaagagacaa

SEQ ID NO: 1461011 - RNA, 13 nt, Human
agauugagagaau

SEQ ID NO: 1461012 - RNA, 15 nt, Human
agauugagagaauuu

SEQ ID NO: 1461013 - RNA, 13 nt, Human
agauugcugaaau

SEQ ID NO: 1461014 - RNA, 14 nt, Human
agauugcugaaauu

SEQ ID NO: 1461015 - RNA, 23 nt, Human
agcaaaauuuuuucucuaggaaa

SEQ ID NO: 1461016 - RNA, 13 nt, Human
agcaaacucuuuu

SEQ ID NO: 1461017 - RNA, 17 nt, Human
agcaaacucuuuuccca

SEQ ID NO: 1461018 - RNA, 20 nt, Human
agcaaagauaucucaucucu

SEQ ID NO: 1461019 - RNA, 18 nt, Human
agcaacaauaaauagaca

SEQ ID NO: 1461020 - RNA, 13 nt, Human
agcaacaauaaau

SEQ ID NO: 1461021 - RNA, 12 nt, Human
agcaacaauaaa

SEQ ID NO: 1461022 - RNA, 15 nt, Human
agcaaaucgaaugaa

SEQ ID NO: 1461023 - RNA, 17 nt, Human
agcaaaucgaaugaaau

SEQ ID NO: 1461024 - RNA, 23 nt, Human
agcaaaucaccacaaacuguaau

SEQ ID NO: 1461025 - RNA, 11 nt, Human
agcaaaucacc

SEQ ID NO: 1461026 - RNA, 18 nt, Human
agcaaaucaccacaaacu

SEQ ID NO: 1461027 - RNA, 21 nt, Human
agcaaaucaccacaaacugua

SEQ ID NO: 1461028 - RNA, 22 nt, Human
agcaaaucaccacaaacuguaa

SEQ ID NO: 1461029 - RNA, 21 nt, Human
agaucugcagggggugugucu

SEQ ID NO: 1461030 - RNA, 17 nt, Human
agccaacuauggccugu

SEQ ID NO: 1461031 - RNA, 16 nt, Human
agccaaggggcuucag

SEQ ID NO: 1461032 - RNA, 19 nt, Human
agcaauuuaaauguuauga

SEQ ID NO: 1461033 - RNA, 17 nt, Human
agcaauuuaaauguuau

SEQ ID NO: 1461034 - RNA, 16 nt, Human
agcaauuuaaauguua

SEQ ID NO: 1461035 - RNA, 13 nt, Human
agcaauuuaaaug

SEQ ID NO: 1461036 - RNA, 14 nt, Human
agcacugccaccag

SEQ ID NO: 1461037 - RNA, 19 nt, Human
agcagugauugucuuaaua

SEQ ID NO: 1461038 - RNA, 18 nt, Human
agacgaaacauuuguucu

SEQ ID NO: 1461039 - RNA, 16 nt, Human
agaccuuuuuuaggaa

SEQ ID NO: 1461040 - RNA, 14 nt, Human
agaccuuuuuuagg

SEQ ID NO: 1461041 - RNA, 23 nt, Human
agaccauggacacuacacccagc

SEQ ID NO: 1461042 - RNA, 22 nt, Human
agaccauggacacuacacccag

SEQ ID NO: 1461043 - RNA, 21 nt, Human
agaccauggacacuacaccca

SEQ ID NO: 1461044 - RNA, 12 nt, Human
agaccauggaca

SEQ ID NO: 1461045 - RNA, 17 nt, Human
agaccaccucucaauau

SEQ ID NO: 1461046 - RNA, 12 nt, Human
agaccaccucuc

SEQ ID NO: 1461047 - RNA, 23 nt, Human
agacaauugagguaaguuuuuug

SEQ ID NO: 1461048 - RNA, 19 nt, Human
agacaauugacaacaguua

SEQ ID NO: 1461049 - RNA, 19 nt, Human
agacaaggaaaaaauaaca

SEQ ID NO: 1461050 - RNA, 15 nt, Human
agacaagccagaacu

SEQ ID NO: 1461051 - RNA, 16 nt, Human
agacaauugacaacag

SEQ ID NO: 1461052 - RNA, 17 nt, Human
agacaagccagaacuug

SEQ ID NO: 1461053 - RNA, 22 nt, Human
agagaggccauucuuucccaac

SEQ ID NO: 1461054 - RNA, 23 nt, Human
agagaggccauucuuucccaaca

SEQ ID NO: 1461055 - RNA, 12 nt, Human
agagaggccauu

SEQ ID NO: 1461056 - RNA, 17 nt, Human
agagccugcaggaucuc

SEQ ID NO: 1461057 - RNA, 14 nt, Human
agagccugcaggau

SEQ ID NO: 1461058 - RNA, 16 nt, Human
agagccugcaggaucu

SEQ ID NO: 1461059 - RNA, 14 nt, Human
agacucuuuaugcu

SEQ ID NO: 1461060 - RNA, 16 nt, Human
agagaaguagaaauca

SEQ ID NO: 1461061 - RNA, 14 nt, Human
agagaaauaugaag

SEQ ID NO: 1461062 - RNA, 21 nt, Human
agaagacugcauuauauuuau

SEQ ID NO: 1461063 - RNA, 11 nt, Human
agaaccaaaga

SEQ ID NO: 1461064 - RNA, 19 nt, Human
agaaccaaagaagaaaguc

SEQ ID NO: 1461065 - RNA, 16 nt, Human
agaaccaaagaagaaa

SEQ ID NO: 1461066 - RNA, 21 nt, Human
agaauccuaggcuccacccca

SEQ ID NO: 1461067 - RNA, 18 nt, Human
agaaucuauauuuaacaa

SEQ ID NO: 1461068 - RNA, 19 nt, Human
agaaucuugguuugccuuc

SEQ ID NO: 1461069 - RNA, 20 nt, Human
agaaucuugguuugccuucc

SEQ ID NO: 1461070 - RNA, 12 nt, Human
agaaugagccuc

SEQ ID NO: 1461071 - RNA, 17 nt, Human
agaacaucccuccuggg

SEQ ID NO: 1461072 - RNA, 13 nt, Human
agaacaucccucc

SEQ ID NO: 1461073 - RNA, 19 nt, Human
agaacauagacagaagaaa

SEQ ID NO: 1461074 - RNA, 21 nt, Human
agaacauagacagaagaaaca

SEQ ID NO: 1461075 - RNA, 18 nt, Human
agaacagcagacucagcu

SEQ ID NO: 1461076 - RNA, 10 nt, Human
agaacaaggc

SEQ ID NO: 1461077 - RNA, 15 nt, Human
agaacaacuaccuga

SEQ ID NO: 1461078 - RNA, 12 nt, Human
agaacacacaca

SEQ ID NO: 1461079 - RNA, 14 nt, Human
agaacacacacacu

SEQ ID NO: 1461080 - RNA, 15 nt, Human
agaacacacacacuu

SEQ ID NO: 1461081 - RNA, 20 nt, Human
agaacacagcaauuccucag

SEQ ID NO: 1461082 - RNA, 17 nt, Human
aucccccagaaaagaaa

SEQ ID NO: 1461083 - RNA, 12 nt, Human
aucccccagaaa

SEQ ID NO: 1461084 - RNA, 17 nt, Human
auccagggggcaagagg

SEQ ID NO: 1461085 - RNA, 12 nt, Human
auccuugaagau

SEQ ID NO: 1461086 - RNA, 17 nt, Human
auccuuccucacaccag

SEQ ID NO: 1461087 - RNA, 13 nt, Human
aucgaaugaaauu

SEQ ID NO: 1461088 - RNA, 14 nt, Human
aucgaaugaaauua

SEQ ID NO: 1461089 - RNA, 23 nt, Human
auccaggccggcuugccacaccc

SEQ ID NO: 1461090 - RNA, 14 nt, Human
auccaggccggcuu

SEQ ID NO: 1461091 - RNA, 21 nt, Human
auccagccuggggcugaggcu

SEQ ID NO: 1461092 - RNA, 12 nt, Human
auccacuuugca

SEQ ID NO: 1461093 - RNA, 19 nt, Human
auccagccuggggcugagg

SEQ ID NO: 1461094 - RNA, 23 nt, Human
auccagccuaacuuacauucuua

SEQ ID NO: 1461095 - RNA, 23 nt, Human
auccacuuuaucuugaauaaugu

SEQ ID NO: 1461096 - RNA, 21 nt, Human
aucaugcauguccuguaaagg

SEQ ID NO: 1461097 - RNA, 19 nt, Human
auauuuuuuucugaaauuu

SEQ ID NO: 1461098 - RNA, 14 nt, Human
auauuuuuuucuga

SEQ ID NO: 1461099 - RNA, 16 nt, Human
auauuuuuuucugaaa

SEQ ID NO: 1461100 - RNA, 18 nt, Human
auauuuuuuucugaaauu

SEQ ID NO: 1461101 - RNA, 18 nt, Human
aucaaaagggccaaagaa

SEQ ID NO: 1461102 - RNA, 22 nt, Human
aucaaaagggccaaagaaccaa

SEQ ID NO: 1461103 - RNA, 16 nt, Human
augaaacuuuuggaag

SEQ ID NO: 1461104 - RNA, 20 nt, Human
augaagccuccuuagaaaaa

SEQ ID NO: 1461105 - RNA, 14 nt, Human
augaauacauuucc

SEQ ID NO: 1461106 - RNA, 21 nt, Human
augaauacauuuccaaaaugg

SEQ ID NO: 1461107 - RNA, 13 nt, Human
augaagcuguugu

SEQ ID NO: 1461108 - RNA, 17 nt, Human
augaggccagaccaugg

SEQ ID NO: 1461109 - RNA, 14 nt, Human
augaggccagacca

SEQ ID NO: 1461110 - RNA, 13 nt, Human
augaggccagacc

SEQ ID NO: 1461111 - RNA, 12 nt, Human
augaggccagac

SEQ ID NO: 1461112 - RNA, 16 nt, Human
augagcucuucauguu

SEQ ID NO: 1461113 - RNA, 19 nt, Human
aucuaggauuuuaagggaa

SEQ ID NO: 1461114 - RNA, 18 nt, Human
aucuaggcaacauaguau

SEQ ID NO: 1461115 - RNA, 11 nt, Human
aucuaggauuu

SEQ ID NO: 1461116 - RNA, 13 nt, Human
augagggaaaaga

SEQ ID NO: 1461117 - RNA, 14 nt, Human
augagggaaaagaa

SEQ ID NO: 1461118 - RNA, 13 nt, Human
augaggcuuucca

SEQ ID NO: 1461119 - RNA, 20 nt, Human
augggacauuugcucaugga

SEQ ID NO: 1461120 - RNA, 23 nt, Human
auggcuuccuggcaauagucaaa

SEQ ID NO: 1461121 - RNA, 18 nt, Human
auggagugcaccaaagag

SEQ ID NO: 1461122 - RNA, 19 nt, Human
auggagugcaccaaagaga

SEQ ID NO: 1461123 - RNA, 20 nt, Human
auggagugcaccaaagagaa

SEQ ID NO: 1461124 - RNA, 16 nt, Human
auggaguguacaagua

SEQ ID NO: 1461125 - RNA, 17 nt, Human
augcuuugaaacagaaa

SEQ ID NO: 1461126 - RNA, 18 nt, Human
augcuuugaaacagaaaa

SEQ ID NO: 1461127 - RNA, 16 nt, Human
augcuuugaaacagaa

SEQ ID NO: 1461128 - RNA, 17 nt, Human
auggagugcaccaaaga

SEQ ID NO: 1461129 - RNA, 24 nt, Human
augcauauuauuuuauguugcaua

SEQ ID NO: 1461130 - RNA, 17 nt, Human
augcauacacucucaaa

SEQ ID NO: 1461131 - RNA, 16 nt, Human
augcauggaaauuccc

SEQ ID NO: 1461132 - RNA, 23 nt, Human
augcauggagggcugcccuguac

SEQ ID NO: 1461133 - RNA, 14 nt, Human
augcauaaaugcau

SEQ ID NO: 1461134 - RNA, 16 nt, Human
augcauguccuguaaa

SEQ ID NO: 1461135 - RNA, 15 nt, Human
agucuggugaagcuc

SEQ ID NO: 1461136 - RNA, 18 nt, Human
agucugugagauucauuc

SEQ ID NO: 1461137 - RNA, 20 nt, Human
aguaucaucagauagcaucu

SEQ ID NO: 1461138 - RNA, 19 nt, Human
agugccuuccuguuuuuca

SEQ ID NO: 1461139 - RNA, 11 nt, Human
agugacagcua

SEQ ID NO: 1461140 - RNA, 22 nt, Human
aguauauugauccagaaagaaa

SEQ ID NO: 1461141 - RNA, 19 nt, Human
aguaacuacaguuagggcu

SEQ ID NO: 1461142 - RNA, 17 nt, Human
aguaacuacaguuaggg

SEQ ID NO: 1461143 - RNA, 14 nt, Human
aguaacucaucugu

SEQ ID NO: 1461144 - RNA, 16 nt, Human
aguaaagaauuauuuu

SEQ ID NO: 1461145 - RNA, 15 nt, Human
aguaaagaauuauuu

SEQ ID NO: 1461146 - RNA, 13 nt, Human
auaaaaagaauga

SEQ ID NO: 1461147 - RNA, 14 nt, Human
auaaaaagaucacu

SEQ ID NO: 1461148 - RNA, 17 nt, Human
auaaaaaagaucccaaa

SEQ ID NO: 1461149 - RNA, 11 nt, Human
auaaaaaagau

SEQ ID NO: 1461150 - RNA, 15 nt, Human
auaaaaaagauccca

SEQ ID NO: 1461151 - RNA, 16 nt, Human
auaaaaaagaucccaa

SEQ ID NO: 1461152 - RNA, 15 nt, Human
auaaaagacagugaa

SEQ ID NO: 1461153 - RNA, 16 nt, Human
auaaaagacagugaaa

SEQ ID NO: 1461154 - RNA, 22 nt, Human
auaaaaagaucacuuucucagu

SEQ ID NO: 1461155 - RNA, 18 nt, Human
auaaaaagaucacuuucu

SEQ ID NO: 1461156 - RNA, 17 nt, Human
auaaaaaugaucuaaac

SEQ ID NO: 1461157 - RNA, 12 nt, Human
auaaaaauguuu

SEQ ID NO: 1461158 - RNA, 16 nt, Human
auaaaaaugaucuaaa

SEQ ID NO: 1461159 - RNA, 20 nt, Human
aguuaacuauugcauuuaua

SEQ ID NO: 1461160 - RNA, 24 nt, Human
aguuaacuauugcauuuauaugua

SEQ ID NO: 1461161 - RNA, 14 nt, Human
aguuaauuuaaagu

SEQ ID NO: 1461162 - RNA, 19 nt, Human
aguuaacuauugcauuuau

SEQ ID NO: 1461163 - RNA, 17 nt, Human
aguuaacuauugcauuu

SEQ ID NO: 1461164 - RNA, 15 nt, Human
aguuaacuauugcau

SEQ ID NO: 1461165 - RNA, 20 nt, Human
aguuaacaccuuuaaagugu

SEQ ID NO: 1461166 - RNA, 18 nt, Human
aguguuuuaugagaaagc

SEQ ID NO: 1461167 - RNA, 21 nt, Human
aguguuuuaugagaaagccuu

SEQ ID NO: 1461168 - RNA, 14 nt, Human
aguguuuucucuga

SEQ ID NO: 1461169 - RNA, 15 nt, Human
aguguuuucucugaa

SEQ ID NO: 1461170 - RNA, 11 nt, Human
aguguuucuuu

SEQ ID NO: 1461171 - RNA, 19 nt, Human
aguggcaucaucucagcuc

SEQ ID NO: 1461172 - RNA, 20 nt, Human
aguggcaucaucucagcuca

SEQ ID NO: 1461173 - RNA, 17 nt, Human
agugcucauuucaggau

SEQ ID NO: 1461174 - RNA, 17 nt, Human
aguucauccauucuauu

SEQ ID NO: 1461175 - RNA, 14 nt, Human
aguugaagcaaauc

SEQ ID NO: 1461176 - RNA, 19 nt, Human
aguuguuccuuaagucaga

SEQ ID NO: 1461177 - RNA, 18 nt, Human
auaagcuuaugcuuaaau

SEQ ID NO: 1461178 - RNA, 16 nt, Human
auaaagauauuguuca

SEQ ID NO: 1461179 - RNA, 16 nt, Human
auacuuuuacaaguaa

SEQ ID NO: 1461180 - RNA, 20 nt, Human
auacuuuuacaaguaacaaa

SEQ ID NO: 1461181 - RNA, 21 nt, Human
auacuuuuacaaguaacaaaa

SEQ ID NO: 1461182 - RNA, 19 nt, Human
auacuuuuuaaauguaaag

SEQ ID NO: 1461183 - RNA, 17 nt, Human
gccuacuccaaaauguu

SEQ ID NO: 1461184 - RNA, 18 nt, Human
gccucugucuucuggacu

SEQ ID NO: 1461185 - RNA, 21 nt, Human
gccuccuggcugucugaggcu

SEQ ID NO: 1461186 - RNA, 19 nt, Human
gccucugucuucuggacug

SEQ ID NO: 1461187 - RNA, 13 nt, Human
gccuccugccggc

SEQ ID NO: 1461188 - RNA, 17 nt, Human
gccuccugccggcuccu

SEQ ID NO: 1461189 - RNA, 20 nt, Human
gccuccugccggcuccuugg

SEQ ID NO: 1461190 - RNA, 22 nt, Human
gccugccuccccugccucacca

SEQ ID NO: 1461191 - RNA, 17 nt, Human
gcccugcugcccucccc

SEQ ID NO: 1461192 - RNA, 15 nt, Human
gcccugcugcccucc

SEQ ID NO: 1461193 - RNA, 14 nt, Human
gcccugcugcccuc

SEQ ID NO: 1461194 - RNA, 13 nt, Human
gcccugcugcccu

SEQ ID NO: 1461195 - RNA, 20 nt, Human
gcccaugggagcugguuaga

SEQ ID NO: 1461196 - RNA, 22 nt, Human
gcccccaguaucucuucagucu

SEQ ID NO: 1461197 - RNA, 12 nt, Human
gcccuacuggga

SEQ ID NO: 1461198 - RNA, 17 nt, Human
gccaugucaaacaaaua

SEQ ID NO: 1461199 - RNA, 20 nt, Human
gccauucuccugccucagcc

SEQ ID NO: 1461200 - RNA, 21 nt, Human
gccauucacuucauaauccag

SEQ ID NO: 1461201 - RNA, 22 nt, Human
gccauucacuucauaauccagu

SEQ ID NO: 1461202 - RNA, 13 nt, Human
gccaggccgggaa

SEQ ID NO: 1461203 - RNA, 21 nt, Human
gccagccacggggacucagcc

SEQ ID NO: 1461204 - RNA, 15 nt, Human
gccaggaggacccag

SEQ ID NO: 1461205 - RNA, 16 nt, Human
gccaggaggacccagg

SEQ ID NO: 1461206 - RNA, 17 nt, Human
gccaggaggacccaggg

SEQ ID NO: 1461207 - RNA, 19 nt, Human
gccaggaggacccagggcu

SEQ ID NO: 1461208 - RNA, 22 nt, Human
gccaggaggacccagggcucug

SEQ ID NO: 1461209 - RNA, 17 nt, Human
gccaggaggugccacug

SEQ ID NO: 1461210 - RNA, 18 nt, Human
gccaggaggugccacugg

SEQ ID NO: 1461211 - RNA, 17 nt, Human
gccagaccauggacacu

SEQ ID NO: 1461212 - RNA, 16 nt, Human
gccagaccauggacac

SEQ ID NO: 1461213 - RNA, 13 nt, Human
gccagaccaugga

SEQ ID NO: 1461214 - RNA, 16 nt, Human
gccagaccagcaggcu

SEQ ID NO: 1461215 - RNA, 18 nt, Human
gccagaccagcaggcugg

SEQ ID NO: 1461216 - RNA, 12 nt, Human
gccagauuuuuu

SEQ ID NO: 1461217 - RNA, 13 nt, Human
gccagauuuuuua

SEQ ID NO: 1461218 - RNA, 23 nt, Human
gccagauuuuuuaaaauuuauau

SEQ ID NO: 1461219 - RNA, 16 nt, Human
gccagauuuuuuaaaa

SEQ ID NO: 1461220 - RNA, 15 nt, Human
gcacuuggcugcaua

SEQ ID NO: 1461221 - RNA, 16 nt, Human
gccacccucaugcugu

SEQ ID NO: 1461222 - RNA, 15 nt, Human
gccacccucaugcug

SEQ ID NO: 1461223 - RNA, 13 nt, Human
gccacccucaugc

SEQ ID NO: 1461224 - RNA, 22 nt, Human
gccacuggagugugcguggugg

SEQ ID NO: 1461225 - RNA, 13 nt, Human
gccaccaugcccg

SEQ ID NO: 1461226 - RNA, 23 nt, Human
gcucuggagcccacuguacuugc

SEQ ID NO: 1461227 - RNA, 14 nt, Human
gcucuucauguuuc

SEQ ID NO: 1461228 - RNA, 15 nt, Human
gcugaaauuuuauau

SEQ ID NO: 1461229 - RNA, 17 nt, Human
gcugaaauuuuauaugc

SEQ ID NO: 1461230 - RNA, 14 nt, Human
gcugagcucucugu

SEQ ID NO: 1461231 - RNA, 12 nt, Human
gcucuaauacau

SEQ ID NO: 1461232 - RNA, 21 nt, Human
gccuguuagcaugcuggugag

SEQ ID NO: 1461233 - RNA, 21 nt, Human
gcuaguaauuggaaaggcagc

SEQ ID NO: 1461234 - RNA, 18 nt, Human
gcuauggugcucugucua

SEQ ID NO: 1461235 - RNA, 13 nt, Human
gcuaugguuuucu

SEQ ID NO: 1461236 - RNA, 14 nt, Human
gcuauuucaucuau

SEQ ID NO: 1461237 - RNA, 15 nt, Human
gcuauuucaucuauu

SEQ ID NO: 1461238 - RNA, 18 nt, Human
gcucaggagcccugggag

SEQ ID NO: 1461239 - RNA, 15 nt, Human
gcucaggagcccugg

SEQ ID NO: 1461240 - RNA, 21 nt, Human
gcucaggagcccugggaggcu

SEQ ID NO: 1461241 - RNA, 16 nt, Human
gcucagguacuuguaa

SEQ ID NO: 1461242 - RNA, 14 nt, Human
gcucaggagcccug

SEQ ID NO: 1461243 - RNA, 18 nt, Human
gcucaccuugugcugggg

SEQ ID NO: 1461244 - RNA, 16 nt, Human
gcugcugccugccugg

SEQ ID NO: 1461245 - RNA, 12 nt, Human
gcugcugccugc

SEQ ID NO: 1461246 - RNA, 20 nt, Human
gcugccuggaagagcagccc

SEQ ID NO: 1461247 - RNA, 12 nt, Human
gcuggagugcag

SEQ ID NO: 1461248 - RNA, 19 nt, Human
gcugggucgcccuggacug

SEQ ID NO: 1461249 - RNA, 18 nt, Human
gcugggucgcccuggacu

SEQ ID NO: 1461250 - RNA, 17 nt, Human
gcugggucgcccuggac

SEQ ID NO: 1461251 - RNA, 16 nt, Human
gcugggucgcccugga

SEQ ID NO: 1461252 - RNA, 14 nt, Human
gcuggagugcagug

SEQ ID NO: 1461253 - RNA, 19 nt, Human
gcuguaauguuaauauuga

SEQ ID NO: 1461254 - RNA, 16 nt, Human
gcuguacacugcacga

SEQ ID NO: 1461255 - RNA, 12 nt, Human
gcuguacacugc

SEQ ID NO: 1461256 - RNA, 17 nt, Human
gcugugcuuaugguacc

SEQ ID NO: 1461257 - RNA, 12 nt, Human
gcuguggccagg

SEQ ID NO: 1461258 - RNA, 13 nt, Human
gcuguggccagga

SEQ ID NO: 1461259 - RNA, 12 nt, Human
gcuuaaaacuuu

SEQ ID NO: 1461260 - RNA, 13 nt, Human
gcuuaaaacuuug

SEQ ID NO: 1461261 - RNA, 18 nt, Human
gcuuaaaacuuugaaguu

SEQ ID NO: 1461262 - RNA, 22 nt, Human
gcuuaaacccauauuguaaaac

SEQ ID NO: 1461263 - RNA, 14 nt, Human
gcuucccuuuccug

SEQ ID NO: 1461264 - RNA, 14 nt, Human
gcuuccuucauuuc

SEQ ID NO: 1461265 - RNA, 17 nt, Human
gcuuccuucauuuccuc

SEQ ID NO: 1461266 - RNA, 13 nt, Human
gcuuccuucauuu

SEQ ID NO: 1461267 - RNA, 19 nt, Human
gcuugaaacccguggcgcu

SEQ ID NO: 1461268 - RNA, 22 nt, Human
gcuugggaaaggugguguuucu

SEQ ID NO: 1461269 - RNA, 17 nt, Human
gcuugggcagcaucccc

SEQ ID NO: 1461270 - RNA, 21 nt, Human
ggccuccguccaggagccugg

SEQ ID NO: 1461271 - RNA, 11 nt, Human
ggccaaagaac

SEQ ID NO: 1461272 - RNA, 22 nt, Human
ggccaaagaaccaaagaagaaa

SEQ ID NO: 1461273 - RNA, 17 nt, Human
ggccaaagaaccaaaga

SEQ ID NO: 1461274 - RNA, 14 nt, Human
ggcaacaucuuuau

SEQ ID NO: 1461275 - RNA, 22 nt, Human
ggaugguucccuugaugaagaa

SEQ ID NO: 1461276 - RNA, 23 nt, Human
ggaugguucccuugaugaagaag

SEQ ID NO: 1461277 - RNA, 16 nt, Human
ggcaaaauccuugcuu

SEQ ID NO: 1461278 - RNA, 16 nt, Human
ggcaaauaucuugaaa

SEQ ID NO: 1461279 - RNA, 20 nt, Human
ggcagagaagaaagaacgga

SEQ ID NO: 1461280 - RNA, 19 nt, Human
ggcagacucuuuaugcuug

SEQ ID NO: 1461281 - RNA, 20 nt, Human
ggcagacucuuuaugcuugc

SEQ ID NO: 1461282 - RNA, 22 nt, Human
ggcagacucuuuaugcuugcaa

SEQ ID NO: 1461283 - RNA, 23 nt, Human
ggcaggcaucggggagccgggag

SEQ ID NO: 1461284 - RNA, 18 nt, Human
ggcaggcaggcucccagg

SEQ ID NO: 1461285 - RNA, 12 nt, Human
ggcagccucugg

SEQ ID NO: 1461286 - RNA, 19 nt, Human
ggagcagagcugauggaga

SEQ ID NO: 1461287 - RNA, 15 nt, Human
ggagcccacuguacu

SEQ ID NO: 1461288 - RNA, 23 nt, Human
ggagcagagcugauggagaagga

SEQ ID NO: 1461289 - RNA, 21 nt, Human
ggaggcucuggagcccacugu

SEQ ID NO: 1461290 - RNA, 22 nt, Human
ggagcccacuguacuugcucuu

SEQ ID NO: 1461291 - RNA, 18 nt, Human
ggagcccacuguacuugc

SEQ ID NO: 1461292 - RNA, 15 nt, Human
ggagcuugggaaugg

SEQ ID NO: 1461293 - RNA, 20 nt, Human
ggaggcucuggagcccacug

SEQ ID NO: 1461294 - RNA, 17 nt, Human
ggaggcucuggagccca

SEQ ID NO: 1461295 - RNA, 17 nt, Human
ggaggccauugugugag

SEQ ID NO: 1461296 - RNA, 19 nt, Human
ggaggaaccagagugcuga

SEQ ID NO: 1461297 - RNA, 16 nt, Human
ggaggcaucagugucc

SEQ ID NO: 1461298 - RNA, 15 nt, Human
ggagagacgggcccu

SEQ ID NO: 1461299 - RNA, 17 nt, Human
ggagagacgggcccugg

SEQ ID NO: 1461300 - RNA, 12 nt, Human
ggagagacuugu

SEQ ID NO: 1461301 - RNA, 17 nt, Human
ggagagaguugaaccua

SEQ ID NO: 1461302 - RNA, 20 nt, Human
ggagagaguugaaccuaaac

SEQ ID NO: 1461303 - RNA, 16 nt, Human
ggacuugugucucugu

SEQ ID NO: 1461304 - RNA, 12 nt, Human
ggacuugugucu

SEQ ID NO: 1461305 - RNA, 23 nt, Human
ggacugugugcucaggagcccug

SEQ ID NO: 1461306 - RNA, 22 nt, Human
ggacugugugcucaggagcccu

SEQ ID NO: 1461307 - RNA, 13 nt, Human
ggaccucaccaag

SEQ ID NO: 1461308 - RNA, 17 nt, Human
ggaccccagccauccag

SEQ ID NO: 1461309 - RNA, 22 nt, Human
ggcugggaauggaggggcagag

SEQ ID NO: 1461310 - RNA, 21 nt, Human
ggcugggaauggaggggcaga

SEQ ID NO: 1461311 - RNA, 23 nt, Human
ggcuccuccaggguggcagcaac

SEQ ID NO: 1461312 - RNA, 17 nt, Human
ggcuccgugugggagac

SEQ ID NO: 1461313 - RNA, 20 nt, Human
ggcuccucgagaucccaaca

SEQ ID NO: 1461314 - RNA, 17 nt, Human
ggcuccuauucaacaca

SEQ ID NO: 1461315 - RNA, 18 nt, Human
ggcuccgugugggagacc

SEQ ID NO: 1461316 - RNA, 14 nt, Human
ggcuccguguggga

SEQ ID NO: 1461317 - RNA, 15 nt, Human
ggcuccgugugggag

SEQ ID NO: 1461318 - RNA, 16 nt, Human
ggcuccgugugggaga

SEQ ID NO: 1461319 - RNA, 21 nt, Human
ggcugaaaggaagcugugcgu

SEQ ID NO: 1461320 - RNA, 15 nt, Human
aaaaagggaggggga

SEQ ID NO: 1461321 - RNA, 18 nt, Human
aaaaagcgaaaaaaucag

SEQ ID NO: 1461322 - RNA, 12 nt, Human
aaaaagcuuaaa

SEQ ID NO: 1461323 - RNA, 15 nt, Human
aaaaagcuuaaaacu

SEQ ID NO: 1461324 - RNA, 17 nt, Human
aaaaagcuuaaaacuuu

SEQ ID NO: 1461325 - RNA, 19 nt, Human
aaaaagcuuaaaacuuuga

SEQ ID NO: 1461326 - RNA, 20 nt, Human
aaaaagcuuaaaacuuugaa

SEQ ID NO: 1461327 - RNA, 13 nt, Human
aaaaagguuuaca

SEQ ID NO: 1461328 - RNA, 18 nt, Human
aaaaagguuuacagaauu

SEQ ID NO: 1461329 - RNA, 12 nt, Human
aaaaaaaauaca

SEQ ID NO: 1461330 - RNA, 16 nt, Human
ggcuucagguccaggc

SEQ ID NO: 1461331 - RNA, 13 nt, Human
ggcuucaggucca

SEQ ID NO: 1461332 - RNA, 20 nt, Human
aaaaaguggguuuuuuaguu

SEQ ID NO: 1461333 - RNA, 22 nt, Human
aaaaaguggguuuuuuaguuga

SEQ ID NO: 1461334 - RNA, 23 nt, Human
aaaaaguggguuuuuuaguugaa

SEQ ID NO: 1461335 - RNA, 19 nt, Human
aaaagggacugagaaauuu

SEQ ID NO: 1461336 - RNA, 13 nt, Human
aaaagguuuacag

SEQ ID NO: 1461337 - RNA, 14 nt, Human
aaaagguuuacaga

SEQ ID NO: 1461338 - RNA, 16 nt, Human
aaaagguuuacagaau

SEQ ID NO: 1461339 - RNA, 16 nt, Human
aaaagggacugagaaa

SEQ ID NO: 1461340 - RNA, 20 nt, Human
aaaaggcuagguacacagcu

SEQ ID NO: 1461341 - RNA, 18 nt, Human
gggauuaugggucacagg

SEQ ID NO: 1461342 - RNA, 20 nt, Human
gggauuaugggucacaggaa

SEQ ID NO: 1461343 - RNA, 14 nt, Human
gggagggggagagg

SEQ ID NO: 1461344 - RNA, 16 nt, Human
gggcagagccaggaag

SEQ ID NO: 1461345 - RNA, 14 nt, Human
gggcagagccagga

SEQ ID NO: 1461346 - RNA, 13 nt, Human
gggcagagccagg

SEQ ID NO: 1461347 - RNA, 16 nt, Human
gggcagcaauuuaaau

SEQ ID NO: 1461348 - RNA, 14 nt, Human
aaaauauauacuaa

SEQ ID NO: 1461349 - RNA, 14 nt, Human
aaaauauguaccaa

SEQ ID NO: 1461350 - RNA, 18 nt, Human
aaaauauauaucaaauau

SEQ ID NO: 1461351 - RNA, 17 nt, Human
aaaauauauacuaaaca

SEQ ID NO: 1461352 - RNA, 13 nt, Human
aaaauauauacua

SEQ ID NO: 1461353 - RNA, 20 nt, Human
aaaauagcuaaauaccucaa

SEQ ID NO: 1461354 - RNA, 13 nt, Human
aaaauaguuugga

SEQ ID NO: 1461355 - RNA, 16 nt, Human
aaaauaguuuggauau

SEQ ID NO: 1461356 - RNA, 19 nt, Human
aaaauaguuuggauaugua

SEQ ID NO: 1461357 - RNA, 22 nt, Human
aaaauaguuuggauauguaaaa

SEQ ID NO: 1461358 - RNA, 20 nt, Human
aaaauaguuuggauauguaa

SEQ ID NO: 1461359 - RNA, 21 nt, Human
aaaauaauuuuuauauuugaa

SEQ ID NO: 1461360 - RNA, 23 nt, Human
aaaauaauuuuuauauuugaaau

SEQ ID NO: 1461361 - RNA, 17 nt, Human
aaaauagcaaaagaaga

SEQ ID NO: 1461362 - RNA, 15 nt, Human
aaaauacuauucuga

SEQ ID NO: 1461363 - RNA, 18 nt, Human
aaaagguuuacagaauuu

SEQ ID NO: 1461364 - RNA, 14 nt, Human
aaaagguuuaugaa

SEQ ID NO: 1461365 - RNA, 19 nt, Human
aaaagguuuaugaaaaaga

SEQ ID NO: 1461366 - RNA, 20 nt, Human
aaaagguuuaugaaaaagaa

SEQ ID NO: 1461367 - RNA, 23 nt, Human
aaaagguuuaugaaaaagaagaa

SEQ ID NO: 1461368 - RNA, 13 nt, Human
aaaaguaauaaaa

SEQ ID NO: 1461369 - RNA, 15 nt, Human
aaaauaaagaaugga

SEQ ID NO: 1461370 - RNA, 16 nt, Human
aaaauaaagaauggaa

SEQ ID NO: 1461371 - RNA, 18 nt, Human
aaaagccuguuuaagaga

SEQ ID NO: 1461372 - RNA, 16 nt, Human
aaaagccuguuuaaga

SEQ ID NO: 1461373 - RNA, 13 nt, Human
aaaacuuuaaagc

SEQ ID NO: 1461374 - RNA, 22 nt, Human
aaaagcuccauuuuuagugaaa

SEQ ID NO: 1461375 - RNA, 14 nt, Human
aaaagcuagaauug

SEQ ID NO: 1461376 - RNA, 17 nt, Human
gggacugcggaggaagg

SEQ ID NO: 1461377 - RNA, 21 nt, Human
aaaaauuaaaccggaccaucu

SEQ ID NO: 1461378 - RNA, 20 nt, Human
aaaaauguucuauuuuaauu

SEQ ID NO: 1461379 - RNA, 14 nt, Human
aaaaaugaucuaaa

SEQ ID NO: 1461380 - RNA, 20 nt, Human
aaaaaugauuucaguagcac

SEQ ID NO: 1461381 - RNA, 16 nt, Human
aaaaaugauuucagua

SEQ ID NO: 1461382 - RNA, 22 nt, Human
gggaaaucaaaagggccaaaga

SEQ ID NO: 1461383 - RNA, 19 nt, Human
aaaaauuaucuauagcuaa

SEQ ID NO: 1461384 - RNA, 22 nt, Human
aaaacauuuauuuugacauaaa

SEQ ID NO: 1461385 - RNA, 19 nt, Human
aaaacugcucauaugaugu

SEQ ID NO: 1461386 - RNA, 17 nt, Human
aaaacuacuucuuuuuu

SEQ ID NO: 1461387 - RNA, 14 nt, Human
aaaacugcauuuca

SEQ ID NO: 1461388 - RNA, 13 nt, Human
aaaacuaaaaacu

SEQ ID NO: 1461389 - RNA, 16 nt, Human
aaaacuaaaaacuaga

SEQ ID NO: 1461390 - RNA, 22 nt, Human
aaaacuacaaccaauggaaugu

SEQ ID NO: 1461391 - RNA, 19 nt, Human
aaaauuuuuaaucuuuaau

SEQ ID NO: 1461392 - RNA, 19 nt, Human
aaaauuuuuucucuaggaa

SEQ ID NO: 1461393 - RNA, 22 nt, Human
aaaauuuuuucucuaggaaaua

SEQ ID NO: 1461394 - RNA, 16 nt, Human
aaaauuuuuaaucuuu

SEQ ID NO: 1461395 - RNA, 13 nt, Human
aaacaaagaaauu

SEQ ID NO: 1461396 - RNA, 20 nt, Human
aaacaaacucguuuuuuaca

SEQ ID NO: 1461397 - RNA, 18 nt, Human
aaacaaagaguucaagaa

SEQ ID NO: 1461398 - RNA, 17 nt, Human
aaacaaggaugaauuaa

SEQ ID NO: 1461399 - RNA, 12 nt, Human
aaaauggaauac

SEQ ID NO: 1461400 - RNA, 22 nt, Human
aaaauggaggccauugugugag

SEQ ID NO: 1461401 - RNA, 19 nt, Human
aaaauggccauuugcuuuu

SEQ ID NO: 1461402 - RNA, 12 nt, Human
aaaauguaggag

SEQ ID NO: 1461403 - RNA, 17 nt, Human
aaaauguaggagacugu

SEQ ID NO: 1461404 - RNA, 14 nt, Human
aaacacaacuauau

SEQ ID NO: 1461405 - RNA, 23 nt, Human
aaacaaguauuuguuaauuuaga

SEQ ID NO: 1461406 - RNA, 19 nt, Human
aaacaagucagucauucag

SEQ ID NO: 1461407 - RNA, 16 nt, Human
aaacaagguuuucagu

SEQ ID NO: 1461408 - RNA, 12 nt, Human
aaacaaguauuu

SEQ ID NO: 1461409 - RNA, 13 nt, Human
aaacaaguauuug

SEQ ID NO: 1461410 - RNA, 22 nt, Human
aaacaaguauuuguuaauuuag

SEQ ID NO: 1461411 - RNA, 13 nt, Human
aaacauauauaac

SEQ ID NO: 1461412 - RNA, 20 nt, Human
aaacauaaucuucugccuuc

SEQ ID NO: 1461413 - RNA, 16 nt, Human
aaacauauauaacaau

SEQ ID NO: 1461414 - RNA, 19 nt, Human
aaacauauauaacaaugcu

SEQ ID NO: 1461415 - RNA, 21 nt, Human
aaacauauauaacaaugcugu

SEQ ID NO: 1461416 - RNA, 14 nt, Human
ggggccaggcuggg

SEQ ID NO: 1461417 - RNA, 13 nt, Human
ggggccaggcugg

SEQ ID NO: 1461418 - RNA, 16 nt, Human
ggggccaggcuggguc

SEQ ID NO: 1461419 - RNA, 23 nt, Human
ggggucucuucugaauaaagcaa

SEQ ID NO: 1461420 - RNA, 12 nt, Human
ggggccugggca

SEQ ID NO: 1461421 - RNA, 12 nt, Human
ggggaagacagu

SEQ ID NO: 1461422 - RNA, 16 nt, Human
ggggaagacaguggcc

SEQ ID NO: 1461423 - RNA, 15 nt, Human
ggggccugggcagga

SEQ ID NO: 1461424 - RNA, 12 nt, Human
ggguaggcagga

SEQ ID NO: 1461425 - RNA, 13 nt, Human
ggguaggcaggau

SEQ ID NO: 1461426 - RNA, 20 nt, Human
ggguaggcaggauuggggaa

SEQ ID NO: 1461427 - RNA, 18 nt, Human
aaaccaaaucacugaacu

SEQ ID NO: 1461428 - RNA, 21 nt, Human
aaacauuuauuuugacauaaa

SEQ ID NO: 1461429 - RNA, 20 nt, Human
aaacauuuauuuugacauaa

SEQ ID NO: 1461430 - RNA, 14 nt, Human
aaacauuuauuuug

SEQ ID NO: 1461431 - RNA, 17 nt, Human
aaacauuuauuuugaca

SEQ ID NO: 1461432 - RNA, 18 nt, Human
aaacauuuauuuugacau

SEQ ID NO: 1461433 - RNA, 23 nt, Human
aaacauguuucuuuguaaugaaa

SEQ ID NO: 1461434 - RNA, 22 nt, Human
aaacauguuucuuuguaaugaa

SEQ ID NO: 1461435 - RNA, 19 nt, Human
aaacauguuucuuuguaau

SEQ ID NO: 1461436 - RNA, 19 nt, Human
aaacauguuuccacuauug

SEQ ID NO: 1461437 - RNA, 12 nt, Human
gggucaggccuu

SEQ ID NO: 1461438 - RNA, 21 nt, Human
aaaccacauuggagauguuua

SEQ ID NO: 1461439 - RNA, 15 nt, Human
aaacuacauauugua

SEQ ID NO: 1461440 - RNA, 21 nt, Human
aaacuacaaccaauggaaugu

SEQ ID NO: 1461441 - RNA, 11 nt, Human
aaacuaaucca

SEQ ID NO: 1461442 - RNA, 15 nt, Human
aaacgucuuaaauau

SEQ ID NO: 1461443 - RNA, 17 nt, Human
aaacuguaauacaauga

SEQ ID NO: 1461444 - RNA, 23 nt, Human
aaacucccacuugucaugugaca

SEQ ID NO: 1461445 - RNA, 22 nt, Human
aaacuagaggugagaaauuuaa

SEQ ID NO: 1461446 - RNA, 18 nt, Human
aaagagaacuuccagauc

SEQ ID NO: 1461447 - RNA, 13 nt, Human
aaagagaaacacg

SEQ ID NO: 1461448 - RNA, 12 nt, Human
aaagagaaacac

SEQ ID NO: 1461449 - RNA, 17 nt, Human
aaagaauggcagaaaag

SEQ ID NO: 1461450 - RNA, 15 nt, Human
aaagaauuauuuugu

SEQ ID NO: 1461451 - RNA, 22 nt, Human
aaacuuuaaagcguuugcacag

SEQ ID NO: 1461452 - RNA, 12 nt, Human
aaacuuuuuuau

SEQ ID NO: 1461453 - RNA, 17 nt, Human
aaacuuuuuuauuuaaa

SEQ ID NO: 1461454 - RNA, 19 nt, Human
aaacuuuuuuauuuaaaaa

SEQ ID NO: 1461455 - RNA, 16 nt, Human
aaagaaugauuaugaa

SEQ ID NO: 1461456 - RNA, 17 nt, Human
gguauucguuaucuaau

SEQ ID NO: 1461457 - RNA, 20 nt, Human
gguagucucacugcuugaac

SEQ ID NO: 1461458 - RNA, 15 nt, Human
gguagucucacugcu

SEQ ID NO: 1461459 - RNA, 17 nt, Human
ggugcacuggccccacc

SEQ ID NO: 1461460 - RNA, 18 nt, Human
ggugauuccgcagugaga

SEQ ID NO: 1461461 - RNA, 13 nt, Human
aaagauuuuuuaa

SEQ ID NO: 1461462 - RNA, 14 nt, Human
aaagauuuuuuaau

SEQ ID NO: 1461463 - RNA, 19 nt, Human
aaagauuuuuuaauaauuu

SEQ ID NO: 1461464 - RNA, 20 nt, Human
aaagauuuuuuaauaauuua

SEQ ID NO: 1461465 - RNA, 22 nt, Human
aaagauuuuuuaauaauuuaga

SEQ ID NO: 1461466 - RNA, 21 nt, Human
aaagauuuuuuaauaauuuag

SEQ ID NO: 1461467 - RNA, 14 nt, Human
aaagcaaaaaagaa

SEQ ID NO: 1461468 - RNA, 15 nt, Human
aaagcaaaaaagaaa

SEQ ID NO: 1461469 - RNA, 21 nt, Human
aaagcaaaaaagaaaaccuuu

SEQ ID NO: 1461470 - RNA, 16 nt, Human
aaagcaaaaaagaaaa

SEQ ID NO: 1461471 - RNA, 15 nt, Human
ggucugguugggcag

SEQ ID NO: 1461472 - RNA, 16 nt, Human
aaagcuacuuauugua

SEQ ID NO: 1461473 - RNA, 17 nt, Human
aaagcuacuuauuguag

SEQ ID NO: 1461474 - RNA, 14 nt, Human
aaagcguuugcaca

SEQ ID NO: 1461475 - RNA, 14 nt, Human
aaagcuaaaauaaa

SEQ ID NO: 1461476 - RNA, 16 nt, Human
aaagcuaaaauaaaga

SEQ ID NO: 1461477 - RNA, 21 nt, Human
aaagcuaaaauaaagaaauag

SEQ ID NO: 1461478 - RNA, 17 nt, Human
aaagcuauauaagacaa

SEQ ID NO: 1461479 - RNA, 17 nt, Human
aaagcuucagugcugcc

SEQ ID NO: 1461480 - RNA, 20 nt, Human
aaagcuucagugcugccgau

SEQ ID NO: 1461481 - RNA, 19 nt, Human
aaagcuuuuuauuccuccu

SEQ ID NO: 1461482 - RNA, 15 nt, Human
aaaggacaucagcaa

SEQ ID NO: 1461483 - RNA, 16 nt, Human
aaaggacaucagcaaa

SEQ ID NO: 1461484 - RNA, 14 nt, Human
aaaggacaucagca

SEQ ID NO: 1461485 - RNA, 13 nt, Human
aaaggaauuuaaa

SEQ ID NO: 1461486 - RNA, 16 nt, Human
aaaggaaagaaaacau

SEQ ID NO: 1461487 - RNA, 15 nt, Human
aaaggaaagaaaaca

SEQ ID NO: 1461488 - RNA, 20 nt, Human
gaacccuaaauaauaaaaau

SEQ ID NO: 1461489 - RNA, 14 nt, Human
gaacugaaaucaua

SEQ ID NO: 1461490 - RNA, 22 nt, Human
gaacuccuugauuuuagccuuc

SEQ ID NO: 1461491 - RNA, 12 nt, Human
gaaccgaggcag

SEQ ID NO: 1461492 - RNA, 15 nt, Human
gaaccgaggcaggga

SEQ ID NO: 1461493 - RNA, 15 nt, Human
gaacuccuugauuuu

SEQ ID NO: 1461494 - RNA, 23 nt, Human
gaagaauacuucucauuuuuuaa

SEQ ID NO: 1461495 - RNA, 21 nt, Human
gaagaaucucaucucagugaa

SEQ ID NO: 1461496 - RNA, 24 nt, Human
gaagaaugcuuaaucagauagaua

SEQ ID NO: 1461497 - RNA, 22 nt, Human
gaagaauguuaagacuugacag

SEQ ID NO: 1461498 - RNA, 12 nt, Human
gaagaauuccag

SEQ ID NO: 1461499 - RNA, 12 nt, Human
gaacugaacacc

SEQ ID NO: 1461500 - RNA, 21 nt, Human
gaacugaacaccauugaaggc

SEQ ID NO: 1461501 - RNA, 22 nt, Human
gaacugaacaccauugaaggcu

SEQ ID NO: 1461502 - RNA, 23 nt, Human
gaacugaacaccauugaaggcuu

SEQ ID NO: 1461503 - RNA, 20 nt, Human
gaagcaaugcuucaucccuu

SEQ ID NO: 1461504 - RNA, 22 nt, Human
gaagcaaccucaguaauuuaga

SEQ ID NO: 1461505 - RNA, 16 nt, Human
gaagcaagcuuaaugg

SEQ ID NO: 1461506 - RNA, 17 nt, Human
gaagcaaaucgaaugaa

SEQ ID NO: 1461507 - RNA, 20 nt, Human
gaagcaaguaaaaaggcuaa

SEQ ID NO: 1461508 - RNA, 20 nt, Human
gaagcaaccucaguaauuua

SEQ ID NO: 1461509 - RNA, 14 nt, Human
gaagcaaaauuuuu

SEQ ID NO: 1461510 - RNA, 14 nt, Human
gaagacaauugaca

SEQ ID NO: 1461511 - RNA, 18 nt, Human
gaagacaauugacaacag

SEQ ID NO: 1461512 - RNA, 12 nt, Human
gaagacacagac

SEQ ID NO: 1461513 - RNA, 21 nt, Human
gaagacacagacugcgauuug

SEQ ID NO: 1461514 - RNA, 23 nt, Human
gaaguugacuuauaguacaugau

SEQ ID NO: 1461515 - RNA, 21 nt, Human
gaaguugacuuauaguacaug

SEQ ID NO: 1461516 - RNA, 19 nt, Human
gaaguuagcuuuaacuuaa

SEQ ID NO: 1461517 - RNA, 17 nt, Human
gaaguuagcuuuaacuu

SEQ ID NO: 1461518 - RNA, 19 nt, Human
gaauauaauuguuuuaucu

SEQ ID NO: 1461519 - RNA, 20 nt, Human
gaauauaauuguuuuaucug

SEQ ID NO: 1461520 - RNA, 20 nt, Human
gaagcuaucguaaaauuaag

SEQ ID NO: 1461521 - RNA, 20 nt, Human
gaagcuauuuuuuucaguuu

SEQ ID NO: 1461522 - RNA, 22 nt, Human
gaccucuccccuggaacugucu

SEQ ID NO: 1461523 - RNA, 12 nt, Human
gaccugaagaau

SEQ ID NO: 1461524 - RNA, 19 nt, Human
gacuuuauagaucagccag

SEQ ID NO: 1461525 - RNA, 17 nt, Human
gacuuuauguaguuuuu

SEQ ID NO: 1461526 - RNA, 14 nt, Human
gacucuuaagaaga

SEQ ID NO: 1461527 - RNA, 15 nt, Human
gacucuuaagaagac

SEQ ID NO: 1461528 - RNA, 21 nt, Human
gacucuuaagaagacugcauu

SEQ ID NO: 1461529 - RNA, 17 nt, Human
gacucuucugagcaccu

SEQ ID NO: 1461530 - RNA, 19 nt, Human
gacugaaaauauuguuuua

SEQ ID NO: 1461531 - RNA, 22 nt, Human
gacugugugcucaggagcccug

SEQ ID NO: 1461532 - RNA, 20 nt, Human
gacugaauuaugaaacuuuu

SEQ ID NO: 1461533 - RNA, 14 nt, Human
gacugaauuaugaa

SEQ ID NO: 1461534 - RNA, 20 nt, Human
gacagaaccccuacaugaaa

SEQ ID NO: 1461535 - RNA, 15 nt, Human
gacacacugaagaag

SEQ ID NO: 1461536 - RNA, 16 nt, Human
gacacacugaagaagc

SEQ ID NO: 1461537 - RNA, 16 nt, Human
gacauuugcucaugga

SEQ ID NO: 1461538 - RNA, 17 nt, Human
gacauuugcucauggaa

SEQ ID NO: 1461539 - RNA, 23 nt, Human
gacauugaccuauuuccagaaau

SEQ ID NO: 1461540 - RNA, 13 nt, Human
gacauucugauuc

SEQ ID NO: 1461541 - RNA, 23 nt, Human
gacauucugauucgaaugacacu

SEQ ID NO: 1461542 - RNA, 22 nt, Human
gacauucugauucgaaugacac

SEQ ID NO: 1461543 - RNA, 20 nt, Human
gagcuggagaugaggccaga

SEQ ID NO: 1461544 - RNA, 17 nt, Human
gagcuggaccucaccaa

SEQ ID NO: 1461545 - RNA, 21 nt, Human
gagcgcacagggagugcacau

SEQ ID NO: 1461546 - RNA, 18 nt, Human
gaggccagaccauggaca

SEQ ID NO: 1461547 - RNA, 12 nt, Human
gaggccagacca

SEQ ID NO: 1461548 - RNA, 22 nt, Human
gaggcuagguggguugaaagcc

SEQ ID NO: 1461549 - RNA, 20 nt, Human
gaggcuauuauuuucacugu

SEQ ID NO: 1461550 - RNA, 9 nt, Human
gagggcugc

SEQ ID NO: 1461551 - RNA, 16 nt, Human
gagggcugccuuugga

SEQ ID NO: 1461552 - RNA, 13 nt, Human
gagggcugcccug

SEQ ID NO: 1461553 - RNA, 16 nt, Human
gaguuuaaauuguaau

SEQ ID NO: 1461554 - RNA, 18 nt, Human
gaguugcugcaaaccuga

SEQ ID NO: 1461555 - RNA, 15 nt, Human
gaguuggaaucacug

SEQ ID NO: 1461556 - RNA, 15 nt, Human
gaggugagaccaccu

SEQ ID NO: 1461557 - RNA, 16 nt, Human
gaggugagaccaccuc

SEQ ID NO: 1461558 - RNA, 22 nt, Human
gaggugcuucuaguucugccag

SEQ ID NO: 1461559 - RNA, 23 nt, Human
gaggugcuucuaguucugccagg

SEQ ID NO: 1461560 - RNA, 17 nt, Human
gagucacuacgccuggc

SEQ ID NO: 1461561 - RNA, 17 nt, Human
gaguccaucagccucca

SEQ ID NO: 1461562 - RNA, 14 nt, Human
gagugcaccaaaga

SEQ ID NO: 1461563 - RNA, 17 nt, Human
gagugcaccaaagagaa

SEQ ID NO: 1461564 - RNA, 15 nt, Human
gagugcaccaaagag

SEQ ID NO: 1461565 - RNA, 19 nt, Human
gagguccuuaggccucuga

SEQ ID NO: 1461566 - RNA, 21 nt, Human
gagguccuuaggccucugaga

SEQ ID NO: 1461567 - RNA, 21 nt, Human
gauuuuuuucccaauugagaa

SEQ ID NO: 1461568 - RNA, 18 nt, Human
gauuuuuuccuucaaagu

SEQ ID NO: 1461569 - RNA, 21 nt, Human
gauuuuuuccuucaaaguuua

SEQ ID NO: 1461570 - RNA, 15 nt, Human
gauuuuuuuuucaua

SEQ ID NO: 1461571 - RNA, 20 nt, Human
gcaaguauuagaauaccaca

SEQ ID NO: 1461572 - RNA, 18 nt, Human
gcaagucagaauagaaau

SEQ ID NO: 1461573 - RNA, 22 nt, Human
gcaauagucaaauugugugaaa

SEQ ID NO: 1461574 - RNA, 17 nt, Human
gcacauaguagaacgcu

SEQ ID NO: 1461575 - RNA, 16 nt, Human
gcacaauaaaaauguu

SEQ ID NO: 1461576 - RNA, 17 nt, Human
gcacaauaaaaauguuu

SEQ ID NO: 1461577 - RNA, 17 nt, Human
gcacaaguuauuuaaau

SEQ ID NO: 1461578 - RNA, 15 nt, Human
gcacuugcuggaaga

SEQ ID NO: 1461579 - RNA, 13 nt, Human
gcacaucccugga

SEQ ID NO: 1461580 - RNA, 14 nt, Human
gcaccggggccugg

SEQ ID NO: 1461581 - RNA, 16 nt, Human
gcaccggggccugggc

SEQ ID NO: 1461582 - RNA, 14 nt, Human
gcaccuacuuacau

SEQ ID NO: 1461583 - RNA, 15 nt, Human
gauggagaaggaagg

SEQ ID NO: 1461584 - RNA, 16 nt, Human
gauggagaaggaaggc

SEQ ID NO: 1461585 - RNA, 14 nt, Human
gauggagaaggaag

SEQ ID NO: 1461586 - RNA, 13 nt, Human
gauggagaaggaa

SEQ ID NO: 1461587 - RNA, 12 nt, Human
gauggagaagga

SEQ ID NO: 1461588 - RNA, 14 nt, Human
gaugcugauggagc

SEQ ID NO: 1461589 - RNA, 17 nt, Human
gauguaaaaucuuguca

SEQ ID NO: 1461590 - RNA, 13 nt, Human
gauguaaaaucuu

SEQ ID NO: 1461591 - RNA, 14 nt, Human
gauguaaaaucuug

SEQ ID NO: 1461592 - RNA, 15 nt, Human
gauguaaaaucuugu

SEQ ID NO: 1461593 - RNA, 16 nt, Human
gauguaaaaucuuguc

SEQ ID NO: 1461594 - RNA, 20 nt, Human
gauguaaaaucuugucaugu

SEQ ID NO: 1461595 - RNA, 16 nt, Human
gauuuaccacuugugu

SEQ ID NO: 1461596 - RNA, 15 nt, Human
gauuuacgcucauug

SEQ ID NO: 1461597 - RNA, 19 nt, Human
gauuuuuuaauaauuuaga

SEQ ID NO: 1461598 - RNA, 15 nt, Human
gauuuaccacuugug

SEQ ID NO: 1461599 - RNA, 14 nt, Human
gauucuuccaucug

SEQ ID NO: 1461600 - RNA, 14 nt, Human
gauuauauuaugaa

SEQ ID NO: 1461601 - RNA, 13 nt, Human
gauuaugggucac

SEQ ID NO: 1461602 - RNA, 15 nt, Human
cuucuguuuuauaau

SEQ ID NO: 1461603 - RNA, 20 nt, Human
cuucuguuuuauaauuuugu

SEQ ID NO: 1461604 - RNA, 22 nt, Human
cuucugagcccgguaagagcaa

SEQ ID NO: 1461605 - RNA, 16 nt, Human
cuucugagcuauuuca

SEQ ID NO: 1461606 - RNA, 17 nt, Human
cuucugagcuauuucau

SEQ ID NO: 1461607 - RNA, 18 nt, Human
cuucugagcuauuucauc

SEQ ID NO: 1461608 - RNA, 20 nt, Human
cuucugagcuauuucaucua

SEQ ID NO: 1461609 - RNA, 18 nt, Human
cuuggccaugcagaaagc

SEQ ID NO: 1461610 - RNA, 15 nt, Human
cuuggccaugcagaa

SEQ ID NO: 1461611 - RNA, 23 nt, Human
cuuggccaugggaggccuuuccc

SEQ ID NO: 1461612 - RNA, 19 nt, Human
cuuggccaugggaggccuu

SEQ ID NO: 1461613 - RNA, 16 nt, Human
cuuggccaugggaggc

SEQ ID NO: 1461614 - RNA, 20 nt, Human
cuuggccaugggaggccuuu

SEQ ID NO: 1461615 - RNA, 14 nt, Human
cuugacaacuggca

SEQ ID NO: 1461616 - RNA, 20 nt, Human
cuugacaacuggcaggcagg

SEQ ID NO: 1461617 - RNA, 16 nt, Human
cuugacaacuggcagg

SEQ ID NO: 1461618 - RNA, 12 nt, Human
cuugccugcagg

SEQ ID NO: 1461619 - RNA, 17 nt, Human
cuugccucaaccuccca

SEQ ID NO: 1461620 - RNA, 18 nt, Human
cuugccucaaccucccaa

SEQ ID NO: 1461621 - RNA, 14 nt, Human
cuuucuaguugaaa

SEQ ID NO: 1461622 - RNA, 16 nt, Human
cuuucuaguugaaaau

SEQ ID NO: 1461623 - RNA, 18 nt, Human
cuuucuaguugaaaauaa

SEQ ID NO: 1461624 - RNA, 21 nt, Human
cuuucuaguugaaaauaaagu

SEQ ID NO: 1461625 - RNA, 22 nt, Human
cuuugagcuacugccgucagug

SEQ ID NO: 1461626 - RNA, 16 nt, Human
cuuuuacuuuucuucu

SEQ ID NO: 1461627 - RNA, 14 nt, Human
cuuugguagaaaag

SEQ ID NO: 1461628 - RNA, 14 nt, Human
cuuugguccuucaa

SEQ ID NO: 1461629 - RNA, 19 nt, Human
cuuuggugagaaccugggu

SEQ ID NO: 1461630 - RNA, 22 nt, Human
cuuuucaaauagggucuaacuc

SEQ ID NO: 1461631 - RNA, 14 nt, Human
cuuucagagccucc

SEQ ID NO: 1461632 - RNA, 23 nt, Human
cuugugauccacucgccucagcc

SEQ ID NO: 1461633 - RNA, 23 nt, Human
cuuuaaagugacuaauggcauga

SEQ ID NO: 1461634 - RNA, 20 nt, Human
cuuuacacaauagaauuaua

SEQ ID NO: 1461635 - RNA, 20 nt, Human
cuuuaaggggaggaaccaga

SEQ ID NO: 1461636 - RNA, 11 nt, Human
cuuucagagcc

SEQ ID NO: 1461637 - RNA, 12 nt, Human
cuuucagagccu

SEQ ID NO: 1461638 - RNA, 13 nt, Human
cuuucagagccuc

SEQ ID NO: 1461639 - RNA, 19 nt, Human
cuuaugguaccagaugcag

SEQ ID NO: 1461640 - RNA, 13 nt, Human
cuuaugguaccag

SEQ ID NO: 1461641 - RNA, 21 nt, Human
cuuauuaacaauuaggcagac

SEQ ID NO: 1461642 - RNA, 23 nt, Human
cuucaugcauggaaauucccuuc

SEQ ID NO: 1461643 - RNA, 21 nt, Human
cuucaugcauggaaauucccu

SEQ ID NO: 1461644 - RNA, 23 nt, Human
cuucaugcugucuacacuaagag

SEQ ID NO: 1461645 - RNA, 17 nt, Human
cuucaguguauggaaau

SEQ ID NO: 1461646 - RNA, 20 nt, Human
cuucaguguauggaaauaaa

SEQ ID NO: 1461647 - RNA, 17 nt, Human
cuucaguuaugauuuuu

SEQ ID NO: 1461648 - RNA, 13 nt, Human
cuuauugccucac

SEQ ID NO: 1461649 - RNA, 14 nt, Human
cuuauugccucacu

SEQ ID NO: 1461650 - RNA, 19 nt, Human
cuuauugccucacuucagg

SEQ ID NO: 1461651 - RNA, 16 nt, Human
cuguucacuuuuccuc

SEQ ID NO: 1461652 - RNA, 17 nt, Human
cuguucacuuuuccucc

SEQ ID NO: 1461653 - RNA, 18 nt, Human
cuguucacuuuuccuccc

SEQ ID NO: 1461654 - RNA, 19 nt, Human
cugugcuauggugcucugu

SEQ ID NO: 1461655 - RNA, 21 nt, Human
cugugcuauggugcucugucu

SEQ ID NO: 1461656 - RNA, 22 nt, Human
cugugcguguguguguguguau

SEQ ID NO: 1461657 - RNA, 23 nt, Human
cuguguaagggccagaaauaucu

SEQ ID NO: 1461658 - RNA, 17 nt, Human
cuguguacauaacugaa

SEQ ID NO: 1461659 - RNA, 19 nt, Human
cuguguacauaacugaaaa

SEQ ID NO: 1461660 - RNA, 20 nt, Human
cuguguacauaacugaaaau

SEQ ID NO: 1461661 - RNA, 22 nt, Human
cuguguacauaacugaaaaugu

SEQ ID NO: 1461662 - RNA, 15 nt, Human
cuguguacugcaguu

SEQ ID NO: 1461663 - RNA, 11 nt, Human
cuuacacccac

SEQ ID NO: 1461664 - RNA, 20 nt, Human
cuuacacccacaguggaaag

SEQ ID NO: 1461665 - RNA, 20 nt, Human
cuguugggagagggcgcagg

SEQ ID NO: 1461666 - RNA, 22 nt, Human
cuguugggagagggcgcaggcc

SEQ ID NO: 1461667 - RNA, 19 nt, Human
cugcccccagagccacagu

SEQ ID NO: 1461668 - RNA, 20 nt, Human
cugcccccagagccacaguu

SEQ ID NO: 1461669 - RNA, 18 nt, Human
cugcccccagagccacag

SEQ ID NO: 1461670 - RNA, 17 nt, Human
cugcccccagagccaca

SEQ ID NO: 1461671 - RNA, 16 nt, Human
cugcccccagagccac

SEQ ID NO: 1461672 - RNA, 14 nt, Human
cugcccccagagcc

SEQ ID NO: 1461673 - RNA, 17 nt, Human
cugccccuacccuggac

SEQ ID NO: 1461674 - RNA, 22 nt, Human
cugcaggcaggaacaaacaggg

SEQ ID NO: 1461675 - RNA, 15 nt, Human
cugcaggcaggaaca

SEQ ID NO: 1461676 - RNA, 14 nt, Human
cugcaggcaggaac

SEQ ID NO: 1461677 - RNA, 14 nt, Human
cugcaggaaucuuu

SEQ ID NO: 1461678 - RNA, 20 nt, Human
cugcaggaucucaccaggca

SEQ ID NO: 1461679 - RNA, 21 nt, Human
cugcaggaucucaccaggcag

SEQ ID NO: 1461680 - RNA, 22 nt, Human
cugcacgaauggaagaggcacc

SEQ ID NO: 1461681 - RNA, 11 nt, Human
cugcagccucc

SEQ ID NO: 1461682 - RNA, 16 nt, Human
cugcaaccuccaccuc

SEQ ID NO: 1461683 - RNA, 14 nt, Human
cugcaaccuccacc

SEQ ID NO: 1461684 - RNA, 17 nt, Human
cugcaaccuccaccucc

SEQ ID NO: 1461685 - RNA, 13 nt, Human
cugcaaccuccac

SEQ ID NO: 1461686 - RNA, 17 nt, Human
cugcaaggucuuugguu

SEQ ID NO: 1461687 - RNA, 14 nt, Human
cugcaccggggccu

SEQ ID NO: 1461688 - RNA, 16 nt, Human
cugcaccggggccugg

SEQ ID NO: 1461689 - RNA, 18 nt, Human
cugcaccggggccugggc

SEQ ID NO: 1461690 - RNA, 19 nt, Human
cugcaccggggccugggca

SEQ ID NO: 1461691 - RNA, 15 nt, Human
cucuuauaucuauau

SEQ ID NO: 1461692 - RNA, 18 nt, Human
cucuuauaucuauauuuu

SEQ ID NO: 1461693 - RNA, 21 nt, Human
cugaugauuuagagugcuguc

SEQ ID NO: 1461694 - RNA, 17 nt, Human
cugauggagaaggaagg

SEQ ID NO: 1461695 - RNA, 15 nt, Human
cugauggagccuucc

SEQ ID NO: 1461696 - RNA, 16 nt, Human
cugauggagaaggaag

SEQ ID NO: 1461697 - RNA, 15 nt, Human
cugauggagaaggaa

SEQ ID NO: 1461698 - RNA, 14 nt, Human
cugauggagaagga

SEQ ID NO: 1461699 - RNA, 13 nt, Human
cugauggagaagg

SEQ ID NO: 1461700 - RNA, 23 nt, Human
cugaugggguggaaggcauggcg

SEQ ID NO: 1461701 - RNA, 21 nt, Human
cugaugggguggaaggcaugg

SEQ ID NO: 1461702 - RNA, 23 nt, Human
cuggacugugugcucaggagccc

SEQ ID NO: 1461703 - RNA, 22 nt, Human
cuggacugugugcucaggagcc

SEQ ID NO: 1461704 - RNA, 19 nt, Human
cuggacugugugcucagga

SEQ ID NO: 1461705 - RNA, 13 nt, Human
cugcuuaauucaa

SEQ ID NO: 1461706 - RNA, 12 nt, Human
cugcuuaauuca

SEQ ID NO: 1461707 - RNA, 15 nt, Human
cuggaugacauuaaa

SEQ ID NO: 1461708 - RNA, 15 nt, Human
cugcugugaaagaag

SEQ ID NO: 1461709 - RNA, 12 nt, Human
cugcuguggcca

SEQ ID NO: 1461710 - RNA, 14 nt, Human
cugcuguggccagg

SEQ ID NO: 1461711 - RNA, 15 nt, Human
cugcuguggccagga

SEQ ID NO: 1461712 - RNA, 16 nt, Human
cugcuguggccaggag

SEQ ID NO: 1461713 - RNA, 17 nt, Human
cugcuguggccaggagg

SEQ ID NO: 1461714 - RNA, 21 nt, Human
cugcuguggccaggaggugcc

SEQ ID NO: 1461715 - RNA, 18 nt, Human
cugcuguggccaggaggu

SEQ ID NO: 1461716 - RNA, 14 nt, Human
cugcugauauuuuc

SEQ ID NO: 1461717 - RNA, 17 nt, Human
cugcugauauuuucucu

SEQ ID NO: 1461718 - RNA, 18 nt, Human
cugcugauauuuucucua

SEQ ID NO: 1461719 - RNA, 19 nt, Human
cugcugauauuuucucuag

SEQ ID NO: 1461720 - RNA, 19 nt, Human
cuggguguaaaaccuggag

SEQ ID NO: 1461721 - RNA, 21 nt, Human
cuggguguaaaaccuggagau

SEQ ID NO: 1461722 - RNA, 15 nt, Human
cuggugccaauuuca

SEQ ID NO: 1461723 - RNA, 16 nt, Human
cuggugccaauuucaa

SEQ ID NO: 1461724 - RNA, 18 nt, Human
cuggugccaauuucaagu

SEQ ID NO: 1461725 - RNA, 20 nt, Human
cuggugccaauuucaaguuc

SEQ ID NO: 1461726 - RNA, 20 nt, Human
cuggguguaaaaccuggaga

SEQ ID NO: 1461727 - RNA, 19 nt, Human
cuggggacagguccucagu

SEQ ID NO: 1461728 - RNA, 12 nt, Human
cuggggacaggu

SEQ ID NO: 1461729 - RNA, 13 nt, Human
cuggggacuugug

SEQ ID NO: 1461730 - RNA, 18 nt, Human
cuggggacuugugucugc

SEQ ID NO: 1461731 - RNA, 17 nt, Human
cuggggacuugugucug

SEQ ID NO: 1461732 - RNA, 13 nt, Human
cugggcaggaggg

SEQ ID NO: 1461733 - RNA, 13 nt, Human
cugggagaaaucu

SEQ ID NO: 1461734 - RNA, 18 nt, Human
cugggagaaaucuggcuu

SEQ ID NO: 1461735 - RNA, 19 nt, Human
cugggagaaaucuggcuuc

SEQ ID NO: 1461736 - RNA, 20 nt, Human
cugggagaaaucuggcuucu

SEQ ID NO: 1461737 - RNA, 21 nt, Human
cugggagaaaucuggcuucug

SEQ ID NO: 1461738 - RNA, 16 nt, Human
cugggagaaaugaaaa

SEQ ID NO: 1461739 - RNA, 18 nt, Human
cugggacuugcaaaaagg

SEQ ID NO: 1461740 - RNA, 17 nt, Human
cugggagaaaugaaaaa

SEQ ID NO: 1461741 - RNA, 20 nt, Human
cuggcuccguccaggagccu

SEQ ID NO: 1461742 - RNA, 13 nt, Human
cucugcagguccc

SEQ ID NO: 1461743 - RNA, 13 nt, Human
cucuuagcugucu

SEQ ID NO: 1461744 - RNA, 22 nt, Human
cucugcacacccuccagagaca

SEQ ID NO: 1461745 - RNA, 20 nt, Human
cucugcacacccuccagaga

SEQ ID NO: 1461746 - RNA, 16 nt, Human
cucuccccaugauguu

SEQ ID NO: 1461747 - RNA, 19 nt, Human
cucuauggggcauccucuu

SEQ ID NO: 1461748 - RNA, 19 nt, Human
cucucugugggcuggcagu

SEQ ID NO: 1461749 - RNA, 23 nt, Human
cucucuuauugccucacuucagg

SEQ ID NO: 1461750 - RNA, 16 nt, Human
cucguggacaccugcc

SEQ ID NO: 1461751 - RNA, 15 nt, Human
cucguggacaccugc

SEQ ID NO: 1461752 - RNA, 20 nt, Human
cucuaugaacucuguuuucu

SEQ ID NO: 1461753 - RNA, 14 nt, Human
cucguggacaccug

SEQ ID NO: 1461754 - RNA, 12 nt, Human
cucguggacacc

SEQ ID NO: 1461755 - RNA, 19 nt, Human
cucccaggagacaguucaa

SEQ ID NO: 1461756 - RNA, 18 nt, Human
cucccaggaacugggcca

SEQ ID NO: 1461757 - RNA, 16 nt, Human
cucccaggagacaguu

SEQ ID NO: 1461758 - RNA, 11 nt, Human
cucccccugcc

SEQ ID NO: 1461759 - RNA, 14 nt, Human
cucaugugacucuu

SEQ ID NO: 1461760 - RNA, 14 nt, Human
cucaugaauguaaa

SEQ ID NO: 1461761 - RNA, 16 nt, Human
cuccugucucccuccu

SEQ ID NO: 1461762 - RNA, 21 nt, Human
cuccuugguucuugaggggac

SEQ ID NO: 1461763 - RNA, 22 nt, Human
cuccucugcccgggagcucagg

SEQ ID NO: 1461764 - RNA, 24 nt, Human
cuccucugcccgggagcucaggaa

SEQ ID NO: 1461765 - RNA, 16 nt, Human
cucagccucucgaagu

SEQ ID NO: 1461766 - RNA, 22 nt, Human
cucaggcccccaccuggcucac

SEQ ID NO: 1461767 - RNA, 17 nt, Human
cucaggcugaccacuuu

SEQ ID NO: 1461768 - RNA, 21 nt, Human
cucaccuugugcuggggacag

SEQ ID NO: 1461769 - RNA, 22 nt, Human
cucaccuugugcuggggacagg

SEQ ID NO: 1461770 - RNA, 22 nt, Human
cucacgccuguaaucccagcau

SEQ ID NO: 1461771 - RNA, 15 nt, Human
cucacuaauucauua

SEQ ID NO: 1461772 - RNA, 15 nt, Human
cucagacccuuucuu

SEQ ID NO: 1461773 - RNA, 14 nt, Human
cucagacccuuucu

SEQ ID NO: 1461774 - RNA, 19 nt, Human
cucagacucuaagaaagaa

SEQ ID NO: 1461775 - RNA, 14 nt, Human
cucagacucuaaga

SEQ ID NO: 1461776 - RNA, 18 nt, Human
cucagacucuaagaaaga

SEQ ID NO: 1461777 - RNA, 15 nt, Human
cucagcccugcacca

SEQ ID NO: 1461778 - RNA, 20 nt, Human
cucagcccugcaccaugcug

SEQ ID NO: 1461779 - RNA, 16 nt, Human
cucagcccugcaccau

SEQ ID NO: 1461780 - RNA, 15 nt, Human
cucagugaagaauac

SEQ ID NO: 1461781 - RNA, 18 nt, Human
cucagugaagaauacuuc

SEQ ID NO: 1461782 - RNA, 15 nt, Human
cucaugaauguaaau

SEQ ID NO: 1461783 - RNA, 16 nt, Human
cucaugaauguaaauu

SEQ ID NO: 1461784 - RNA, 22 nt, Human
cucaugaauguaaauuuguacu

SEQ ID NO: 1461785 - RNA, 21 nt, Human
cucaugaauguaaauuuguac

SEQ ID NO: 1461786 - RNA, 16 nt, Human
cucaugcaaaucaauu

SEQ ID NO: 1461787 - RNA, 19 nt, Human
cucaugcaaaucaauuacu

SEQ ID NO: 1461788 - RNA, 20 nt, Human
cucaugcaaaucaauuacug

SEQ ID NO: 1461789 - RNA, 16 nt, Human
cucaaucagucucaga

SEQ ID NO: 1461790 - RNA, 16 nt, Human
cuauguuuuuaaugua

SEQ ID NO: 1461791 - RNA, 14 nt, Human
cuauguuuuuaaug

SEQ ID NO: 1461792 - RNA, 19 nt, Human
cuauguuuugacauuuuua

SEQ ID NO: 1461793 - RNA, 18 nt, Human
cuauguuuugacauuuuu

SEQ ID NO: 1461794 - RNA, 15 nt, Human
cuauguuuuuaaugu

SEQ ID NO: 1461795 - RNA, 18 nt, Human
cuaucucauuuccaagca

SEQ ID NO: 1461796 - RNA, 16 nt, Human
cuauguccuaauaaua

SEQ ID NO: 1461797 - RNA, 19 nt, Human
cuaucagaguugcugcaaa

SEQ ID NO: 1461798 - RNA, 23 nt, Human
cguuaucuaauagggcaauuaau

SEQ ID NO: 1461799 - RNA, 19 nt, Human
cguucaacuuuuccuuuga

SEQ ID NO: 1461800 - RNA, 14 nt, Human
cguguuucugacuc

SEQ ID NO: 1461801 - RNA, 15 nt, Human
cguguuucugacucu

SEQ ID NO: 1461802 - RNA, 11 nt, Human
cuaaagccaaa

SEQ ID NO: 1461803 - RNA, 18 nt, Human
cuaaagccaaacauauau

SEQ ID NO: 1461804 - RNA, 23 nt, Human
cuaaaguaaaaacaaagaaauua

SEQ ID NO: 1461805 - RNA, 13 nt, Human
cgugacacaaaca

SEQ ID NO: 1461806 - RNA, 14 nt, Human
cgugagccaccucg

SEQ ID NO: 1461807 - RNA, 19 nt, Human
cuaaguacacaauaagcaa

SEQ ID NO: 1461808 - RNA, 20 nt, Human
cuaaguacacaauaagcaaa

SEQ ID NO: 1461809 - RNA, 19 nt, Human
cuaaguccaguguuucuuu

SEQ ID NO: 1461810 - RNA, 22 nt, Human
cuaagaaguacauuguuaccuc

SEQ ID NO: 1461811 - RNA, 13 nt, Human
cuaagagaaguag

SEQ ID NO: 1461812 - RNA, 15 nt, Human
cuaagagaaguagaa

SEQ ID NO: 1461813 - RNA, 17 nt, Human
cuaagagaaguagaaau

SEQ ID NO: 1461814 - RNA, 19 nt, Human
cuaagagaaguagaaauca

SEQ ID NO: 1461815 - RNA, 20 nt, Human
cgccacagcccuuuugucuc

SEQ ID NO: 1461816 - RNA, 21 nt, Human
cgccacagcccuuuugucucu

SEQ ID NO: 1461817 - RNA, 19 nt, Human
cgccacagcccuuuugucu

SEQ ID NO: 1461818 - RNA, 17 nt, Human
cgccacagcccuuuugu

SEQ ID NO: 1461819 - RNA, 14 nt, Human
cgccacagcccuuu

SEQ ID NO: 1461820 - RNA, 12 nt, Human
ccuuuucccaac

SEQ ID NO: 1461821 - RNA, 12 nt, Human
ccuuuuccaugc

SEQ ID NO: 1461822 - RNA, 23 nt, Human
ccuuuucccaaaauguugaaaua

SEQ ID NO: 1461823 - RNA, 12 nt, Human
ccuuucccuaag

SEQ ID NO: 1461824 - RNA, 14 nt, Human
cguacugcagccuc

SEQ ID NO: 1461825 - RNA, 15 nt, Human
cguacugcagccucc

SEQ ID NO: 1461826 - RNA, 20 nt, Human
cgguggcucacgccuguaau

SEQ ID NO: 1461827 - RNA, 14 nt, Human
cguaagauuuccuu

SEQ ID NO: 1461828 - RNA, 14 nt, Human
ccuugcauaauggu

SEQ ID NO: 1461829 - RNA, 15 nt, Human
ccuuucccuaagcca

SEQ ID NO: 1461830 - RNA, 17 nt, Human
ccuuucccuaagccagc

SEQ ID NO: 1461831 - RNA, 15 nt, Human
ccuugcggcuccuca

SEQ ID NO: 1461832 - RNA, 16 nt, Human
ccuugcggcuccucag

SEQ ID NO: 1461833 - RNA, 17 nt, Human
ccuugcggcuccucagg

SEQ ID NO: 1461834 - RNA, 18 nt, Human
ccuugcggcuccucaggg

SEQ ID NO: 1461835 - RNA, 19 nt, Human
ccuugcggcuccucaggga

SEQ ID NO: 1461836 - RNA, 20 nt, Human
ccuugcggcuccucagggac

SEQ ID NO: 1461837 - RNA, 13 nt, Human
ccuucccugcugu

SEQ ID NO: 1461838 - RNA, 19 nt, Human
ccuucucuguucauuuccu

SEQ ID NO: 1461839 - RNA, 21 nt, Human
ccuucucuguucauuuccuca

SEQ ID NO: 1461840 - RNA, 13 nt, Human
ccuucucuguuca

SEQ ID NO: 1461841 - RNA, 17 nt, Human
ccuucucuguucauuuc

SEQ ID NO: 1461842 - RNA, 18 nt, Human
ccuucucuguucauuucc

SEQ ID NO: 1461843 - RNA, 18 nt, Human
ccugcugcugccugccug

SEQ ID NO: 1461844 - RNA, 17 nt, Human
ccugcugcugccugccu

SEQ ID NO: 1461845 - RNA, 16 nt, Human
ccugcugcugccugcc

SEQ ID NO: 1461846 - RNA, 15 nt, Human
ccugcugcugccugc

SEQ ID NO: 1461847 - RNA, 14 nt, Human
ccugcugcccuccc

SEQ ID NO: 1461848 - RNA, 17 nt, Human
ccuguuaccuacuuuga

SEQ ID NO: 1461849 - RNA, 18 nt, Human
ccuguuaccuacuuugac

SEQ ID NO: 1461850 - RNA, 19 nt, Human
ccuguuaccuacuuugacu

SEQ ID NO: 1461851 - RNA, 17 nt, Human
ccuguugagcaucacag

SEQ ID NO: 1461852 - RNA, 12 nt, Human
ccuguugggaga

SEQ ID NO: 1461853 - RNA, 19 nt, Human
ccuuagcuggcauuacagc

SEQ ID NO: 1461854 - RNA, 22 nt, Human
ccuuagcuggcauuacagcugg

SEQ ID NO: 1461855 - RNA, 17 nt, Human
ccuuaugacugccaaga

SEQ ID NO: 1461856 - RNA, 16 nt, Human
ccuuaucgaaacucau

SEQ ID NO: 1461857 - RNA, 16 nt, Human
ccuuaggccucugaga

SEQ ID NO: 1461858 - RNA, 14 nt, Human
ccuuaggccucuga

SEQ ID NO: 1461859 - RNA, 18 nt, Human
ccuuauugcuguccugga

SEQ ID NO: 1461860 - RNA, 14 nt, Human
ccagagacuuuagg

SEQ ID NO: 1461861 - RNA, 23 nt, Human
ccagacuucccacggcuccucga

SEQ ID NO: 1461862 - RNA, 22 nt, Human
ccagacugcuuccaauuuucug

SEQ ID NO: 1461863 - RNA, 18 nt, Human
ccagagaaaaagggaggg

SEQ ID NO: 1461864 - RNA, 18 nt, Human
ccagaugcacaucccugg

SEQ ID NO: 1461865 - RNA, 15 nt, Human
ccacucuuucuuuca

SEQ ID NO: 1461866 - RNA, 20 nt, Human
ccacuuugcacagcucuccg

SEQ ID NO: 1461867 - RNA, 16 nt, Human
ccagacuacuugggag

SEQ ID NO: 1461868 - RNA, 18 nt, Human
ccaggcaggagcccuucu

SEQ ID NO: 1461869 - RNA, 12 nt, Human
ccaggcagccuc

SEQ ID NO: 1461870 - RNA, 16 nt, Human
ccaggcagccucuggg

SEQ ID NO: 1461871 - RNA, 17 nt, Human
ccaggcagccucugggg

SEQ ID NO: 1461872 - RNA, 14 nt, Human
ccaggcagccucug

SEQ ID NO: 1461873 - RNA, 15 nt, Human
ccaggauacuggcac

SEQ ID NO: 1461874 - RNA, 17 nt, Human
ccaggauacuggcacag

SEQ ID NO: 1461875 - RNA, 15 nt, Human
ccaggggccaugaau

SEQ ID NO: 1461876 - RNA, 17 nt, Human
ccccagccauccagggg

SEQ ID NO: 1461877 - RNA, 16 nt, Human
ccccauucuuccuagu

SEQ ID NO: 1461878 - RNA, 21 nt, Human
ccccauucuuccuaguuuucu

SEQ ID NO: 1461879 - RNA, 23 nt, Human
ccccauucuuccuaguuuucucc

SEQ ID NO: 1461880 - RNA, 20 nt, Human
cccauucuuccuaguuuucu

SEQ ID NO: 1461881 - RNA, 22 nt, Human
cccccugugccuugucacgcca

SEQ ID NO: 1461882 - RNA, 21 nt, Human
ccccgcguggaacucgugucu

SEQ ID NO: 1461883 - RNA, 12 nt, Human
cccauucuuccu

SEQ ID NO: 1461884 - RNA, 21 nt, Human
cccauucuuccuaguuuucuc

SEQ ID NO: 1461885 - RNA, 23 nt, Human
cccagcuggggccaggcuggguc

SEQ ID NO: 1461886 - RNA, 22 nt, Human
cccagcuggggccaggcugggu

SEQ ID NO: 1461887 - RNA, 14 nt, Human
cccauccaguucau

SEQ ID NO: 1461888 - RNA, 21 nt, Human
cccauccaguucaugagaauc

SEQ ID NO: 1461889 - RNA, 20 nt, Human
ccauugugccuaaguccagu

SEQ ID NO: 1461890 - RNA, 15 nt, Human
ccauugucucagagc

SEQ ID NO: 1461891 - RNA, 19 nt, Human
cccaagcuguuuucuucua

SEQ ID NO: 1461892 - RNA, 20 nt, Human
cccaagcaccugggauuaca

SEQ ID NO: 1461893 - RNA, 18 nt, Human
cccaccauuuggcauccc

SEQ ID NO: 1461894 - RNA, 23 nt, Human
cccaccauuuggcaucccugggc

SEQ ID NO: 1461895 - RNA, 20 nt, Human
cccaccauuuggcaucccug

SEQ ID NO: 1461896 - RNA, 23 nt, Human
cccacuguacuugcucuugaugc

SEQ ID NO: 1461897 - RNA, 19 nt, Human
cccacuguaucuaggcaac

SEQ ID NO: 1461898 - RNA, 19 nt, Human
cccacuguacuugcucuug

SEQ ID NO: 1461899 - RNA, 18 nt, Human
cccacuguacuugcucuu

SEQ ID NO: 1461900 - RNA, 18 nt, Human
ccaugggcacugugggua

SEQ ID NO: 1461901 - RNA, 21 nt, Human
ccaugagcuccuuaaggcucu

SEQ ID NO: 1461902 - RNA, 16 nt, Human
ccauggguagccuggg

SEQ ID NO: 1461903 - RNA, 23 nt, Human
ccugccuggacuuggccccugcc

SEQ ID NO: 1461904 - RNA, 19 nt, Human
ccugccuggaccagccucu

SEQ ID NO: 1461905 - RNA, 12 nt, Human
ccugccuggacc

SEQ ID NO: 1461906 - RNA, 14 nt, Human
ccugccucuuaaau

SEQ ID NO: 1461907 - RNA, 21 nt, Human
ccugccucuuaaauaaaccuu

SEQ ID NO: 1461908 - RNA, 21 nt, Human
ccugccucucugcaggucccu

SEQ ID NO: 1461909 - RNA, 20 nt, Human
ccugccucucugcagguccc

SEQ ID NO: 1461910 - RNA, 23 nt, Human
ccugccuccugccggcuccuugg

SEQ ID NO: 1461911 - RNA, 13 nt, Human
ccugcugcccucc

SEQ ID NO: 1461912 - RNA, 12 nt, Human
ccugcugcccuc

SEQ ID NO: 1461913 - RNA, 11 nt, Human
ccugcugcccu

SEQ ID NO: 1461914 - RNA, 18 nt, Human
ccugcugcccucccccuc

SEQ ID NO: 1461915 - RNA, 17 nt, Human
ccugccucucugcaggu

SEQ ID NO: 1461916 - RNA, 19 nt, Human
ccugacuagggagccaugu

SEQ ID NO: 1461917 - RNA, 16 nt, Human
ccugcagacucacugu

SEQ ID NO: 1461918 - RNA, 23 nt, Human
ccucuuggggaguuuaggguggg

SEQ ID NO: 1461919 - RNA, 22 nt, Human
ccucuuggggaguuuagggugg

SEQ ID NO: 1461920 - RNA, 19 nt, Human
ccucgccggaucugaggga

SEQ ID NO: 1461921 - RNA, 18 nt, Human
ccucgccggaucugaggg

SEQ ID NO: 1461922 - RNA, 20 nt, Human
ccucucgcuccucaaccccu

SEQ ID NO: 1461923 - RNA, 23 nt, Human
ccucucgcuccucaaccccuccc

SEQ ID NO: 1461924 - RNA, 17 nt, Human
ccucucugcaggucccu

SEQ ID NO: 1461925 - RNA, 16 nt, Human
ccucucugcagguccc

SEQ ID NO: 1461926 - RNA, 23 nt, Human
ccucucguaagauuuccuucuuu

SEQ ID NO: 1461927 - RNA, 22 nt, Human
ccucucgcuccucaaccccucc

SEQ ID NO: 1461928 - RNA, 19 nt, Human
ccucucguaagauuuccuu

SEQ ID NO: 1461929 - RNA, 22 nt, Human
ccucucguaagauuuccuucuu

SEQ ID NO: 1461930 - RNA, 19 nt, Human
ccucucugcaggucccuaa

SEQ ID NO: 1461931 - RNA, 18 nt, Human
ccucucugcaggucccua

SEQ ID NO: 1461932 - RNA, 20 nt, Human
ccucucugcaggucccuaau

SEQ ID NO: 1461933 - RNA, 21 nt, Human
ccucugcccgggagcucagga

SEQ ID NO: 1461934 - RNA, 22 nt, Human
ccucugcccgggagcucaggaa

SEQ ID NO: 1461935 - RNA, 15 nt, Human
ccucugcccuuccug

SEQ ID NO: 1461936 - RNA, 19 nt, Human
ccucugcccuuccugcagg

SEQ ID NO: 1461937 - RNA, 18 nt, Human
ccuccguccaggagccug

SEQ ID NO: 1461938 - RNA, 15 nt, Human
ccuccuuucuggcuu

SEQ ID NO: 1461939 - RNA, 12 nt, Human
ccucccuggaug

SEQ ID NO: 1461940 - RNA, 15 nt, Human
ccucaugaauguaaa

SEQ ID NO: 1461941 - RNA, 16 nt, Human
ccucaugaauguaaau

SEQ ID NO: 1461942 - RNA, 17 nt, Human
ccucaugaauguaaauu

SEQ ID NO: 1461943 - RNA, 19 nt, Human
ccucaugaauguaaauuug

SEQ ID NO: 1461944 - RNA, 20 nt, Human
ccucaugaauguaaauuugu

SEQ ID NO: 1461945 - RNA, 23 nt, Human
ccucaugaauguaaauuuguacu

SEQ ID NO: 1461946 - RNA, 22 nt, Human
ccucaugaauguaaauuuguac

SEQ ID NO: 1461947 - RNA, 13 nt, Human
ccucaugaaugua

SEQ ID NO: 1461948 - RNA, 22 nt, Human
ccucaggcaaucugcccgccug

SEQ ID NO: 1461949 - RNA, 21 nt, Human
ccuagcgcuaucucccugccu

SEQ ID NO: 1461950 - RNA, 21 nt, Human
ccuagcugugaccucuccccu

SEQ ID NO: 1461951 - RNA, 17 nt, Human
ccuagcuggcucuguga

SEQ ID NO: 1461952 - RNA, 15 nt, Human
ccuagcuggcucugu

SEQ ID NO: 1461953 - RNA, 14 nt, Human
ccuagcuggcucug

SEQ ID NO: 1461954 - RNA, 13 nt, Human
ccuagcuggcucu

SEQ ID NO: 1461955 - RNA, 18 nt, Human
cccugcccugccaccugu

SEQ ID NO: 1461956 - RNA, 17 nt, Human
cccugcccugccaccug

SEQ ID NO: 1461957 - RNA, 15 nt, Human
cccugcccugccacc

SEQ ID NO: 1461958 - RNA, 20 nt, Human
cccuggauuuuuaccagucu

SEQ ID NO: 1461959 - RNA, 24 nt, Human
cccuggauuuuuaccagucucaca

SEQ ID NO: 1461960 - RNA, 16 nt, Human
cccuggauuuuuacca

SEQ ID NO: 1461961 - RNA, 11 nt, Human
cccugagcuga

SEQ ID NO: 1461962 - RNA, 14 nt, Human
cccugagcugacca

SEQ ID NO: 1461963 - RNA, 20 nt, Human
cccugaauuuaaauagcuuu

SEQ ID NO: 1461964 - RNA, 14 nt, Human
cccugaacaagaau

SEQ ID NO: 1461965 - RNA, 17 nt, Human
cccuccucuccaccauc

SEQ ID NO: 1461966 - RNA, 16 nt, Human
ccuaauccccuucucc

SEQ ID NO: 1461967 - RNA, 18 nt, Human
ccuaauccccuucucccc

SEQ ID NO: 1461968 - RNA, 22 nt, Human
ccuaaugacaucaccacaguuu

SEQ ID NO: 1461969 - RNA, 20 nt, Human
ccuagcccucucacauuuau

SEQ ID NO: 1461970 - RNA, 13 nt, Human
ccuagcccucuca

SEQ ID NO: 1461971 - RNA, 23 nt, Human
ccgaaggugaggagcuugaaacc

SEQ ID NO: 1461972 - RNA, 19 nt, Human
ccgaaggaaaagggcuuuc

SEQ ID NO: 1461973 - RNA, 15 nt, Human
ccgaaaaucauauaa

SEQ ID NO: 1461974 - RNA, 17 nt, Human
caucagaaacacccuca

SEQ ID NO: 1461975 - RNA, 19 nt, Human
caucagaaacacccucaca

SEQ ID NO: 1461976 - RNA, 19 nt, Human
caucacuuguacaaaauaa

SEQ ID NO: 1461977 - RNA, 16 nt, Human
caucuggauuccagag

SEQ ID NO: 1461978 - RNA, 20 nt, Human
caucuggcaacaucuuuauc

SEQ ID NO: 1461979 - RNA, 12 nt, Human
cauccugcaggc

SEQ ID NO: 1461980 - RNA, 15 nt, Human
cauccucuuuuucca

SEQ ID NO: 1461981 - RNA, 23 nt, Human
caucccacucacaacagcugccu

SEQ ID NO: 1461982 - RNA, 23 nt, Human
caucccaaaaucauaagauauuu

SEQ ID NO: 1461983 - RNA, 16 nt, Human
cauccauucuccugag

SEQ ID NO: 1461984 - RNA, 21 nt, Human
cauauuauuuuauguugcaua

SEQ ID NO: 1461985 - RNA, 16 nt, Human
cauagguuuaauaauu

SEQ ID NO: 1461986 - RNA, 17 nt, Human
cauagguagaauguaaa

SEQ ID NO: 1461987 - RNA, 23 nt, Human
cauagguagaauguaaagcuugu

SEQ ID NO: 1461988 - RNA, 18 nt, Human
cauaauuauuauuuggcc

SEQ ID NO: 1461989 - RNA, 14 nt, Human
cauaauucacucug

SEQ ID NO: 1461990 - RNA, 17 nt, Human
cauaauucacucugagu

SEQ ID NO: 1461991 - RNA, 21 nt, Human
cauaauucacucugaguguuu

SEQ ID NO: 1461992 - RNA, 23 nt, Human
cauaauucacucugaguguuuua

SEQ ID NO: 1461993 - RNA, 21 nt, Human
cauaauuauccaggaagggaa

SEQ ID NO: 1461994 - RNA, 12 nt, Human
caguuuucauaa

SEQ ID NO: 1461995 - RNA, 19 nt, Human
caguuuuccuaugcuuuga

SEQ ID NO: 1461996 - RNA, 19 nt, Human
caguuuauuugaaccaaua

SEQ ID NO: 1461997 - RNA, 18 nt, Human
caguuuauuugaaccaau

SEQ ID NO: 1461998 - RNA, 14 nt, Human
caguuuauuuguug

SEQ ID NO: 1461999 - RNA, 15 nt, Human
caguucaaagcagga

SEQ ID NO: 1462000 - RNA, 14 nt, Human
caguucaagaaagc

SEQ ID NO: 1462001 - RNA, 22 nt, Human
caguuauuauauuuacaaaugg

SEQ ID NO: 1462002 - RNA, 22 nt, Human
caguuaucuaaguuaauuuaaa

SEQ ID NO: 1462003 - RNA, 22 nt, Human
caguuaugauuuuuuuuucaua

SEQ ID NO: 1462004 - RNA, 17 nt, Human
cagucucuauaccaaua

SEQ ID NO: 1462005 - RNA, 22 nt, Human
cagucucacaugauuccagcca

SEQ ID NO: 1462006 - RNA, 23 nt, Human
cagucucuauaccaauaaaguga

SEQ ID NO: 1462007 - RNA, 22 nt, Human
cagucucuauaccaauaaagug

SEQ ID NO: 1462008 - RNA, 21 nt, Human
cagucucuauaccaauaaagu

SEQ ID NO: 1462009 - RNA, 20 nt, Human
cagucucuauaccaauaaag

SEQ ID NO: 1462010 - RNA, 19 nt, Human
cagucucuauaccaauaaa

SEQ ID NO: 1462011 - RNA, 22 nt, Human
cagucuaaagcugguuuaaugu

SEQ ID NO: 1462012 - RNA, 21 nt, Human
caguuauuauauuuacaaaug

SEQ ID NO: 1462013 - RNA, 17 nt, Human
caguuauuauauuuaca

SEQ ID NO: 1462014 - RNA, 21 nt, Human
caguuauaaguagcaggccaa

SEQ ID NO: 1462015 - RNA, 16 nt, Human
caguuaucuaaguuaa

SEQ ID NO: 1462016 - RNA, 16 nt, Human
cagugauugucuuaau

SEQ ID NO: 1462017 - RNA, 20 nt, Human
cagugauugucuuaauauug

SEQ ID NO: 1462018 - RNA, 15 nt, Human
cagugguaaaaaggc

SEQ ID NO: 1462019 - RNA, 21 nt, Human
ccaacuccagaaagugacaag

SEQ ID NO: 1462020 - RNA, 20 nt, Human
ccaaaucacugaacuuugcu

SEQ ID NO: 1462021 - RNA, 14 nt, Human
ccaacucaccugag

SEQ ID NO: 1462022 - RNA, 15 nt, Human
ccaacuauggccugu

SEQ ID NO: 1462023 - RNA, 14 nt, Human
ccaacuauggccug

SEQ ID NO: 1462024 - RNA, 16 nt, Human
ccaacuauggccugug

SEQ ID NO: 1462025 - RNA, 20 nt, Human
ccaauggaaugugauguuca

SEQ ID NO: 1462026 - RNA, 22 nt, Human
ccaauggaaugugauguucaug

SEQ ID NO: 1462027 - RNA, 17 nt, Human
ccaaggagucacugaga

SEQ ID NO: 1462028 - RNA, 19 nt, Human
ccaaggagucacugagacc

SEQ ID NO: 1462029 - RNA, 22 nt, Human
ccaaggagucacugagaccaag

SEQ ID NO: 1462030 - RNA, 19 nt, Human
ccaaaguccugggauuaca

SEQ ID NO: 1462031 - RNA, 16 nt, Human
cauuggagauguuuag

SEQ ID NO: 1462032 - RNA, 15 nt, Human
cauuuagguuucuga

SEQ ID NO: 1462033 - RNA, 14 nt, Human
cauuuauauugaua

SEQ ID NO: 1462034 - RNA, 20 nt, Human
cauuuauauugauaagaucu

SEQ ID NO: 1462035 - RNA, 21 nt, Human
cauuuauauugauaagaucuu

SEQ ID NO: 1462036 - RNA, 12 nt, Human
ccaaaaaacuac

SEQ ID NO: 1462037 - RNA, 19 nt, Human
ccaaaaaaaaauacaugcu

SEQ ID NO: 1462038 - RNA, 17 nt, Human
ccaaaaguuacauguuu

SEQ ID NO: 1462039 - RNA, 15 nt, Human
ccaaaagcuuuuuau

SEQ ID NO: 1462040 - RNA, 23 nt, Human
ccaaaagauugcugaaauuuuau

SEQ ID NO: 1462041 - RNA, 17 nt, Human
cauuuguauaaaauaau

SEQ ID NO: 1462042 - RNA, 14 nt, Human
cauuuguauaaaau

SEQ ID NO: 1462043 - RNA, 16 nt, Human
cauuuguauaaaauaa

SEQ ID NO: 1462044 - RNA, 15 nt, Human
cauuuguuucuacuu

SEQ ID NO: 1462045 - RNA, 16 nt, Human
cauuuguuggaaugaa

SEQ ID NO: 1462046 - RNA, 14 nt, Human
cauuuggguccagg

SEQ ID NO: 1462047 - RNA, 15 nt, Human
cauuuggguccagga

SEQ ID NO: 1462048 - RNA, 16 nt, Human
cauuuggguccaggag

SEQ ID NO: 1462049 - RNA, 17 nt, Human
cauuuggguccaggagg

SEQ ID NO: 1462050 - RNA, 18 nt, Human
cauuuggguccaggagga

SEQ ID NO: 1462051 - RNA, 16 nt, Human
cauuuggcaucccugg

SEQ ID NO: 1462052 - RNA, 20 nt, Human
cauuuggcaucccugggccu

SEQ ID NO: 1462053 - RNA, 18 nt, Human
cauuuggcaucccugggc

SEQ ID NO: 1462054 - RNA, 16 nt, Human
cauuuaugaagcaagc

SEQ ID NO: 1462055 - RNA, 17 nt, Human
cauuuaugagcucuuca

SEQ ID NO: 1462056 - RNA, 20 nt, Human
cauuuaugagcucuucaugu

SEQ ID NO: 1462057 - RNA, 23 nt, Human
cauuuaugagcucuucauguuuc

SEQ ID NO: 1462058 - RNA, 21 nt, Human
caugaauauuuaguguucaua

SEQ ID NO: 1462059 - RNA, 13 nt, Human
caugaauguaaau

SEQ ID NO: 1462060 - RNA, 14 nt, Human
caugaauguaaauu

SEQ ID NO: 1462061 - RNA, 16 nt, Human
caugaauguaaauuug

SEQ ID NO: 1462062 - RNA, 17 nt, Human
caugaauguaaauuugu

SEQ ID NO: 1462063 - RNA, 22 nt, Human
caugaauguaaauuuguacuau

SEQ ID NO: 1462064 - RNA, 19 nt, Human
caugaauguaaauuuguac

SEQ ID NO: 1462065 - RNA, 22 nt, Human
caugaugccucugucuucugga

SEQ ID NO: 1462066 - RNA, 23 nt, Human
caugaugccucugucuucuggac

SEQ ID NO: 1462067 - RNA, 16 nt, Human
caugaugccucugucu

SEQ ID NO: 1462068 - RNA, 17 nt, Human
caugaugccucugucuu

SEQ ID NO: 1462069 - RNA, 20 nt, Human
caugaugccucugucuucug

SEQ ID NO: 1462070 - RNA, 16 nt, Human
cauggcccugccaugc

SEQ ID NO: 1462071 - RNA, 18 nt, Human
cauuauuacuuuugcugu

SEQ ID NO: 1462072 - RNA, 23 nt, Human
cauuauuacuuuugcuguaaugu

SEQ ID NO: 1462073 - RNA, 12 nt, Human
cauuauuacuuu

SEQ ID NO: 1462074 - RNA, 16 nt, Human
cauuauuacuuuugcu

SEQ ID NO: 1462075 - RNA, 17 nt, Human
cagauuucugaggaaau

SEQ ID NO: 1462076 - RNA, 15 nt, Human
cagauuucugaggaa

SEQ ID NO: 1462077 - RNA, 14 nt, Human
cagauuucugagga

SEQ ID NO: 1462078 - RNA, 14 nt, Human
cagauuuccagccu

SEQ ID NO: 1462079 - RNA, 14 nt, Human
cagcaccagaaugu

SEQ ID NO: 1462080 - RNA, 13 nt, Human
cagauuuaugcau

SEQ ID NO: 1462081 - RNA, 14 nt, Human
cagauugucagcuc

SEQ ID NO: 1462082 - RNA, 13 nt, Human
cagauuguuugca

SEQ ID NO: 1462083 - RNA, 16 nt, Human
cagccagaccagcagg

SEQ ID NO: 1462084 - RNA, 14 nt, Human
cagauaugauucaa

SEQ ID NO: 1462085 - RNA, 15 nt, Human
cagauaugauucaaa

SEQ ID NO: 1462086 - RNA, 22 nt, Human
cagagcugauggagaaggaagg

SEQ ID NO: 1462087 - RNA, 19 nt, Human
cagagcugauggagaagga

SEQ ID NO: 1462088 - RNA, 21 nt, Human
cagagcugauggagaaggaag

SEQ ID NO: 1462089 - RNA, 20 nt, Human
cagagcugauggagaaggaa

SEQ ID NO: 1462090 - RNA, 17 nt, Human
cagagacuuuagggggu

SEQ ID NO: 1462091 - RNA, 11 nt, Human
cagacagauga

SEQ ID NO: 1462092 - RNA, 17 nt, Human
cagacagaugaggcuuu

SEQ ID NO: 1462093 - RNA, 18 nt, Human
cagacagaugaggcuuuc

SEQ ID NO: 1462094 - RNA, 23 nt, Human
cagacuccuucaacaauucuaaa

SEQ ID NO: 1462095 - RNA, 18 nt, Human
cagacuccuucaacaauu

SEQ ID NO: 1462096 - RNA, 14 nt, Human
cagacucuaagaaa

SEQ ID NO: 1462097 - RNA, 17 nt, Human
cagacucuaagaaagaa

SEQ ID NO: 1462098 - RNA, 18 nt, Human
cagacucuaagaaagaac

SEQ ID NO: 1462099 - RNA, 15 nt, Human
cagacucuuuaugcu

SEQ ID NO: 1462100 - RNA, 19 nt, Human
cagacucuuuaugcuugca

SEQ ID NO: 1462101 - RNA, 18 nt, Human
cagacucuuuaugcuugc

SEQ ID NO: 1462102 - RNA, 14 nt, Human
cagacugcuuccaa

SEQ ID NO: 1462103 - RNA, 20 nt, Human
cagacugcuuccaauuuucu

SEQ ID NO: 1462104 - RNA, 18 nt, Human
cagacugcgauuuguccc

SEQ ID NO: 1462105 - RNA, 22 nt, Human
cagggagacuggguaggaaaga

SEQ ID NO: 1462106 - RNA, 15 nt, Human
cagggcggggguggc

SEQ ID NO: 1462107 - RNA, 20 nt, Human
caggccggcuugccacaccc

SEQ ID NO: 1462108 - RNA, 13 nt, Human
caggccgggaaaa

SEQ ID NO: 1462109 - RNA, 13 nt, Human
caggcuaauuuuu

SEQ ID NO: 1462110 - RNA, 22 nt, Human
caggcuaauuuuuuuguauuuu

SEQ ID NO: 1462111 - RNA, 18 nt, Human
caggcgugagccaccucg

SEQ ID NO: 1462112 - RNA, 17 nt, Human
caggccuuugagcucag

SEQ ID NO: 1462113 - RNA, 16 nt, Human
caggccuuugagcuca

SEQ ID NO: 1462114 - RNA, 17 nt, Human
caggccgugacgucugg

SEQ ID NO: 1462115 - RNA, 18 nt, Human
caggccgugacgucuggg

SEQ ID NO: 1462116 - RNA, 19 nt, Human
caggccgugacgucugggu

SEQ ID NO: 1462117 - RNA, 20 nt, Human
caggccgugacgucugggug

SEQ ID NO: 1462118 - RNA, 19 nt, Human
caggaggacccagggcucu

SEQ ID NO: 1462119 - RNA, 15 nt, Human
caggaggacccaggg

SEQ ID NO: 1462120 - RNA, 16 nt, Human
caggaggacccagggc

SEQ ID NO: 1462121 - RNA, 17 nt, Human
caggaggacccagggcu

SEQ ID NO: 1462122 - RNA, 18 nt, Human
caggaggacccagggcuc

SEQ ID NO: 1462123 - RNA, 20 nt, Human
caggaggacccagggcucug

SEQ ID NO: 1462124 - RNA, 20 nt, Human
cagcuguaugauucccagcc

SEQ ID NO: 1462125 - RNA, 18 nt, Human
cagcugucaucaauuaaa

SEQ ID NO: 1462126 - RNA, 14 nt, Human
cagcuuauugucua

SEQ ID NO: 1462127 - RNA, 20 nt, Human
cagcuuauugucuagugaaa

SEQ ID NO: 1462128 - RNA, 16 nt, Human
caggaaagagaacuuc

SEQ ID NO: 1462129 - RNA, 20 nt, Human
caggaaagagaacuuccaga

SEQ ID NO: 1462130 - RNA, 17 nt, Human
cagcugagagaaaauaa

SEQ ID NO: 1462131 - RNA, 14 nt, Human
cagcggcaucaggc

SEQ ID NO: 1462132 - RNA, 13 nt, Human
caccugcccugcc

SEQ ID NO: 1462133 - RNA, 12 nt, Human
caccugcccugc

SEQ ID NO: 1462134 - RNA, 18 nt, Human
caccuaggcuaggguggg

SEQ ID NO: 1462135 - RNA, 19 nt, Human
caccuaggcuagggugggg

SEQ ID NO: 1462136 - RNA, 17 nt, Human
caccuaggcuagggugg

SEQ ID NO: 1462137 - RNA, 20 nt, Human
cacccucguggacaccugcc

SEQ ID NO: 1462138 - RNA, 19 nt, Human
cacccucguggacaccugc

SEQ ID NO: 1462139 - RNA, 18 nt, Human
cacccucguggacaccug

SEQ ID NO: 1462140 - RNA, 17 nt, Human
cacccucguggacaccu

SEQ ID NO: 1462141 - RNA, 16 nt, Human
caccugcccugcccug

SEQ ID NO: 1462142 - RNA, 14 nt, Human
caccugcccugccc

SEQ ID NO: 1462143 - RNA, 23 nt, Human
cacugaagaagcaccaaucauga

SEQ ID NO: 1462144 - RNA, 14 nt, Human
cacuagacaagcca

SEQ ID NO: 1462145 - RNA, 16 nt, Human
cacuagacaagccaga

SEQ ID NO: 1462146 - RNA, 17 nt, Human
cacuagacaagccagaa

SEQ ID NO: 1462147 - RNA, 19 nt, Human
cacuagacaagccagaacu

SEQ ID NO: 1462148 - RNA, 21 nt, Human
cacuagacaagccagaacuug

SEQ ID NO: 1462149 - RNA, 19 nt, Human
cacuagcccaaugaaauga

SEQ ID NO: 1462150 - RNA, 16 nt, Human
cacuagcccaaugaaa

SEQ ID NO: 1462151 - RNA, 14 nt, Human
cacgcuuuccugaa

SEQ ID NO: 1462152 - RNA, 16 nt, Human
cacaugaaguccaagc

SEQ ID NO: 1462153 - RNA, 16 nt, Human
caccaggacuagggcu

SEQ ID NO: 1462154 - RNA, 13 nt, Human
cacccagcaauag

SEQ ID NO: 1462155 - RNA, 22 nt, Human
caccaggauagagacuggaaca

SEQ ID NO: 1462156 - RNA, 13 nt, Human
caccaggcagccu

SEQ ID NO: 1462157 - RNA, 20 nt, Human
cacccagguuggagugcagu

SEQ ID NO: 1462158 - RNA, 20 nt, Human
cacccaggcuggacugcaau

SEQ ID NO: 1462159 - RNA, 16 nt, Human
cacccagcaauagaga

SEQ ID NO: 1462160 - RNA, 21 nt, Human
caaguuccuuggccaugcaga

SEQ ID NO: 1462161 - RNA, 20 nt, Human
caaguuauuuuuaauuuggu

SEQ ID NO: 1462162 - RNA, 18 nt, Human
caaguuccaaguugcuaa

SEQ ID NO: 1462163 - RNA, 16 nt, Human
caaguauuuguuaauu

SEQ ID NO: 1462164 - RNA, 19 nt, Human
caaguauuuguuaauuuag

SEQ ID NO: 1462165 - RNA, 15 nt, Human
caaguaaaaaggcua

SEQ ID NO: 1462166 - RNA, 10 nt, Human
caaguaaaaa

SEQ ID NO: 1462167 - RNA, 14 nt, Human
caaguaacaaaaau

SEQ ID NO: 1462168 - RNA, 17 nt, Human
caaguaacaaaaauaaa

SEQ ID NO: 1462169 - RNA, 17 nt, Human
caaucagccuaguugau

SEQ ID NO: 1462170 - RNA, 12 nt, Human
caauauuuuucu

SEQ ID NO: 1462171 - RNA, 15 nt, Human
caaucaagucuguuu

SEQ ID NO: 1462172 - RNA, 18 nt, Human
caaucaagucuguuuacu

SEQ ID NO: 1462173 - RNA, 17 nt, Human
caauugggagcugccaa

SEQ ID NO: 1462174 - RNA, 20 nt, Human
caauugggagcugccaagag

SEQ ID NO: 1462175 - RNA, 21 nt, Human
caauugggagcugccaagagu

SEQ ID NO: 1462176 - RNA, 11 nt, Human
caauuucaagu

SEQ ID NO: 1462177 - RNA, 19 nt, Human
caacuauauuguuugcuaa

SEQ ID NO: 1462178 - RNA, 19 nt, Human
caacuaucucauuuccaag

SEQ ID NO: 1462179 - RNA, 13 nt, Human
caacuauggccug

SEQ ID NO: 1462180 - RNA, 14 nt, Human
caacuauggccugu

SEQ ID NO: 1462181 - RNA, 14 nt, Human
caacuauuuucaga

SEQ ID NO: 1462182 - RNA, 12 nt, Human
caacuccagaaa

SEQ ID NO: 1462183 - RNA, 21 nt, Human
caacuauuuucagaugugaac

SEQ ID NO: 1462184 - RNA, 17 nt, Human
caacuauuuucagaugu

SEQ ID NO: 1462185 - RNA, 22 nt, Human
caagaauaaucacgcuuuccug

SEQ ID NO: 1462186 - RNA, 23 nt, Human
caagaauaaucacgcuuuccuga

SEQ ID NO: 1462187 - RNA, 21 nt, Human
caagaauaaucacgcuuuccu

SEQ ID NO: 1462188 - RNA, 14 nt, Human
caagacaugucugu

SEQ ID NO: 1462189 - RNA, 15 nt, Human
caagacaugucuguu

SEQ ID NO: 1462190 - RNA, 17 nt, Human
caagacaugucuguucu

SEQ ID NO: 1462191 - RNA, 19 nt, Human
caagcaaaugugaaucauu

SEQ ID NO: 1462192 - RNA, 17 nt, Human
caagcaaaugugaauca

SEQ ID NO: 1462193 - RNA, 15 nt, Human
caagcaaaugugaau

SEQ ID NO: 1462194 - RNA, 14 nt, Human
caagcaauccuccc

SEQ ID NO: 1462195 - RNA, 14 nt, Human
caagcaaguauuag

SEQ ID NO: 1462196 - RNA, 19 nt, Human
auuuuuauauuugaaauau

SEQ ID NO: 1462197 - RNA, 15 nt, Human
auuuuuaaacaagua

SEQ ID NO: 1462198 - RNA, 13 nt, Human
auuuuuaaacaag

SEQ ID NO: 1462199 - RNA, 14 nt, Human
auuuuuaaacaagu

SEQ ID NO: 1462200 - RNA, 17 nt, Human
auuuuuaugccaccuga

SEQ ID NO: 1462201 - RNA, 16 nt, Human
auuuuuaaaacccauu

SEQ ID NO: 1462202 - RNA, 17 nt, Human
auuuuuaaaacccauuu

SEQ ID NO: 1462203 - RNA, 15 nt, Human
auuuuuuucugaauu

SEQ ID NO: 1462204 - RNA, 16 nt, Human
auuuuuuucugaaauu

SEQ ID NO: 1462205 - RNA, 17 nt, Human
auuuuuuucugaaauuu

SEQ ID NO: 1462206 - RNA, 19 nt, Human
auuuuuuucccaauugaga

SEQ ID NO: 1462207 - RNA, 18 nt, Human
auuuuuauuuuugcugag

SEQ ID NO: 1462208 - RNA, 14 nt, Human
auuuuuuuuacauu

SEQ ID NO: 1462209 - RNA, 14 nt, Human
auuuuuuuuaacau

SEQ ID NO: 1462210 - RNA, 18 nt, Human
auuuuuuuuaaguauuua

SEQ ID NO: 1462211 - RNA, 18 nt, Human
auuuuuuuuaacauuccu

SEQ ID NO: 1462212 - RNA, 21 nt, Human
auuuuuuuuucauacacuuau

SEQ ID NO: 1462213 - RNA, 19 nt, Human
auuuuuuuuucauacacuu

SEQ ID NO: 1462214 - RNA, 20 nt, Human
auuuuuuuuucauacacuua

SEQ ID NO: 1462215 - RNA, 22 nt, Human
caaaagauugcugaaauuuuau

SEQ ID NO: 1462216 - RNA, 14 nt, Human
auuuuuuuuucaua

SEQ ID NO: 1462217 - RNA, 16 nt, Human
auuuuuuuuucauaca

SEQ ID NO: 1462218 - RNA, 19 nt, Human
caaaagcccauucauucca

SEQ ID NO: 1462219 - RNA, 15 nt, Human
caaaagcccauucau

SEQ ID NO: 1462220 - RNA, 21 nt, Human
caaacauauauauacuauuaa

SEQ ID NO: 1462221 - RNA, 14 nt, Human
caaaccaggacccu

SEQ ID NO: 1462222 - RNA, 20 nt, Human
caaaccacuuuuugcagcuu

SEQ ID NO: 1462223 - RNA, 15 nt, Human
auuuugaaaaacugc

SEQ ID NO: 1462224 - RNA, 22 nt, Human
auuuucuggauuccccaucuca

SEQ ID NO: 1462225 - RNA, 13 nt, Human
auuuugaaaaacu

SEQ ID NO: 1462226 - RNA, 18 nt, Human
auuuucuggaauacauga

SEQ ID NO: 1462227 - RNA, 19 nt, Human
auuuucuggaauacaugaa

SEQ ID NO: 1462228 - RNA, 22 nt, Human
auuuucuggaauacaugaaaua

SEQ ID NO: 1462229 - RNA, 15 nt, Human
auuuucugcuacuuu

SEQ ID NO: 1462230 - RNA, 23 nt, Human
auuuucucccuggauuuuuacca

SEQ ID NO: 1462231 - RNA, 22 nt, Human
auuuucucccuggauuuuuacc

SEQ ID NO: 1462232 - RNA, 18 nt, Human
auuuucucccuggauuuu

SEQ ID NO: 1462233 - RNA, 14 nt, Human
auuuucucccugga

SEQ ID NO: 1462234 - RNA, 19 nt, Human
auuuucuauaauuuaaaua

SEQ ID NO: 1462235 - RNA, 18 nt, Human
auuuucuauaauuuaaau

SEQ ID NO: 1462236 - RNA, 17 nt, Human
auuuucuauaauuuaaa

SEQ ID NO: 1462237 - RNA, 19 nt, Human
auuuguucuauagcuuuuc

SEQ ID NO: 1462238 - RNA, 23 nt, Human
auuuguuaauuuagaaaacuuua

SEQ ID NO: 1462239 - RNA, 19 nt, Human
auuuguuaauuuagaaaac

SEQ ID NO: 1462240 - RNA, 14 nt, Human
auuuguguugaaga

SEQ ID NO: 1462241 - RNA, 15 nt, Human
auuuguguugaagag

SEQ ID NO: 1462242 - RNA, 21 nt, Human
auuugcagcugagagaaaaua

SEQ ID NO: 1462243 - RNA, 18 nt, Human
auuuguguugaagagguu

SEQ ID NO: 1462244 - RNA, 22 nt, Human
auuuguguugaagagguuuuaa

SEQ ID NO: 1462245 - RNA, 20 nt, Human
auuuugaaaucaugaagaua

SEQ ID NO: 1462246 - RNA, 16 nt, Human
auugagguaaguuuuu

SEQ ID NO: 1462247 - RNA, 14 nt, Human
auugagguaaguuu

SEQ ID NO: 1462248 - RNA, 17 nt, Human
auugauaagaucuuuua

SEQ ID NO: 1462249 - RNA, 22 nt, Human
auuuaauagguuuggacaaaau

SEQ ID NO: 1462250 - RNA, 17 nt, Human
auuuaauagcaaagaau

SEQ ID NO: 1462251 - RNA, 18 nt, Human
auuuaauagcaaagaauu

SEQ ID NO: 1462252 - RNA, 20 nt, Human
auuuaauagcaaagaauuga

SEQ ID NO: 1462253 - RNA, 15 nt, Human
auuucaccuguaaac

SEQ ID NO: 1462254 - RNA, 16 nt, Human
auuucaccuguaaacc

SEQ ID NO: 1462255 - RNA, 18 nt, Human
auuucaccuguaaaccug

SEQ ID NO: 1462256 - RNA, 19 nt, Human
auuucaccuguaaaccuga

SEQ ID NO: 1462257 - RNA, 14 nt, Human
auuucaccuguaaa

SEQ ID NO: 1462258 - RNA, 18 nt, Human
auuuauccugaaauuuca

SEQ ID NO: 1462259 - RNA, 19 nt, Human
auuuauccugaaauuucag

SEQ ID NO: 1462260 - RNA, 20 nt, Human
auuuauccugaaauuucaga

SEQ ID NO: 1462261 - RNA, 21 nt, Human
auuuauccugaaauuucagau

SEQ ID NO: 1462262 - RNA, 17 nt, Human
auuuaucgcagaccuuu

SEQ ID NO: 1462263 - RNA, 19 nt, Human
auuucacaacagccugaca

SEQ ID NO: 1462264 - RNA, 14 nt, Human
auuucuuaaacacu

SEQ ID NO: 1462265 - RNA, 20 nt, Human
auuaaauuuuuuuuacauuu

SEQ ID NO: 1462266 - RNA, 19 nt, Human
auuaaauuuuuuuuacauu

SEQ ID NO: 1462267 - RNA, 18 nt, Human
auuaaauuuuuuuuacau

SEQ ID NO: 1462268 - RNA, 17 nt, Human
auuaaauuuuuuuuaca

SEQ ID NO: 1462269 - RNA, 21 nt, Human
auuaacaugaauauuuagugu

SEQ ID NO: 1462270 - RNA, 12 nt, Human
auuaacauaccu

SEQ ID NO: 1462271 - RNA, 23 nt, Human
auuaacauaccuaagaaguacau

SEQ ID NO: 1462272 - RNA, 24 nt, Human
auuaacauaccuaagaaguacauu

SEQ ID NO: 1462273 - RNA, 19 nt, Human
auuaacaauuaggcagacu

SEQ ID NO: 1462274 - RNA, 16 nt, Human
auuaauuuaugcagaa

SEQ ID NO: 1462275 - RNA, 17 nt, Human
auuaauuuaugcagaau

SEQ ID NO: 1462276 - RNA, 14 nt, Human
auuacacuugguaa

SEQ ID NO: 1462277 - RNA, 19 nt, Human
auuacacuugguaauugua

SEQ ID NO: 1462278 - RNA, 14 nt, Human
auuacacccaaaga

SEQ ID NO: 1462279 - RNA, 22 nt, Human
auugaggacacugauauggguc
